United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 67

SEQ ID NO: 2405714 - RNA, 22 nt, Bordetella pertussis
ugaacugcaggccgccggccuc

SEQ ID NO: 2405715 - RNA, 15 nt, Bordetella pertussis
ugaacugcuggaaca

SEQ ID NO: 2405716 - RNA, 14 nt, Bordetella pertussis
ugaagacgauggug

SEQ ID NO: 2405717 - RNA, 15 nt, Bordetella pertussis
ugaagacgcccaggu

SEQ ID NO: 2405718 - RNA, 13 nt, Bordetella pertussis
ugaagacgccguc

SEQ ID NO: 2405719 - RNA, 15 nt, Bordetella pertussis
ugaagacgcgcucgc

SEQ ID NO: 2405720 - RNA, 19 nt, Bordetella pertussis
ugaagacgcgcucgccguc

SEQ ID NO: 2405721 - RNA, 18 nt, Bordetella pertussis
ugaagcccauggcguagg

SEQ ID NO: 2405722 - RNA, 20 nt, Bordetella pertussis
ugaagcccgagcggcgccag

SEQ ID NO: 2405723 - RNA, 22 nt, Bordetella pertussis
ugaagccguccuugagggcgcg

SEQ ID NO: 2405724 - RNA, 22 nt, Bordetella pertussis
ugaagccguccuuggcgccggc

SEQ ID NO: 2405725 - RNA, 21 nt, Bordetella pertussis
ugaagcgccgccacaggcuga

SEQ ID NO: 2405726 - RNA, 20 nt, Bordetella pertussis
ugaagcguucggccuugcca

SEQ ID NO: 2405727 - RNA, 15 nt, Bordetella pertussis
ugaagcugcccagca

SEQ ID NO: 2405728 - RNA, 14 nt, Bordetella pertussis
ugaagcuggcgccg

SEQ ID NO: 2405729 - RNA, 20 nt, Bordetella pertussis
ugaaggaccucgcgccgguc

SEQ ID NO: 2405730 - RNA, 21 nt, Bordetella pertussis
ugaaggccacgcgggcguggu

SEQ ID NO: 2405731 - RNA, 18 nt, Bordetella pertussis
ugaaggccgaggccaggu

SEQ ID NO: 2405732 - RNA, 20 nt, Bordetella pertussis
ugaaggccgaggccagguug

SEQ ID NO: 2405733 - RNA, 19 nt, Bordetella pertussis
ugaaggcgcccgggcugcc

SEQ ID NO: 2405734 - RNA, 23 nt, Bordetella pertussis
ugaagggcuggccggccaacagc

SEQ ID NO: 2405735 - RNA, 18 nt, Bordetella pertussis
ugaaggggcuccccugcu

SEQ ID NO: 2405736 - RNA, 19 nt, Bordetella pertussis
ugaaguccggaucccaggc

SEQ ID NO: 2405737 - RNA, 16 nt, Bordetella pertussis
ugaagucgcggcccgc

SEQ ID NO: 2405738 - RNA, 18 nt, Bordetella pertussis
ugaagucgcggcccgcca

SEQ ID NO: 2405739 - RNA, 20 nt, Bordetella pertussis
ugaauccggggugccugucc

SEQ ID NO: 2405740 - RNA, 21 nt, Bordetella pertussis
ugaaucgcaugcgguuucuca

SEQ ID NO: 2405741 - RNA, 16 nt, Bordetella pertussis
ugaauuccagccaggc

SEQ ID NO: 2405742 - RNA, 16 nt, Bordetella pertussis
ugacauaggagaguuc

SEQ ID NO: 2405743 - RNA, 23 nt, Bordetella pertussis
ugacauccucgggcgacuccagc

SEQ ID NO: 2405744 - RNA, 18 nt, Bordetella pertussis
ugacaucgccgcugcgca

SEQ ID NO: 2405745 - RNA, 21 nt, Bordetella pertussis
ugacaucgccgcugcgcagca

SEQ ID NO: 2405746 - RNA, 12 nt, Bordetella pertussis
ugacaugcacga

SEQ ID NO: 2405747 - RNA, 13 nt, Bordetella pertussis
ugacaugcgggcc

SEQ ID NO: 2405748 - RNA, 17 nt, Bordetella pertussis
ugacaugcgggccucga

SEQ ID NO: 2405749 - RNA, 19 nt, Bordetella pertussis
ugacauggccacggcccug

SEQ ID NO: 2405750 - RNA, 16 nt, Bordetella pertussis
ugaccaccaggccgcc

SEQ ID NO: 2405751 - RNA, 16 nt, Bordetella pertussis
ugaccaccgggaugcc

SEQ ID NO: 2405752 - RNA, 22 nt, Bordetella pertussis
ugaccaccgucuugcccgccag

SEQ ID NO: 2405753 - RNA, 14 nt, Bordetella pertussis
ugaccaccuugccc

SEQ ID NO: 2405754 - RNA, 13 nt, Bordetella pertussis
ugaccacggccag

SEQ ID NO: 2405755 - RNA, 14 nt, Bordetella pertussis
ugaccacggccagc

SEQ ID NO: 2405756 - RNA, 16 nt, Bordetella pertussis
ugaccacggccagcag

SEQ ID NO: 2405757 - RNA, 17 nt, Bordetella pertussis
ugaccacggccagcagc

SEQ ID NO: 2405758 - RNA, 18 nt, Bordetella pertussis
ugaccacggccagcagca

SEQ ID NO: 2405759 - RNA, 20 nt, Bordetella pertussis
ugaccacggccagcagcacg

SEQ ID NO: 2405760 - RNA, 14 nt, Bordetella pertussis
ugaccacggcgcgc

SEQ ID NO: 2405761 - RNA, 15 nt, Bordetella pertussis
ugaccacggcgcgcc

SEQ ID NO: 2405762 - RNA, 22 nt, Bordetella pertussis
ugaccacgucgaucaggcccag

SEQ ID NO: 2405763 - RNA, 19 nt, Bordetella pertussis
ugaccagcaccagcgccug

SEQ ID NO: 2405764 - RNA, 22 nt, Bordetella pertussis
ugaccagcacgauggucagcgg

SEQ ID NO: 2405765 - RNA, 15 nt, Bordetella pertussis
ugaccagcagcaccg

SEQ ID NO: 2405766 - RNA, 23 nt, Bordetella pertussis
ugaccagcagcaccgugccggcg

SEQ ID NO: 2405767 - RNA, 19 nt, Bordetella pertussis
ugaccagcagcgccggggg

SEQ ID NO: 2405768 - RNA, 12 nt, Bordetella pertussis
ugaccagcgccg

SEQ ID NO: 2405769 - RNA, 15 nt, Bordetella pertussis
ugaccagcgccggcg

SEQ ID NO: 2405770 - RNA, 16 nt, Bordetella pertussis
ugaccagcgccggcgc

SEQ ID NO: 2405771 - RNA, 12 nt, Bordetella pertussis
ugaccagcgcgg

SEQ ID NO: 2405772 - RNA, 21 nt, Bordetella pertussis
ugaccagcgcgucgcacuggg

SEQ ID NO: 2405773 - RNA, 20 nt, Bordetella pertussis
ugaccagcugcaccaggcuu

SEQ ID NO: 2405774 - RNA, 23 nt, Bordetella pertussis
ugaccagcuugucgaccaccggc

SEQ ID NO: 2405775 - RNA, 14 nt, Bordetella pertussis
ugaccagggcgccg

SEQ ID NO: 2405776 - RNA, 18 nt, Bordetella pertussis
ugaccagggcgccgaccg

SEQ ID NO: 2405777 - RNA, 19 nt, Bordetella pertussis
ugaccaguucgcgcagcgc

SEQ ID NO: 2405778 - RNA, 21 nt, Bordetella pertussis
ugaccaucacgagcagguugg

SEQ ID NO: 2405779 - RNA, 14 nt, Bordetella pertussis
ugaccaugccggcc

SEQ ID NO: 2405780 - RNA, 15 nt, Bordetella pertussis
ugaccaugcgcaccg

SEQ ID NO: 2405781 - RNA, 17 nt, Bordetella pertussis
ugacccauaccagcccg

SEQ ID NO: 2405782 - RNA, 13 nt, Bordetella pertussis
ugacccccgccgu

SEQ ID NO: 2405783 - RNA, 17 nt, Bordetella pertussis
ugacccccgccguggcg

SEQ ID NO: 2405784 - RNA, 18 nt, Bordetella pertussis
ugacccuggccgaacgcc

SEQ ID NO: 2405785 - RNA, 14 nt, Bordetella pertussis
ugaccgaagcgcgg

SEQ ID NO: 2405786 - RNA, 16 nt, Bordetella pertussis
ugaccgaagcgggcga

SEQ ID NO: 2405787 - RNA, 15 nt, Bordetella pertussis
ugaccgacaggccug

SEQ ID NO: 2405788 - RNA, 13 nt, Bordetella pertussis
ugaccgacggccu

SEQ ID NO: 2405789 - RNA, 18 nt, Bordetella pertussis
ugaccgacgugcgccgca

SEQ ID NO: 2405790 - RNA, 21 nt, Bordetella pertussis
ugaccgacgugcgccgcauca

SEQ ID NO: 2405791 - RNA, 19 nt, Bordetella pertussis
ugaccgacgugcugcugca

SEQ ID NO: 2405792 - RNA, 13 nt, Bordetella pertussis
ugaccgagcccgg

SEQ ID NO: 2405793 - RNA, 15 nt, Bordetella pertussis
ugaccgcaugcugca

SEQ ID NO: 2405794 - RNA, 21 nt, Bordetella pertussis
ugaccgcaugcugcagcugcu

SEQ ID NO: 2405795 - RNA, 13 nt, Bordetella pertussis
ugaccgccgccag

SEQ ID NO: 2405796 - RNA, 14 nt, Bordetella pertussis
ugaccgccgcgccg

SEQ ID NO: 2405797 - RNA, 17 nt, Bordetella pertussis
ugaccgccgcgccggug

SEQ ID NO: 2405798 - RNA, 16 nt, Bordetella pertussis
ugaccgccggcaccag

SEQ ID NO: 2405799 - RNA, 17 nt, Bordetella pertussis
ugaccgccuccaggaug

SEQ ID NO: 2405800 - RNA, 17 nt, Bordetella pertussis
ugaccgccucgaugccc

SEQ ID NO: 2405801 - RNA, 21 nt, Bordetella pertussis
ugaccgccucgaugcccucgc

SEQ ID NO: 2405802 - RNA, 16 nt, Bordetella pertussis
ugaccgcguaggccuu

SEQ ID NO: 2405803 - RNA, 12 nt, Bordetella pertussis
ugaccgcguccg

SEQ ID NO: 2405804 - RNA, 14 nt, Bordetella pertussis
ugaccggccaggcg

SEQ ID NO: 2405805 - RNA, 13 nt, Bordetella pertussis
ugaccggcggcac

SEQ ID NO: 2405806 - RNA, 18 nt, Bordetella pertussis
ugaccggcggcacggccg

SEQ ID NO: 2405807 - RNA, 21 nt, Bordetella pertussis
ugaccggcggcacggccggcc

SEQ ID NO: 2405808 - RNA, 20 nt, Bordetella pertussis
ugaccggcguauggcccgcc

SEQ ID NO: 2405809 - RNA, 20 nt, Bordetella pertussis
ugaccggcguguccagcggc

SEQ ID NO: 2405810 - RNA, 21 nt, Bordetella pertussis
ugaccggcuauaccgggcugg

SEQ ID NO: 2405811 - RNA, 19 nt, Bordetella pertussis
ugaccuauaauucguugga

SEQ ID NO: 2405812 - RNA, 16 nt, Bordetella pertussis
ugaccuauucgucguc

SEQ ID NO: 2405813 - RNA, 16 nt, Bordetella pertussis
ugaccucgcccaggcc

SEQ ID NO: 2405814 - RNA, 12 nt, Bordetella pertussis
ugaccucggccu

SEQ ID NO: 2405815 - RNA, 15 nt, Bordetella pertussis
ugaccucggccugcg

SEQ ID NO: 2405816 - RNA, 21 nt, Bordetella pertussis
ugaccugcacgauggcgccgg

SEQ ID NO: 2405817 - RNA, 13 nt, Bordetella pertussis
ugaccugcgccag

SEQ ID NO: 2405818 - RNA, 13 nt, Bordetella pertussis
ugaccuggcgcgc

SEQ ID NO: 2405819 - RNA, 14 nt, Bordetella pertussis
ugaccuggcgcgcg

SEQ ID NO: 2405820 - RNA, 13 nt, Bordetella pertussis
ugaccugggccag

SEQ ID NO: 2405821 - RNA, 14 nt, Bordetella pertussis
ugaccuggucgggc

SEQ ID NO: 2405822 - RNA, 22 nt, Bordetella pertussis
ugacgaaacgcgcguccuuggc

SEQ ID NO: 2405823 - RNA, 20 nt, Bordetella pertussis
ugacgaccuugcggccgcgc

SEQ ID NO: 2405824 - RNA, 22 nt, Bordetella pertussis
ugacgaccuugcggccgcgcac

SEQ ID NO: 2405825 - RNA, 12 nt, Bordetella pertussis
ugacgacgccgg

SEQ ID NO: 2405826 - RNA, 17 nt, Bordetella pertussis
ugacgaggugccugucc

SEQ ID NO: 2405827 - RNA, 20 nt, Bordetella pertussis
ugacgaggugccuguccccc

SEQ ID NO: 2405828 - RNA, 16 nt, Bordetella pertussis
ugacgaucucgcccug

SEQ ID NO: 2405829 - RNA, 19 nt, Bordetella pertussis
ugacgcagccgcccggcag

SEQ ID NO: 2405830 - RNA, 14 nt, Bordetella pertussis
ugacgcccacgcuc

SEQ ID NO: 2405831 - RNA, 21 nt, Bordetella pertussis
ugacgccgccgaacggggccg

SEQ ID NO: 2405832 - RNA, 22 nt, Bordetella pertussis
ugacgccgccgaacggggccgc

SEQ ID NO: 2405833 - RNA, 23 nt, Bordetella pertussis
ugacgccgccgaagggcaccgug

SEQ ID NO: 2405834 - RNA, 20 nt, Bordetella pertussis
ugacgccggcgaaugccggc

SEQ ID NO: 2405835 - RNA, 22 nt, Bordetella pertussis
ugacgccggcgaaugccggccg

SEQ ID NO: 2405836 - RNA, 13 nt, Bordetella pertussis
ugacgccggcggc

SEQ ID NO: 2405837 - RNA, 23 nt, Bordetella pertussis
ugacgcgcgcggugucgccgccg

SEQ ID NO: 2405838 - RNA, 20 nt, Bordetella pertussis
ugacgcgcugaugcgcggcg

SEQ ID NO: 2405839 - RNA, 18 nt, Bordetella pertussis
ugacgcucauccaggcgc

SEQ ID NO: 2405840 - RNA, 16 nt, Bordetella pertussis
ugacgcugauggccgc

SEQ ID NO: 2405841 - RNA, 19 nt, Bordetella pertussis
ugacgcugauggccgccag

SEQ ID NO: 2405842 - RNA, 14 nt, Bordetella pertussis
ugacgcugcucuug

SEQ ID NO: 2405843 - RNA, 17 nt, Bordetella pertussis
ugacgcuggagauggcg

SEQ ID NO: 2405844 - RNA, 20 nt, Bordetella pertussis
ugacgcuggagauggcgccg

SEQ ID NO: 2405845 - RNA, 18 nt, Bordetella pertussis
ugacgcuggagcgcggcg

SEQ ID NO: 2405846 - RNA, 20 nt, Bordetella pertussis
ugacgcuggagcgcggcggc

SEQ ID NO: 2405847 - RNA, 12 nt, Bordetella pertussis
ugacggccagga

SEQ ID NO: 2405848 - RNA, 17 nt, Bordetella pertussis
ugacggccaggacggca

SEQ ID NO: 2405849 - RNA, 18 nt, Bordetella pertussis
ugacggccauccggccac

SEQ ID NO: 2405850 - RNA, 12 nt, Bordetella pertussis
ugacggcccagc

SEQ ID NO: 2405851 - RNA, 15 nt, Bordetella pertussis
ugacggccgccacgc

SEQ ID NO: 2405852 - RNA, 16 nt, Bordetella pertussis
ugacggcggcgcgcgg

SEQ ID NO: 2405853 - RNA, 22 nt, Bordetella pertussis
ugacggcuucgaccacgcggcg

SEQ ID NO: 2405854 - RNA, 18 nt, Bordetella pertussis
ugacgggcggcggcgcgc

SEQ ID NO: 2405855 - RNA, 13 nt, Bordetella pertussis
ugacgggcugggc

SEQ ID NO: 2405856 - RNA, 15 nt, Bordetella pertussis
ugacggggacgccgg

SEQ ID NO: 2405857 - RNA, 16 nt, Bordetella pertussis
ugacggggacgccggc

SEQ ID NO: 2405858 - RNA, 17 nt, Bordetella pertussis
ugacggggcggcgccug

SEQ ID NO: 2405859 - RNA, 19 nt, Bordetella pertussis
ugacggggucggggcaggc

SEQ ID NO: 2405860 - RNA, 22 nt, Bordetella pertussis
ugacggggucggggcaggccug

SEQ ID NO: 2405861 - RNA, 20 nt, Bordetella pertussis
ugacggggugccuguccccg

SEQ ID NO: 2405862 - RNA, 23 nt, Bordetella pertussis
ugacgggucacccgccgcaccag

SEQ ID NO: 2405863 - RNA, 20 nt, Bordetella pertussis
ugacgguaagcaccagguug

SEQ ID NO: 2405864 - RNA, 14 nt, Bordetella pertussis
ugacggugccggcc

SEQ ID NO: 2405865 - RNA, 22 nt, Bordetella pertussis
ugacguagcggaucgcggcgcg

SEQ ID NO: 2405866 - RNA, 14 nt, Bordetella pertussis
ugacguccagccag

SEQ ID NO: 2405867 - RNA, 21 nt, Bordetella pertussis
ugacguccagcgccaccagca

SEQ ID NO: 2405868 - RNA, 20 nt, Bordetella pertussis
ugacguccggcgggccgcug

SEQ ID NO: 2405869 - RNA, 21 nt, Bordetella pertussis
ugacguggcaguccucguugc

SEQ ID NO: 2405870 - RNA, 20 nt, Bordetella pertussis
ugacguucggggcgucgcug

SEQ ID NO: 2405871 - RNA, 19 nt, Bordetella pertussis
ugacguucuccagcgccgu

SEQ ID NO: 2405872 - RNA, 16 nt, Bordetella pertussis
ugacguugccgcgcgc

SEQ ID NO: 2405873 - RNA, 18 nt, Bordetella pertussis
ugacugcggugccugucc

SEQ ID NO: 2405874 - RNA, 15 nt, Bordetella pertussis
ugacugugcagccac

SEQ ID NO: 2405875 - RNA, 16 nt, Bordetella pertussis
ugacuucggccgccag

SEQ ID NO: 2405876 - RNA, 20 nt, Bordetella pertussis
ugagaaaagugaucaccgcc

SEQ ID NO: 2405877 - RNA, 15 nt, Bordetella pertussis
ugagaauggcgcggu

SEQ ID NO: 2405878 - RNA, 19 nt, Bordetella pertussis
ugagacacggcaguaugac

SEQ ID NO: 2405879 - RNA, 17 nt, Bordetella pertussis
ugagacggcggaucuuc

SEQ ID NO: 2405880 - RNA, 14 nt, Bordetella pertussis
ugagaucgcccgcg

SEQ ID NO: 2405881 - RNA, 22 nt, Bordetella pertussis
ugagaucgcccgcgugcgugcc

SEQ ID NO: 2405882 - RNA, 21 nt, Bordetella pertussis
ugagaugccagcggcgcagcc

SEQ ID NO: 2405883 - RNA, 13 nt, Bordetella pertussis
ugagauugugcag

SEQ ID NO: 2405884 - RNA, 20 nt, Bordetella pertussis
ugagcaccacguccuggggc

SEQ ID NO: 2405885 - RNA, 22 nt, Bordetella pertussis
ugagcaccacguccuggggcgc

SEQ ID NO: 2405886 - RNA, 15 nt, Bordetella pertussis
ugagcaccagcagcc

SEQ ID NO: 2405887 - RNA, 19 nt, Bordetella pertussis
ugagcaccagcagccccag

SEQ ID NO: 2405888 - RNA, 16 nt, Bordetella pertussis
ugagcacgcaugcgac

SEQ ID NO: 2405889 - RNA, 14 nt, Bordetella pertussis
ugagcacggcgcgg

SEQ ID NO: 2405890 - RNA, 16 nt, Bordetella pertussis
ugagcaggccgggucg

SEQ ID NO: 2405891 - RNA, 16 nt, Bordetella pertussis
ugagcaggcgccugcc

SEQ ID NO: 2405892 - RNA, 14 nt, Bordetella pertussis
ugagcaggcgcgag

SEQ ID NO: 2405893 - RNA, 15 nt, Bordetella pertussis
ugagccaggcgcccg

SEQ ID NO: 2405894 - RNA, 16 nt, Bordetella pertussis
ugagccaggcgcccgg

SEQ ID NO: 2405895 - RNA, 14 nt, Bordetella pertussis
ugagccaugccguc

SEQ ID NO: 2405896 - RNA, 23 nt, Bordetella pertussis
ugagccaugccgucuggcggcag

SEQ ID NO: 2405897 - RNA, 17 nt, Bordetella pertussis
ugagccauuccggcugg

SEQ ID NO: 2405898 - RNA, 21 nt, Bordetella pertussis
ugagccauuccggcuggucgg

SEQ ID NO: 2405899 - RNA, 16 nt, Bordetella pertussis
ugagccgauacaggcg

SEQ ID NO: 2405900 - RNA, 17 nt, Bordetella pertussis
ugagccgauacaggcgc

SEQ ID NO: 2405901 - RNA, 23 nt, Bordetella pertussis
ugagccggcagaucggcgcuggc

SEQ ID NO: 2405902 - RNA, 13 nt, Bordetella pertussis
ugagcgccgacgg

SEQ ID NO: 2405903 - RNA, 15 nt, Bordetella pertussis
ugagcgccgacgggc

SEQ ID NO: 2405904 - RNA, 13 nt, Bordetella pertussis
ugagcgccgccgc

SEQ ID NO: 2405905 - RNA, 13 nt, Bordetella pertussis
ugagcgccggggc

SEQ ID NO: 2405906 - RNA, 14 nt, Bordetella pertussis
ugagcgccggggcg

SEQ ID NO: 2405907 - RNA, 20 nt, Bordetella pertussis
ugagcgccggggcguggccg

SEQ ID NO: 2405908 - RNA, 21 nt, Bordetella pertussis
ugagcgccggggcguggccgc

SEQ ID NO: 2405909 - RNA, 14 nt, Bordetella pertussis
ugagcgcgccgccg

SEQ ID NO: 2405910 - RNA, 13 nt, Bordetella pertussis
ugagcgcggccuc

SEQ ID NO: 2405911 - RNA, 19 nt, Bordetella pertussis
ugagcgcggccucgccggc

SEQ ID NO: 2405912 - RNA, 17 nt, Bordetella pertussis
ugagcgcuugacggcca

SEQ ID NO: 2405913 - RNA, 15 nt, Bordetella pertussis
ugagcggcccgggcg

SEQ ID NO: 2405914 - RNA, 13 nt, Bordetella pertussis
ugagcggcucgcc

SEQ ID NO: 2405915 - RNA, 20 nt, Bordetella pertussis
ugagcgugaagucggccggc

SEQ ID NO: 2405916 - RNA, 20 nt, Bordetella pertussis
ugagcuacccccugaccggc

SEQ ID NO: 2405917 - RNA, 18 nt, Bordetella pertussis
ugagcugaugcucgcccu

SEQ ID NO: 2405918 - RNA, 13 nt, Bordetella pertussis
ugagcugcgcgug

SEQ ID NO: 2405919 - RNA, 17 nt, Bordetella pertussis
ugagcuggcgcaggucc

SEQ ID NO: 2405920 - RNA, 14 nt, Bordetella pertussis
ugagcuucgccccc

SEQ ID NO: 2405921 - RNA, 17 nt, Bordetella pertussis
ugaggaacuggacggcg

SEQ ID NO: 2405922 - RNA, 18 nt, Bordetella pertussis
ugaggauaucggccaggc

SEQ ID NO: 2405923 - RNA, 17 nt, Bordetella pertussis
ugaggaugcgcgcggcc

SEQ ID NO: 2405924 - RNA, 15 nt, Bordetella pertussis
ugaggaugugcagcg

SEQ ID NO: 2405925 - RNA, 15 nt, Bordetella pertussis
ugaggccagcacgcc

SEQ ID NO: 2405926 - RNA, 21 nt, Bordetella pertussis
ugaggccagcacgccggccag

SEQ ID NO: 2405927 - RNA, 20 nt, Bordetella pertussis
ugaggccagggagugcgagg

SEQ ID NO: 2405928 - RNA, 14 nt, Bordetella pertussis
ugaggcccgauggc

SEQ ID NO: 2405929 - RNA, 19 nt, Bordetella pertussis
ugaggccgaucucacgggc

SEQ ID NO: 2405930 - RNA, 15 nt, Bordetella pertussis
ugaggcggccgggcg

SEQ ID NO: 2405931 - RNA, 20 nt, Bordetella pertussis
ugaggcggcgguaccaggcc

SEQ ID NO: 2405932 - RNA, 17 nt, Bordetella pertussis
ugaggcuuucgaagcgc

SEQ ID NO: 2405933 - RNA, 18 nt, Bordetella pertussis
ugaggcuuucgaagcgcu

SEQ ID NO: 2405934 - RNA, 16 nt, Bordetella pertussis
ugagggcgaucaugca

SEQ ID NO: 2405935 - RNA, 17 nt, Bordetella pertussis
ugaggggccagccuggc

SEQ ID NO: 2405936 - RNA, 13 nt, Bordetella pertussis
ugaggucgcgcgu

SEQ ID NO: 2405937 - RNA, 13 nt, Bordetella pertussis
ugagucuggagau

SEQ ID NO: 2405938 - RNA, 18 nt, Bordetella pertussis
ugagucuggagaugggua

SEQ ID NO: 2405939 - RNA, 16 nt, Bordetella pertussis
ugaguucgcgcgccgg

SEQ ID NO: 2405940 - RNA, 19 nt, Bordetella pertussis
ugaguucuggcaucagggc

SEQ ID NO: 2405941 - RNA, 17 nt, Bordetella pertussis
ugaguuuggcgaaggcg

SEQ ID NO: 2405942 - RNA, 19 nt, Bordetella pertussis
ugauacguucagauacaaa

SEQ ID NO: 2405943 - RNA, 22 nt, Bordetella pertussis
ugaucacccacagcagcgcgcc

SEQ ID NO: 2405944 - RNA, 17 nt, Bordetella pertussis
ugaucagcaggcccacc

SEQ ID NO: 2405945 - RNA, 20 nt, Bordetella pertussis
ugaucagggccacggcgcuu

SEQ ID NO: 2405946 - RNA, 19 nt, Bordetella pertussis
ugaucagggccgccagggc

SEQ ID NO: 2405947 - RNA, 16 nt, Bordetella pertussis
ugaucagggccgugcc

SEQ ID NO: 2405948 - RNA, 23 nt, Bordetella pertussis
ugaucagguccaugaacgccgcg

SEQ ID NO: 2405949 - RNA, 15 nt, Bordetella pertussis
ugaucaugaugauga

SEQ ID NO: 2405950 - RNA, 20 nt, Bordetella pertussis
ugaucccggcgcuggccgcc

SEQ ID NO: 2405951 - RNA, 21 nt, Bordetella pertussis
ugauccgcaccggugggagcc

SEQ ID NO: 2405952 - RNA, 23 nt, Bordetella pertussis
ugauccgcaccggugggagccag

SEQ ID NO: 2405953 - RNA, 12 nt, Bordetella pertussis
ugauccucgcca

SEQ ID NO: 2405954 - RNA, 12 nt, Bordetella pertussis
ugauccuggcuc

SEQ ID NO: 2405955 - RNA, 14 nt, Bordetella pertussis
ugaucgaccgccag

SEQ ID NO: 2405956 - RNA, 16 nt, Bordetella pertussis
ugaucgaguaggccgg

SEQ ID NO: 2405957 - RNA, 13 nt, Bordetella pertussis
ugaucgccagcgc

SEQ ID NO: 2405958 - RNA, 18 nt, Bordetella pertussis
ugaucgccgacgaugucg

SEQ ID NO: 2405959 - RNA, 13 nt, Bordetella pertussis
ugaucgccgccuu

SEQ ID NO: 2405960 - RNA, 23 nt, Bordetella pertussis
ugaucgccggcgcccccagcagc

SEQ ID NO: 2405961 - RNA, 17 nt, Bordetella pertussis
ugaucgccucggggcuc

SEQ ID NO: 2405962 - RNA, 20 nt, Bordetella pertussis
ugaucgcgcagcaccgccag

SEQ ID NO: 2405963 - RNA, 14 nt, Bordetella pertussis
ugaucggcgcaacc

SEQ ID NO: 2405964 - RNA, 13 nt, Bordetella pertussis
ugaucggcgccau

SEQ ID NO: 2405965 - RNA, 16 nt, Bordetella pertussis
ugaucuacgcgcgcgc

SEQ ID NO: 2405966 - RNA, 15 nt, Bordetella pertussis
ugaucucgcgcaccg

SEQ ID NO: 2405967 - RNA, 13 nt, Bordetella pertussis
ugaucugcucgcc

SEQ ID NO: 2405968 - RNA, 18 nt, Bordetella pertussis
ugaucugcucgccgcgcg

SEQ ID NO: 2405969 - RNA, 23 nt, Bordetella pertussis
ugaucugcuugaggccgcgcgcc

SEQ ID NO: 2405970 - RNA, 15 nt, Bordetella pertussis
ugaucuggccgucga

SEQ ID NO: 2405971 - RNA, 20 nt, Bordetella pertussis
ugaucugguccacggcggcg

SEQ ID NO: 2405972 - RNA, 16 nt, Bordetella pertussis
ugaucuugaugcggcc

SEQ ID NO: 2405973 - RNA, 13 nt, Bordetella pertussis
ugaucuugugcau

SEQ ID NO: 2405974 - RNA, 22 nt, Bordetella pertussis
ugaugacgaccuugcccgucag

SEQ ID NO: 2405975 - RNA, 14 nt, Bordetella pertussis
ugaugauccugcug

SEQ ID NO: 2405976 - RNA, 15 nt, Bordetella pertussis
ugaugauccugcugg

SEQ ID NO: 2405977 - RNA, 19 nt, Bordetella pertussis
ugaugaucggcgccaugau

SEQ ID NO: 2405978 - RNA, 10 nt, Bordetella pertussis
ugaugauggc

SEQ ID NO: 2405979 - RNA, 14 nt, Bordetella pertussis
ugaugcaggccugc

SEQ ID NO: 2405980 - RNA, 21 nt, Bordetella pertussis
ugaugcaggcggucgaggcgc

SEQ ID NO: 2405981 - RNA, 13 nt, Bordetella pertussis
ugaugcccagcgc

SEQ ID NO: 2405982 - RNA, 16 nt, Bordetella pertussis
ugaugcccagcgccag

SEQ ID NO: 2405983 - RNA, 19 nt, Bordetella pertussis
ugaugcccagcgccagggc

SEQ ID NO: 2405984 - RNA, 13 nt, Bordetella pertussis
ugaugcccagcuc

SEQ ID NO: 2405985 - RNA, 18 nt, Bordetella pertussis
ugaugcccagcucauggc

SEQ ID NO: 2405986 - RNA, 19 nt, Bordetella pertussis
ugaugcccagcucauggca

SEQ ID NO: 2405987 - RNA, 12 nt, Bordetella pertussis
ugaugcccagga

SEQ ID NO: 2405988 - RNA, 12 nt, Bordetella pertussis
ugaugcccaggc

SEQ ID NO: 2405989 - RNA, 20 nt, Bordetella pertussis
ugaugcccaugcgcugcgcc

SEQ ID NO: 2405990 - RNA, 17 nt, Bordetella pertussis
ugaugcccuucggcaug

SEQ ID NO: 2405991 - RNA, 21 nt, Bordetella pertussis
ugaugcccuucggcaugcugc

SEQ ID NO: 2405992 - RNA, 13 nt, Bordetella pertussis
ugaugccgaccag

SEQ ID NO: 2405993 - RNA, 15 nt, Bordetella pertussis
ugaugccgccgaacc

SEQ ID NO: 2405994 - RNA, 22 nt, Bordetella pertussis
ugaugccgccgaaccagcgcac

SEQ ID NO: 2405995 - RNA, 17 nt, Bordetella pertussis
ugaugccgccggcgggc

SEQ ID NO: 2405996 - RNA, 21 nt, Bordetella pertussis
ugaugccguaccaggugcgca

SEQ ID NO: 2405997 - RNA, 13 nt, Bordetella pertussis
ugaugccuguccc

SEQ ID NO: 2405998 - RNA, 15 nt, Bordetella pertussis
ugaugccugucccgc

SEQ ID NO: 2405999 - RNA, 18 nt, Bordetella pertussis
ugaugcgcgccgcucuug

SEQ ID NO: 2406000 - RNA, 19 nt, Bordetella pertussis
ugaugcgcgccgcucuugg

SEQ ID NO: 2406001 - RNA, 13 nt, Bordetella pertussis
ugaugcgcugggc

SEQ ID NO: 2406002 - RNA, 14 nt, Bordetella pertussis
ugaugcggcgccac

SEQ ID NO: 2406003 - RNA, 18 nt, Bordetella pertussis
ugaugcggcgccacgcag

SEQ ID NO: 2406004 - RNA, 19 nt, Bordetella pertussis
ugaugcugccgggcaugaa

SEQ ID NO: 2406005 - RNA, 15 nt, Bordetella pertussis
ugaugcuggucagcc

SEQ ID NO: 2406006 - RNA, 22 nt, Bordetella pertussis
ugaugcuggucagccugggcgc

SEQ ID NO: 2406007 - RNA, 21 nt, Bordetella pertussis
ugauggaggccaggaucccga

SEQ ID NO: 2406008 - RNA, 17 nt, Bordetella pertussis
ugauggauuucgaccgc

SEQ ID NO: 2406009 - RNA, 12 nt, Bordetella pertussis
ugauggccaggu

SEQ ID NO: 2406010 - RNA, 15 nt, Bordetella pertussis
ugauggccaggucca

SEQ ID NO: 2406011 - RNA, 17 nt, Bordetella pertussis
ugauggccauggccagc

SEQ ID NO: 2406012 - RNA, 19 nt, Bordetella pertussis
ugauggccgaguccugguu

SEQ ID NO: 2406013 - RNA, 13 nt, Bordetella pertussis
ugauggccgccag

SEQ ID NO: 2406014 - RNA, 19 nt, Bordetella pertussis
ugauggccgccagcggcug

SEQ ID NO: 2406015 - RNA, 20 nt, Bordetella pertussis
ugauggccgccagcggcugg

SEQ ID NO: 2406016 - RNA, 19 nt, Bordetella pertussis
ugauggccucggcggccuc

SEQ ID NO: 2406017 - RNA, 21 nt, Bordetella pertussis
ugauggcgauguccagcgagc

SEQ ID NO: 2406018 - RNA, 14 nt, Bordetella pertussis
ugauggggccgggc

SEQ ID NO: 2406019 - RNA, 16 nt, Bordetella pertussis
ugauggggccgggcgc

SEQ ID NO: 2406020 - RNA, 18 nt, Bordetella pertussis
ugauggggucgccgggca

SEQ ID NO: 2406021 - RNA, 19 nt, Bordetella pertussis
ugauggggucgccgggcag

SEQ ID NO: 2406022 - RNA, 16 nt, Bordetella pertussis
ugauggucggugccgc

SEQ ID NO: 2406023 - RNA, 13 nt, Bordetella pertussis
ugauggugcugcc

SEQ ID NO: 2406024 - RNA, 15 nt, Bordetella pertussis
ugauguagcccaugu

SEQ ID NO: 2406025 - RNA, 22 nt, Bordetella pertussis
ugaugucgcgcaccgccugcug

SEQ ID NO: 2406026 - RNA, 15 nt, Bordetella pertussis
ugaugucgcgcgccu

SEQ ID NO: 2406027 - RNA, 17 nt, Bordetella pertussis
ugauuccgcuggcgauc

SEQ ID NO: 2406028 - RNA, 20 nt, Bordetella pertussis
ugauuccugucgcgcugcuu

SEQ ID NO: 2406029 - RNA, 15 nt, Bordetella pertussis
ugcaacacgaccagc

SEQ ID NO: 2406030 - RNA, 20 nt, Bordetella pertussis
ugcaacacgaccagcaggcc

SEQ ID NO: 2406031 - RNA, 20 nt, Bordetella pertussis
ugcaaccgucggugaugcuc

SEQ ID NO: 2406032 - RNA, 14 nt, Bordetella pertussis
ugcaaccuggucaa

SEQ ID NO: 2406033 - RNA, 16 nt, Bordetella pertussis
ugcaacuggugcacga

SEQ ID NO: 2406034 - RNA, 17 nt, Bordetella pertussis
ugcaagacgcccaggcc

SEQ ID NO: 2406035 - RNA, 13 nt, Bordetella pertussis
ugcaaggccugcu

SEQ ID NO: 2406036 - RNA, 15 nt, Bordetella pertussis
ugcaauacagugguu

SEQ ID NO: 2406037 - RNA, 15 nt, Bordetella pertussis
ugcaaugcggccagg

SEQ ID NO: 2406038 - RNA, 16 nt, Bordetella pertussis
ugcaauucgccgaugc

SEQ ID NO: 2406039 - RNA, 22 nt, Bordetella pertussis
ugcaauuucucaagaaaaacaa

SEQ ID NO: 2406040 - RNA, 13 nt, Bordetella pertussis
ugcaccacgcgcu

SEQ ID NO: 2406041 - RNA, 16 nt, Bordetella pertussis
ugcaccacgcgcucca

SEQ ID NO: 2406042 - RNA, 16 nt, Bordetella pertussis
ugcaccacggccacgu

SEQ ID NO: 2406043 - RNA, 12 nt, Bordetella pertussis
ugcaccagcaca

SEQ ID NO: 2406044 - RNA, 13 nt, Bordetella pertussis
ugcaccagcacau

SEQ ID NO: 2406045 - RNA, 12 nt, Bordetella pertussis
ugcaccagccau

SEQ ID NO: 2406046 - RNA, 21 nt, Bordetella pertussis
ugcaccagcccgaugcgccag

SEQ ID NO: 2406047 - RNA, 14 nt, Bordetella pertussis
ugcaccagcgcgcc

SEQ ID NO: 2406048 - RNA, 15 nt, Bordetella pertussis
ugcaccagcgcgccg

SEQ ID NO: 2406049 - RNA, 18 nt, Bordetella pertussis
ugcaccagcgcgccgcgc

SEQ ID NO: 2406050 - RNA, 22 nt, Bordetella pertussis
ugcaccagcgcgccgcgcgcgg

SEQ ID NO: 2406051 - RNA, 19 nt, Bordetella pertussis
ugcaccaggccacccgccg

SEQ ID NO: 2406052 - RNA, 14 nt, Bordetella pertussis
ugcaccaugccgac

SEQ ID NO: 2406053 - RNA, 14 nt, Bordetella pertussis
ugcaccgccgcgcg

SEQ ID NO: 2406054 - RNA, 24 nt, Bordetella pertussis
ugcaccgccgcgcggugcucggcg

SEQ ID NO: 2406055 - RNA, 17 nt, Bordetella pertussis
ugcaccgcguggcgcug

SEQ ID NO: 2406056 - RNA, 21 nt, Bordetella pertussis
ugcaccggcuugucgaccagu

SEQ ID NO: 2406057 - RNA, 16 nt, Bordetella pertussis
ugcaccgggccgaaca

SEQ ID NO: 2406058 - RNA, 12 nt, Bordetella pertussis
ugcaccucagga

SEQ ID NO: 2406059 - RNA, 21 nt, Bordetella pertussis
ugcaccugcagggucagcccg

SEQ ID NO: 2406060 - RNA, 18 nt, Bordetella pertussis
ugcaccugccugccgccu

SEQ ID NO: 2406061 - RNA, 20 nt, Bordetella pertussis
ugcaccugcgucugcacgcu

SEQ ID NO: 2406062 - RNA, 15 nt, Bordetella pertussis
ugcaccuugggcgcc

SEQ ID NO: 2406063 - RNA, 15 nt, Bordetella pertussis
ugcacgaccaggccg

SEQ ID NO: 2406064 - RNA, 16 nt, Bordetella pertussis
ugcacgacuacggcgg

SEQ ID NO: 2406065 - RNA, 19 nt, Bordetella pertussis
ugcacgauauuggcgucgg

SEQ ID NO: 2406066 - RNA, 20 nt, Bordetella pertussis
ugcacgauauuggcgucggc

SEQ ID NO: 2406067 - RNA, 22 nt, Bordetella pertussis
ugcacgauauuggcgucggccg

SEQ ID NO: 2406068 - RNA, 21 nt, Bordetella pertussis
ugcacgaucuugauccaggaa

SEQ ID NO: 2406069 - RNA, 18 nt, Bordetella pertussis
ugcacgaugcccagggcc

SEQ ID NO: 2406070 - RNA, 15 nt, Bordetella pertussis
ugcacgauggcgccg

SEQ ID NO: 2406071 - RNA, 17 nt, Bordetella pertussis
ugcacgauggcgccggc

SEQ ID NO: 2406072 - RNA, 17 nt, Bordetella pertussis
ugcacgauguugccgcc

SEQ ID NO: 2406073 - RNA, 21 nt, Bordetella pertussis
ugcacgauguugccgccggcc

SEQ ID NO: 2406074 - RNA, 15 nt, Bordetella pertussis
ugcacgcagcgcagg

SEQ ID NO: 2406075 - RNA, 22 nt, Bordetella pertussis
ugcacgcaggauaccggagcgg

SEQ ID NO: 2406076 - RNA, 15 nt, Bordetella pertussis
ugcacgcccgcggcg

SEQ ID NO: 2406077 - RNA, 20 nt, Bordetella pertussis
ugcacgcccgcggcgcccag

SEQ ID NO: 2406078 - RNA, 22 nt, Bordetella pertussis
ugcacgcccgcggcgcccagcu

SEQ ID NO: 2406079 - RNA, 12 nt, Bordetella pertussis
ugcacgccggcc

SEQ ID NO: 2406080 - RNA, 21 nt, Bordetella pertussis
ugcacgccgggcgcgcugccc

SEQ ID NO: 2406081 - RNA, 16 nt, Bordetella pertussis
ugcacgcgcgcgggcg

SEQ ID NO: 2406082 - RNA, 18 nt, Bordetella pertussis
ugcacgcgcgcgggcgcg

SEQ ID NO: 2406083 - RNA, 19 nt, Bordetella pertussis
ugcacgcgcgcgggcgcgc

SEQ ID NO: 2406084 - RNA, 13 nt, Bordetella pertussis
ugcacgcgcgcgu

SEQ ID NO: 2406085 - RNA, 14 nt, Bordetella pertussis
ugcacgcgggccag

SEQ ID NO: 2406086 - RNA, 18 nt, Bordetella pertussis
ugcacgcgggccaguugc

SEQ ID NO: 2406087 - RNA, 13 nt, Bordetella pertussis
ugcacgcgggcgc

SEQ ID NO: 2406088 - RNA, 19 nt, Bordetella pertussis
ugcacgcucuugagcgcgg

SEQ ID NO: 2406089 - RNA, 22 nt, Bordetella pertussis
ugcacgcucuugagcgcggccu

SEQ ID NO: 2406090 - RNA, 16 nt, Bordetella pertussis
ugcacggccuugucgc

SEQ ID NO: 2406091 - RNA, 21 nt, Bordetella pertussis
ugcacggccuugucgcgcccg

SEQ ID NO: 2406092 - RNA, 18 nt, Bordetella pertussis
ugcacggcggaaugcggc

SEQ ID NO: 2406093 - RNA, 16 nt, Bordetella pertussis
ugcacgggccauggau

SEQ ID NO: 2406094 - RNA, 22 nt, Bordetella pertussis
ugcacgggccauggaugcgcgc

SEQ ID NO: 2406095 - RNA, 18 nt, Bordetella pertussis
ugcacggugggcagcagc

SEQ ID NO: 2406096 - RNA, 18 nt, Bordetella pertussis
ugcacguagcgcagcacc

SEQ ID NO: 2406097 - RNA, 17 nt, Bordetella pertussis
ugcacgugggcacgccg

SEQ ID NO: 2406098 - RNA, 19 nt, Bordetella pertussis
ugcacgugggcacgccggc

SEQ ID NO: 2406099 - RNA, 14 nt, Bordetella pertussis
ugcagaccagcacc

SEQ ID NO: 2406100 - RNA, 15 nt, Bordetella pertussis
ugcagaccagcaccg

SEQ ID NO: 2406101 - RNA, 12 nt, Bordetella pertussis
ugcagacggcgg

SEQ ID NO: 2406102 - RNA, 22 nt, Bordetella pertussis
ugcagaucaucggcgccaucaa

SEQ ID NO: 2406103 - RNA, 13 nt, Bordetella pertussis
ugcagaucugcac

SEQ ID NO: 2406104 - RNA, 19 nt, Bordetella pertussis
ugcagcacacggucagcaa

SEQ ID NO: 2406105 - RNA, 22 nt, Bordetella pertussis
ugcagcacacggucagcaaccc

SEQ ID NO: 2406106 - RNA, 15 nt, Bordetella pertussis
ugcagcacgcaccag

SEQ ID NO: 2406107 - RNA, 19 nt, Bordetella pertussis
ugcagcacgcaccaggcgc

SEQ ID NO: 2406108 - RNA, 23 nt, Bordetella pertussis
ugcagcacgcaccaggcgcacgg

SEQ ID NO: 2406109 - RNA, 20 nt, Bordetella pertussis
ugcagcagcauuucgaugcg

SEQ ID NO: 2406110 - RNA, 10 nt, Bordetella pertussis
ugcagcagcg

SEQ ID NO: 2406111 - RNA, 19 nt, Bordetella pertussis
ugcagcagcguggccgcca

SEQ ID NO: 2406112 - RNA, 16 nt, Bordetella pertussis
ugcagcaggcgcacca

SEQ ID NO: 2406113 - RNA, 22 nt, Bordetella pertussis
ugcagcaggcgcaccagcgcgc

SEQ ID NO: 2406114 - RNA, 23 nt, Bordetella pertussis
ugcagcaggcgcaccagcgcgcc

SEQ ID NO: 2406115 - RNA, 17 nt, Bordetella pertussis
ugcagcaggcugggcga

SEQ ID NO: 2406116 - RNA, 13 nt, Bordetella pertussis
ugcagcagguagu

SEQ ID NO: 2406117 - RNA, 19 nt, Bordetella pertussis
ugcagcaguucggcgucgg

SEQ ID NO: 2406118 - RNA, 21 nt, Bordetella pertussis
ugcagccacaggcccaugccg

SEQ ID NO: 2406119 - RNA, 13 nt, Bordetella pertussis
ugcagccacgccu

SEQ ID NO: 2406120 - RNA, 21 nt, Bordetella pertussis
ugcagccacgccuggccgcgc

SEQ ID NO: 2406121 - RNA, 22 nt, Bordetella pertussis
ugcagccacgccuggccgcgcu

SEQ ID NO: 2406122 - RNA, 21 nt, Bordetella pertussis
ugcagccagaucucgcguccg

SEQ ID NO: 2406123 - RNA, 19 nt, Bordetella pertussis
ugcagccagauucccccgc

SEQ ID NO: 2406124 - RNA, 12 nt, Bordetella pertussis
ugcagccagcgg

SEQ ID NO: 2406125 - RNA, 19 nt, Bordetella pertussis
ugcagccaguugggccagg

SEQ ID NO: 2406126 - RNA, 22 nt, Bordetella pertussis
ugcagccaguugggccagggcc

SEQ ID NO: 2406127 - RNA, 14 nt, Bordetella pertussis
ugcagcccagcacc

SEQ ID NO: 2406128 - RNA, 15 nt, Bordetella pertussis
ugcagcccagcgcga

SEQ ID NO: 2406129 - RNA, 16 nt, Bordetella pertussis
ugcagcccagcgcgau

SEQ ID NO: 2406130 - RNA, 15 nt, Bordetella pertussis
ugcagcccggccaga

SEQ ID NO: 2406131 - RNA, 19 nt, Bordetella pertussis
ugcagccgcaccagcgcau

SEQ ID NO: 2406132 - RNA, 12 nt, Bordetella pertussis
ugcagccgccgc

SEQ ID NO: 2406133 - RNA, 21 nt, Bordetella pertussis
ugcagcgacuugucgcgcccg

SEQ ID NO: 2406134 - RNA, 12 nt, Bordetella pertussis
ugcagcgcacca

SEQ ID NO: 2406135 - RNA, 18 nt, Bordetella pertussis
ugcagcgcacgguccagg

SEQ ID NO: 2406136 - RNA, 22 nt, Bordetella pertussis
ugcagcgcaucgccgcaggcgu

SEQ ID NO: 2406137 - RNA, 15 nt, Bordetella pertussis
ugcagcgccgccugg

SEQ ID NO: 2406138 - RNA, 16 nt, Bordetella pertussis
ugcagcgccgcgcgcu

SEQ ID NO: 2406139 - RNA, 14 nt, Bordetella pertussis
ugcagcgcgccagg

SEQ ID NO: 2406140 - RNA, 16 nt, Bordetella pertussis
ugcagcgcgccaggcg

SEQ ID NO: 2406141 - RNA, 17 nt, Bordetella pertussis
ugcagcgcgccaggcgc

SEQ ID NO: 2406142 - RNA, 20 nt, Bordetella pertussis
ugcagcgcgccaggcgcugc

SEQ ID NO: 2406143 - RNA, 12 nt, Bordetella pertussis
ugcagcgcgcgc

SEQ ID NO: 2406144 - RNA, 19 nt, Bordetella pertussis
ugcagcgcucaguagcucg

SEQ ID NO: 2406145 - RNA, 17 nt, Bordetella pertussis
ugcagcggacggcgcgg

SEQ ID NO: 2406146 - RNA, 13 nt, Bordetella pertussis
ugcagcggcagca

SEQ ID NO: 2406147 - RNA, 23 nt, Bordetella pertussis
ugcagcggcagcauggcgcgcgg

SEQ ID NO: 2406148 - RNA, 22 nt, Bordetella pertussis
ugcagcggcggcacgguggcga

SEQ ID NO: 2406149 - RNA, 21 nt, Bordetella pertussis
ugcagcggcuucaugccggcg

SEQ ID NO: 2406150 - RNA, 14 nt, Bordetella pertussis
ugcagcgucugcug

SEQ ID NO: 2406151 - RNA, 15 nt, Bordetella pertussis
ugcagcgucugcugg

SEQ ID NO: 2406152 - RNA, 18 nt, Bordetella pertussis
ugcagcgucuggcacgcu

SEQ ID NO: 2406153 - RNA, 19 nt, Bordetella pertussis
ugcagcgugauggggccgg

SEQ ID NO: 2406154 - RNA, 20 nt, Bordetella pertussis
ugcagcgugauggggccggg

SEQ ID NO: 2406155 - RNA, 22 nt, Bordetella pertussis
ugcagcgugauggggccgggcg

SEQ ID NO: 2406156 - RNA, 23 nt, Bordetella pertussis
ugcagcgugauggggccgggcgc

SEQ ID NO: 2406157 - RNA, 15 nt, Bordetella pertussis
ugcagcugcgccagc

SEQ ID NO: 2406158 - RNA, 19 nt, Bordetella pertussis
ugcagcugcuugcccaggc

SEQ ID NO: 2406159 - RNA, 18 nt, Bordetella pertussis
ugcagcuggauggccugc

SEQ ID NO: 2406160 - RNA, 20 nt, Bordetella pertussis
ugcagcuguagcccuggcgc

SEQ ID NO: 2406161 - RNA, 14 nt, Bordetella pertussis
ugcagcuugcgcgc

SEQ ID NO: 2406162 - RNA, 17 nt, Bordetella pertussis
ugcagcuugcgcgccag

SEQ ID NO: 2406163 - RNA, 22 nt, Bordetella pertussis
ugcaggaaauacucgagccggc

SEQ ID NO: 2406164 - RNA, 22 nt, Bordetella pertussis
ugcaggaacucgcacacgcgcu

SEQ ID NO: 2406165 - RNA, 18 nt, Bordetella pertussis
ugcaggaagccugcgcgc

SEQ ID NO: 2406166 - RNA, 16 nt, Bordetella pertussis
ugcaggaucgcggcca

SEQ ID NO: 2406167 - RNA, 17 nt, Bordetella pertussis
ugcaggaucgcggccag

SEQ ID NO: 2406168 - RNA, 21 nt, Bordetella pertussis
ugcaggauggcgucgaccgcc

SEQ ID NO: 2406169 - RNA, 15 nt, Bordetella pertussis
ugcaggauggggcgg

SEQ ID NO: 2406170 - RNA, 17 nt, Bordetella pertussis
ugcaggauuuccucguc

SEQ ID NO: 2406171 - RNA, 13 nt, Bordetella pertussis
ugcaggccaggcu

SEQ ID NO: 2406172 - RNA, 21 nt, Bordetella pertussis
ugcaggccaugcucguccauc

SEQ ID NO: 2406173 - RNA, 15 nt, Bordetella pertussis
ugcaggcccaccggc

SEQ ID NO: 2406174 - RNA, 19 nt, Bordetella pertussis
ugcaggcccgacaggaaca

SEQ ID NO: 2406175 - RNA, 12 nt, Bordetella pertussis
ugcaggccgaaa

SEQ ID NO: 2406176 - RNA, 14 nt, Bordetella pertussis
ugcaggccgccggc

SEQ ID NO: 2406177 - RNA, 17 nt, Bordetella pertussis
ugcaggccgccggccag

SEQ ID NO: 2406178 - RNA, 18 nt, Bordetella pertussis
ugcaggccgccggccagc

SEQ ID NO: 2406179 - RNA, 20 nt, Bordetella pertussis
ugcaggccgccggccagcgc

SEQ ID NO: 2406180 - RNA, 23 nt, Bordetella pertussis
ugcaggccgccggccagcgcggc

SEQ ID NO: 2406181 - RNA, 12 nt, Bordetella pertussis
ugcaggccgcga

SEQ ID NO: 2406182 - RNA, 17 nt, Bordetella pertussis
ugcaggccggcgcgcau

SEQ ID NO: 2406183 - RNA, 18 nt, Bordetella pertussis
ugcaggccggcgcgcauc

SEQ ID NO: 2406184 - RNA, 17 nt, Bordetella pertussis
ugcaggcgccagucccc

SEQ ID NO: 2406185 - RNA, 18 nt, Bordetella pertussis
ugcaggcgcggguaggca

SEQ ID NO: 2406186 - RNA, 13 nt, Bordetella pertussis
ugcaggcgcugcg

SEQ ID NO: 2406187 - RNA, 13 nt, Bordetella pertussis
ugcaggcggcgca

SEQ ID NO: 2406188 - RNA, 16 nt, Bordetella pertussis
ugcaggcggcgcauca

SEQ ID NO: 2406189 - RNA, 22 nt, Bordetella pertussis
ugcaggcggcgcaucagcgcgc

SEQ ID NO: 2406190 - RNA, 22 nt, Bordetella pertussis
ugcaggcuggacccggagcugc

SEQ ID NO: 2406191 - RNA, 19 nt, Bordetella pertussis
ugcaggcuuugcuggccau

SEQ ID NO: 2406192 - RNA, 12 nt, Bordetella pertussis
ugcagggccagg

SEQ ID NO: 2406193 - RNA, 21 nt, Bordetella pertussis
ugcagggcgucugcucgccgu

SEQ ID NO: 2406194 - RNA, 15 nt, Bordetella pertussis
ugcagggcugcgaug

SEQ ID NO: 2406195 - RNA, 19 nt, Bordetella pertussis
ugcaggggguggcggccgu

SEQ ID NO: 2406196 - RNA, 15 nt, Bordetella pertussis
ugcagggucagggug

SEQ ID NO: 2406197 - RNA, 20 nt, Bordetella pertussis
ugcagggucagggugucgcc

SEQ ID NO: 2406198 - RNA, 18 nt, Bordetella pertussis
ugcagggugucggccagg

SEQ ID NO: 2406199 - RNA, 19 nt, Bordetella pertussis
ugcagggugucggccaggg

SEQ ID NO: 2406200 - RNA, 19 nt, Bordetella pertussis
ugcaggguuggcgcgccgu

SEQ ID NO: 2406201 - RNA, 17 nt, Bordetella pertussis
ugcaggucuucgggcgu

SEQ ID NO: 2406202 - RNA, 16 nt, Bordetella pertussis
ugcaggugccgccggc

SEQ ID NO: 2406203 - RNA, 13 nt, Bordetella pertussis
ugcagguggccag

SEQ ID NO: 2406204 - RNA, 14 nt, Bordetella pertussis
ugcagguggccagc

SEQ ID NO: 2406205 - RNA, 16 nt, Bordetella pertussis
ugcaguacaggcgcgu

SEQ ID NO: 2406206 - RNA, 15 nt, Bordetella pertussis
ugcauacccauggcc

SEQ ID NO: 2406207 - RNA, 18 nt, Bordetella pertussis
ugcaucacgguaggcgcg

SEQ ID NO: 2406208 - RNA, 19 nt, Bordetella pertussis
ugcaucccaauuggccgcc

SEQ ID NO: 2406209 - RNA, 17 nt, Bordetella pertussis
ugcauccggcccagcgc

SEQ ID NO: 2406210 - RNA, 14 nt, Bordetella pertussis
ugcaucgccaugcc

SEQ ID NO: 2406211 - RNA, 18 nt, Bordetella pertussis
ugcaucgccaugccggcc

SEQ ID NO: 2406212 - RNA, 21 nt, Bordetella pertussis
ugcaucuccaggaugcgcgac

SEQ ID NO: 2406213 - RNA, 22 nt, Bordetella pertussis
ugcaucucgaagcgcucguccu

SEQ ID NO: 2406214 - RNA, 20 nt, Bordetella pertussis
ugcaugaccgccgccagcag

SEQ ID NO: 2406215 - RNA, 22 nt, Bordetella pertussis
ugcaugaccgccgccagcagcg

SEQ ID NO: 2406216 - RNA, 15 nt, Bordetella pertussis
ugcaugaccgccggc

SEQ ID NO: 2406217 - RNA, 20 nt, Bordetella pertussis
ugcaugaccgccggcaccag

SEQ ID NO: 2406218 - RNA, 16 nt, Bordetella pertussis
ugcaugacggccagga

SEQ ID NO: 2406219 - RNA, 18 nt, Bordetella pertussis
ugcaugcgcacggacagc

SEQ ID NO: 2406220 - RNA, 12 nt, Bordetella pertussis
ugcaugcgcgcc

SEQ ID NO: 2406221 - RNA, 18 nt, Bordetella pertussis
ugcauguacucggccagg

SEQ ID NO: 2406222 - RNA, 14 nt, Bordetella pertussis
ugcauguaguucac

SEQ ID NO: 2406223 - RNA, 20 nt, Bordetella pertussis
ugcauguaguucacccaggu

SEQ ID NO: 2406224 - RNA, 17 nt, Bordetella pertussis
ugcauucggcggccggc

SEQ ID NO: 2406225 - RNA, 23 nt, Bordetella pertussis
ugccaaggaucaccguucuuccg

SEQ ID NO: 2406226 - RNA, 20 nt, Bordetella pertussis
ugccacacgcgguagguagc

SEQ ID NO: 2406227 - RNA, 19 nt, Bordetella pertussis
ugccacagcgugacggcgg

SEQ ID NO: 2406228 - RNA, 14 nt, Bordetella pertussis
ugccaccagcgcgc

SEQ ID NO: 2406229 - RNA, 19 nt, Bordetella pertussis
ugccaccagcgcgccagca

SEQ ID NO: 2406230 - RNA, 14 nt, Bordetella pertussis
ugccaccgcccagg

SEQ ID NO: 2406231 - RNA, 15 nt, Bordetella pertussis
ugccaccgcccaggc

SEQ ID NO: 2406232 - RNA, 19 nt, Bordetella pertussis
ugccaccgcccaggcgcag

SEQ ID NO: 2406233 - RNA, 13 nt, Bordetella pertussis
ugccacggcgggc

SEQ ID NO: 2406234 - RNA, 15 nt, Bordetella pertussis
ugccacggcgggccg

SEQ ID NO: 2406235 - RNA, 15 nt, Bordetella pertussis
ugccacuauuuucag

SEQ ID NO: 2406236 - RNA, 19 nt, Bordetella pertussis
ugccagacggccagcgcgc

SEQ ID NO: 2406237 - RNA, 21 nt, Bordetella pertussis
ugccagacggccagcgcgcgu

SEQ ID NO: 2406238 - RNA, 22 nt, Bordetella pertussis
ugccagauccgguaugccugcc

SEQ ID NO: 2406239 - RNA, 16 nt, Bordetella pertussis
ugccagcaggucgcgc

SEQ ID NO: 2406240 - RNA, 19 nt, Bordetella pertussis
ugccagcccccugcggggu

SEQ ID NO: 2406241 - RNA, 22 nt, Bordetella pertussis
ugccagccgcuggcgaucaggc

SEQ ID NO: 2406242 - RNA, 13 nt, Bordetella pertussis
ugccagcggcgca

SEQ ID NO: 2406243 - RNA, 16 nt, Bordetella pertussis
ugccagcggcgcagcc

SEQ ID NO: 2406244 - RNA, 17 nt, Bordetella pertussis
ugccagcggcgcagccg

SEQ ID NO: 2406245 - RNA, 20 nt, Bordetella pertussis
ugccagcggcgcagccggcc

SEQ ID NO: 2406246 - RNA, 22 nt, Bordetella pertussis
ugccagcggcgcagccggccgg

SEQ ID NO: 2406247 - RNA, 14 nt, Bordetella pertussis
ugccagcuggccca

SEQ ID NO: 2406248 - RNA, 21 nt, Bordetella pertussis
ugccagcuggcccaguucggc

SEQ ID NO: 2406249 - RNA, 18 nt, Bordetella pertussis
ugccaggcccggcgcgca

SEQ ID NO: 2406250 - RNA, 20 nt, Bordetella pertussis
ugccaggcgagcgccgcgcu

SEQ ID NO: 2406251 - RNA, 13 nt, Bordetella pertussis
ugccaggcgccgc

SEQ ID NO: 2406252 - RNA, 20 nt, Bordetella pertussis
ugccaggcgccgcguccggc

SEQ ID NO: 2406253 - RNA, 20 nt, Bordetella pertussis
ugccagggugaccuggcgcg

SEQ ID NO: 2406254 - RNA, 21 nt, Bordetella pertussis
ugccagggugaccuggcgcgc

SEQ ID NO: 2406255 - RNA, 21 nt, Bordetella pertussis
ugccaggugaacaccucgaac

SEQ ID NO: 2406256 - RNA, 16 nt, Bordetella pertussis
ugccaguccccaugcg

SEQ ID NO: 2406257 - RNA, 20 nt, Bordetella pertussis
ugccagucccccgcggggac

SEQ ID NO: 2406258 - RNA, 18 nt, Bordetella pertussis
ugccaguugaaccgcaac

SEQ ID NO: 2406259 - RNA, 18 nt, Bordetella pertussis
ugccaguugccgccgccg

SEQ ID NO: 2406260 - RNA, 22 nt, Bordetella pertussis
ugccaguuguagugguguagcc

SEQ ID NO: 2406261 - RNA, 24 nt, Bordetella pertussis
ugccauaaggcuucucgaccaggc

SEQ ID NO: 2406262 - RNA, 15 nt, Bordetella pertussis
ugccauacagcaagg

SEQ ID NO: 2406263 - RNA, 13 nt, Bordetella pertussis
ugccauacggcac

SEQ ID NO: 2406264 - RNA, 15 nt, Bordetella pertussis
ugccauacggcacgg

SEQ ID NO: 2406265 - RNA, 17 nt, Bordetella pertussis
ugccauaggccagcgcc

SEQ ID NO: 2406266 - RNA, 18 nt, Bordetella pertussis
ugccauaggccagcgccu

SEQ ID NO: 2406267 - RNA, 15 nt, Bordetella pertussis
ugccauagucgcgca

SEQ ID NO: 2406268 - RNA, 17 nt, Bordetella pertussis
ugccauccagccaggcc

SEQ ID NO: 2406269 - RNA, 18 nt, Bordetella pertussis
ugccauccagccaggccg

SEQ ID NO: 2406270 - RNA, 20 nt, Bordetella pertussis
ugccaucgauaugggcggcc

SEQ ID NO: 2406271 - RNA, 14 nt, Bordetella pertussis
ugccaugccgcgcg

SEQ ID NO: 2406272 - RNA, 18 nt, Bordetella pertussis
ugccaugccgcgcgccuu

SEQ ID NO: 2406273 - RNA, 16 nt, Bordetella pertussis
ugccauggccgcgcgg

SEQ ID NO: 2406274 - RNA, 16 nt, Bordetella pertussis
ugccauuccagcuccg

SEQ ID NO: 2406275 - RNA, 20 nt, Bordetella pertussis
ugccauuccagcuccggcgg

SEQ ID NO: 2406276 - RNA, 19 nt, Bordetella pertussis
ugccauucgguggucugcc

SEQ ID NO: 2406277 - RNA, 21 nt, Bordetella pertussis
ugccauucgguggucugccag

SEQ ID NO: 2406278 - RNA, 15 nt, Bordetella pertussis
ugccauuggucugug

SEQ ID NO: 2406279 - RNA, 20 nt, Bordetella pertussis
ugccauuggucugugggcgg

SEQ ID NO: 2406280 - RNA, 18 nt, Bordetella pertussis
ugcccaaugucaccgacg

SEQ ID NO: 2406281 - RNA, 19 nt, Bordetella pertussis
ugcccaccagccgcccggc

SEQ ID NO: 2406282 - RNA, 23 nt, Bordetella pertussis
ugcccaccgacaugaccgcgucc

SEQ ID NO: 2406283 - RNA, 12 nt, Bordetella pertussis
ugcccaccgcca

SEQ ID NO: 2406284 - RNA, 14 nt, Bordetella pertussis
ugcccaccgccagg

SEQ ID NO: 2406285 - RNA, 23 nt, Bordetella pertussis
ugcccaccgccaggaagaucggc

SEQ ID NO: 2406286 - RNA, 16 nt, Bordetella pertussis
ugcccaccuuccugcu

SEQ ID NO: 2406287 - RNA, 18 nt, Bordetella pertussis
ugcccacgccuuccggcc

SEQ ID NO: 2406288 - RNA, 13 nt, Bordetella pertussis
ugcccacgcgcuc

SEQ ID NO: 2406289 - RNA, 24 nt, Bordetella pertussis
ugcccagcaauucguugaucuggc

SEQ ID NO: 2406290 - RNA, 16 nt, Bordetella pertussis
ugcccagcaccaggcc

SEQ ID NO: 2406291 - RNA, 15 nt, Bordetella pertussis
ugcccagcgccaggg

SEQ ID NO: 2406292 - RNA, 16 nt, Bordetella pertussis
ugcccagcgccagggc

SEQ ID NO: 2406293 - RNA, 19 nt, Bordetella pertussis
ugcccagcgccgccgacgg

SEQ ID NO: 2406294 - RNA, 19 nt, Bordetella pertussis
ugcccagcguguaggcggc

SEQ ID NO: 2406295 - RNA, 20 nt, Bordetella pertussis
ugcccagcguguaggcggcc

SEQ ID NO: 2406296 - RNA, 21 nt, Bordetella pertussis
ugcccagcguguaggcggccg

SEQ ID NO: 2406297 - RNA, 18 nt, Bordetella pertussis
ugcccagcuggcaccgcg

SEQ ID NO: 2406298 - RNA, 22 nt, Bordetella pertussis
ugcccaggaucgucgucaugau

SEQ ID NO: 2406299 - RNA, 19 nt, Bordetella pertussis
ugcccaggaugcccuuggc

SEQ ID NO: 2406300 - RNA, 21 nt, Bordetella pertussis
ugcccaggauggagagggccu

SEQ ID NO: 2406301 - RNA, 16 nt, Bordetella pertussis
ugcccaggccagcgcc

SEQ ID NO: 2406302 - RNA, 17 nt, Bordetella pertussis
ugcccaggccagcgccg

SEQ ID NO: 2406303 - RNA, 13 nt, Bordetella pertussis
ugcccaggcccag

SEQ ID NO: 2406304 - RNA, 14 nt, Bordetella pertussis
ugcccaggcccagu

SEQ ID NO: 2406305 - RNA, 16 nt, Bordetella pertussis
ugcccaggcccgccag

SEQ ID NO: 2406306 - RNA, 17 nt, Bordetella pertussis
ugcccaggcccuggcug

SEQ ID NO: 2406307 - RNA, 14 nt, Bordetella pertussis
ugcccaggccggcg

SEQ ID NO: 2406308 - RNA, 15 nt, Bordetella pertussis
ugcccaggccggcgc

SEQ ID NO: 2406309 - RNA, 22 nt, Bordetella pertussis
ugcccagggccacgaaacccag

SEQ ID NO: 2406310 - RNA, 16 nt, Bordetella pertussis
ugcccagggccgcgcc

SEQ ID NO: 2406311 - RNA, 17 nt, Bordetella pertussis
ugcccagggccgcgccg

SEQ ID NO: 2406312 - RNA, 21 nt, Bordetella pertussis
ugcccaggucguugcgcgaag

SEQ ID NO: 2406313 - RNA, 22 nt, Bordetella pertussis
ugcccagguugaaggccgcgau

SEQ ID NO: 2406314 - RNA, 17 nt, Bordetella pertussis
ugcccaguacgaugccg

SEQ ID NO: 2406315 - RNA, 17 nt, Bordetella pertussis
ugcccaguucgcggccg

SEQ ID NO: 2406316 - RNA, 18 nt, Bordetella pertussis
ugcccaguucgcggccgg

SEQ ID NO: 2406317 - RNA, 21 nt, Bordetella pertussis
ugcccaguuucgcgaccacca

SEQ ID NO: 2406318 - RNA, 21 nt, Bordetella pertussis
ugcccaucaggccgaugcguc

SEQ ID NO: 2406319 - RNA, 15 nt, Bordetella pertussis
ugcccaugccgccau

SEQ ID NO: 2406320 - RNA, 21 nt, Bordetella pertussis
ugcccaugccgccaugcagcu

SEQ ID NO: 2406321 - RNA, 20 nt, Bordetella pertussis
ugcccauggggugcuccugc

SEQ ID NO: 2406322 - RNA, 21 nt, Bordetella pertussis
ugcccauggggugcuccugcc

SEQ ID NO: 2406323 - RNA, 23 nt, Bordetella pertussis
ugcccauggggugcuccugccag

SEQ ID NO: 2406324 - RNA, 17 nt, Bordetella pertussis
ugccccaacggcgcacc

SEQ ID NO: 2406325 - RNA, 20 nt, Bordetella pertussis
ugccccaacggcgcaccguc

SEQ ID NO: 2406326 - RNA, 14 nt, Bordetella pertussis
ugccccacgccgau

SEQ ID NO: 2406327 - RNA, 18 nt, Bordetella pertussis
ugccccacgccgaugccg

SEQ ID NO: 2406328 - RNA, 22 nt, Bordetella pertussis
ugccccacggguaccaggcucc

SEQ ID NO: 2406329 - RNA, 13 nt, Bordetella pertussis
ugccccagguccg

SEQ ID NO: 2406330 - RNA, 19 nt, Bordetella pertussis
ugccccagguccgccggca

SEQ ID NO: 2406331 - RNA, 20 nt, Bordetella pertussis
ugccccagguccgccggcac

SEQ ID NO: 2406332 - RNA, 14 nt, Bordetella pertussis
ugccccaguccagg

SEQ ID NO: 2406333 - RNA, 18 nt, Bordetella pertussis
ugccccaguccaggccgg

SEQ ID NO: 2406334 - RNA, 14 nt, Bordetella pertussis
ugccccauccagcg

SEQ ID NO: 2406335 - RNA, 15 nt, Bordetella pertussis
ugccccauccagcgg

SEQ ID NO: 2406336 - RNA, 15 nt, Bordetella pertussis
ugccccaucccaucc

SEQ ID NO: 2406337 - RNA, 19 nt, Bordetella pertussis
ugccccauggcaugcaccg

SEQ ID NO: 2406338 - RNA, 21 nt, Bordetella pertussis
ugccccauuuuuuugccugcu

SEQ ID NO: 2406339 - RNA, 19 nt, Bordetella pertussis
ugccccgauccgcgggcgg

SEQ ID NO: 2406340 - RNA, 23 nt, Bordetella pertussis
ugccccgauccgcgggcgggccg

SEQ ID NO: 2406341 - RNA, 17 nt, Bordetella pertussis
ugccccgcaugcgcaga

SEQ ID NO: 2406342 - RNA, 15 nt, Bordetella pertussis
ugccccucggcgggc

SEQ ID NO: 2406343 - RNA, 16 nt, Bordetella pertussis
ugccccucggcgggcu

SEQ ID NO: 2406344 - RNA, 16 nt, Bordetella pertussis
ugccccugcggggaca

SEQ ID NO: 2406345 - RNA, 20 nt, Bordetella pertussis
ugccccugcggggacaggca

SEQ ID NO: 2406346 - RNA, 21 nt, Bordetella pertussis
ugccccugcggggacaggcac

SEQ ID NO: 2406347 - RNA, 19 nt, Bordetella pertussis
ugcccgaagcgcagcacca

SEQ ID NO: 2406348 - RNA, 20 nt, Bordetella pertussis
ugcccgaagcgcagcaccag

SEQ ID NO: 2406349 - RNA, 13 nt, Bordetella pertussis
ugcccgaagcggc

SEQ ID NO: 2406350 - RNA, 22 nt, Bordetella pertussis
ugcccgaagcggcccggguggg

SEQ ID NO: 2406351 - RNA, 16 nt, Bordetella pertussis
ugcccgaaggcagcgg

SEQ ID NO: 2406352 - RNA, 20 nt, Bordetella pertussis
ugcccgaccgcaugggcgcc

SEQ ID NO: 2406353 - RNA, 14 nt, Bordetella pertussis
ugcccgacgccgcg

SEQ ID NO: 2406354 - RNA, 17 nt, Bordetella pertussis
ugcccgacgccgcgcgc

SEQ ID NO: 2406355 - RNA, 16 nt, Bordetella pertussis
ugcccgacggcgccga

SEQ ID NO: 2406356 - RNA, 19 nt, Bordetella pertussis
ugcccgacggcgccgaucc

SEQ ID NO: 2406357 - RNA, 21 nt, Bordetella pertussis
ugcccgagcgcgacagcacca

SEQ ID NO: 2406358 - RNA, 23 nt, Bordetella pertussis
ugcccgagcgcgacagcaccaac

SEQ ID NO: 2406359 - RNA, 14 nt, Bordetella pertussis
ugcccgaggcggcg

SEQ ID NO: 2406360 - RNA, 17 nt, Bordetella pertussis
ugcccgaggcggcgcgg

SEQ ID NO: 2406361 - RNA, 16 nt, Bordetella pertussis
ugcccgagggcgcguc

SEQ ID NO: 2406362 - RNA, 17 nt, Bordetella pertussis
ugcccgcaacgccgccc

SEQ ID NO: 2406363 - RNA, 13 nt, Bordetella pertussis
ugcccgccagcgc

SEQ ID NO: 2406364 - RNA, 15 nt, Bordetella pertussis
ugcccgccagcgcgg

SEQ ID NO: 2406365 - RNA, 16 nt, Bordetella pertussis
ugcccgccagcgcggc

SEQ ID NO: 2406366 - RNA, 23 nt, Bordetella pertussis
ugcccgccccauugggacgccag

SEQ ID NO: 2406367 - RNA, 20 nt, Bordetella pertussis
ugcccgccccgugcaccaug

SEQ ID NO: 2406368 - RNA, 23 nt, Bordetella pertussis
ugcccgccccgugcaccaugccg

SEQ ID NO: 2406369 - RNA, 22 nt, Bordetella pertussis
ugcccgccuggucgcuggcgcc

SEQ ID NO: 2406370 - RNA, 23 nt, Bordetella pertussis
ugcccgccuggucgcuggcgccg

SEQ ID NO: 2406371 - RNA, 20 nt, Bordetella pertussis
ugcccgcgcaccaggcgcgg

SEQ ID NO: 2406372 - RNA, 22 nt, Bordetella pertussis
ugcccgcgcaccaggcgcggcg

SEQ ID NO: 2406373 - RNA, 23 nt, Bordetella pertussis
ugcccgcgcaccaggcgcggcgu

SEQ ID NO: 2406374 - RNA, 23 nt, Bordetella pertussis
ugcccgcgguccagcacggcgag

SEQ ID NO: 2406375 - RNA, 15 nt, Bordetella pertussis
ugcccgcguccacca

SEQ ID NO: 2406376 - RNA, 15 nt, Bordetella pertussis
ugcccgcuggccaug

SEQ ID NO: 2406377 - RNA, 21 nt, Bordetella pertussis
ugcccgcuggccaugccgucg

SEQ ID NO: 2406378 - RNA, 13 nt, Bordetella pertussis
ugcccggcaggca

SEQ ID NO: 2406379 - RNA, 15 nt, Bordetella pertussis
ugcccggcaggcaca

SEQ ID NO: 2406380 - RNA, 16 nt, Bordetella pertussis
ugcccggcaggcacac

SEQ ID NO: 2406381 - RNA, 21 nt, Bordetella pertussis
ugcccggcagggugacgggcu

SEQ ID NO: 2406382 - RNA, 13 nt, Bordetella pertussis
ugcccggcgagca

SEQ ID NO: 2406383 - RNA, 18 nt, Bordetella pertussis
ugcccggcgagcauggcg

SEQ ID NO: 2406384 - RNA, 13 nt, Bordetella pertussis
ugcccggcgggcc

SEQ ID NO: 2406385 - RNA, 14 nt, Bordetella pertussis
ugcccggcgggccg

SEQ ID NO: 2406386 - RNA, 23 nt, Bordetella pertussis
ugcccgggaucugcgagccuucg

SEQ ID NO: 2406387 - RNA, 14 nt, Bordetella pertussis
ugcccgggcaccag

SEQ ID NO: 2406388 - RNA, 13 nt, Bordetella pertussis
ugcccgggcagca

SEQ ID NO: 2406389 - RNA, 16 nt, Bordetella pertussis
ugcccgggcagcaccg

SEQ ID NO: 2406390 - RNA, 18 nt, Bordetella pertussis
ugcccgggcagcaccgcu

SEQ ID NO: 2406391 - RNA, 19 nt, Bordetella pertussis
ugcccgggcgggaauucgc

SEQ ID NO: 2406392 - RNA, 15 nt, Bordetella pertussis
ugcccgggcuggccg

SEQ ID NO: 2406393 - RNA, 17 nt, Bordetella pertussis
ugcccgggcuggccgcc

SEQ ID NO: 2406394 - RNA, 17 nt, Bordetella pertussis
ugcccgggguugccaag

SEQ ID NO: 2406395 - RNA, 17 nt, Bordetella pertussis
ugcccgguucgugccgg

SEQ ID NO: 2406396 - RNA, 18 nt, Bordetella pertussis
ugcccgguucgugccggg

SEQ ID NO: 2406397 - RNA, 18 nt, Bordetella pertussis
ugcccguacgucaaggcc

SEQ ID NO: 2406398 - RNA, 14 nt, Bordetella pertussis
ugcccguagcagau

SEQ ID NO: 2406399 - RNA, 18 nt, Bordetella pertussis
ugcccgucagcggcgcgc

SEQ ID NO: 2406400 - RNA, 14 nt, Bordetella pertussis
ugcccgucagggua

SEQ ID NO: 2406401 - RNA, 23 nt, Bordetella pertussis
ugcccgucaugcgccgcagcacc

SEQ ID NO: 2406402 - RNA, 17 nt, Bordetella pertussis
ugcccgucgcuggcgcg

SEQ ID NO: 2406403 - RNA, 18 nt, Bordetella pertussis
ugcccgucuauggccugc

SEQ ID NO: 2406404 - RNA, 17 nt, Bordetella pertussis
ugcccgucuuggcgugg

SEQ ID NO: 2406405 - RNA, 16 nt, Bordetella pertussis
ugcccgugcgugcgcc

SEQ ID NO: 2406406 - RNA, 16 nt, Bordetella pertussis
ugcccgugcgugugcc

SEQ ID NO: 2406407 - RNA, 16 nt, Bordetella pertussis
ugcccguucacgcgca

SEQ ID NO: 2406408 - RNA, 17 nt, Bordetella pertussis
ugcccguucacgcgcag

SEQ ID NO: 2406409 - RNA, 16 nt, Bordetella pertussis
ugcccguugccgcgcg

SEQ ID NO: 2406410 - RNA, 22 nt, Bordetella pertussis
ugcccguuggcgucgagcaccg

SEQ ID NO: 2406411 - RNA, 23 nt, Bordetella pertussis
ugcccucccagaaacuggcgcug

SEQ ID NO: 2406412 - RNA, 15 nt, Bordetella pertussis
ugcccuccucggcca

SEQ ID NO: 2406413 - RNA, 18 nt, Bordetella pertussis
ugcccuccucggccaggu

SEQ ID NO: 2406414 - RNA, 19 nt, Bordetella pertussis
ugcccucgcccgugcgcgg

SEQ ID NO: 2406415 - RNA, 20 nt, Bordetella pertussis
ugcccucgcgcacggugcgc

SEQ ID NO: 2406416 - RNA, 19 nt, Bordetella pertussis
ugcccucggucagcgccag

SEQ ID NO: 2406417 - RNA, 22 nt, Bordetella pertussis
ugcccucuuccugaacgacggu

SEQ ID NO: 2406418 - RNA, 17 nt, Bordetella pertussis
ugcccucuucggcggcc

SEQ ID NO: 2406419 - RNA, 16 nt, Bordetella pertussis
ugcccugacccgcugg

SEQ ID NO: 2406420 - RNA, 22 nt, Bordetella pertussis
ugcccugcaugaccgccgccag

SEQ ID NO: 2406421 - RNA, 14 nt, Bordetella pertussis
ugcccugcgccagc

SEQ ID NO: 2406422 - RNA, 17 nt, Bordetella pertussis
ugcccugcgccagcgcc

SEQ ID NO: 2406423 - RNA, 18 nt, Bordetella pertussis
ugcccugcgccagcgccu

SEQ ID NO: 2406424 - RNA, 19 nt, Bordetella pertussis
ugcccugcgccagcgccuc

SEQ ID NO: 2406425 - RNA, 21 nt, Bordetella pertussis
ugcccugcggcgcggccagca

SEQ ID NO: 2406426 - RNA, 22 nt, Bordetella pertussis
ugcccugcggcgcggccagcac

SEQ ID NO: 2406427 - RNA, 14 nt, Bordetella pertussis
ugcccugcugcugc

SEQ ID NO: 2406428 - RNA, 19 nt, Bordetella pertussis
ugcccuggaucaggauggg

SEQ ID NO: 2406429 - RNA, 20 nt, Bordetella pertussis
ugcccuggaucaggaugggc

SEQ ID NO: 2406430 - RNA, 12 nt, Bordetella pertussis
ugcccuggccac

SEQ ID NO: 2406431 - RNA, 21 nt, Bordetella pertussis
ugcccuggccacgcugcugcc

SEQ ID NO: 2406432 - RNA, 15 nt, Bordetella pertussis
ugcccuggcccaggc

SEQ ID NO: 2406433 - RNA, 16 nt, Bordetella pertussis
ugcccuggcccaggcc

SEQ ID NO: 2406434 - RNA, 18 nt, Bordetella pertussis
ugcccuucggcaugcugc

SEQ ID NO: 2406435 - RNA, 22 nt, Bordetella pertussis
ugcccuugaccgacgugcugcu

SEQ ID NO: 2406436 - RNA, 16 nt, Bordetella pertussis
ugcccuugcuguacuc

SEQ ID NO: 2406437 - RNA, 14 nt, Bordetella pertussis
ugcccuuggcggcg

SEQ ID NO: 2406438 - RNA, 14 nt, Bordetella pertussis
ugccgaacagcaug

SEQ ID NO: 2406439 - RNA, 22 nt, Bordetella pertussis
ugccgaacagcauggcggcgcc

SEQ ID NO: 2406440 - RNA, 16 nt, Bordetella pertussis
ugccgaacagccaggg

SEQ ID NO: 2406441 - RNA, 18 nt, Bordetella pertussis
ugccgaacagccagggca

SEQ ID NO: 2406442 - RNA, 21 nt, Bordetella pertussis
ugccgaacucgcgcucggcca

SEQ ID NO: 2406443 - RNA, 17 nt, Bordetella pertussis
ugccgaacugucgcgcc

SEQ ID NO: 2406444 - RNA, 19 nt, Bordetella pertussis
ugccgaagcgucggccugc

SEQ ID NO: 2406445 - RNA, 19 nt, Bordetella pertussis
ugccgaccaccagcaccga

SEQ ID NO: 2406446 - RNA, 12 nt, Bordetella pertussis
ugccgaccaggc

SEQ ID NO: 2406447 - RNA, 19 nt, Bordetella pertussis
ugccgacggauucgcccag

SEQ ID NO: 2406448 - RNA, 14 nt, Bordetella pertussis
ugccgagacggccg

SEQ ID NO: 2406449 - RNA, 16 nt, Bordetella pertussis
ugccgagacggccgcc

SEQ ID NO: 2406450 - RNA, 12 nt, Bordetella pertussis
ugccgagcagau

SEQ ID NO: 2406451 - RNA, 19 nt, Bordetella pertussis
ugccgauacgggcgcggcg

SEQ ID NO: 2406452 - RNA, 20 nt, Bordetella pertussis
ugccgauacgggcgcggcgu

SEQ ID NO: 2406453 - RNA, 13 nt, Bordetella pertussis
ugccgaucagcgg

SEQ ID NO: 2406454 - RNA, 16 nt, Bordetella pertussis
ugccgaucagcgggcu

SEQ ID NO: 2406455 - RNA, 18 nt, Bordetella pertussis
ugccgaucagcgggcugg

SEQ ID NO: 2406456 - RNA, 21 nt, Bordetella pertussis
ugccgaucagcgggcuggcca

SEQ ID NO: 2406457 - RNA, 16 nt, Bordetella pertussis
ugccgauccagcgccu

SEQ ID NO: 2406458 - RNA, 15 nt, Bordetella pertussis
ugccgaugcggcgca

SEQ ID NO: 2406459 - RNA, 21 nt, Bordetella pertussis
ugccgaugcgguaggcccagc

SEQ ID NO: 2406460 - RNA, 23 nt, Bordetella pertussis
ugccgcaaccgucgaccggcccg

SEQ ID NO: 2406461 - RNA, 18 nt, Bordetella pertussis
ugccgcacgaucgcgccg

SEQ ID NO: 2406462 - RNA, 21 nt, Bordetella pertussis
ugccgcacgaucgcgccggcc

SEQ ID NO: 2406463 - RNA, 23 nt, Bordetella pertussis
ugccgcacgaucgcgccggccug

SEQ ID NO: 2406464 - RNA, 17 nt, Bordetella pertussis
ugccgcacgguggcgcc

SEQ ID NO: 2406465 - RNA, 22 nt, Bordetella pertussis
ugccgcacgguggcgccgucgc

SEQ ID NO: 2406466 - RNA, 20 nt, Bordetella pertussis
ugccgcagacggucgacacc

SEQ ID NO: 2406467 - RNA, 18 nt, Bordetella pertussis
ugccgcagauggccagca

SEQ ID NO: 2406468 - RNA, 19 nt, Bordetella pertussis
ugccgcagauggccagcag

SEQ ID NO: 2406469 - RNA, 20 nt, Bordetella pertussis
ugccgcagauggccagcagc

SEQ ID NO: 2406470 - RNA, 21 nt, Bordetella pertussis
ugccgcagauggccagcagcg

SEQ ID NO: 2406471 - RNA, 19 nt, Bordetella pertussis
ugccgcagaugucaguccu

SEQ ID NO: 2406472 - RNA, 13 nt, Bordetella pertussis
ugccgcagcacca

SEQ ID NO: 2406473 - RNA, 21 nt, Bordetella pertussis
ugccgcagcaccacaucgccg

SEQ ID NO: 2406474 - RNA, 17 nt, Bordetella pertussis
ugccgcagcccgcgcgc

SEQ ID NO: 2406475 - RNA, 18 nt, Bordetella pertussis
ugccgcagcccgcgcgcc

SEQ ID NO: 2406476 - RNA, 17 nt, Bordetella pertussis
ugccgcagcggccaugg

SEQ ID NO: 2406477 - RNA, 15 nt, Bordetella pertussis
ugccgcagcggggac

SEQ ID NO: 2406478 - RNA, 16 nt, Bordetella pertussis
ugccgcagcggggaca

SEQ ID NO: 2406479 - RNA, 22 nt, Bordetella pertussis
ugccgcagcggggacaggcgcc

SEQ ID NO: 2406480 - RNA, 14 nt, Bordetella pertussis
ugccgcaggccagc

SEQ ID NO: 2406481 - RNA, 20 nt, Bordetella pertussis
ugccgcaguugaacacgcgg

SEQ ID NO: 2406482 - RNA, 21 nt, Bordetella pertussis
ugccgcaucccgcccccgccg

SEQ ID NO: 2406483 - RNA, 15 nt, Bordetella pertussis
ugccgccaacgcggc

SEQ ID NO: 2406484 - RNA, 22 nt, Bordetella pertussis
ugccgccaacgcggcgcgugca

SEQ ID NO: 2406485 - RNA, 19 nt, Bordetella pertussis
ugccgccaagggcgcgcca

SEQ ID NO: 2406486 - RNA, 20 nt, Bordetella pertussis
ugccgccaagggcgcgccag

SEQ ID NO: 2406487 - RNA, 19 nt, Bordetella pertussis
ugccgccacgggcccgcgc

SEQ ID NO: 2406488 - RNA, 21 nt, Bordetella pertussis
ugccgccacgggcccgcgcag

SEQ ID NO: 2406489 - RNA, 17 nt, Bordetella pertussis
ugccgccaugcagcugg

SEQ ID NO: 2406490 - RNA, 19 nt, Bordetella pertussis
ugccgccaugcgccagcag

SEQ ID NO: 2406491 - RNA, 22 nt, Bordetella pertussis
ugccgccaugcgccagcaggau

SEQ ID NO: 2406492 - RNA, 17 nt, Bordetella pertussis
ugccgcccacgaucacc

SEQ ID NO: 2406493 - RNA, 22 nt, Bordetella pertussis
ugccgcccacgaucaccacgcc

SEQ ID NO: 2406494 - RNA, 13 nt, Bordetella pertussis
ugccgcccacgcc

SEQ ID NO: 2406495 - RNA, 13 nt, Bordetella pertussis
ugccgcccacugc

SEQ ID NO: 2406496 - RNA, 19 nt, Bordetella pertussis
ugccgcccacugccaggcg

SEQ ID NO: 2406497 - RNA, 13 nt, Bordetella pertussis
ugccgcccagcau

SEQ ID NO: 2406498 - RNA, 23 nt, Bordetella pertussis
ugccgcccagcaugcgcgcgacu

SEQ ID NO: 2406499 - RNA, 11 nt, Bordetella pertussis
ugccgcccagg

SEQ ID NO: 2406500 - RNA, 13 nt, Bordetella pertussis
ugccgcccaggag

SEQ ID NO: 2406501 - RNA, 20 nt, Bordetella pertussis
ugccgcccaggagcaacugg

SEQ ID NO: 2406502 - RNA, 23 nt, Bordetella pertussis
ugccgcccaggucggacgcgccg

SEQ ID NO: 2406503 - RNA, 24 nt, Bordetella pertussis
ugccgcccaggucggacgcgccgg

SEQ ID NO: 2406504 - RNA, 17 nt, Bordetella pertussis
ugccgcccaugccgccg

SEQ ID NO: 2406505 - RNA, 20 nt, Bordetella pertussis
ugccgcccgagcuggccggc

SEQ ID NO: 2406506 - RNA, 13 nt, Bordetella pertussis
ugccgcccgccau

SEQ ID NO: 2406507 - RNA, 15 nt, Bordetella pertussis
ugccgcccuggcgca

SEQ ID NO: 2406508 - RNA, 16 nt, Bordetella pertussis
ugccgcccuggcgcag

SEQ ID NO: 2406509 - RNA, 15 nt, Bordetella pertussis
ugccgccgaaccagc

SEQ ID NO: 2406510 - RNA, 17 nt, Bordetella pertussis
ugccgccgaaccagcgc

SEQ ID NO: 2406511 - RNA, 18 nt, Bordetella pertussis
ugccgccgaugugcggcg

SEQ ID NO: 2406512 - RNA, 14 nt, Bordetella pertussis
ugccgccgccgcgc

SEQ ID NO: 2406513 - RNA, 18 nt, Bordetella pertussis
ugccgccgccggcgcggu

SEQ ID NO: 2406514 - RNA, 13 nt, Bordetella pertussis
ugccgccgcgcag

SEQ ID NO: 2406515 - RNA, 15 nt, Bordetella pertussis
ugccgccgcgcagcc

SEQ ID NO: 2406516 - RNA, 20 nt, Bordetella pertussis
ugccgccgcgcaggaugacg

SEQ ID NO: 2406517 - RNA, 14 nt, Bordetella pertussis
ugccgccgcugccg

SEQ ID NO: 2406518 - RNA, 15 nt, Bordetella pertussis
ugccgccggacggcg

SEQ ID NO: 2406519 - RNA, 14 nt, Bordetella pertussis
ugccgccggccagg

SEQ ID NO: 2406520 - RNA, 14 nt, Bordetella pertussis
ugccgccggcgcgu

SEQ ID NO: 2406521 - RNA, 13 nt, Bordetella pertussis
ugccgccggcggg

SEQ ID NO: 2406522 - RNA, 17 nt, Bordetella pertussis
ugccgccggcgggcaac

SEQ ID NO: 2406523 - RNA, 22 nt, Bordetella pertussis
ugccgccgggcaugcaccaggc

SEQ ID NO: 2406524 - RNA, 23 nt, Bordetella pertussis
ugccgccgugcuucucguagaac

SEQ ID NO: 2406525 - RNA, 13 nt, Bordetella pertussis
ugccgccugccag

SEQ ID NO: 2406526 - RNA, 13 nt, Bordetella pertussis
ugccgccuggcca

SEQ ID NO: 2406527 - RNA, 16 nt, Bordetella pertussis
ugccgccuggccagau

SEQ ID NO: 2406528 - RNA, 19 nt, Bordetella pertussis
ugccgccuucgccgugguc

SEQ ID NO: 2406529 - RNA, 15 nt, Bordetella pertussis
ugccgcgaggcgcag

SEQ ID NO: 2406530 - RNA, 17 nt, Bordetella pertussis
ugccgcgcacccaggcc

SEQ ID NO: 2406531 - RNA, 16 nt, Bordetella pertussis
ugccgcgcaccugggc

SEQ ID NO: 2406532 - RNA, 18 nt, Bordetella pertussis
ugccgcgcaccugggcgu

SEQ ID NO: 2406533 - RNA, 19 nt, Bordetella pertussis
ugccgcgcaccugggcguc

SEQ ID NO: 2406534 - RNA, 20 nt, Bordetella pertussis
ugccgcgcauuugccgcggc

SEQ ID NO: 2406535 - RNA, 13 nt, Bordetella pertussis
ugccgcgcccggc

SEQ ID NO: 2406536 - RNA, 20 nt, Bordetella pertussis
ugccgcgcccggcggccagg

SEQ ID NO: 2406537 - RNA, 13 nt, Bordetella pertussis
ugccgcgccgacc

SEQ ID NO: 2406538 - RNA, 17 nt, Bordetella pertussis
ugccgcgcgauccggcg

SEQ ID NO: 2406539 - RNA, 20 nt, Bordetella pertussis
ugccgcgcgcaccggcuugg

SEQ ID NO: 2406540 - RNA, 13 nt, Bordetella pertussis
ugccgcgcgcgca

SEQ ID NO: 2406541 - RNA, 24 nt, Bordetella pertussis
ugccgcgcgcgcagacgcgcucag

SEQ ID NO: 2406542 - RNA, 15 nt, Bordetella pertussis
ugccgcgcgcggccg

SEQ ID NO: 2406543 - RNA, 22 nt, Bordetella pertussis
ugccgcgcggcgcguucagcag

SEQ ID NO: 2406544 - RNA, 23 nt, Bordetella pertussis
ugccgcgcggcgcguucagcagc

SEQ ID NO: 2406545 - RNA, 19 nt, Bordetella pertussis
ugccgcgcggcguauggcg

SEQ ID NO: 2406546 - RNA, 22 nt, Bordetella pertussis
ugccgcgcggcguauggcgcgg

SEQ ID NO: 2406547 - RNA, 18 nt, Bordetella pertussis
ugccgcgcgguggggcgc

SEQ ID NO: 2406548 - RNA, 18 nt, Bordetella pertussis
ugccgcgcguacgcggcg

SEQ ID NO: 2406549 - RNA, 21 nt, Bordetella pertussis
ugccgcgcguacgcggcgcgg

SEQ ID NO: 2406550 - RNA, 22 nt, Bordetella pertussis
ugccgcggauugccguccuggc

SEQ ID NO: 2406551 - RNA, 20 nt, Bordetella pertussis
ugccgcggcaaauggggcgg

SEQ ID NO: 2406552 - RNA, 23 nt, Bordetella pertussis
ugccgcggcaaauggggcggccg

SEQ ID NO: 2406553 - RNA, 16 nt, Bordetella pertussis
ugccgcggcaugcugg

SEQ ID NO: 2406554 - RNA, 20 nt, Bordetella pertussis
ugccgcggcaugcugguugg

SEQ ID NO: 2406555 - RNA, 14 nt, Bordetella pertussis
ugccgcggccgccc

SEQ ID NO: 2406556 - RNA, 18 nt, Bordetella pertussis
ugccgcggccgcccccag

SEQ ID NO: 2406557 - RNA, 16 nt, Bordetella pertussis
ugccgcggcgcggccc

SEQ ID NO: 2406558 - RNA, 20 nt, Bordetella pertussis
ugccgcggcgcggcccgcca

SEQ ID NO: 2406559 - RNA, 16 nt, Bordetella pertussis
ugccgcggcgcggccu

SEQ ID NO: 2406560 - RNA, 17 nt, Bordetella pertussis
ugccgcgggcggcgccg

SEQ ID NO: 2406561 - RNA, 19 nt, Bordetella pertussis
ugccgcgggcggcgccggc

SEQ ID NO: 2406562 - RNA, 16 nt, Bordetella pertussis
ugccgcgguggcgggc

SEQ ID NO: 2406563 - RNA, 20 nt, Bordetella pertussis
ugccgcgguggcgggcgugc

SEQ ID NO: 2406564 - RNA, 21 nt, Bordetella pertussis
ugccgcgguggcgggcgugcg

SEQ ID NO: 2406565 - RNA, 18 nt, Bordetella pertussis
ugccgcguaugcggcagc

SEQ ID NO: 2406566 - RNA, 19 nt, Bordetella pertussis
ugccgcguaugcggcagca

SEQ ID NO: 2406567 - RNA, 17 nt, Bordetella pertussis
ugccgcgucccgugccg

SEQ ID NO: 2406568 - RNA, 21 nt, Bordetella pertussis
ugccgcgucccgugccggccg

SEQ ID NO: 2406569 - RNA, 22 nt, Bordetella pertussis
ugccgcgucccgugccggccgg

SEQ ID NO: 2406570 - RNA, 15 nt, Bordetella pertussis
ugccgcgucgauccg

SEQ ID NO: 2406571 - RNA, 21 nt, Bordetella pertussis
ugccgcgucgauccggcagca

SEQ ID NO: 2406572 - RNA, 15 nt, Bordetella pertussis
ugccgcgugcccgcg

SEQ ID NO: 2406573 - RNA, 19 nt, Bordetella pertussis
ugccgcgugcccgcgucca

SEQ ID NO: 2406574 - RNA, 20 nt, Bordetella pertussis
ugccgcucaauucggccuga

SEQ ID NO: 2406575 - RNA, 19 nt, Bordetella pertussis
ugccgcugaccagcacgau

SEQ ID NO: 2406576 - RNA, 20 nt, Bordetella pertussis
ugccgcugaucuuccugggc

SEQ ID NO: 2406577 - RNA, 15 nt, Bordetella pertussis
ugccgcugcaugggc

SEQ ID NO: 2406578 - RNA, 17 nt, Bordetella pertussis
ugccgcugcccaccuuc

SEQ ID NO: 2406579 - RNA, 14 nt, Bordetella pertussis
ugccgcugcccagc

SEQ ID NO: 2406580 - RNA, 17 nt, Bordetella pertussis
ugccgcuggacgcgccg

SEQ ID NO: 2406581 - RNA, 23 nt, Bordetella pertussis
ugccgcuggacgcgccgaacacc

SEQ ID NO: 2406582 - RNA, 19 nt, Bordetella pertussis
ugccgcuggcgauggccug

SEQ ID NO: 2406583 - RNA, 20 nt, Bordetella pertussis
ugccgcuggcggcccugccg

SEQ ID NO: 2406584 - RNA, 16 nt, Bordetella pertussis
ugccgcuggugaucug

SEQ ID NO: 2406585 - RNA, 19 nt, Bordetella pertussis
ugccgcuggugaucugcug

SEQ ID NO: 2406586 - RNA, 12 nt, Bordetella pertussis
ugccgcuggugc

SEQ ID NO: 2406587 - RNA, 18 nt, Bordetella pertussis
ugccgcuguggcgcgcca

SEQ ID NO: 2406588 - RNA, 16 nt, Bordetella pertussis
ugccgcuucaggaaca

SEQ ID NO: 2406589 - RNA, 13 nt, Bordetella pertussis
ugccggaaaucac

SEQ ID NO: 2406590 - RNA, 15 nt, Bordetella pertussis
ugccggaacaggcgc

SEQ ID NO: 2406591 - RNA, 16 nt, Bordetella pertussis
ugccggaacaggcgcc

SEQ ID NO: 2406592 - RNA, 13 nt, Bordetella pertussis
ugccggacgccga

SEQ ID NO: 2406593 - RNA, 21 nt, Bordetella pertussis
ugccggacgccgacugggugc

SEQ ID NO: 2406594 - RNA, 13 nt, Bordetella pertussis
ugccggagcagca

SEQ ID NO: 2406595 - RNA, 16 nt, Bordetella pertussis
ugccggagcagcagcg

SEQ ID NO: 2406596 - RNA, 20 nt, Bordetella pertussis
ugccggagcagcagcgggcu

SEQ ID NO: 2406597 - RNA, 16 nt, Bordetella pertussis
ugccggagcccgucag

SEQ ID NO: 2406598 - RNA, 16 nt, Bordetella pertussis
ugccggaucagcgccu

SEQ ID NO: 2406599 - RNA, 13 nt, Bordetella pertussis
ugccggcagcagg

SEQ ID NO: 2406600 - RNA, 19 nt, Bordetella pertussis
ugccggcauaggcggcgca

SEQ ID NO: 2406601 - RNA, 22 nt, Bordetella pertussis
ugccggcauaggcggcgcaggc

SEQ ID NO: 2406602 - RNA, 23 nt, Bordetella pertussis
ugccggcauaggcggcgcaggcc

SEQ ID NO: 2406603 - RNA, 13 nt, Bordetella pertussis
ugccggccagcag

SEQ ID NO: 2406604 - RNA, 14 nt, Bordetella pertussis
ugccggccagcagc

SEQ ID NO: 2406605 - RNA, 17 nt, Bordetella pertussis
ugccggccagccugccc

SEQ ID NO: 2406606 - RNA, 18 nt, Bordetella pertussis
ugccggccaugcucagca

SEQ ID NO: 2406607 - RNA, 23 nt, Bordetella pertussis
ugccggcccgguauuccucgacg

SEQ ID NO: 2406608 - RNA, 17 nt, Bordetella pertussis
ugccggccgaccggcgc

SEQ ID NO: 2406609 - RNA, 19 nt, Bordetella pertussis
ugccggccgaccggcgcgc

SEQ ID NO: 2406610 - RNA, 16 nt, Bordetella pertussis
ugccggccgcccaggc

SEQ ID NO: 2406611 - RNA, 21 nt, Bordetella pertussis
ugccggccgcccaggcgcagc

SEQ ID NO: 2406612 - RNA, 14 nt, Bordetella pertussis
ugccggccggccag

SEQ ID NO: 2406613 - RNA, 19 nt, Bordetella pertussis
ugccggccugaggcccgau

SEQ ID NO: 2406614 - RNA, 18 nt, Bordetella pertussis
ugccggccuggcgggccg

SEQ ID NO: 2406615 - RNA, 22 nt, Bordetella pertussis
ugccggccuggcgggccgaggc

SEQ ID NO: 2406616 - RNA, 15 nt, Bordetella pertussis
ugccggcgaucacgc

SEQ ID NO: 2406617 - RNA, 19 nt, Bordetella pertussis
ugccggcgaugaugggguc

SEQ ID NO: 2406618 - RNA, 12 nt, Bordetella pertussis
ugccggcgcaca

SEQ ID NO: 2406619 - RNA, 12 nt, Bordetella pertussis
ugccggcgcgca

SEQ ID NO: 2406620 - RNA, 23 nt, Bordetella pertussis
ugccggcgcgcaaaccgacgcgg

SEQ ID NO: 2406621 - RNA, 15 nt, Bordetella pertussis
ugccggcgcgcccag

SEQ ID NO: 2406622 - RNA, 21 nt, Bordetella pertussis
ugccggcgcgccucggcgcgc

SEQ ID NO: 2406623 - RNA, 23 nt, Bordetella pertussis
ugccggcgcgccucggcgcgcgc

SEQ ID NO: 2406624 - RNA, 14 nt, Bordetella pertussis
ugccggcgcgggcg

SEQ ID NO: 2406625 - RNA, 15 nt, Bordetella pertussis
ugccggcgcgggcgc

SEQ ID NO: 2406626 - RNA, 16 nt, Bordetella pertussis
ugccggcgcgggcgca

SEQ ID NO: 2406627 - RNA, 17 nt, Bordetella pertussis
ugccggcgcgggcgcag

SEQ ID NO: 2406628 - RNA, 20 nt, Bordetella pertussis
ugccggcggccuaugugcag

SEQ ID NO: 2406629 - RNA, 22 nt, Bordetella pertussis
ugccggcggccuaugugcaggc

SEQ ID NO: 2406630 - RNA, 22 nt, Bordetella pertussis
ugccggcggcgccuucgaucuu

SEQ ID NO: 2406631 - RNA, 22 nt, Bordetella pertussis
ugccggcguccugcggcggcag

SEQ ID NO: 2406632 - RNA, 17 nt, Bordetella pertussis
ugccggcguggcgcgca

SEQ ID NO: 2406633 - RNA, 20 nt, Bordetella pertussis
ugccggcguuggccgggucg

SEQ ID NO: 2406634 - RNA, 15 nt, Bordetella pertussis
ugccgggacaggcac

SEQ ID NO: 2406635 - RNA, 22 nt, Bordetella pertussis
ugccgggcaagcagauggccau

SEQ ID NO: 2406636 - RNA, 13 nt, Bordetella pertussis
ugccgggccuggu

SEQ ID NO: 2406637 - RNA, 15 nt, Bordetella pertussis
ugccgggccuggugc

SEQ ID NO: 2406638 - RNA, 16 nt, Bordetella pertussis
ugccgggccuggugcc

SEQ ID NO: 2406639 - RNA, 20 nt, Bordetella pertussis
ugccgggccuggugcccgac

SEQ ID NO: 2406640 - RNA, 22 nt, Bordetella pertussis
ugccgggcucgaugaccagcag

SEQ ID NO: 2406641 - RNA, 15 nt, Bordetella pertussis
ugccgggcuugcgca

SEQ ID NO: 2406642 - RNA, 22 nt, Bordetella pertussis
ugccggggcacccaggcgggcu

SEQ ID NO: 2406643 - RNA, 23 nt, Bordetella pertussis
ugccggguugcaggaugcgcggc

SEQ ID NO: 2406644 - RNA, 19 nt, Bordetella pertussis
ugccgguaaccgacgcagc

SEQ ID NO: 2406645 - RNA, 22 nt, Bordetella pertussis
ugccgguaaccgacgcagcgca

SEQ ID NO: 2406646 - RNA, 21 nt, Bordetella pertussis
ugccggucaggaugcgcgcca

SEQ ID NO: 2406647 - RNA, 18 nt, Bordetella pertussis
ugccggucuccagcgcgu

SEQ ID NO: 2406648 - RNA, 15 nt, Bordetella pertussis
ugccggugcgcgugg

SEQ ID NO: 2406649 - RNA, 17 nt, Bordetella pertussis
ugccggugcucggccag

SEQ ID NO: 2406650 - RNA, 22 nt, Bordetella pertussis
ugccggugcucggccagcgcgc

SEQ ID NO: 2406651 - RNA, 16 nt, Bordetella pertussis
ugccgguggacggcca

SEQ ID NO: 2406652 - RNA, 17 nt, Bordetella pertussis
ugccgguggacggccag

SEQ ID NO: 2406653 - RNA, 20 nt, Bordetella pertussis
ugccgguuuuuuugcgccgc

SEQ ID NO: 2406654 - RNA, 21 nt, Bordetella pertussis
ugccgguuuuuuugcgccgcu

SEQ ID NO: 2406655 - RNA, 15 nt, Bordetella pertussis
ugccguaccaggugc

SEQ ID NO: 2406656 - RNA, 17 nt, Bordetella pertussis
ugccguaccaggugcgc

SEQ ID NO: 2406657 - RNA, 19 nt, Bordetella pertussis
ugccguacgagugcaggcc

SEQ ID NO: 2406658 - RNA, 19 nt, Bordetella pertussis
ugccguacgccaucgacgc

SEQ ID NO: 2406659 - RNA, 18 nt, Bordetella pertussis
ugccguaggcgccggccu

SEQ ID NO: 2406660 - RNA, 14 nt, Bordetella pertussis
ugccguaggugcgc

SEQ ID NO: 2406661 - RNA, 13 nt, Bordetella pertussis
ugccgucacgcgu

SEQ ID NO: 2406662 - RNA, 16 nt, Bordetella pertussis
ugccguccacgcccag

SEQ ID NO: 2406663 - RNA, 18 nt, Bordetella pertussis
ugccguccacgcccagcg

SEQ ID NO: 2406664 - RNA, 20 nt, Bordetella pertussis
ugccguccacgccgcgcgcg

SEQ ID NO: 2406665 - RNA, 21 nt, Bordetella pertussis
ugccguccagcgcggcgccau

SEQ ID NO: 2406666 - RNA, 16 nt, Bordetella pertussis
ugccguccggcaccuc

SEQ ID NO: 2406667 - RNA, 14 nt, Bordetella pertussis
ugccguccugcugc

SEQ ID NO: 2406668 - RNA, 22 nt, Bordetella pertussis
ugccguccugcugcggcacgau

SEQ ID NO: 2406669 - RNA, 14 nt, Bordetella pertussis
ugccguccuggcga

SEQ ID NO: 2406670 - RNA, 20 nt, Bordetella pertussis
ugccguccuugugccaggug

SEQ ID NO: 2406671 - RNA, 20 nt, Bordetella pertussis
ugccgucgagaaugacggug

SEQ ID NO: 2406672 - RNA, 18 nt, Bordetella pertussis
ugccgucgagcgcggcca

SEQ ID NO: 2406673 - RNA, 19 nt, Bordetella pertussis
ugccgucgagcgcggccag

SEQ ID NO: 2406674 - RNA, 20 nt, Bordetella pertussis
ugccgucgagcgcggccagg

SEQ ID NO: 2406675 - RNA, 11 nt, Bordetella pertussis
ugccgucgcca

SEQ ID NO: 2406676 - RNA, 14 nt, Bordetella pertussis
ugccgucgcgcacc

SEQ ID NO: 2406677 - RNA, 15 nt, Bordetella pertussis
ugccgucggccgcgc

SEQ ID NO: 2406678 - RNA, 16 nt, Bordetella pertussis
ugccgucggccgcgcc

SEQ ID NO: 2406679 - RNA, 15 nt, Bordetella pertussis
ugccgucggccugga

SEQ ID NO: 2406680 - RNA, 15 nt, Bordetella pertussis
ugccgucggcguugu

SEQ ID NO: 2406681 - RNA, 22 nt, Bordetella pertussis
ugccgucggcguugugccggcg

SEQ ID NO: 2406682 - RNA, 14 nt, Bordetella pertussis
ugccgucgggcgcc

SEQ ID NO: 2406683 - RNA, 14 nt, Bordetella pertussis
ugccgucuggcggc

SEQ ID NO: 2406684 - RNA, 17 nt, Bordetella pertussis
ugccgucuuggcgggcu

SEQ ID NO: 2406685 - RNA, 15 nt, Bordetella pertussis
ugccgugaggcagcc

SEQ ID NO: 2406686 - RNA, 21 nt, Bordetella pertussis
ugccguggacgugcgcgaccg

SEQ ID NO: 2406687 - RNA, 16 nt, Bordetella pertussis
ugccgugggacaggca

SEQ ID NO: 2406688 - RNA, 17 nt, Bordetella pertussis
ugccgugggacaggcac

SEQ ID NO: 2406689 - RNA, 16 nt, Bordetella pertussis
ugccguucccgccggg

SEQ ID NO: 2406690 - RNA, 17 nt, Bordetella pertussis
ugccguucggccagcgc

SEQ ID NO: 2406691 - RNA, 19 nt, Bordetella pertussis
ugccguucggccagcgcgc

SEQ ID NO: 2406692 - RNA, 23 nt, Bordetella pertussis
ugccguugcccagauccagcuug

SEQ ID NO: 2406693 - RNA, 24 nt, Bordetella pertussis
ugccguugcccagauccagcuugc

SEQ ID NO: 2406694 - RNA, 14 nt, Bordetella pertussis
ugccguugucgguc

SEQ ID NO: 2406695 - RNA, 16 nt, Bordetella pertussis
ugccguuuucgaucag

SEQ ID NO: 2406696 - RNA, 23 nt, Bordetella pertussis
ugccucagaccacgacggucugg

SEQ ID NO: 2406697 - RNA, 16 nt, Bordetella pertussis
ugccuccaggcgcaag

SEQ ID NO: 2406698 - RNA, 21 nt, Bordetella pertussis
ugccuccaggcgcaagccugg

SEQ ID NO: 2406699 - RNA, 20 nt, Bordetella pertussis
ugccucgaagcggcucaggc

SEQ ID NO: 2406700 - RNA, 16 nt, Bordetella pertussis
ugccucgcggcagugg

SEQ ID NO: 2406701 - RNA, 19 nt, Bordetella pertussis
ugccucguucaugucgcgg

SEQ ID NO: 2406702 - RNA, 20 nt, Bordetella pertussis
ugccugcaaaaaacaagcuc

SEQ ID NO: 2406703 - RNA, 14 nt, Bordetella pertussis
ugccugcagcgcgc

SEQ ID NO: 2406704 - RNA, 12 nt, Bordetella pertussis
ugccugccagcc

SEQ ID NO: 2406705 - RNA, 18 nt, Bordetella pertussis
ugccugccagcccaccag

SEQ ID NO: 2406706 - RNA, 21 nt, Bordetella pertussis
ugccugccagcccaccagcgc

SEQ ID NO: 2406707 - RNA, 13 nt, Bordetella pertussis
ugccugccgagcg

SEQ ID NO: 2406708 - RNA, 16 nt, Bordetella pertussis
ugccugccgccugcca

SEQ ID NO: 2406709 - RNA, 12 nt, Bordetella pertussis
ugccugccggcc

SEQ ID NO: 2406710 - RNA, 14 nt, Bordetella pertussis
ugccugccggccgg

SEQ ID NO: 2406711 - RNA, 18 nt, Bordetella pertussis
ugccugcgaacgcccggc

SEQ ID NO: 2406712 - RNA, 19 nt, Bordetella pertussis
ugccugcgaacgcccggcc

SEQ ID NO: 2406713 - RNA, 19 nt, Bordetella pertussis
ugccugcgaugccggcgug

SEQ ID NO: 2406714 - RNA, 21 nt, Bordetella pertussis
ugccugcgaugccggcguggc

SEQ ID NO: 2406715 - RNA, 14 nt, Bordetella pertussis
ugccugcucguugc

SEQ ID NO: 2406716 - RNA, 21 nt, Bordetella pertussis
ugccugcuugcaggaagcgca

SEQ ID NO: 2406717 - RNA, 17 nt, Bordetella pertussis
ugccuggacgcgcuggc

SEQ ID NO: 2406718 - RNA, 19 nt, Bordetella pertussis
ugccuggacgcgcuggccg

SEQ ID NO: 2406719 - RNA, 15 nt, Bordetella pertussis
ugccugggugcuggu

SEQ ID NO: 2406720 - RNA, 16 nt, Bordetella pertussis
ugccugggugcuggug

SEQ ID NO: 2406721 - RNA, 19 nt, Bordetella pertussis
ugccugggugcuggugcgc

SEQ ID NO: 2406722 - RNA, 17 nt, Bordetella pertussis
ugccugguaggcgagca

SEQ ID NO: 2406723 - RNA, 15 nt, Bordetella pertussis
ugccuggucgaagua

SEQ ID NO: 2406724 - RNA, 20 nt, Bordetella pertussis
ugccugucccaaccgggaca

SEQ ID NO: 2406725 - RNA, 12 nt, Bordetella pertussis
ugccugucccag

SEQ ID NO: 2406726 - RNA, 20 nt, Bordetella pertussis
ugccugucccagcggggaca

SEQ ID NO: 2406727 - RNA, 15 nt, Bordetella pertussis
ugccuguccccacag

SEQ ID NO: 2406728 - RNA, 19 nt, Bordetella pertussis
ugccuguccccacaugggg

SEQ ID NO: 2406729 - RNA, 20 nt, Bordetella pertussis
ugccuguccccaccgggaca

SEQ ID NO: 2406730 - RNA, 17 nt, Bordetella pertussis
ugccuguccccacgggg

SEQ ID NO: 2406731 - RNA, 22 nt, Bordetella pertussis
ugccuguccccgcacggggacu

SEQ ID NO: 2406732 - RNA, 15 nt, Bordetella pertussis
ugccuguccccgcag

SEQ ID NO: 2406733 - RNA, 20 nt, Bordetella pertussis
ugccuguccccgcggggaca

SEQ ID NO: 2406734 - RNA, 16 nt, Bordetella pertussis
ugccuguccccgcugg

SEQ ID NO: 2406735 - RNA, 20 nt, Bordetella pertussis
ugccuguccccguggggaca

SEQ ID NO: 2406736 - RNA, 20 nt, Bordetella pertussis
ugccugucccugcgggggca

SEQ ID NO: 2406737 - RNA, 17 nt, Bordetella pertussis
ugccuuacgcgguccgc

SEQ ID NO: 2406738 - RNA, 19 nt, Bordetella pertussis
ugccuuggggcggcccagc

SEQ ID NO: 2406739 - RNA, 21 nt, Bordetella pertussis
ugccuuggggcggcccagcgg

SEQ ID NO: 2406740 - RNA, 21 nt, Bordetella pertussis
ugccuuggggcggcccggcgg

SEQ ID NO: 2406741 - RNA, 22 nt, Bordetella pertussis
ugccuugguggggucgaugcca

SEQ ID NO: 2406742 - RNA, 15 nt, Bordetella pertussis
ugcgaaacagcagcg

SEQ ID NO: 2406743 - RNA, 15 nt, Bordetella pertussis
ugcgaaacccgcugg

SEQ ID NO: 2406744 - RNA, 20 nt, Bordetella pertussis
ugcgaaacccgcugggccag

SEQ ID NO: 2406745 - RNA, 14 nt, Bordetella pertussis
ugcgaaagccggcc

SEQ ID NO: 2406746 - RNA, 19 nt, Bordetella pertussis
ugcgaaagcgcgucgagca

SEQ ID NO: 2406747 - RNA, 20 nt, Bordetella pertussis
ugcgaaaucuucugcgccac

SEQ ID NO: 2406748 - RNA, 20 nt, Bordetella pertussis
ugcgaacgcccggcccaggc

SEQ ID NO: 2406749 - RNA, 12 nt, Bordetella pertussis
ugcgaacggccg

SEQ ID NO: 2406750 - RNA, 15 nt, Bordetella pertussis
ugcgacagcaccggg

SEQ ID NO: 2406751 - RNA, 13 nt, Bordetella pertussis
ugcgacagcagca

SEQ ID NO: 2406752 - RNA, 17 nt, Bordetella pertussis
ugcgacagcagggccag

SEQ ID NO: 2406753 - RNA, 19 nt, Bordetella pertussis
ugcgacagcagggccaggc

SEQ ID NO: 2406754 - RNA, 13 nt, Bordetella pertussis
ugcgacagcgaca

SEQ ID NO: 2406755 - RNA, 12 nt, Bordetella pertussis
ugcgacaggcgc

SEQ ID NO: 2406756 - RNA, 13 nt, Bordetella pertussis
ugcgacaggcgca

SEQ ID NO: 2406757 - RNA, 16 nt, Bordetella pertussis
ugcgacgauccggcga

SEQ ID NO: 2406758 - RNA, 18 nt, Bordetella pertussis
ugcgacggaugggcgccg

SEQ ID NO: 2406759 - RNA, 13 nt, Bordetella pertussis
ugcgacugcagga

SEQ ID NO: 2406760 - RNA, 21 nt, Bordetella pertussis
ugcgagacgaaggcgccggcc

SEQ ID NO: 2406761 - RNA, 16 nt, Bordetella pertussis
ugcgagacgcgcucgc

SEQ ID NO: 2406762 - RNA, 20 nt, Bordetella pertussis
ugcgagagauagcccagcac

SEQ ID NO: 2406763 - RNA, 21 nt, Bordetella pertussis
ugcgagagauagcccagcacc

SEQ ID NO: 2406764 - RNA, 16 nt, Bordetella pertussis
ugcgagcaaaggacac

SEQ ID NO: 2406765 - RNA, 12 nt, Bordetella pertussis
ugcgagcacggc

SEQ ID NO: 2406766 - RNA, 17 nt, Bordetella pertussis
ugcgagcacggcguggc

SEQ ID NO: 2406767 - RNA, 22 nt, Bordetella pertussis
ugcgagcacggcguggcgcgca

SEQ ID NO: 2406768 - RNA, 22 nt, Bordetella pertussis
ugcgagcagaugcaccggccag

SEQ ID NO: 2406769 - RNA, 23 nt, Bordetella pertussis
ugcgagcagaugcaccggccagu

SEQ ID NO: 2406770 - RNA, 21 nt, Bordetella pertussis
ugcgagccgccgcccuugcgc

SEQ ID NO: 2406771 - RNA, 17 nt, Bordetella pertussis
ugcgagccuucggccgg

SEQ ID NO: 2406772 - RNA, 18 nt, Bordetella pertussis
ugcgagccuucggccggc

SEQ ID NO: 2406773 - RNA, 19 nt, Bordetella pertussis
ugcgaggaaugcggcggga

SEQ ID NO: 2406774 - RNA, 19 nt, Bordetella pertussis
ugcgaggcgaacaggcaca

SEQ ID NO: 2406775 - RNA, 15 nt, Bordetella pertussis
ugcgaggcggccuug

SEQ ID NO: 2406776 - RNA, 16 nt, Bordetella pertussis
ugcgaggugcccgcga

SEQ ID NO: 2406777 - RNA, 23 nt, Bordetella pertussis
ugcgaggugcccgcgaagcagcc

SEQ ID NO: 2406778 - RNA, 21 nt, Bordetella pertussis
ugcgauagcgggccugcagca

SEQ ID NO: 2406779 - RNA, 15 nt, Bordetella pertussis
ugcgaucggccucgg

SEQ ID NO: 2406780 - RNA, 14 nt, Bordetella pertussis
ugcgcaacgcgcgc

SEQ ID NO: 2406781 - RNA, 15 nt, Bordetella pertussis
ugcgcaagccggccg

SEQ ID NO: 2406782 - RNA, 19 nt, Bordetella pertussis
ugcgcaaguucaucaucgc

SEQ ID NO: 2406783 - RNA, 17 nt, Bordetella pertussis
ugcgcacaucgcccgug

SEQ ID NO: 2406784 - RNA, 18 nt, Bordetella pertussis
ugcgcacaucgcccgugc

SEQ ID NO: 2406785 - RNA, 17 nt, Bordetella pertussis
ugcgcaccaccgccgau

SEQ ID NO: 2406786 - RNA, 20 nt, Bordetella pertussis
ugcgcaccaggcccaugaag

SEQ ID NO: 2406787 - RNA, 24 nt, Bordetella pertussis
ugcgcaccaggcgcucgcgcgcca

SEQ ID NO: 2406788 - RNA, 23 nt, Bordetella pertussis
ugcgcaccgacugcgcauggucg

SEQ ID NO: 2406789 - RNA, 15 nt, Bordetella pertussis
ugcgcaccggccagg

SEQ ID NO: 2406790 - RNA, 13 nt, Bordetella pertussis
ugcgcaccggccg

SEQ ID NO: 2406791 - RNA, 17 nt, Bordetella pertussis
ugcgcacgauggggccg

SEQ ID NO: 2406792 - RNA, 13 nt, Bordetella pertussis
ugcgcacgcgcgu

SEQ ID NO: 2406793 - RNA, 20 nt, Bordetella pertussis
ugcgcacgcgcgugauggag

SEQ ID NO: 2406794 - RNA, 20 nt, Bordetella pertussis
ugcgcacggacagcccgcgc

SEQ ID NO: 2406795 - RNA, 21 nt, Bordetella pertussis
ugcgcacggacagcccgcgcu

SEQ ID NO: 2406796 - RNA, 19 nt, Bordetella pertussis
ugcgcagacgacgcagcgu

SEQ ID NO: 2406797 - RNA, 21 nt, Bordetella pertussis
ugcgcagcacaugggcgcggu

SEQ ID NO: 2406798 - RNA, 12 nt, Bordetella pertussis
ugcgcagcacca

SEQ ID NO: 2406799 - RNA, 16 nt, Bordetella pertussis
ugcgcagcaccagcau

SEQ ID NO: 2406800 - RNA, 15 nt, Bordetella pertussis
ugcgcagcagcagcg

SEQ ID NO: 2406801 - RNA, 12 nt, Bordetella pertussis
ugcgcagcagcg

SEQ ID NO: 2406802 - RNA, 14 nt, Bordetella pertussis
ugcgcagcagcgcg

SEQ ID NO: 2406803 - RNA, 23 nt, Bordetella pertussis
ugcgcagcagcgcgguggccagc

SEQ ID NO: 2406804 - RNA, 16 nt, Bordetella pertussis
ugcgcagcaggcgcgu

SEQ ID NO: 2406805 - RNA, 15 nt, Bordetella pertussis
ugcgcagccgggcug

SEQ ID NO: 2406806 - RNA, 23 nt, Bordetella pertussis
ugcgcagcgacucgaacaccggc

SEQ ID NO: 2406807 - RNA, 12 nt, Bordetella pertussis
ugcgcagcgagu

SEQ ID NO: 2406808 - RNA, 11 nt, Bordetella pertussis
ugcgcagcgcg

SEQ ID NO: 2406809 - RNA, 12 nt, Bordetella pertussis
ugcgcagcgcgg

SEQ ID NO: 2406810 - RNA, 15 nt, Bordetella pertussis
ugcgcagcgcggcgu

SEQ ID NO: 2406811 - RNA, 21 nt, Bordetella pertussis
ugcgcagcgcgucggcgcggu

SEQ ID NO: 2406812 - RNA, 23 nt, Bordetella pertussis
ugcgcagcgcgucggcgcggucg

SEQ ID NO: 2406813 - RNA, 14 nt, Bordetella pertussis
ugcgcagcucgugg

SEQ ID NO: 2406814 - RNA, 19 nt, Bordetella pertussis
ugcgcagcucguggcgcgc

SEQ ID NO: 2406815 - RNA, 20 nt, Bordetella pertussis
ugcgcagcucguggcgcgcc

SEQ ID NO: 2406816 - RNA, 15 nt, Bordetella pertussis
ugcgcaggcccgaca

SEQ ID NO: 2406817 - RNA, 16 nt, Bordetella pertussis
ugcgcaggcccgacag

SEQ ID NO: 2406818 - RNA, 14 nt, Bordetella pertussis
ugcgcaggcgccgc

SEQ ID NO: 2406819 - RNA, 15 nt, Bordetella pertussis
ugcgcaggcgccgca

SEQ ID NO: 2406820 - RNA, 19 nt, Bordetella pertussis
ugcgcaggcgcgcgggggu

SEQ ID NO: 2406821 - RNA, 20 nt, Bordetella pertussis
ugcgcaggcgcguggccacg

SEQ ID NO: 2406822 - RNA, 19 nt, Bordetella pertussis
ugcgcaggcugucgaugcg

SEQ ID NO: 2406823 - RNA, 13 nt, Bordetella pertussis
ugcgcagggcggg

SEQ ID NO: 2406824 - RNA, 22 nt, Bordetella pertussis
ugcgcagggcgggcggugcggc

SEQ ID NO: 2406825 - RNA, 17 nt, Bordetella pertussis
ugcgcaggucggccagg

SEQ ID NO: 2406826 - RNA, 18 nt, Bordetella pertussis
ugcgcaggucggccagga

SEQ ID NO: 2406827 - RNA, 21 nt, Bordetella pertussis
ugcgcaucgaucagcgcgccg

SEQ ID NO: 2406828 - RNA, 14 nt, Bordetella pertussis
ugcgcaucgaugcg

SEQ ID NO: 2406829 - RNA, 19 nt, Bordetella pertussis
ugcgcaucgcgaccgccaa

SEQ ID NO: 2406830 - RNA, 17 nt, Bordetella pertussis
ugcgcaugcgccugucc

SEQ ID NO: 2406831 - RNA, 13 nt, Bordetella pertussis
ugcgcauggccag

SEQ ID NO: 2406832 - RNA, 16 nt, Bordetella pertussis
ugcgcauggccagcac

SEQ ID NO: 2406833 - RNA, 16 nt, Bordetella pertussis
ugcgcauggccagcgc

SEQ ID NO: 2406834 - RNA, 18 nt, Bordetella pertussis
ugcgcauggccagcgcgc

SEQ ID NO: 2406835 - RNA, 20 nt, Bordetella pertussis
ugcgcauggccagcgcgcag

SEQ ID NO: 2406836 - RNA, 13 nt, Bordetella pertussis
ugcgcaugggcgc

SEQ ID NO: 2406837 - RNA, 15 nt, Bordetella pertussis
ugcgcaugggcgcag

SEQ ID NO: 2406838 - RNA, 19 nt, Bordetella pertussis
ugcgcaugggcgcaggccg

SEQ ID NO: 2406839 - RNA, 20 nt, Bordetella pertussis
ugcgccaacggugccagucc

SEQ ID NO: 2406840 - RNA, 19 nt, Bordetella pertussis
ugcgccaauuguccugguc

SEQ ID NO: 2406841 - RNA, 24 nt, Bordetella pertussis
ugcgccacagcaugaccucggccu

SEQ ID NO: 2406842 - RNA, 13 nt, Bordetella pertussis
ugcgccaccagcu

SEQ ID NO: 2406843 - RNA, 22 nt, Bordetella pertussis
ugcgccaccagcuugcgcgccg

SEQ ID NO: 2406844 - RNA, 15 nt, Bordetella pertussis
ugcgccaccccgccg

SEQ ID NO: 2406845 - RNA, 22 nt, Bordetella pertussis
ugcgccacgcccacuuccucgg

SEQ ID NO: 2406846 - RNA, 13 nt, Bordetella pertussis
ugcgccacgcccg

SEQ ID NO: 2406847 - RNA, 16 nt, Bordetella pertussis
ugcgccacgcccgucc

SEQ ID NO: 2406848 - RNA, 20 nt, Bordetella pertussis
ugcgccacguccagcacggc

SEQ ID NO: 2406849 - RNA, 15 nt, Bordetella pertussis
ugcgccagcacggca

SEQ ID NO: 2406850 - RNA, 19 nt, Bordetella pertussis
ugcgccagccacgcgcgcu

SEQ ID NO: 2406851 - RNA, 22 nt, Bordetella pertussis
ugcgccagccacgcgcgcuggc

SEQ ID NO: 2406852 - RNA, 15 nt, Bordetella pertussis
ugcgccagccgcgcc

SEQ ID NO: 2406853 - RNA, 13 nt, Bordetella pertussis
ugcgccagccguu

SEQ ID NO: 2406854 - RNA, 14 nt, Bordetella pertussis
ugcgccagccguug

SEQ ID NO: 2406855 - RNA, 21 nt, Bordetella pertussis
ugcgccagccguugcgccagc

SEQ ID NO: 2406856 - RNA, 13 nt, Bordetella pertussis
ugcgccagcgcca

SEQ ID NO: 2406857 - RNA, 15 nt, Bordetella pertussis
ugcgccagcgccugg

SEQ ID NO: 2406858 - RNA, 17 nt, Bordetella pertussis
ugcgccagcgcugucca

SEQ ID NO: 2406859 - RNA, 18 nt, Bordetella pertussis
ugcgccagcgcuguccag

SEQ ID NO: 2406860 - RNA, 21 nt, Bordetella pertussis
ugcgccagcgcuguccaggcc

SEQ ID NO: 2406861 - RNA, 14 nt, Bordetella pertussis
ugcgccagcggcga

SEQ ID NO: 2406862 - RNA, 17 nt, Bordetella pertussis
ugcgccagcuugcgcgc

SEQ ID NO: 2406863 - RNA, 18 nt, Bordetella pertussis
ugcgccagcuugcgcgcc

SEQ ID NO: 2406864 - RNA, 17 nt, Bordetella pertussis
ugcgccaggcaaaggcc

SEQ ID NO: 2406865 - RNA, 20 nt, Bordetella pertussis
ugcgccaggcaaaggcccag

SEQ ID NO: 2406866 - RNA, 15 nt, Bordetella pertussis
ugcgccaggugcuug

SEQ ID NO: 2406867 - RNA, 17 nt, Bordetella pertussis
ugcgccaggugggccag

SEQ ID NO: 2406868 - RNA, 18 nt, Bordetella pertussis
ugcgccaggugggccagg

SEQ ID NO: 2406869 - RNA, 15 nt, Bordetella pertussis
ugcgccaguccagcg

SEQ ID NO: 2406870 - RNA, 19 nt, Bordetella pertussis
ugcgccaguccagcgcgcc

SEQ ID NO: 2406871 - RNA, 15 nt, Bordetella pertussis
ugcgccauggcgcgc

SEQ ID NO: 2406872 - RNA, 16 nt, Bordetella pertussis
ugcgcccauggcgcgc

SEQ ID NO: 2406873 - RNA, 17 nt, Bordetella pertussis
ugcgcccccauguccag

SEQ ID NO: 2406874 - RNA, 13 nt, Bordetella pertussis
ugcgccccgccac

SEQ ID NO: 2406875 - RNA, 19 nt, Bordetella pertussis
ugcgccccgccaugcgcag

SEQ ID NO: 2406876 - RNA, 17 nt, Bordetella pertussis
ugcgccccgccucgacg

SEQ ID NO: 2406877 - RNA, 16 nt, Bordetella pertussis
ugcgccccgcuggccg

SEQ ID NO: 2406878 - RNA, 21 nt, Bordetella pertussis
ugcgcccgcuacgcgggcuug

SEQ ID NO: 2406879 - RNA, 21 nt, Bordetella pertussis
ugcgcccgcuaugcgggcuug

SEQ ID NO: 2406880 - RNA, 15 nt, Bordetella pertussis
ugcgcccggccaccg

SEQ ID NO: 2406881 - RNA, 20 nt, Bordetella pertussis
ugcgcccugcgaacccgccg

SEQ ID NO: 2406882 - RNA, 22 nt, Bordetella pertussis
ugcgccgaggccugcugugcga

SEQ ID NO: 2406883 - RNA, 17 nt, Bordetella pertussis
ugcgccgcaccagcgcc

SEQ ID NO: 2406884 - RNA, 22 nt, Bordetella pertussis
ugcgccgcaccagcgccgacgg

SEQ ID NO: 2406885 - RNA, 14 nt, Bordetella pertussis
ugcgccgcagcacc

SEQ ID NO: 2406886 - RNA, 13 nt, Bordetella pertussis
ugcgccgcaugcg

SEQ ID NO: 2406887 - RNA, 15 nt, Bordetella pertussis
ugcgccgcaugcggc

SEQ ID NO: 2406888 - RNA, 13 nt, Bordetella pertussis
ugcgccgccccag

SEQ ID NO: 2406889 - RNA, 18 nt, Bordetella pertussis
ugcgccgcccgugccagu

SEQ ID NO: 2406890 - RNA, 20 nt, Bordetella pertussis
ugcgccgccgccgcggccug

SEQ ID NO: 2406891 - RNA, 16 nt, Bordetella pertussis
ugcgccgccgcgcgcu

SEQ ID NO: 2406892 - RNA, 23 nt, Bordetella pertussis
ugcgccgccgcgcgcuggcugug

SEQ ID NO: 2406893 - RNA, 17 nt, Bordetella pertussis
ugcgccgccggccugcu

SEQ ID NO: 2406894 - RNA, 19 nt, Bordetella pertussis
ugcgccgccggccugcugc

SEQ ID NO: 2406895 - RNA, 13 nt, Bordetella pertussis
ugcgccgcgccaa

SEQ ID NO: 2406896 - RNA, 22 nt, Bordetella pertussis
ugcgccgcgccguacagggccg

SEQ ID NO: 2406897 - RNA, 12 nt, Bordetella pertussis
ugcgccgcggcg

SEQ ID NO: 2406898 - RNA, 16 nt, Bordetella pertussis
ugcgccgcggcgcugg

SEQ ID NO: 2406899 - RNA, 12 nt, Bordetella pertussis
ugcgccgcguca

SEQ ID NO: 2406900 - RNA, 21 nt, Bordetella pertussis
ugcgccgcuacgcggcgucag

SEQ ID NO: 2406901 - RNA, 17 nt, Bordetella pertussis
ugcgccgcuuccggccg

SEQ ID NO: 2406902 - RNA, 22 nt, Bordetella pertussis
ugcgccgcuuccggccggaacu

SEQ ID NO: 2406903 - RNA, 16 nt, Bordetella pertussis
ugcgccggcauggcca

SEQ ID NO: 2406904 - RNA, 13 nt, Bordetella pertussis
ugcgccggcccgg

SEQ ID NO: 2406905 - RNA, 14 nt, Bordetella pertussis
ugcgccggccuggc

SEQ ID NO: 2406906 - RNA, 16 nt, Bordetella pertussis
ugcgccggccuggcgc

SEQ ID NO: 2406907 - RNA, 19 nt, Bordetella pertussis
ugcgccggccuggcgcgac

SEQ ID NO: 2406908 - RNA, 17 nt, Bordetella pertussis
ugcgccggcucagcccc

SEQ ID NO: 2406909 - RNA, 15 nt, Bordetella pertussis
ugcgccgggcgcggc

SEQ ID NO: 2406910 - RNA, 18 nt, Bordetella pertussis
ugcgccgggcgcggccag

SEQ ID NO: 2406911 - RNA, 21 nt, Bordetella pertussis
ugcgccgggcgcggccaggcg

SEQ ID NO: 2406912 - RNA, 14 nt, Bordetella pertussis
ugcgccggggcgcc

SEQ ID NO: 2406913 - RNA, 17 nt, Bordetella pertussis
ugcgccggguccggccg

SEQ ID NO: 2406914 - RNA, 17 nt, Bordetella pertussis
ugcgccguccucaggcc

SEQ ID NO: 2406915 - RNA, 21 nt, Bordetella pertussis
ugcgccgugacguugagcgcc

SEQ ID NO: 2406916 - RNA, 15 nt, Bordetella pertussis
ugcgccgugcccggc

SEQ ID NO: 2406917 - RNA, 14 nt, Bordetella pertussis
ugcgccugcagcgc

SEQ ID NO: 2406918 - RNA, 13 nt, Bordetella pertussis
ugcgccugcuggu

SEQ ID NO: 2406919 - RNA, 17 nt, Bordetella pertussis
ugcgccugcuggucggc

SEQ ID NO: 2406920 - RNA, 19 nt, Bordetella pertussis
ugcgccugcuggucggccu

SEQ ID NO: 2406921 - RNA, 12 nt, Bordetella pertussis
ugcgccuggccg

SEQ ID NO: 2406922 - RNA, 22 nt, Bordetella pertussis
ugcgccuggcggacgauggccu

SEQ ID NO: 2406923 - RNA, 12 nt, Bordetella pertussis
ugcgccuggcgu

SEQ ID NO: 2406924 - RNA, 16 nt, Bordetella pertussis
ugcgccuggcugaggu

SEQ ID NO: 2406925 - RNA, 15 nt, Bordetella pertussis
ugcgccuuccgggcg

SEQ ID NO: 2406926 - RNA, 15 nt, Bordetella pertussis
ugcgccuuggcgcgc

SEQ ID NO: 2406927 - RNA, 16 nt, Bordetella pertussis
ugcgccuuggcgcgca

SEQ ID NO: 2406928 - RNA, 17 nt, Bordetella pertussis
ugcgccuuggcgcgcag

SEQ ID NO: 2406929 - RNA, 21 nt, Bordetella pertussis
ugcgcgaaacccccuggguga

SEQ ID NO: 2406930 - RNA, 22 nt, Bordetella pertussis
ugcgcgaacgcgcgccggccag

SEQ ID NO: 2406931 - RNA, 16 nt, Bordetella pertussis
ugcgcgaacgcggcca

SEQ ID NO: 2406932 - RNA, 13 nt, Bordetella pertussis
ugcgcgaagcgcc

SEQ ID NO: 2406933 - RNA, 13 nt, Bordetella pertussis
ugcgcgaagcgcu

SEQ ID NO: 2406934 - RNA, 15 nt, Bordetella pertussis
ugcgcgaagcgcugg

SEQ ID NO: 2406935 - RNA, 22 nt, Bordetella pertussis
ugcgcgaagcggaaacgcgcgc

SEQ ID NO: 2406936 - RNA, 23 nt, Bordetella pertussis
ugcgcgaagcggaaacgcgcgcg

SEQ ID NO: 2406937 - RNA, 16 nt, Bordetella pertussis
ugcgcgaaggccgccc

SEQ ID NO: 2406938 - RNA, 15 nt, Bordetella pertussis
ugcgcgacagcaggc

SEQ ID NO: 2406939 - RNA, 20 nt, Bordetella pertussis
ugcgcgacagcuugaugggc

SEQ ID NO: 2406940 - RNA, 18 nt, Bordetella pertussis
ugcgcgacaggcccgcgg

SEQ ID NO: 2406941 - RNA, 17 nt, Bordetella pertussis
ugcgcgaccgcgcggcg

SEQ ID NO: 2406942 - RNA, 18 nt, Bordetella pertussis
ugcgcgaccuccggcaac

SEQ ID NO: 2406943 - RNA, 22 nt, Bordetella pertussis
ugcgcgacgaaucggucacgau

SEQ ID NO: 2406944 - RNA, 11 nt, Bordetella pertussis
ugcgcgacggc

SEQ ID NO: 2406945 - RNA, 18 nt, Bordetella pertussis
ugcgcgacuucagguagg

SEQ ID NO: 2406946 - RNA, 12 nt, Bordetella pertussis
ugcgcgagccgc

SEQ ID NO: 2406947 - RNA, 15 nt, Bordetella pertussis
ugcgcgagcgcgugg

SEQ ID NO: 2406948 - RNA, 19 nt, Bordetella pertussis
ugcgcgaggugccggacgc

SEQ ID NO: 2406949 - RNA, 22 nt, Bordetella pertussis
ugcgcgaggugccggacgccga

SEQ ID NO: 2406950 - RNA, 21 nt, Bordetella pertussis
ugcgcgaggugggcggcagca

SEQ ID NO: 2406951 - RNA, 19 nt, Bordetella pertussis
ugcgcgaugagcuggcgca

SEQ ID NO: 2406952 - RNA, 21 nt, Bordetella pertussis
ugcgcgaugagcuggcgcagg

SEQ ID NO: 2406953 - RNA, 14 nt, Bordetella pertussis
ugcgcgaugcgcgc

SEQ ID NO: 2406954 - RNA, 18 nt, Bordetella pertussis
ugcgcgaugcgcgcgugc

SEQ ID NO: 2406955 - RNA, 19 nt, Bordetella pertussis
ugcgcgaugcgcgcgugca

SEQ ID NO: 2406956 - RNA, 13 nt, Bordetella pertussis
ugcgcgcagggcg

SEQ ID NO: 2406957 - RNA, 16 nt, Bordetella pertussis
ugcgcgcagggcggcc

SEQ ID NO: 2406958 - RNA, 17 nt, Bordetella pertussis
ugcgcgcagggcggccg

SEQ ID NO: 2406959 - RNA, 18 nt, Bordetella pertussis
ugcgcgcagggcggccgg

SEQ ID NO: 2406960 - RNA, 13 nt, Bordetella pertussis
ugcgcgccacgac

SEQ ID NO: 2406961 - RNA, 13 nt, Bordetella pertussis
ugcgcgccagcuc

SEQ ID NO: 2406962 - RNA, 23 nt, Bordetella pertussis
ugcgcgccagcucgcgcagcagg

SEQ ID NO: 2406963 - RNA, 22 nt, Bordetella pertussis
ugcgcgccagcucuucgagcgc

SEQ ID NO: 2406964 - RNA, 13 nt, Bordetella pertussis
ugcgcgccaggcg

SEQ ID NO: 2406965 - RNA, 16 nt, Bordetella pertussis
ugcgcgccaggcgcgc

SEQ ID NO: 2406966 - RNA, 20 nt, Bordetella pertussis
ugcgcgccaggucgcgcacc

SEQ ID NO: 2406967 - RNA, 20 nt, Bordetella pertussis
ugcgcgccaguucaaggcgc

SEQ ID NO: 2406968 - RNA, 15 nt, Bordetella pertussis
ugcgcgccaugcaac

SEQ ID NO: 2406969 - RNA, 19 nt, Bordetella pertussis
ugcgcgcccccacgccgcu

SEQ ID NO: 2406970 - RNA, 19 nt, Bordetella pertussis
ugcgcgccccgucggccgu

SEQ ID NO: 2406971 - RNA, 15 nt, Bordetella pertussis
ugcgcgccgcucuug

SEQ ID NO: 2406972 - RNA, 17 nt, Bordetella pertussis
ugcgcgccgcucuuggc

SEQ ID NO: 2406973 - RNA, 17 nt, Bordetella pertussis
ugcgcgccggcaugguc

SEQ ID NO: 2406974 - RNA, 22 nt, Bordetella pertussis
ugcgcgccggcgccuuggccug

SEQ ID NO: 2406975 - RNA, 23 nt, Bordetella pertussis
ugcgcgccggcgccuuggccugg

SEQ ID NO: 2406976 - RNA, 23 nt, Bordetella pertussis
ugcgcgccguacagccgcggcag

SEQ ID NO: 2406977 - RNA, 21 nt, Bordetella pertussis
ugcgcgccgucggcgucgaag

SEQ ID NO: 2406978 - RNA, 14 nt, Bordetella pertussis
ugcgcgccugcugg

SEQ ID NO: 2406979 - RNA, 16 nt, Bordetella pertussis
ugcgcgccugcugguc

SEQ ID NO: 2406980 - RNA, 23 nt, Bordetella pertussis
ugcgcgccuugaaccccggcugc

SEQ ID NO: 2406981 - RNA, 19 nt, Bordetella pertussis
ugcgcgcgagcggcggccg

SEQ ID NO: 2406982 - RNA, 13 nt, Bordetella pertussis
ugcgcgcgcagcc

SEQ ID NO: 2406983 - RNA, 15 nt, Bordetella pertussis
ugcgcgcgccagcgc

SEQ ID NO: 2406984 - RNA, 12 nt, Bordetella pertussis
ugcgcgcgcccc

SEQ ID NO: 2406985 - RNA, 18 nt, Bordetella pertussis
ugcgcgcgcccccagcgc

SEQ ID NO: 2406986 - RNA, 21 nt, Bordetella pertussis
ugcgcgcgcgcuggggcuguc

SEQ ID NO: 2406987 - RNA, 17 nt, Bordetella pertussis
ugcgcgcgcgggccagc

SEQ ID NO: 2406988 - RNA, 22 nt, Bordetella pertussis
ugcgcgcgcgguugagcgccag

SEQ ID NO: 2406989 - RNA, 12 nt, Bordetella pertussis
ugcgcgcggcca

SEQ ID NO: 2406990 - RNA, 14 nt, Bordetella pertussis
ugcgcgcggccagc

SEQ ID NO: 2406991 - RNA, 12 nt, Bordetella pertussis
ugcgcgcggccg

SEQ ID NO: 2406992 - RNA, 21 nt, Bordetella pertussis
ugcgcgcggccgaggucggcg

SEQ ID NO: 2406993 - RNA, 14 nt, Bordetella pertussis
ugcgcgcgugcagc

SEQ ID NO: 2406994 - RNA, 17 nt, Bordetella pertussis
ugcgcgcgugcagcgcc

SEQ ID NO: 2406995 - RNA, 13 nt, Bordetella pertussis
ugcgcggccaccc

SEQ ID NO: 2406996 - RNA, 14 nt, Bordetella pertussis
ugcgcggccacccu

SEQ ID NO: 2406997 - RNA, 12 nt, Bordetella pertussis
ugcgcggccagc

SEQ ID NO: 2406998 - RNA, 19 nt, Bordetella pertussis
ugcgcggccagcaccggcc

SEQ ID NO: 2406999 - RNA, 15 nt, Bordetella pertussis
ugcgcggccaugccg

SEQ ID NO: 2407000 - RNA, 12 nt, Bordetella pertussis
ugcgcggccgag

SEQ ID NO: 2407001 - RNA, 20 nt, Bordetella pertussis
ugcgcggccgagcgggccag

SEQ ID NO: 2407002 - RNA, 21 nt, Bordetella pertussis
ugcgcggccgagcgggccagc

SEQ ID NO: 2407003 - RNA, 15 nt, Bordetella pertussis
ugcgcggccgcgcgc

SEQ ID NO: 2407004 - RNA, 19 nt, Bordetella pertussis
ugcgcggcgagcgccgcca

SEQ ID NO: 2407005 - RNA, 20 nt, Bordetella pertussis
ugcgcggcgagcgccgccag

SEQ ID NO: 2407006 - RNA, 20 nt, Bordetella pertussis
ugcgcggcgaucgacagccu

SEQ ID NO: 2407007 - RNA, 14 nt, Bordetella pertussis
ugcgcggcgcagcc

SEQ ID NO: 2407008 - RNA, 22 nt, Bordetella pertussis
ugcgcggcgcagcccagcgcga

SEQ ID NO: 2407009 - RNA, 13 nt, Bordetella pertussis
ugcgcggcgcgcc

SEQ ID NO: 2407010 - RNA, 21 nt, Bordetella pertussis
ugcgcggcgcucagagcccca

SEQ ID NO: 2407011 - RNA, 20 nt, Bordetella pertussis
ugcgcggcgggaccgugccg

SEQ ID NO: 2407012 - RNA, 19 nt, Bordetella pertussis
ugcgcggcgggccccgcag

SEQ ID NO: 2407013 - RNA, 18 nt, Bordetella pertussis
ugcgcggcggugccgccc

SEQ ID NO: 2407014 - RNA, 22 nt, Bordetella pertussis
ugcgcggcggugccgcccaccg

SEQ ID NO: 2407015 - RNA, 23 nt, Bordetella pertussis
ugcgcggcuugcagcggacggcg

SEQ ID NO: 2407016 - RNA, 13 nt, Bordetella pertussis
ugcgcgggcgcgg

SEQ ID NO: 2407017 - RNA, 14 nt, Bordetella pertussis
ugcgcgggcgcggc

SEQ ID NO: 2407018 - RNA, 19 nt, Bordetella pertussis
ugcgcgggcgcggcaggcg

SEQ ID NO: 2407019 - RNA, 16 nt, Bordetella pertussis
ugcgcgggcgcgggcu

SEQ ID NO: 2407020 - RNA, 14 nt, Bordetella pertussis
ugcgcggggccagg

SEQ ID NO: 2407021 - RNA, 20 nt, Bordetella pertussis
ugcgcggggccgguccgcuc

SEQ ID NO: 2407022 - RNA, 13 nt, Bordetella pertussis
ugcgcggugcggg

SEQ ID NO: 2407023 - RNA, 20 nt, Bordetella pertussis
ugcgcggugcgggugggcgc

SEQ ID NO: 2407024 - RNA, 22 nt, Bordetella pertussis
ugcgcggugcgggugggcgcgc

SEQ ID NO: 2407025 - RNA, 15 nt, Bordetella pertussis
ugcgcgguugggcgc

SEQ ID NO: 2407026 - RNA, 19 nt, Bordetella pertussis
ugcgcgguugggcgcacag

SEQ ID NO: 2407027 - RNA, 21 nt, Bordetella pertussis
ugcgcguacguggcgcggcug

SEQ ID NO: 2407028 - RNA, 23 nt, Bordetella pertussis
ugcgcguaggcgcgcgcaucggc

SEQ ID NO: 2407029 - RNA, 15 nt, Bordetella pertussis
ugcgcguaguccgag

SEQ ID NO: 2407030 - RNA, 22 nt, Bordetella pertussis
ugcgcguaguccgagcccgggc

SEQ ID NO: 2407031 - RNA, 13 nt, Bordetella pertussis
ugcgcguccuggc

SEQ ID NO: 2407032 - RNA, 15 nt, Bordetella pertussis
ugcgcguccugggcc

SEQ ID NO: 2407033 - RNA, 17 nt, Bordetella pertussis
ugcgcguccugggccga

SEQ ID NO: 2407034 - RNA, 23 nt, Bordetella pertussis
ugcgcguccugggccgagcgcgc

SEQ ID NO: 2407035 - RNA, 16 nt, Bordetella pertussis
ugcgcgucgacagcau

SEQ ID NO: 2407036 - RNA, 23 nt, Bordetella pertussis
ugcgcgucgacagcaugaacggc

SEQ ID NO: 2407037 - RNA, 16 nt, Bordetella pertussis
ugcgcgucuccagcgc

SEQ ID NO: 2407038 - RNA, 19 nt, Bordetella pertussis
ugcgcgucuccagcgccgg

SEQ ID NO: 2407039 - RNA, 21 nt, Bordetella pertussis
ugcgcgugacgauauccaggc

SEQ ID NO: 2407040 - RNA, 13 nt, Bordetella pertussis
ugcgcgugcacga

SEQ ID NO: 2407041 - RNA, 15 nt, Bordetella pertussis
ugcgcgugcgcaggu

SEQ ID NO: 2407042 - RNA, 14 nt, Bordetella pertussis
ugcgcguggcgcga

SEQ ID NO: 2407043 - RNA, 18 nt, Bordetella pertussis
ugcgcguucaugucgguc

SEQ ID NO: 2407044 - RNA, 15 nt, Bordetella pertussis
ugcgcguuccggccg

SEQ ID NO: 2407045 - RNA, 15 nt, Bordetella pertussis
ugcgcguugagcagc

SEQ ID NO: 2407046 - RNA, 16 nt, Bordetella pertussis
ugcgcguuggccugac

SEQ ID NO: 2407047 - RNA, 13 nt, Bordetella pertussis
ugcgcucgcccag

SEQ ID NO: 2407048 - RNA, 20 nt, Bordetella pertussis
ugcgcucggucauguccagc

SEQ ID NO: 2407049 - RNA, 13 nt, Bordetella pertussis
ugcgcucggucca

SEQ ID NO: 2407050 - RNA, 14 nt, Bordetella pertussis
ugcgcugcuggcca

SEQ ID NO: 2407051 - RNA, 15 nt, Bordetella pertussis
ugcgcuggccggccg

SEQ ID NO: 2407052 - RNA, 12 nt, Bordetella pertussis
ugcgcuggcgca

SEQ ID NO: 2407053 - RNA, 14 nt, Bordetella pertussis
ugcgcuggcgcaag

SEQ ID NO: 2407054 - RNA, 13 nt, Bordetella pertussis
ugcgcuggcgcgc

SEQ ID NO: 2407055 - RNA, 18 nt, Bordetella pertussis
ugcgcuggcgcgcggccg

SEQ ID NO: 2407056 - RNA, 17 nt, Bordetella pertussis
ugcgcuggcugggccug

SEQ ID NO: 2407057 - RNA, 18 nt, Bordetella pertussis
ugcgcuggcugggccugc

SEQ ID NO: 2407058 - RNA, 20 nt, Bordetella pertussis
ugcgcugggcaugggcggcc

SEQ ID NO: 2407059 - RNA, 13 nt, Bordetella pertussis
ugcgcugggccag

SEQ ID NO: 2407060 - RNA, 15 nt, Bordetella pertussis
ugcgcugggccaggc

SEQ ID NO: 2407061 - RNA, 20 nt, Bordetella pertussis
ugcgcugggccaggccggcc

SEQ ID NO: 2407062 - RNA, 12 nt, Bordetella pertussis
ugcgcugggcgg

SEQ ID NO: 2407063 - RNA, 14 nt, Bordetella pertussis
ugcgcuggucgcgc

SEQ ID NO: 2407064 - RNA, 18 nt, Bordetella pertussis
ugcgcuggucgcgcagca

SEQ ID NO: 2407065 - RNA, 14 nt, Bordetella pertussis
ugcgcuugccgacc

SEQ ID NO: 2407066 - RNA, 16 nt, Bordetella pertussis
ugcgcuuggcaggcgu

SEQ ID NO: 2407067 - RNA, 18 nt, Bordetella pertussis
ugcgcuugucgccgcugc

SEQ ID NO: 2407068 - RNA, 14 nt, Bordetella pertussis
ugcgcuuguggucg

SEQ ID NO: 2407069 - RNA, 16 nt, Bordetella pertussis
ugcgcuuguggucggc

SEQ ID NO: 2407070 - RNA, 17 nt, Bordetella pertussis
ugcgcuuuuuucuccag

SEQ ID NO: 2407071 - RNA, 20 nt, Bordetella pertussis
ugcgcuuuuuucuccagcgc

SEQ ID NO: 2407072 - RNA, 22 nt, Bordetella pertussis
ugcgcuuuuuucuccagcgcca

SEQ ID NO: 2407073 - RNA, 23 nt, Bordetella pertussis
ugcggacccaguucggccgccag

SEQ ID NO: 2407074 - RNA, 14 nt, Bordetella pertussis
ugcggacgccagcc

SEQ ID NO: 2407075 - RNA, 15 nt, Bordetella pertussis
ugcggacgggccagu

SEQ ID NO: 2407076 - RNA, 17 nt, Bordetella pertussis
ugcggaggcggccgcgg

SEQ ID NO: 2407077 - RNA, 15 nt, Bordetella pertussis
ugcggaucaagcggc

SEQ ID NO: 2407078 - RNA, 16 nt, Bordetella pertussis
ugcggaugcagcagcg

SEQ ID NO: 2407079 - RNA, 21 nt, Bordetella pertussis
ugcggcacaaccuggcgcgcg

SEQ ID NO: 2407080 - RNA, 16 nt, Bordetella pertussis
ugcggcaccucggccg

SEQ ID NO: 2407081 - RNA, 15 nt, Bordetella pertussis
ugcggcaccugcugc

SEQ ID NO: 2407082 - RNA, 17 nt, Bordetella pertussis
ugcggcaccugcugcuu

SEQ ID NO: 2407083 - RNA, 21 nt, Bordetella pertussis
ugcggcacgauuucgccgauc

SEQ ID NO: 2407084 - RNA, 15 nt, Bordetella pertussis
ugcggcacggccagc

SEQ ID NO: 2407085 - RNA, 13 nt, Bordetella pertussis
ugcggcacggcug

SEQ ID NO: 2407086 - RNA, 13 nt, Bordetella pertussis
ugcggcacgugcc

SEQ ID NO: 2407087 - RNA, 22 nt, Bordetella pertussis
ugcggcacgugccggauggcgc

SEQ ID NO: 2407088 - RNA, 15 nt, Bordetella pertussis
ugcggcagccaggug

SEQ ID NO: 2407089 - RNA, 18 nt, Bordetella pertussis
ugcggcagcgacucgccg

SEQ ID NO: 2407090 - RNA, 21 nt, Bordetella pertussis
ugcggcagcgacucgccgugc

SEQ ID NO: 2407091 - RNA, 14 nt, Bordetella pertussis
ugcggcagggccuc

SEQ ID NO: 2407092 - RNA, 15 nt, Bordetella pertussis
ugcggcagggccucc

SEQ ID NO: 2407093 - RNA, 23 nt, Bordetella pertussis
ugcggcaggugcgucacgcacag

SEQ ID NO: 2407094 - RNA, 12 nt, Bordetella pertussis
ugcggcccagcc

SEQ ID NO: 2407095 - RNA, 14 nt, Bordetella pertussis
ugcggcccagccgc

SEQ ID NO: 2407096 - RNA, 22 nt, Bordetella pertussis
ugcggcccagccgcucggccac

SEQ ID NO: 2407097 - RNA, 16 nt, Bordetella pertussis
ugcggcccgcggccuu

SEQ ID NO: 2407098 - RNA, 14 nt, Bordetella pertussis
ugcggccgccaccc

SEQ ID NO: 2407099 - RNA, 21 nt, Bordetella pertussis
ugcggccgcgcaccugcugcg

SEQ ID NO: 2407100 - RNA, 22 nt, Bordetella pertussis
ugcggccggugaucuugccgau

SEQ ID NO: 2407101 - RNA, 16 nt, Bordetella pertussis
ugcggccgugcgccag

SEQ ID NO: 2407102 - RNA, 17 nt, Bordetella pertussis
ugcggccgugcgccagc

SEQ ID NO: 2407103 - RNA, 17 nt, Bordetella pertussis
ugcggccguugcuccag

SEQ ID NO: 2407104 - RNA, 23 nt, Bordetella pertussis
ugcggccguugcuccagccaggc

SEQ ID NO: 2407105 - RNA, 18 nt, Bordetella pertussis
ugcggcgacagggcgucg

SEQ ID NO: 2407106 - RNA, 15 nt, Bordetella pertussis
ugcggcgcaugcugc

SEQ ID NO: 2407107 - RNA, 11 nt, Bordetella pertussis
ugcggcgccac

SEQ ID NO: 2407108 - RNA, 16 nt, Bordetella pertussis
ugcggcgccacgcaga

SEQ ID NO: 2407109 - RNA, 14 nt, Bordetella pertussis
ugcggcgccacugc

SEQ ID NO: 2407110 - RNA, 19 nt, Bordetella pertussis
ugcggcgccacugccaggc

SEQ ID NO: 2407111 - RNA, 17 nt, Bordetella pertussis
ugcggcgccagcgccgc

SEQ ID NO: 2407112 - RNA, 20 nt, Bordetella pertussis
ugcggcgccggugcgcggcg

SEQ ID NO: 2407113 - RNA, 14 nt, Bordetella pertussis
ugcggcgccugggc

SEQ ID NO: 2407114 - RNA, 22 nt, Bordetella pertussis
ugcggcgcgaccugcgcgaccg

SEQ ID NO: 2407115 - RNA, 12 nt, Bordetella pertussis
ugcggcgcgccg

SEQ ID NO: 2407116 - RNA, 13 nt, Bordetella pertussis
ugcggcgcgccgc

SEQ ID NO: 2407117 - RNA, 15 nt, Bordetella pertussis
ugcggcgcggccagc

SEQ ID NO: 2407118 - RNA, 15 nt, Bordetella pertussis
ugcggcgcggcgcgu

SEQ ID NO: 2407119 - RNA, 20 nt, Bordetella pertussis
ugcggcgcggcgcgugccag

SEQ ID NO: 2407120 - RNA, 13 nt, Bordetella pertussis
ugcggcgcuggcu

SEQ ID NO: 2407121 - RNA, 23 nt, Bordetella pertussis
ugcggcgcuggcuggacgcgcgc

SEQ ID NO: 2407122 - RNA, 15 nt, Bordetella pertussis
ugcggcggcagcuug

SEQ ID NO: 2407123 - RNA, 14 nt, Bordetella pertussis
ugcggcggcgacuc

SEQ ID NO: 2407124 - RNA, 15 nt, Bordetella pertussis
ugcggcggcgggcgg

SEQ ID NO: 2407125 - RNA, 17 nt, Bordetella pertussis
ugcggcggcgggcggcc

SEQ ID NO: 2407126 - RNA, 18 nt, Bordetella pertussis
ugcggcggcgggcggccg

SEQ ID NO: 2407127 - RNA, 24 nt, Bordetella pertussis
ugcggcggcugugggccucgcugg

SEQ ID NO: 2407128 - RNA, 23 nt, Bordetella pertussis
ugcggcgggacuguaccgcgcga

SEQ ID NO: 2407129 - RNA, 13 nt, Bordetella pertussis
ugcggcgggcggg

SEQ ID NO: 2407130 - RNA, 14 nt, Bordetella pertussis
ugcggcuccugcug

SEQ ID NO: 2407131 - RNA, 20 nt, Bordetella pertussis
ugcggcuccugcuggcgcgu

SEQ ID NO: 2407132 - RNA, 12 nt, Bordetella pertussis
ugcggcugauca

SEQ ID NO: 2407133 - RNA, 20 nt, Bordetella pertussis
ugcggcugggugcggucagu

SEQ ID NO: 2407134 - RNA, 13 nt, Bordetella pertussis
ugcgggacaggca

SEQ ID NO: 2407135 - RNA, 15 nt, Bordetella pertussis
ugcgggacaggcgcc

SEQ ID NO: 2407136 - RNA, 17 nt, Bordetella pertussis
ugcgggacaggcgccac

SEQ ID NO: 2407137 - RNA, 13 nt, Bordetella pertussis
ugcgggacggcca

SEQ ID NO: 2407138 - RNA, 14 nt, Bordetella pertussis
ugcgggacggccag

SEQ ID NO: 2407139 - RNA, 15 nt, Bordetella pertussis
ugcgggacggccagg

SEQ ID NO: 2407140 - RNA, 20 nt, Bordetella pertussis
ugcgggacggccaggggcag

SEQ ID NO: 2407141 - RNA, 17 nt, Bordetella pertussis
ugcgggaggugccgcag

SEQ ID NO: 2407142 - RNA, 18 nt, Bordetella pertussis
ugcgggcaaacggcggca

SEQ ID NO: 2407143 - RNA, 22 nt, Bordetella pertussis
ugcgggcaucgcccugcucgau

SEQ ID NO: 2407144 - RNA, 16 nt, Bordetella pertussis
ugcgggccacgccggc

SEQ ID NO: 2407145 - RNA, 18 nt, Bordetella pertussis
ugcgggccacgccggccg

SEQ ID NO: 2407146 - RNA, 18 nt, Bordetella pertussis
ugcgggccggcgcgccug

SEQ ID NO: 2407147 - RNA, 22 nt, Bordetella pertussis
ugcgggccggcugggcggccuu

SEQ ID NO: 2407148 - RNA, 14 nt, Bordetella pertussis
ugcgggccgggcag

SEQ ID NO: 2407149 - RNA, 18 nt, Bordetella pertussis
ugcgggccgggcaggccg

SEQ ID NO: 2407150 - RNA, 22 nt, Bordetella pertussis
ugcgggccgggcaggccgcgcu

SEQ ID NO: 2407151 - RNA, 23 nt, Bordetella pertussis
ugcgggccuacuucggcagcuug

SEQ ID NO: 2407152 - RNA, 22 nt, Bordetella pertussis
ugcgggccugcaguucggccgc

SEQ ID NO: 2407153 - RNA, 14 nt, Bordetella pertussis
ugcgggccuggauc

SEQ ID NO: 2407154 - RNA, 12 nt, Bordetella pertussis
ugcgggcgccgc

SEQ ID NO: 2407155 - RNA, 12 nt, Bordetella pertussis
ugcgggcgcgcu

SEQ ID NO: 2407156 - RNA, 13 nt, Bordetella pertussis
ugcgggcggccug

SEQ ID NO: 2407157 - RNA, 14 nt, Bordetella pertussis
ugcgggcggccugg

SEQ ID NO: 2407158 - RNA, 13 nt, Bordetella pertussis
ugcggggacaggc

SEQ ID NO: 2407159 - RNA, 14 nt, Bordetella pertussis
ugcggggacaggca

SEQ ID NO: 2407160 - RNA, 18 nt, Bordetella pertussis
ugcggggacaggcacccg

SEQ ID NO: 2407161 - RNA, 16 nt, Bordetella pertussis
ugcggggacaggcacu

SEQ ID NO: 2407162 - RNA, 21 nt, Bordetella pertussis
ugcggggacuggcuccgaagg

SEQ ID NO: 2407163 - RNA, 12 nt, Bordetella pertussis
ugcggggcaccu

SEQ ID NO: 2407164 - RNA, 14 nt, Bordetella pertussis
ugcggggcgcccag

SEQ ID NO: 2407165 - RNA, 20 nt, Bordetella pertussis
ugcggggcggcaggucgcgc

SEQ ID NO: 2407166 - RNA, 14 nt, Bordetella pertussis
ugcggggcggcgua

SEQ ID NO: 2407167 - RNA, 16 nt, Bordetella pertussis
ugcgggucaaggcggg

SEQ ID NO: 2407168 - RNA, 15 nt, Bordetella pertussis
ugcgggucaggccgc

SEQ ID NO: 2407169 - RNA, 22 nt, Bordetella pertussis
ugcgggucgaguugcgcgccau

SEQ ID NO: 2407170 - RNA, 16 nt, Bordetella pertussis
ugcgggucggcgccau

SEQ ID NO: 2407171 - RNA, 18 nt, Bordetella pertussis
ugcgggugccuguccccg

SEQ ID NO: 2407172 - RNA, 21 nt, Bordetella pertussis
ugcgggugggcauccagcggc

SEQ ID NO: 2407173 - RNA, 17 nt, Bordetella pertussis
ugcgggugggcgcgccg

SEQ ID NO: 2407174 - RNA, 20 nt, Bordetella pertussis
ugcgggugggcgcgccgcga

SEQ ID NO: 2407175 - RNA, 18 nt, Bordetella pertussis
ugcggguguugucaugcg

SEQ ID NO: 2407176 - RNA, 13 nt, Bordetella pertussis
ugcgguaguucag

SEQ ID NO: 2407177 - RNA, 20 nt, Bordetella pertussis
ugcgguaguucagcagcgcc

SEQ ID NO: 2407178 - RNA, 13 nt, Bordetella pertussis
ugcgguccaggaa

SEQ ID NO: 2407179 - RNA, 18 nt, Bordetella pertussis
ugcgguccaggaagcgca

SEQ ID NO: 2407180 - RNA, 19 nt, Bordetella pertussis
ugcgguccaugucggccga

SEQ ID NO: 2407181 - RNA, 15 nt, Bordetella pertussis
ugcggucggccacau

SEQ ID NO: 2407182 - RNA, 20 nt, Bordetella pertussis
ugcggucggccgcgccgccg

SEQ ID NO: 2407183 - RNA, 19 nt, Bordetella pertussis
ugcggucuaccgaagccga

SEQ ID NO: 2407184 - RNA, 13 nt, Bordetella pertussis
ugcggugccuguc

SEQ ID NO: 2407185 - RNA, 14 nt, Bordetella pertussis
ugcggugccugucc

SEQ ID NO: 2407186 - RNA, 17 nt, Bordetella pertussis
ugcggugccugucccca

SEQ ID NO: 2407187 - RNA, 14 nt, Bordetella pertussis
ugcgguggugcgcc

SEQ ID NO: 2407188 - RNA, 19 nt, Bordetella pertussis
ugcggugucccucggagcc

SEQ ID NO: 2407189 - RNA, 18 nt, Bordetella pertussis
ugcgguucgucagggccg

SEQ ID NO: 2407190 - RNA, 20 nt, Bordetella pertussis
ugcgguucgucagggccgca

SEQ ID NO: 2407191 - RNA, 18 nt, Bordetella pertussis
ugcgguucugggcccgau

SEQ ID NO: 2407192 - RNA, 19 nt, Bordetella pertussis
ugcgguugaucagggccgc

SEQ ID NO: 2407193 - RNA, 20 nt, Bordetella pertussis
ugcgguugcgaggcggccuu

SEQ ID NO: 2407194 - RNA, 14 nt, Bordetella pertussis
ugcguaccagccca

SEQ ID NO: 2407195 - RNA, 21 nt, Bordetella pertussis
ugcguaggcaggggcuccagg

SEQ ID NO: 2407196 - RNA, 17 nt, Bordetella pertussis
ugcgucacgaaagcgcc

SEQ ID NO: 2407197 - RNA, 20 nt, Bordetella pertussis
ugcgucacgaaagcgcccag

SEQ ID NO: 2407198 - RNA, 18 nt, Bordetella pertussis
ugcgucacgcacagcacc

SEQ ID NO: 2407199 - RNA, 20 nt, Bordetella pertussis
ugcgucaggggcaugccggc

SEQ ID NO: 2407200 - RNA, 20 nt, Bordetella pertussis
ugcguccagccgagccuggc

SEQ ID NO: 2407201 - RNA, 17 nt, Bordetella pertussis
ugcguccgccgugcagg

SEQ ID NO: 2407202 - RNA, 23 nt, Bordetella pertussis
ugcguccgccgugcaggcccggg

SEQ ID NO: 2407203 - RNA, 12 nt, Bordetella pertussis
ugcguccggcgc

SEQ ID NO: 2407204 - RNA, 20 nt, Bordetella pertussis
ugcguccgucggguugccgc

SEQ ID NO: 2407205 - RNA, 16 nt, Bordetella pertussis
ugcgucgaacggccgg

SEQ ID NO: 2407206 - RNA, 20 nt, Bordetella pertussis
ugcgucgccuggucgacgcc

SEQ ID NO: 2407207 - RNA, 23 nt, Bordetella pertussis
ugcgucgccuggucgacgccggc

SEQ ID NO: 2407208 - RNA, 14 nt, Bordetella pertussis
ugcgucucggccug

SEQ ID NO: 2407209 - RNA, 15 nt, Bordetella pertussis
ugcgucucggccugu

SEQ ID NO: 2407210 - RNA, 14 nt, Bordetella pertussis
ugcgucugcacgcu

SEQ ID NO: 2407211 - RNA, 15 nt, Bordetella pertussis
ugcgucugcgugccg

SEQ ID NO: 2407212 - RNA, 17 nt, Bordetella pertussis
ugcgugaagcccauggc

SEQ ID NO: 2407213 - RNA, 16 nt, Bordetella pertussis
ugcgugacacggccau

SEQ ID NO: 2407214 - RNA, 21 nt, Bordetella pertussis
ugcgugaccacgaucaugguc

SEQ ID NO: 2407215 - RNA, 17 nt, Bordetella pertussis
ugcgugacccggggcag

SEQ ID NO: 2407216 - RNA, 18 nt, Bordetella pertussis
ugcgugccgacgaugccg

SEQ ID NO: 2407217 - RNA, 19 nt, Bordetella pertussis
ugcgugccgacgaugccgc

SEQ ID NO: 2407218 - RNA, 14 nt, Bordetella pertussis
ugcgugccgcccag

SEQ ID NO: 2407219 - RNA, 16 nt, Bordetella pertussis
ugcgugcgccuguccc

SEQ ID NO: 2407220 - RNA, 18 nt, Bordetella pertussis
ugcgugcgccuguccccg

SEQ ID NO: 2407221 - RNA, 15 nt, Bordetella pertussis
ugcguggccgccggg

SEQ ID NO: 2407222 - RNA, 14 nt, Bordetella pertussis
ugcguggcggcguc

SEQ ID NO: 2407223 - RNA, 15 nt, Bordetella pertussis
ugcguggcgggccgc

SEQ ID NO: 2407224 - RNA, 18 nt, Bordetella pertussis
ugcguggcgggccgcgcc

SEQ ID NO: 2407225 - RNA, 18 nt, Bordetella pertussis
ugcgugugccuguccccg

SEQ ID NO: 2407226 - RNA, 17 nt, Bordetella pertussis
ugcguguuccagcgccu

SEQ ID NO: 2407227 - RNA, 20 nt, Bordetella pertussis
ugcguuccaugacguccagc

SEQ ID NO: 2407228 - RNA, 21 nt, Bordetella pertussis
ugcguuccaugacguccagcg

SEQ ID NO: 2407229 - RNA, 19 nt, Bordetella pertussis
ugcguucgaaagccagcgc

SEQ ID NO: 2407230 - RNA, 14 nt, Bordetella pertussis
ugcguucggccagc

SEQ ID NO: 2407231 - RNA, 15 nt, Bordetella pertussis
ugcguucggccagcc

SEQ ID NO: 2407232 - RNA, 22 nt, Bordetella pertussis
ugcuaguacaccgucgcgcgca

SEQ ID NO: 2407233 - RNA, 19 nt, Bordetella pertussis
ugcucaaccucgacgcgca

SEQ ID NO: 2407234 - RNA, 14 nt, Bordetella pertussis
ugcucaucggcagg

SEQ ID NO: 2407235 - RNA, 16 nt, Bordetella pertussis
ugcucaucggcaggcc

SEQ ID NO: 2407236 - RNA, 20 nt, Bordetella pertussis
ugcucaucggcaggccggcg

SEQ ID NO: 2407237 - RNA, 21 nt, Bordetella pertussis
ugcucaucggcaggccggcgc

SEQ ID NO: 2407238 - RNA, 12 nt, Bordetella pertussis
ugcuccaccacc

SEQ ID NO: 2407239 - RNA, 18 nt, Bordetella pertussis
ugcuccaccaccaucugc

SEQ ID NO: 2407240 - RNA, 17 nt, Bordetella pertussis
ugcuccagaacgcgccg

SEQ ID NO: 2407241 - RNA, 20 nt, Bordetella pertussis
ugcuccagccaggcgcgcag

SEQ ID NO: 2407242 - RNA, 12 nt, Bordetella pertussis
ugcuccaggccg

SEQ ID NO: 2407243 - RNA, 20 nt, Bordetella pertussis
ugcucccaguucugcagcgu

SEQ ID NO: 2407244 - RNA, 18 nt, Bordetella pertussis
ugcuccgguacgccugca

SEQ ID NO: 2407245 - RNA, 21 nt, Bordetella pertussis
ugcuccgguacgccugcaccg

SEQ ID NO: 2407246 - RNA, 17 nt, Bordetella pertussis
ugcuccugccaggcgcc

SEQ ID NO: 2407247 - RNA, 16 nt, Bordetella pertussis
ugcucgaaaugcgcgu

SEQ ID NO: 2407248 - RNA, 23 nt, Bordetella pertussis
ugcucgaaaugcgcguuggccug

SEQ ID NO: 2407249 - RNA, 18 nt, Bordetella pertussis
ugcucgagcaugcgggcc

SEQ ID NO: 2407250 - RNA, 18 nt, Bordetella pertussis
ugcucgauaugcagcacc

SEQ ID NO: 2407251 - RNA, 19 nt, Bordetella pertussis
ugcucgauaugcagcaccg

SEQ ID NO: 2407252 - RNA, 21 nt, Bordetella pertussis
ugcucgaucuucucgacggcg

SEQ ID NO: 2407253 - RNA, 15 nt, Bordetella pertussis
ugcucgaugccggcc

SEQ ID NO: 2407254 - RNA, 12 nt, Bordetella pertussis
ugcucgcaggcc

SEQ ID NO: 2407255 - RNA, 13 nt, Bordetella pertussis
ugcucgcaggccu

SEQ ID NO: 2407256 - RNA, 17 nt, Bordetella pertussis
ugcucgcaggccugcug

SEQ ID NO: 2407257 - RNA, 20 nt, Bordetella pertussis
ugcucgcccauggcaucgag

SEQ ID NO: 2407258 - RNA, 13 nt, Bordetella pertussis
ugcucgccgcgcg

SEQ ID NO: 2407259 - RNA, 14 nt, Bordetella pertussis
ugcucgccgcgcga

SEQ ID NO: 2407260 - RNA, 17 nt, Bordetella pertussis
ugcucgccggccagcgc

SEQ ID NO: 2407261 - RNA, 12 nt, Bordetella pertussis
ugcucgcgcgca

SEQ ID NO: 2407262 - RNA, 17 nt, Bordetella pertussis
ugcucgcgcgcaguccu

SEQ ID NO: 2407263 - RNA, 19 nt, Bordetella pertussis
ugcucgcggauuugcuuca

SEQ ID NO: 2407264 - RNA, 14 nt, Bordetella pertussis
ugcucggccagcgc

SEQ ID NO: 2407265 - RNA, 16 nt, Bordetella pertussis
ugcucggccagcgcgc

SEQ ID NO: 2407266 - RNA, 20 nt, Bordetella pertussis
ugcucggccagcgcgcgcca

SEQ ID NO: 2407267 - RNA, 21 nt, Bordetella pertussis
ugcucggcggucagcgcggcg

SEQ ID NO: 2407268 - RNA, 17 nt, Bordetella pertussis
ugcucgggacgcaggcc

SEQ ID NO: 2407269 - RNA, 19 nt, Bordetella pertussis
ugcucgggacgcaggccca

SEQ ID NO: 2407270 - RNA, 13 nt, Bordetella pertussis
ugcucggugagcg

SEQ ID NO: 2407271 - RNA, 18 nt, Bordetella pertussis
ugcucggugcucuggccc

SEQ ID NO: 2407272 - RNA, 19 nt, Bordetella pertussis
ugcucgucgccaugcggcu

SEQ ID NO: 2407273 - RNA, 21 nt, Bordetella pertussis
ugcucgucgccaugcggcugg

SEQ ID NO: 2407274 - RNA, 13 nt, Bordetella pertussis
ugcucuccaugcu

SEQ ID NO: 2407275 - RNA, 12 nt, Bordetella pertussis
ugcucugcccgu

SEQ ID NO: 2407276 - RNA, 17 nt, Bordetella pertussis
ugcucuggcacaccagc

SEQ ID NO: 2407277 - RNA, 22 nt, Bordetella pertussis
ugcucuggcacaccagcgccag

SEQ ID NO: 2407278 - RNA, 12 nt, Bordetella pertussis
ugcucuggcccg

SEQ ID NO: 2407279 - RNA, 13 nt, Bordetella pertussis
ugcucuuggcaac

SEQ ID NO: 2407280 - RNA, 14 nt, Bordetella pertussis
ugcugaaccugcug

SEQ ID NO: 2407281 - RNA, 15 nt, Bordetella pertussis
ugcugaaccugcugg

SEQ ID NO: 2407282 - RNA, 22 nt, Bordetella pertussis
ugcugaacgcgcgugaacggcu

SEQ ID NO: 2407283 - RNA, 18 nt, Bordetella pertussis
ugcugaauugcgggccgg

SEQ ID NO: 2407284 - RNA, 15 nt, Bordetella pertussis
ugcugacaggcgucu

SEQ ID NO: 2407285 - RNA, 17 nt, Bordetella pertussis
ugcugaccaccgggaug

SEQ ID NO: 2407286 - RNA, 17 nt, Bordetella pertussis
ugcugaccgacggccug

SEQ ID NO: 2407287 - RNA, 17 nt, Bordetella pertussis
ugcugacggacuggugc

SEQ ID NO: 2407288 - RNA, 19 nt, Bordetella pertussis
ugcugacgguaagcaccag

SEQ ID NO: 2407289 - RNA, 20 nt, Bordetella pertussis
ugcugacggugccggccagc

SEQ ID NO: 2407290 - RNA, 15 nt, Bordetella pertussis
ugcugacugugcagc

SEQ ID NO: 2407291 - RNA, 14 nt, Bordetella pertussis
ugcugagacggcgg

SEQ ID NO: 2407292 - RNA, 15 nt, Bordetella pertussis
ugcugauccaguugc

SEQ ID NO: 2407293 - RNA, 15 nt, Bordetella pertussis
ugcugauccuggcau

SEQ ID NO: 2407294 - RNA, 18 nt, Bordetella pertussis
ugcugauccuggcauuga

SEQ ID NO: 2407295 - RNA, 18 nt, Bordetella pertussis
ugcugaucgacaugcugg

SEQ ID NO: 2407296 - RNA, 20 nt, Bordetella pertussis
ugcugaucgacaugcuggcc

SEQ ID NO: 2407297 - RNA, 21 nt, Bordetella pertussis
ugcugaucgacaugcuggccc

SEQ ID NO: 2407298 - RNA, 13 nt, Bordetella pertussis
ugcugaucgaucg

SEQ ID NO: 2407299 - RNA, 15 nt, Bordetella pertussis
ugcugcaauucgccg

SEQ ID NO: 2407300 - RNA, 23 nt, Bordetella pertussis
ugcugcacgcgcgcgggcgcgcc

SEQ ID NO: 2407301 - RNA, 17 nt, Bordetella pertussis
ugcugcacgugaugcag

SEQ ID NO: 2407302 - RNA, 11 nt, Bordetella pertussis
ugcugcagcgc

SEQ ID NO: 2407303 - RNA, 15 nt, Bordetella pertussis
ugcugcagcgcacca

SEQ ID NO: 2407304 - RNA, 20 nt, Bordetella pertussis
ugcugcagcgcaucgccgca

SEQ ID NO: 2407305 - RNA, 15 nt, Bordetella pertussis
ugcugcaggcgcggg

SEQ ID NO: 2407306 - RNA, 15 nt, Bordetella pertussis
ugcugcagggcugcg

SEQ ID NO: 2407307 - RNA, 13 nt, Bordetella pertussis
ugcugcauguccu

SEQ ID NO: 2407308 - RNA, 16 nt, Bordetella pertussis
ugcugccaugccgcgc

SEQ ID NO: 2407309 - RNA, 14 nt, Bordetella pertussis
ugcugccccccgag

SEQ ID NO: 2407310 - RNA, 17 nt, Bordetella pertussis
ugcugccccccgagggg

SEQ ID NO: 2407311 - RNA, 13 nt, Bordetella pertussis
ugcugcccgacgg

SEQ ID NO: 2407312 - RNA, 22 nt, Bordetella pertussis
ugcugcccgacggcgccgaucc

SEQ ID NO: 2407313 - RNA, 15 nt, Bordetella pertussis
ugcugcccgccgccg

SEQ ID NO: 2407314 - RNA, 16 nt, Bordetella pertussis
ugcugccggauuggcg

SEQ ID NO: 2407315 - RNA, 20 nt, Bordetella pertussis
ugcugccggauuggcgcugc

SEQ ID NO: 2407316 - RNA, 16 nt, Bordetella pertussis
ugcugccgucggcguu

SEQ ID NO: 2407317 - RNA, 22 nt, Bordetella pertussis
ugcugcgacagcagggccaggc

SEQ ID NO: 2407318 - RNA, 23 nt, Bordetella pertussis
ugcugcgcaagggagaccggguu

SEQ ID NO: 2407319 - RNA, 15 nt, Bordetella pertussis
ugcugcgccuggccg

SEQ ID NO: 2407320 - RNA, 16 nt, Bordetella pertussis
ugcugcgccuggccgc

SEQ ID NO: 2407321 - RNA, 17 nt, Bordetella pertussis
ugcugcgcguggccauc

SEQ ID NO: 2407322 - RNA, 21 nt, Bordetella pertussis
ugcugcggcacggccagcggc

SEQ ID NO: 2407323 - RNA, 22 nt, Bordetella pertussis
ugcugcggcacggccagcggcg

SEQ ID NO: 2407324 - RNA, 15 nt, Bordetella pertussis
ugcugcggcagccag

SEQ ID NO: 2407325 - RNA, 23 nt, Bordetella pertussis
ugcugcgggucgaguugcgcgcc

SEQ ID NO: 2407326 - RNA, 22 nt, Bordetella pertussis
ugcugcguaucugaucggacug

SEQ ID NO: 2407327 - RNA, 17 nt, Bordetella pertussis
ugcugcucaacggccac

SEQ ID NO: 2407328 - RNA, 22 nt, Bordetella pertussis
ugcugcuggagaucgccgagcg

SEQ ID NO: 2407329 - RNA, 24 nt, Bordetella pertussis
ugcugcuggagaucgccgagcggc

SEQ ID NO: 2407330 - RNA, 20 nt, Bordetella pertussis
ugcugcuguucgccacgcug

SEQ ID NO: 2407331 - RNA, 22 nt, Bordetella pertussis
ugcugcuugaccuuggcuugca

SEQ ID NO: 2407332 - RNA, 14 nt, Bordetella pertussis
ugcuggaacaccau

SEQ ID NO: 2407333 - RNA, 20 nt, Bordetella pertussis
ugcuggacccgcugcgaccc

SEQ ID NO: 2407334 - RNA, 13 nt, Bordetella pertussis
ugcuggaccgcgc

SEQ ID NO: 2407335 - RNA, 18 nt, Bordetella pertussis
ugcuggaccgcgccuggg

SEQ ID NO: 2407336 - RNA, 19 nt, Bordetella pertussis
ugcuggaccgcgccugggg

SEQ ID NO: 2407337 - RNA, 20 nt, Bordetella pertussis
ugcuggagaucgccgagcgg

SEQ ID NO: 2407338 - RNA, 21 nt, Bordetella pertussis
ugcuggagcgccacgccguca

SEQ ID NO: 2407339 - RNA, 10 nt, Bordetella pertussis
ugcuggaggu

SEQ ID NO: 2407340 - RNA, 21 nt, Bordetella pertussis
ugcuggccaacgccacgccca

SEQ ID NO: 2407341 - RNA, 18 nt, Bordetella pertussis
ugcuggccaagcgcgccg

SEQ ID NO: 2407342 - RNA, 19 nt, Bordetella pertussis
ugcuggcccagcugggcgg

SEQ ID NO: 2407343 - RNA, 21 nt, Bordetella pertussis
ugcuggcccagcugggcggcg

SEQ ID NO: 2407344 - RNA, 13 nt, Bordetella pertussis
ugcuggcccagga

SEQ ID NO: 2407345 - RNA, 13 nt, Bordetella pertussis
ugcuggccgacgc

SEQ ID NO: 2407346 - RNA, 14 nt, Bordetella pertussis
ugcuggccgccggc

SEQ ID NO: 2407347 - RNA, 14 nt, Bordetella pertussis
ugcuggccggccag

SEQ ID NO: 2407348 - RNA, 15 nt, Bordetella pertussis
ugcuggccggccagc

SEQ ID NO: 2407349 - RNA, 15 nt, Bordetella pertussis
ugcuggcgcagcagc

SEQ ID NO: 2407350 - RNA, 23 nt, Bordetella pertussis
ugcuggcgcagcagcgccggcag

SEQ ID NO: 2407351 - RNA, 21 nt, Bordetella pertussis
ugcuggcgcaguaucccggcc

SEQ ID NO: 2407352 - RNA, 11 nt, Bordetella pertussis
ugcuggcgcgc

SEQ ID NO: 2407353 - RNA, 21 nt, Bordetella pertussis
ugcuggcgcgcaccaucgccg

SEQ ID NO: 2407354 - RNA, 13 nt, Bordetella pertussis
ugcuggcgcgcca

SEQ ID NO: 2407355 - RNA, 14 nt, Bordetella pertussis
ugcuggcgcgccag

SEQ ID NO: 2407356 - RNA, 11 nt, Bordetella pertussis
ugcuggcgcgu

SEQ ID NO: 2407357 - RNA, 21 nt, Bordetella pertussis
ugcuggcgcgucggcgcgcgc

SEQ ID NO: 2407358 - RNA, 19 nt, Bordetella pertussis
ugcuggcguuugcgcgcgc

SEQ ID NO: 2407359 - RNA, 13 nt, Bordetella pertussis
ugcuggcugcccu

SEQ ID NO: 2407360 - RNA, 19 nt, Bordetella pertussis
ugcugggcaugauggugcu

SEQ ID NO: 2407361 - RNA, 14 nt, Bordetella pertussis
ugcugggccgcgcu

SEQ ID NO: 2407362 - RNA, 12 nt, Bordetella pertussis
ugcugggccggg

SEQ ID NO: 2407363 - RNA, 15 nt, Bordetella pertussis
ugcugggcggccagg

SEQ ID NO: 2407364 - RNA, 23 nt, Bordetella pertussis
ugcugggcgggcugguggugggc

SEQ ID NO: 2407365 - RNA, 14 nt, Bordetella pertussis
ugcuggggguuggc

SEQ ID NO: 2407366 - RNA, 20 nt, Bordetella pertussis
ugcugggguggagcgcggcg

SEQ ID NO: 2407367 - RNA, 24 nt, Bordetella pertussis
ugcugggguggagcgcggcgcugg

SEQ ID NO: 2407368 - RNA, 15 nt, Bordetella pertussis
ugcugguacagcccc

SEQ ID NO: 2407369 - RNA, 17 nt, Bordetella pertussis
ugcugguacagccccag

SEQ ID NO: 2407370 - RNA, 21 nt, Bordetella pertussis
ugcugguacagccccagcgcc

SEQ ID NO: 2407371 - RNA, 23 nt, Bordetella pertussis
ugcugguacagccccagcgccag

SEQ ID NO: 2407372 - RNA, 24 nt, Bordetella pertussis
ugcuggucaucuacagcgccuggc

SEQ ID NO: 2407373 - RNA, 22 nt, Bordetella pertussis
ugcuggucgccaucugcugcga

SEQ ID NO: 2407374 - RNA, 12 nt, Bordetella pertussis
ugcuggucgcgg

SEQ ID NO: 2407375 - RNA, 19 nt, Bordetella pertussis
ugcuggucgcgggccaggc

SEQ ID NO: 2407376 - RNA, 20 nt, Bordetella pertussis
ugcuggucgcgggccaggcc

SEQ ID NO: 2407377 - RNA, 13 nt, Bordetella pertussis
ugcuggucggccu

SEQ ID NO: 2407378 - RNA, 13 nt, Bordetella pertussis
ugcuggucggcgu

SEQ ID NO: 2407379 - RNA, 16 nt, Bordetella pertussis
ugcuggugccgcuggc

SEQ ID NO: 2407380 - RNA, 23 nt, Bordetella pertussis
ugcuggugccgcuggcggcccug

SEQ ID NO: 2407381 - RNA, 16 nt, Bordetella pertussis
ugcuggugcuggugcc

SEQ ID NO: 2407382 - RNA, 17 nt, Bordetella pertussis
ugcuguaccucagccug

SEQ ID NO: 2407383 - RNA, 21 nt, Bordetella pertussis
ugcugugccccacacgcgcgc

SEQ ID NO: 2407384 - RNA, 20 nt, Bordetella pertussis
ugcuguuggcguggcuggcg

SEQ ID NO: 2407385 - RNA, 16 nt, Bordetella pertussis
ugcuuauaggcuuuca

SEQ ID NO: 2407386 - RNA, 14 nt, Bordetella pertussis
ugcuucaugcgcuc

SEQ ID NO: 2407387 - RNA, 22 nt, Bordetella pertussis
ugcuugagcaccacguccuggg

SEQ ID NO: 2407388 - RNA, 15 nt, Bordetella pertussis
ugcuugaggccgcgc

SEQ ID NO: 2407389 - RNA, 17 nt, Bordetella pertussis
ugcuugaggccgcgcgc

SEQ ID NO: 2407390 - RNA, 20 nt, Bordetella pertussis
ugcuugccauaggccagcgc

SEQ ID NO: 2407391 - RNA, 13 nt, Bordetella pertussis
ugcuugcccagca

SEQ ID NO: 2407392 - RNA, 13 nt, Bordetella pertussis
ugcuugcccagcg

SEQ ID NO: 2407393 - RNA, 12 nt, Bordetella pertussis
ugcuugccuguc

SEQ ID NO: 2407394 - RNA, 21 nt, Bordetella pertussis
ugcuugcgauaggugcgcagc

SEQ ID NO: 2407395 - RNA, 23 nt, Bordetella pertussis
ugcuugcgauaggugcgcagccg

SEQ ID NO: 2407396 - RNA, 16 nt, Bordetella pertussis
ugcuugcgcgugcgca

SEQ ID NO: 2407397 - RNA, 21 nt, Bordetella pertussis
ugcuugcggcuguccaccugc

SEQ ID NO: 2407398 - RNA, 15 nt, Bordetella pertussis
ugcuuggcagccuug

SEQ ID NO: 2407399 - RNA, 18 nt, Bordetella pertussis
ugcuuggcgcgcagcagc

SEQ ID NO: 2407400 - RNA, 15 nt, Bordetella pertussis
ugcuugggggcgugg

SEQ ID NO: 2407401 - RNA, 15 nt, Bordetella pertussis
ugcuuucggcgacuu

SEQ ID NO: 2407402 - RNA, 17 nt, Bordetella pertussis
ugcuuugagcaggcgcu

SEQ ID NO: 2407403 - RNA, 14 nt, Bordetella pertussis
ugcuuugcgggcgc

SEQ ID NO: 2407404 - RNA, 17 nt, Bordetella pertussis
ugcuuugcgggcgcgcu

SEQ ID NO: 2407405 - RNA, 21 nt, Bordetella pertussis
uggaaaccgcgucgucgugca

SEQ ID NO: 2407406 - RNA, 21 nt, Bordetella pertussis
uggaaauacagaucgccgccg

SEQ ID NO: 2407407 - RNA, 14 nt, Bordetella pertussis
uggaaaugccggcg

SEQ ID NO: 2407408 - RNA, 16 nt, Bordetella pertussis
uggaaaugccggcggc

SEQ ID NO: 2407409 - RNA, 16 nt, Bordetella pertussis
uggaacaccaugcccg

SEQ ID NO: 2407410 - RNA, 15 nt, Bordetella pertussis
uggaacauggcccgg

SEQ ID NO: 2407411 - RNA, 22 nt, Bordetella pertussis
uggaaccgccgcuuucgaccuu

SEQ ID NO: 2407412 - RNA, 22 nt, Bordetella pertussis
uggaaccgcgguacgcgggcau

SEQ ID NO: 2407413 - RNA, 18 nt, Bordetella pertussis
uggaaccgguuggccagc

SEQ ID NO: 2407414 - RNA, 18 nt, Bordetella pertussis
uggaacucguuggccagc

SEQ ID NO: 2407415 - RNA, 21 nt, Bordetella pertussis
uggaacuugggaucggccagg

SEQ ID NO: 2407416 - RNA, 23 nt, Bordetella pertussis
uggaacuugggaucggccaggcc

SEQ ID NO: 2407417 - RNA, 17 nt, Bordetella pertussis
uggaagacguggcccgc

SEQ ID NO: 2407418 - RNA, 20 nt, Bordetella pertussis
uggaagaucacauaggccgg

SEQ ID NO: 2407419 - RNA, 13 nt, Bordetella pertussis
uggaagcgcgcca

SEQ ID NO: 2407420 - RNA, 14 nt, Bordetella pertussis
uggaagcuggccag

SEQ ID NO: 2407421 - RNA, 15 nt, Bordetella pertussis
uggaagcuggccagc

SEQ ID NO: 2407422 - RNA, 18 nt, Bordetella pertussis
uggaagcuggccagcggu

SEQ ID NO: 2407423 - RNA, 17 nt, Bordetella pertussis
uggaaucauuggccagc

SEQ ID NO: 2407424 - RNA, 12 nt, Bordetella pertussis
uggacaagaaag

SEQ ID NO: 2407425 - RNA, 15 nt, Bordetella pertussis
uggacaagauacggc

SEQ ID NO: 2407426 - RNA, 16 nt, Bordetella pertussis
uggacacgaugaacgc

SEQ ID NO: 2407427 - RNA, 20 nt, Bordetella pertussis
uggacacgcccaugauggug

SEQ ID NO: 2407428 - RNA, 14 nt, Bordetella pertussis
uggacagauccagc

SEQ ID NO: 2407429 - RNA, 20 nt, Bordetella pertussis
uggacagcaguucggccggc

SEQ ID NO: 2407430 - RNA, 18 nt, Bordetella pertussis
uggacagcgccagcccgc

SEQ ID NO: 2407431 - RNA, 22 nt, Bordetella pertussis
uggacagcgcguuggcguugcc

SEQ ID NO: 2407432 - RNA, 17 nt, Bordetella pertussis
uggacaggaacuccggc

SEQ ID NO: 2407433 - RNA, 19 nt, Bordetella pertussis
uggacaggaacuccggcgg

SEQ ID NO: 2407434 - RNA, 10 nt, Bordetella pertussis
uggacaggcg

SEQ ID NO: 2407435 - RNA, 19 nt, Bordetella pertussis
uggacaggcgugcgcagcu

SEQ ID NO: 2407436 - RNA, 18 nt, Bordetella pertussis
uggacagugcccugaccc

SEQ ID NO: 2407437 - RNA, 14 nt, Bordetella pertussis
uggaccccgugguc

SEQ ID NO: 2407438 - RNA, 18 nt, Bordetella pertussis
uggaccccuugcggccgc

SEQ ID NO: 2407439 - RNA, 13 nt, Bordetella pertussis
uggaccgccgccg

SEQ ID NO: 2407440 - RNA, 15 nt, Bordetella pertussis
uggaccgccuggccu

SEQ ID NO: 2407441 - RNA, 19 nt, Bordetella pertussis
uggaccgcgcgcgacgaca

SEQ ID NO: 2407442 - RNA, 16 nt, Bordetella pertussis
uggaccggcuccggcc

SEQ ID NO: 2407443 - RNA, 22 nt, Bordetella pertussis
uggaccugccguucgcgcugcc

SEQ ID NO: 2407444 - RNA, 20 nt, Bordetella pertussis
uggacgaauacgcuggcgcg

SEQ ID NO: 2407445 - RNA, 16 nt, Bordetella pertussis
uggacgagcucgucgg

SEQ ID NO: 2407446 - RNA, 18 nt, Bordetella pertussis
uggacgagcucgucgguc

SEQ ID NO: 2407447 - RNA, 22 nt, Bordetella pertussis
uggacgagcucgucggucagcu

SEQ ID NO: 2407448 - RNA, 15 nt, Bordetella pertussis
uggacgaggcgaugg

SEQ ID NO: 2407449 - RNA, 23 nt, Bordetella pertussis
uggacgaggcgauggucggccgg

SEQ ID NO: 2407450 - RNA, 16 nt, Bordetella pertussis
uggacgagggccgcgg

SEQ ID NO: 2407451 - RNA, 18 nt, Bordetella pertussis
uggacgagggccggcgcc

SEQ ID NO: 2407452 - RNA, 21 nt, Bordetella pertussis
uggacgagggccggcgccagc

SEQ ID NO: 2407453 - RNA, 22 nt, Bordetella pertussis
uggacgagggccggcgccagca

SEQ ID NO: 2407454 - RNA, 18 nt, Bordetella pertussis
uggacgccaagaccgcgg

SEQ ID NO: 2407455 - RNA, 11 nt, Bordetella pertussis
uggacgccgaa

SEQ ID NO: 2407456 - RNA, 20 nt, Bordetella pertussis
uggacgccgccggcccagga

SEQ ID NO: 2407457 - RNA, 16 nt, Bordetella pertussis
uggacgcgcgcggcga

SEQ ID NO: 2407458 - RNA, 16 nt, Bordetella pertussis
uggacgcgcuggccga

SEQ ID NO: 2407459 - RNA, 14 nt, Bordetella pertussis
uggacggccagcag

SEQ ID NO: 2407460 - RNA, 16 nt, Bordetella pertussis
uggacgucugagcgcc

SEQ ID NO: 2407461 - RNA, 15 nt, Bordetella pertussis
uggacuauggccugg

SEQ ID NO: 2407462 - RNA, 17 nt, Bordetella pertussis
uggacuauggccuggau

SEQ ID NO: 2407463 - RNA, 18 nt, Bordetella pertussis
uggacucgauggcgcagg

SEQ ID NO: 2407464 - RNA, 16 nt, Bordetella pertussis
uggagaagcgccgcgc

SEQ ID NO: 2407465 - RNA, 15 nt, Bordetella pertussis
uggagaccggcaugg

SEQ ID NO: 2407466 - RNA, 19 nt, Bordetella pertussis
uggagaccggcgccugcgg

SEQ ID NO: 2407467 - RNA, 22 nt, Bordetella pertussis
uggagacggaugccgucuuggc

SEQ ID NO: 2407468 - RNA, 19 nt, Bordetella pertussis
uggagacguagccgcugcc

SEQ ID NO: 2407469 - RNA, 13 nt, Bordetella pertussis
uggagaucaugac

SEQ ID NO: 2407470 - RNA, 15 nt, Bordetella pertussis
uggagaucgccgagc

SEQ ID NO: 2407471 - RNA, 12 nt, Bordetella pertussis
uggagauggcgc

SEQ ID NO: 2407472 - RNA, 13 nt, Bordetella pertussis
uggagauggcgcc

SEQ ID NO: 2407473 - RNA, 20 nt, Bordetella pertussis
uggagauggguacagcgcgc

SEQ ID NO: 2407474 - RNA, 21 nt, Bordetella pertussis
uggagauggguacagcgcgcc

SEQ ID NO: 2407475 - RNA, 17 nt, Bordetella pertussis
uggagaugugcccgaga

SEQ ID NO: 2407476 - RNA, 16 nt, Bordetella pertussis
uggagcgcggcggcgu

SEQ ID NO: 2407477 - RNA, 17 nt, Bordetella pertussis
uggagcgcggcggcgug

SEQ ID NO: 2407478 - RNA, 22 nt, Bordetella pertussis
uggagcggccuggccccgcgcg

SEQ ID NO: 2407479 - RNA, 23 nt, Bordetella pertussis
uggagcucuaugucgccggccag

SEQ ID NO: 2407480 - RNA, 15 nt, Bordetella pertussis
uggagcuggggccgc

SEQ ID NO: 2407481 - RNA, 14 nt, Bordetella pertussis
uggagcuuggccgg

SEQ ID NO: 2407482 - RNA, 13 nt, Bordetella pertussis
uggaggcgcagcg

SEQ ID NO: 2407483 - RNA, 14 nt, Bordetella pertussis
uggaggcgcagcgc

SEQ ID NO: 2407484 - RNA, 16 nt, Bordetella pertussis
uggaggcgcagcgcgg

SEQ ID NO: 2407485 - RNA, 17 nt, Bordetella pertussis
uggaggcgcagcgcggc

SEQ ID NO: 2407486 - RNA, 14 nt, Bordetella pertussis
uggaggggcgcagg

SEQ ID NO: 2407487 - RNA, 14 nt, Bordetella pertussis
uggaguagccgcuc

SEQ ID NO: 2407488 - RNA, 15 nt, Bordetella pertussis
uggaguaguggccca

SEQ ID NO: 2407489 - RNA, 20 nt, Bordetella pertussis
uggaguucuucuuggccaga

SEQ ID NO: 2407490 - RNA, 17 nt, Bordetella pertussis
uggaucaggaugggcgc

SEQ ID NO: 2407491 - RNA, 19 nt, Bordetella pertussis
uggaucaggaugggcgcgg

SEQ ID NO: 2407492 - RNA, 21 nt, Bordetella pertussis
uggaucccggcgaucaugccg

SEQ ID NO: 2407493 - RNA, 22 nt, Bordetella pertussis
uggauccgccggugucggggcc

SEQ ID NO: 2407494 - RNA, 21 nt, Bordetella pertussis
uggaucgccgaucggcaaagc

SEQ ID NO: 2407495 - RNA, 19 nt, Bordetella pertussis
uggaucgcgcccagcgagc

SEQ ID NO: 2407496 - RNA, 23 nt, Bordetella pertussis
uggaucuggugaaacagcaucag

SEQ ID NO: 2407497 - RNA, 14 nt, Bordetella pertussis
uggaucuuggccug

SEQ ID NO: 2407498 - RNA, 15 nt, Bordetella pertussis
uggaugacucgggca

SEQ ID NO: 2407499 - RNA, 14 nt, Bordetella pertussis
uggaugaugcgcga

SEQ ID NO: 2407500 - RNA, 17 nt, Bordetella pertussis
uggaugccaugccgggc

SEQ ID NO: 2407501 - RNA, 21 nt, Bordetella pertussis
uggaugccaugccgggcaagc

SEQ ID NO: 2407502 - RNA, 12 nt, Bordetella pertussis
uggaugcgcgcc

SEQ ID NO: 2407503 - RNA, 13 nt, Bordetella pertussis
uggauggccugcu

SEQ ID NO: 2407504 - RNA, 17 nt, Bordetella pertussis
uggauggccugcucgcc

SEQ ID NO: 2407505 - RNA, 21 nt, Bordetella pertussis
uggauggcgguaaagaccuug

SEQ ID NO: 2407506 - RNA, 16 nt, Bordetella pertussis
uggauggcguauggaa

SEQ ID NO: 2407507 - RNA, 21 nt, Bordetella pertussis
uggauggcucgggcagcagca

SEQ ID NO: 2407508 - RNA, 18 nt, Bordetella pertussis
uggauggucacgcccagg

SEQ ID NO: 2407509 - RNA, 19 nt, Bordetella pertussis
uggauggucacgcccaggc

SEQ ID NO: 2407510 - RNA, 21 nt, Bordetella pertussis
uggauggucacgcccaggcgc

SEQ ID NO: 2407511 - RNA, 14 nt, Bordetella pertussis
uggauggugccgcc

SEQ ID NO: 2407512 - RNA, 23 nt, Bordetella pertussis
uggauucgauugccuggucgaag

SEQ ID NO: 2407513 - RNA, 13 nt, Bordetella pertussis
uggcaaagcgcgc

SEQ ID NO: 2407514 - RNA, 20 nt, Bordetella pertussis
uggcaaccucgccgcgccag

SEQ ID NO: 2407515 - RNA, 21 nt, Bordetella pertussis
uggcaaccucgccgcgccagc

SEQ ID NO: 2407516 - RNA, 20 nt, Bordetella pertussis
uggcaacguugcugcagcgu

SEQ ID NO: 2407517 - RNA, 15 nt, Bordetella pertussis
uggcaaggcccgccg

SEQ ID NO: 2407518 - RNA, 13 nt, Bordetella pertussis
uggcacagcgcgg

SEQ ID NO: 2407519 - RNA, 17 nt, Bordetella pertussis
uggcacaucagcgugcc

SEQ ID NO: 2407520 - RNA, 13 nt, Bordetella pertussis
uggcaccggcaaa

SEQ ID NO: 2407521 - RNA, 20 nt, Bordetella pertussis
uggcaccggccgacccgcgg

SEQ ID NO: 2407522 - RNA, 14 nt, Bordetella pertussis
uggcaccugccgac

SEQ ID NO: 2407523 - RNA, 19 nt, Bordetella pertussis
uggcacgacguggccuacc

SEQ ID NO: 2407524 - RNA, 23 nt, Bordetella pertussis
uggcacugucggcguuccuggcg

SEQ ID NO: 2407525 - RNA, 20 nt, Bordetella pertussis
uggcagacguacuugaucug

SEQ ID NO: 2407526 - RNA, 15 nt, Bordetella pertussis
uggcagaugcgcgcc

SEQ ID NO: 2407527 - RNA, 20 nt, Bordetella pertussis
uggcagaugcgcgccaggcg

SEQ ID NO: 2407528 - RNA, 22 nt, Bordetella pertussis
uggcagcagaucggcggccugg

SEQ ID NO: 2407529 - RNA, 11 nt, Bordetella pertussis
uggcagccuug

SEQ ID NO: 2407530 - RNA, 13 nt, Bordetella pertussis
uggcagccuuggu

SEQ ID NO: 2407531 - RNA, 18 nt, Bordetella pertussis
uggcagccuuggucagcg

SEQ ID NO: 2407532 - RNA, 23 nt, Bordetella pertussis
uggcagcgaccgcggcgguccug

SEQ ID NO: 2407533 - RNA, 14 nt, Bordetella pertussis
uggcagcuggcgcg

SEQ ID NO: 2407534 - RNA, 14 nt, Bordetella pertussis
uggcaggaggcggc

SEQ ID NO: 2407535 - RNA, 12 nt, Bordetella pertussis
uggcaggccagc

SEQ ID NO: 2407536 - RNA, 23 nt, Bordetella pertussis
uggcaggcuggcauugagggcgu

SEQ ID NO: 2407537 - RNA, 20 nt, Bordetella pertussis
uggcagguguuguugcacga

SEQ ID NO: 2407538 - RNA, 13 nt, Bordetella pertussis
uggcagugcgcgu

SEQ ID NO: 2407539 - RNA, 15 nt, Bordetella pertussis
uggcauagaugccga

SEQ ID NO: 2407540 - RNA, 23 nt, Bordetella pertussis
uggcauagaugccgaacagccag

SEQ ID NO: 2407541 - RNA, 19 nt, Bordetella pertussis
uggcauaguccucgugguu

SEQ ID NO: 2407542 - RNA, 15 nt, Bordetella pertussis
uggcaucgucgcgcu

SEQ ID NO: 2407543 - RNA, 23 nt, Bordetella pertussis
uggcaucgucgcgcugcgacagc

SEQ ID NO: 2407544 - RNA, 20 nt, Bordetella pertussis
uggcaugaaaaagggcgcac

SEQ ID NO: 2407545 - RNA, 13 nt, Bordetella pertussis
uggcaugagcgcc

SEQ ID NO: 2407546 - RNA, 22 nt, Bordetella pertussis
uggcaugagcgccucguuccug

SEQ ID NO: 2407547 - RNA, 14 nt, Bordetella pertussis
uggcaugcaccgcg

SEQ ID NO: 2407548 - RNA, 16 nt, Bordetella pertussis
uggcaugccaugcgca

SEQ ID NO: 2407549 - RNA, 19 nt, Bordetella pertussis
uggcauggcgcgugcgcgc

SEQ ID NO: 2407550 - RNA, 20 nt, Bordetella pertussis
uggcauggcgcgugcgcgcg

SEQ ID NO: 2407551 - RNA, 22 nt, Bordetella pertussis
uggcauggcgcgugcgcgcgcc

SEQ ID NO: 2407552 - RNA, 18 nt, Bordetella pertussis
uggcaugugccaccgccc

SEQ ID NO: 2407553 - RNA, 20 nt, Bordetella pertussis
uggcaugugccaccgcccag

SEQ ID NO: 2407554 - RNA, 22 nt, Bordetella pertussis
uggcaugugccaccgcccaggc

SEQ ID NO: 2407555 - RNA, 16 nt, Bordetella pertussis
uggcauugacgcccac

SEQ ID NO: 2407556 - RNA, 15 nt, Bordetella pertussis
uggccaagggcgccg

SEQ ID NO: 2407557 - RNA, 20 nt, Bordetella pertussis
uggccaccacgcccaucugc

SEQ ID NO: 2407558 - RNA, 12 nt, Bordetella pertussis
uggccaccaggc

SEQ ID NO: 2407559 - RNA, 16 nt, Bordetella pertussis
uggccaccaggcgcgc

SEQ ID NO: 2407560 - RNA, 12 nt, Bordetella pertussis
uggccaccaggu

SEQ ID NO: 2407561 - RNA, 17 nt, Bordetella pertussis
uggccacccgacagcuc

SEQ ID NO: 2407562 - RNA, 19 nt, Bordetella pertussis
uggccaccgaagcggcguu

SEQ ID NO: 2407563 - RNA, 13 nt, Bordetella pertussis
uggccacgaagac

SEQ ID NO: 2407564 - RNA, 14 nt, Bordetella pertussis
uggccacgcugcug

SEQ ID NO: 2407565 - RNA, 15 nt, Bordetella pertussis
uggccacggccgcga

SEQ ID NO: 2407566 - RNA, 19 nt, Bordetella pertussis
uggccacggcuugcuucag

SEQ ID NO: 2407567 - RNA, 19 nt, Bordetella pertussis
uggccacguugucgcgcgu

SEQ ID NO: 2407568 - RNA, 17 nt, Bordetella pertussis
uggccacugccuuacuc

SEQ ID NO: 2407569 - RNA, 21 nt, Bordetella pertussis
uggccacugccuuacucgcuc

SEQ ID NO: 2407570 - RNA, 14 nt, Bordetella pertussis
uggccacuggccgc

SEQ ID NO: 2407571 - RNA, 17 nt, Bordetella pertussis
uggccacuggccgcgcu

SEQ ID NO: 2407572 - RNA, 19 nt, Bordetella pertussis
uggccagcaagcgcucggc

SEQ ID NO: 2407573 - RNA, 21 nt, Bordetella pertussis
uggccagcacauacgccgccg

SEQ ID NO: 2407574 - RNA, 13 nt, Bordetella pertussis
uggccagcagcgc

SEQ ID NO: 2407575 - RNA, 14 nt, Bordetella pertussis
uggccagcagcgca

SEQ ID NO: 2407576 - RNA, 15 nt, Bordetella pertussis
uggccagcagcgcau

SEQ ID NO: 2407577 - RNA, 20 nt, Bordetella pertussis
uggccagcagcgcaucgcgc

SEQ ID NO: 2407578 - RNA, 17 nt, Bordetella pertussis
uggccagccaggcggug

SEQ ID NO: 2407579 - RNA, 20 nt, Bordetella pertussis
uggccagccgcucgcgcgac

SEQ ID NO: 2407580 - RNA, 14 nt, Bordetella pertussis
uggccagccggccc

SEQ ID NO: 2407581 - RNA, 16 nt, Bordetella pertussis
uggccagccggcccag

SEQ ID NO: 2407582 - RNA, 12 nt, Bordetella pertussis
uggccagcgccg

SEQ ID NO: 2407583 - RNA, 16 nt, Bordetella pertussis
uggccagcgccgccag

SEQ ID NO: 2407584 - RNA, 22 nt, Bordetella pertussis
uggccagcgcgacggccucguc

SEQ ID NO: 2407585 - RNA, 15 nt, Bordetella pertussis
uggccagcgcgccuu

SEQ ID NO: 2407586 - RNA, 13 nt, Bordetella pertussis
uggccagcggggc

SEQ ID NO: 2407587 - RNA, 21 nt, Bordetella pertussis
uggccagcgguucgucggcgc

SEQ ID NO: 2407588 - RNA, 19 nt, Bordetella pertussis
uggccagcuccaccgggcu

SEQ ID NO: 2407589 - RNA, 20 nt, Bordetella pertussis
uggccagcuccaccgggcug

SEQ ID NO: 2407590 - RNA, 14 nt, Bordetella pertussis
uggccagcuggcgc

SEQ ID NO: 2407591 - RNA, 16 nt, Bordetella pertussis
uggccagcuggcgcgu

SEQ ID NO: 2407592 - RNA, 18 nt, Bordetella pertussis
uggccagcuggcgcgugg

SEQ ID NO: 2407593 - RNA, 23 nt, Bordetella pertussis
uggccagcuggcggcgcagcacc

SEQ ID NO: 2407594 - RNA, 23 nt, Bordetella pertussis
uggccaggcugucccagauggcg

SEQ ID NO: 2407595 - RNA, 23 nt, Bordetella pertussis
uggccagggaggaacugggcgcc

SEQ ID NO: 2407596 - RNA, 12 nt, Bordetella pertussis
uggccagggccg

SEQ ID NO: 2407597 - RNA, 24 nt, Bordetella pertussis
uggccaggguuugcuggcgcagca

SEQ ID NO: 2407598 - RNA, 21 nt, Bordetella pertussis
uggccagguccacauccgcgc

SEQ ID NO: 2407599 - RNA, 17 nt, Bordetella pertussis
uggccagguggcggcgg

SEQ ID NO: 2407600 - RNA, 18 nt, Bordetella pertussis
uggccagguggcggcggc

SEQ ID NO: 2407601 - RNA, 19 nt, Bordetella pertussis
uggccaucaagaaggucga

SEQ ID NO: 2407602 - RNA, 13 nt, Bordetella pertussis
uggccaucaccgc

SEQ ID NO: 2407603 - RNA, 17 nt, Bordetella pertussis
uggccaucuaugucggc

SEQ ID NO: 2407604 - RNA, 19 nt, Bordetella pertussis
uggccaugcaccagcacau

SEQ ID NO: 2407605 - RNA, 12 nt, Bordetella pertussis
uggccaugcugg

SEQ ID NO: 2407606 - RNA, 13 nt, Bordetella pertussis
uggccaugcuggg

SEQ ID NO: 2407607 - RNA, 14 nt, Bordetella pertussis
uggccaugcugggc

SEQ ID NO: 2407608 - RNA, 15 nt, Bordetella pertussis
uggccaugcugggcg

SEQ ID NO: 2407609 - RNA, 16 nt, Bordetella pertussis
uggccaugcugggcgg

SEQ ID NO: 2407610 - RNA, 12 nt, Bordetella pertussis
uggccauggaca

SEQ ID NO: 2407611 - RNA, 18 nt, Bordetella pertussis
uggccauggacagcaccg

SEQ ID NO: 2407612 - RNA, 22 nt, Bordetella pertussis
uggccauguccuggcaggccgc

SEQ ID NO: 2407613 - RNA, 20 nt, Bordetella pertussis
uggccauuccuuccgggccc

SEQ ID NO: 2407614 - RNA, 18 nt, Bordetella pertussis
uggcccaagcccguggcg

SEQ ID NO: 2407615 - RNA, 18 nt, Bordetella pertussis
uggcccacgcccauguag

SEQ ID NO: 2407616 - RNA, 20 nt, Bordetella pertussis
uggcccacucaugcgcugca

SEQ ID NO: 2407617 - RNA, 19 nt, Bordetella pertussis
uggcccacucggugcgcgc

SEQ ID NO: 2407618 - RNA, 20 nt, Bordetella pertussis
uggcccacucggugcgcgcg

SEQ ID NO: 2407619 - RNA, 22 nt, Bordetella pertussis
uggcccacucggugcgcgcgcc

SEQ ID NO: 2407620 - RNA, 22 nt, Bordetella pertussis
uggcccagaccaagcgccacag

SEQ ID NO: 2407621 - RNA, 13 nt, Bordetella pertussis
uggcccagaucug

SEQ ID NO: 2407622 - RNA, 18 nt, Bordetella pertussis
uggcccagaucugccgca

SEQ ID NO: 2407623 - RNA, 13 nt, Bordetella pertussis
uggcccagcaccg

SEQ ID NO: 2407624 - RNA, 15 nt, Bordetella pertussis
uggcccagcaccgcc

SEQ ID NO: 2407625 - RNA, 16 nt, Bordetella pertussis
uggcccagcaccgccg

SEQ ID NO: 2407626 - RNA, 21 nt, Bordetella pertussis
uggcccagcaccgccgccagu

SEQ ID NO: 2407627 - RNA, 19 nt, Bordetella pertussis
uggcccagccggugcgcgg

SEQ ID NO: 2407628 - RNA, 20 nt, Bordetella pertussis
uggcccagccggugcgcggc

SEQ ID NO: 2407629 - RNA, 18 nt, Bordetella pertussis
uggcccagcuccagcugg

SEQ ID NO: 2407630 - RNA, 19 nt, Bordetella pertussis
uggcccagcuccagcuggc

SEQ ID NO: 2407631 - RNA, 20 nt, Bordetella pertussis
uggcccagcuccagcuggcg

SEQ ID NO: 2407632 - RNA, 21 nt, Bordetella pertussis
uggcccagcuccagcuggcgc

SEQ ID NO: 2407633 - RNA, 22 nt, Bordetella pertussis
uggcccagcuccagcuggcgca

SEQ ID NO: 2407634 - RNA, 22 nt, Bordetella pertussis
uggcccaggccgaaccacagca

SEQ ID NO: 2407635 - RNA, 21 nt, Bordetella pertussis
uggcccagggcagcggccaga

SEQ ID NO: 2407636 - RNA, 22 nt, Bordetella pertussis
uggcccaguugaaucggcgcga

SEQ ID NO: 2407637 - RNA, 23 nt, Bordetella pertussis
uggcccaguugaaucggcgcgag

SEQ ID NO: 2407638 - RNA, 16 nt, Bordetella pertussis
uggccccaggcgcccg

SEQ ID NO: 2407639 - RNA, 13 nt, Bordetella pertussis
uggccccaggcgu

SEQ ID NO: 2407640 - RNA, 12 nt, Bordetella pertussis
uggccccgggcg

SEQ ID NO: 2407641 - RNA, 15 nt, Bordetella pertussis
uggccccgggcgggu

SEQ ID NO: 2407642 - RNA, 21 nt, Bordetella pertussis
uggcccgaacggcccauccau

SEQ ID NO: 2407643 - RNA, 16 nt, Bordetella pertussis
uggcccgauacaugau

SEQ ID NO: 2407644 - RNA, 16 nt, Bordetella pertussis
uggcccgcaccgggcg

SEQ ID NO: 2407645 - RNA, 19 nt, Bordetella pertussis
uggcccgcaccgggcggcc

SEQ ID NO: 2407646 - RNA, 21 nt, Bordetella pertussis
uggcccgcagguggggcagca

SEQ ID NO: 2407647 - RNA, 22 nt, Bordetella pertussis
uggcccgcagguggggcagcag

SEQ ID NO: 2407648 - RNA, 17 nt, Bordetella pertussis
uggcccgccaccacggc

SEQ ID NO: 2407649 - RNA, 19 nt, Bordetella pertussis
uggcccgccagcaaggcgg

SEQ ID NO: 2407650 - RNA, 20 nt, Bordetella pertussis
uggcccgccagcaaggcggc

SEQ ID NO: 2407651 - RNA, 21 nt, Bordetella pertussis
uggcccgccauugcacgcgca

SEQ ID NO: 2407652 - RNA, 16 nt, Bordetella pertussis
uggcccgcgccgcguc

SEQ ID NO: 2407653 - RNA, 20 nt, Bordetella pertussis
uggcccgcgcgagcggcgug

SEQ ID NO: 2407654 - RNA, 18 nt, Bordetella pertussis
uggcccgcgugacggccg

SEQ ID NO: 2407655 - RNA, 20 nt, Bordetella pertussis
uggcccggcaccguccagca

SEQ ID NO: 2407656 - RNA, 16 nt, Bordetella pertussis
uggcccggcgggaaca

SEQ ID NO: 2407657 - RNA, 14 nt, Bordetella pertussis
uggcccggcucgcc

SEQ ID NO: 2407658 - RNA, 21 nt, Bordetella pertussis
uggcccgguuggggucgcgcu

SEQ ID NO: 2407659 - RNA, 16 nt, Bordetella pertussis
uggcccgucaugugca

SEQ ID NO: 2407660 - RNA, 14 nt, Bordetella pertussis
uggcccugcagcgg

SEQ ID NO: 2407661 - RNA, 23 nt, Bordetella pertussis
uggcccugcagcggccaguccac

SEQ ID NO: 2407662 - RNA, 12 nt, Bordetella pertussis
uggcccugcugg

SEQ ID NO: 2407663 - RNA, 16 nt, Bordetella pertussis
uggcccuggcgggccg

SEQ ID NO: 2407664 - RNA, 13 nt, Bordetella pertussis
uggcccuucuuca

SEQ ID NO: 2407665 - RNA, 14 nt, Bordetella pertussis
uggcccuucuucag

SEQ ID NO: 2407666 - RNA, 19 nt, Bordetella pertussis
uggcccuugcccagcgugu

SEQ ID NO: 2407667 - RNA, 21 nt, Bordetella pertussis
uggcccuugccgccuucccag

SEQ ID NO: 2407668 - RNA, 22 nt, Bordetella pertussis
uggccgaaccauugcagggugu

SEQ ID NO: 2407669 - RNA, 16 nt, Bordetella pertussis
uggccgaacgccgccg

SEQ ID NO: 2407670 - RNA, 19 nt, Bordetella pertussis
uggccgacagcgucgagcu

SEQ ID NO: 2407671 - RNA, 22 nt, Bordetella pertussis
uggccgacggguggguggacag

SEQ ID NO: 2407672 - RNA, 15 nt, Bordetella pertussis
uggccgagaugccgu

SEQ ID NO: 2407673 - RNA, 14 nt, Bordetella pertussis
uggccgagcgcggc

SEQ ID NO: 2407674 - RNA, 19 nt, Bordetella pertussis
uggccgaggugcccaucag

SEQ ID NO: 2407675 - RNA, 14 nt, Bordetella pertussis
uggccgaucugcug

SEQ ID NO: 2407676 - RNA, 17 nt, Bordetella pertussis
uggccgaucugcugggc

SEQ ID NO: 2407677 - RNA, 19 nt, Bordetella pertussis
uggccgaucugcugggccg

SEQ ID NO: 2407678 - RNA, 20 nt, Bordetella pertussis
uggccgaucugcugggccgg

SEQ ID NO: 2407679 - RNA, 23 nt, Bordetella pertussis
uggccgauggccucgcugccagg

SEQ ID NO: 2407680 - RNA, 15 nt, Bordetella pertussis
uggccgauucgaccu

SEQ ID NO: 2407681 - RNA, 17 nt, Bordetella pertussis
uggccgcagccggcugc

SEQ ID NO: 2407682 - RNA, 23 nt, Bordetella pertussis
uggccgccacacgaggaccgcga

SEQ ID NO: 2407683 - RNA, 14 nt, Bordetella pertussis
uggccgccaccagc

SEQ ID NO: 2407684 - RNA, 15 nt, Bordetella pertussis
uggccgccaccagcg

SEQ ID NO: 2407685 - RNA, 18 nt, Bordetella pertussis
uggccgccaccagcgcgu

SEQ ID NO: 2407686 - RNA, 20 nt, Bordetella pertussis
uggccgccagcggcuggcgc

SEQ ID NO: 2407687 - RNA, 23 nt, Bordetella pertussis
uggccgccagcggcuggcgccgu

SEQ ID NO: 2407688 - RNA, 23 nt, Bordetella pertussis
uggccgccagcguaucgccgccg

SEQ ID NO: 2407689 - RNA, 17 nt, Bordetella pertussis
uggccgccauggcgcug

SEQ ID NO: 2407690 - RNA, 11 nt, Bordetella pertussis
uggccgcccag

SEQ ID NO: 2407691 - RNA, 17 nt, Bordetella pertussis
uggccgcccgcggccug

SEQ ID NO: 2407692 - RNA, 13 nt, Bordetella pertussis
uggccgcccuggc

SEQ ID NO: 2407693 - RNA, 15 nt, Bordetella pertussis
uggccgcccuggcgc

SEQ ID NO: 2407694 - RNA, 19 nt, Bordetella pertussis
uggccgccgaacggcagca

SEQ ID NO: 2407695 - RNA, 23 nt, Bordetella pertussis
uggccgccgaacggcagcagcgc

SEQ ID NO: 2407696 - RNA, 10 nt, Bordetella pertussis
uggccgccgc

SEQ ID NO: 2407697 - RNA, 15 nt, Bordetella pertussis
uggccgccgccacca

SEQ ID NO: 2407698 - RNA, 16 nt, Bordetella pertussis
uggccgccgcgcgccg

SEQ ID NO: 2407699 - RNA, 16 nt, Bordetella pertussis
uggccgccgcggccuc

SEQ ID NO: 2407700 - RNA, 17 nt, Bordetella pertussis
uggccgccgcggccucg

SEQ ID NO: 2407701 - RNA, 16 nt, Bordetella pertussis
uggccgccgcgggcgc

SEQ ID NO: 2407702 - RNA, 19 nt, Bordetella pertussis
uggccgccgcgggcgccgc

SEQ ID NO: 2407703 - RNA, 15 nt, Bordetella pertussis
uggccgccggcgcgg

SEQ ID NO: 2407704 - RNA, 23 nt, Bordetella pertussis
uggccgccggcgcgguggccaug

SEQ ID NO: 2407705 - RNA, 14 nt, Bordetella pertussis
uggccgccggcggc

SEQ ID NO: 2407706 - RNA, 14 nt, Bordetella pertussis
uggccgccgggucg

SEQ ID NO: 2407707 - RNA, 13 nt, Bordetella pertussis
uggccgccugcug

SEQ ID NO: 2407708 - RNA, 15 nt, Bordetella pertussis
uggccgccugcugcg

SEQ ID NO: 2407709 - RNA, 15 nt, Bordetella pertussis
uggccgcgcaaggcc

SEQ ID NO: 2407710 - RNA, 12 nt, Bordetella pertussis
uggccgcgccca

SEQ ID NO: 2407711 - RNA, 14 nt, Bordetella pertussis
uggccgcgcccagc

SEQ ID NO: 2407712 - RNA, 18 nt, Bordetella pertussis
uggccgcgcccagcgcgg

SEQ ID NO: 2407713 - RNA, 12 nt, Bordetella pertussis
uggccgcgcccg

SEQ ID NO: 2407714 - RNA, 21 nt, Bordetella pertussis
uggccgcgccgcuggcggccg

SEQ ID NO: 2407715 - RNA, 14 nt, Bordetella pertussis
uggccgcgcgcagc

SEQ ID NO: 2407716 - RNA, 18 nt, Bordetella pertussis
uggccgcgcgccggcgcc

SEQ ID NO: 2407717 - RNA, 19 nt, Bordetella pertussis
uggccgcgcgccggcgccg

SEQ ID NO: 2407718 - RNA, 20 nt, Bordetella pertussis
uggccgcgcgccggcgccgu

SEQ ID NO: 2407719 - RNA, 15 nt, Bordetella pertussis
uggccgcgcggcgcc

SEQ ID NO: 2407720 - RNA, 17 nt, Bordetella pertussis
uggccgcgcggcgccug

SEQ ID NO: 2407721 - RNA, 23 nt, Bordetella pertussis
uggccgcgcggcgccugccugcc

SEQ ID NO: 2407722 - RNA, 17 nt, Bordetella pertussis
uggccgcgcgguacgca

SEQ ID NO: 2407723 - RNA, 22 nt, Bordetella pertussis
uggccgcgcgguacgcaccgcc

SEQ ID NO: 2407724 - RNA, 14 nt, Bordetella pertussis
uggccgcgcucagc

SEQ ID NO: 2407725 - RNA, 18 nt, Bordetella pertussis
uggccgcgcucagccuug

SEQ ID NO: 2407726 - RNA, 20 nt, Bordetella pertussis
uggccgcgcucaggccgcug

SEQ ID NO: 2407727 - RNA, 13 nt, Bordetella pertussis
uggccgcgcugcu

SEQ ID NO: 2407728 - RNA, 17 nt, Bordetella pertussis
uggccgcgcuggcggcg

SEQ ID NO: 2407729 - RNA, 20 nt, Bordetella pertussis
uggccgcgcuggcggcgcag

SEQ ID NO: 2407730 - RNA, 14 nt, Bordetella pertussis
uggccgcggcccag

SEQ ID NO: 2407731 - RNA, 17 nt, Bordetella pertussis
uggccgcggcccagcgc

SEQ ID NO: 2407732 - RNA, 19 nt, Bordetella pertussis
uggccgcggcccagcgcgg

SEQ ID NO: 2407733 - RNA, 12 nt, Bordetella pertussis
uggccgcggcgu

SEQ ID NO: 2407734 - RNA, 21 nt, Bordetella pertussis
uggccgcggcguccgcgccga

SEQ ID NO: 2407735 - RNA, 23 nt, Bordetella pertussis
uggccgcgguaaugacgcagccg

SEQ ID NO: 2407736 - RNA, 18 nt, Bordetella pertussis
uggccgcgguccgggcca

SEQ ID NO: 2407737 - RNA, 22 nt, Bordetella pertussis
uggccgcguacaacgccgcguc

SEQ ID NO: 2407738 - RNA, 23 nt, Bordetella pertussis
uggccgcguaggcggucagcugg

SEQ ID NO: 2407739 - RNA, 13 nt, Bordetella pertussis
uggccgcuccaga

SEQ ID NO: 2407740 - RNA, 23 nt, Bordetella pertussis
uggccgcuucggcggccauggca

SEQ ID NO: 2407741 - RNA, 22 nt, Bordetella pertussis
uggccgcuucggcggccgcguc

SEQ ID NO: 2407742 - RNA, 16 nt, Bordetella pertussis
uggccggaucgagcgc

SEQ ID NO: 2407743 - RNA, 19 nt, Bordetella pertussis
uggccggcaucgcgcugac

SEQ ID NO: 2407744 - RNA, 14 nt, Bordetella pertussis
uggccggccaacag

SEQ ID NO: 2407745 - RNA, 23 nt, Bordetella pertussis
uggccggccaacagcucgcgcca

SEQ ID NO: 2407746 - RNA, 19 nt, Bordetella pertussis
uggccggccccauccucau

SEQ ID NO: 2407747 - RNA, 15 nt, Bordetella pertussis
uggccggccgccggg

SEQ ID NO: 2407748 - RNA, 22 nt, Bordetella pertussis
uggccggccgcguggccgcgcu

SEQ ID NO: 2407749 - RNA, 12 nt, Bordetella pertussis
uggccggccugc

SEQ ID NO: 2407750 - RNA, 17 nt, Bordetella pertussis
uggccggccugccggcg

SEQ ID NO: 2407751 - RNA, 19 nt, Bordetella pertussis
uggccggccugccggcgca

SEQ ID NO: 2407752 - RNA, 13 nt, Bordetella pertussis
uggccggccuggc

SEQ ID NO: 2407753 - RNA, 16 nt, Bordetella pertussis
uggccggccuggcgcg

SEQ ID NO: 2407754 - RNA, 16 nt, Bordetella pertussis
uggccggcgacggcau

SEQ ID NO: 2407755 - RNA, 19 nt, Bordetella pertussis
uggccggcgauugcgccag

SEQ ID NO: 2407756 - RNA, 23 nt, Bordetella pertussis
uggccggcgauugcgccagcgcu

SEQ ID NO: 2407757 - RNA, 15 nt, Bordetella pertussis
uggccggcgcgaacc

SEQ ID NO: 2407758 - RNA, 19 nt, Bordetella pertussis
uggccggcgcgaaccccuc

SEQ ID NO: 2407759 - RNA, 13 nt, Bordetella pertussis
uggccggcgcgcg

SEQ ID NO: 2407760 - RNA, 18 nt, Bordetella pertussis
uggccggcgcgcggccgu

SEQ ID NO: 2407761 - RNA, 13 nt, Bordetella pertussis
uggccggcgcgcu

SEQ ID NO: 2407762 - RNA, 16 nt, Bordetella pertussis
uggccggcgcggcagc

SEQ ID NO: 2407763 - RNA, 20 nt, Bordetella pertussis
uggccggcgcggcagccugg

SEQ ID NO: 2407764 - RNA, 21 nt, Bordetella pertussis
uggccggcgcggcagccuggg

SEQ ID NO: 2407765 - RNA, 22 nt, Bordetella pertussis
uggccggcgcugggcaggcugg

SEQ ID NO: 2407766 - RNA, 14 nt, Bordetella pertussis
uggccggcgggggc

SEQ ID NO: 2407767 - RNA, 18 nt, Bordetella pertussis
uggccggcgggggcgggu

SEQ ID NO: 2407768 - RNA, 19 nt, Bordetella pertussis
uggccggcguggccugccc

SEQ ID NO: 2407769 - RNA, 21 nt, Bordetella pertussis
uggccggcguguucagcgcgc

SEQ ID NO: 2407770 - RNA, 23 nt, Bordetella pertussis
uggccggcguguucagcgcgcgc

SEQ ID NO: 2407771 - RNA, 18 nt, Bordetella pertussis
uggccgggagcggccagc

SEQ ID NO: 2407772 - RNA, 20 nt, Bordetella pertussis
uggccgggagcggccagcaa

SEQ ID NO: 2407773 - RNA, 22 nt, Bordetella pertussis
uggccgggagcggccagcaagc

SEQ ID NO: 2407774 - RNA, 20 nt, Bordetella pertussis
uggccggggaagccgccggc

SEQ ID NO: 2407775 - RNA, 12 nt, Bordetella pertussis
uggccggggcgu

SEQ ID NO: 2407776 - RNA, 21 nt, Bordetella pertussis
uggccggggcgucgucgcggu

SEQ ID NO: 2407777 - RNA, 19 nt, Bordetella pertussis
uggccgggguccugaggcc

SEQ ID NO: 2407778 - RNA, 22 nt, Bordetella pertussis
uggccgggguccugaggccagg

SEQ ID NO: 2407779 - RNA, 23 nt, Bordetella pertussis
uggccgggguccugaggccaggc

SEQ ID NO: 2407780 - RNA, 15 nt, Bordetella pertussis
uggccgggucgcgca

SEQ ID NO: 2407781 - RNA, 18 nt, Bordetella pertussis
uggccgggucgcgcagca

SEQ ID NO: 2407782 - RNA, 19 nt, Bordetella pertussis
uggccgggucgcgcagcag

SEQ ID NO: 2407783 - RNA, 19 nt, Bordetella pertussis
uggccgggugguccaugcg

SEQ ID NO: 2407784 - RNA, 20 nt, Bordetella pertussis
uggccggugagauccagcga

SEQ ID NO: 2407785 - RNA, 18 nt, Bordetella pertussis
uggccggugaugcggcgc

SEQ ID NO: 2407786 - RNA, 19 nt, Bordetella pertussis
uggccggugaugcggcgcg

SEQ ID NO: 2407787 - RNA, 22 nt, Bordetella pertussis
uggccggugaugcggcgcgccg

SEQ ID NO: 2407788 - RNA, 13 nt, Bordetella pertussis
uggccggugccag

SEQ ID NO: 2407789 - RNA, 15 nt, Bordetella pertussis
uggccggugccaguc

SEQ ID NO: 2407790 - RNA, 22 nt, Bordetella pertussis
uggccgguucgaugaccugggc

SEQ ID NO: 2407791 - RNA, 21 nt, Bordetella pertussis
uggccguagcguuggcggccg

SEQ ID NO: 2407792 - RNA, 22 nt, Bordetella pertussis
uggccguagcguuggcggccgg

SEQ ID NO: 2407793 - RNA, 18 nt, Bordetella pertussis
uggccgucgccagcgacg

SEQ ID NO: 2407794 - RNA, 11 nt, Bordetella pertussis
uggccgucguc

SEQ ID NO: 2407795 - RNA, 17 nt, Bordetella pertussis
uggccguggcgugcagg

SEQ ID NO: 2407796 - RNA, 15 nt, Bordetella pertussis
uggccguuggccagc

SEQ ID NO: 2407797 - RNA, 16 nt, Bordetella pertussis
uggccuaccacgcaug

SEQ ID NO: 2407798 - RNA, 14 nt, Bordetella pertussis
uggccucgcccugg

SEQ ID NO: 2407799 - RNA, 15 nt, Bordetella pertussis
uggccucggcauggc

SEQ ID NO: 2407800 - RNA, 16 nt, Bordetella pertussis
uggccucggcauggcg

SEQ ID NO: 2407801 - RNA, 17 nt, Bordetella pertussis
uggccucggcauggcgc

SEQ ID NO: 2407802 - RNA, 19 nt, Bordetella pertussis
uggccucggcauggcgcgc

SEQ ID NO: 2407803 - RNA, 13 nt, Bordetella pertussis
uggccucggcggc

SEQ ID NO: 2407804 - RNA, 15 nt, Bordetella pertussis
uggccugccgcgccg

SEQ ID NO: 2407805 - RNA, 23 nt, Bordetella pertussis
uggccugccgcgccgaccggccc

SEQ ID NO: 2407806 - RNA, 13 nt, Bordetella pertussis
uggccugcgccgc

SEQ ID NO: 2407807 - RNA, 19 nt, Bordetella pertussis
uggccugcgccgccgcgcg

SEQ ID NO: 2407808 - RNA, 16 nt, Bordetella pertussis
uggccugcggaugcag

SEQ ID NO: 2407809 - RNA, 18 nt, Bordetella pertussis
uggccugcucgcccacau

SEQ ID NO: 2407810 - RNA, 17 nt, Bordetella pertussis
uggccugcuugaagacg

SEQ ID NO: 2407811 - RNA, 17 nt, Bordetella pertussis
uggccugcuuggcgcgc

SEQ ID NO: 2407812 - RNA, 23 nt, Bordetella pertussis
uggccugcuuggcgcgcagcagc

SEQ ID NO: 2407813 - RNA, 18 nt, Bordetella pertussis
uggccuggaugugcaggc

SEQ ID NO: 2407814 - RNA, 13 nt, Bordetella pertussis
uggccuggcccag

SEQ ID NO: 2407815 - RNA, 16 nt, Bordetella pertussis
uggccuggccgccggc

SEQ ID NO: 2407816 - RNA, 13 nt, Bordetella pertussis
uggccugggccag

SEQ ID NO: 2407817 - RNA, 15 nt, Bordetella pertussis
uggccugggccagga

SEQ ID NO: 2407818 - RNA, 17 nt, Bordetella pertussis
uggccugguuggccgcc

SEQ ID NO: 2407819 - RNA, 18 nt, Bordetella pertussis
uggccugguuggccgccu

SEQ ID NO: 2407820 - RNA, 20 nt, Bordetella pertussis
uggccugguuggccgccugg

SEQ ID NO: 2407821 - RNA, 16 nt, Bordetella pertussis
uggccugucugguggc

SEQ ID NO: 2407822 - RNA, 21 nt, Bordetella pertussis
uggccuuccugcugacaggcg

SEQ ID NO: 2407823 - RNA, 18 nt, Bordetella pertussis
uggccuucgaccugcccg

SEQ ID NO: 2407824 - RNA, 13 nt, Bordetella pertussis
uggccuucuucac

SEQ ID NO: 2407825 - RNA, 22 nt, Bordetella pertussis
uggccuucuucacguagccggc

SEQ ID NO: 2407826 - RNA, 17 nt, Bordetella pertussis
uggccuugacggcgcgg

SEQ ID NO: 2407827 - RNA, 15 nt, Bordetella pertussis
uggccuugcgcgucc

SEQ ID NO: 2407828 - RNA, 21 nt, Bordetella pertussis
uggccuugcgcuuuuuucucc

SEQ ID NO: 2407829 - RNA, 17 nt, Bordetella pertussis
uggccuugcugcccgac

SEQ ID NO: 2407830 - RNA, 19 nt, Bordetella pertussis
uggccuugcugcccgacgg

SEQ ID NO: 2407831 - RNA, 16 nt, Bordetella pertussis
uggccuuggaguagcc

SEQ ID NO: 2407832 - RNA, 20 nt, Bordetella pertussis
uggccuuggaguagccgcuc

SEQ ID NO: 2407833 - RNA, 17 nt, Bordetella pertussis
uggccuuuuccaggcgu

SEQ ID NO: 2407834 - RNA, 22 nt, Bordetella pertussis
uggcgaacaguugcaccagugc

SEQ ID NO: 2407835 - RNA, 24 nt, Bordetella pertussis
uggcgaacauguuguuggucgcca

SEQ ID NO: 2407836 - RNA, 16 nt, Bordetella pertussis
uggcgaacgugcgcgc

SEQ ID NO: 2407837 - RNA, 23 nt, Bordetella pertussis
uggcgaagaacaccgccgcgccg

SEQ ID NO: 2407838 - RNA, 18 nt, Bordetella pertussis
uggcgaagaccgugaucg

SEQ ID NO: 2407839 - RNA, 20 nt, Bordetella pertussis
uggcgaagaccgugaucggc

SEQ ID NO: 2407840 - RNA, 13 nt, Bordetella pertussis
uggcgaaggccgc

SEQ ID NO: 2407841 - RNA, 21 nt, Bordetella pertussis
uggcgaaggcgucggccaugg

SEQ ID NO: 2407842 - RNA, 22 nt, Bordetella pertussis
uggcgaaggcgucggccauggc

SEQ ID NO: 2407843 - RNA, 19 nt, Bordetella pertussis
uggcgaccacuaucagcgc

SEQ ID NO: 2407844 - RNA, 19 nt, Bordetella pertussis
uggcgacgcccagccugcc

SEQ ID NO: 2407845 - RNA, 21 nt, Bordetella pertussis
uggcgacgcccagccugccgg

SEQ ID NO: 2407846 - RNA, 16 nt, Bordetella pertussis
uggcgacgcgcugccg

SEQ ID NO: 2407847 - RNA, 21 nt, Bordetella pertussis
uggcgacgucgggcagggcga

SEQ ID NO: 2407848 - RNA, 20 nt, Bordetella pertussis
uggcgaggacaggccagugc

SEQ ID NO: 2407849 - RNA, 21 nt, Bordetella pertussis
uggcgagggucaggcgcgcuu

SEQ ID NO: 2407850 - RNA, 16 nt, Bordetella pertussis
uggcgaucaccgacag

SEQ ID NO: 2407851 - RNA, 13 nt, Bordetella pertussis
uggcgaucacggc

SEQ ID NO: 2407852 - RNA, 16 nt, Bordetella pertussis
uggcgaucacggccaa

SEQ ID NO: 2407853 - RNA, 21 nt, Bordetella pertussis
uggcgaucaggaaaagcaggc

SEQ ID NO: 2407854 - RNA, 15 nt, Bordetella pertussis
uggcgaucaguuccu

SEQ ID NO: 2407855 - RNA, 17 nt, Bordetella pertussis
uggcgauccagggccgc

SEQ ID NO: 2407856 - RNA, 18 nt, Bordetella pertussis
uggcgauccagggccgcc

SEQ ID NO: 2407857 - RNA, 20 nt, Bordetella pertussis
uggcgauccagggccgccag

SEQ ID NO: 2407858 - RNA, 22 nt, Bordetella pertussis
uggcgauccauguggccagcuc

SEQ ID NO: 2407859 - RNA, 19 nt, Bordetella pertussis
uggcgaucgaacgcggcca

SEQ ID NO: 2407860 - RNA, 20 nt, Bordetella pertussis
uggcgaucgaacgcggccag

SEQ ID NO: 2407861 - RNA, 20 nt, Bordetella pertussis
uggcgaucucguccugcagg

SEQ ID NO: 2407862 - RNA, 18 nt, Bordetella pertussis
uggcgaucuucugggcgg

SEQ ID NO: 2407863 - RNA, 16 nt, Bordetella pertussis
uggcgaugaccucggc

SEQ ID NO: 2407864 - RNA, 17 nt, Bordetella pertussis
uggcgaugcccaccagc

SEQ ID NO: 2407865 - RNA, 19 nt, Bordetella pertussis
uggcgaugcccaccagccg

SEQ ID NO: 2407866 - RNA, 12 nt, Bordetella pertussis
uggcgaugccgg

SEQ ID NO: 2407867 - RNA, 17 nt, Bordetella pertussis
uggcgaugcgggccacg

SEQ ID NO: 2407868 - RNA, 18 nt, Bordetella pertussis
uggcgaugcgggccacgc

SEQ ID NO: 2407869 - RNA, 15 nt, Bordetella pertussis
uggcgauggccgcca

SEQ ID NO: 2407870 - RNA, 19 nt, Bordetella pertussis
uggcgauggccgccagcgu

SEQ ID NO: 2407871 - RNA, 15 nt, Bordetella pertussis
uggcgauggccugau

SEQ ID NO: 2407872 - RNA, 12 nt, Bordetella pertussis
uggcgauggcgc

SEQ ID NO: 2407873 - RNA, 16 nt, Bordetella pertussis
uggcgauguucacgcg

SEQ ID NO: 2407874 - RNA, 20 nt, Bordetella pertussis
uggcgcaaggcaugcgccag

SEQ ID NO: 2407875 - RNA, 12 nt, Bordetella pertussis
uggcgcaccagg

SEQ ID NO: 2407876 - RNA, 13 nt, Bordetella pertussis
uggcgcaccaggc

SEQ ID NO: 2407877 - RNA, 20 nt, Bordetella pertussis
uggcgcaccaggcuggggcc

SEQ ID NO: 2407878 - RNA, 14 nt, Bordetella pertussis
uggcgcaccgcgcu

SEQ ID NO: 2407879 - RNA, 14 nt, Bordetella pertussis
uggcgcacgccggg

SEQ ID NO: 2407880 - RNA, 15 nt, Bordetella pertussis
uggcgcacgccgggc

SEQ ID NO: 2407881 - RNA, 17 nt, Bordetella pertussis
uggcgcagaugggcggc

SEQ ID NO: 2407882 - RNA, 18 nt, Bordetella pertussis
uggcgcagaugggcggcg

SEQ ID NO: 2407883 - RNA, 20 nt, Bordetella pertussis
uggcgcagaugggcggcgac

SEQ ID NO: 2407884 - RNA, 19 nt, Bordetella pertussis
uggcgcagcaaggcgcgcc

SEQ ID NO: 2407885 - RNA, 22 nt, Bordetella pertussis
uggcgcagcacgccgcgccagg

SEQ ID NO: 2407886 - RNA, 15 nt, Bordetella pertussis
uggcgcagcagcgcc

SEQ ID NO: 2407887 - RNA, 13 nt, Bordetella pertussis
uggcgcagcaggc

SEQ ID NO: 2407888 - RNA, 17 nt, Bordetella pertussis
uggcgcagcaggcgcgc

SEQ ID NO: 2407889 - RNA, 12 nt, Bordetella pertussis
uggcgcaggaac

SEQ ID NO: 2407890 - RNA, 21 nt, Bordetella pertussis
uggcgcaggccggcggccagc

SEQ ID NO: 2407891 - RNA, 14 nt, Bordetella pertussis
uggcgcaggcgcgc

SEQ ID NO: 2407892 - RNA, 18 nt, Bordetella pertussis
uggcgcaggcgcgccagg

SEQ ID NO: 2407893 - RNA, 17 nt, Bordetella pertussis
uggcgcaggcgcgcgcc

SEQ ID NO: 2407894 - RNA, 13 nt, Bordetella pertussis
uggcgcagguccu

SEQ ID NO: 2407895 - RNA, 16 nt, Bordetella pertussis
uggcgcagugggccag

SEQ ID NO: 2407896 - RNA, 17 nt, Bordetella pertussis
uggcgccaacccgccau

SEQ ID NO: 2407897 - RNA, 16 nt, Bordetella pertussis
uggcgccagcccgccc

SEQ ID NO: 2407898 - RNA, 17 nt, Bordetella pertussis
uggcgccagcccgcccg

SEQ ID NO: 2407899 - RNA, 13 nt, Bordetella pertussis
uggcgccagcugg

SEQ ID NO: 2407900 - RNA, 13 nt, Bordetella pertussis
uggcgccaugcga

SEQ ID NO: 2407901 - RNA, 13 nt, Bordetella pertussis
uggcgccaugugc

SEQ ID NO: 2407902 - RNA, 12 nt, Bordetella pertussis
uggcgcccagcu

SEQ ID NO: 2407903 - RNA, 15 nt, Bordetella pertussis
uggcgcccaucgcgg

SEQ ID NO: 2407904 - RNA, 13 nt, Bordetella pertussis
uggcgcccgccug

SEQ ID NO: 2407905 - RNA, 16 nt, Bordetella pertussis
uggcgcccgccugcgc

SEQ ID NO: 2407906 - RNA, 18 nt, Bordetella pertussis
uggcgcccgccugcgcca

SEQ ID NO: 2407907 - RNA, 19 nt, Bordetella pertussis
uggcgcccgccugcgccag

SEQ ID NO: 2407908 - RNA, 20 nt, Bordetella pertussis
uggcgcccgccugcgccagc

SEQ ID NO: 2407909 - RNA, 21 nt, Bordetella pertussis
uggcgcccgccugcgccagcc

SEQ ID NO: 2407910 - RNA, 21 nt, Bordetella pertussis
uggcgcccggccugcgggcgc

SEQ ID NO: 2407911 - RNA, 22 nt, Bordetella pertussis
uggcgcccggccugcgggcgcc

SEQ ID NO: 2407912 - RNA, 23 nt, Bordetella pertussis
uggcgcccggccugcgggcgccg

SEQ ID NO: 2407913 - RNA, 18 nt, Bordetella pertussis
uggcgcccggcggcgcgg

SEQ ID NO: 2407914 - RNA, 17 nt, Bordetella pertussis
uggcgccgaaggcggcg

SEQ ID NO: 2407915 - RNA, 19 nt, Bordetella pertussis
uggcgccgaaggcggcgcc

SEQ ID NO: 2407916 - RNA, 17 nt, Bordetella pertussis
uggcgccgacccugccc

SEQ ID NO: 2407917 - RNA, 20 nt, Bordetella pertussis
uggcgccgacccugcccggc

SEQ ID NO: 2407918 - RNA, 14 nt, Bordetella pertussis
uggcgccgauggcg

SEQ ID NO: 2407919 - RNA, 18 nt, Bordetella pertussis
uggcgccgauggcgccgc

SEQ ID NO: 2407920 - RNA, 21 nt, Bordetella pertussis
uggcgccgcacaucgucgacg

SEQ ID NO: 2407921 - RNA, 14 nt, Bordetella pertussis
uggcgccgcgcccg

SEQ ID NO: 2407922 - RNA, 13 nt, Bordetella pertussis
uggcgccgcgccg

SEQ ID NO: 2407923 - RNA, 21 nt, Bordetella pertussis
uggcgccgcgccgccgccugg

SEQ ID NO: 2407924 - RNA, 12 nt, Bordetella pertussis
uggcgccgcgcg

SEQ ID NO: 2407925 - RNA, 13 nt, Bordetella pertussis
uggcgccgcgcgc

SEQ ID NO: 2407926 - RNA, 16 nt, Bordetella pertussis
uggcgccgcgcgccau

SEQ ID NO: 2407927 - RNA, 20 nt, Bordetella pertussis
uggcgccgcgcucgcgccag

SEQ ID NO: 2407928 - RNA, 15 nt, Bordetella pertussis
uggcgccgcgggccu

SEQ ID NO: 2407929 - RNA, 22 nt, Bordetella pertussis
uggcgccgcugucgcugaucug

SEQ ID NO: 2407930 - RNA, 23 nt, Bordetella pertussis
uggcgccgcugucgcugaucugc

SEQ ID NO: 2407931 - RNA, 19 nt, Bordetella pertussis
uggcgccggacugggcguc

SEQ ID NO: 2407932 - RNA, 18 nt, Bordetella pertussis
uggcgccggccaccgccu

SEQ ID NO: 2407933 - RNA, 13 nt, Bordetella pertussis
uggcgccggccag

SEQ ID NO: 2407934 - RNA, 14 nt, Bordetella pertussis
uggcgccggccagc

SEQ ID NO: 2407935 - RNA, 16 nt, Bordetella pertussis
uggcgccggccagcgc

SEQ ID NO: 2407936 - RNA, 19 nt, Bordetella pertussis
uggcgccggccagcgcgcc

SEQ ID NO: 2407937 - RNA, 12 nt, Bordetella pertussis
uggcgccggccg

SEQ ID NO: 2407938 - RNA, 17 nt, Bordetella pertussis
uggcgccggcggccucc

SEQ ID NO: 2407939 - RNA, 23 nt, Bordetella pertussis
uggcgccggcuucgucauggucg

SEQ ID NO: 2407940 - RNA, 23 nt, Bordetella pertussis
uggcgccggucugggcgcggaac

SEQ ID NO: 2407941 - RNA, 22 nt, Bordetella pertussis
uggcgccguguuguccuggaca

SEQ ID NO: 2407942 - RNA, 17 nt, Bordetella pertussis
uggcgccguuccugcag

SEQ ID NO: 2407943 - RNA, 18 nt, Bordetella pertussis
uggcgccguuccugcagc

SEQ ID NO: 2407944 - RNA, 23 nt, Bordetella pertussis
uggcgccguuccugcagcgugcu

SEQ ID NO: 2407945 - RNA, 20 nt, Bordetella pertussis
uggcgccguucgucgcgcag

SEQ ID NO: 2407946 - RNA, 17 nt, Bordetella pertussis
uggcgccuuccggcagc

SEQ ID NO: 2407947 - RNA, 20 nt, Bordetella pertussis
uggcgccuuccggcagcggc

SEQ ID NO: 2407948 - RNA, 22 nt, Bordetella pertussis
uggcgccuucgaacucgauggc

SEQ ID NO: 2407949 - RNA, 20 nt, Bordetella pertussis
uggcgcgauccuucgcggcc

SEQ ID NO: 2407950 - RNA, 21 nt, Bordetella pertussis
uggcgcgauccuucgcggccg

SEQ ID NO: 2407951 - RNA, 23 nt, Bordetella pertussis
uggcgcgaugugacggcucgaug

SEQ ID NO: 2407952 - RNA, 19 nt, Bordetella pertussis
uggcgcgcaaccaggggcg

SEQ ID NO: 2407953 - RNA, 14 nt, Bordetella pertussis
uggcgcgcaccauc

SEQ ID NO: 2407954 - RNA, 18 nt, Bordetella pertussis
uggcgcgcaccaucgccg

SEQ ID NO: 2407955 - RNA, 15 nt, Bordetella pertussis
uggcgcgcaccuggg

SEQ ID NO: 2407956 - RNA, 19 nt, Bordetella pertussis
uggcgcgcaccugggaggg

SEQ ID NO: 2407957 - RNA, 15 nt, Bordetella pertussis
uggcgcgcagcagcg

SEQ ID NO: 2407958 - RNA, 19 nt, Bordetella pertussis
uggcgcgcaucggcgccga

SEQ ID NO: 2407959 - RNA, 20 nt, Bordetella pertussis
uggcgcgccaggaagcgcgc

SEQ ID NO: 2407960 - RNA, 23 nt, Bordetella pertussis
uggcgcgccgccucgcgcuccag

SEQ ID NO: 2407961 - RNA, 14 nt, Bordetella pertussis
uggcgcgccggauc

SEQ ID NO: 2407962 - RNA, 15 nt, Bordetella pertussis
uggcgcgccguggcu

SEQ ID NO: 2407963 - RNA, 19 nt, Bordetella pertussis
uggcgcgccuugcgcggcg

SEQ ID NO: 2407964 - RNA, 21 nt, Bordetella pertussis
uggcgcgcgaccaggcuggag

SEQ ID NO: 2407965 - RNA, 18 nt, Bordetella pertussis
uggcgcgcgacggcgccg

SEQ ID NO: 2407966 - RNA, 19 nt, Bordetella pertussis
uggcgcgcgccgaugcgcc

SEQ ID NO: 2407967 - RNA, 17 nt, Bordetella pertussis
uggcgcgcggauccagc

SEQ ID NO: 2407968 - RNA, 13 nt, Bordetella pertussis
uggcgcgcggccu

SEQ ID NO: 2407969 - RNA, 17 nt, Bordetella pertussis
uggcgcgcggccugggc

SEQ ID NO: 2407970 - RNA, 19 nt, Bordetella pertussis
uggcgcgcggccugggcgg

SEQ ID NO: 2407971 - RNA, 20 nt, Bordetella pertussis
uggcgcgcggccugggcggc

SEQ ID NO: 2407972 - RNA, 14 nt, Bordetella pertussis
uggcgcgcggcugg

SEQ ID NO: 2407973 - RNA, 19 nt, Bordetella pertussis
uggcgcgcggcuggcuguu

SEQ ID NO: 2407974 - RNA, 15 nt, Bordetella pertussis
uggcgcgcggcuggg

SEQ ID NO: 2407975 - RNA, 18 nt, Bordetella pertussis
uggcgcgcggcuggggcu

SEQ ID NO: 2407976 - RNA, 19 nt, Bordetella pertussis
uggcgcgcggcuggggcug

SEQ ID NO: 2407977 - RNA, 23 nt, Bordetella pertussis
uggcgcgcggcuggggcugcugg

SEQ ID NO: 2407978 - RNA, 19 nt, Bordetella pertussis
uggcgcgcuguucggcgau

SEQ ID NO: 2407979 - RNA, 20 nt, Bordetella pertussis
uggcgcggaugaccugcgcc

SEQ ID NO: 2407980 - RNA, 16 nt, Bordetella pertussis
uggcgcggccggaggc

SEQ ID NO: 2407981 - RNA, 23 nt, Bordetella pertussis
uggcgcggccggaggccgcccac

SEQ ID NO: 2407982 - RNA, 19 nt, Bordetella pertussis
uggcgcggcgccugcgcgc

SEQ ID NO: 2407983 - RNA, 20 nt, Bordetella pertussis
uggcgcggcgccugcgcgcg

SEQ ID NO: 2407984 - RNA, 21 nt, Bordetella pertussis
uggcgcggcgcuacgccgccg

SEQ ID NO: 2407985 - RNA, 15 nt, Bordetella pertussis
uggcgcggcggccag

SEQ ID NO: 2407986 - RNA, 18 nt, Bordetella pertussis
uggcgcggcggccaggcg

SEQ ID NO: 2407987 - RNA, 19 nt, Bordetella pertussis
uggcgcggcggccaggcgu

SEQ ID NO: 2407988 - RNA, 13 nt, Bordetella pertussis
uggcgcggcuggc

SEQ ID NO: 2407989 - RNA, 15 nt, Bordetella pertussis
uggcgcggcuggcga

SEQ ID NO: 2407990 - RNA, 20 nt, Bordetella pertussis
uggcgcgguccacgcccugg

SEQ ID NO: 2407991 - RNA, 21 nt, Bordetella pertussis
uggcgcgguccacgcccuggc

SEQ ID NO: 2407992 - RNA, 21 nt, Bordetella pertussis
uggcgcgguccacgcgggcau

SEQ ID NO: 2407993 - RNA, 18 nt, Bordetella pertussis
uggcgcgucgccgcgccg

SEQ ID NO: 2407994 - RNA, 19 nt, Bordetella pertussis
uggcgcgugcgcgcgccau

SEQ ID NO: 2407995 - RNA, 18 nt, Bordetella pertussis
uggcgcgugucaugcugu

SEQ ID NO: 2407996 - RNA, 12 nt, Bordetella pertussis
uggcgcuccagc

SEQ ID NO: 2407997 - RNA, 13 nt, Bordetella pertussis
uggcgcuccagcc

SEQ ID NO: 2407998 - RNA, 17 nt, Bordetella pertussis
uggcgcuccaugcggcg

SEQ ID NO: 2407999 - RNA, 19 nt, Bordetella pertussis
uggcgcuccucgcgcgcgg

SEQ ID NO: 2408000 - RNA, 14 nt, Bordetella pertussis
uggcgcucgggcgc

SEQ ID NO: 2408001 - RNA, 15 nt, Bordetella pertussis
uggcgcucgggcgcg

SEQ ID NO: 2408002 - RNA, 16 nt, Bordetella pertussis
uggcgcucgggcgcgg

SEQ ID NO: 2408003 - RNA, 17 nt, Bordetella pertussis
uggcgcucgggcgcggc

SEQ ID NO: 2408004 - RNA, 15 nt, Bordetella pertussis
uggcgcugcacaggg

SEQ ID NO: 2408005 - RNA, 19 nt, Bordetella pertussis
uggcgcugcacagggacca

SEQ ID NO: 2408006 - RNA, 14 nt, Bordetella pertussis
uggcgcugcagcgu

SEQ ID NO: 2408007 - RNA, 21 nt, Bordetella pertussis
uggcgcugcagcgucugcugg

SEQ ID NO: 2408008 - RNA, 15 nt, Bordetella pertussis
uggcgcugcugcugg

SEQ ID NO: 2408009 - RNA, 16 nt, Bordetella pertussis
uggcgcugcugcuggc

SEQ ID NO: 2408010 - RNA, 20 nt, Bordetella pertussis
uggcgcugcugcuggcugcc

SEQ ID NO: 2408011 - RNA, 14 nt, Bordetella pertussis
uggcgcuggccgcc

SEQ ID NO: 2408012 - RNA, 21 nt, Bordetella pertussis
uggcgcuguuuccgggccugg

SEQ ID NO: 2408013 - RNA, 19 nt, Bordetella pertussis
uggcgcuugugcgucggcu

SEQ ID NO: 2408014 - RNA, 18 nt, Bordetella pertussis
uggcggacacgcccuggc

SEQ ID NO: 2408015 - RNA, 19 nt, Bordetella pertussis
uggcggaccgaacggccgg

SEQ ID NO: 2408016 - RNA, 22 nt, Bordetella pertussis
uggcggaccgaacggccgguca

SEQ ID NO: 2408017 - RNA, 17 nt, Bordetella pertussis
uggcggacgauggccug

SEQ ID NO: 2408018 - RNA, 23 nt, Bordetella pertussis
uggcggcagcucgcgcugcgcgc

SEQ ID NO: 2408019 - RNA, 16 nt, Bordetella pertussis
uggcggcaggcgcgag

SEQ ID NO: 2408020 - RNA, 13 nt, Bordetella pertussis
uggcggccacaac

SEQ ID NO: 2408021 - RNA, 11 nt, Bordetella pertussis
uggcggccagg

SEQ ID NO: 2408022 - RNA, 14 nt, Bordetella pertussis
uggcggccaggccg

SEQ ID NO: 2408023 - RNA, 20 nt, Bordetella pertussis
uggcggccaggccggggccg

SEQ ID NO: 2408024 - RNA, 23 nt, Bordetella pertussis
uggcggcccuguucgcgcggccc

SEQ ID NO: 2408025 - RNA, 16 nt, Bordetella pertussis
uggcggccgccagcgc

SEQ ID NO: 2408026 - RNA, 16 nt, Bordetella pertussis
uggcggccgcccagca

SEQ ID NO: 2408027 - RNA, 16 nt, Bordetella pertussis
uggcggccgccgccag

SEQ ID NO: 2408028 - RNA, 20 nt, Bordetella pertussis
uggcggccgcgggcagcaau

SEQ ID NO: 2408029 - RNA, 16 nt, Bordetella pertussis
uggcggccgcgggcgu

SEQ ID NO: 2408030 - RNA, 13 nt, Bordetella pertussis
uggcggccgugcc

SEQ ID NO: 2408031 - RNA, 21 nt, Bordetella pertussis
uggcggccguuggcgugcagc

SEQ ID NO: 2408032 - RNA, 22 nt, Bordetella pertussis
uggcggccuggccgcgcgccug

SEQ ID NO: 2408033 - RNA, 19 nt, Bordetella pertussis
uggcggccuucaugaucug

SEQ ID NO: 2408034 - RNA, 21 nt, Bordetella pertussis
uggcggccuucaugaucuggc

SEQ ID NO: 2408035 - RNA, 20 nt, Bordetella pertussis
uggcggccuugcgggccggc

SEQ ID NO: 2408036 - RNA, 14 nt, Bordetella pertussis
uggcggcgaugccg

SEQ ID NO: 2408037 - RNA, 15 nt, Bordetella pertussis
uggcggcgaugccgc

SEQ ID NO: 2408038 - RNA, 19 nt, Bordetella pertussis
uggcggcgauguggcgcgc

SEQ ID NO: 2408039 - RNA, 20 nt, Bordetella pertussis
uggcggcgauguggcgcgcc

SEQ ID NO: 2408040 - RNA, 17 nt, Bordetella pertussis
uggcggcgcagcaccag

SEQ ID NO: 2408041 - RNA, 18 nt, Bordetella pertussis
uggcggcgcagcgcccag

SEQ ID NO: 2408042 - RNA, 20 nt, Bordetella pertussis
uggcggcgcagcgcccaggc

SEQ ID NO: 2408043 - RNA, 17 nt, Bordetella pertussis
uggcggcgcgcggcugg

SEQ ID NO: 2408044 - RNA, 22 nt, Bordetella pertussis
uggcggcgcgcuuggucagcau

SEQ ID NO: 2408045 - RNA, 15 nt, Bordetella pertussis
uggcggcgcuggcgu

SEQ ID NO: 2408046 - RNA, 15 nt, Bordetella pertussis
uggcggcgguagcgc

SEQ ID NO: 2408047 - RNA, 16 nt, Bordetella pertussis
uggcggcuggcgcggc

SEQ ID NO: 2408048 - RNA, 18 nt, Bordetella pertussis
uggcggcuggcgcggccg

SEQ ID NO: 2408049 - RNA, 16 nt, Bordetella pertussis
uggcggcugucgggcg

SEQ ID NO: 2408050 - RNA, 12 nt, Bordetella pertussis
uggcgggccagc

SEQ ID NO: 2408051 - RNA, 14 nt, Bordetella pertussis
uggcgggccagcuc

SEQ ID NO: 2408052 - RNA, 15 nt, Bordetella pertussis
uggcgggccgcgccg

SEQ ID NO: 2408053 - RNA, 19 nt, Bordetella pertussis
uggcgggcgagaucagcca

SEQ ID NO: 2408054 - RNA, 15 nt, Bordetella pertussis
uggcggggcguucga

SEQ ID NO: 2408055 - RNA, 18 nt, Bordetella pertussis
uggcggguccacguggcg

SEQ ID NO: 2408056 - RNA, 19 nt, Bordetella pertussis
uggcgggugcugcagcgca

SEQ ID NO: 2408057 - RNA, 14 nt, Bordetella pertussis
uggcggucaccaac

SEQ ID NO: 2408058 - RNA, 16 nt, Bordetella pertussis
uggcggucaccaacgc

SEQ ID NO: 2408059 - RNA, 23 nt, Bordetella pertussis
uggcggugaaggcgcccgggcug

SEQ ID NO: 2408060 - RNA, 11 nt, Bordetella pertussis
uggcggugcgc

SEQ ID NO: 2408061 - RNA, 14 nt, Bordetella pertussis
uggcggugcgccgc

SEQ ID NO: 2408062 - RNA, 22 nt, Bordetella pertussis
uggcggugcgccgcaugcggcg

SEQ ID NO: 2408063 - RNA, 14 nt, Bordetella pertussis
uggcgguggccagc

SEQ ID NO: 2408064 - RNA, 18 nt, Bordetella pertussis
uggcgguggccagcgccu

SEQ ID NO: 2408065 - RNA, 13 nt, Bordetella pertussis
uggcggugguggc

SEQ ID NO: 2408066 - RNA, 19 nt, Bordetella pertussis
uggcgguuguugcccaccg

SEQ ID NO: 2408067 - RNA, 14 nt, Bordetella pertussis
uggcguacagcagg

SEQ ID NO: 2408068 - RNA, 15 nt, Bordetella pertussis
uggcguacagcaggg

SEQ ID NO: 2408069 - RNA, 17 nt, Bordetella pertussis
uggcguaggcggccuug

SEQ ID NO: 2408070 - RNA, 20 nt, Bordetella pertussis
uggcguauggaauacgccga

SEQ ID NO: 2408071 - RNA, 15 nt, Bordetella pertussis
uggcguccaccuuga

SEQ ID NO: 2408072 - RNA, 14 nt, Bordetella pertussis
uggcguccagcagc

SEQ ID NO: 2408073 - RNA, 15 nt, Bordetella pertussis
uggcguccagcagca

SEQ ID NO: 2408074 - RNA, 15 nt, Bordetella pertussis
uggcguccagccugc

SEQ ID NO: 2408075 - RNA, 23 nt, Bordetella pertussis
uggcguccagccugcccgggcag

SEQ ID NO: 2408076 - RNA, 16 nt, Bordetella pertussis
uggcguccaggcgcgc

SEQ ID NO: 2408077 - RNA, 20 nt, Bordetella pertussis
uggcguccaggcgcgccagc

SEQ ID NO: 2408078 - RNA, 22 nt, Bordetella pertussis
uggcguccgauaucccauggga

SEQ ID NO: 2408079 - RNA, 16 nt, Bordetella pertussis
uggcguccggccccag

SEQ ID NO: 2408080 - RNA, 14 nt, Bordetella pertussis
uggcgucgaucaug

SEQ ID NO: 2408081 - RNA, 18 nt, Bordetella pertussis
uggcgucgaucaugaugc

SEQ ID NO: 2408082 - RNA, 17 nt, Bordetella pertussis
uggcgucguggggcgcg

SEQ ID NO: 2408083 - RNA, 12 nt, Bordetella pertussis
uggcgugcagcc

SEQ ID NO: 2408084 - RNA, 17 nt, Bordetella pertussis
uggcgugcaggccggcg

SEQ ID NO: 2408085 - RNA, 14 nt, Bordetella pertussis
uggcgugcaggcug

SEQ ID NO: 2408086 - RNA, 23 nt, Bordetella pertussis
uggcgugcagguacgccaugcga

SEQ ID NO: 2408087 - RNA, 20 nt, Bordetella pertussis
uggcgugcagguacugggcc

SEQ ID NO: 2408088 - RNA, 22 nt, Bordetella pertussis
uggcgugcagguacugggccac

SEQ ID NO: 2408089 - RNA, 15 nt, Bordetella pertussis
uggcguggcgcgcgc

SEQ ID NO: 2408090 - RNA, 15 nt, Bordetella pertussis
uggcguggcuggcgu

SEQ ID NO: 2408091 - RNA, 23 nt, Bordetella pertussis
uggcguguccgccguagcgcgcc

SEQ ID NO: 2408092 - RNA, 17 nt, Bordetella pertussis
uggcgugucuccgggcg

SEQ ID NO: 2408093 - RNA, 16 nt, Bordetella pertussis
uggcguucaaucgcgc

SEQ ID NO: 2408094 - RNA, 18 nt, Bordetella pertussis
uggcguucagcgggcgcg

SEQ ID NO: 2408095 - RNA, 16 nt, Bordetella pertussis
uggcguucgcgcgcgg

SEQ ID NO: 2408096 - RNA, 21 nt, Bordetella pertussis
uggcguucgcggugggcagcg

SEQ ID NO: 2408097 - RNA, 18 nt, Bordetella pertussis
uggcguucucgacccgcu

SEQ ID NO: 2408098 - RNA, 19 nt, Bordetella pertussis
uugaccacggccagcagca

SEQ ID NO: 2408099 - RNA, 17 nt, Bordetella pertussis
uugaccagcaccagcgc

SEQ ID NO: 2408100 - RNA, 21 nt, Bordetella pertussis
uugaccgccucgaucgccagg

SEQ ID NO: 2408101 - RNA, 16 nt, Bordetella pertussis
uugaccuggucggccu

SEQ ID NO: 2408102 - RNA, 16 nt, Bordetella pertussis
uugacgaucucgcccu

SEQ ID NO: 2408103 - RNA, 16 nt, Bordetella pertussis
uugacgaugcccaggu

SEQ ID NO: 2408104 - RNA, 22 nt, Bordetella pertussis
uugacgccggcuucagccgcaa

SEQ ID NO: 2408105 - RNA, 13 nt, Bordetella pertussis
uugacgcgcgcgg

SEQ ID NO: 2408106 - RNA, 17 nt, Bordetella pertussis
uugacgcugcucuuggc

SEQ ID NO: 2408107 - RNA, 13 nt, Bordetella pertussis
uugacggccagga

SEQ ID NO: 2408108 - RNA, 15 nt, Bordetella pertussis
uugacggccaggacg

SEQ ID NO: 2408109 - RNA, 18 nt, Bordetella pertussis
uugagaaugcccaggaug

SEQ ID NO: 2408110 - RNA, 15 nt, Bordetella pertussis
uugagaugccagcgg

SEQ ID NO: 2408111 - RNA, 16 nt, Bordetella pertussis
uugagcaacgugcgca

SEQ ID NO: 2408112 - RNA, 16 nt, Bordetella pertussis
uugagcagcaugugcu

SEQ ID NO: 2408113 - RNA, 22 nt, Bordetella pertussis
uugagcguggcguccaugcuga

SEQ ID NO: 2408114 - RNA, 23 nt, Bordetella pertussis
uugaggaacuggacggcgcuggg

SEQ ID NO: 2408115 - RNA, 13 nt, Bordetella pertussis
uugaggccagcac

SEQ ID NO: 2408116 - RNA, 14 nt, Bordetella pertussis
uugagggcguacga

SEQ ID NO: 2408117 - RNA, 14 nt, Bordetella pertussis
uugaguacgacgcc

SEQ ID NO: 2408118 - RNA, 17 nt, Bordetella pertussis
uugauccagcgcucggg

SEQ ID NO: 2408119 - RNA, 13 nt, Bordetella pertussis
uugaugcccagcu

SEQ ID NO: 2408120 - RNA, 10 nt, Bordetella pertussis
uugaugccgc

SEQ ID NO: 2408121 - RNA, 14 nt, Bordetella pertussis
uugaugccgcccag

SEQ ID NO: 2408122 - RNA, 14 nt, Bordetella pertussis
uugaugccgucggc

SEQ ID NO: 2408123 - RNA, 21 nt, Bordetella pertussis
uugaugcgggucaaggcgggg

SEQ ID NO: 2408124 - RNA, 23 nt, Bordetella pertussis
uugaugcgggucaaggcggggcu

SEQ ID NO: 2408125 - RNA, 14 nt, Bordetella pertussis
uugauggccagcgc

SEQ ID NO: 2408126 - RNA, 18 nt, Bordetella pertussis
uugauggccagcgcgcgg

SEQ ID NO: 2408127 - RNA, 23 nt, Bordetella pertussis
uugauggcgauggcuuggcgcuu

SEQ ID NO: 2408128 - RNA, 18 nt, Bordetella pertussis
uugauggggccgcgccgu

SEQ ID NO: 2408129 - RNA, 18 nt, Bordetella pertussis
uugcaaauucugcaaaag

SEQ ID NO: 2408130 - RNA, 20 nt, Bordetella pertussis
uugcaccagugcgccggcgc

SEQ ID NO: 2408131 - RNA, 24 nt, Bordetella pertussis
uugcaccgcgucggccugccagcc

SEQ ID NO: 2408132 - RNA, 19 nt, Bordetella pertussis
uugcacggugccgcgcgcu

SEQ ID NO: 2408133 - RNA, 14 nt, Bordetella pertussis
uugcagcagcacgc

SEQ ID NO: 2408134 - RNA, 18 nt, Bordetella pertussis
uugcagcgcgccaggcgc

SEQ ID NO: 2408135 - RNA, 11 nt, Bordetella pertussis
uugcagcggcg

SEQ ID NO: 2408136 - RNA, 17 nt, Bordetella pertussis
uugcagggugucggcca

SEQ ID NO: 2408137 - RNA, 20 nt, Bordetella pertussis
uugcagggugucggccaggg

SEQ ID NO: 2408138 - RNA, 15 nt, Bordetella pertussis
uugcaguucgccggc

SEQ ID NO: 2408139 - RNA, 17 nt, Bordetella pertussis
uugcaguucgccggcgc

SEQ ID NO: 2408140 - RNA, 12 nt, Bordetella pertussis
uugcaucuccag

SEQ ID NO: 2408141 - RNA, 14 nt, Bordetella pertussis
uugccaagauggcc

SEQ ID NO: 2408142 - RNA, 20 nt, Bordetella pertussis
uugccaagauggcccagggc

SEQ ID NO: 2408143 - RNA, 14 nt, Bordetella pertussis
uugccacggcgggc

SEQ ID NO: 2408144 - RNA, 23 nt, Bordetella pertussis
uugccacuauuuucagaagcgcc

SEQ ID NO: 2408145 - RNA, 18 nt, Bordetella pertussis
uugccagggccuggcaca

SEQ ID NO: 2408146 - RNA, 14 nt, Bordetella pertussis
uugcccaccacggc

SEQ ID NO: 2408147 - RNA, 12 nt, Bordetella pertussis
uugcccagcacc

SEQ ID NO: 2408148 - RNA, 15 nt, Bordetella pertussis
uugcccagcagcucc

SEQ ID NO: 2408149 - RNA, 18 nt, Bordetella pertussis
uugccccgauccgcgggc

SEQ ID NO: 2408150 - RNA, 19 nt, Bordetella pertussis
uugcccgagcgcgacagca

SEQ ID NO: 2408151 - RNA, 22 nt, Bordetella pertussis
uugcccgagcgcgacagcacca

SEQ ID NO: 2408152 - RNA, 17 nt, Bordetella pertussis
uugcccgccccgugcac

SEQ ID NO: 2408153 - RNA, 12 nt, Bordetella pertussis
uugcccgucagc

SEQ ID NO: 2408154 - RNA, 20 nt, Bordetella pertussis
uugcccgucagcggcgcgcc

SEQ ID NO: 2408155 - RNA, 12 nt, Bordetella pertussis
uugcccuggcca

SEQ ID NO: 2408156 - RNA, 17 nt, Bordetella pertussis
uugcccuucggggcagc

SEQ ID NO: 2408157 - RNA, 16 nt, Bordetella pertussis
uugcccuugaauucca

SEQ ID NO: 2408158 - RNA, 16 nt, Bordetella pertussis
uugccgaagcgucggc

SEQ ID NO: 2408159 - RNA, 21 nt, Bordetella pertussis
uugccgaagcgucggccugca

SEQ ID NO: 2408160 - RNA, 13 nt, Bordetella pertussis
uugccgaccucca

SEQ ID NO: 2408161 - RNA, 21 nt, Bordetella pertussis
uugccgcacgaucgcgccggc

SEQ ID NO: 2408162 - RNA, 12 nt, Bordetella pertussis
uugccgccgccc

SEQ ID NO: 2408163 - RNA, 19 nt, Bordetella pertussis
uugccgccgccgcgcgcgg

SEQ ID NO: 2408164 - RNA, 21 nt, Bordetella pertussis
uugccgcgcggcgcguucagc

SEQ ID NO: 2408165 - RNA, 17 nt, Bordetella pertussis
uugccgcggcgcggccu

SEQ ID NO: 2408166 - RNA, 14 nt, Bordetella pertussis
uugccggagcagca

SEQ ID NO: 2408167 - RNA, 18 nt, Bordetella pertussis
uugccggaggucggcgca

SEQ ID NO: 2408168 - RNA, 20 nt, Bordetella pertussis
uugccggccgcccaggcgca

SEQ ID NO: 2408169 - RNA, 13 nt, Bordetella pertussis
uugccggcgcgca

SEQ ID NO: 2408170 - RNA, 18 nt, Bordetella pertussis
uugccggcgcgcaaaccg

SEQ ID NO: 2408171 - RNA, 14 nt, Bordetella pertussis
uugccggugcgcgu

SEQ ID NO: 2408172 - RNA, 15 nt, Bordetella pertussis
uugccggugcucggc

SEQ ID NO: 2408173 - RNA, 17 nt, Bordetella pertussis
uugccgucggccgcgcc

SEQ ID NO: 2408174 - RNA, 17 nt, Bordetella pertussis
uugccguucaugccgac

SEQ ID NO: 2408175 - RNA, 16 nt, Bordetella pertussis
uugccguuguccgccu

SEQ ID NO: 2408176 - RNA, 12 nt, Bordetella pertussis
uugccugggugc

SEQ ID NO: 2408177 - RNA, 18 nt, Bordetella pertussis
uugccugggugcuggugc

SEQ ID NO: 2408178 - RNA, 16 nt, Bordetella pertussis
uugccuuggggcggcc

SEQ ID NO: 2408179 - RNA, 19 nt, Bordetella pertussis
uugcgaacggccgcccggc

SEQ ID NO: 2408180 - RNA, 16 nt, Bordetella pertussis
uugcgacgccgccgau

SEQ ID NO: 2408181 - RNA, 22 nt, Bordetella pertussis
uugcgcaagccggccgcgccgc

SEQ ID NO: 2408182 - RNA, 15 nt, Bordetella pertussis
uugcgcaccaugugc

SEQ ID NO: 2408183 - RNA, 21 nt, Bordetella pertussis
uugcgcaccccggugucgccg

SEQ ID NO: 2408184 - RNA, 12 nt, Bordetella pertussis
uugcgcacggcg

SEQ ID NO: 2408185 - RNA, 15 nt, Bordetella pertussis
uugcgcacggcggcg

SEQ ID NO: 2408186 - RNA, 15 nt, Bordetella pertussis
uugcgcagcgcggcg

SEQ ID NO: 2408187 - RNA, 16 nt, Bordetella pertussis
uugcgcaucgcgcacc

SEQ ID NO: 2408188 - RNA, 14 nt, Bordetella pertussis
uugcgccacgcccg

SEQ ID NO: 2408189 - RNA, 13 nt, Bordetella pertussis
uugcgccccgcca

SEQ ID NO: 2408190 - RNA, 16 nt, Bordetella pertussis
uugcgcccgcaucggc

SEQ ID NO: 2408191 - RNA, 22 nt, Bordetella pertussis
uugcgcccgcaucggcuggcgc

SEQ ID NO: 2408192 - RNA, 16 nt, Bordetella pertussis
uugcgccgcccgugcc

SEQ ID NO: 2408193 - RNA, 22 nt, Bordetella pertussis
uugcgccggcgcuacagggugc

SEQ ID NO: 2408194 - RNA, 20 nt, Bordetella pertussis
uugcgccguugcgggcugcg

SEQ ID NO: 2408195 - RNA, 15 nt, Bordetella pertussis
uugcgcgccaguuca

SEQ ID NO: 2408196 - RNA, 15 nt, Bordetella pertussis
uugcgcggccagggc

SEQ ID NO: 2408197 - RNA, 13 nt, Bordetella pertussis
uugcgcggcgcgu

SEQ ID NO: 2408198 - RNA, 16 nt, Bordetella pertussis
uugcgcguccaggcca

SEQ ID NO: 2408199 - RNA, 22 nt, Bordetella pertussis
uugcgcugcccgucgcuggcgc

SEQ ID NO: 2408200 - RNA, 17 nt, Bordetella pertussis
uugcgcuggcgcgcggc

SEQ ID NO: 2408201 - RNA, 14 nt, Bordetella pertussis
uugcggcagcgccg

SEQ ID NO: 2408202 - RNA, 13 nt, Bordetella pertussis
uugcggcaggugc

SEQ ID NO: 2408203 - RNA, 15 nt, Bordetella pertussis
uugcggcccuugcgc

SEQ ID NO: 2408204 - RNA, 13 nt, Bordetella pertussis
uugcggccgccac

SEQ ID NO: 2408205 - RNA, 13 nt, Bordetella pertussis
uugcggccgccga

SEQ ID NO: 2408206 - RNA, 18 nt, Bordetella pertussis
uugcggcgcgaccugcgc

SEQ ID NO: 2408207 - RNA, 13 nt, Bordetella pertussis
uugcggcgcuggc

SEQ ID NO: 2408208 - RNA, 14 nt, Bordetella pertussis
uugcggcgcuuggc

SEQ ID NO: 2408209 - RNA, 13 nt, Bordetella pertussis
uugcgggccggcg

SEQ ID NO: 2408210 - RNA, 21 nt, Bordetella pertussis
uugcgggccggcugggcggcc

SEQ ID NO: 2408211 - RNA, 23 nt, Bordetella pertussis
uugcgggccuacuucggcagcuu

SEQ ID NO: 2408212 - RNA, 20 nt, Bordetella pertussis
uugcgggucgucccagcgca

SEQ ID NO: 2408213 - RNA, 21 nt, Bordetella pertussis
uugcgguaguucagcagcgcc

SEQ ID NO: 2408214 - RNA, 15 nt, Bordetella pertussis
uugcgucccaccugc

SEQ ID NO: 2408215 - RNA, 15 nt, Bordetella pertussis
uugcguccggcgcgc

SEQ ID NO: 2408216 - RNA, 18 nt, Bordetella pertussis
uugcgucuccacgccgcc

SEQ ID NO: 2408217 - RNA, 15 nt, Bordetella pertussis
uugcgucuccagcgc

SEQ ID NO: 2408218 - RNA, 19 nt, Bordetella pertussis
uugcgucuccagcgcggcg

SEQ ID NO: 2408219 - RNA, 15 nt, Bordetella pertussis
uugcgugccgcccag

SEQ ID NO: 2408220 - RNA, 23 nt, Bordetella pertussis
uugcgugggcuccguuccgaugc

SEQ ID NO: 2408221 - RNA, 19 nt, Bordetella pertussis
uugcucgacauagagauug

SEQ ID NO: 2408222 - RNA, 15 nt, Bordetella pertussis
uugcucgaccagguc

SEQ ID NO: 2408223 - RNA, 15 nt, Bordetella pertussis
uugcucgugcuggcc

SEQ ID NO: 2408224 - RNA, 13 nt, Bordetella pertussis
uugcucuugaccu

SEQ ID NO: 2408225 - RNA, 16 nt, Bordetella pertussis
uugcugaaccugcugg

SEQ ID NO: 2408226 - RNA, 18 nt, Bordetella pertussis
uugcugaaccugcuggcc

SEQ ID NO: 2408227 - RNA, 15 nt, Bordetella pertussis
uugcugcugcuggcu

SEQ ID NO: 2408228 - RNA, 19 nt, Bordetella pertussis
uugcuggcaaagcgcgcgu

SEQ ID NO: 2408229 - RNA, 14 nt, Bordetella pertussis
uugcuggcccagga

SEQ ID NO: 2408230 - RNA, 23 nt, Bordetella pertussis
uuggacagcaguucggccggcgg

SEQ ID NO: 2408231 - RNA, 15 nt, Bordetella pertussis
uuggacaggcgugcg

SEQ ID NO: 2408232 - RNA, 21 nt, Bordetella pertussis
uuggcaaccucgccgcgccag

SEQ ID NO: 2408233 - RNA, 12 nt, Bordetella pertussis
uuggcaggccag

SEQ ID NO: 2408234 - RNA, 23 nt, Bordetella pertussis
uuggcauggcgcgugcgcgcgcc

SEQ ID NO: 2408235 - RNA, 14 nt, Bordetella pertussis
uuggccaaugcgcc

SEQ ID NO: 2408236 - RNA, 18 nt, Bordetella pertussis
uuggccacuuccagcgcc

SEQ ID NO: 2408237 - RNA, 14 nt, Bordetella pertussis
uuggccagcagcgc

SEQ ID NO: 2408238 - RNA, 17 nt, Bordetella pertussis
uuggccagcagcgcauc

SEQ ID NO: 2408239 - RNA, 10 nt, Bordetella pertussis
uuggccagcg

SEQ ID NO: 2408240 - RNA, 20 nt, Bordetella pertussis
uuggccagcgcgacggccuc

SEQ ID NO: 2408241 - RNA, 15 nt, Bordetella pertussis
uuggccgcagccggc

SEQ ID NO: 2408242 - RNA, 11 nt, Bordetella pertussis
uuggccgccag

SEQ ID NO: 2408243 - RNA, 22 nt, Bordetella pertussis
uuggccgccagccggcccgaca

SEQ ID NO: 2408244 - RNA, 18 nt, Bordetella pertussis
uuggccgccaggacuucg

SEQ ID NO: 2408245 - RNA, 17 nt, Bordetella pertussis
uuggccgcccuggcgcg

SEQ ID NO: 2408246 - RNA, 18 nt, Bordetella pertussis
uuggccggcgcgcccuug

SEQ ID NO: 2408247 - RNA, 17 nt, Bordetella pertussis
uuggccgucgccagcga

SEQ ID NO: 2408248 - RNA, 12 nt, Bordetella pertussis
uuggccugggcc

SEQ ID NO: 2408249 - RNA, 16 nt, Bordetella pertussis
uuggccuucggcgauc

SEQ ID NO: 2408250 - RNA, 15 nt, Bordetella pertussis
uuggccuugacggcg

SEQ ID NO: 2408251 - RNA, 17 nt, Bordetella pertussis
uuggccuugcgcgucca

SEQ ID NO: 2408252 - RNA, 17 nt, Bordetella pertussis
uuggccuuggcggcccc

SEQ ID NO: 2408253 - RNA, 20 nt, Bordetella pertussis
uuggcgaacgugcgcgccag

SEQ ID NO: 2408254 - RNA, 19 nt, Bordetella pertussis
uuggcgaaggcgucggcca

SEQ ID NO: 2408255 - RNA, 21 nt, Bordetella pertussis
uuggcgaaggcgucggccaug

SEQ ID NO: 2408256 - RNA, 19 nt, Bordetella pertussis
uuggcgaucucguccugca

SEQ ID NO: 2408257 - RNA, 17 nt, Bordetella pertussis
uuggcgauggccgccag

SEQ ID NO: 2408258 - RNA, 13 nt, Bordetella pertussis
uuggcgcacgccg

SEQ ID NO: 2408259 - RNA, 16 nt, Bordetella pertussis
uuggcgcccagcgcca

SEQ ID NO: 2408260 - RNA, 16 nt, Bordetella pertussis
uuggcgccgcgcucgc

SEQ ID NO: 2408261 - RNA, 20 nt, Bordetella pertussis
uuggcgccgcgcucgcgcca

SEQ ID NO: 2408262 - RNA, 13 nt, Bordetella pertussis
uuggcgcgcagca

SEQ ID NO: 2408263 - RNA, 16 nt, Bordetella pertussis
uuggcgcgcagcagcg

SEQ ID NO: 2408264 - RNA, 16 nt, Bordetella pertussis
uuggcggccggccagc

SEQ ID NO: 2408265 - RNA, 22 nt, Bordetella pertussis
uuggcggccuggccgcgcgccu

SEQ ID NO: 2408266 - RNA, 14 nt, Bordetella pertussis
uuggcggcgaucga

SEQ ID NO: 2408267 - RNA, 19 nt, Bordetella pertussis
uuggcggcuuccuggucac

SEQ ID NO: 2408268 - RNA, 13 nt, Bordetella pertussis
uuggcguacggcg

SEQ ID NO: 2408269 - RNA, 15 nt, Bordetella pertussis
uuggcguccggcccc

SEQ ID NO: 2408270 - RNA, 13 nt, Bordetella pertussis
uuggcgugcagcc

SEQ ID NO: 2408271 - RNA, 13 nt, Bordetella pertussis
uuggcgugcgcga

SEQ ID NO: 2408272 - RNA, 17 nt, Bordetella pertussis
uuggcgugcuugccgcc

SEQ ID NO: 2408273 - RNA, 18 nt, Bordetella pertussis
uuggcuguaucuggccug

SEQ ID NO: 2408274 - RNA, 23 nt, Bordetella pertussis
uuggcuguaucuggccugucugg

SEQ ID NO: 2408275 - RNA, 20 nt, Bordetella pertussis
uugggaaggccgcgccgcgg

SEQ ID NO: 2408276 - RNA, 16 nt, Bordetella pertussis
uugggacgcggccuuu

SEQ ID NO: 2408277 - RNA, 20 nt, Bordetella pertussis
uugggauggaugccgucggc

SEQ ID NO: 2408278 - RNA, 13 nt, Bordetella pertussis
uugggcgcgccca

SEQ ID NO: 2408279 - RNA, 23 nt, Bordetella pertussis
uuggucgcgaccucggcggcguc

SEQ ID NO: 2408280 - RNA, 13 nt, Bordetella pertussis
uuggucugcaggc

SEQ ID NO: 2408281 - RNA, 16 nt, Bordetella pertussis
uuggugcgcgccaggu

SEQ ID NO: 2408282 - RNA, 19 nt, Bordetella pertussis
uuguagggaaucgucauga

SEQ ID NO: 2408283 - RNA, 18 nt, Bordetella pertussis
uuguauuccaucuugccg

SEQ ID NO: 2408284 - RNA, 17 nt, Bordetella pertussis
uuguauugcgucagggc

SEQ ID NO: 2408285 - RNA, 18 nt, Bordetella pertussis
uugucaagcagcgccggc

SEQ ID NO: 2408286 - RNA, 13 nt, Bordetella pertussis
uuguccagcggca

SEQ ID NO: 2408287 - RNA, 13 nt, Bordetella pertussis
uuguccaggccga

SEQ ID NO: 2408288 - RNA, 12 nt, Bordetella pertussis
uuguccagguug

SEQ ID NO: 2408289 - RNA, 20 nt, Bordetella pertussis
uuguccgccacccuggcacg

SEQ ID NO: 2408290 - RNA, 19 nt, Bordetella pertussis
uuguccuggucgaccaggc

SEQ ID NO: 2408291 - RNA, 20 nt, Bordetella pertussis
uugucgaccaguuggcccuu

SEQ ID NO: 2408292 - RNA, 22 nt, Bordetella pertussis
uugucgcgcgagaccagcggau

SEQ ID NO: 2408293 - RNA, 22 nt, Bordetella pertussis
uugucgucgggaccgaacacca

SEQ ID NO: 2408294 - RNA, 19 nt, Bordetella pertussis
uugugcaugacggccagga

SEQ ID NO: 2408295 - RNA, 18 nt, Bordetella pertussis
uugugcguuggcgcggcg

SEQ ID NO: 2408296 - RNA, 22 nt, Bordetella pertussis
uugugcugccaugccgcgcgcc

SEQ ID NO: 2408297 - RNA, 18 nt, Bordetella pertussis
uuguucaggaaggcccgg

SEQ ID NO: 2408298 - RNA, 19 nt, Bordetella pertussis
uuguuccacgaggucuugc

SEQ ID NO: 2408299 - RNA, 17 nt, Bordetella pertussis
uuuacccugaacucuuc

SEQ ID NO: 2408300 - RNA, 23 nt, Bordetella pertussis
uuuacgccgagaagauuucccag

SEQ ID NO: 2408301 - RNA, 17 nt, Bordetella pertussis
uuucagauccuuggugc

SEQ ID NO: 2408302 - RNA, 14 nt, Bordetella pertussis
uuucaggaugccgc

SEQ ID NO: 2408303 - RNA, 15 nt, Bordetella pertussis
uuucaggaugccgcc

SEQ ID NO: 2408304 - RNA, 12 nt, Bordetella pertussis
uuuccacagcca

SEQ ID NO: 2408305 - RNA, 21 nt, Bordetella pertussis
uuuccaggaaagaggccaggc

SEQ ID NO: 2408306 - RNA, 13 nt, Bordetella pertussis
uuuccaucagcuc

SEQ ID NO: 2408307 - RNA, 19 nt, Bordetella pertussis
uuuccaucagcucgaccac

SEQ ID NO: 2408308 - RNA, 17 nt, Bordetella pertussis
uuucccucggugcugcu

SEQ ID NO: 2408309 - RNA, 19 nt, Bordetella pertussis
uuucccucggugcugcugu

SEQ ID NO: 2408310 - RNA, 16 nt, Bordetella pertussis
uuuccgccaugcggcg

SEQ ID NO: 2408311 - RNA, 16 nt, Bordetella pertussis
uuuccgccgagaaauc

SEQ ID NO: 2408312 - RNA, 22 nt, Bordetella pertussis
uuuccgccgagaaauccagcgc

SEQ ID NO: 2408313 - RNA, 20 nt, Bordetella pertussis
uuuccggaccggugcccucg

SEQ ID NO: 2408314 - RNA, 15 nt, Bordetella pertussis
uuuccgggccuggcc

SEQ ID NO: 2408315 - RNA, 17 nt, Bordetella pertussis
uuuccgggccuggccug

SEQ ID NO: 2408316 - RNA, 22 nt, Bordetella pertussis
uuuccuggagcuuggccggugc

SEQ ID NO: 2408317 - RNA, 20 nt, Bordetella pertussis
uuucgagccgcagaacagca

SEQ ID NO: 2408318 - RNA, 13 nt, Bordetella pertussis
uuucgaugcgcac

SEQ ID NO: 2408319 - RNA, 18 nt, Bordetella pertussis
uuucgcagcggaugccgc

SEQ ID NO: 2408320 - RNA, 20 nt, Bordetella pertussis
uuucgcccgcccacauggcg

SEQ ID NO: 2408321 - RNA, 19 nt, Bordetella pertussis
uuucgcgcgcgccugcccc

SEQ ID NO: 2408322 - RNA, 16 nt, Bordetella pertussis
uuucgcgcguugccuu

SEQ ID NO: 2408323 - RNA, 13 nt, Bordetella pertussis
uuucgcuggccau

SEQ ID NO: 2408324 - RNA, 17 nt, Bordetella pertussis
uuucggccgggaaggcg

SEQ ID NO: 2408325 - RNA, 17 nt, Bordetella pertussis
uuucggggcgcaagauc

SEQ ID NO: 2408326 - RNA, 13 nt, Bordetella pertussis
uuucgucgagcuc

SEQ ID NO: 2408327 - RNA, 14 nt, Bordetella pertussis
uuucguggucgugc

SEQ ID NO: 2408328 - RNA, 18 nt, Bordetella pertussis
uuucguugcauugcacaa

SEQ ID NO: 2408329 - RNA, 23 nt, Bordetella pertussis
uuucuacgccgaauugcuggagc

SEQ ID NO: 2408330 - RNA, 22 nt, Bordetella pertussis
uuucucagcgcgcuuuucucaa

SEQ ID NO: 2408331 - RNA, 15 nt, Bordetella pertussis
uuucucgcucuuggc

SEQ ID NO: 2408332 - RNA, 20 nt, Bordetella pertussis
uuucucgggcgucaugcgcu

SEQ ID NO: 2408333 - RNA, 19 nt, Bordetella pertussis
uuugcccuggccacgcugc

SEQ ID NO: 2408334 - RNA, 15 nt, Bordetella pertussis
uuugcgcaguggcga

SEQ ID NO: 2408335 - RNA, 21 nt, Bordetella pertussis
uuugcgucuccacgccgccga

SEQ ID NO: 2408336 - RNA, 23 nt, Bordetella pertussis
uuuggcgcacgccgggcgcggcc

SEQ ID NO: 2408337 - RNA, 13 nt, Bordetella pertussis
uuugggucaugga

SEQ ID NO: 2408338 - RNA, 15 nt, Bordetella pertussis
uuugguagcaggcgc

SEQ ID NO: 2408339 - RNA, 17 nt, Bordetella pertussis
uuuuacaggcagcggcc

SEQ ID NO: 2408340 - RNA, 22 nt, Bordetella pertussis
uuuuccucuaccccguagaacu

SEQ ID NO: 2408341 - RNA, 18 nt, Bordetella pertussis
uuuucggacgcagcuucu

SEQ ID NO: 2408342 - RNA, 15 nt, Bordetella pertussis
uuuugccuuggggcg

SEQ ID NO: 2408343 - RNA, 15 nt, Bordetella pertussis
uuuugcggcacggcu

SEQ ID NO: 2408344 - RNA, 13 nt, Bordetella pertussis
uuuugggaaggcc

SEQ ID NO: 2408345 - RNA, 22 nt, Bordetella pertussis
uuuuugccuuggggcggcccag

SEQ ID NO: 2408346 - RNA, 22 nt, Bordetella pertussis
uuuuugccuuggggcggcccgg

SEQ ID NO: 2408347 - RNA, 18 nt, Bordetella pertussis
uuuuugggaaggccgcgc

SEQ ID NO: 2408348 - RNA, 15 nt, Bordetella pertussis
ugggcgcgcgcccag

SEQ ID NO: 2408349 - RNA, 24 nt, Bordetella pertussis
ugggcgcggaacagccuggucagg

SEQ ID NO: 2408350 - RNA, 18 nt, Bordetella pertussis
ugggcgcggcgcgcgccg

SEQ ID NO: 2408351 - RNA, 17 nt, Bordetella pertussis
ugggcgcggcggccugg

SEQ ID NO: 2408352 - RNA, 15 nt, Bordetella pertussis
ugggcgcgguagcgc

SEQ ID NO: 2408353 - RNA, 14 nt, Bordetella pertussis
ugggcgcuuggccc

SEQ ID NO: 2408354 - RNA, 22 nt, Bordetella pertussis
ugggcggagucgauaugccgau

SEQ ID NO: 2408355 - RNA, 16 nt, Bordetella pertussis
ugggcggcagcaggcg

SEQ ID NO: 2408356 - RNA, 21 nt, Bordetella pertussis
ugggcggcagcaggcgcguga

SEQ ID NO: 2408357 - RNA, 18 nt, Bordetella pertussis
ugggcggccucggccagc

SEQ ID NO: 2408358 - RNA, 14 nt, Bordetella pertussis
ugggcggugaccau

SEQ ID NO: 2408359 - RNA, 20 nt, Bordetella pertussis
ugggcgucgaaggcggccgg

SEQ ID NO: 2408360 - RNA, 16 nt, Bordetella pertussis
ugggcgucgagcggcg

SEQ ID NO: 2408361 - RNA, 22 nt, Bordetella pertussis
ugggcgucgaucuucgccugca

SEQ ID NO: 2408362 - RNA, 18 nt, Bordetella pertussis
ugggcgugaaaggccagc

SEQ ID NO: 2408363 - RNA, 18 nt, Bordetella pertussis
ugggcguggcgcgcgugc

SEQ ID NO: 2408364 - RNA, 17 nt, Bordetella pertussis
ugggcguucucguuggg

SEQ ID NO: 2408365 - RNA, 20 nt, Bordetella pertussis
ugggcuccguuccgaugcug

SEQ ID NO: 2408366 - RNA, 14 nt, Bordetella pertussis
ugggcucgcgcgag

SEQ ID NO: 2408367 - RNA, 18 nt, Bordetella pertussis
ugggcucgcgcgagccca

SEQ ID NO: 2408368 - RNA, 23 nt, Bordetella pertussis
ugggcucggucucgcccauggga

SEQ ID NO: 2408369 - RNA, 21 nt, Bordetella pertussis
ugggcucgucgacgcggccgu

SEQ ID NO: 2408370 - RNA, 23 nt, Bordetella pertussis
ugggcucgucgacgcggccgugg

SEQ ID NO: 2408371 - RNA, 14 nt, Bordetella pertussis
ugggcucgugcagc

SEQ ID NO: 2408372 - RNA, 20 nt, Bordetella pertussis
ugggcuguauagaugcgcgg

SEQ ID NO: 2408373 - RNA, 23 nt, Bordetella pertussis
ugggcuguucguagucgagccag

SEQ ID NO: 2408374 - RNA, 21 nt, Bordetella pertussis
ugggcuuugccugcgaugccg

SEQ ID NO: 2408375 - RNA, 16 nt, Bordetella pertussis
uggggacaggcacccg

SEQ ID NO: 2408376 - RNA, 13 nt, Bordetella pertussis
uggggacgggcgc

SEQ ID NO: 2408377 - RNA, 16 nt, Bordetella pertussis
uggggacuggcaccug

SEQ ID NO: 2408378 - RNA, 19 nt, Bordetella pertussis
uggggacuggcaccugcaa

SEQ ID NO: 2408379 - RNA, 14 nt, Bordetella pertussis
uggggacuggcgcc

SEQ ID NO: 2408380 - RNA, 13 nt, Bordetella pertussis
uggggagcgcggc

SEQ ID NO: 2408381 - RNA, 15 nt, Bordetella pertussis
uggggagcgcggccc

SEQ ID NO: 2408382 - RNA, 20 nt, Bordetella pertussis
uggggaucgaacuugcgcgc

SEQ ID NO: 2408383 - RNA, 14 nt, Bordetella pertussis
uggggcagccaucc

SEQ ID NO: 2408384 - RNA, 22 nt, Bordetella pertussis
uggggcagccauccucgcccag

SEQ ID NO: 2408385 - RNA, 18 nt, Bordetella pertussis
uggggcaggacgccggcg

SEQ ID NO: 2408386 - RNA, 13 nt, Bordetella pertussis
uggggcaggaucc

SEQ ID NO: 2408387 - RNA, 13 nt, Bordetella pertussis
uggggcaggcgca

SEQ ID NO: 2408388 - RNA, 19 nt, Bordetella pertussis
uggggcaggcgcagcggcg

SEQ ID NO: 2408389 - RNA, 14 nt, Bordetella pertussis
uggggcccgcaucc

SEQ ID NO: 2408390 - RNA, 17 nt, Bordetella pertussis
uggggccgagcgugccg

SEQ ID NO: 2408391 - RNA, 16 nt, Bordetella pertussis
uggggccgcggcgcgc

SEQ ID NO: 2408392 - RNA, 22 nt, Bordetella pertussis
uggggccgcggcgcgcgcggcg

SEQ ID NO: 2408393 - RNA, 15 nt, Bordetella pertussis
uggggccgggcgcca

SEQ ID NO: 2408394 - RNA, 16 nt, Bordetella pertussis
uggggccgggcgccag

SEQ ID NO: 2408395 - RNA, 16 nt, Bordetella pertussis
uggggcgaggggggcg

SEQ ID NO: 2408396 - RNA, 16 nt, Bordetella pertussis
uggggcgaggucagca

SEQ ID NO: 2408397 - RNA, 18 nt, Bordetella pertussis
uggggcggcccagcggca

SEQ ID NO: 2408398 - RNA, 15 nt, Bordetella pertussis
uggggcggcccggcg

SEQ ID NO: 2408399 - RNA, 16 nt, Bordetella pertussis
uggggcgggcgcugcg

SEQ ID NO: 2408400 - RNA, 16 nt, Bordetella pertussis
uggggcgggcgggcgc

SEQ ID NO: 2408401 - RNA, 15 nt, Bordetella pertussis
uggggcuggccgccg

SEQ ID NO: 2408402 - RNA, 10 nt, Bordetella pertussis
uggggcuguc

SEQ ID NO: 2408403 - RNA, 17 nt, Bordetella pertussis
ugggggacuggcacccg

SEQ ID NO: 2408404 - RNA, 13 nt, Bordetella pertussis
ugggggcccacau

SEQ ID NO: 2408405 - RNA, 17 nt, Bordetella pertussis
ugggggcccacaugccg

SEQ ID NO: 2408406 - RNA, 20 nt, Bordetella pertussis
ugggggcgaagacgauggcg

SEQ ID NO: 2408407 - RNA, 21 nt, Bordetella pertussis
ugggggcgguaccguccuggc

SEQ ID NO: 2408408 - RNA, 14 nt, Bordetella pertussis
ugggggucagcgcc

SEQ ID NO: 2408409 - RNA, 15 nt, Bordetella pertussis
ugggggucagcgccg

SEQ ID NO: 2408410 - RNA, 13 nt, Bordetella pertussis
ugggguaggcgcg

SEQ ID NO: 2408411 - RNA, 17 nt, Bordetella pertussis
uggggucgccgggcagc

SEQ ID NO: 2408412 - RNA, 14 nt, Bordetella pertussis
uggggucgcgcugg

SEQ ID NO: 2408413 - RNA, 20 nt, Bordetella pertussis
ugggguugacguuguccagg

SEQ ID NO: 2408414 - RNA, 14 nt, Bordetella pertussis
uggguacagcgcgc

SEQ ID NO: 2408415 - RNA, 17 nt, Bordetella pertussis
uggguacgccggccuga

SEQ ID NO: 2408416 - RNA, 19 nt, Bordetella pertussis
uggguccgcgugggcaugg

SEQ ID NO: 2408417 - RNA, 16 nt, Bordetella pertussis
ugggucugcaccggcu

SEQ ID NO: 2408418 - RNA, 20 nt, Bordetella pertussis
ugggugaagccaagcagggc

SEQ ID NO: 2408419 - RNA, 17 nt, Bordetella pertussis
ugggugacgcuggagcg

SEQ ID NO: 2408420 - RNA, 17 nt, Bordetella pertussis
ugggugcgguaggcgcc

SEQ ID NO: 2408421 - RNA, 12 nt, Bordetella pertussis
uggguggccagc

SEQ ID NO: 2408422 - RNA, 15 nt, Bordetella pertussis
uggguggccagcgcc

SEQ ID NO: 2408423 - RNA, 20 nt, Bordetella pertussis
uggguguggccaugcaccag

SEQ ID NO: 2408424 - RNA, 22 nt, Bordetella pertussis
uggguguggccaugcaccagca

SEQ ID NO: 2408425 - RNA, 17 nt, Bordetella pertussis
uggguucaggccuguuc

SEQ ID NO: 2408426 - RNA, 23 nt, Bordetella pertussis
uggguucgaaucccaccaucucc

SEQ ID NO: 2408427 - RNA, 17 nt, Bordetella pertussis
ugguacgacgagcgcac

SEQ ID NO: 2408428 - RNA, 11 nt, Bordetella pertussis
ugguagaccgg

SEQ ID NO: 2408429 - RNA, 16 nt, Bordetella pertussis
ugguagaucagcgcgu

SEQ ID NO: 2408430 - RNA, 14 nt, Bordetella pertussis
ugguagaugcgcgc

SEQ ID NO: 2408431 - RNA, 15 nt, Bordetella pertussis
ugguagaugcgcgcg

SEQ ID NO: 2408432 - RNA, 16 nt, Bordetella pertussis
ugguagaugcgcgcga

SEQ ID NO: 2408433 - RNA, 15 nt, Bordetella pertussis
ugguagcaggcgcgc

SEQ ID NO: 2408434 - RNA, 20 nt, Bordetella pertussis
ugguagcaggcgcgcucagg

SEQ ID NO: 2408435 - RNA, 15 nt, Bordetella pertussis
ugguagccggcgacg

SEQ ID NO: 2408436 - RNA, 23 nt, Bordetella pertussis
ugguaggccgauucgccguggcu

SEQ ID NO: 2408437 - RNA, 15 nt, Bordetella pertussis
ugguaguuggccagg

SEQ ID NO: 2408438 - RNA, 14 nt, Bordetella pertussis
ugguaucccucgcc

SEQ ID NO: 2408439 - RNA, 12 nt, Bordetella pertussis
ugguaucgcgcc

SEQ ID NO: 2408440 - RNA, 15 nt, Bordetella pertussis
ugguaucgcgccagc

SEQ ID NO: 2408441 - RNA, 23 nt, Bordetella pertussis
ugguaucgcgccagcgccgcgcg

SEQ ID NO: 2408442 - RNA, 15 nt, Bordetella pertussis
uggucaagggcggcc

SEQ ID NO: 2408443 - RNA, 21 nt, Bordetella pertussis
uggucaagggcggccaugccg

SEQ ID NO: 2408444 - RNA, 21 nt, Bordetella pertussis
uggucacacugucgccacggg

SEQ ID NO: 2408445 - RNA, 20 nt, Bordetella pertussis
uggucaccacccgcacgccg

SEQ ID NO: 2408446 - RNA, 20 nt, Bordetella pertussis
uggucagcaucagcagaccc

SEQ ID NO: 2408447 - RNA, 13 nt, Bordetella pertussis
uggucagccgugu

SEQ ID NO: 2408448 - RNA, 22 nt, Bordetella pertussis
uggucagccugggcgccuggcu

SEQ ID NO: 2408449 - RNA, 17 nt, Bordetella pertussis
uggucagccuggggcag

SEQ ID NO: 2408450 - RNA, 20 nt, Bordetella pertussis
uggucagcggcauuuccauu

SEQ ID NO: 2408451 - RNA, 17 nt, Bordetella pertussis
uggucaucgauggccac

SEQ ID NO: 2408452 - RNA, 20 nt, Bordetella pertussis
uggucaucgauggccacgaa

SEQ ID NO: 2408453 - RNA, 17 nt, Bordetella pertussis
uggucaucgccaugcug

SEQ ID NO: 2408454 - RNA, 18 nt, Bordetella pertussis
uggucaucgccaugcugc

SEQ ID NO: 2408455 - RNA, 20 nt, Bordetella pertussis
uggucaugacgggcggcggc

SEQ ID NO: 2408456 - RNA, 12 nt, Bordetella pertussis
uggucaugcccu

SEQ ID NO: 2408457 - RNA, 17 nt, Bordetella pertussis
ugguccaggcggugcgu

SEQ ID NO: 2408458 - RNA, 14 nt, Bordetella pertussis
ugguccgccgccgc

SEQ ID NO: 2408459 - RNA, 13 nt, Bordetella pertussis
ugguccgugaagc

SEQ ID NO: 2408460 - RNA, 20 nt, Bordetella pertussis
ugguccuaaauugccgcgag

SEQ ID NO: 2408461 - RNA, 22 nt, Bordetella pertussis
uggucgaacgcuuccugggccu

SEQ ID NO: 2408462 - RNA, 20 nt, Bordetella pertussis
uggucgaaguagaacgccgg

SEQ ID NO: 2408463 - RNA, 15 nt, Bordetella pertussis
uggucgaccagcagc

SEQ ID NO: 2408464 - RNA, 21 nt, Bordetella pertussis
uggucgaccaggccggugcgc

SEQ ID NO: 2408465 - RNA, 22 nt, Bordetella pertussis
uggucgacccacuugagcagcg

SEQ ID NO: 2408466 - RNA, 17 nt, Bordetella pertussis
uggucgagagccugggc

SEQ ID NO: 2408467 - RNA, 15 nt, Bordetella pertussis
uggucgagcgggcgc

SEQ ID NO: 2408468 - RNA, 18 nt, Bordetella pertussis
uggucgagcgggcgccag

SEQ ID NO: 2408469 - RNA, 14 nt, Bordetella pertussis
uggucgauggucag

SEQ ID NO: 2408470 - RNA, 17 nt, Bordetella pertussis
uggucgcacgacagcau

SEQ ID NO: 2408471 - RNA, 14 nt, Bordetella pertussis
uggucgcaguccca

SEQ ID NO: 2408472 - RNA, 15 nt, Bordetella pertussis
uggucgccagcacgc

SEQ ID NO: 2408473 - RNA, 19 nt, Bordetella pertussis
uggucgccagcacgcgcag

SEQ ID NO: 2408474 - RNA, 16 nt, Bordetella pertussis
uggucgcccagcagau

SEQ ID NO: 2408475 - RNA, 20 nt, Bordetella pertussis
uggucgcgaccucggcggcg

SEQ ID NO: 2408476 - RNA, 21 nt, Bordetella pertussis
uggucgcgaccucggcggcgu

SEQ ID NO: 2408477 - RNA, 21 nt, Bordetella pertussis
uggucgcgcagcugccugagc

SEQ ID NO: 2408478 - RNA, 15 nt, Bordetella pertussis
uggucgcgcccgccg

SEQ ID NO: 2408479 - RNA, 19 nt, Bordetella pertussis
uggucgcgcccgccguggc

SEQ ID NO: 2408480 - RNA, 12 nt, Bordetella pertussis
uggucgcggccg

SEQ ID NO: 2408481 - RNA, 17 nt, Bordetella pertussis
uggucgcgggccaggcc

SEQ ID NO: 2408482 - RNA, 19 nt, Bordetella pertussis
uggucgcuggcgccggugc

SEQ ID NO: 2408483 - RNA, 17 nt, Bordetella pertussis
uggucggccggaugcgc

SEQ ID NO: 2408484 - RNA, 16 nt, Bordetella pertussis
uggucggccucggcga

SEQ ID NO: 2408485 - RNA, 21 nt, Bordetella pertussis
uggucggcgcggcagugggcg

SEQ ID NO: 2408486 - RNA, 13 nt, Bordetella pertussis
uggucggcguggu

SEQ ID NO: 2408487 - RNA, 20 nt, Bordetella pertussis
uggucgggaugccccgcccg

SEQ ID NO: 2408488 - RNA, 15 nt, Bordetella pertussis
uggucgggcgugagc

SEQ ID NO: 2408489 - RNA, 18 nt, Bordetella pertussis
uggucgggcgugagcgcc

SEQ ID NO: 2408490 - RNA, 18 nt, Bordetella pertussis
uggucggguccagcacgc

SEQ ID NO: 2408491 - RNA, 22 nt, Bordetella pertussis
uggucgucgcgaaacccuccca

SEQ ID NO: 2408492 - RNA, 23 nt, Bordetella pertussis
uggucugcaagguggcgugcagc

SEQ ID NO: 2408493 - RNA, 20 nt, Bordetella pertussis
uggucugccaguccauccag

SEQ ID NO: 2408494 - RNA, 14 nt, Bordetella pertussis
uggugaaacagcau

SEQ ID NO: 2408495 - RNA, 18 nt, Bordetella pertussis
uggugaaagccgccggcg

SEQ ID NO: 2408496 - RNA, 18 nt, Bordetella pertussis
uggugaagaaccgccgca

SEQ ID NO: 2408497 - RNA, 23 nt, Bordetella pertussis
uggugaagcccucgucgcggccg

SEQ ID NO: 2408498 - RNA, 15 nt, Bordetella pertussis
uggugaccggcguga

SEQ ID NO: 2408499 - RNA, 20 nt, Bordetella pertussis
uggugaugucggaguugccc

SEQ ID NO: 2408500 - RNA, 18 nt, Bordetella pertussis
uggugcaccacgcgcucc

SEQ ID NO: 2408501 - RNA, 20 nt, Bordetella pertussis
uggugcacgaugcccagggc

SEQ ID NO: 2408502 - RNA, 14 nt, Bordetella pertussis
uggugcacgccgau

SEQ ID NO: 2408503 - RNA, 13 nt, Bordetella pertussis
uggugcagcggca

SEQ ID NO: 2408504 - RNA, 15 nt, Bordetella pertussis
uggugcagcggcagc

SEQ ID NO: 2408505 - RNA, 20 nt, Bordetella pertussis
uggugcagcggcagcauggc

SEQ ID NO: 2408506 - RNA, 22 nt, Bordetella pertussis
uggugcagcggcagcauggcgc

SEQ ID NO: 2408507 - RNA, 15 nt, Bordetella pertussis
uggugcccagcgagc

SEQ ID NO: 2408508 - RNA, 21 nt, Bordetella pertussis
uggugccggaaaaugccgcgg

SEQ ID NO: 2408509 - RNA, 17 nt, Bordetella pertussis
uggugccugcuugcagg

SEQ ID NO: 2408510 - RNA, 21 nt, Bordetella pertussis
uggugcgcacaucgcccgugc

SEQ ID NO: 2408511 - RNA, 20 nt, Bordetella pertussis
uggugcgcaccuugcccacg

SEQ ID NO: 2408512 - RNA, 12 nt, Bordetella pertussis
uggugcgccucg

SEQ ID NO: 2408513 - RNA, 13 nt, Bordetella pertussis
uggugcgcguccu

SEQ ID NO: 2408514 - RNA, 20 nt, Bordetella pertussis
uggugcgcguccugggccga

SEQ ID NO: 2408515 - RNA, 23 nt, Bordetella pertussis
uggugcgcuaccgcuucccuggc

SEQ ID NO: 2408516 - RNA, 14 nt, Bordetella pertussis
uggugcgggccgcg

SEQ ID NO: 2408517 - RNA, 15 nt, Bordetella pertussis
uggugcgggccgcgc

SEQ ID NO: 2408518 - RNA, 17 nt, Bordetella pertussis
uggugcucaguuucuuc

SEQ ID NO: 2408519 - RNA, 14 nt, Bordetella pertussis
uggugcugcugggc

SEQ ID NO: 2408520 - RNA, 16 nt, Bordetella pertussis
uggugcugcugggcgc

SEQ ID NO: 2408521 - RNA, 18 nt, Bordetella pertussis
uggugcuggccgaaccau

SEQ ID NO: 2408522 - RNA, 11 nt, Bordetella pertussis
uggugcugggc

SEQ ID NO: 2408523 - RNA, 14 nt, Bordetella pertussis
uggugcugggcggc

SEQ ID NO: 2408524 - RNA, 21 nt, Bordetella pertussis
uggugcuggugcuggugccgc

SEQ ID NO: 2408525 - RNA, 14 nt, Bordetella pertussis
ugguggccuugcug

SEQ ID NO: 2408526 - RNA, 20 nt, Bordetella pertussis
ugguggccuugcugcccgac

SEQ ID NO: 2408527 - RNA, 24 nt, Bordetella pertussis
ugguggcgauccauguggccagcu

SEQ ID NO: 2408528 - RNA, 21 nt, Bordetella pertussis
ugguggcgcagaugggcggcg

SEQ ID NO: 2408529 - RNA, 14 nt, Bordetella pertussis
uggugggccgacgg

SEQ ID NO: 2408530 - RNA, 15 nt, Bordetella pertussis
uggugggccgacggc

SEQ ID NO: 2408531 - RNA, 14 nt, Bordetella pertussis
uggugggcggcaau

SEQ ID NO: 2408532 - RNA, 13 nt, Bordetella pertussis
uggugggcgugcc

SEQ ID NO: 2408533 - RNA, 14 nt, Bordetella pertussis
ugguggggccgggc

SEQ ID NO: 2408534 - RNA, 16 nt, Bordetella pertussis
ugguggggcuggccgc

SEQ ID NO: 2408535 - RNA, 12 nt, Bordetella pertussis
ugguggucuggu

SEQ ID NO: 2408536 - RNA, 16 nt, Bordetella pertussis
ugguggucuggucgca

SEQ ID NO: 2408537 - RNA, 13 nt, Bordetella pertussis
ugguggugcagcg

SEQ ID NO: 2408538 - RNA, 17 nt, Bordetella pertussis
ugguggugcagcggcag

SEQ ID NO: 2408539 - RNA, 19 nt, Bordetella pertussis
ugguggugcagcggcagca

SEQ ID NO: 2408540 - RNA, 16 nt, Bordetella pertussis
ugguggugccugcuug

SEQ ID NO: 2408541 - RNA, 16 nt, Bordetella pertussis
ugguggugcgggccgc

SEQ ID NO: 2408542 - RNA, 19 nt, Bordetella pertussis
ugguguacagccgccuggc

SEQ ID NO: 2408543 - RNA, 17 nt, Bordetella pertussis
uggugucgaagccgugc

SEQ ID NO: 2408544 - RNA, 16 nt, Bordetella pertussis
uggugucggcggccag

SEQ ID NO: 2408545 - RNA, 15 nt, Bordetella pertussis
uggugucggcggcga

SEQ ID NO: 2408546 - RNA, 13 nt, Bordetella pertussis
uggugugccuguc

SEQ ID NO: 2408547 - RNA, 15 nt, Bordetella pertussis
uggugugccuguccc

SEQ ID NO: 2408548 - RNA, 20 nt, Bordetella pertussis
ugguuacucuguucuaccug

SEQ ID NO: 2408549 - RNA, 14 nt, Bordetella pertussis
ugguugagcagcac

SEQ ID NO: 2408550 - RNA, 16 nt, Bordetella pertussis
ugguuggccacaucau

SEQ ID NO: 2408551 - RNA, 20 nt, Bordetella pertussis
ugguuggccacaucaucgac

SEQ ID NO: 2408552 - RNA, 14 nt, Bordetella pertussis
ugguuggccacgaa

SEQ ID NO: 2408553 - RNA, 21 nt, Bordetella pertussis
ugguuggccacgaagcgcagc

SEQ ID NO: 2408554 - RNA, 20 nt, Bordetella pertussis
ugguugucgaugugcugauc

SEQ ID NO: 2408555 - RNA, 22 nt, Bordetella pertussis
uguaaaaacccggccugcgcgc

SEQ ID NO: 2408556 - RNA, 12 nt, Bordetella pertussis
uguaacaacacg

SEQ ID NO: 2408557 - RNA, 19 nt, Bordetella pertussis
uguacaagcgcacgcuggg

SEQ ID NO: 2408558 - RNA, 21 nt, Bordetella pertussis
uguaccagaugagacacggca

SEQ ID NO: 2408559 - RNA, 22 nt, Bordetella pertussis
uguaccccauaguccucuacug

SEQ ID NO: 2408560 - RNA, 23 nt, Bordetella pertussis
uguaccccauaguccucuacugg

SEQ ID NO: 2408561 - RNA, 19 nt, Bordetella pertussis
uguaccgggccgacgcgcc

SEQ ID NO: 2408562 - RNA, 21 nt, Bordetella pertussis
uguaccucagccugcuggugc

SEQ ID NO: 2408563 - RNA, 13 nt, Bordetella pertussis
uguacgacagcaa

SEQ ID NO: 2408564 - RNA, 19 nt, Bordetella pertussis
uguacgacgucuugcugcc

SEQ ID NO: 2408565 - RNA, 21 nt, Bordetella pertussis
uguacgcaucggcgccggcgu

SEQ ID NO: 2408566 - RNA, 14 nt, Bordetella pertussis
uguacucggccagg

SEQ ID NO: 2408567 - RNA, 18 nt, Bordetella pertussis
uguacuggucgcgcagcu

SEQ ID NO: 2408568 - RNA, 15 nt, Bordetella pertussis
uguagaucuggcgcg

SEQ ID NO: 2408569 - RNA, 20 nt, Bordetella pertussis
uguagcccuggcgcugcagc

SEQ ID NO: 2408570 - RNA, 22 nt, Bordetella pertussis
uguagcccuggcgcugcagcgu

SEQ ID NO: 2408571 - RNA, 12 nt, Bordetella pertussis
uguagcgcagcc

SEQ ID NO: 2408572 - RNA, 23 nt, Bordetella pertussis
uguagcucaguugguagagcagc

SEQ ID NO: 2408573 - RNA, 15 nt, Bordetella pertussis
uguagcugcccgcga

SEQ ID NO: 2408574 - RNA, 13 nt, Bordetella pertussis
uguaggccagguu

SEQ ID NO: 2408575 - RNA, 17 nt, Bordetella pertussis
uguaggcgccgcgcccg

SEQ ID NO: 2408576 - RNA, 18 nt, Bordetella pertussis
uguaggcgggcagcggcg

SEQ ID NO: 2408577 - RNA, 14 nt, Bordetella pertussis
uguaggucagcgcc

SEQ ID NO: 2408578 - RNA, 23 nt, Bordetella pertussis
uguaggucagcgccuugccgccg

SEQ ID NO: 2408579 - RNA, 18 nt, Bordetella pertussis
uguagugguguagccagg

SEQ ID NO: 2408580 - RNA, 15 nt, Bordetella pertussis
uguaguucacccagg

SEQ ID NO: 2408581 - RNA, 16 nt, Bordetella pertussis
uguaguucagcaguuc

SEQ ID NO: 2408582 - RNA, 17 nt, Bordetella pertussis
uguaucguugucgcgcc

SEQ ID NO: 2408583 - RNA, 21 nt, Bordetella pertussis
uguaucguugucgcgccgcga

SEQ ID NO: 2408584 - RNA, 22 nt, Bordetella pertussis
uguauggcugcaccugccugcc

SEQ ID NO: 2408585 - RNA, 14 nt, Bordetella pertussis
uguauuggcccagu

SEQ ID NO: 2408586 - RNA, 14 nt, Bordetella pertussis
ugucaagcagcgcc

SEQ ID NO: 2408587 - RNA, 20 nt, Bordetella pertussis
ugucaagcagcgccggcugg

SEQ ID NO: 2408588 - RNA, 23 nt, Bordetella pertussis
ugucaauagguuguauucgucca

SEQ ID NO: 2408589 - RNA, 22 nt, Bordetella pertussis
ugucaccgacgccagcgauacc

SEQ ID NO: 2408590 - RNA, 21 nt, Bordetella pertussis
ugucaguccucaugcgggaca

SEQ ID NO: 2408591 - RNA, 16 nt, Bordetella pertussis
ugucagucguccuccg

SEQ ID NO: 2408592 - RNA, 17 nt, Bordetella pertussis
ugucaguuuccaucggg

SEQ ID NO: 2408593 - RNA, 12 nt, Bordetella pertussis
uguccaccagcc

SEQ ID NO: 2408594 - RNA, 16 nt, Bordetella pertussis
uguccaccauccugcc

SEQ ID NO: 2408595 - RNA, 18 nt, Bordetella pertussis
uguccaccauccugcccc

SEQ ID NO: 2408596 - RNA, 13 nt, Bordetella pertussis
uguccacgccgaa

SEQ ID NO: 2408597 - RNA, 14 nt, Bordetella pertussis
uguccacgccgaag

SEQ ID NO: 2408598 - RNA, 15 nt, Bordetella pertussis
uguccagcgccagca

SEQ ID NO: 2408599 - RNA, 13 nt, Bordetella pertussis
uguccagcgcgcc

SEQ ID NO: 2408600 - RNA, 16 nt, Bordetella pertussis
uguccagcgcgcccag

SEQ ID NO: 2408601 - RNA, 16 nt, Bordetella pertussis
uguccagcggcgccag

SEQ ID NO: 2408602 - RNA, 14 nt, Bordetella pertussis
uguccagcuccagc

SEQ ID NO: 2408603 - RNA, 17 nt, Bordetella pertussis
uguccagcuccagcgcu

SEQ ID NO: 2408604 - RNA, 19 nt, Bordetella pertussis
uguccaggccggggccgcc

SEQ ID NO: 2408605 - RNA, 20 nt, Bordetella pertussis
uguccaggccggggccgccc

SEQ ID NO: 2408606 - RNA, 22 nt, Bordetella pertussis
uguccaggccggggccgcccag

SEQ ID NO: 2408607 - RNA, 14 nt, Bordetella pertussis
uguccagguagcgc

SEQ ID NO: 2408608 - RNA, 14 nt, Bordetella pertussis
uguccauggccugc

SEQ ID NO: 2408609 - RNA, 13 nt, Bordetella pertussis
ugucccaaccggg

SEQ ID NO: 2408610 - RNA, 13 nt, Bordetella pertussis
ugucccacaggcg

SEQ ID NO: 2408611 - RNA, 16 nt, Bordetella pertussis
ugucccacaggcgcgc

SEQ ID NO: 2408612 - RNA, 21 nt, Bordetella pertussis
ugucccacaggcgcgcggcgu

SEQ ID NO: 2408613 - RNA, 15 nt, Bordetella pertussis
ugucccagcggggac

SEQ ID NO: 2408614 - RNA, 17 nt, Bordetella pertussis
ugucccagcggggacag

SEQ ID NO: 2408615 - RNA, 18 nt, Bordetella pertussis
ugucccagcggggacagg

SEQ ID NO: 2408616 - RNA, 22 nt, Bordetella pertussis
ugucccagcggggacaggcacc

SEQ ID NO: 2408617 - RNA, 12 nt, Bordetella pertussis
ugucccagcucc

SEQ ID NO: 2408618 - RNA, 13 nt, Bordetella pertussis
uguccccacaggg

SEQ ID NO: 2408619 - RNA, 22 nt, Bordetella pertussis
uguccccacagggggacuggca

SEQ ID NO: 2408620 - RNA, 23 nt, Bordetella pertussis
uguccccacagggggacuggcac

SEQ ID NO: 2408621 - RNA, 20 nt, Bordetella pertussis
uguccccaccgggacaggca

SEQ ID NO: 2408622 - RNA, 22 nt, Bordetella pertussis
uguccccacggggacaggcacc

SEQ ID NO: 2408623 - RNA, 20 nt, Bordetella pertussis
uguccccacguggacaggca

SEQ ID NO: 2408624 - RNA, 22 nt, Bordetella pertussis
uguccccacguggacaggcacc

SEQ ID NO: 2408625 - RNA, 22 nt, Bordetella pertussis
uguccccacugggggacuggca

SEQ ID NO: 2408626 - RNA, 22 nt, Bordetella pertussis
uguccccgaacggggacuggca

SEQ ID NO: 2408627 - RNA, 23 nt, Bordetella pertussis
uguccccgaacggggacuggcac

SEQ ID NO: 2408628 - RNA, 22 nt, Bordetella pertussis
uguccccgcacggggacuggca

SEQ ID NO: 2408629 - RNA, 15 nt, Bordetella pertussis
uguccccgcggggac

SEQ ID NO: 2408630 - RNA, 20 nt, Bordetella pertussis
uguccccgcggggacaggca

SEQ ID NO: 2408631 - RNA, 22 nt, Bordetella pertussis
uguccccgcggggacaggcacc

SEQ ID NO: 2408632 - RNA, 16 nt, Bordetella pertussis
uguccccgucgggaca

SEQ ID NO: 2408633 - RNA, 20 nt, Bordetella pertussis
uguccccgucgggacaggcu

SEQ ID NO: 2408634 - RNA, 20 nt, Bordetella pertussis
uguccccguggggacaggca

SEQ ID NO: 2408635 - RNA, 18 nt, Bordetella pertussis
ugucccgacggggacagg

SEQ ID NO: 2408636 - RNA, 20 nt, Bordetella pertussis
ugucccgacggggacaggcu

SEQ ID NO: 2408637 - RNA, 13 nt, Bordetella pertussis
ugucccgaggcgc

SEQ ID NO: 2408638 - RNA, 15 nt, Bordetella pertussis
ugucccgaggcgccc

SEQ ID NO: 2408639 - RNA, 18 nt, Bordetella pertussis
ugucccgaggcgccccag

SEQ ID NO: 2408640 - RNA, 15 nt, Bordetella pertussis
ugucccggcggggac

SEQ ID NO: 2408641 - RNA, 16 nt, Bordetella pertussis
ugucccggcggggaca

SEQ ID NO: 2408642 - RNA, 20 nt, Bordetella pertussis
ugucccggcggggacaggcg

SEQ ID NO: 2408643 - RNA, 23 nt, Bordetella pertussis
ugucccggcggggcaggcgccug

SEQ ID NO: 2408644 - RNA, 18 nt, Bordetella pertussis
ugucccggcugggacagg

SEQ ID NO: 2408645 - RNA, 14 nt, Bordetella pertussis
ugucccucggagcc

SEQ ID NO: 2408646 - RNA, 22 nt, Bordetella pertussis
ugucccugcgggggcaggcacg

SEQ ID NO: 2408647 - RNA, 16 nt, Bordetella pertussis
uguccgaaccacccgg

SEQ ID NO: 2408648 - RNA, 13 nt, Bordetella pertussis
uguccgaugcgcu

SEQ ID NO: 2408649 - RNA, 12 nt, Bordetella pertussis
uguccgccaccc

SEQ ID NO: 2408650 - RNA, 19 nt, Bordetella pertussis
uguccgccugcggacggcg

SEQ ID NO: 2408651 - RNA, 21 nt, Bordetella pertussis
uguccgccugcggacggcggg

SEQ ID NO: 2408652 - RNA, 17 nt, Bordetella pertussis
uguccguaucgcggccg

SEQ ID NO: 2408653 - RNA, 15 nt, Bordetella pertussis
uguccugcagguccu

SEQ ID NO: 2408654 - RNA, 13 nt, Bordetella pertussis
uguccuggcgcgc

SEQ ID NO: 2408655 - RNA, 16 nt, Bordetella pertussis
uguccuggcgcgccag

SEQ ID NO: 2408656 - RNA, 18 nt, Bordetella pertussis
uguccuggucggcgcggc

SEQ ID NO: 2408657 - RNA, 19 nt, Bordetella pertussis
uguccugguugccgaggac

SEQ ID NO: 2408658 - RNA, 23 nt, Bordetella pertussis
uguccuugaacgccuugacgauc

SEQ ID NO: 2408659 - RNA, 15 nt, Bordetella pertussis
ugucgaacaccaggu

SEQ ID NO: 2408660 - RNA, 14 nt, Bordetella pertussis
ugucgaacagcugc

SEQ ID NO: 2408661 - RNA, 18 nt, Bordetella pertussis
ugucgaagccgugcucgu

SEQ ID NO: 2408662 - RNA, 13 nt, Bordetella pertussis
ugucgaccaguug

SEQ ID NO: 2408663 - RNA, 14 nt, Bordetella pertussis
ugucgaccaugucc

SEQ ID NO: 2408664 - RNA, 16 nt, Bordetella pertussis
ugucgacgcgaugccc

SEQ ID NO: 2408665 - RNA, 17 nt, Bordetella pertussis
ugucgagcgcgaugcca

SEQ ID NO: 2408666 - RNA, 21 nt, Bordetella pertussis
ugucgagguaagugggcugcg

SEQ ID NO: 2408667 - RNA, 17 nt, Bordetella pertussis
ugucgaugccguacacg

SEQ ID NO: 2408668 - RNA, 15 nt, Bordetella pertussis
ugucgcaggccgcgg

SEQ ID NO: 2408669 - RNA, 18 nt, Bordetella pertussis
ugucgcaggccgcggcca

SEQ ID NO: 2408670 - RNA, 19 nt, Bordetella pertussis
ugucgcaggccgcggccag

SEQ ID NO: 2408671 - RNA, 17 nt, Bordetella pertussis
ugucgcagucggggccg

SEQ ID NO: 2408672 - RNA, 16 nt, Bordetella pertussis
ugucgcccaccacgcc

SEQ ID NO: 2408673 - RNA, 15 nt, Bordetella pertussis
ugucgcccaugcuga

SEQ ID NO: 2408674 - RNA, 12 nt, Bordetella pertussis
ugucgccgaccc

SEQ ID NO: 2408675 - RNA, 18 nt, Bordetella pertussis
ugucgccgccgcgcacca

SEQ ID NO: 2408676 - RNA, 15 nt, Bordetella pertussis
ugucgccgccgcgcc

SEQ ID NO: 2408677 - RNA, 16 nt, Bordetella pertussis
ugucgccgccgcgccg

SEQ ID NO: 2408678 - RNA, 15 nt, Bordetella pertussis
ugucgccgccugcgg

SEQ ID NO: 2408679 - RNA, 14 nt, Bordetella pertussis
ugucgccgcggccg

SEQ ID NO: 2408680 - RNA, 20 nt, Bordetella pertussis
ugucgccgcggccggcgcag

SEQ ID NO: 2408681 - RNA, 12 nt, Bordetella pertussis
ugucgccgcugc

SEQ ID NO: 2408682 - RNA, 13 nt, Bordetella pertussis
ugucgccggccag

SEQ ID NO: 2408683 - RNA, 13 nt, Bordetella pertussis
ugucgccguggcg

SEQ ID NO: 2408684 - RNA, 19 nt, Bordetella pertussis
ugucgccguggcgggucca

SEQ ID NO: 2408685 - RNA, 17 nt, Bordetella pertussis
ugucgcgcccgaagccg

SEQ ID NO: 2408686 - RNA, 18 nt, Bordetella pertussis
ugucgcgcccgauggugc

SEQ ID NO: 2408687 - RNA, 19 nt, Bordetella pertussis
ugucgcgccgcgaugcacg

SEQ ID NO: 2408688 - RNA, 19 nt, Bordetella pertussis
ugucgcgcgacuggcccag

SEQ ID NO: 2408689 - RNA, 13 nt, Bordetella pertussis
ugucgcgcgccug

SEQ ID NO: 2408690 - RNA, 19 nt, Bordetella pertussis
ugucgcggcccacggccag

SEQ ID NO: 2408691 - RNA, 22 nt, Bordetella pertussis
ugucgcgggcccgcucggccag

SEQ ID NO: 2408692 - RNA, 23 nt, Bordetella pertussis
ugucgcucccccaugcggggaca

SEQ ID NO: 2408693 - RNA, 20 nt, Bordetella pertussis
ugucggacaacugcgcgaau

SEQ ID NO: 2408694 - RNA, 13 nt, Bordetella pertussis
ugucggacgagca

SEQ ID NO: 2408695 - RNA, 23 nt, Bordetella pertussis
ugucggcaaccugcacgcgggcg

SEQ ID NO: 2408696 - RNA, 12 nt, Bordetella pertussis
ugucggccaggg

SEQ ID NO: 2408697 - RNA, 14 nt, Bordetella pertussis
ugucggccagggcg

SEQ ID NO: 2408698 - RNA, 19 nt, Bordetella pertussis
ugucggccgaaccgcgcag

SEQ ID NO: 2408699 - RNA, 20 nt, Bordetella pertussis
ugucggccuucugcgccagc

SEQ ID NO: 2408700 - RNA, 21 nt, Bordetella pertussis
ugucggccuucugcgccagcg

SEQ ID NO: 2408701 - RNA, 20 nt, Bordetella pertussis
ugucggcgcagauggcggcg

SEQ ID NO: 2408702 - RNA, 14 nt, Bordetella pertussis
ugucggcggcgagc

SEQ ID NO: 2408703 - RNA, 19 nt, Bordetella pertussis
ugucggggccgggccggcg

SEQ ID NO: 2408704 - RNA, 22 nt, Bordetella pertussis
ugucggggugccguucggccag

SEQ ID NO: 2408705 - RNA, 18 nt, Bordetella pertussis
ugucggugaaggccacgc

SEQ ID NO: 2408706 - RNA, 17 nt, Bordetella pertussis
ugucggugauccacugc

SEQ ID NO: 2408707 - RNA, 14 nt, Bordetella pertussis
ugucguacaggccg

SEQ ID NO: 2408708 - RNA, 18 nt, Bordetella pertussis
ugucguccagcuccaggu

SEQ ID NO: 2408709 - RNA, 14 nt, Bordetella pertussis
ugucgucgagcacu

SEQ ID NO: 2408710 - RNA, 17 nt, Bordetella pertussis
ugucgugaucgccagcg

SEQ ID NO: 2408711 - RNA, 18 nt, Bordetella pertussis
ugucguugcacagcacgu

SEQ ID NO: 2408712 - RNA, 19 nt, Bordetella pertussis
ugugacggauucccagcuc

SEQ ID NO: 2408713 - RNA, 13 nt, Bordetella pertussis
ugugcacgugcga

SEQ ID NO: 2408714 - RNA, 20 nt, Bordetella pertussis
ugugcaggacgaacaggccg

SEQ ID NO: 2408715 - RNA, 13 nt, Bordetella pertussis
ugugcaugcgcgc

SEQ ID NO: 2408716 - RNA, 15 nt, Bordetella pertussis
ugugcaugcgcgcca

SEQ ID NO: 2408717 - RNA, 16 nt, Bordetella pertussis
ugugcaugcgcgccag

SEQ ID NO: 2408718 - RNA, 17 nt, Bordetella pertussis
ugugccaccgcccaggc

SEQ ID NO: 2408719 - RNA, 18 nt, Bordetella pertussis
ugugccagcccccugcgg

SEQ ID NO: 2408720 - RNA, 14 nt, Bordetella pertussis
ugugccagcuggcc

SEQ ID NO: 2408721 - RNA, 17 nt, Bordetella pertussis
ugugccagcuggcccag

SEQ ID NO: 2408722 - RNA, 15 nt, Bordetella pertussis
ugugccccuugccca

SEQ ID NO: 2408723 - RNA, 16 nt, Bordetella pertussis
ugugccccuugcccaa

SEQ ID NO: 2408724 - RNA, 19 nt, Bordetella pertussis
ugugccccuugcccaacgc

SEQ ID NO: 2408725 - RNA, 15 nt, Bordetella pertussis
ugugccgccagcggg

SEQ ID NO: 2408726 - RNA, 13 nt, Bordetella pertussis
ugugccggcgcag

SEQ ID NO: 2408727 - RNA, 12 nt, Bordetella pertussis
ugugccuguccc

SEQ ID NO: 2408728 - RNA, 15 nt, Bordetella pertussis
ugugccugucccagc

SEQ ID NO: 2408729 - RNA, 16 nt, Bordetella pertussis
ugugccugucccagcg

SEQ ID NO: 2408730 - RNA, 19 nt, Bordetella pertussis
ugugccugucccagcgggg

SEQ ID NO: 2408731 - RNA, 15 nt, Bordetella pertussis
ugugccuguccccgc

SEQ ID NO: 2408732 - RNA, 21 nt, Bordetella pertussis
ugugcgagagcuccagccggg

SEQ ID NO: 2408733 - RNA, 21 nt, Bordetella pertussis
ugugcgagggcucgaccgccg

SEQ ID NO: 2408734 - RNA, 13 nt, Bordetella pertussis
ugugcgccagcgc

SEQ ID NO: 2408735 - RNA, 15 nt, Bordetella pertussis
ugugcgccggggcgc

SEQ ID NO: 2408736 - RNA, 12 nt, Bordetella pertussis
ugugcgcgccaa

SEQ ID NO: 2408737 - RNA, 14 nt, Bordetella pertussis
ugugcgcgggcgcg

SEQ ID NO: 2408738 - RNA, 20 nt, Bordetella pertussis
ugugcggcgugagcacgacg

SEQ ID NO: 2408739 - RNA, 18 nt, Bordetella pertussis
ugugcggcguggcggggc

SEQ ID NO: 2408740 - RNA, 15 nt, Bordetella pertussis
ugugcugccaugccg

SEQ ID NO: 2408741 - RNA, 22 nt, Bordetella pertussis
uguggacgccgccggcccagga

SEQ ID NO: 2408742 - RNA, 14 nt, Bordetella pertussis
uguggcaggccagc

SEQ ID NO: 2408743 - RNA, 13 nt, Bordetella pertussis
uguggccguggcg

SEQ ID NO: 2408744 - RNA, 12 nt, Bordetella pertussis
uguggcgcgcca

SEQ ID NO: 2408745 - RNA, 22 nt, Bordetella pertussis
uguggcgggucccaaccagggc

SEQ ID NO: 2408746 - RNA, 15 nt, Bordetella pertussis
uguggcgucgggggc

SEQ ID NO: 2408747 - RNA, 14 nt, Bordetella pertussis
ugugggggacaggc

SEQ ID NO: 2408748 - RNA, 15 nt, Bordetella pertussis
ugugggggcgcggcg

SEQ ID NO: 2408749 - RNA, 16 nt, Bordetella pertussis
ugugguagccgccguc

SEQ ID NO: 2408750 - RNA, 18 nt, Bordetella pertussis
ugugguuggcgcugcugc

SEQ ID NO: 2408751 - RNA, 12 nt, Bordetella pertussis
uguuauuuuucc

SEQ ID NO: 2408752 - RNA, 22 nt, Bordetella pertussis
uguuauuuuuccaugcaugcga

SEQ ID NO: 2408753 - RNA, 20 nt, Bordetella pertussis
uguucacgcccaggaaggcg

SEQ ID NO: 2408754 - RNA, 18 nt, Bordetella pertussis
uguucagaaaccugaccu

SEQ ID NO: 2408755 - RNA, 15 nt, Bordetella pertussis
uguucagcgcgcgcg

SEQ ID NO: 2408756 - RNA, 17 nt, Bordetella pertussis
uguucaggccaugcugg

SEQ ID NO: 2408757 - RNA, 21 nt, Bordetella pertussis
uguucagguguucgcgcacca

SEQ ID NO: 2408758 - RNA, 23 nt, Bordetella pertussis
uguuccacgaggucuugccgauc

SEQ ID NO: 2408759 - RNA, 17 nt, Bordetella pertussis
uguuccagcgccuggcg

SEQ ID NO: 2408760 - RNA, 19 nt, Bordetella pertussis
uguuccggcuggauggugc

SEQ ID NO: 2408761 - RNA, 16 nt, Bordetella pertussis
uguucgacacuucggu

SEQ ID NO: 2408762 - RNA, 15 nt, Bordetella pertussis
uguucgacgcggccg

SEQ ID NO: 2408763 - RNA, 15 nt, Bordetella pertussis
uguucgauggcggcc

SEQ ID NO: 2408764 - RNA, 18 nt, Bordetella pertussis
uguucgccaaucugccgc

SEQ ID NO: 2408765 - RNA, 12 nt, Bordetella pertussis
uguucgccgcac

SEQ ID NO: 2408766 - RNA, 17 nt, Bordetella pertussis
uguucgccgcaccaggc

SEQ ID NO: 2408767 - RNA, 22 nt, Bordetella pertussis
uguucgccgcaccaggccgcgg

SEQ ID NO: 2408768 - RNA, 13 nt, Bordetella pertussis
uguucgcgcagca

SEQ ID NO: 2408769 - RNA, 21 nt, Bordetella pertussis
uguucgcgcagcaggccgcgc

SEQ ID NO: 2408770 - RNA, 15 nt, Bordetella pertussis
uguucggaugcgcgu

SEQ ID NO: 2408771 - RNA, 16 nt, Bordetella pertussis
uguucgggccggcugc

SEQ ID NO: 2408772 - RNA, 22 nt, Bordetella pertussis
uguucgggcgcggugcgcacca

SEQ ID NO: 2408773 - RNA, 21 nt, Bordetella pertussis
uguucggggcagggcgccugc

SEQ ID NO: 2408774 - RNA, 18 nt, Bordetella pertussis
uguucgugauccugacca

SEQ ID NO: 2408775 - RNA, 19 nt, Bordetella pertussis
uguucgugauccugaccau

SEQ ID NO: 2408776 - RNA, 14 nt, Bordetella pertussis
uguucuucaggcuc

SEQ ID NO: 2408777 - RNA, 16 nt, Bordetella pertussis
uguucuucaggcucca

SEQ ID NO: 2408778 - RNA, 15 nt, Bordetella pertussis
uguucuuguugcucu

SEQ ID NO: 2408779 - RNA, 21 nt, Bordetella pertussis
uguugaccaccacgcuggcuu

SEQ ID NO: 2408780 - RNA, 22 nt, Bordetella pertussis
uguugauccgccaauggcggau

SEQ ID NO: 2408781 - RNA, 16 nt, Bordetella pertussis
uguugcauucccggac

SEQ ID NO: 2408782 - RNA, 21 nt, Bordetella pertussis
uguugcauucccggaccgcgc

SEQ ID NO: 2408783 - RNA, 14 nt, Bordetella pertussis
uguugccgcgucga

SEQ ID NO: 2408784 - RNA, 13 nt, Bordetella pertussis
uguugccggccag

SEQ ID NO: 2408785 - RNA, 22 nt, Bordetella pertussis
uguugcgaaacccgcugggcca

SEQ ID NO: 2408786 - RNA, 15 nt, Bordetella pertussis
uguugcgccuguccc

SEQ ID NO: 2408787 - RNA, 13 nt, Bordetella pertussis
uguugcgcgccgu

SEQ ID NO: 2408788 - RNA, 15 nt, Bordetella pertussis
uguugcucgugcugg

SEQ ID NO: 2408789 - RNA, 17 nt, Bordetella pertussis
uguugcucgugcuggcc

SEQ ID NO: 2408790 - RNA, 16 nt, Bordetella pertussis
uguugcucuugaccug

SEQ ID NO: 2408791 - RNA, 14 nt, Bordetella pertussis
uguugcuggccacc

SEQ ID NO: 2408792 - RNA, 14 nt, Bordetella pertussis
uguugcuuggcguc

SEQ ID NO: 2408793 - RNA, 17 nt, Bordetella pertussis
uguuggaaaucgugccg

SEQ ID NO: 2408794 - RNA, 17 nt, Bordetella pertussis
uguuggccgccagccgg

SEQ ID NO: 2408795 - RNA, 18 nt, Bordetella pertussis
uguuggcgccggccgcgc

SEQ ID NO: 2408796 - RNA, 13 nt, Bordetella pertussis
uguugggccaccu

SEQ ID NO: 2408797 - RNA, 14 nt, Bordetella pertussis
uguuguccuggaca

SEQ ID NO: 2408798 - RNA, 14 nt, Bordetella pertussis
uguuguucagguug

SEQ ID NO: 2408799 - RNA, 14 nt, Bordetella pertussis
uguuguuggucgcc

SEQ ID NO: 2408800 - RNA, 16 nt, Bordetella pertussis
uguuucucgcucuugg

SEQ ID NO: 2408801 - RNA, 11 nt, Bordetella pertussis
uuacagcuuuu

SEQ ID NO: 2408802 - RNA, 11 nt, Bordetella pertussis
uuacaugcagc

SEQ ID NO: 2408803 - RNA, 21 nt, Bordetella pertussis
uuacgccgagaagauuuccca

SEQ ID NO: 2408804 - RNA, 20 nt, Bordetella pertussis
uuacuuguacgacgucuugc

SEQ ID NO: 2408805 - RNA, 13 nt, Bordetella pertussis
uuauacggcgcga

SEQ ID NO: 2408806 - RNA, 11 nt, Bordetella pertussis
uuauauauaga

SEQ ID NO: 2408807 - RNA, 14 nt, Bordetella pertussis
uucaaagaucugcu

SEQ ID NO: 2408808 - RNA, 20 nt, Bordetella pertussis
uucaaccggcguucuggcgc

SEQ ID NO: 2408809 - RNA, 22 nt, Bordetella pertussis
uucacagccauugcccacagca

SEQ ID NO: 2408810 - RNA, 23 nt, Bordetella pertussis
uucacagccauugcccacagcac

SEQ ID NO: 2408811 - RNA, 19 nt, Bordetella pertussis
uucacauagcccggcgcga

SEQ ID NO: 2408812 - RNA, 18 nt, Bordetella pertussis
uucaccaggaagcgcgcc

SEQ ID NO: 2408813 - RNA, 18 nt, Bordetella pertussis
uucaccccgccaccgccc

SEQ ID NO: 2408814 - RNA, 14 nt, Bordetella pertussis
uucaccgcuggacg

SEQ ID NO: 2408815 - RNA, 13 nt, Bordetella pertussis
uucacgcccagga

SEQ ID NO: 2408816 - RNA, 20 nt, Bordetella pertussis
uucacgcgcaagccgcugga

SEQ ID NO: 2408817 - RNA, 16 nt, Bordetella pertussis
uucagcauggagcugg

SEQ ID NO: 2408818 - RNA, 22 nt, Bordetella pertussis
uucagccacacgaucagcgccc

SEQ ID NO: 2408819 - RNA, 13 nt, Bordetella pertussis
uucagcccggcgc

SEQ ID NO: 2408820 - RNA, 20 nt, Bordetella pertussis
uucagccgcaagcuggcggc

SEQ ID NO: 2408821 - RNA, 18 nt, Bordetella pertussis
uucagcgccgagcgccag

SEQ ID NO: 2408822 - RNA, 20 nt, Bordetella pertussis
uucagcgcgccagcgcgcga

SEQ ID NO: 2408823 - RNA, 15 nt, Bordetella pertussis
uucagcgcgcgcgcc

SEQ ID NO: 2408824 - RNA, 16 nt, Bordetella pertussis
uucagcgcgcgcgccg

SEQ ID NO: 2408825 - RNA, 14 nt, Bordetella pertussis
uucaggaugccgcc

SEQ ID NO: 2408826 - RNA, 19 nt, Bordetella pertussis
uucaggccugcggcgccag

SEQ ID NO: 2408827 - RNA, 13 nt, Bordetella pertussis
uucaggcgccgca

SEQ ID NO: 2408828 - RNA, 13 nt, Bordetella pertussis
uucaggcgcgcgg

SEQ ID NO: 2408829 - RNA, 16 nt, Bordetella pertussis
uucaggcgcgcggcag

SEQ ID NO: 2408830 - RNA, 13 nt, Bordetella pertussis
uucagggcgccgg

SEQ ID NO: 2408831 - RNA, 14 nt, Bordetella pertussis
uucagggguagacg

SEQ ID NO: 2408832 - RNA, 12 nt, Bordetella pertussis
uucaggucgcga

SEQ ID NO: 2408833 - RNA, 21 nt, Bordetella pertussis
uucagugcucgggcugcggcu

SEQ ID NO: 2408834 - RNA, 15 nt, Bordetella pertussis
uucaucacgggcgcc

SEQ ID NO: 2408835 - RNA, 16 nt, Bordetella pertussis
uucauccagcgcgcga

SEQ ID NO: 2408836 - RNA, 21 nt, Bordetella pertussis
uucaucgagcauugccgcggc

SEQ ID NO: 2408837 - RNA, 19 nt, Bordetella pertussis
uucaugggcggcgagccga

SEQ ID NO: 2408838 - RNA, 20 nt, Bordetella pertussis
uuccaagcgcacgcgcagca

SEQ ID NO: 2408839 - RNA, 23 nt, Bordetella pertussis
uuccaaguugcucauggcggcac

SEQ ID NO: 2408840 - RNA, 11 nt, Bordetella pertussis
uuccacagcca

SEQ ID NO: 2408841 - RNA, 13 nt, Bordetella pertussis
uuccacagcgccg

SEQ ID NO: 2408842 - RNA, 17 nt, Bordetella pertussis
uuccagaacggcgcggg

SEQ ID NO: 2408843 - RNA, 19 nt, Bordetella pertussis
uuccagaucgaccaggacc

SEQ ID NO: 2408844 - RNA, 17 nt, Bordetella pertussis
uuccagaugcgcagcag

SEQ ID NO: 2408845 - RNA, 14 nt, Bordetella pertussis
uuccagccaggccu

SEQ ID NO: 2408846 - RNA, 15 nt, Bordetella pertussis
uuccagccaggccuc

SEQ ID NO: 2408847 - RNA, 19 nt, Bordetella pertussis
uuccagccaguacaggcug

SEQ ID NO: 2408848 - RNA, 18 nt, Bordetella pertussis
uuccagccuggcaaugcg

SEQ ID NO: 2408849 - RNA, 19 nt, Bordetella pertussis
uuccagcgccgccuucacc

SEQ ID NO: 2408850 - RNA, 17 nt, Bordetella pertussis
uuccagcucguccaggu

SEQ ID NO: 2408851 - RNA, 15 nt, Bordetella pertussis
uuccagcucugcucu

SEQ ID NO: 2408852 - RNA, 22 nt, Bordetella pertussis
uuccaggaaagaggccaggccc

SEQ ID NO: 2408853 - RNA, 16 nt, Bordetella pertussis
uuccaggacgacaggc

SEQ ID NO: 2408854 - RNA, 17 nt, Bordetella pertussis
uuccaggacgacaggca

SEQ ID NO: 2408855 - RNA, 21 nt, Bordetella pertussis
uuccaggacgacaggcaugca

SEQ ID NO: 2408856 - RNA, 22 nt, Bordetella pertussis
uuccaggacgacaggcaugcag

SEQ ID NO: 2408857 - RNA, 18 nt, Bordetella pertussis
uuccaggcauucccgccc

SEQ ID NO: 2408858 - RNA, 20 nt, Bordetella pertussis
uuccaggcgcccgccaccag

SEQ ID NO: 2408859 - RNA, 17 nt, Bordetella pertussis
uuccagggcgcgccgca

SEQ ID NO: 2408860 - RNA, 20 nt, Bordetella pertussis
uuccaggucaucaccagggu

SEQ ID NO: 2408861 - RNA, 20 nt, Bordetella pertussis
uuccauaugcugaaggucgc

SEQ ID NO: 2408862 - RNA, 16 nt, Bordetella pertussis
uuccaucagcucgacc

SEQ ID NO: 2408863 - RNA, 21 nt, Bordetella pertussis
uuccaucagcucgaccacggc

SEQ ID NO: 2408864 - RNA, 20 nt, Bordetella pertussis
uuccaucggggggcaggcug

SEQ ID NO: 2408865 - RNA, 19 nt, Bordetella pertussis
uucccagcuccacgcacac

SEQ ID NO: 2408866 - RNA, 21 nt, Bordetella pertussis
uucccaggcgaggcuggcgcc

SEQ ID NO: 2408867 - RNA, 14 nt, Bordetella pertussis
uucccauccuggcc

SEQ ID NO: 2408868 - RNA, 15 nt, Bordetella pertussis
uucccauccuggccg

SEQ ID NO: 2408869 - RNA, 13 nt, Bordetella pertussis
uuccccaucaucu

SEQ ID NO: 2408870 - RNA, 16 nt, Bordetella pertussis
uucccgcccagcgacg

SEQ ID NO: 2408871 - RNA, 11 nt, Bordetella pertussis
uucccguggcu

SEQ ID NO: 2408872 - RNA, 21 nt, Bordetella pertussis
uuccgcacgccgaccuggcgc

SEQ ID NO: 2408873 - RNA, 17 nt, Bordetella pertussis
uuccgccuacuggcgcg

SEQ ID NO: 2408874 - RNA, 23 nt, Bordetella pertussis
uuccgccuacuggcgcgcgcaag

SEQ ID NO: 2408875 - RNA, 17 nt, Bordetella pertussis
uuccgcgaaacggcggg

SEQ ID NO: 2408876 - RNA, 16 nt, Bordetella pertussis
uuccgcuaccaggcgc

SEQ ID NO: 2408877 - RNA, 24 nt, Bordetella pertussis
uuccgcuaccaggcgcgcgcgcgg

SEQ ID NO: 2408878 - RNA, 16 nt, Bordetella pertussis
uuccgcuuccggccgg

SEQ ID NO: 2408879 - RNA, 18 nt, Bordetella pertussis
uuccgcuucggacagcag

SEQ ID NO: 2408880 - RNA, 16 nt, Bordetella pertussis
uuccggaauccacagc

SEQ ID NO: 2408881 - RNA, 21 nt, Bordetella pertussis
uuccggcagcggccagcgcgg

SEQ ID NO: 2408882 - RNA, 20 nt, Bordetella pertussis
uuccggcaucaguucaggcu

SEQ ID NO: 2408883 - RNA, 15 nt, Bordetella pertussis
uuccggccccaugaa

SEQ ID NO: 2408884 - RNA, 19 nt, Bordetella pertussis
uuccggcucggaccuggcc

SEQ ID NO: 2408885 - RNA, 20 nt, Bordetella pertussis
uuccggcucggaccuggcca

SEQ ID NO: 2408886 - RNA, 21 nt, Bordetella pertussis
uuccgguucaccauugaaacg

SEQ ID NO: 2408887 - RNA, 14 nt, Bordetella pertussis
uuccguuugagaca

SEQ ID NO: 2408888 - RNA, 21 nt, Bordetella pertussis
uuccucccagaccugcgcgcc

SEQ ID NO: 2408889 - RNA, 15 nt, Bordetella pertussis
uuccucgaccagguc

SEQ ID NO: 2408890 - RNA, 19 nt, Bordetella pertussis
uuccucgccgcccagccgg

SEQ ID NO: 2408891 - RNA, 13 nt, Bordetella pertussis
uuccucggcgcgc

SEQ ID NO: 2408892 - RNA, 11 nt, Bordetella pertussis
uuccugaacga

SEQ ID NO: 2408893 - RNA, 23 nt, Bordetella pertussis
uuccugaacgacgguacaccuga

SEQ ID NO: 2408894 - RNA, 19 nt, Bordetella pertussis
uuccugcagcgugcugcgu

SEQ ID NO: 2408895 - RNA, 19 nt, Bordetella pertussis
uuccugccgcacuucgggc

SEQ ID NO: 2408896 - RNA, 20 nt, Bordetella pertussis
uuccugcugcgccuggcgga

SEQ ID NO: 2408897 - RNA, 23 nt, Bordetella pertussis
uuccugcuuugagcaggcgcugg

SEQ ID NO: 2408898 - RNA, 22 nt, Bordetella pertussis
uuccuggagcuuggccggugcc

SEQ ID NO: 2408899 - RNA, 14 nt, Bordetella pertussis
uuccuggccggcgc

SEQ ID NO: 2408900 - RNA, 13 nt, Bordetella pertussis
uuccuggcgcugu

SEQ ID NO: 2408901 - RNA, 13 nt, Bordetella pertussis
uuccugggugcgc

SEQ ID NO: 2408902 - RNA, 18 nt, Bordetella pertussis
uuccugggugcugccgcc

SEQ ID NO: 2408903 - RNA, 18 nt, Bordetella pertussis
uuccuggucacccggcgc

SEQ ID NO: 2408904 - RNA, 19 nt, Bordetella pertussis
uuccuggucacccggcgca

SEQ ID NO: 2408905 - RNA, 14 nt, Bordetella pertussis
uuccugguucaggc

SEQ ID NO: 2408906 - RNA, 23 nt, Bordetella pertussis
uuccuguucgccaaucugccgcu

SEQ ID NO: 2408907 - RNA, 13 nt, Bordetella pertussis
uuccuugccaucc

SEQ ID NO: 2408908 - RNA, 18 nt, Bordetella pertussis
uuccuuggucagcgaugu

SEQ ID NO: 2408909 - RNA, 15 nt, Bordetella pertussis
uuccuuuauugaaau

SEQ ID NO: 2408910 - RNA, 16 nt, Bordetella pertussis
uucgaacaacagcgcc

SEQ ID NO: 2408911 - RNA, 14 nt, Bordetella pertussis
uucgaacaaggcgg

SEQ ID NO: 2408912 - RNA, 15 nt, Bordetella pertussis
uucgaacaaggcggu

SEQ ID NO: 2408913 - RNA, 16 nt, Bordetella pertussis
uucgacacccuugcgc

SEQ ID NO: 2408914 - RNA, 15 nt, Bordetella pertussis
uucgacagcgcgcag

SEQ ID NO: 2408915 - RNA, 13 nt, Bordetella pertussis
uucgaccagcgac

SEQ ID NO: 2408916 - RNA, 22 nt, Bordetella pertussis
uucgaccugcccgagaccgccc

SEQ ID NO: 2408917 - RNA, 14 nt, Bordetella pertussis
uucgacgccggcag

SEQ ID NO: 2408918 - RNA, 15 nt, Bordetella pertussis
uucgacgggcaggcc

SEQ ID NO: 2408919 - RNA, 15 nt, Bordetella pertussis
uucgacguccagccc

SEQ ID NO: 2408920 - RNA, 18 nt, Bordetella pertussis
uucgacuucguccggcgc

SEQ ID NO: 2408921 - RNA, 18 nt, Bordetella pertussis
uucgagcaggcgcaggcc

SEQ ID NO: 2408922 - RNA, 22 nt, Bordetella pertussis
uucgagcaucauggcgcgcgcc

SEQ ID NO: 2408923 - RNA, 14 nt, Bordetella pertussis
uucgagcgcgcgca

SEQ ID NO: 2408924 - RNA, 18 nt, Bordetella pertussis
uucgagcgcggcgcgcga

SEQ ID NO: 2408925 - RNA, 16 nt, Bordetella pertussis
uucgaucgccuggggc

SEQ ID NO: 2408926 - RNA, 15 nt, Bordetella pertussis
uucgaugcuggcgcg

SEQ ID NO: 2408927 - RNA, 15 nt, Bordetella pertussis
uucgaugcuggcggc

SEQ ID NO: 2408928 - RNA, 17 nt, Bordetella pertussis
uucgauggcggccaggg

SEQ ID NO: 2408929 - RNA, 17 nt, Bordetella pertussis
uucgcaauacgucgcga

SEQ ID NO: 2408930 - RNA, 18 nt, Bordetella pertussis
uucgcauaccggccgcgg

SEQ ID NO: 2408931 - RNA, 22 nt, Bordetella pertussis
uucgcauacggacgagcgcagc

SEQ ID NO: 2408932 - RNA, 23 nt, Bordetella pertussis
uucgcauacggacgagcgcagca

SEQ ID NO: 2408933 - RNA, 20 nt, Bordetella pertussis
uucgcccaccaccagcggcg

SEQ ID NO: 2408934 - RNA, 21 nt, Bordetella pertussis
uucgcccagcgcuugcacgcc

SEQ ID NO: 2408935 - RNA, 21 nt, Bordetella pertussis
uucgcccgccaccacgcgcac

SEQ ID NO: 2408936 - RNA, 12 nt, Bordetella pertussis
uucgcccgugcc

SEQ ID NO: 2408937 - RNA, 12 nt, Bordetella pertussis
uucgccgcgcac

SEQ ID NO: 2408938 - RNA, 14 nt, Bordetella pertussis
uucgccgcgcacag

SEQ ID NO: 2408939 - RNA, 17 nt, Bordetella pertussis
uucgccgcgcacagccc

SEQ ID NO: 2408940 - RNA, 22 nt, Bordetella pertussis
uucgccggaggcgcgcagcucc

SEQ ID NO: 2408941 - RNA, 14 nt, Bordetella pertussis
uucgccgggcggcg

SEQ ID NO: 2408942 - RNA, 16 nt, Bordetella pertussis
uucgccgugcagggcc

SEQ ID NO: 2408943 - RNA, 20 nt, Bordetella pertussis
uucgccguggcuggucacgu

SEQ ID NO: 2408944 - RNA, 19 nt, Bordetella pertussis
uucgccuggccggcuugca

SEQ ID NO: 2408945 - RNA, 12 nt, Bordetella pertussis
uucgccuggcgg

SEQ ID NO: 2408946 - RNA, 19 nt, Bordetella pertussis
uucgcgaccugcgggcgca

SEQ ID NO: 2408947 - RNA, 16 nt, Bordetella pertussis
uucgcgauccagcagc

SEQ ID NO: 2408948 - RNA, 13 nt, Bordetella pertussis
uucgcgcaccagc

SEQ ID NO: 2408949 - RNA, 11 nt, Bordetella pertussis
uucgcgcagca

SEQ ID NO: 2408950 - RNA, 19 nt, Bordetella pertussis
uucgcgcagcaacccgccc

SEQ ID NO: 2408951 - RNA, 23 nt, Bordetella pertussis
uucgcgcagcagcuugccgaccg

SEQ ID NO: 2408952 - RNA, 12 nt, Bordetella pertussis
uucgcgcagcgc

SEQ ID NO: 2408953 - RNA, 19 nt, Bordetella pertussis
uucgcgcgccagcgcggcg

SEQ ID NO: 2408954 - RNA, 14 nt, Bordetella pertussis
uucgcgcgcgccug

SEQ ID NO: 2408955 - RNA, 18 nt, Bordetella pertussis
uucgcgcugcccaccgcc

SEQ ID NO: 2408956 - RNA, 20 nt, Bordetella pertussis
uucgcgucgucguuucccag

SEQ ID NO: 2408957 - RNA, 18 nt, Bordetella pertussis
uucgcugacgcguucuuc

SEQ ID NO: 2408958 - RNA, 18 nt, Bordetella pertussis
uucgcugcgaaacagcag

SEQ ID NO: 2408959 - RNA, 15 nt, Bordetella pertussis
uucgcuggcggaccg

SEQ ID NO: 2408960 - RNA, 22 nt, Bordetella pertussis
uucgcuggcggaccgaacggcc

SEQ ID NO: 2408961 - RNA, 21 nt, Bordetella pertussis
uucggccacuuucgcgcgcgc

SEQ ID NO: 2408962 - RNA, 14 nt, Bordetella pertussis
uucggccagcggca

SEQ ID NO: 2408963 - RNA, 15 nt, Bordetella pertussis
uucggccgccaggua

SEQ ID NO: 2408964 - RNA, 19 nt, Bordetella pertussis
uucggccggcugcgcgccg

SEQ ID NO: 2408965 - RNA, 17 nt, Bordetella pertussis
uucggccgucagcagca

SEQ ID NO: 2408966 - RNA, 18 nt, Bordetella pertussis
uucggccgucagcagcag

SEQ ID NO: 2408967 - RNA, 19 nt, Bordetella pertussis
uucggcgaacgacagaccg

SEQ ID NO: 2408968 - RNA, 14 nt, Bordetella pertussis
uucggcgaccaggu

SEQ ID NO: 2408969 - RNA, 22 nt, Bordetella pertussis
uucggcgacgaucuccaccccc

SEQ ID NO: 2408970 - RNA, 12 nt, Bordetella pertussis
uucggcgagccg

SEQ ID NO: 2408971 - RNA, 20 nt, Bordetella pertussis
uucggcgcgcgugccgcgca

SEQ ID NO: 2408972 - RNA, 21 nt, Bordetella pertussis
uucggcgcgcgugccgcgcag

SEQ ID NO: 2408973 - RNA, 20 nt, Bordetella pertussis
uucggcgcggcgggcgcugg

SEQ ID NO: 2408974 - RNA, 22 nt, Bordetella pertussis
uucggcgcggcgggcucagccc

SEQ ID NO: 2408975 - RNA, 23 nt, Bordetella pertussis
uucggcgcgugcggaugcagcag

SEQ ID NO: 2408976 - RNA, 21 nt, Bordetella pertussis
uucggcggccagccggcgcgc

SEQ ID NO: 2408977 - RNA, 22 nt, Bordetella pertussis
uucggcggccagccggcgcgcc

SEQ ID NO: 2408978 - RNA, 16 nt, Bordetella pertussis
uucggcggccaugccg

SEQ ID NO: 2408979 - RNA, 16 nt, Bordetella pertussis
uucggcgucggugccg

SEQ ID NO: 2408980 - RNA, 15 nt, Bordetella pertussis
uucggcuugcacgcc

SEQ ID NO: 2408981 - RNA, 19 nt, Bordetella pertussis
uucgggcaugucgcggccc

SEQ ID NO: 2408982 - RNA, 17 nt, Bordetella pertussis
uucgggcgcggugcgca

SEQ ID NO: 2408983 - RNA, 21 nt, Bordetella pertussis
uucgggcgcggugcgcaccag

SEQ ID NO: 2408984 - RNA, 20 nt, Bordetella pertussis
uucgggcggcaggugcgcca

SEQ ID NO: 2408985 - RNA, 12 nt, Bordetella pertussis
uucggggcagcg

SEQ ID NO: 2408986 - RNA, 15 nt, Bordetella pertussis
uucggggcagggcgc

SEQ ID NO: 2408987 - RNA, 14 nt, Bordetella pertussis
uucggguugcaaau

SEQ ID NO: 2408988 - RNA, 17 nt, Bordetella pertussis
uucggugcgcagcggca

SEQ ID NO: 2408989 - RNA, 18 nt, Bordetella pertussis
uucggugcgcagcggcag

SEQ ID NO: 2408990 - RNA, 15 nt, Bordetella pertussis
uucgguggcgcgcag

SEQ ID NO: 2408991 - RNA, 13 nt, Bordetella pertussis
uucggugucggcg

SEQ ID NO: 2408992 - RNA, 20 nt, Bordetella pertussis
uucgucagggccgcagcacc

SEQ ID NO: 2408993 - RNA, 13 nt, Bordetella pertussis
uucguccagguug

SEQ ID NO: 2408994 - RNA, 19 nt, Bordetella pertussis
uucguccucgaccaggaug

SEQ ID NO: 2408995 - RNA, 16 nt, Bordetella pertussis
uucgucgagcucgaug

SEQ ID NO: 2408996 - RNA, 15 nt, Bordetella pertussis
uucgucgcgcagcag

SEQ ID NO: 2408997 - RNA, 13 nt, Bordetella pertussis
uucgucgcgccag

SEQ ID NO: 2408998 - RNA, 16 nt, Bordetella pertussis
uucgucggcgcucuug

SEQ ID NO: 2408999 - RNA, 15 nt, Bordetella pertussis
uucgucgggcagcgc

SEQ ID NO: 2409000 - RNA, 19 nt, Bordetella pertussis
uucgucgucgccaccgccc

SEQ ID NO: 2409001 - RNA, 20 nt, Bordetella pertussis
uucgucgucggucggcuuga

SEQ ID NO: 2409002 - RNA, 21 nt, Bordetella pertussis
uucgugcaccagcccgaugcg

SEQ ID NO: 2409003 - RNA, 13 nt, Bordetella pertussis
uucuccagcgcca

SEQ ID NO: 2409004 - RNA, 13 nt, Bordetella pertussis
uucucgcugcuga

SEQ ID NO: 2409005 - RNA, 19 nt, Bordetella pertussis
uucucggccucgcggcgca

SEQ ID NO: 2409006 - RNA, 23 nt, Bordetella pertussis
uucucggccucgcggcgcagcau

SEQ ID NO: 2409007 - RNA, 17 nt, Bordetella pertussis
uucucgggcgucaugcg

SEQ ID NO: 2409008 - RNA, 18 nt, Bordetella pertussis
uucucggugcgccgccgc

SEQ ID NO: 2409009 - RNA, 19 nt, Bordetella pertussis
uucugcaaggccugcugca

SEQ ID NO: 2409010 - RNA, 18 nt, Bordetella pertussis
uucugcagcgugcggaca

SEQ ID NO: 2409011 - RNA, 14 nt, Bordetella pertussis
uucugcaucggcau

SEQ ID NO: 2409012 - RNA, 17 nt, Bordetella pertussis
uucugccagacggccag

SEQ ID NO: 2409013 - RNA, 16 nt, Bordetella pertussis
uucugcgccugcuggu

SEQ ID NO: 2409014 - RNA, 22 nt, Bordetella pertussis
uucugcgccugcuggucggccu

SEQ ID NO: 2409015 - RNA, 15 nt, Bordetella pertussis
uucugcuugccggcc

SEQ ID NO: 2409016 - RNA, 20 nt, Bordetella pertussis
uucuggaagauguaccagcc

SEQ ID NO: 2409017 - RNA, 21 nt, Bordetella pertussis
uucuggaagauguaccagccc

SEQ ID NO: 2409018 - RNA, 14 nt, Bordetella pertussis
uucuggacgcugac

SEQ ID NO: 2409019 - RNA, 16 nt, Bordetella pertussis
uucuggacgcugaccg

SEQ ID NO: 2409020 - RNA, 13 nt, Bordetella pertussis
uucuggcgcagca

SEQ ID NO: 2409021 - RNA, 20 nt, Bordetella pertussis
uucuggcgcagcaaggcgcg

SEQ ID NO: 2409022 - RNA, 20 nt, Bordetella pertussis
uucuuccaguucgcuuucca

SEQ ID NO: 2409023 - RNA, 12 nt, Bordetella pertussis
uucuugccggcc

SEQ ID NO: 2409024 - RNA, 21 nt, Bordetella pertussis
uucuugcugcuguuggcgugg

SEQ ID NO: 2409025 - RNA, 19 nt, Bordetella pertussis
uucuuguugcucuugaccu

SEQ ID NO: 2409026 - RNA, 20 nt, Bordetella pertussis
uugaacaccccggucagcag

SEQ ID NO: 2409027 - RNA, 22 nt, Bordetella pertussis
uugaacagccgccccagcagca

SEQ ID NO: 2409028 - RNA, 21 nt, Bordetella pertussis
uugaacagcuggaagcgcgcc

SEQ ID NO: 2409029 - RNA, 19 nt, Bordetella pertussis
uugaacucggccagcagcu

SEQ ID NO: 2409030 - RNA, 13 nt, Bordetella pertussis
uugaacugcaggc

SEQ ID NO: 2409031 - RNA, 14 nt, Bordetella pertussis
uugaacugcgcggu

SEQ ID NO: 2409032 - RNA, 18 nt, Bordetella pertussis
uugaacugcgcggucuug

SEQ ID NO: 2409033 - RNA, 21 nt, Bordetella pertussis
uugaacugcuggaacaccaug

SEQ ID NO: 2409034 - RNA, 16 nt, Bordetella pertussis
uugaagacgcccaggu

SEQ ID NO: 2409035 - RNA, 22 nt, Bordetella pertussis
uugaagcgguauucguugccga

SEQ ID NO: 2409036 - RNA, 21 nt, Bordetella pertussis
uugaaggcgaugggcaccugc

SEQ ID NO: 2409037 - RNA, 18 nt, Bordetella pertussis
uugaaggcuuucugcuug

SEQ ID NO: 2409038 - RNA, 15 nt, Bordetella pertussis
uugaaguugcucggc

SEQ ID NO: 2409039 - RNA, 18 nt, Bordetella pertussis
uggcguugacggcccagc

SEQ ID NO: 2409040 - RNA, 23 nt, Bordetella pertussis
uggcguugacguggcugagccau

SEQ ID NO: 2409041 - RNA, 23 nt, Bordetella pertussis
uggcguugaugaugaucggcgcc

SEQ ID NO: 2409042 - RNA, 20 nt, Bordetella pertussis
uggcguugauguccggguug

SEQ ID NO: 2409043 - RNA, 15 nt, Bordetella pertussis
uggcguugccggccu

SEQ ID NO: 2409044 - RNA, 20 nt, Bordetella pertussis
uggcguugcgcaccaugugc

SEQ ID NO: 2409045 - RNA, 14 nt, Bordetella pertussis
uggcguuggccugc

SEQ ID NO: 2409046 - RNA, 17 nt, Bordetella pertussis
uggcguuggccugccau

SEQ ID NO: 2409047 - RNA, 14 nt, Bordetella pertussis
uggcguuugcgcgc

SEQ ID NO: 2409048 - RNA, 17 nt, Bordetella pertussis
uggcguuuuuccaggaa

SEQ ID NO: 2409049 - RNA, 17 nt, Bordetella pertussis
uggcuaaaaggaaauau

SEQ ID NO: 2409050 - RNA, 23 nt, Bordetella pertussis
uggcucaugguuucgagcaucau

SEQ ID NO: 2409051 - RNA, 14 nt, Bordetella pertussis
uggcucccaccggu

SEQ ID NO: 2409052 - RNA, 23 nt, Bordetella pertussis
uggcucguucgcucggcguccuc

SEQ ID NO: 2409053 - RNA, 19 nt, Bordetella pertussis
uggcucuccgugcaucggc

SEQ ID NO: 2409054 - RNA, 13 nt, Bordetella pertussis
uggcucugaucgc

SEQ ID NO: 2409055 - RNA, 21 nt, Bordetella pertussis
uggcugacgauguucaggcca

SEQ ID NO: 2409056 - RNA, 21 nt, Bordetella pertussis
uggcugagccauuccggcugg

SEQ ID NO: 2409057 - RNA, 15 nt, Bordetella pertussis
uggcugcccuggcgc

SEQ ID NO: 2409058 - RNA, 14 nt, Bordetella pertussis
uggcugcgcgccgu

SEQ ID NO: 2409059 - RNA, 16 nt, Bordetella pertussis
uggcugcgcgccuggc

SEQ ID NO: 2409060 - RNA, 17 nt, Bordetella pertussis
uggcuggacgcgcgcgg

SEQ ID NO: 2409061 - RNA, 20 nt, Bordetella pertussis
uggcuggggcuggcauggcg

SEQ ID NO: 2409062 - RNA, 13 nt, Bordetella pertussis
uggcuggucacgu

SEQ ID NO: 2409063 - RNA, 17 nt, Bordetella pertussis
uggcuguaucuggccug

SEQ ID NO: 2409064 - RNA, 19 nt, Bordetella pertussis
uggcuguaucuggccuguc

SEQ ID NO: 2409065 - RNA, 19 nt, Bordetella pertussis
uggcuucccgguccaggcc

SEQ ID NO: 2409066 - RNA, 21 nt, Bordetella pertussis
uggcuucgcgcacauccagcc

SEQ ID NO: 2409067 - RNA, 17 nt, Bordetella pertussis
uggcuucgucgccggcg

SEQ ID NO: 2409068 - RNA, 18 nt, Bordetella pertussis
uggcuucgucgccggcgu

SEQ ID NO: 2409069 - RNA, 14 nt, Bordetella pertussis
uggcuugcagcgcc

SEQ ID NO: 2409070 - RNA, 15 nt, Bordetella pertussis
uggcuuggcgcuuac

SEQ ID NO: 2409071 - RNA, 15 nt, Bordetella pertussis
uggcuuggcggccag

SEQ ID NO: 2409072 - RNA, 16 nt, Bordetella pertussis
ugggaaauccgccggg

SEQ ID NO: 2409073 - RNA, 22 nt, Bordetella pertussis
ugggacaggcacaccgugccgc

SEQ ID NO: 2409074 - RNA, 19 nt, Bordetella pertussis
ugggacaggcacaccgugg

SEQ ID NO: 2409075 - RNA, 22 nt, Bordetella pertussis
ugggacaggcacaccguggcau

SEQ ID NO: 2409076 - RNA, 19 nt, Bordetella pertussis
ugggacaggcccagcccgc

SEQ ID NO: 2409077 - RNA, 13 nt, Bordetella pertussis
ugggacgcggccu

SEQ ID NO: 2409078 - RNA, 21 nt, Bordetella pertussis
ugggagagccggccacgcgcu

SEQ ID NO: 2409079 - RNA, 21 nt, Bordetella pertussis
ugggaggcgugcugcaccugc

SEQ ID NO: 2409080 - RNA, 14 nt, Bordetella pertussis
ugggaucgcgccag

SEQ ID NO: 2409081 - RNA, 15 nt, Bordetella pertussis
ugggaucggccaggc

SEQ ID NO: 2409082 - RNA, 14 nt, Bordetella pertussis
ugggcaaaacgcgc

SEQ ID NO: 2409083 - RNA, 21 nt, Bordetella pertussis
ugggcaaccgccacgugcugc

SEQ ID NO: 2409084 - RNA, 16 nt, Bordetella pertussis
ugggcaagccgauccg

SEQ ID NO: 2409085 - RNA, 19 nt, Bordetella pertussis
ugggcacauacagcggagc

SEQ ID NO: 2409086 - RNA, 19 nt, Bordetella pertussis
ugggcacauccagcgccag

SEQ ID NO: 2409087 - RNA, 17 nt, Bordetella pertussis
ugggcaccaccaccgcc

SEQ ID NO: 2409088 - RNA, 19 nt, Bordetella pertussis
ugggcaccgugaugcgcgc

SEQ ID NO: 2409089 - RNA, 21 nt, Bordetella pertussis
ugggcaccgugaugcgcgccg

SEQ ID NO: 2409090 - RNA, 20 nt, Bordetella pertussis
ugggcaccucggggugcagc

SEQ ID NO: 2409091 - RNA, 17 nt, Bordetella pertussis
ugggcacgccggccuug

SEQ ID NO: 2409092 - RNA, 14 nt, Bordetella pertussis
ugggcacgcgcgcg

SEQ ID NO: 2409093 - RNA, 20 nt, Bordetella pertussis
ugggcacgcgcgcggcgcgg

SEQ ID NO: 2409094 - RNA, 17 nt, Bordetella pertussis
ugggcaggcuggcgcgg

SEQ ID NO: 2409095 - RNA, 16 nt, Bordetella pertussis
ugggcaguucgcccgg

SEQ ID NO: 2409096 - RNA, 17 nt, Bordetella pertussis
ugggcaguucgcccggc

SEQ ID NO: 2409097 - RNA, 21 nt, Bordetella pertussis
ugggcaguucgcccggcucca

SEQ ID NO: 2409098 - RNA, 15 nt, Bordetella pertussis
ugggcauagcgcgcc

SEQ ID NO: 2409099 - RNA, 13 nt, Bordetella pertussis
ugggcaucagggg

SEQ ID NO: 2409100 - RNA, 22 nt, Bordetella pertussis
ugggcaucaggggcucggccag

SEQ ID NO: 2409101 - RNA, 23 nt, Bordetella pertussis
ugggcaucaggggcucggccagg

SEQ ID NO: 2409102 - RNA, 18 nt, Bordetella pertussis
ugggcaugggcggcccgg

SEQ ID NO: 2409103 - RNA, 17 nt, Bordetella pertussis
ugggcaugguggcgaag

SEQ ID NO: 2409104 - RNA, 22 nt, Bordetella pertussis
ugggccaaccacgagcugcagc

SEQ ID NO: 2409105 - RNA, 22 nt, Bordetella pertussis
ugggccacagggcgaaggccag

SEQ ID NO: 2409106 - RNA, 18 nt, Bordetella pertussis
ugggccagcaacuggugc

SEQ ID NO: 2409107 - RNA, 20 nt, Bordetella pertussis
ugggccagcagcuggcgcag

SEQ ID NO: 2409108 - RNA, 18 nt, Bordetella pertussis
ugggccagcaggcucagc

SEQ ID NO: 2409109 - RNA, 16 nt, Bordetella pertussis
ugggccagcaggucgu

SEQ ID NO: 2409110 - RNA, 13 nt, Bordetella pertussis
ugggccagccagc

SEQ ID NO: 2409111 - RNA, 24 nt, Bordetella pertussis
ugggccaggcgcuccagcaccugc

SEQ ID NO: 2409112 - RNA, 13 nt, Bordetella pertussis
ugggccagggccu

SEQ ID NO: 2409113 - RNA, 21 nt, Bordetella pertussis
ugggccaguccgcagcgcagc

SEQ ID NO: 2409114 - RNA, 18 nt, Bordetella pertussis
ugggccaguucgcggcgc

SEQ ID NO: 2409115 - RNA, 21 nt, Bordetella pertussis
ugggccaugcguaucggcagc

SEQ ID NO: 2409116 - RNA, 15 nt, Bordetella pertussis
ugggcccgaucgccg

SEQ ID NO: 2409117 - RNA, 13 nt, Bordetella pertussis
ugggcccgggcgc

SEQ ID NO: 2409118 - RNA, 15 nt, Bordetella pertussis
ugggcccgggcgcgc

SEQ ID NO: 2409119 - RNA, 16 nt, Bordetella pertussis
ugggcccgggcgcgcu

SEQ ID NO: 2409120 - RNA, 15 nt, Bordetella pertussis
ugggccgacaugccg

SEQ ID NO: 2409121 - RNA, 14 nt, Bordetella pertussis
ugggccgagcgcgc

SEQ ID NO: 2409122 - RNA, 18 nt, Bordetella pertussis
ugggccgagcgcgccagc

SEQ ID NO: 2409123 - RNA, 13 nt, Bordetella pertussis
ugggccgaggcgc

SEQ ID NO: 2409124 - RNA, 23 nt, Bordetella pertussis
ugggccgccugcugggccgcgcu

SEQ ID NO: 2409125 - RNA, 13 nt, Bordetella pertussis
ugggccgcgccug

SEQ ID NO: 2409126 - RNA, 14 nt, Bordetella pertussis
ugggccggcgcgcg

SEQ ID NO: 2409127 - RNA, 15 nt, Bordetella pertussis
ugggccggcgcgcgc

SEQ ID NO: 2409128 - RNA, 22 nt, Bordetella pertussis
ugggccggcgcgcgcaggcgcu

SEQ ID NO: 2409129 - RNA, 14 nt, Bordetella pertussis
ugggccucggccag

SEQ ID NO: 2409130 - RNA, 14 nt, Bordetella pertussis
ugggccugcggcgu

SEQ ID NO: 2409131 - RNA, 22 nt, Bordetella pertussis
ugggccugcugucgcugggaug

SEQ ID NO: 2409132 - RNA, 13 nt, Bordetella pertussis
ugggccugggcgc

SEQ ID NO: 2409133 - RNA, 17 nt, Bordetella pertussis
ugggccuguacuggaug

SEQ ID NO: 2409134 - RNA, 16 nt, Bordetella pertussis
ugggcgaagccacggc

SEQ ID NO: 2409135 - RNA, 19 nt, Bordetella pertussis
ugggcgaagccacggcccg

SEQ ID NO: 2409136 - RNA, 23 nt, Bordetella pertussis
ugggcgaagccacggcccgccag

SEQ ID NO: 2409137 - RNA, 18 nt, Bordetella pertussis
ugggcgaauccaccggcg

SEQ ID NO: 2409138 - RNA, 15 nt, Bordetella pertussis
ugggcgacgcggcgu

SEQ ID NO: 2409139 - RNA, 13 nt, Bordetella pertussis
ugggcgagcaggc

SEQ ID NO: 2409140 - RNA, 18 nt, Bordetella pertussis
ugggcgagguagggcgcg

SEQ ID NO: 2409141 - RNA, 19 nt, Bordetella pertussis
ugggcgagguagggcgcgg

SEQ ID NO: 2409142 - RNA, 23 nt, Bordetella pertussis
ugggcgagguagggcgcggccag

SEQ ID NO: 2409143 - RNA, 15 nt, Bordetella pertussis
ugggcgccggccagg

SEQ ID NO: 2409144 - RNA, 16 nt, Bordetella pertussis
ugggcgccggccagga

SEQ ID NO: 2409145 - RNA, 15 nt, Bordetella pertussis
ugggcgccggcggcg

SEQ ID NO: 2409146 - RNA, 18 nt, Bordetella pertussis
ugggcgccuacggcggcg

SEQ ID NO: 2409147 - RNA, 18 nt, Bordetella pertussis
ugggcgccugcggggccg

SEQ ID NO: 2409148 - RNA, 16 nt, Bordetella pertussis
ugggcgcgaugggccu

SEQ ID NO: 2409149 - RNA, 20 nt, Bordetella pertussis
ugggcgcgaugggccugccc

SEQ ID NO: 2409150 - RNA, 21 nt, Bordetella pertussis
ugggcgcgaugggccugccca

SEQ ID NO: 2409151 - RNA, 15 nt, Bordetella pertussis
ugggcgcgcccggcg

SEQ ID NO: 2409152 - RNA, 14 nt, Bordetella pertussis
ugggcgcgcgccag

SEQ ID NO: 2409153 - RNA, 18 nt, Bordetella pertussis
ugggcgcgcgccagguug

SEQ ID NO: 2409154 - RNA, 13 nt, Bordetella pertussis
agcccccugcggg

SEQ ID NO: 2409155 - RNA, 13 nt, Bordetella pertussis
agccccgcggccg

SEQ ID NO: 2409156 - RNA, 12 nt, Bordetella pertussis
agccccggcgcg

SEQ ID NO: 2409157 - RNA, 19 nt, Bordetella pertussis
agccccggcgcgccggccg

SEQ ID NO: 2409158 - RNA, 12 nt, Bordetella pertussis
agccccugcggg

SEQ ID NO: 2409159 - RNA, 16 nt, Bordetella pertussis
agcccgacggccagcg

SEQ ID NO: 2409160 - RNA, 16 nt, Bordetella pertussis
agcccgagcggcgcca

SEQ ID NO: 2409161 - RNA, 21 nt, Bordetella pertussis
agcccgaggcacaaggccgag

SEQ ID NO: 2409162 - RNA, 14 nt, Bordetella pertussis
agcccgaucgacgg

SEQ ID NO: 2409163 - RNA, 15 nt, Bordetella pertussis
agcccgaucgacggc

SEQ ID NO: 2409164 - RNA, 17 nt, Bordetella pertussis
agcccgaucgacggccg

SEQ ID NO: 2409165 - RNA, 11 nt, Bordetella pertussis
agcccgaugcc

SEQ ID NO: 2409166 - RNA, 20 nt, Bordetella pertussis
agcccgaugccgccaugcgc

SEQ ID NO: 2409167 - RNA, 16 nt, Bordetella pertussis
agcccgaugcgccagg

SEQ ID NO: 2409168 - RNA, 16 nt, Bordetella pertussis
agcccgcacauacaag

SEQ ID NO: 2409169 - RNA, 21 nt, Bordetella pertussis
agcccgcacauacaaggcgcg

SEQ ID NO: 2409170 - RNA, 14 nt, Bordetella pertussis
agcccgcaccgccc

SEQ ID NO: 2409171 - RNA, 13 nt, Bordetella pertussis
agcccgccaucgc

SEQ ID NO: 2409172 - RNA, 19 nt, Bordetella pertussis
agcccgccaucgccaggac

SEQ ID NO: 2409173 - RNA, 19 nt, Bordetella pertussis
agcccgcccgcgcccagcu

SEQ ID NO: 2409174 - RNA, 14 nt, Bordetella pertussis
agcccgccggcgcg

SEQ ID NO: 2409175 - RNA, 17 nt, Bordetella pertussis
agcccgccggcgcgcgc

SEQ ID NO: 2409176 - RNA, 17 nt, Bordetella pertussis
agcccgccuggcgccgc

SEQ ID NO: 2409177 - RNA, 18 nt, Bordetella pertussis
agcccgccuggcgccgcg

SEQ ID NO: 2409178 - RNA, 17 nt, Bordetella pertussis
agcccgcgcacgcccgc

SEQ ID NO: 2409179 - RNA, 15 nt, Bordetella pertussis
agcccgcgccaccac

SEQ ID NO: 2409180 - RNA, 13 nt, Bordetella pertussis
agcccgcgcgcgu

SEQ ID NO: 2409181 - RNA, 16 nt, Bordetella pertussis
agcccgcgcgcguuca

SEQ ID NO: 2409182 - RNA, 16 nt, Bordetella pertussis
agcccgcgcuggcgca

SEQ ID NO: 2409183 - RNA, 20 nt, Bordetella pertussis
agcccgcggccaccaggcug

SEQ ID NO: 2409184 - RNA, 16 nt, Bordetella pertussis
agcccgcgucggcgcg

SEQ ID NO: 2409185 - RNA, 18 nt, Bordetella pertussis
agcccgcguucaggcgcg

SEQ ID NO: 2409186 - RNA, 19 nt, Bordetella pertussis
agcccgcugccgagacggc

SEQ ID NO: 2409187 - RNA, 20 nt, Bordetella pertussis
agcccgcugccgagacggcc

SEQ ID NO: 2409188 - RNA, 21 nt, Bordetella pertussis
agcccgcugccgagacggccg

SEQ ID NO: 2409189 - RNA, 13 nt, Bordetella pertussis
agcccgcuggccg

SEQ ID NO: 2409190 - RNA, 21 nt, Bordetella pertussis
agcccgcuggccgaucugcug

SEQ ID NO: 2409191 - RNA, 19 nt, Bordetella pertussis
agcccggcaccaugcgcac

SEQ ID NO: 2409192 - RNA, 20 nt, Bordetella pertussis
agcccggccagagccuggaa

SEQ ID NO: 2409193 - RNA, 17 nt, Bordetella pertussis
agcccggccccaggccg

SEQ ID NO: 2409194 - RNA, 18 nt, Bordetella pertussis
agcccggccccaggccgg

SEQ ID NO: 2409195 - RNA, 21 nt, Bordetella pertussis
agccggcaagccagggcagga

SEQ ID NO: 2409196 - RNA, 16 nt, Bordetella pertussis
agccggcacgccugcc

SEQ ID NO: 2409197 - RNA, 17 nt, Bordetella pertussis
agccggcacgccugccg

SEQ ID NO: 2409198 - RNA, 19 nt, Bordetella pertussis
agccggcacgccugccgcg

SEQ ID NO: 2409199 - RNA, 20 nt, Bordetella pertussis
agccggccacgcgcugcagc

SEQ ID NO: 2409200 - RNA, 22 nt, Bordetella pertussis
agccggccacgcgcugcagcag

SEQ ID NO: 2409201 - RNA, 13 nt, Bordetella pertussis
agccggccagcgc

SEQ ID NO: 2409202 - RNA, 21 nt, Bordetella pertussis
agccggccagcgccugggcgc

SEQ ID NO: 2409203 - RNA, 12 nt, Bordetella pertussis
agccggccaggu

SEQ ID NO: 2409204 - RNA, 13 nt, Bordetella pertussis
agccggccauggc

SEQ ID NO: 2409205 - RNA, 17 nt, Bordetella pertussis
agccggccauggccgcc

SEQ ID NO: 2409206 - RNA, 12 nt, Bordetella pertussis
agccggcccagc

SEQ ID NO: 2409207 - RNA, 12 nt, Bordetella pertussis
agcgccggggcg

SEQ ID NO: 2409208 - RNA, 17 nt, Bordetella pertussis
agcgccggggcguggcc

SEQ ID NO: 2409209 - RNA, 23 nt, Bordetella pertussis
agcgccggggggcgcacgccgcg

SEQ ID NO: 2409210 - RNA, 22 nt, Bordetella pertussis
agcgccggggucagcgccggca

SEQ ID NO: 2409211 - RNA, 23 nt, Bordetella pertussis
agcgccgggucaucgagguggcg

SEQ ID NO: 2409212 - RNA, 16 nt, Bordetella pertussis
agcgccguaccagcgc

SEQ ID NO: 2409213 - RNA, 23 nt, Bordetella pertussis
agcgccucaucguucugcgucaa

SEQ ID NO: 2409214 - RNA, 16 nt, Bordetella pertussis
agcgccucgcaucggc

SEQ ID NO: 2409215 - RNA, 12 nt, Bordetella pertussis
agcgccucgcgc

SEQ ID NO: 2409216 - RNA, 14 nt, Bordetella pertussis
agcgccucgcgcuc

SEQ ID NO: 2409217 - RNA, 17 nt, Bordetella pertussis
agcgccucgcgcuccau

SEQ ID NO: 2409218 - RNA, 17 nt, Bordetella pertussis
agcgccucgcgcucgag

SEQ ID NO: 2409219 - RNA, 21 nt, Bordetella pertussis
agcgccucgcgcucgagcgcg

SEQ ID NO: 2409220 - RNA, 17 nt, Bordetella pertussis
agcgccucgucgcgcaa

SEQ ID NO: 2409221 - RNA, 13 nt, Bordetella pertussis
agcgccucguucc

SEQ ID NO: 2409222 - RNA, 15 nt, Bordetella pertussis
agcgccucguuccug

SEQ ID NO: 2409223 - RNA, 19 nt, Bordetella pertussis
agcgccucguuccuguucc

SEQ ID NO: 2409224 - RNA, 21 nt, Bordetella pertussis
agcgccucguuccuguuccug

SEQ ID NO: 2409225 - RNA, 13 nt, Bordetella pertussis
agcgccugcaggc

SEQ ID NO: 2409226 - RNA, 13 nt, Bordetella pertussis
agcgccugccgcg

SEQ ID NO: 2409227 - RNA, 22 nt, Bordetella pertussis
agcgccugccgcgugcccgcgu

SEQ ID NO: 2409228 - RNA, 12 nt, Bordetella pertussis
agcgccugcgcg

SEQ ID NO: 2409229 - RNA, 12 nt, Bordetella pertussis
agcgccuggccg

SEQ ID NO: 2409230 - RNA, 13 nt, Bordetella pertussis
agcgccuggccga

SEQ ID NO: 2409231 - RNA, 14 nt, Bordetella pertussis
agcgccuggccgag

SEQ ID NO: 2409232 - RNA, 12 nt, Bordetella pertussis
agcgccuggcgg

SEQ ID NO: 2409233 - RNA, 16 nt, Bordetella pertussis
agcgccuggcgggccu

SEQ ID NO: 2409234 - RNA, 15 nt, Bordetella pertussis
agcgccugggcggcc

SEQ ID NO: 2409235 - RNA, 16 nt, Bordetella pertussis
agcgccugggcggcca

SEQ ID NO: 2409236 - RNA, 19 nt, Bordetella pertussis
agcgccugggguaggcgcg

SEQ ID NO: 2409237 - RNA, 23 nt, Bordetella pertussis
agcgccugggguaggcgcggucc

SEQ ID NO: 2409238 - RNA, 14 nt, Bordetella pertussis
agcgccuugcggcg

SEQ ID NO: 2409239 - RNA, 19 nt, Bordetella pertussis
agcgcgaaauccagcgcgc

SEQ ID NO: 2409240 - RNA, 20 nt, Bordetella pertussis
agcgcgaaauccagcgcgcc

SEQ ID NO: 2409241 - RNA, 21 nt, Bordetella pertussis
agcgcgaaauccagcgcgccc

SEQ ID NO: 2409242 - RNA, 21 nt, Bordetella pertussis
agcgcgaaaugcccagcgagc

SEQ ID NO: 2409243 - RNA, 15 nt, Bordetella pertussis
agcgcgaacgccugc

SEQ ID NO: 2409244 - RNA, 17 nt, Bordetella pertussis
agcgcgaacgccugcca

SEQ ID NO: 2409245 - RNA, 15 nt, Bordetella pertussis
agcgcgaccggcgcg

SEQ ID NO: 2409246 - RNA, 17 nt, Bordetella pertussis
agcgcgaucucgcgcag

SEQ ID NO: 2409247 - RNA, 18 nt, Bordetella pertussis
agcgcgaugccaucgcug

SEQ ID NO: 2409248 - RNA, 21 nt, Bordetella pertussis
agcgcgaugucgcccaugcug

SEQ ID NO: 2409249 - RNA, 19 nt, Bordetella pertussis
agcgcgauucccuggcgcg

SEQ ID NO: 2409250 - RNA, 16 nt, Bordetella pertussis
agcgcgcaacccacgg

SEQ ID NO: 2409251 - RNA, 18 nt, Bordetella pertussis
agcgcgcaggacaaggcg

SEQ ID NO: 2409252 - RNA, 20 nt, Bordetella pertussis
agcgcgcaggaucagcuuga

SEQ ID NO: 2409253 - RNA, 23 nt, Bordetella pertussis
agcgcgcaggugugccagccgcu

SEQ ID NO: 2409254 - RNA, 22 nt, Bordetella pertussis
agcgcgccacaauugccagccu

SEQ ID NO: 2409255 - RNA, 13 nt, Bordetella pertussis
agcgcgccagcac

SEQ ID NO: 2409256 - RNA, 14 nt, Bordetella pertussis
agcgcgccagcaga

SEQ ID NO: 2409257 - RNA, 15 nt, Bordetella pertussis
agcgcgccagccgcg

SEQ ID NO: 2409258 - RNA, 12 nt, Bordetella pertussis
agcgcgccagcg

SEQ ID NO: 2409259 - RNA, 15 nt, Bordetella pertussis
agcgcgccagcgcgc

SEQ ID NO: 2409260 - RNA, 13 nt, Bordetella pertussis
agcgcgccaggcg

SEQ ID NO: 2409261 - RNA, 21 nt, Bordetella pertussis
agcgcgccaugaacucgcgcu

SEQ ID NO: 2409262 - RNA, 22 nt, Bordetella pertussis
agcgcgccaugaacucgcgcuc

SEQ ID NO: 2409263 - RNA, 20 nt, Bordetella pertussis
agcgcgcccgaggcgcgcag

SEQ ID NO: 2409264 - RNA, 16 nt, Bordetella pertussis
agcgcgcccgaugccu

SEQ ID NO: 2409265 - RNA, 18 nt, Bordetella pertussis
agcgcgcccgcuugcgcg

SEQ ID NO: 2409266 - RNA, 23 nt, Bordetella pertussis
agcgcgcccgcuugggccgcgcc

SEQ ID NO: 2409267 - RNA, 16 nt, Bordetella pertussis
agcgcgcccucguuga

SEQ ID NO: 2409268 - RNA, 20 nt, Bordetella pertussis
agcgcgccgaagcgcaggcc

SEQ ID NO: 2409269 - RNA, 13 nt, Bordetella pertussis
agccgcaccagcg

SEQ ID NO: 2409270 - RNA, 14 nt, Bordetella pertussis
agccgcaccagcgc

SEQ ID NO: 2409271 - RNA, 13 nt, Bordetella pertussis
agccgcaccaugc

SEQ ID NO: 2409272 - RNA, 15 nt, Bordetella pertussis
agccgcaccaugcgg

SEQ ID NO: 2409273 - RNA, 13 nt, Bordetella pertussis
agccgcacgcccg

SEQ ID NO: 2409274 - RNA, 18 nt, Bordetella pertussis
agccgcagaacagcagcg

SEQ ID NO: 2409275 - RNA, 13 nt, Bordetella pertussis
agccgcagcggca

SEQ ID NO: 2409276 - RNA, 20 nt, Bordetella pertussis
agccgccagcgccuggaccu

SEQ ID NO: 2409277 - RNA, 18 nt, Bordetella pertussis
agccgccauaggcgcgca

SEQ ID NO: 2409278 - RNA, 19 nt, Bordetella pertussis
agccgccauaggcgcgcac

SEQ ID NO: 2409279 - RNA, 21 nt, Bordetella pertussis
agccgccccacgagaagccga

SEQ ID NO: 2409280 - RNA, 16 nt, Bordetella pertussis
agccgccccagcagca

SEQ ID NO: 2409281 - RNA, 17 nt, Bordetella pertussis
agccgccccagcagcag

SEQ ID NO: 2409282 - RNA, 15 nt, Bordetella pertussis
agccgccccggcgcg

SEQ ID NO: 2409283 - RNA, 22 nt, Bordetella pertussis
agccgccccggcgcggcgcgcg

SEQ ID NO: 2409284 - RNA, 12 nt, Bordetella pertussis
agccgcccggcg

SEQ ID NO: 2409285 - RNA, 21 nt, Bordetella pertussis
agccgccgcccuugcgccagu

SEQ ID NO: 2409286 - RNA, 12 nt, Bordetella pertussis
agccgccgccgu

SEQ ID NO: 2409287 - RNA, 14 nt, Bordetella pertussis
agccgccgccguca

SEQ ID NO: 2409288 - RNA, 22 nt, Bordetella pertussis
agccgccgccgucaacgcccag

SEQ ID NO: 2409289 - RNA, 21 nt, Bordetella pertussis
agccgccgcgauugcaggugg

SEQ ID NO: 2409290 - RNA, 14 nt, Bordetella pertussis
agccgccgucgaug

SEQ ID NO: 2409291 - RNA, 15 nt, Bordetella pertussis
agccgccgucgaugu

SEQ ID NO: 2409292 - RNA, 14 nt, Bordetella pertussis
agccgccugagcac

SEQ ID NO: 2409293 - RNA, 16 nt, Bordetella pertussis
agccgccugagcacau

SEQ ID NO: 2409294 - RNA, 23 nt, Bordetella pertussis
agccgccugagcacaugcccggc

SEQ ID NO: 2409295 - RNA, 14 nt, Bordetella pertussis
agccgccuggcgcg

SEQ ID NO: 2409296 - RNA, 23 nt, Bordetella pertussis
agccgcgagguauuggccuugcc

SEQ ID NO: 2409297 - RNA, 18 nt, Bordetella pertussis
agccgcgcacacauggcg

SEQ ID NO: 2409298 - RNA, 15 nt, Bordetella pertussis
agccgcgccaagggc

SEQ ID NO: 2409299 - RNA, 14 nt, Bordetella pertussis
agccgcgccagcgc

SEQ ID NO: 2409300 - RNA, 19 nt, Bordetella pertussis
agccgcgccagcgccucca

SEQ ID NO: 2409301 - RNA, 19 nt, Bordetella pertussis
agccgcgccugcagcagcg

SEQ ID NO: 2409302 - RNA, 22 nt, Bordetella pertussis
agccgcgccugcagcagcggca

SEQ ID NO: 2409303 - RNA, 18 nt, Bordetella pertussis
agccgcgcgccugcagca

SEQ ID NO: 2409304 - RNA, 20 nt, Bordetella pertussis
agccgcgcgccugcagcagc

SEQ ID NO: 2409305 - RNA, 13 nt, Bordetella pertussis
agccgcgcgccuu

SEQ ID NO: 2409306 - RNA, 17 nt, Bordetella pertussis
agccgcgcgcggccggc

SEQ ID NO: 2409307 - RNA, 16 nt, Bordetella pertussis
agccgcgcggccgggc

SEQ ID NO: 2409308 - RNA, 17 nt, Bordetella pertussis
agccgcgcggccgggcu

SEQ ID NO: 2409309 - RNA, 13 nt, Bordetella pertussis
agccgcggccgcc

SEQ ID NO: 2409310 - RNA, 15 nt, Bordetella pertussis
agccgcggccgccgu

SEQ ID NO: 2409311 - RNA, 15 nt, Bordetella pertussis
agccgcggcgccgca

SEQ ID NO: 2409312 - RNA, 15 nt, Bordetella pertussis
agccgcucagguaga

SEQ ID NO: 2409313 - RNA, 15 nt, Bordetella pertussis
agccgcuccagccac

SEQ ID NO: 2409314 - RNA, 20 nt, Bordetella pertussis
agccgcuccagccaccacug

SEQ ID NO: 2409315 - RNA, 21 nt, Bordetella pertussis
agccgcuccagccaccacugc

SEQ ID NO: 2409316 - RNA, 14 nt, Bordetella pertussis
agccgcucggccac

SEQ ID NO: 2409317 - RNA, 17 nt, Bordetella pertussis
agccgcucggccacgcg

SEQ ID NO: 2409318 - RNA, 19 nt, Bordetella pertussis
agccgcucggccacgcgcu

SEQ ID NO: 2409319 - RNA, 16 nt, Bordetella pertussis
agccgcugacugggcg

SEQ ID NO: 2409320 - RNA, 12 nt, Bordetella pertussis
agccgcugcaga

SEQ ID NO: 2409321 - RNA, 13 nt, Bordetella pertussis
agccgcugcagcg

SEQ ID NO: 2409322 - RNA, 19 nt, Bordetella pertussis
agccgcugccguugucggu

SEQ ID NO: 2409323 - RNA, 15 nt, Bordetella pertussis
agccgcugcgcgcgg

SEQ ID NO: 2409324 - RNA, 16 nt, Bordetella pertussis
agccgcugcgcgcggc

SEQ ID NO: 2409325 - RNA, 17 nt, Bordetella pertussis
agccgcugcgcuggccg

SEQ ID NO: 2409326 - RNA, 19 nt, Bordetella pertussis
agccgcugcgcuggccgcg

SEQ ID NO: 2409327 - RNA, 18 nt, Bordetella pertussis
agccgcuggauuucgccg

SEQ ID NO: 2409328 - RNA, 20 nt, Bordetella pertussis
agccgcuggauuucgccgcg

SEQ ID NO: 2409329 - RNA, 14 nt, Bordetella pertussis
agccgcuggcgcgc

SEQ ID NO: 2409330 - RNA, 17 nt, Bordetella pertussis
agccgcuggcgcgccgc

SEQ ID NO: 2409331 - RNA, 18 nt, Bordetella pertussis
agccgcuggcgcgccgcc

SEQ ID NO: 2409332 - RNA, 17 nt, Bordetella pertussis
agccgcugucgcaggcg

SEQ ID NO: 2409333 - RNA, 15 nt, Bordetella pertussis
agccgcuugcggcca

SEQ ID NO: 2409334 - RNA, 16 nt, Bordetella pertussis
agccgcuugcggccag

SEQ ID NO: 2409335 - RNA, 19 nt, Bordetella pertussis
agccgcuugcggccaggcg

SEQ ID NO: 2409336 - RNA, 18 nt, Bordetella pertussis
agccgcuuggccugcgcc

SEQ ID NO: 2409337 - RNA, 20 nt, Bordetella pertussis
agccgcuuggccugcgccac

SEQ ID NO: 2409338 - RNA, 22 nt, Bordetella pertussis
agccgcuuggccugcgccaccg

SEQ ID NO: 2409339 - RNA, 22 nt, Bordetella pertussis
agccggaaugcaccacggccac

SEQ ID NO: 2409340 - RNA, 23 nt, Bordetella pertussis
agccggaaugcaccacggccacg

SEQ ID NO: 2409341 - RNA, 13 nt, Bordetella pertussis
agccggacccgcg

SEQ ID NO: 2409342 - RNA, 18 nt, Bordetella pertussis
agccggacccgcgccgca

SEQ ID NO: 2409343 - RNA, 19 nt, Bordetella pertussis
agccggacccgcgccgcag

SEQ ID NO: 2409344 - RNA, 13 nt, Bordetella pertussis
agccggacguggg

SEQ ID NO: 2409345 - RNA, 19 nt, Bordetella pertussis
agccggacgugggcgccua

SEQ ID NO: 2409346 - RNA, 17 nt, Bordetella pertussis
agccggagcagucgcgc

SEQ ID NO: 2409347 - RNA, 22 nt, Bordetella pertussis
agcgagaccguggaaaccgcgu

SEQ ID NO: 2409348 - RNA, 15 nt, Bordetella pertussis
agcgagagcgccacg

SEQ ID NO: 2409349 - RNA, 14 nt, Bordetella pertussis
agcgagccggccag

SEQ ID NO: 2409350 - RNA, 14 nt, Bordetella pertussis
agcgagcgaaagcc

SEQ ID NO: 2409351 - RNA, 13 nt, Bordetella pertussis
agcgagcggggcu

SEQ ID NO: 2409352 - RNA, 16 nt, Bordetella pertussis
agcgagcugcgcugcu

SEQ ID NO: 2409353 - RNA, 18 nt, Bordetella pertussis
agcgaggacacgcagcug

SEQ ID NO: 2409354 - RNA, 14 nt, Bordetella pertussis
agcgaggcggcaag

SEQ ID NO: 2409355 - RNA, 20 nt, Bordetella pertussis
agcgagucgaccaguucggc

SEQ ID NO: 2409356 - RNA, 20 nt, Bordetella pertussis
agcgagugcgccccgccacg

SEQ ID NO: 2409357 - RNA, 19 nt, Bordetella pertussis
agcgcaaacgggggcaggc

SEQ ID NO: 2409358 - RNA, 20 nt, Bordetella pertussis
agcgcaaacgggggcaggcc

SEQ ID NO: 2409359 - RNA, 21 nt, Bordetella pertussis
agcgcaaacgggggcaggccg

SEQ ID NO: 2409360 - RNA, 21 nt, Bordetella pertussis
agcgcaagcaggucacgacgg

SEQ ID NO: 2409361 - RNA, 13 nt, Bordetella pertussis
agcgcaagcccgu

SEQ ID NO: 2409362 - RNA, 19 nt, Bordetella pertussis
agcgcaaggguuguggccg

SEQ ID NO: 2409363 - RNA, 18 nt, Bordetella pertussis
agcgcaauggacacagcg

SEQ ID NO: 2409364 - RNA, 22 nt, Bordetella pertussis
agcgcaauggacacagcggcgc

SEQ ID NO: 2409365 - RNA, 16 nt, Bordetella pertussis
agcgcacaggcggcgc

SEQ ID NO: 2409366 - RNA, 17 nt, Bordetella pertussis
agcgcacaggcggcgcc

SEQ ID NO: 2409367 - RNA, 20 nt, Bordetella pertussis
agcgcacaggcggcgccggc

SEQ ID NO: 2409368 - RNA, 22 nt, Bordetella pertussis
agcgcacaggcggcgccggcac

SEQ ID NO: 2409369 - RNA, 16 nt, Bordetella pertussis
agcgcaccaccaccau

SEQ ID NO: 2409370 - RNA, 19 nt, Bordetella pertussis
agcgcaccaccaccaugug

SEQ ID NO: 2409371 - RNA, 15 nt, Bordetella pertussis
agcgcaccaccagca

SEQ ID NO: 2409372 - RNA, 16 nt, Bordetella pertussis
agcgcaccaccagcac

SEQ ID NO: 2409373 - RNA, 22 nt, Bordetella pertussis
agcgcaccaccagcaccgccac

SEQ ID NO: 2409374 - RNA, 13 nt, Bordetella pertussis
agcgcaccauggc

SEQ ID NO: 2409375 - RNA, 23 nt, Bordetella pertussis
agcgcaccccggccgacggcaag

SEQ ID NO: 2409376 - RNA, 15 nt, Bordetella pertussis
agcgcaccgacggca

SEQ ID NO: 2409377 - RNA, 18 nt, Bordetella pertussis
agcgcaccgacggcagcc

SEQ ID NO: 2409378 - RNA, 17 nt, Bordetella pertussis
agcgcaccgucgccagg

SEQ ID NO: 2409379 - RNA, 15 nt, Bordetella pertussis
agcgcacgcaccgcg

SEQ ID NO: 2409380 - RNA, 17 nt, Bordetella pertussis
agcgcacgcaccgcgcc

SEQ ID NO: 2409381 - RNA, 19 nt, Bordetella pertussis
agcgcacgcaccgcgccag

SEQ ID NO: 2409382 - RNA, 12 nt, Bordetella pertussis
agcgcacgcagc

SEQ ID NO: 2409383 - RNA, 18 nt, Bordetella pertussis
agcgcacgcagcgcucau

SEQ ID NO: 2409384 - RNA, 12 nt, Bordetella pertussis
agcgcacgcgca

SEQ ID NO: 2409385 - RNA, 13 nt, Bordetella pertussis
agcgcacgcgcag

SEQ ID NO: 2409386 - RNA, 14 nt, Bordetella pertussis
agcgcacgguccag

SEQ ID NO: 2409387 - RNA, 22 nt, Bordetella pertussis
agcgcacgguccaggcggccgc

SEQ ID NO: 2409388 - RNA, 18 nt, Bordetella pertussis
agcgcagcaagcugcugc

SEQ ID NO: 2409389 - RNA, 18 nt, Bordetella pertussis
agcgcagcaccgcgcgca

SEQ ID NO: 2409390 - RNA, 19 nt, Bordetella pertussis
agcgcagcaccgcgcgcac

SEQ ID NO: 2409391 - RNA, 23 nt, Bordetella pertussis
agcgcagcaccggcagauggugc

SEQ ID NO: 2409392 - RNA, 22 nt, Bordetella pertussis
agcgcagcagauugccgcgcgg

SEQ ID NO: 2409393 - RNA, 13 nt, Bordetella pertussis
agcgcagccacgg

SEQ ID NO: 2409394 - RNA, 14 nt, Bordetella pertussis
agcgcagccgcucc

SEQ ID NO: 2409395 - RNA, 13 nt, Bordetella pertussis
agcgcagcgccac

SEQ ID NO: 2409396 - RNA, 17 nt, Bordetella pertussis
agcgcagcgccacgcug

SEQ ID NO: 2409397 - RNA, 22 nt, Bordetella pertussis
agcgcagcuucuaucugccgcg

SEQ ID NO: 2409398 - RNA, 14 nt, Bordetella pertussis
agcgcaucgagcuc

SEQ ID NO: 2409399 - RNA, 20 nt, Bordetella pertussis
agcgcaucgaucucggccuc

SEQ ID NO: 2409400 - RNA, 16 nt, Bordetella pertussis
agcgcaucgccgcagg

SEQ ID NO: 2409401 - RNA, 18 nt, Bordetella pertussis
agcgcaucgccgcaggcg

SEQ ID NO: 2409402 - RNA, 23 nt, Bordetella pertussis
agcgcaucgcgaugcgcagcagc

SEQ ID NO: 2409403 - RNA, 17 nt, Bordetella pertussis
agcgcaugaugcugccg

SEQ ID NO: 2409404 - RNA, 21 nt, Bordetella pertussis
agcgcaugaugcugccgggca

SEQ ID NO: 2409405 - RNA, 15 nt, Bordetella pertussis
agcgcaugccgucga

SEQ ID NO: 2409406 - RNA, 21 nt, Bordetella pertussis
agcgcgccgaagcgcaggccu

SEQ ID NO: 2409407 - RNA, 13 nt, Bordetella pertussis
agcgcgccgccag

SEQ ID NO: 2409408 - RNA, 21 nt, Bordetella pertussis
agcgcgccgccagcgcgcgcg

SEQ ID NO: 2409409 - RNA, 22 nt, Bordetella pertussis
agcgcgccgccagcgcgcgcga

SEQ ID NO: 2409410 - RNA, 23 nt, Bordetella pertussis
agcgcgccgcccaccaccagcgc

SEQ ID NO: 2409411 - RNA, 13 nt, Bordetella pertussis
agcgcgccgccga

SEQ ID NO: 2409412 - RNA, 23 nt, Bordetella pertussis
agcgcgccgcgaaacguccccac

SEQ ID NO: 2409413 - RNA, 18 nt, Bordetella pertussis
agcgcgccgcgccgggcg

SEQ ID NO: 2409414 - RNA, 21 nt, Bordetella pertussis
agcgcgccgcgccgggcgcgc

SEQ ID NO: 2409415 - RNA, 13 nt, Bordetella pertussis
agcgcgccgcgcg

SEQ ID NO: 2409416 - RNA, 16 nt, Bordetella pertussis
agcgcgccgcgcgcac

SEQ ID NO: 2409417 - RNA, 21 nt, Bordetella pertussis
agcgcgccgcgcgcggcggcc

SEQ ID NO: 2409418 - RNA, 22 nt, Bordetella pertussis
agcgcgccgcgcgcggcggccu

SEQ ID NO: 2409419 - RNA, 23 nt, Bordetella pertussis
agcgcugcagccauucggccacu

SEQ ID NO: 2409420 - RNA, 21 nt, Bordetella pertussis
agcgcugcgccaacggugcca

SEQ ID NO: 2409421 - RNA, 18 nt, Bordetella pertussis
agcgcugcgccgcggcgc

SEQ ID NO: 2409422 - RNA, 16 nt, Bordetella pertussis
agcgcuggacgcccug

SEQ ID NO: 2409423 - RNA, 18 nt, Bordetella pertussis
agcgcuggcccgucaugg

SEQ ID NO: 2409424 - RNA, 17 nt, Bordetella pertussis
agcgcugggcgccagca

SEQ ID NO: 2409425 - RNA, 18 nt, Bordetella pertussis
agcgcugggcgccagcag

SEQ ID NO: 2409426 - RNA, 22 nt, Bordetella pertussis
agcgcuggguguagucgcggcc

SEQ ID NO: 2409427 - RNA, 23 nt, Bordetella pertussis
agcgcuggguguagucgcggccg

SEQ ID NO: 2409428 - RNA, 21 nt, Bordetella pertussis
agcgcuguccaggccggggcc

SEQ ID NO: 2409429 - RNA, 22 nt, Bordetella pertussis
agcgcuucgggcagcucgcgcg

SEQ ID NO: 2409430 - RNA, 16 nt, Bordetella pertussis
agcgcuucgugcagcg

SEQ ID NO: 2409431 - RNA, 22 nt, Bordetella pertussis
agcgcuucugccagacggccag

SEQ ID NO: 2409432 - RNA, 16 nt, Bordetella pertussis
agcgcuugacggccaa

SEQ ID NO: 2409433 - RNA, 14 nt, Bordetella pertussis
agcgcuugcacgcc

SEQ ID NO: 2409434 - RNA, 13 nt, Bordetella pertussis
agcgcuugccuga

SEQ ID NO: 2409435 - RNA, 17 nt, Bordetella pertussis
agcggaaacgcgcgcgc

SEQ ID NO: 2409436 - RNA, 16 nt, Bordetella pertussis
agcggaaugauggugg

SEQ ID NO: 2409437 - RNA, 21 nt, Bordetella pertussis
agcggaaugaugguggggcug

SEQ ID NO: 2409438 - RNA, 17 nt, Bordetella pertussis
agcggaauggggcccgc

SEQ ID NO: 2409439 - RNA, 18 nt, Bordetella pertussis
agcggaauggggcccgca

SEQ ID NO: 2409440 - RNA, 17 nt, Bordetella pertussis
agcggaauguugccgaa

SEQ ID NO: 2409441 - RNA, 15 nt, Bordetella pertussis
agcggaccuggucgu

SEQ ID NO: 2409442 - RNA, 18 nt, Bordetella pertussis
agcggacgguagcgcacg

SEQ ID NO: 2409443 - RNA, 12 nt, Bordetella pertussis
agcggagccgcg

SEQ ID NO: 2409444 - RNA, 15 nt, Bordetella pertussis
agcggagcgacggca

SEQ ID NO: 2409445 - RNA, 17 nt, Bordetella pertussis
agcggaucgccgggcag

SEQ ID NO: 2409446 - RNA, 15 nt, Bordetella pertussis
agcggaucgccggua

SEQ ID NO: 2409447 - RNA, 17 nt, Bordetella pertussis
agcggaugaagggcugg

SEQ ID NO: 2409448 - RNA, 17 nt, Bordetella pertussis
agcggaugaugcggcgc

SEQ ID NO: 2409449 - RNA, 21 nt, Bordetella pertussis
agcggaugaugcggcgccacg

SEQ ID NO: 2409450 - RNA, 23 nt, Bordetella pertussis
agcggauugaccagcgcggccgu

SEQ ID NO: 2409451 - RNA, 15 nt, Bordetella pertussis
agcggcaaagccgcu

SEQ ID NO: 2409452 - RNA, 18 nt, Bordetella pertussis
agcggcaaagccgcugcg

SEQ ID NO: 2409453 - RNA, 21 nt, Bordetella pertussis
agcggcaaaguagugccccca

SEQ ID NO: 2409454 - RNA, 15 nt, Bordetella pertussis
agcggcacgccggcg

SEQ ID NO: 2409455 - RNA, 18 nt, Bordetella pertussis
agcggcacgccggcggcc

SEQ ID NO: 2409456 - RNA, 13 nt, Bordetella pertussis
agcggcagcagcg

SEQ ID NO: 2409457 - RNA, 13 nt, Bordetella pertussis
agcggcagcaugg

SEQ ID NO: 2409458 - RNA, 17 nt, Bordetella pertussis
agcggcagcauggcgcg

SEQ ID NO: 2409459 - RNA, 18 nt, Bordetella pertussis
agcggcagcauggcgcgc

SEQ ID NO: 2409460 - RNA, 20 nt, Bordetella pertussis
agcggcagcauggcgcgcgg

SEQ ID NO: 2409461 - RNA, 21 nt, Bordetella pertussis
agcggcagcgcaccgucgcca

SEQ ID NO: 2409462 - RNA, 14 nt, Bordetella pertussis
agcggcagcgcgca

SEQ ID NO: 2409463 - RNA, 24 nt, Bordetella pertussis
agcggcagcgcgcaggacaaggcg

SEQ ID NO: 2409464 - RNA, 18 nt, Bordetella pertussis
agcggcaggcuggccggc

SEQ ID NO: 2409465 - RNA, 23 nt, Bordetella pertussis
agcggcaggcuggccggcguggc

SEQ ID NO: 2409466 - RNA, 20 nt, Bordetella pertussis
agcggcaggggcucgcgccc

SEQ ID NO: 2409467 - RNA, 17 nt, Bordetella pertussis
agcggcaucacgccggu

SEQ ID NO: 2409468 - RNA, 10 nt, Bordetella pertussis
agcggccagc

SEQ ID NO: 2409469 - RNA, 14 nt, Bordetella pertussis
agcggccagcaagc

SEQ ID NO: 2409470 - RNA, 18 nt, Bordetella pertussis
agcggccagcaagcgcgc

SEQ ID NO: 2409471 - RNA, 19 nt, Bordetella pertussis
agcggccagcaagcgcgcc

SEQ ID NO: 2409472 - RNA, 22 nt, Bordetella pertussis
agcggccagcaagcgcgccaug

SEQ ID NO: 2409473 - RNA, 12 nt, Bordetella pertussis
agcggccagccu

SEQ ID NO: 2409474 - RNA, 16 nt, Bordetella pertussis
agcggccagccugccg

SEQ ID NO: 2409475 - RNA, 22 nt, Bordetella pertussis
agcggccagccugccgcggccg

SEQ ID NO: 2409476 - RNA, 16 nt, Bordetella pertussis
agcggccagcgcggcg

SEQ ID NO: 2409477 - RNA, 14 nt, Bordetella pertussis
agcggccaucgggc

SEQ ID NO: 2409478 - RNA, 16 nt, Bordetella pertussis
agcggccaucgggcug

SEQ ID NO: 2409479 - RNA, 18 nt, Bordetella pertussis
agcggcccacccggcacg

SEQ ID NO: 2409480 - RNA, 14 nt, Bordetella pertussis
agcggccccaggua

SEQ ID NO: 2409481 - RNA, 19 nt, Bordetella pertussis
agcggccccagucgcugcu

SEQ ID NO: 2409482 - RNA, 17 nt, Bordetella pertussis
agcggcccgcgcccugc

SEQ ID NO: 2409483 - RNA, 20 nt, Bordetella pertussis
agcggcccgggcgagauggc

SEQ ID NO: 2409484 - RNA, 21 nt, Bordetella pertussis
agcggcccgggugggcggcau

SEQ ID NO: 2409485 - RNA, 18 nt, Bordetella pertussis
agcggccgcugccgcgcg

SEQ ID NO: 2409486 - RNA, 20 nt, Bordetella pertussis
agcggccggccugcgggcug

SEQ ID NO: 2409487 - RNA, 11 nt, Bordetella pertussis
agcggccggcg

SEQ ID NO: 2409488 - RNA, 14 nt, Bordetella pertussis
agcggccggcgcgc

SEQ ID NO: 2409489 - RNA, 17 nt, Bordetella pertussis
agcggccggcgcgcgcg

SEQ ID NO: 2409490 - RNA, 18 nt, Bordetella pertussis
agcggccggcgcgcgcga

SEQ ID NO: 2409491 - RNA, 17 nt, Bordetella pertussis
agcggccuguucgcggu

SEQ ID NO: 2409492 - RNA, 16 nt, Bordetella pertussis
agcggcgagcgcggcg

SEQ ID NO: 2409493 - RNA, 17 nt, Bordetella pertussis
agcggcgagcgcggcga

SEQ ID NO: 2409494 - RNA, 14 nt, Bordetella pertussis
agcggcgauccgcc

SEQ ID NO: 2409495 - RNA, 23 nt, Bordetella pertussis
agcggcgcaacccggccucgcug

SEQ ID NO: 2409496 - RNA, 20 nt, Bordetella pertussis
agcggcgcaccagcgaggcg

SEQ ID NO: 2409497 - RNA, 18 nt, Bordetella pertussis
agcggcgcagccggccgg

SEQ ID NO: 2409498 - RNA, 12 nt, Bordetella pertussis
agcggcgccagc

SEQ ID NO: 2409499 - RNA, 20 nt, Bordetella pertussis
agcggcgccaugcgcaccac

SEQ ID NO: 2409500 - RNA, 15 nt, Bordetella pertussis
agcggcgccgcuucc

SEQ ID NO: 2409501 - RNA, 20 nt, Bordetella pertussis
agcggcgccggaucggccgg

SEQ ID NO: 2409502 - RNA, 16 nt, Bordetella pertussis
agcggcgcgacgcgcu

SEQ ID NO: 2409503 - RNA, 19 nt, Bordetella pertussis
agcggcgcgagcgcacagg

SEQ ID NO: 2409504 - RNA, 21 nt, Bordetella pertussis
agcggcgcgagcgcacaggcg

SEQ ID NO: 2409505 - RNA, 17 nt, Bordetella pertussis
agcggcgcgcccaccag

SEQ ID NO: 2409506 - RNA, 20 nt, Bordetella pertussis
agcggcgcgcccaccagggu

SEQ ID NO: 2409507 - RNA, 12 nt, Bordetella pertussis
agcggcgcgcgc

SEQ ID NO: 2409508 - RNA, 14 nt, Bordetella pertussis
agcggcgcggcgcg

SEQ ID NO: 2409509 - RNA, 16 nt, Bordetella pertussis
agcggcgcggcgcgcu

SEQ ID NO: 2409510 - RNA, 12 nt, Bordetella pertussis
agcggcggcacg

SEQ ID NO: 2409511 - RNA, 13 nt, Bordetella pertussis
agcggcggccgcg

SEQ ID NO: 2409512 - RNA, 12 nt, Bordetella pertussis
agcggcggcgcg

SEQ ID NO: 2409513 - RNA, 23 nt, Bordetella pertussis
agcggcggcuucgcgcagcaagu

SEQ ID NO: 2409514 - RNA, 19 nt, Bordetella pertussis
agcggcguauaggccaccc

SEQ ID NO: 2409515 - RNA, 20 nt, Bordetella pertussis
agcggcguauaggccacccc

SEQ ID NO: 2409516 - RNA, 17 nt, Bordetella pertussis
agcggcgugaugcccag

SEQ ID NO: 2409517 - RNA, 18 nt, Bordetella pertussis
agcggcgugaugcccagg

SEQ ID NO: 2409518 - RNA, 19 nt, Bordetella pertussis
agcggcgugaugcccaggc

SEQ ID NO: 2409519 - RNA, 14 nt, Bordetella pertussis
agcggcgugcgcgu

SEQ ID NO: 2409520 - RNA, 16 nt, Bordetella pertussis
agcggcgugcgcgugc

SEQ ID NO: 2409521 - RNA, 22 nt, Bordetella pertussis
agcggcgugcgcgugcaugugu

SEQ ID NO: 2409522 - RNA, 13 nt, Bordetella pertussis
agcguucgcgcuu

SEQ ID NO: 2409523 - RNA, 13 nt, Bordetella pertussis
agcguucggccac

SEQ ID NO: 2409524 - RNA, 14 nt, Bordetella pertussis
agcguugcggcguc

SEQ ID NO: 2409525 - RNA, 13 nt, Bordetella pertussis
agcguuggcggcc

SEQ ID NO: 2409526 - RNA, 14 nt, Bordetella pertussis
agcguuggcggccg

SEQ ID NO: 2409527 - RNA, 18 nt, Bordetella pertussis
agcguuggcggccggcca

SEQ ID NO: 2409528 - RNA, 20 nt, Bordetella pertussis
agcguuggcggccggccagc

SEQ ID NO: 2409529 - RNA, 22 nt, Bordetella pertussis
agcguuggcggccggccagcca

SEQ ID NO: 2409530 - RNA, 21 nt, Bordetella pertussis
agcguuuccagggcgcgccgc

SEQ ID NO: 2409531 - RNA, 22 nt, Bordetella pertussis
agcguuuccagggcgcgccgca

SEQ ID NO: 2409532 - RNA, 15 nt, Bordetella pertussis
agcuacccccugacc

SEQ ID NO: 2409533 - RNA, 16 nt, Bordetella pertussis
agcuccaccgggcuga

SEQ ID NO: 2409534 - RNA, 22 nt, Bordetella pertussis
agcuccacgcacaccgcccgaa

SEQ ID NO: 2409535 - RNA, 16 nt, Bordetella pertussis
agcuccagccgcaggc

SEQ ID NO: 2409536 - RNA, 13 nt, Bordetella pertussis
agcuccagccggg

SEQ ID NO: 2409537 - RNA, 20 nt, Bordetella pertussis
agcuccagccgggucggcug

SEQ ID NO: 2409538 - RNA, 14 nt, Bordetella pertussis
agcuccagcgcgcc

SEQ ID NO: 2409539 - RNA, 16 nt, Bordetella pertussis
agcuccagcuggcgca

SEQ ID NO: 2409540 - RNA, 16 nt, Bordetella pertussis
agcuccaggugccaga

SEQ ID NO: 2409541 - RNA, 19 nt, Bordetella pertussis
agcucccccacgccgccgu

SEQ ID NO: 2409542 - RNA, 22 nt, Bordetella pertussis
agcuccccgggcgugaccagcu

SEQ ID NO: 2409543 - RNA, 21 nt, Bordetella pertussis
agcuccgauucucaccagcgc

SEQ ID NO: 2409544 - RNA, 21 nt, Bordetella pertussis
agcuccguauccuggucgauc

SEQ ID NO: 2409545 - RNA, 14 nt, Bordetella pertussis
agcuccucgaccug

SEQ ID NO: 2409546 - RNA, 16 nt, Bordetella pertussis
agcuccucgagcgugg

SEQ ID NO: 2409547 - RNA, 14 nt, Bordetella pertussis
agcuccucggccug

SEQ ID NO: 2409548 - RNA, 18 nt, Bordetella pertussis
agcuccucggccugccgg

SEQ ID NO: 2409549 - RNA, 19 nt, Bordetella pertussis
agcuccucggccugccggc

SEQ ID NO: 2409550 - RNA, 21 nt, Bordetella pertussis
agcuccucggccugccggcgc

SEQ ID NO: 2409551 - RNA, 20 nt, Bordetella pertussis
agcuccugcaggauggggcg

SEQ ID NO: 2409552 - RNA, 18 nt, Bordetella pertussis
agcuccuugaccaguucg

SEQ ID NO: 2409553 - RNA, 22 nt, Bordetella pertussis
agcucgaccaucauggccaggg

SEQ ID NO: 2409554 - RNA, 23 nt, Bordetella pertussis
agcucgaccaucauggccagggc

SEQ ID NO: 2409555 - RNA, 19 nt, Bordetella pertussis
agcucgaccgucagcaugc

SEQ ID NO: 2409556 - RNA, 13 nt, Bordetella pertussis
agcucgacgcgcu

SEQ ID NO: 2409557 - RNA, 17 nt, Bordetella pertussis
agcucgcgcaugcagcg

SEQ ID NO: 2409558 - RNA, 13 nt, Bordetella pertussis
agcucgcgccagg

SEQ ID NO: 2409559 - RNA, 12 nt, Bordetella pertussis
agcucgcgcgcu

SEQ ID NO: 2409560 - RNA, 20 nt, Bordetella pertussis
agcucgcgcugcgcgccgcc

SEQ ID NO: 2409561 - RNA, 23 nt, Bordetella pertussis
agcucgcgcugcgcgccgccgcg

SEQ ID NO: 2409562 - RNA, 16 nt, Bordetella pertussis
agcucgcguugcaccg

SEQ ID NO: 2409563 - RNA, 20 nt, Bordetella pertussis
agcucgcguugcaccgcguc

SEQ ID NO: 2409564 - RNA, 21 nt, Bordetella pertussis
agcucggcccauugcggcacc

SEQ ID NO: 2409565 - RNA, 15 nt, Bordetella pertussis
agcucggccugcggc

SEQ ID NO: 2409566 - RNA, 18 nt, Bordetella pertussis
agcucggccugcggcucg

SEQ ID NO: 2409567 - RNA, 20 nt, Bordetella pertussis
agcucggcgaagccgcagcg

SEQ ID NO: 2409568 - RNA, 21 nt, Bordetella pertussis
agcucggcgaagccgcagcgg

SEQ ID NO: 2409569 - RNA, 23 nt, Bordetella pertussis
agcucggcgaagccgcagcggca

SEQ ID NO: 2409570 - RNA, 17 nt, Bordetella pertussis
agcucggcgaugcgcga

SEQ ID NO: 2409571 - RNA, 13 nt, Bordetella pertussis
agcucggcggcga

SEQ ID NO: 2409572 - RNA, 15 nt, Bordetella pertussis
agcucggugcagccc

SEQ ID NO: 2409573 - RNA, 20 nt, Bordetella pertussis
agcucguccagguugcccga

SEQ ID NO: 2409574 - RNA, 13 nt, Bordetella pertussis
agcucgucgccgc

SEQ ID NO: 2409575 - RNA, 19 nt, Bordetella pertussis
agcucgucggucagcucaa

SEQ ID NO: 2409576 - RNA, 15 nt, Bordetella pertussis
agcucguggcgcgcc

SEQ ID NO: 2409577 - RNA, 21 nt, Bordetella pertussis
agcucguggcgcgccuccagc

SEQ ID NO: 2409578 - RNA, 17 nt, Bordetella pertussis
agcucguguagggccug

SEQ ID NO: 2409579 - RNA, 18 nt, Bordetella pertussis
agcucguguagggccugg

SEQ ID NO: 2409580 - RNA, 18 nt, Bordetella pertussis
agcucuaugucgccggcc

SEQ ID NO: 2409581 - RNA, 20 nt, Bordetella pertussis
agcucucgaagaagcagccg

SEQ ID NO: 2409582 - RNA, 18 nt, Bordetella pertussis
agcucucuccauggcagc

SEQ ID NO: 2409583 - RNA, 15 nt, Bordetella pertussis
agcucugguccaggc

SEQ ID NO: 2409584 - RNA, 17 nt, Bordetella pertussis
agcucuucgagcgcggc

SEQ ID NO: 2409585 - RNA, 19 nt, Bordetella pertussis
agcucuucgagcgcggcgc

SEQ ID NO: 2409586 - RNA, 20 nt, Bordetella pertussis
agcucuucgagcgcggcgcg

SEQ ID NO: 2409587 - RNA, 23 nt, Bordetella pertussis
agcucuucgagcgcggcgcgcga

SEQ ID NO: 2409588 - RNA, 18 nt, Bordetella pertussis
agcugaccucgcccaggc

SEQ ID NO: 2409589 - RNA, 20 nt, Bordetella pertussis
agcugaccucgcccaggccg

SEQ ID NO: 2409590 - RNA, 15 nt, Bordetella pertussis
agcugacgaaacgcg

SEQ ID NO: 2409591 - RNA, 18 nt, Bordetella pertussis
agcugacgaaacgcgcgu

SEQ ID NO: 2409592 - RNA, 23 nt, Bordetella pertussis
agcugacgggucuccacgaaguc

SEQ ID NO: 2409593 - RNA, 15 nt, Bordetella pertussis
agcugagcaccagca

SEQ ID NO: 2409594 - RNA, 16 nt, Bordetella pertussis
agcugagcaccagcag

SEQ ID NO: 2409595 - RNA, 18 nt, Bordetella pertussis
agcugagcaccagcagcc

SEQ ID NO: 2409596 - RNA, 15 nt, Bordetella pertussis
agcugcacccacacu

SEQ ID NO: 2409597 - RNA, 15 nt, Bordetella pertussis
agcugcagcccggcc

SEQ ID NO: 2409598 - RNA, 17 nt, Bordetella pertussis
agcugcagcccggccag

SEQ ID NO: 2409599 - RNA, 20 nt, Bordetella pertussis
agcugcagcccggccagagc

SEQ ID NO: 2409600 - RNA, 14 nt, Bordetella pertussis
agcugcaguaugca

SEQ ID NO: 2409601 - RNA, 18 nt, Bordetella pertussis
agcugcaguaugcaaccg

SEQ ID NO: 2409602 - RNA, 16 nt, Bordetella pertussis
agcugccggcauugcc

SEQ ID NO: 2409603 - RNA, 21 nt, Bordetella pertussis
agcugccggcauugcccacca

SEQ ID NO: 2409604 - RNA, 20 nt, Bordetella pertussis
agcugccugagcaccgccgc

SEQ ID NO: 2409605 - RNA, 17 nt, Bordetella pertussis
agcugcgaaagcgcguc

SEQ ID NO: 2409606 - RNA, 14 nt, Bordetella pertussis
agcugcgcgaccuc

SEQ ID NO: 2409607 - RNA, 13 nt, Bordetella pertussis
agcugcggcgcgg

SEQ ID NO: 2409608 - RNA, 14 nt, Bordetella pertussis
agcugcggcgcggc

SEQ ID NO: 2409609 - RNA, 16 nt, Bordetella pertussis
agcugcggcgcggcgc

SEQ ID NO: 2409610 - RNA, 17 nt, Bordetella pertussis
agcugcggcgcggcgcg

SEQ ID NO: 2409611 - RNA, 16 nt, Bordetella pertussis
agcugcgugcgaucgg

SEQ ID NO: 2409612 - RNA, 14 nt, Bordetella pertussis
agcugcguggcgac

SEQ ID NO: 2409613 - RNA, 15 nt, Bordetella pertussis
agcugcucaccucga

SEQ ID NO: 2409614 - RNA, 16 nt, Bordetella pertussis
agcugcugcuggaccu

SEQ ID NO: 2409615 - RNA, 17 nt, Bordetella pertussis
agcugcugcuggaccug

SEQ ID NO: 2409616 - RNA, 22 nt, Bordetella pertussis
agcugcugcuggaccuggccac

SEQ ID NO: 2409617 - RNA, 15 nt, Bordetella pertussis
agcugcuggccggcc

SEQ ID NO: 2409618 - RNA, 14 nt, Bordetella pertussis
agcugcuggcgcgc

SEQ ID NO: 2409619 - RNA, 17 nt, Bordetella pertussis
agcugcuggcgcgccag

SEQ ID NO: 2409620 - RNA, 18 nt, Bordetella pertussis
agcugcuggcgcgccagg

SEQ ID NO: 2409621 - RNA, 20 nt, Bordetella pertussis
agcugcuggcgcgccaggcg

SEQ ID NO: 2409622 - RNA, 15 nt, Bordetella pertussis
agcugcugugcgccg

SEQ ID NO: 2409623 - RNA, 14 nt, Bordetella pertussis
agcugcuguuggcc

SEQ ID NO: 2409624 - RNA, 20 nt, Bordetella pertussis
agcugcuucaguuccaggcg

SEQ ID NO: 2409625 - RNA, 19 nt, Bordetella pertussis
agcugcuucaugcgcuccu

SEQ ID NO: 2409626 - RNA, 22 nt, Bordetella pertussis
agcugcuugcccaggccggcgc

SEQ ID NO: 2409627 - RNA, 23 nt, Bordetella pertussis
agcugcuugcccaggccggcgcg

SEQ ID NO: 2409628 - RNA, 14 nt, Bordetella pertussis
agcuggaacgcgcc

SEQ ID NO: 2409629 - RNA, 17 nt, Bordetella pertussis
agcuggaagcgcgccag

SEQ ID NO: 2409630 - RNA, 12 nt, Bordetella pertussis
aggacagcccca

SEQ ID NO: 2409631 - RNA, 18 nt, Bordetella pertussis
aggacagccccagcagca

SEQ ID NO: 2409632 - RNA, 12 nt, Bordetella pertussis
aggacagccgcu

SEQ ID NO: 2409633 - RNA, 13 nt, Bordetella pertussis
aggacaggggccu

SEQ ID NO: 2409634 - RNA, 14 nt, Bordetella pertussis
aggaccaggaugau

SEQ ID NO: 2409635 - RNA, 22 nt, Bordetella pertussis
aggaccaggaugaugcagcaca

SEQ ID NO: 2409636 - RNA, 18 nt, Bordetella pertussis
aggaccgaggugccagcc

SEQ ID NO: 2409637 - RNA, 16 nt, Bordetella pertussis
aggaccgcgaugcugc

SEQ ID NO: 2409638 - RNA, 22 nt, Bordetella pertussis
aggaccuguacuggcuggucuu

SEQ ID NO: 2409639 - RNA, 19 nt, Bordetella pertussis
aggaccuguggcgcacccu

SEQ ID NO: 2409640 - RNA, 15 nt, Bordetella pertussis
aggacgaacaggccg

SEQ ID NO: 2409641 - RNA, 13 nt, Bordetella pertussis
aggacgacaggca

SEQ ID NO: 2409642 - RNA, 16 nt, Bordetella pertussis
aggacgccaccagugc

SEQ ID NO: 2409643 - RNA, 21 nt, Bordetella pertussis
aggacgccaccagugcgccgg

SEQ ID NO: 2409644 - RNA, 22 nt, Bordetella pertussis
aggacgccggcgccggcgacgc

SEQ ID NO: 2409645 - RNA, 24 nt, Bordetella pertussis
aggccgccggccaccagcggcgcc

SEQ ID NO: 2409646 - RNA, 16 nt, Bordetella pertussis
aggccgccggccagcg

SEQ ID NO: 2409647 - RNA, 18 nt, Bordetella pertussis
aggccgccggccagcgcg

SEQ ID NO: 2409648 - RNA, 12 nt, Bordetella pertussis
aggccgccggcg

SEQ ID NO: 2409649 - RNA, 14 nt, Bordetella pertussis
aggccgccggcgcg

SEQ ID NO: 2409650 - RNA, 17 nt, Bordetella pertussis
aggccgccggcggcguc

SEQ ID NO: 2409651 - RNA, 22 nt, Bordetella pertussis
aggccgccggggaggccucgac

SEQ ID NO: 2409652 - RNA, 15 nt, Bordetella pertussis
aggccgccguacgag

SEQ ID NO: 2409653 - RNA, 22 nt, Bordetella pertussis
aggccgccuauguaggcgccgc

SEQ ID NO: 2409654 - RNA, 15 nt, Bordetella pertussis
aggccgcgaacgcgc

SEQ ID NO: 2409655 - RNA, 18 nt, Bordetella pertussis
aggccgcgaacgcgccgg

SEQ ID NO: 2409656 - RNA, 20 nt, Bordetella pertussis
aggccgcgaugucgcgcgcg

SEQ ID NO: 2409657 - RNA, 15 nt, Bordetella pertussis
aggccgcgcagcacg

SEQ ID NO: 2409658 - RNA, 21 nt, Bordetella pertussis
aggccgcgcagcacgcccgcg

SEQ ID NO: 2409659 - RNA, 23 nt, Bordetella pertussis
aggccgcgcagcacgcccgcgcg

SEQ ID NO: 2409660 - RNA, 17 nt, Bordetella pertussis
aggccgcgccacaggcg

SEQ ID NO: 2409661 - RNA, 12 nt, Bordetella pertussis
aggccgcgccua

SEQ ID NO: 2409662 - RNA, 18 nt, Bordetella pertussis
aggccgcgcgcauccagg

SEQ ID NO: 2409663 - RNA, 13 nt, Bordetella pertussis
aggccgcgcgccu

SEQ ID NO: 2409664 - RNA, 15 nt, Bordetella pertussis
aggccgcgcgugcgg

SEQ ID NO: 2409665 - RNA, 18 nt, Bordetella pertussis
aggccgcgcugccagcca

SEQ ID NO: 2409666 - RNA, 19 nt, Bordetella pertussis
aggccgcgcuggugcuggc

SEQ ID NO: 2409667 - RNA, 21 nt, Bordetella pertussis
aggccgcgcuggugcuggccg

SEQ ID NO: 2409668 - RNA, 15 nt, Bordetella pertussis
aggccgcggccaggc

SEQ ID NO: 2409669 - RNA, 16 nt, Bordetella pertussis
aggccgcggccaggcc

SEQ ID NO: 2409670 - RNA, 19 nt, Bordetella pertussis
aggccgcggccaggcccau

SEQ ID NO: 2409671 - RNA, 20 nt, Bordetella pertussis
aggccgcggcgcccggugcg

SEQ ID NO: 2409672 - RNA, 16 nt, Bordetella pertussis
aggccgcuacggcggu

SEQ ID NO: 2409673 - RNA, 15 nt, Bordetella pertussis
aggccgcugggcaca

SEQ ID NO: 2409674 - RNA, 17 nt, Bordetella pertussis
aggccgcuucgugcggc

SEQ ID NO: 2409675 - RNA, 20 nt, Bordetella pertussis
aggccgcuuucgaccagcga

SEQ ID NO: 2409676 - RNA, 21 nt, Bordetella pertussis
aggccgcuuucgaccagcgac

SEQ ID NO: 2409677 - RNA, 23 nt, Bordetella pertussis
aggccggcaagaugccggccugu

SEQ ID NO: 2409678 - RNA, 20 nt, Bordetella pertussis
aggccggcacguccggcacg

SEQ ID NO: 2409679 - RNA, 16 nt, Bordetella pertussis
aggccggcaugcgccg

SEQ ID NO: 2409680 - RNA, 20 nt, Bordetella pertussis
aggccggcaugcgccggccc

SEQ ID NO: 2409681 - RNA, 13 nt, Bordetella pertussis
aggccggccagca

SEQ ID NO: 2409682 - RNA, 23 nt, Bordetella pertussis
aggccggccagggccacgccggc

SEQ ID NO: 2409683 - RNA, 13 nt, Bordetella pertussis
aggccggcccagu

SEQ ID NO: 2409684 - RNA, 23 nt, Bordetella pertussis
aggccggcccgccccacggcgag

SEQ ID NO: 2409685 - RNA, 24 nt, Bordetella pertussis
aggccggccugcaaugcggccagg

SEQ ID NO: 2409686 - RNA, 22 nt, Bordetella pertussis
aggccggcgauggacacgauga

SEQ ID NO: 2409687 - RNA, 14 nt, Bordetella pertussis
aggccggcgccagc

SEQ ID NO: 2409688 - RNA, 15 nt, Bordetella pertussis
aggccggcgcgccgg

SEQ ID NO: 2409689 - RNA, 16 nt, Bordetella pertussis
aggccggcgcgccggc

SEQ ID NO: 2409690 - RNA, 16 nt, Bordetella pertussis
aggccggcgcgcgcgu

SEQ ID NO: 2409691 - RNA, 13 nt, Bordetella pertussis
aggccggcgcgcu

SEQ ID NO: 2409692 - RNA, 14 nt, Bordetella pertussis
aggccggcggcacg

SEQ ID NO: 2409693 - RNA, 16 nt, Bordetella pertussis
aggccggcggccagcg

SEQ ID NO: 2409694 - RNA, 17 nt, Bordetella pertussis
aggccggcggccagcgc

SEQ ID NO: 2409695 - RNA, 22 nt, Bordetella pertussis
aggccggcggccagcgcgccgc

SEQ ID NO: 2409696 - RNA, 14 nt, Bordetella pertussis
aggccggcggcggg

SEQ ID NO: 2409697 - RNA, 13 nt, Bordetella pertussis
aggccggcggcgu

SEQ ID NO: 2409698 - RNA, 16 nt, Bordetella pertussis
aggccggcggcgucuu

SEQ ID NO: 2409699 - RNA, 16 nt, Bordetella pertussis
aggccggcucgccgca

SEQ ID NO: 2409700 - RNA, 20 nt, Bordetella pertussis
aggccggcucgccgcauacc

SEQ ID NO: 2409701 - RNA, 19 nt, Bordetella pertussis
aggccggggaaacggccaa

SEQ ID NO: 2409702 - RNA, 21 nt, Bordetella pertussis
aggccggggaaacggccaagc

SEQ ID NO: 2409703 - RNA, 15 nt, Bordetella pertussis
aggccggggccgccc

SEQ ID NO: 2409704 - RNA, 15 nt, Bordetella pertussis
aggccggugcgcaca

SEQ ID NO: 2409705 - RNA, 18 nt, Bordetella pertussis
aggccggugcgcacaugg

SEQ ID NO: 2409706 - RNA, 21 nt, Bordetella pertussis
aggccgguggaccagggcacg

SEQ ID NO: 2409707 - RNA, 17 nt, Bordetella pertussis
aggccguaaccggccag

SEQ ID NO: 2409708 - RNA, 20 nt, Bordetella pertussis
aggccguaaccggccagucc

SEQ ID NO: 2409709 - RNA, 18 nt, Bordetella pertussis
aggccgucgagccgggcg

SEQ ID NO: 2409710 - RNA, 14 nt, Bordetella pertussis
aggccgucggccag

SEQ ID NO: 2409711 - RNA, 16 nt, Bordetella pertussis
aggccgucggccaggg

SEQ ID NO: 2409712 - RNA, 15 nt, Bordetella pertussis
aggccguggcccagc

SEQ ID NO: 2409713 - RNA, 20 nt, Bordetella pertussis
aggccguggcccagccgcau

SEQ ID NO: 2409714 - RNA, 15 nt, Bordetella pertussis
aggccguggcgcacc

SEQ ID NO: 2409715 - RNA, 17 nt, Bordetella pertussis
aggccguuggccgcgcg

SEQ ID NO: 2409716 - RNA, 20 nt, Bordetella pertussis
aggccguuggccgcgcggua

SEQ ID NO: 2409717 - RNA, 22 nt, Bordetella pertussis
aggccguuggccgcgcgguacg

SEQ ID NO: 2409718 - RNA, 15 nt, Bordetella pertussis
aggccguuggcgcgc

SEQ ID NO: 2409719 - RNA, 19 nt, Bordetella pertussis
aggccguuguccuggcgcg

SEQ ID NO: 2409720 - RNA, 20 nt, Bordetella pertussis
aggccguuguccuggcgcgc

SEQ ID NO: 2409721 - RNA, 20 nt, Bordetella pertussis
aggccucgaagaucaacaag

SEQ ID NO: 2409722 - RNA, 22 nt, Bordetella pertussis
aggccucgcccgaucggccggc

SEQ ID NO: 2409723 - RNA, 13 nt, Bordetella pertussis
aggccucgcgcuc

SEQ ID NO: 2409724 - RNA, 22 nt, Bordetella pertussis
aggccucgcgcucgaacaucgc

SEQ ID NO: 2409725 - RNA, 13 nt, Bordetella pertussis
aggccucggccac

SEQ ID NO: 2409726 - RNA, 14 nt, Bordetella pertussis
aggccucggccacc

SEQ ID NO: 2409727 - RNA, 16 nt, Bordetella pertussis
aggccucggccaccug

SEQ ID NO: 2409728 - RNA, 21 nt, Bordetella pertussis
aggccucggccaccuggcgca

SEQ ID NO: 2409729 - RNA, 18 nt, Bordetella pertussis
aggccucgugcugcugca

SEQ ID NO: 2409730 - RNA, 22 nt, Bordetella pertussis
aggccucgugcugcugcaggcg

SEQ ID NO: 2409731 - RNA, 21 nt, Bordetella pertussis
aggccugcccgggcaccaggu

SEQ ID NO: 2409732 - RNA, 19 nt, Bordetella pertussis
aggccugccugauggcgcg

SEQ ID NO: 2409733 - RNA, 18 nt, Bordetella pertussis
aggccugcggcgccagcg

SEQ ID NO: 2409734 - RNA, 19 nt, Bordetella pertussis
aggccugcggcgccagcgc

SEQ ID NO: 2409735 - RNA, 15 nt, Bordetella pertussis
aggccugcugcagcg

SEQ ID NO: 2409736 - RNA, 17 nt, Bordetella pertussis
aggccugcugcagcgug

SEQ ID NO: 2409737 - RNA, 21 nt, Bordetella pertussis
aggccuggucgagcgggcgcc

SEQ ID NO: 2409738 - RNA, 15 nt, Bordetella pertussis
aggccuguucggccg

SEQ ID NO: 2409739 - RNA, 20 nt, Bordetella pertussis
aggccuucaccuugccgcug

SEQ ID NO: 2409740 - RNA, 14 nt, Bordetella pertussis
aggccuuccaccag

SEQ ID NO: 2409741 - RNA, 23 nt, Bordetella pertussis
aggccuucgcgguaggacggcag

SEQ ID NO: 2409742 - RNA, 14 nt, Bordetella pertussis
aggccuugccgccg

SEQ ID NO: 2409743 - RNA, 16 nt, Bordetella pertussis
aggccuugccgccgcc

SEQ ID NO: 2409744 - RNA, 17 nt, Bordetella pertussis
aggccuuggccugggcc

SEQ ID NO: 2409745 - RNA, 20 nt, Bordetella pertussis
aggccuuggccugggccgac

SEQ ID NO: 2409746 - RNA, 20 nt, Bordetella pertussis
aggccuuucucaaggccgaa

SEQ ID NO: 2409747 - RNA, 22 nt, Bordetella pertussis
aggcgaaaccggugaucagcag

SEQ ID NO: 2409748 - RNA, 12 nt, Bordetella pertussis
aggcgaaacgcc

SEQ ID NO: 2409749 - RNA, 15 nt, Bordetella pertussis
aggcgaacaggcaca

SEQ ID NO: 2409750 - RNA, 15 nt, Bordetella pertussis
aggcgaaccuggcgg

SEQ ID NO: 2409751 - RNA, 13 nt, Bordetella pertussis
aggcgaauccgca

SEQ ID NO: 2409752 - RNA, 15 nt, Bordetella pertussis
aggcgaccggcaccu

SEQ ID NO: 2409753 - RNA, 13 nt, Bordetella pertussis
aggcgagcagguc

SEQ ID NO: 2409754 - RNA, 14 nt, Bordetella pertussis
aggcgagcgcggca

SEQ ID NO: 2409755 - RNA, 22 nt, Bordetella pertussis
aggcgagcgcggcauagcccag

SEQ ID NO: 2409756 - RNA, 14 nt, Bordetella pertussis
aggcgagcggcguc

SEQ ID NO: 2409757 - RNA, 16 nt, Bordetella pertussis
aggcgagcggcgucgc

SEQ ID NO: 2409758 - RNA, 13 nt, Bordetella pertussis
aggcgaugcccag

SEQ ID NO: 2409759 - RNA, 15 nt, Bordetella pertussis
aggcgaugcccagcg

SEQ ID NO: 2409760 - RNA, 12 nt, Bordetella pertussis
aaaaaaagaggc

SEQ ID NO: 2409761 - RNA, 13 nt, Bordetella pertussis
aaaaccaggcugc

SEQ ID NO: 2409762 - RNA, 15 nt, Bordetella pertussis
aaaaccggcgccugg

SEQ ID NO: 2409763 - RNA, 13 nt, Bordetella pertussis
aaaagcaacaacc

SEQ ID NO: 2409764 - RNA, 14 nt, Bordetella pertussis
aaaagcugccggca

SEQ ID NO: 2409765 - RNA, 22 nt, Bordetella pertussis
aaacagcuuccuuuauugaaau

SEQ ID NO: 2409766 - RNA, 11 nt, Bordetella pertussis
aaacagcagcg

SEQ ID NO: 2409767 - RNA, 22 nt, Bordetella pertussis
aaacagcaucagcggcagcacg

SEQ ID NO: 2409768 - RNA, 22 nt, Bordetella pertussis
aaacaggcccacggcaucgccg

SEQ ID NO: 2409769 - RNA, 14 nt, Bordetella pertussis
aaacaggcgccguc

SEQ ID NO: 2409770 - RNA, 18 nt, Bordetella pertussis
aaaccaacggggccgcca

SEQ ID NO: 2409771 - RNA, 15 nt, Bordetella pertussis
aaacccggcaauccc

SEQ ID NO: 2409772 - RNA, 14 nt, Bordetella pertussis
aaacccucgugauc

SEQ ID NO: 2409773 - RNA, 17 nt, Bordetella pertussis
aaaccgacgcggccagc

SEQ ID NO: 2409774 - RNA, 19 nt, Bordetella pertussis
aaaccgcucguaucgcccu

SEQ ID NO: 2409775 - RNA, 16 nt, Bordetella pertussis
aaaccggugaucagca

SEQ ID NO: 2409776 - RNA, 22 nt, Bordetella pertussis
aaaccgucgaugaccagcgccg

SEQ ID NO: 2409777 - RNA, 22 nt, Bordetella pertussis
aaacgccagcccgacggccagc

SEQ ID NO: 2409778 - RNA, 18 nt, Bordetella pertussis
aaacgcggcgccgccggc

SEQ ID NO: 2409779 - RNA, 21 nt, Bordetella pertussis
aaacgcugcgcgaugcgcgcg

SEQ ID NO: 2409780 - RNA, 13 nt, Bordetella pertussis
aaacggccaagca

SEQ ID NO: 2409781 - RNA, 20 nt, Bordetella pertussis
aaacggccaagcagcgccug

SEQ ID NO: 2409782 - RNA, 23 nt, Bordetella pertussis
aaacgggggcaggccgcgguggu

SEQ ID NO: 2409783 - RNA, 13 nt, Bordetella pertussis
aaacugcaaaauu

SEQ ID NO: 2409784 - RNA, 20 nt, Bordetella pertussis
aaacuuccccgcgugccugu

SEQ ID NO: 2409785 - RNA, 18 nt, Bordetella pertussis
aaagaaauugggcguggc

SEQ ID NO: 2409786 - RNA, 16 nt, Bordetella pertussis
aaagaggccacccgaa

SEQ ID NO: 2409787 - RNA, 15 nt, Bordetella pertussis
aaagcaagacagcaa

SEQ ID NO: 2409788 - RNA, 16 nt, Bordetella pertussis
aaagcccgcgccacca

SEQ ID NO: 2409789 - RNA, 12 nt, Bordetella pertussis
aaagccgcccgg

SEQ ID NO: 2409790 - RNA, 22 nt, Bordetella pertussis
aaagcgcggcugcgggccggcg

SEQ ID NO: 2409791 - RNA, 22 nt, Bordetella pertussis
aaagcggcgauccgccgcggcc

SEQ ID NO: 2409792 - RNA, 18 nt, Bordetella pertussis
aaagcggcgugugcccag

SEQ ID NO: 2409793 - RNA, 22 nt, Bordetella pertussis
aaagcggguugcggcagcgccg

SEQ ID NO: 2409794 - RNA, 19 nt, Bordetella pertussis
aaaggaaaucgcggcgcug

SEQ ID NO: 2409795 - RNA, 11 nt, Bordetella pertussis
aaaggcccagg

SEQ ID NO: 2409796 - RNA, 15 nt, Bordetella pertussis
aaauagccgaccacc

SEQ ID NO: 2409797 - RNA, 22 nt, Bordetella pertussis
aaaucccccgcgucggacgcgc

SEQ ID NO: 2409798 - RNA, 22 nt, Bordetella pertussis
aaauccgggcgcugcgccggcg

SEQ ID NO: 2409799 - RNA, 21 nt, Bordetella pertussis
aaaucgaggaaggcccgcguc

SEQ ID NO: 2409800 - RNA, 15 nt, Bordetella pertussis
aaaucgccgccggcg

SEQ ID NO: 2409801 - RNA, 23 nt, Bordetella pertussis
aaauggggcggccgggagccugu

SEQ ID NO: 2409802 - RNA, 20 nt, Bordetella pertussis
aaauugacggcgcucuuggu

SEQ ID NO: 2409803 - RNA, 14 nt, Bordetella pertussis
aacaacggggucau

SEQ ID NO: 2409804 - RNA, 11 nt, Bordetella pertussis
aacaaggcggu

SEQ ID NO: 2409805 - RNA, 20 nt, Bordetella pertussis
aacaagguacccgcgccggc

SEQ ID NO: 2409806 - RNA, 21 nt, Bordetella pertussis
aacaagguacccgcgccggcg

SEQ ID NO: 2409807 - RNA, 19 nt, Bordetella pertussis
aacacaucgagggcgucau

SEQ ID NO: 2409808 - RNA, 22 nt, Bordetella pertussis
aacaccaggguggcgccggcca

SEQ ID NO: 2409809 - RNA, 23 nt, Bordetella pertussis
aacaccccggucagcagggcgcc

SEQ ID NO: 2409810 - RNA, 16 nt, Bordetella pertussis
aacaccgccgcgccgc

SEQ ID NO: 2409811 - RNA, 22 nt, Bordetella pertussis
aacaccggcaggccgcgcugcc

SEQ ID NO: 2409812 - RNA, 15 nt, Bordetella pertussis
aacacgaccagcagg

SEQ ID NO: 2409813 - RNA, 15 nt, Bordetella pertussis
aacacgaugccucga

SEQ ID NO: 2409814 - RNA, 11 nt, Bordetella pertussis
aacacgcgcga

SEQ ID NO: 2409815 - RNA, 15 nt, Bordetella pertussis
aacacgcgcgacgcc

SEQ ID NO: 2409816 - RNA, 23 nt, Bordetella pertussis
aacacgcgcgccgcgggcugcga

SEQ ID NO: 2409817 - RNA, 16 nt, Bordetella pertussis
aacacgcggugcaucu

SEQ ID NO: 2409818 - RNA, 16 nt, Bordetella pertussis
aacagcaccagcaugc

SEQ ID NO: 2409819 - RNA, 13 nt, Bordetella pertussis
aacagcagcggaa

SEQ ID NO: 2409820 - RNA, 12 nt, Bordetella pertussis
aacagcagcgug

SEQ ID NO: 2409821 - RNA, 13 nt, Bordetella pertussis
aacagcaucagcg

SEQ ID NO: 2409822 - RNA, 18 nt, Bordetella pertussis
aacagccgccccagcagc

SEQ ID NO: 2409823 - RNA, 22 nt, Bordetella pertussis
aacagccgccccagcagcagcg

SEQ ID NO: 2409824 - RNA, 18 nt, Bordetella pertussis
aacagcgaaagcacggcg

SEQ ID NO: 2409825 - RNA, 13 nt, Bordetella pertussis
aacagcgccugca

SEQ ID NO: 2409826 - RNA, 13 nt, Bordetella pertussis
aacagcuucucca

SEQ ID NO: 2409827 - RNA, 17 nt, Bordetella pertussis
aacagcuucuccaugcg

SEQ ID NO: 2409828 - RNA, 17 nt, Bordetella pertussis
aacagcuugcccggcgu

SEQ ID NO: 2409829 - RNA, 18 nt, Bordetella pertussis
aacaggcgcgccagccgc

SEQ ID NO: 2409830 - RNA, 12 nt, Bordetella pertussis
aacaggcggcug

SEQ ID NO: 2409831 - RNA, 16 nt, Bordetella pertussis
aacaggcggcugaaga

SEQ ID NO: 2409832 - RNA, 21 nt, Bordetella pertussis
aacaguacuacaguaugggcu

SEQ ID NO: 2409833 - RNA, 19 nt, Bordetella pertussis
aacaguugcaccagugcgc

SEQ ID NO: 2409834 - RNA, 16 nt, Bordetella pertussis
aacaucgcccugucgg

SEQ ID NO: 2409835 - RNA, 11 nt, Bordetella pertussis
aacaucgcgca

SEQ ID NO: 2409836 - RNA, 15 nt, Bordetella pertussis
aacaucuccaccagc

SEQ ID NO: 2409837 - RNA, 17 nt, Bordetella pertussis
aacaugacuucggucag

SEQ ID NO: 2409838 - RNA, 20 nt, Bordetella pertussis
aacauguccaccagccggcc

SEQ ID NO: 2409839 - RNA, 23 nt, Bordetella pertussis
aacauguuguuggucgccacgcc

SEQ ID NO: 2409840 - RNA, 20 nt, Bordetella pertussis
aacauuggguacgacggccg

SEQ ID NO: 2409841 - RNA, 18 nt, Bordetella pertussis
aaccaaggagucccuuca

SEQ ID NO: 2409842 - RNA, 11 nt, Bordetella pertussis
aaccacagcau

SEQ ID NO: 2409843 - RNA, 13 nt, Bordetella pertussis
aaccagaucaggu

SEQ ID NO: 2409844 - RNA, 12 nt, Bordetella pertussis
aaccaggccgcc

SEQ ID NO: 2409845 - RNA, 23 nt, Bordetella pertussis
aaccaggcugcccuggcccaggc

SEQ ID NO: 2409846 - RNA, 16 nt, Bordetella pertussis
aaccaguugcgggccu

SEQ ID NO: 2409847 - RNA, 19 nt, Bordetella pertussis
aacccacccccagcagcau

SEQ ID NO: 2409848 - RNA, 20 nt, Bordetella pertussis
aacccacggcguggcgcgcc

SEQ ID NO: 2409849 - RNA, 18 nt, Bordetella pertussis
aacccagcagcggcagca

SEQ ID NO: 2409850 - RNA, 14 nt, Bordetella pertussis
aaccccaccggcaa

SEQ ID NO: 2409851 - RNA, 23 nt, Bordetella pertussis
aaccccgagggcgcggcgccgcu

SEQ ID NO: 2409852 - RNA, 22 nt, Bordetella pertussis
aaccccgccagguucgccuggc

SEQ ID NO: 2409853 - RNA, 14 nt, Bordetella pertussis
aacccgacgaugau

SEQ ID NO: 2409854 - RNA, 18 nt, Bordetella pertussis
aacccgccauccuggccg

SEQ ID NO: 2409855 - RNA, 11 nt, Bordetella pertussis
aacccgcccgg

SEQ ID NO: 2409856 - RNA, 23 nt, Bordetella pertussis
aacccgccgcgaucagcgcggcc

SEQ ID NO: 2409857 - RNA, 13 nt, Bordetella pertussis
aacccgccggcca

SEQ ID NO: 2409858 - RNA, 18 nt, Bordetella pertussis
aacccggccggcgccggc

SEQ ID NO: 2409859 - RNA, 22 nt, Bordetella pertussis
aacccgggcuuucggucucgcg

SEQ ID NO: 2409860 - RNA, 19 nt, Bordetella pertussis
aacccucgcacggccguca

SEQ ID NO: 2409861 - RNA, 18 nt, Bordetella pertussis
aaccgaauuccggcucgg

SEQ ID NO: 2409862 - RNA, 16 nt, Bordetella pertussis
aaccgcaacgccagca

SEQ ID NO: 2409863 - RNA, 20 nt, Bordetella pertussis
aaccgcaccggaggcgccgc

SEQ ID NO: 2409864 - RNA, 14 nt, Bordetella pertussis
aaccgcagcgccac

SEQ ID NO: 2409865 - RNA, 19 nt, Bordetella pertussis
aaccgcagcgccaccggcu

SEQ ID NO: 2409866 - RNA, 18 nt, Bordetella pertussis
aaccgccgcaagacggcg

SEQ ID NO: 2409867 - RNA, 11 nt, Bordetella pertussis
aaccgccgcuu

SEQ ID NO: 2409868 - RNA, 18 nt, Bordetella pertussis
aaccgcgccucguccucg

SEQ ID NO: 2409869 - RNA, 21 nt, Bordetella pertussis
aaccggcaucccugcuugcgc

SEQ ID NO: 2409870 - RNA, 14 nt, Bordetella pertussis
aaccggcgcgcgcg

SEQ ID NO: 2409871 - RNA, 13 nt, Bordetella pertussis
aaccggugcuggu

SEQ ID NO: 2409872 - RNA, 14 nt, Bordetella pertussis
aaccgucgaccggc

SEQ ID NO: 2409873 - RNA, 18 nt, Bordetella pertussis
aaccgucgaugaccagcg

SEQ ID NO: 2409874 - RNA, 13 nt, Bordetella pertussis
aaccucgacgcgc

SEQ ID NO: 2409875 - RNA, 14 nt, Bordetella pertussis
aaccucgacgcgca

SEQ ID NO: 2409876 - RNA, 20 nt, Bordetella pertussis
aaccucgacgcgcauuucga

SEQ ID NO: 2409877 - RNA, 15 nt, Bordetella pertussis
aaccgcagcgccacc

SEQ ID NO: 2409878 - RNA, 16 nt, Bordetella pertussis
aaccgcagcgccaccg

SEQ ID NO: 2409879 - RNA, 20 nt, Bordetella pertussis
acccugccgugggacaggca

SEQ ID NO: 2409880 - RNA, 23 nt, Bordetella pertussis
acccugccgugggacaggcacuc

SEQ ID NO: 2409881 - RNA, 16 nt, Bordetella pertussis
acccugccuccaggcg

SEQ ID NO: 2409882 - RNA, 19 nt, Bordetella pertussis
acccugcucuacaccauca

SEQ ID NO: 2409883 - RNA, 12 nt, Bordetella pertussis
acccuggccgaa

SEQ ID NO: 2409884 - RNA, 22 nt, Bordetella pertussis
acccuguacaagcgcacgcugg

SEQ ID NO: 2409885 - RNA, 13 nt, Bordetella pertussis
acccuucgcgcug

SEQ ID NO: 2409886 - RNA, 14 nt, Bordetella pertussis
acccuucgcgcugc

SEQ ID NO: 2409887 - RNA, 14 nt, Bordetella pertussis
acccuugccgcagg

SEQ ID NO: 2409888 - RNA, 20 nt, Bordetella pertussis
acccuugcucagucgggcag

SEQ ID NO: 2409889 - RNA, 21 nt, Bordetella pertussis
acccuuucauuucggcgccgc

SEQ ID NO: 2409890 - RNA, 18 nt, Bordetella pertussis
acccuuuuuacaugcagc

SEQ ID NO: 2409891 - RNA, 19 nt, Bordetella pertussis
accgaaaagcccacguagg

SEQ ID NO: 2409892 - RNA, 16 nt, Bordetella pertussis
accgaaaugccgcagc

SEQ ID NO: 2409893 - RNA, 18 nt, Bordetella pertussis
accgaaaugccgcagcac

SEQ ID NO: 2409894 - RNA, 19 nt, Bordetella pertussis
accgaaaugccgcagcacc

SEQ ID NO: 2409895 - RNA, 23 nt, Bordetella pertussis
accgaacccugccucagaccacg

SEQ ID NO: 2409896 - RNA, 22 nt, Bordetella pertussis
accgaaccgauccagcccgcgg

SEQ ID NO: 2409897 - RNA, 14 nt, Bordetella pertussis
accgaacggccggu

SEQ ID NO: 2409898 - RNA, 20 nt, Bordetella pertussis
accgaacggccggucagccc

SEQ ID NO: 2409899 - RNA, 14 nt, Bordetella pertussis
accgaagcggcguu

SEQ ID NO: 2409900 - RNA, 17 nt, Bordetella pertussis
accgaaucgaacuuggc

SEQ ID NO: 2409901 - RNA, 21 nt, Bordetella pertussis
accgaauuccggcucggaccu

SEQ ID NO: 2409902 - RNA, 13 nt, Bordetella pertussis
accgacagcacau

SEQ ID NO: 2409903 - RNA, 17 nt, Bordetella pertussis
accgacaggaugggcgc

SEQ ID NO: 2409904 - RNA, 15 nt, Bordetella pertussis
accgacaggccuggc

SEQ ID NO: 2409905 - RNA, 15 nt, Bordetella pertussis
accgaccagcgcgcg

SEQ ID NO: 2409906 - RNA, 14 nt, Bordetella pertussis
accgaccgccacga

SEQ ID NO: 2409907 - RNA, 18 nt, Bordetella pertussis
accgaccugaucgcgcag

SEQ ID NO: 2409908 - RNA, 19 nt, Bordetella pertussis
accgaccugaucgcgcagc

SEQ ID NO: 2409909 - RNA, 13 nt, Bordetella pertussis
accgacgcagcgc

SEQ ID NO: 2409910 - RNA, 13 nt, Bordetella pertussis
accgacggcagcc

SEQ ID NO: 2409911 - RNA, 13 nt, Bordetella pertussis
accgacggccugg

SEQ ID NO: 2409912 - RNA, 14 nt, Bordetella pertussis
accgacggcgcggc

SEQ ID NO: 2409913 - RNA, 16 nt, Bordetella pertussis
accgacggcgcggcga

SEQ ID NO: 2409914 - RNA, 14 nt, Bordetella pertussis
accgacugcgcaug

SEQ ID NO: 2409915 - RNA, 16 nt, Bordetella pertussis
accgagacgcugucgc

SEQ ID NO: 2409916 - RNA, 13 nt, Bordetella pertussis
accgagcccggca

SEQ ID NO: 2409917 - RNA, 17 nt, Bordetella pertussis
accgagcccggcaccau

SEQ ID NO: 2409918 - RNA, 17 nt, Bordetella pertussis
accgagccggccagcgc

SEQ ID NO: 2409919 - RNA, 12 nt, Bordetella pertussis
accgagcgcgcc

SEQ ID NO: 2409920 - RNA, 23 nt, Bordetella pertussis
accgagcugagcaccagcagccc

SEQ ID NO: 2409921 - RNA, 22 nt, Bordetella pertussis
accgagggccggacuggcgcgc

SEQ ID NO: 2409922 - RNA, 20 nt, Bordetella pertussis
accgagggcgcguccaagca

SEQ ID NO: 2409923 - RNA, 14 nt, Bordetella pertussis
accgaggugccggc

SEQ ID NO: 2409924 - RNA, 15 nt, Bordetella pertussis
accgaggugccggcg

SEQ ID NO: 2409925 - RNA, 16 nt, Bordetella pertussis
accgaggugccggcgg

SEQ ID NO: 2409926 - RNA, 19 nt, Bordetella pertussis
accgaggugccggcgguga

SEQ ID NO: 2409927 - RNA, 17 nt, Bordetella pertussis
accgaucuacgacgccu

SEQ ID NO: 2409928 - RNA, 14 nt, Bordetella pertussis
accgaugcgccggc

SEQ ID NO: 2409929 - RNA, 17 nt, Bordetella pertussis
accgaugcgccggccug

SEQ ID NO: 2409930 - RNA, 19 nt, Bordetella pertussis
accgaugcgccggccuggc

SEQ ID NO: 2409931 - RNA, 17 nt, Bordetella pertussis
accgauggugccgggcu

SEQ ID NO: 2409932 - RNA, 20 nt, Bordetella pertussis
accgauucgaacucgccgaa

SEQ ID NO: 2409933 - RNA, 14 nt, Bordetella pertussis
accgauucgcgcac

SEQ ID NO: 2409934 - RNA, 14 nt, Bordetella pertussis
accgcaaggaagug

SEQ ID NO: 2409935 - RNA, 15 nt, Bordetella pertussis
accgcaaggaagugg

SEQ ID NO: 2409936 - RNA, 19 nt, Bordetella pertussis
accgcaccggaggcgccgc

SEQ ID NO: 2409937 - RNA, 17 nt, Bordetella pertussis
accgcacgauggcgcgc

SEQ ID NO: 2409938 - RNA, 16 nt, Bordetella pertussis
accgcagaagcagccg

SEQ ID NO: 2409939 - RNA, 19 nt, Bordetella pertussis
accgcagaagcagccgcgc

SEQ ID NO: 2409940 - RNA, 23 nt, Bordetella pertussis
accgcaggcaagcugcuggcgcg

SEQ ID NO: 2409941 - RNA, 20 nt, Bordetella pertussis
accgcaggggauugccgcgc

SEQ ID NO: 2409942 - RNA, 22 nt, Bordetella pertussis
accgcaggggauugccgcgcgg

SEQ ID NO: 2409943 - RNA, 16 nt, Bordetella pertussis
accgcauagcgcauga

SEQ ID NO: 2409944 - RNA, 16 nt, Bordetella pertussis
accgcauagcuggaga

SEQ ID NO: 2409945 - RNA, 14 nt, Bordetella pertussis
accgcaucgcgcag

SEQ ID NO: 2409946 - RNA, 20 nt, Bordetella pertussis
accgcaucgcgcagcgugcg

SEQ ID NO: 2409947 - RNA, 22 nt, Bordetella pertussis
accgcaugcggcacaaccuggc

SEQ ID NO: 2409948 - RNA, 15 nt, Bordetella pertussis
accgcaugggccagg

SEQ ID NO: 2409949 - RNA, 17 nt, Bordetella pertussis
accgcaugggccaggcg

SEQ ID NO: 2409950 - RNA, 20 nt, Bordetella pertussis
accgccaagcagaccuacca

SEQ ID NO: 2409951 - RNA, 18 nt, Bordetella pertussis
accgccacgaagugcgcc

SEQ ID NO: 2409952 - RNA, 18 nt, Bordetella pertussis
accgccacgcgguccagc

SEQ ID NO: 2409953 - RNA, 23 nt, Bordetella pertussis
accgccacgucauaggcuucgcc

SEQ ID NO: 2409954 - RNA, 20 nt, Bordetella pertussis
accgccagcaggcccugggc

SEQ ID NO: 2409955 - RNA, 14 nt, Bordetella pertussis
accgccagcgcguc

SEQ ID NO: 2409956 - RNA, 21 nt, Bordetella pertussis
accgccagcgcgucguccagc

SEQ ID NO: 2409957 - RNA, 23 nt, Bordetella pertussis
accgccagcucggccugcggcuc

SEQ ID NO: 2409958 - RNA, 24 nt, Bordetella pertussis
accgccagcucggccugcggcucg

SEQ ID NO: 2409959 - RNA, 19 nt, Bordetella pertussis
accgccaggcagauccgcc

SEQ ID NO: 2409960 - RNA, 14 nt, Bordetella pertussis
accgccaugcgcau

SEQ ID NO: 2409961 - RNA, 15 nt, Bordetella pertussis
accgccauggcggcc

SEQ ID NO: 2409962 - RNA, 16 nt, Bordetella pertussis
accgccauggcggccg

SEQ ID NO: 2409963 - RNA, 18 nt, Bordetella pertussis
accgccaugugcgccgcg

SEQ ID NO: 2409964 - RNA, 19 nt, Bordetella pertussis
accgccaugugcgccgcgc

SEQ ID NO: 2409965 - RNA, 20 nt, Bordetella pertussis
accgccaugugcgccgcgcc

SEQ ID NO: 2409966 - RNA, 19 nt, Bordetella pertussis
accgcccgcaugucccagc

SEQ ID NO: 2409967 - RNA, 20 nt, Bordetella pertussis
accgccgauaccacgcgcgg

SEQ ID NO: 2409968 - RNA, 16 nt, Bordetella pertussis
accgccgccacgcgca

SEQ ID NO: 2409969 - RNA, 13 nt, Bordetella pertussis
accgccgccaguu

SEQ ID NO: 2409970 - RNA, 17 nt, Bordetella pertussis
accgccgcccgcaggca

SEQ ID NO: 2409971 - RNA, 15 nt, Bordetella pertussis
accgccgcccgccag

SEQ ID NO: 2409972 - RNA, 19 nt, Bordetella pertussis
accgccgcccgccaggcca

SEQ ID NO: 2409973 - RNA, 14 nt, Bordetella pertussis
accgccgccgccac

SEQ ID NO: 2409974 - RNA, 22 nt, Bordetella pertussis
accgccgccgccaccagcggcg

SEQ ID NO: 2409975 - RNA, 17 nt, Bordetella pertussis
accgccgccgcgccgcu

SEQ ID NO: 2409976 - RNA, 13 nt, Bordetella pertussis
accgccgcgccca

SEQ ID NO: 2409977 - RNA, 15 nt, Bordetella pertussis
accgccgcguccucg

SEQ ID NO: 2409978 - RNA, 24 nt, Bordetella pertussis
accgccggcaccagcgccacgccc

SEQ ID NO: 2409979 - RNA, 21 nt, Bordetella pertussis
accgccggccggugcaucggc

SEQ ID NO: 2409980 - RNA, 13 nt, Bordetella pertussis
accgccggcggcg

SEQ ID NO: 2409981 - RNA, 16 nt, Bordetella pertussis
accgccgggacaggca

SEQ ID NO: 2409982 - RNA, 16 nt, Bordetella pertussis
accgccgguucggucg

SEQ ID NO: 2409983 - RNA, 15 nt, Bordetella pertussis
accgccguggccggc

SEQ ID NO: 2409984 - RNA, 16 nt, Bordetella pertussis
accgccguggccggca

SEQ ID NO: 2409985 - RNA, 22 nt, Bordetella pertussis
accgccuccaggaugagcgccu

SEQ ID NO: 2409986 - RNA, 13 nt, Bordetella pertussis
accgccucgacgc

SEQ ID NO: 2409987 - RNA, 17 nt, Bordetella pertussis
accgccucgacgcccgg

SEQ ID NO: 2409988 - RNA, 15 nt, Bordetella pertussis
accgccucgaucgcc

SEQ ID NO: 2409989 - RNA, 18 nt, Bordetella pertussis
accgccugcugcgccugg

SEQ ID NO: 2409990 - RNA, 19 nt, Bordetella pertussis
accgccugcugcgccuggc

SEQ ID NO: 2409991 - RNA, 20 nt, Bordetella pertussis
accgccugcugcgccuggcc

SEQ ID NO: 2409992 - RNA, 19 nt, Bordetella pertussis
accggcgugagcgccaccg

SEQ ID NO: 2409993 - RNA, 23 nt, Bordetella pertussis
accggcgugcagagcaccacggc

SEQ ID NO: 2409994 - RNA, 21 nt, Bordetella pertussis
accggcgugcgcuggcugggc

SEQ ID NO: 2409995 - RNA, 19 nt, Bordetella pertussis
accggcguguccagcggcg

SEQ ID NO: 2409996 - RNA, 21 nt, Bordetella pertussis
accggcguguccagcggcgcc

SEQ ID NO: 2409997 - RNA, 22 nt, Bordetella pertussis
accggcguguccagcggcgcca

SEQ ID NO: 2409998 - RNA, 16 nt, Bordetella pertussis
accggcuauaccgggc

SEQ ID NO: 2409999 - RNA, 19 nt, Bordetella pertussis
accggcuauaccgggcugg

SEQ ID NO: 2410000 - RNA, 22 nt, Bordetella pertussis
accggcucgaucgccgccggca

SEQ ID NO: 2410001 - RNA, 14 nt, Bordetella pertussis
accggcucgggcuc

SEQ ID NO: 2410002 - RNA, 16 nt, Bordetella pertussis
accggcugcaugcgcg

SEQ ID NO: 2410003 - RNA, 15 nt, Bordetella pertussis
accggcugccagggc

SEQ ID NO: 2410004 - RNA, 13 nt, Bordetella pertussis
accggcuugccgu

SEQ ID NO: 2410005 - RNA, 17 nt, Bordetella pertussis
accggcuuggccucggc

SEQ ID NO: 2410006 - RNA, 14 nt, Bordetella pertussis
accgggaauggcgc

SEQ ID NO: 2410007 - RNA, 13 nt, Bordetella pertussis
accgggccgacgc

SEQ ID NO: 2410008 - RNA, 17 nt, Bordetella pertussis
accgggccggccugcgu

SEQ ID NO: 2410009 - RNA, 21 nt, Bordetella pertussis
accgggccggccugcgucgcc

SEQ ID NO: 2410010 - RNA, 15 nt, Bordetella pertussis
accgggcggcccggc

SEQ ID NO: 2410011 - RNA, 21 nt, Bordetella pertussis
accgggcugaacauccugacc

SEQ ID NO: 2410012 - RNA, 14 nt, Bordetella pertussis
accggggcagggcg

SEQ ID NO: 2410013 - RNA, 20 nt, Bordetella pertussis
accggggcguccaccgccga

SEQ ID NO: 2410014 - RNA, 20 nt, Bordetella pertussis
accgggucgucgggcggcgc

SEQ ID NO: 2410015 - RNA, 18 nt, Bordetella pertussis
accggguggcugcgcagg

SEQ ID NO: 2410016 - RNA, 14 nt, Bordetella pertussis
accggguugcccgg

SEQ ID NO: 2410017 - RNA, 19 nt, Bordetella pertussis
accggguugcccggcaggc

SEQ ID NO: 2410018 - RNA, 13 nt, Bordetella pertussis
accgguccagaug

SEQ ID NO: 2410019 - RNA, 17 nt, Bordetella pertussis
accggucggccggcagc

SEQ ID NO: 2410020 - RNA, 18 nt, Bordetella pertussis
accggugaucagcaggcc

SEQ ID NO: 2410021 - RNA, 12 nt, Bordetella pertussis
accggugcccuc

SEQ ID NO: 2410022 - RNA, 14 nt, Bordetella pertussis
accggugcccucga

SEQ ID NO: 2410023 - RNA, 12 nt, Bordetella pertussis
accggugcuggu

SEQ ID NO: 2410024 - RNA, 15 nt, Bordetella pertussis
accggugcuggugcu

SEQ ID NO: 2410025 - RNA, 18 nt, Bordetella pertussis
accgguggccauggacag

SEQ ID NO: 2410026 - RNA, 19 nt, Bordetella pertussis
accgguggugcugcugggc

SEQ ID NO: 2410027 - RNA, 16 nt, Bordetella pertussis
accgguuggccagcuc

SEQ ID NO: 2410028 - RNA, 13 nt, Bordetella pertussis
accguacccgcgc

SEQ ID NO: 2410029 - RNA, 15 nt, Bordetella pertussis
accguagcgcaggcg

SEQ ID NO: 2410030 - RNA, 13 nt, Bordetella pertussis
accgucagcaugc

SEQ ID NO: 2410031 - RNA, 17 nt, Bordetella pertussis
accgucaggaagcccga

SEQ ID NO: 2410032 - RNA, 15 nt, Bordetella pertussis
accguccuugagcgc

SEQ ID NO: 2410033 - RNA, 18 nt, Bordetella pertussis
accguccuugagcgccag

SEQ ID NO: 2410034 - RNA, 20 nt, Bordetella pertussis
accguccuugagcgccagcu

SEQ ID NO: 2410035 - RNA, 21 nt, Bordetella pertussis
accgucgacuucgacccggac

SEQ ID NO: 2410036 - RNA, 13 nt, Bordetella pertussis
accgucgaugacc

SEQ ID NO: 2410037 - RNA, 18 nt, Bordetella pertussis
accgucgaugaccagcgc

SEQ ID NO: 2410038 - RNA, 19 nt, Bordetella pertussis
accgucgaugaccagcgcc

SEQ ID NO: 2410039 - RNA, 16 nt, Bordetella pertussis
accgucgcgcgcacgc

SEQ ID NO: 2410040 - RNA, 15 nt, Bordetella pertussis
accgucguccucggc

SEQ ID NO: 2410041 - RNA, 16 nt, Bordetella pertussis
accgucguccucggca

SEQ ID NO: 2410042 - RNA, 17 nt, Bordetella pertussis
accgucuugcccgccag

SEQ ID NO: 2410043 - RNA, 17 nt, Bordetella pertussis
accgucuuggccgucaa

SEQ ID NO: 2410044 - RNA, 21 nt, Bordetella pertussis
accgugauauagaccagcagc

SEQ ID NO: 2410045 - RNA, 16 nt, Bordetella pertussis
accgugaucggcgcaa

SEQ ID NO: 2410046 - RNA, 20 nt, Bordetella pertussis
accgugaugcgcgccgcucu

SEQ ID NO: 2410047 - RNA, 21 nt, Bordetella pertussis
accgugaugcgcgccgcucuu

SEQ ID NO: 2410048 - RNA, 16 nt, Bordetella pertussis
accgugccgccgagga

SEQ ID NO: 2410049 - RNA, 19 nt, Bordetella pertussis
accgugcgccaacgcgucg

SEQ ID NO: 2410050 - RNA, 20 nt, Bordetella pertussis
accgugcgccaacgcgucga

SEQ ID NO: 2410051 - RNA, 13 nt, Bordetella pertussis
accguggccacgg

SEQ ID NO: 2410052 - RNA, 18 nt, Bordetella pertussis
accgugugaucgccgacg

SEQ ID NO: 2410053 - RNA, 21 nt, Bordetella pertussis
accuaccaggccgacgaggcg

SEQ ID NO: 2410054 - RNA, 19 nt, Bordetella pertussis
accucagccugcuggugcu

SEQ ID NO: 2410055 - RNA, 14 nt, Bordetella pertussis
accuccaccgccag

SEQ ID NO: 2410056 - RNA, 13 nt, Bordetella pertussis
accuccaggccca

SEQ ID NO: 2410057 - RNA, 21 nt, Bordetella pertussis
accuccugguccgugaagccg

SEQ ID NO: 2410058 - RNA, 13 nt, Bordetella pertussis
accucgagcaccu

SEQ ID NO: 2410059 - RNA, 19 nt, Bordetella pertussis
accucgaucaccaccggca

SEQ ID NO: 2410060 - RNA, 17 nt, Bordetella pertussis
accucgaugaacgaccc

SEQ ID NO: 2410061 - RNA, 18 nt, Bordetella pertussis
accucgcccaggccgggc

SEQ ID NO: 2410062 - RNA, 22 nt, Bordetella pertussis
accucgcccaggccgggcgagc

SEQ ID NO: 2410063 - RNA, 15 nt, Bordetella pertussis
accucgccgcgccag

SEQ ID NO: 2410064 - RNA, 13 nt, Bordetella pertussis
accucgcgccggu

SEQ ID NO: 2410065 - RNA, 15 nt, Bordetella pertussis
accucgcgcugcagc

SEQ ID NO: 2410066 - RNA, 16 nt, Bordetella pertussis
accucgcgcugcagca

SEQ ID NO: 2410067 - RNA, 17 nt, Bordetella pertussis
accucgcgcugcagcau

SEQ ID NO: 2410068 - RNA, 18 nt, Bordetella pertussis
accucgcgguugcgucuc

SEQ ID NO: 2410069 - RNA, 13 nt, Bordetella pertussis
accucgcuugccc

SEQ ID NO: 2410070 - RNA, 14 nt, Bordetella pertussis
accucgcuugcccg

SEQ ID NO: 2410071 - RNA, 21 nt, Bordetella pertussis
accucggacgagacaggcgcg

SEQ ID NO: 2410072 - RNA, 20 nt, Bordetella pertussis
accucggcaccgaggccgag

SEQ ID NO: 2410073 - RNA, 18 nt, Bordetella pertussis
accucggccggggcgguc

SEQ ID NO: 2410074 - RNA, 13 nt, Bordetella pertussis
accucggcggcgu

SEQ ID NO: 2410075 - RNA, 13 nt, Bordetella pertussis
accucggcgucgc

SEQ ID NO: 2410076 - RNA, 18 nt, Bordetella pertussis
accucggcguggcgggga

SEQ ID NO: 2410077 - RNA, 15 nt, Bordetella pertussis
accucggggcgcggc

SEQ ID NO: 2410078 - RNA, 15 nt, Bordetella pertussis
accucggggugcagc

SEQ ID NO: 2410079 - RNA, 19 nt, Bordetella pertussis
accucguaaguggcggcgg

SEQ ID NO: 2410080 - RNA, 20 nt, Bordetella pertussis
accucuccacuggccuucuu

SEQ ID NO: 2410081 - RNA, 20 nt, Bordetella pertussis
accugaauccguaagcgcug

SEQ ID NO: 2410082 - RNA, 15 nt, Bordetella pertussis
accugacccugcgca

SEQ ID NO: 2410083 - RNA, 14 nt, Bordetella pertussis
accugagccaggcg

SEQ ID NO: 2410084 - RNA, 15 nt, Bordetella pertussis
accugagccaggcgc

SEQ ID NO: 2410085 - RNA, 17 nt, Bordetella pertussis
accugaucgccucgguc

SEQ ID NO: 2410086 - RNA, 16 nt, Bordetella pertussis
accugaucgcgcagcg

SEQ ID NO: 2410087 - RNA, 20 nt, Bordetella pertussis
accugaugccugucccgcac

SEQ ID NO: 2410088 - RNA, 22 nt, Bordetella pertussis
accugcaagauuucauggcguc

SEQ ID NO: 2410089 - RNA, 14 nt, Bordetella pertussis
accugcaccgccgc

SEQ ID NO: 2410090 - RNA, 14 nt, Bordetella pertussis
accugcaccgucag

SEQ ID NO: 2410091 - RNA, 16 nt, Bordetella pertussis
accugcacgauggcgc

SEQ ID NO: 2410092 - RNA, 20 nt, Bordetella pertussis
accugcacgauggcgccggc

SEQ ID NO: 2410093 - RNA, 15 nt, Bordetella pertussis
accugcagcaggcgc

SEQ ID NO: 2410094 - RNA, 21 nt, Bordetella pertussis
accugcagcaggcgcaccagc

SEQ ID NO: 2410095 - RNA, 22 nt, Bordetella pertussis
accugcaggcccaccggcaugc

SEQ ID NO: 2410096 - RNA, 16 nt, Bordetella pertussis
accugcaggccgccgg

SEQ ID NO: 2410097 - RNA, 19 nt, Bordetella pertussis
accugcaggccgccggcca

SEQ ID NO: 2410098 - RNA, 20 nt, Bordetella pertussis
accugcagggucagcccgcc

SEQ ID NO: 2410099 - RNA, 22 nt, Bordetella pertussis
accugcagggucagcccgccau

SEQ ID NO: 2410100 - RNA, 22 nt, Bordetella pertussis
accugccgacuucuggggugcc

SEQ ID NO: 2410101 - RNA, 13 nt, Bordetella pertussis
accugccgcccga

SEQ ID NO: 2410102 - RNA, 12 nt, Bordetella pertussis
accugccugccg

SEQ ID NO: 2410103 - RNA, 23 nt, Bordetella pertussis
accugccugccgccugccaguuc

SEQ ID NO: 2410104 - RNA, 17 nt, Bordetella pertussis
accugcgacagcaccgg

SEQ ID NO: 2410105 - RNA, 11 nt, Bordetella pertussis
aaugcccaguu

SEQ ID NO: 2410106 - RNA, 21 nt, Bordetella pertussis
aaugccccacggguaccaggc

SEQ ID NO: 2410107 - RNA, 14 nt, Bordetella pertussis
aaugcccgcccuug

SEQ ID NO: 2410108 - RNA, 16 nt, Bordetella pertussis
aaugcgacagcgacag

SEQ ID NO: 2410109 - RNA, 14 nt, Bordetella pertussis
aaugcggccaggcc

SEQ ID NO: 2410110 - RNA, 16 nt, Bordetella pertussis
aaugcggcgacagggc

SEQ ID NO: 2410111 - RNA, 20 nt, Bordetella pertussis
aaugcggcgacagggcgucg

SEQ ID NO: 2410112 - RNA, 17 nt, Bordetella pertussis
aaugcggcggcgcuggc

SEQ ID NO: 2410113 - RNA, 19 nt, Bordetella pertussis
aaugcggcggcgcuggccu

SEQ ID NO: 2410114 - RNA, 20 nt, Bordetella pertussis
aaugcggguguugucaugcg

SEQ ID NO: 2410115 - RNA, 15 nt, Bordetella pertussis
aaugcguggccggcg

SEQ ID NO: 2410116 - RNA, 13 nt, Bordetella pertussis
aauggaugcgcgc

SEQ ID NO: 2410117 - RNA, 14 nt, Bordetella pertussis
aauggaugcgcgcc

SEQ ID NO: 2410118 - RNA, 21 nt, Bordetella pertussis
aauggcggccucgggcaacug

SEQ ID NO: 2410119 - RNA, 20 nt, Bordetella pertussis
aauggcggcgguagcgcucg

SEQ ID NO: 2410120 - RNA, 13 nt, Bordetella pertussis
aaugggccgcagc

SEQ ID NO: 2410121 - RNA, 14 nt, Bordetella pertussis
aauggucaagcggc

SEQ ID NO: 2410122 - RNA, 23 nt, Bordetella pertussis
aauggugcggccaugauacccau

SEQ ID NO: 2410123 - RNA, 22 nt, Bordetella pertussis
aaugucccacaggcgcgcggcg

SEQ ID NO: 2410124 - RNA, 18 nt, Bordetella pertussis
aauguccggggcgcuugc

SEQ ID NO: 2410125 - RNA, 15 nt, Bordetella pertussis
aauucaagccgcacc

SEQ ID NO: 2410126 - RNA, 17 nt, Bordetella pertussis
aauuccaguugcgcgcc

SEQ ID NO: 2410127 - RNA, 18 nt, Bordetella pertussis
aauucguuggagcaagcg

SEQ ID NO: 2410128 - RNA, 18 nt, Bordetella pertussis
aauugacggcgcucuugg

SEQ ID NO: 2410129 - RNA, 14 nt, Bordetella pertussis
aauugccccagcac

SEQ ID NO: 2410130 - RNA, 19 nt, Bordetella pertussis
aauugcuugccugucccca

SEQ ID NO: 2410131 - RNA, 13 nt, Bordetella pertussis
accuggacccgcu

SEQ ID NO: 2410132 - RNA, 17 nt, Bordetella pertussis
accuggacgagggccgc

SEQ ID NO: 2410133 - RNA, 22 nt, Bordetella pertussis
accuggacgagggccgcggcga

SEQ ID NO: 2410134 - RNA, 21 nt, Bordetella pertussis
accuggaucacgugccagccg

SEQ ID NO: 2410135 - RNA, 18 nt, Bordetella pertussis
accuggccacaagcggcc

SEQ ID NO: 2410136 - RNA, 12 nt, Bordetella pertussis
accuggcccggc

SEQ ID NO: 2410137 - RNA, 16 nt, Bordetella pertussis
accuggcccggcaccg

SEQ ID NO: 2410138 - RNA, 18 nt, Bordetella pertussis
accuggcgcaaggcgucg

SEQ ID NO: 2410139 - RNA, 15 nt, Bordetella pertussis
accuggcgcccggcg

SEQ ID NO: 2410140 - RNA, 22 nt, Bordetella pertussis
accuggcgcccggcggcgcgcu

SEQ ID NO: 2410141 - RNA, 20 nt, Bordetella pertussis
accuggcugaacaggccuuc

SEQ ID NO: 2410142 - RNA, 18 nt, Bordetella pertussis
accugggaggggccggcu

SEQ ID NO: 2410143 - RNA, 13 nt, Bordetella pertussis
accugggccagca

SEQ ID NO: 2410144 - RNA, 20 nt, Bordetella pertussis
accugggccaucgggauacc

SEQ ID NO: 2410145 - RNA, 13 nt, Bordetella pertussis
accugggcgucga

SEQ ID NO: 2410146 - RNA, 22 nt, Bordetella pertussis
accuggggguucgugggcgagc

SEQ ID NO: 2410147 - RNA, 13 nt, Bordetella pertussis
accugggucggaa

SEQ ID NO: 2410148 - RNA, 15 nt, Bordetella pertussis
accugguacggcauc

SEQ ID NO: 2410149 - RNA, 17 nt, Bordetella pertussis
accugguacggcauccc

SEQ ID NO: 2410150 - RNA, 16 nt, Bordetella pertussis
accugguauccggcgc

SEQ ID NO: 2410151 - RNA, 17 nt, Bordetella pertussis
accugguccugcgugau

SEQ ID NO: 2410152 - RNA, 16 nt, Bordetella pertussis
accuggucgaucagcc

SEQ ID NO: 2410153 - RNA, 17 nt, Bordetella pertussis
accuggucggccuucau

SEQ ID NO: 2410154 - RNA, 21 nt, Bordetella pertussis
accuggucgucggccacgccc

SEQ ID NO: 2410155 - RNA, 13 nt, Bordetella pertussis
accuggugcacca

SEQ ID NO: 2410156 - RNA, 15 nt, Bordetella pertussis
accugguggcgcugg

SEQ ID NO: 2410157 - RNA, 16 nt, Bordetella pertussis
accugguggcgcuggc

SEQ ID NO: 2410158 - RNA, 19 nt, Bordetella pertussis
accugguggcgcuggccca

SEQ ID NO: 2410159 - RNA, 13 nt, Bordetella pertussis
accugguguucgg

SEQ ID NO: 2410160 - RNA, 15 nt, Bordetella pertussis
accuguggcgcaccc

SEQ ID NO: 2410161 - RNA, 20 nt, Bordetella pertussis
accuuccuccgacaggcgcc

SEQ ID NO: 2410162 - RNA, 22 nt, Bordetella pertussis
accuuccugcuggaccugcugu

SEQ ID NO: 2410163 - RNA, 17 nt, Bordetella pertussis
accuucgcgcagcggcg

SEQ ID NO: 2410164 - RNA, 18 nt, Bordetella pertussis
accuucucgaugcgcgcc

SEQ ID NO: 2410165 - RNA, 19 nt, Bordetella pertussis
accuucucgaugcgcgcca

SEQ ID NO: 2410166 - RNA, 18 nt, Bordetella pertussis
accuucugccgccaggca

SEQ ID NO: 2410167 - RNA, 21 nt, Bordetella pertussis
accuugagaugccagcggcgc

SEQ ID NO: 2410168 - RNA, 13 nt, Bordetella pertussis
accuugcccacgc

SEQ ID NO: 2410169 - RNA, 17 nt, Bordetella pertussis
accuugcccagcagcuc

SEQ ID NO: 2410170 - RNA, 22 nt, Bordetella pertussis
accuugcccagcagcuccucgg

SEQ ID NO: 2410171 - RNA, 15 nt, Bordetella pertussis
accuugccccacuug

SEQ ID NO: 2410172 - RNA, 20 nt, Bordetella pertussis
accuugccgauccagcgccu

SEQ ID NO: 2410173 - RNA, 23 nt, Bordetella pertussis
accuugccgauccagcgccuggg

SEQ ID NO: 2410174 - RNA, 15 nt, Bordetella pertussis
accuugcggccgcgc

SEQ ID NO: 2410175 - RNA, 18 nt, Bordetella pertussis
accuugcggccgcgcacc

SEQ ID NO: 2410176 - RNA, 21 nt, Bordetella pertussis
accuugcggccgcgcaccugc

SEQ ID NO: 2410177 - RNA, 19 nt, Bordetella pertussis
accuugcuggaccgcgccu

SEQ ID NO: 2410178 - RNA, 18 nt, Bordetella pertussis
accuuggcgcccagcuug

SEQ ID NO: 2410179 - RNA, 15 nt, Bordetella pertussis
accuugggcgccugc

SEQ ID NO: 2410180 - RNA, 20 nt, Bordetella pertussis
accuuguugcgguggugcgc

SEQ ID NO: 2410181 - RNA, 20 nt, Bordetella pertussis
accuuguuggcgccggccgc

SEQ ID NO: 2410182 - RNA, 14 nt, Bordetella pertussis
acgaaaaccaggcu

SEQ ID NO: 2410183 - RNA, 14 nt, Bordetella pertussis
acgaaauagccgac

SEQ ID NO: 2410184 - RNA, 18 nt, Bordetella pertussis
acgaaauagccgaccacc

SEQ ID NO: 2410185 - RNA, 14 nt, Bordetella pertussis
acgaaaugccggcg

SEQ ID NO: 2410186 - RNA, 16 nt, Bordetella pertussis
acgaacacgcgcgccg

SEQ ID NO: 2410187 - RNA, 22 nt, Bordetella pertussis
acgaaccacaggguggcgccca

SEQ ID NO: 2410188 - RNA, 23 nt, Bordetella pertussis
acgaacccgcccgaaccggcauc

SEQ ID NO: 2410189 - RNA, 21 nt, Bordetella pertussis
acgaacuucggcaucugccag

SEQ ID NO: 2410190 - RNA, 18 nt, Bordetella pertussis
acgaagcaaacaggcugc

SEQ ID NO: 2410191 - RNA, 16 nt, Bordetella pertussis
acgaaggcgaucugcg

SEQ ID NO: 2410192 - RNA, 13 nt, Bordetella pertussis
acgaaggcgccgg

SEQ ID NO: 2410193 - RNA, 16 nt, Bordetella pertussis
acgaaggcgccggcca

SEQ ID NO: 2410194 - RNA, 18 nt, Bordetella pertussis
acgaagggauagcgccgu

SEQ ID NO: 2410195 - RNA, 16 nt, Bordetella pertussis
acgaagggcagcagca

SEQ ID NO: 2410196 - RNA, 21 nt, Bordetella pertussis
acgaagguguugaccacgccc

SEQ ID NO: 2410197 - RNA, 20 nt, Bordetella pertussis
acgaagguuucguagccgcc

SEQ ID NO: 2410198 - RNA, 23 nt, Bordetella pertussis
acgaaguacucgccggcgcugcg

SEQ ID NO: 2410199 - RNA, 15 nt, Bordetella pertussis
acgaauaaucgccgg

SEQ ID NO: 2410200 - RNA, 13 nt, Bordetella pertussis
acgaauacgcugg

SEQ ID NO: 2410201 - RNA, 22 nt, Bordetella pertussis
acgacacccggucggcccaggu

SEQ ID NO: 2410202 - RNA, 23 nt, Bordetella pertussis
acgacacccggucggcccagguc

SEQ ID NO: 2410203 - RNA, 18 nt, Bordetella pertussis
acgacacgcccagcaggc

SEQ ID NO: 2410204 - RNA, 14 nt, Bordetella pertussis
acgacacgccgcgc

SEQ ID NO: 2410205 - RNA, 19 nt, Bordetella pertussis
acgacacgucaucguggcc

SEQ ID NO: 2410206 - RNA, 17 nt, Bordetella pertussis
acgacagcggcgagcgc

SEQ ID NO: 2410207 - RNA, 23 nt, Bordetella pertussis
acgacaggguccagguggcccgc

SEQ ID NO: 2410208 - RNA, 18 nt, Bordetella pertussis
acgaccaccagcgcacug

SEQ ID NO: 2410209 - RNA, 14 nt, Bordetella pertussis
acgaccagcaggcc

SEQ ID NO: 2410210 - RNA, 17 nt, Bordetella pertussis
acgaccagcaggcccac

SEQ ID NO: 2410211 - RNA, 17 nt, Bordetella pertussis
acgaccccgccgugccg

SEQ ID NO: 2410212 - RNA, 13 nt, Bordetella pertussis
acgacccgcugaa

SEQ ID NO: 2410213 - RNA, 19 nt, Bordetella pertussis
acgacccgcugaaggaccu

SEQ ID NO: 2410214 - RNA, 19 nt, Bordetella pertussis
acgaccgagccggccagcg

SEQ ID NO: 2410215 - RNA, 12 nt, Bordetella pertussis
acgaccggcucg

SEQ ID NO: 2410216 - RNA, 19 nt, Bordetella pertussis
acgaccugaauccguaagc

SEQ ID NO: 2410217 - RNA, 20 nt, Bordetella pertussis
acgaccugcaaccccaccgg

SEQ ID NO: 2410218 - RNA, 18 nt, Bordetella pertussis
acgccaagcugcuggccg

SEQ ID NO: 2410219 - RNA, 14 nt, Bordetella pertussis
acgccaccaggccg

SEQ ID NO: 2410220 - RNA, 16 nt, Bordetella pertussis
acgccaccagugcgcc

SEQ ID NO: 2410221 - RNA, 20 nt, Bordetella pertussis
acgccaccagugcgccggcg

SEQ ID NO: 2410222 - RNA, 21 nt, Bordetella pertussis
acgccacuacacucugcccga

SEQ ID NO: 2410223 - RNA, 14 nt, Bordetella pertussis
acgccacuuccuug

SEQ ID NO: 2410224 - RNA, 15 nt, Bordetella pertussis
acgccacuugcaggc

SEQ ID NO: 2410225 - RNA, 22 nt, Bordetella pertussis
acgccagcccgacggccagcgc

SEQ ID NO: 2410226 - RNA, 13 nt, Bordetella pertussis
acgccagcccgcc

SEQ ID NO: 2410227 - RNA, 20 nt, Bordetella pertussis
acgccagcccgccggcgcgc

SEQ ID NO: 2410228 - RNA, 12 nt, Bordetella pertussis
acgccagcgcgc

SEQ ID NO: 2410229 - RNA, 20 nt, Bordetella pertussis
acgccagggucugcuggucg

SEQ ID NO: 2410230 - RNA, 22 nt, Bordetella pertussis
acgccaucgacgcuugccggcg

SEQ ID NO: 2410231 - RNA, 19 nt, Bordetella pertussis
acgccaucuugcaggcgcc

SEQ ID NO: 2410232 - RNA, 20 nt, Bordetella pertussis
acgccaucuugcaggcgcca

SEQ ID NO: 2410233 - RNA, 22 nt, Bordetella pertussis
acgccaucuugcaggcgccagu

SEQ ID NO: 2410234 - RNA, 17 nt, Bordetella pertussis
acgccauggacgccgaa

SEQ ID NO: 2410235 - RNA, 18 nt, Bordetella pertussis
acgccauggcggcggcca

SEQ ID NO: 2410236 - RNA, 20 nt, Bordetella pertussis
acgccauggucucguccacc

SEQ ID NO: 2410237 - RNA, 12 nt, Bordetella pertussis
acgcccacgcuc

SEQ ID NO: 2410238 - RNA, 20 nt, Bordetella pertussis
acgcccacuuccucggcgcg

SEQ ID NO: 2410239 - RNA, 12 nt, Bordetella pertussis
acgcccagcagg

SEQ ID NO: 2410240 - RNA, 14 nt, Bordetella pertussis
acgcccagcaggcu

SEQ ID NO: 2410241 - RNA, 19 nt, Bordetella pertussis
acgcccagccgcagcaggc

SEQ ID NO: 2410242 - RNA, 14 nt, Bordetella pertussis
acgcccagccugcc

SEQ ID NO: 2410243 - RNA, 17 nt, Bordetella pertussis
acgcccagccugccggc

SEQ ID NO: 2410244 - RNA, 22 nt, Bordetella pertussis
acgcccagccugccggcggccu

SEQ ID NO: 2410245 - RNA, 17 nt, Bordetella pertussis
acgcccagcgccggcac

SEQ ID NO: 2410246 - RNA, 18 nt, Bordetella pertussis
acgcccagcgccggcacg

SEQ ID NO: 2410247 - RNA, 13 nt, Bordetella pertussis
acgcccagcuggg

SEQ ID NO: 2410248 - RNA, 13 nt, Bordetella pertussis
acgcccaggccca

SEQ ID NO: 2410249 - RNA, 17 nt, Bordetella pertussis
acgcccaggcccaccgc

SEQ ID NO: 2410250 - RNA, 14 nt, Bordetella pertussis
acgcccagguccga

SEQ ID NO: 2410251 - RNA, 23 nt, Bordetella pertussis
acgcccagguccgaaccgaccgc

SEQ ID NO: 2410252 - RNA, 17 nt, Bordetella pertussis
acgcccagguugcggcc

SEQ ID NO: 2410253 - RNA, 18 nt, Bordetella pertussis
acgcccagguugcggccg

SEQ ID NO: 2410254 - RNA, 12 nt, Bordetella pertussis
acgcccaguccc

SEQ ID NO: 2410255 - RNA, 23 nt, Bordetella pertussis
acgcccaucugguugagcagcac

SEQ ID NO: 2410256 - RNA, 20 nt, Bordetella pertussis
acgcccaugauggugccggu

SEQ ID NO: 2410257 - RNA, 13 nt, Bordetella pertussis
acgcccaugcgau

SEQ ID NO: 2410258 - RNA, 20 nt, Bordetella pertussis
acgcccauguagaacgccag

SEQ ID NO: 2410259 - RNA, 19 nt, Bordetella pertussis
acgcccgacgguaucucag

SEQ ID NO: 2410260 - RNA, 15 nt, Bordetella pertussis
acgcccgagauggcg

SEQ ID NO: 2410261 - RNA, 16 nt, Bordetella pertussis
acgcccgccagcagcu

SEQ ID NO: 2410262 - RNA, 14 nt, Bordetella pertussis
acgcccgcccgcug

SEQ ID NO: 2410263 - RNA, 15 nt, Bordetella pertussis
acgcccgccugcagc

SEQ ID NO: 2410264 - RNA, 19 nt, Bordetella pertussis
acgcccgccugcagcagcg

SEQ ID NO: 2410265 - RNA, 13 nt, Bordetella pertussis
acgcccgcgccca

SEQ ID NO: 2410266 - RNA, 14 nt, Bordetella pertussis
acgcccgcgccgca

SEQ ID NO: 2410267 - RNA, 17 nt, Bordetella pertussis
acgcccgcggcgcccag

SEQ ID NO: 2410268 - RNA, 13 nt, Bordetella pertussis
acgcccggcccag

SEQ ID NO: 2410269 - RNA, 13 nt, Bordetella pertussis
acgcccggccgcc

SEQ ID NO: 2410270 - RNA, 23 nt, Bordetella pertussis
acgcccggccgccucaccgcgcc

SEQ ID NO: 2410271 - RNA, 13 nt, Bordetella pertussis
acgcccggcgcgg

SEQ ID NO: 2410272 - RNA, 17 nt, Bordetella pertussis
acgcccgucucgcgcgc

SEQ ID NO: 2410273 - RNA, 18 nt, Bordetella pertussis
acgcccgucucgcgcgcc

SEQ ID NO: 2410274 - RNA, 20 nt, Bordetella pertussis
acgcccgucucgcgcgccag

SEQ ID NO: 2410275 - RNA, 21 nt, Bordetella pertussis
acgcccgucucgcgcgccagg

SEQ ID NO: 2410276 - RNA, 23 nt, Bordetella pertussis
acgcccgucucgcgcgccaggug

SEQ ID NO: 2410277 - RNA, 21 nt, Bordetella pertussis
acgcccuggcagcuggcgcgg

SEQ ID NO: 2410278 - RNA, 23 nt, Bordetella pertussis
acgcccuggccguacauggccag

SEQ ID NO: 2410279 - RNA, 12 nt, Bordetella pertussis
acgcccuggccu

SEQ ID NO: 2410280 - RNA, 21 nt, Bordetella pertussis
acgcccuggccuucgaccugc

SEQ ID NO: 2410281 - RNA, 13 nt, Bordetella pertussis
acgcccuggcgca

SEQ ID NO: 2410282 - RNA, 21 nt, Bordetella pertussis
acgcccuggcgcaggccggcg

SEQ ID NO: 2410283 - RNA, 22 nt, Bordetella pertussis
acgcccuggcgcaggccggcgg

SEQ ID NO: 2410284 - RNA, 16 nt, Bordetella pertussis
acgcccuggcuggcgg

SEQ ID NO: 2410285 - RNA, 18 nt, Bordetella pertussis
acgcccuggcuggcggcc

SEQ ID NO: 2410286 - RNA, 21 nt, Bordetella pertussis
acgcccuggcuggcggcccau

SEQ ID NO: 2410287 - RNA, 19 nt, Bordetella pertussis
acgccgaacugcuugcgcg

SEQ ID NO: 2410288 - RNA, 22 nt, Bordetella pertussis
acgccgaacugcuugcgcgugc

SEQ ID NO: 2410289 - RNA, 12 nt, Bordetella pertussis
acgccgaagugg

SEQ ID NO: 2410290 - RNA, 19 nt, Bordetella pertussis
acgccgaauugcuggagcg

SEQ ID NO: 2410291 - RNA, 19 nt, Bordetella pertussis
acgccgaccucggcaccga

SEQ ID NO: 2410292 - RNA, 16 nt, Bordetella pertussis
acgccgaccuggcgcc

SEQ ID NO: 2410293 - RNA, 20 nt, Bordetella pertussis
acgccgaccuggcgcccgac

SEQ ID NO: 2410294 - RNA, 17 nt, Bordetella pertussis
acgccgacgaugccggu

SEQ ID NO: 2410295 - RNA, 20 nt, Bordetella pertussis
acgccgacugggugcgccug

SEQ ID NO: 2410296 - RNA, 15 nt, Bordetella pertussis
acgccgaugaccagg

SEQ ID NO: 2410297 - RNA, 21 nt, Bordetella pertussis
acgccgauguccacgaaggcg

SEQ ID NO: 2410298 - RNA, 17 nt, Bordetella pertussis
acgccgccacgcuggcc

SEQ ID NO: 2410299 - RNA, 18 nt, Bordetella pertussis
acgccgccacgcuggccg

SEQ ID NO: 2410300 - RNA, 19 nt, Bordetella pertussis
acgccgccacgcuggccgc

SEQ ID NO: 2410301 - RNA, 22 nt, Bordetella pertussis
acgccgccacgcuggccgcgcu

SEQ ID NO: 2410302 - RNA, 16 nt, Bordetella pertussis
acgccgccauggugcc

SEQ ID NO: 2410303 - RNA, 13 nt, Bordetella pertussis
acgccgcccagcg

SEQ ID NO: 2410304 - RNA, 17 nt, Bordetella pertussis
acgccgcccagcgcgug

SEQ ID NO: 2410305 - RNA, 23 nt, Bordetella pertussis
acgccgcccguccgggcggcguu

SEQ ID NO: 2410306 - RNA, 16 nt, Bordetella pertussis
acgccgccgaagggca

SEQ ID NO: 2410307 - RNA, 23 nt, Bordetella pertussis
acgccgccgaccucgucgggcug

SEQ ID NO: 2410308 - RNA, 14 nt, Bordetella pertussis
acgccgccgauggc

SEQ ID NO: 2410309 - RNA, 18 nt, Bordetella pertussis
acgccgccgauggcgcca

SEQ ID NO: 2410310 - RNA, 15 nt, Bordetella pertussis
acgccgccgccguau

SEQ ID NO: 2410311 - RNA, 17 nt, Bordetella pertussis
acgccgccggcagggcc

SEQ ID NO: 2410312 - RNA, 19 nt, Bordetella pertussis
acgccgccggcagggccag

SEQ ID NO: 2410313 - RNA, 22 nt, Bordetella pertussis
acgccgccggcagggccagcgc

SEQ ID NO: 2410314 - RNA, 13 nt, Bordetella pertussis
acgccgccggcca

SEQ ID NO: 2410315 - RNA, 14 nt, Bordetella pertussis
acgccgccggccag

SEQ ID NO: 2410316 - RNA, 15 nt, Bordetella pertussis
acgccgccggcgcac

SEQ ID NO: 2410317 - RNA, 20 nt, Bordetella pertussis
acgccgccggcgcacccggu

SEQ ID NO: 2410318 - RNA, 15 nt, Bordetella pertussis
acgccgccuggcccg

SEQ ID NO: 2410319 - RNA, 16 nt, Bordetella pertussis
acgccgccuggcccga

SEQ ID NO: 2410320 - RNA, 20 nt, Bordetella pertussis
acgccgcgacacaaggcggc

SEQ ID NO: 2410321 - RNA, 10 nt, Bordetella pertussis
acgccgcgcc

SEQ ID NO: 2410322 - RNA, 13 nt, Bordetella pertussis
acgccgcgccagg

SEQ ID NO: 2410323 - RNA, 15 nt, Bordetella pertussis
acgccgcgcccgccc

SEQ ID NO: 2410324 - RNA, 16 nt, Bordetella pertussis
acgccgcgcgaucgcc

SEQ ID NO: 2410325 - RNA, 18 nt, Bordetella pertussis
acgccgcggugcugggcu

SEQ ID NO: 2410326 - RNA, 14 nt, Bordetella pertussis
acgccgcguccgcc

SEQ ID NO: 2410327 - RNA, 18 nt, Bordetella pertussis
acgccgcguccgcccgcu

SEQ ID NO: 2410328 - RNA, 21 nt, Bordetella pertussis
acgccgcgucgcuggccggac

SEQ ID NO: 2410329 - RNA, 17 nt, Bordetella pertussis
acgccgcugauggcggu

SEQ ID NO: 2410330 - RNA, 18 nt, Bordetella pertussis
acgccgcugauggcgguc

SEQ ID NO: 2410331 - RNA, 18 nt, Bordetella pertussis
acgcgcccucaguccagc

SEQ ID NO: 2410332 - RNA, 16 nt, Bordetella pertussis
acgcgccgaacaccag

SEQ ID NO: 2410333 - RNA, 13 nt, Bordetella pertussis
acgcgccgccagg

SEQ ID NO: 2410334 - RNA, 15 nt, Bordetella pertussis
acgcgccgccaggcg

SEQ ID NO: 2410335 - RNA, 16 nt, Bordetella pertussis
acgcgccgccaggcgc

SEQ ID NO: 2410336 - RNA, 17 nt, Bordetella pertussis
acgcgccgccaggcgcg

SEQ ID NO: 2410337 - RNA, 19 nt, Bordetella pertussis
acgcgccgccaggcgcgau

SEQ ID NO: 2410338 - RNA, 13 nt, Bordetella pertussis
acgcgccggaugc

SEQ ID NO: 2410339 - RNA, 23 nt, Bordetella pertussis
acgcgccggaugcgcguggcgcg

SEQ ID NO: 2410340 - RNA, 13 nt, Bordetella pertussis
acgcgccggccca

SEQ ID NO: 2410341 - RNA, 15 nt, Bordetella pertussis
acgcgccggcccagg

SEQ ID NO: 2410342 - RNA, 19 nt, Bordetella pertussis
acgcgccggcccaggcgcg

SEQ ID NO: 2410343 - RNA, 21 nt, Bordetella pertussis
acgcgccggcccaggcgcgcu

SEQ ID NO: 2410344 - RNA, 14 nt, Bordetella pertussis
acgcgccgggccac

SEQ ID NO: 2410345 - RNA, 20 nt, Bordetella pertussis
acgcgcgacgccgugguggu

SEQ ID NO: 2410346 - RNA, 18 nt, Bordetella pertussis
acgcgcgauccgcgccag

SEQ ID NO: 2410347 - RNA, 12 nt, Bordetella pertussis
acgcgcgccagc

SEQ ID NO: 2410348 - RNA, 15 nt, Bordetella pertussis
acgcgcgcgcccugc

SEQ ID NO: 2410349 - RNA, 12 nt, Bordetella pertussis
acgcgcgcgccg

SEQ ID NO: 2410350 - RNA, 23 nt, Bordetella pertussis
acgcgcgcgccgccggccagccu

SEQ ID NO: 2410351 - RNA, 13 nt, Bordetella pertussis
acgcgcgcgccgg

SEQ ID NO: 2410352 - RNA, 15 nt, Bordetella pertussis
acgcgcgcgccggca

SEQ ID NO: 2410353 - RNA, 17 nt, Bordetella pertussis
acgcgcgcgcgcacagg

SEQ ID NO: 2410354 - RNA, 13 nt, Bordetella pertussis
acgcgcgcggcgc

SEQ ID NO: 2410355 - RNA, 19 nt, Bordetella pertussis
acgcgcgcggcgcggcugg

SEQ ID NO: 2410356 - RNA, 17 nt, Bordetella pertussis
acgcgcgcgggcgcgcc

SEQ ID NO: 2410357 - RNA, 17 nt, Bordetella pertussis
acgcgcggaucggccac

SEQ ID NO: 2410358 - RNA, 21 nt, Bordetella pertussis
acgcgcggaucggccacgaug

SEQ ID NO: 2410359 - RNA, 13 nt, Bordetella pertussis
acgcgcggcagcg

SEQ ID NO: 2410360 - RNA, 23 nt, Bordetella pertussis
acgcgcggccuauuuggcggccu

SEQ ID NO: 2410361 - RNA, 13 nt, Bordetella pertussis
acgcgcgggcugg

SEQ ID NO: 2410362 - RNA, 15 nt, Bordetella pertussis
acgcgcuccggcugc

SEQ ID NO: 2410363 - RNA, 17 nt, Bordetella pertussis
acgcgcuccggcugcgc

SEQ ID NO: 2410364 - RNA, 18 nt, Bordetella pertussis
acgcgcuccggcugcgcg

SEQ ID NO: 2410365 - RNA, 20 nt, Bordetella pertussis
acgcgcuccggcugcgcgcg

SEQ ID NO: 2410366 - RNA, 22 nt, Bordetella pertussis
acgcgcuccugcucggcgaugc

SEQ ID NO: 2410367 - RNA, 14 nt, Bordetella pertussis
acgcgcucgccguc

SEQ ID NO: 2410368 - RNA, 16 nt, Bordetella pertussis
acgcgcucgccgucga

SEQ ID NO: 2410369 - RNA, 15 nt, Bordetella pertussis
acgcgcucgcgcgcg

SEQ ID NO: 2410370 - RNA, 18 nt, Bordetella pertussis
acgcgcucgcgcgcgugc

SEQ ID NO: 2410371 - RNA, 17 nt, Bordetella pertussis
acgcgcucgggcagcuc

SEQ ID NO: 2410372 - RNA, 14 nt, Bordetella pertussis
acgcgcugcgcgcc

SEQ ID NO: 2410373 - RNA, 15 nt, Bordetella pertussis
acgcgcugcgcgccg

SEQ ID NO: 2410374 - RNA, 13 nt, Bordetella pertussis
acgcgcuggccga

SEQ ID NO: 2410375 - RNA, 14 nt, Bordetella pertussis
acgcgcuggccgac

SEQ ID NO: 2410376 - RNA, 15 nt, Bordetella pertussis
acgcgcuggcgcagg

SEQ ID NO: 2410377 - RNA, 15 nt, Bordetella pertussis
acgcgcugggcgugg

SEQ ID NO: 2410378 - RNA, 19 nt, Bordetella pertussis
acgcgcugggcguggcgcg

SEQ ID NO: 2410379 - RNA, 20 nt, Bordetella pertussis
acgcgcugggcguggcgcgc

SEQ ID NO: 2410380 - RNA, 16 nt, Bordetella pertussis
acgcgcuguaggcgcc

SEQ ID NO: 2410381 - RNA, 20 nt, Bordetella pertussis
acgcgcuguaggcgccggcg

SEQ ID NO: 2410382 - RNA, 16 nt, Bordetella pertussis
acgcgcuguugcuggc

SEQ ID NO: 2410383 - RNA, 17 nt, Bordetella pertussis
acgcgcuguugcuggcc

SEQ ID NO: 2410384 - RNA, 19 nt, Bordetella pertussis
acgcgcuguugcuggccac

SEQ ID NO: 2410385 - RNA, 20 nt, Bordetella pertussis
acgcgcuguugcuggccacc

SEQ ID NO: 2410386 - RNA, 14 nt, Bordetella pertussis
acgcgcuuccagga

SEQ ID NO: 2410387 - RNA, 15 nt, Bordetella pertussis
acgcgcuuccaggag

SEQ ID NO: 2410388 - RNA, 20 nt, Bordetella pertussis
acgcggaggagguggcuggu

SEQ ID NO: 2410389 - RNA, 13 nt, Bordetella pertussis
acgcggcagggcc

SEQ ID NO: 2410390 - RNA, 17 nt, Bordetella pertussis
acgcggccagaccuugc

SEQ ID NO: 2410391 - RNA, 20 nt, Bordetella pertussis
acgcggccagaccuugcgcg

SEQ ID NO: 2410392 - RNA, 15 nt, Bordetella pertussis
acgcggccagcggau

SEQ ID NO: 2410393 - RNA, 17 nt, Bordetella pertussis
acgcggccagcggcgcu

SEQ ID NO: 2410394 - RNA, 15 nt, Bordetella pertussis
acgcggccgcgcagg

SEQ ID NO: 2410395 - RNA, 13 nt, Bordetella pertussis
acgcggccgggca

SEQ ID NO: 2410396 - RNA, 14 nt, Bordetella pertussis
acgcggccguggag

SEQ ID NO: 2410397 - RNA, 21 nt, Bordetella pertussis
acgcggccguggaggcggcgg

SEQ ID NO: 2410398 - RNA, 16 nt, Bordetella pertussis
acgcggccguggcggc

SEQ ID NO: 2410399 - RNA, 19 nt, Bordetella pertussis
acgcggccguggcggccug

SEQ ID NO: 2410400 - RNA, 21 nt, Bordetella pertussis
acgcggccguggcggccugcg

SEQ ID NO: 2410401 - RNA, 14 nt, Bordetella pertussis
acgcggcgcagcau

SEQ ID NO: 2410402 - RNA, 15 nt, Bordetella pertussis
acgcggcgcccgcgc

SEQ ID NO: 2410403 - RNA, 15 nt, Bordetella pertussis
acgcggcgcggcagg

SEQ ID NO: 2410404 - RNA, 17 nt, Bordetella pertussis
acgcggcgcggcagguu

SEQ ID NO: 2410405 - RNA, 20 nt, Bordetella pertussis
acgcggcgcugcuggccggc

SEQ ID NO: 2410406 - RNA, 22 nt, Bordetella pertussis
acgcggcgcugcuggccggcca

SEQ ID NO: 2410407 - RNA, 14 nt, Bordetella pertussis
acgcggcggccggu

SEQ ID NO: 2410408 - RNA, 22 nt, Bordetella pertussis
acgcggcggugcgacugcagga

SEQ ID NO: 2410409 - RNA, 16 nt, Bordetella pertussis
acgcgggccacgcgcc

SEQ ID NO: 2410410 - RNA, 14 nt, Bordetella pertussis
acgcgggccggccg

SEQ ID NO: 2410411 - RNA, 15 nt, Bordetella pertussis
acgcgggccggccgu

SEQ ID NO: 2410412 - RNA, 16 nt, Bordetella pertussis
acgcgggccggccguu

SEQ ID NO: 2410413 - RNA, 15 nt, Bordetella pertussis
acgcgggcggccgac

SEQ ID NO: 2410414 - RNA, 16 nt, Bordetella pertussis
acgcgggcguggucau

SEQ ID NO: 2410415 - RNA, 15 nt, Bordetella pertussis
acgcgggcuugcugc

SEQ ID NO: 2410416 - RNA, 11 nt, Bordetella pertussis
acgcggggaca

SEQ ID NO: 2410417 - RNA, 16 nt, Bordetella pertussis
acgcggggacaggcac

SEQ ID NO: 2410418 - RNA, 18 nt, Bordetella pertussis
acgcggggacaggcacac

SEQ ID NO: 2410419 - RNA, 19 nt, Bordetella pertussis
acgcgguagguagcgcgca

SEQ ID NO: 2410420 - RNA, 14 nt, Bordetella pertussis
acgcgguccacgcc

SEQ ID NO: 2410421 - RNA, 14 nt, Bordetella pertussis
acgcgguccagccc

SEQ ID NO: 2410422 - RNA, 18 nt, Bordetella pertussis
acgcgguccagccccugc

SEQ ID NO: 2410423 - RNA, 21 nt, Bordetella pertussis
acgcgguccagccccugcccg

SEQ ID NO: 2410424 - RNA, 14 nt, Bordetella pertussis
acgcggucgaugcg

SEQ ID NO: 2410425 - RNA, 15 nt, Bordetella pertussis
acgcggucgaugcgc

SEQ ID NO: 2410426 - RNA, 16 nt, Bordetella pertussis
acgcggucgaugcgca

SEQ ID NO: 2410427 - RNA, 22 nt, Bordetella pertussis
acgcggucgcauuggccgccgc

SEQ ID NO: 2410428 - RNA, 21 nt, Bordetella pertussis
acgcggugcaucucggcaucg

SEQ ID NO: 2410429 - RNA, 22 nt, Bordetella pertussis
acgcggugcaucucggcaucgg

SEQ ID NO: 2410430 - RNA, 12 nt, Bordetella pertussis
acgcgguggcgu

SEQ ID NO: 2410431 - RNA, 15 nt, Bordetella pertussis
acgcguccucggcca

SEQ ID NO: 2410432 - RNA, 16 nt, Bordetella pertussis
acgcguccucggccag

SEQ ID NO: 2410433 - RNA, 17 nt, Bordetella pertussis
acgcguccucggccagc

SEQ ID NO: 2410434 - RNA, 23 nt, Bordetella pertussis
acgcgucgcucauggaggggcgc

SEQ ID NO: 2410435 - RNA, 19 nt, Bordetella pertussis
acgcgugaauaccgcgcac

SEQ ID NO: 2410436 - RNA, 15 nt, Bordetella pertussis
acgcgugcaccagcc

SEQ ID NO: 2410437 - RNA, 15 nt, Bordetella pertussis
acgcgugcgcggccg

SEQ ID NO: 2410438 - RNA, 16 nt, Bordetella pertussis
acgcgugcgcggccgc

SEQ ID NO: 2410439 - RNA, 21 nt, Bordetella pertussis
acgcgugcgcggccgcgcgcu

SEQ ID NO: 2410440 - RNA, 20 nt, Bordetella pertussis
acgcgugggcggcggcaugc

SEQ ID NO: 2410441 - RNA, 15 nt, Bordetella pertussis
acgcguucgccgucg

SEQ ID NO: 2410442 - RNA, 18 nt, Bordetella pertussis
acgcguuguucgggccgg

SEQ ID NO: 2410443 - RNA, 19 nt, Bordetella pertussis
acgcuagggcguggcgcga

SEQ ID NO: 2410444 - RNA, 23 nt, Bordetella pertussis
acgcucagcaugcgcugggcggu

SEQ ID NO: 2410445 - RNA, 16 nt, Bordetella pertussis
acggccagcgccagcc

SEQ ID NO: 2410446 - RNA, 14 nt, Bordetella pertussis
acggccagcgcgac

SEQ ID NO: 2410447 - RNA, 14 nt, Bordetella pertussis
acggccagcgcgcg

SEQ ID NO: 2410448 - RNA, 13 nt, Bordetella pertussis
acggccagcggcg

SEQ ID NO: 2410449 - RNA, 14 nt, Bordetella pertussis
acggccaggacggc

SEQ ID NO: 2410450 - RNA, 13 nt, Bordetella pertussis
acggcccacgcug

SEQ ID NO: 2410451 - RNA, 22 nt, Bordetella pertussis
acggcccagcucugguccaggc

SEQ ID NO: 2410452 - RNA, 13 nt, Bordetella pertussis
acggcccauccau

SEQ ID NO: 2410453 - RNA, 15 nt, Bordetella pertussis
acggcccauccaucu

SEQ ID NO: 2410454 - RNA, 13 nt, Bordetella pertussis
acggccccagcgc

SEQ ID NO: 2410455 - RNA, 15 nt, Bordetella pertussis
acggccccagcgccg

SEQ ID NO: 2410456 - RNA, 18 nt, Bordetella pertussis
acggccccagcgccgcga

SEQ ID NO: 2410457 - RNA, 13 nt, Bordetella pertussis
acggcccgccagg

SEQ ID NO: 2410458 - RNA, 23 nt, Bordetella pertussis
acggcccgccaggaagcgggccu

SEQ ID NO: 2410459 - RNA, 13 nt, Bordetella pertussis
acggcccuggucu

SEQ ID NO: 2410460 - RNA, 18 nt, Bordetella pertussis
acggccgcaagcuggccg

SEQ ID NO: 2410461 - RNA, 16 nt, Bordetella pertussis
acggccgcaugcguga

SEQ ID NO: 2410462 - RNA, 11 nt, Bordetella pertussis
acggccgccac

SEQ ID NO: 2410463 - RNA, 13 nt, Bordetella pertussis
acggccgccaccu

SEQ ID NO: 2410464 - RNA, 15 nt, Bordetella pertussis
acggccgccaccugg

SEQ ID NO: 2410465 - RNA, 19 nt, Bordetella pertussis
acggccgccaccugggccg

SEQ ID NO: 2410466 - RNA, 20 nt, Bordetella pertussis
acggccgccaccugggccgc

SEQ ID NO: 2410467 - RNA, 24 nt, Bordetella pertussis
acggccgccaccugggccgccugc

SEQ ID NO: 2410468 - RNA, 15 nt, Bordetella pertussis
acggccgccacgccc

SEQ ID NO: 2410469 - RNA, 17 nt, Bordetella pertussis
acggccgcccggcaugg

SEQ ID NO: 2410470 - RNA, 11 nt, Bordetella pertussis
acggccgccga

SEQ ID NO: 2410471 - RNA, 17 nt, Bordetella pertussis
acggccgcggccggcac

SEQ ID NO: 2410472 - RNA, 17 nt, Bordetella pertussis
acggccggccaggcgcc

SEQ ID NO: 2410473 - RNA, 20 nt, Bordetella pertussis
acggccggccaggcgccgcu

SEQ ID NO: 2410474 - RNA, 21 nt, Bordetella pertussis
acggccggccaggcgccgcuc

SEQ ID NO: 2410475 - RNA, 14 nt, Bordetella pertussis
acggccggccugca

SEQ ID NO: 2410476 - RNA, 13 nt, Bordetella pertussis
acggccggcgcac

SEQ ID NO: 2410477 - RNA, 14 nt, Bordetella pertussis
acggccggcgcacg

SEQ ID NO: 2410478 - RNA, 20 nt, Bordetella pertussis
acggccggcgcgugcuggcg

SEQ ID NO: 2410479 - RNA, 13 nt, Bordetella pertussis
acggccggguccc

SEQ ID NO: 2410480 - RNA, 18 nt, Bordetella pertussis
acggccgggucccuggcc

SEQ ID NO: 2410481 - RNA, 14 nt, Bordetella pertussis
acggccggucagcc

SEQ ID NO: 2410482 - RNA, 14 nt, Bordetella pertussis
acggccucggccag

SEQ ID NO: 2410483 - RNA, 18 nt, Bordetella pertussis
acggccugcgcgccgacc

SEQ ID NO: 2410484 - RNA, 19 nt, Bordetella pertussis
acggccugcgcgccgacca

SEQ ID NO: 2410485 - RNA, 19 nt, Bordetella pertussis
acggccuucauggcgucgu

SEQ ID NO: 2410486 - RNA, 19 nt, Bordetella pertussis
acggcgaggaggugcgccg

SEQ ID NO: 2410487 - RNA, 18 nt, Bordetella pertussis
acggcgaggaugccgcgc

SEQ ID NO: 2410488 - RNA, 17 nt, Bordetella pertussis
acggcgagucugaaagg

SEQ ID NO: 2410489 - RNA, 20 nt, Bordetella pertussis
acggcgaugaacagcggcac

SEQ ID NO: 2410490 - RNA, 21 nt, Bordetella pertussis
acggcgaugaacagcggcacg

SEQ ID NO: 2410491 - RNA, 14 nt, Bordetella pertussis
acggcgaugccggc

SEQ ID NO: 2410492 - RNA, 15 nt, Bordetella pertussis
acggcgaugccggcg

SEQ ID NO: 2410493 - RNA, 16 nt, Bordetella pertussis
acggcgaugccggcgc

SEQ ID NO: 2410494 - RNA, 18 nt, Bordetella pertussis
acggcgaugccggcgcug

SEQ ID NO: 2410495 - RNA, 18 nt, Bordetella pertussis
acggcgaugcugccgucg

SEQ ID NO: 2410496 - RNA, 19 nt, Bordetella pertussis
acggcgcacaccaucagcu

SEQ ID NO: 2410497 - RNA, 17 nt, Bordetella pertussis
acggcgcacccgcggcg

SEQ ID NO: 2410498 - RNA, 15 nt, Bordetella pertussis
acggcgccaaagcac

SEQ ID NO: 2410499 - RNA, 18 nt, Bordetella pertussis
acggcgcccugcagggca

SEQ ID NO: 2410500 - RNA, 21 nt, Bordetella pertussis
acggcgcccugcagggcaugg

SEQ ID NO: 2410501 - RNA, 16 nt, Bordetella pertussis
acggcgcccugcgcgu

SEQ ID NO: 2410502 - RNA, 15 nt, Bordetella pertussis
acggcgccgauccgg

SEQ ID NO: 2410503 - RNA, 17 nt, Bordetella pertussis
acggcgccgugcuggag

SEQ ID NO: 2410504 - RNA, 14 nt, Bordetella pertussis
acggcgccuggcgc

SEQ ID NO: 2410505 - RNA, 15 nt, Bordetella pertussis
acggcgccuugacgc

SEQ ID NO: 2410506 - RNA, 21 nt, Bordetella pertussis
acggcgccuugacgcugcucu

SEQ ID NO: 2410507 - RNA, 14 nt, Bordetella pertussis
acggcgcgaaggug

SEQ ID NO: 2410508 - RNA, 16 nt, Bordetella pertussis
acggcgcgaaggugcg

SEQ ID NO: 2410509 - RNA, 12 nt, Bordetella pertussis
acggcgcgcccg

SEQ ID NO: 2410510 - RNA, 22 nt, Bordetella pertussis
acggcgcgcccgcaggcggcgg

SEQ ID NO: 2410511 - RNA, 17 nt, Bordetella pertussis
acggcgcgcccgccgcg

SEQ ID NO: 2410512 - RNA, 21 nt, Bordetella pertussis
acggcgcgcccgccgcgucgg

SEQ ID NO: 2410513 - RNA, 12 nt, Bordetella pertussis
acggcgcgcgcc

SEQ ID NO: 2410514 - RNA, 16 nt, Bordetella pertussis
acggcgcgcgccugcu

SEQ ID NO: 2410515 - RNA, 17 nt, Bordetella pertussis
acggcgcgcgccugcuc

SEQ ID NO: 2410516 - RNA, 16 nt, Bordetella pertussis
acggcgcgcgcguuga

SEQ ID NO: 2410517 - RNA, 16 nt, Bordetella pertussis
acggcgcggaucgugc

SEQ ID NO: 2410518 - RNA, 16 nt, Bordetella pertussis
acggcgcggcgaucgg

SEQ ID NO: 2410519 - RNA, 20 nt, Bordetella pertussis
acggcgcgggcacucggcca

SEQ ID NO: 2410520 - RNA, 18 nt, Bordetella pertussis
acggcgcgggcggucggc

SEQ ID NO: 2410521 - RNA, 18 nt, Bordetella pertussis
acggcgcggugccugugc

SEQ ID NO: 2410522 - RNA, 17 nt, Bordetella pertussis
acggcgcucggccucga

SEQ ID NO: 2410523 - RNA, 11 nt, Bordetella pertussis
acggcgcucuu

SEQ ID NO: 2410524 - RNA, 21 nt, Bordetella pertussis
acggcgcucuugguggugccu

SEQ ID NO: 2410525 - RNA, 21 nt, Bordetella pertussis
acggcgcuggggaagcgcucg

SEQ ID NO: 2410526 - RNA, 19 nt, Bordetella pertussis
acggcggaaugcggcgaca

SEQ ID NO: 2410527 - RNA, 21 nt, Bordetella pertussis
acggcggaaugcggcgacagg

SEQ ID NO: 2410528 - RNA, 15 nt, Bordetella pertussis
acggcggacuggccg

SEQ ID NO: 2410529 - RNA, 18 nt, Bordetella pertussis
acggcggacuggccgcgc

SEQ ID NO: 2410530 - RNA, 19 nt, Bordetella pertussis
acggcggacuggccgcgcc

SEQ ID NO: 2410531 - RNA, 17 nt, Bordetella pertussis
acggcggaucuucccgc

SEQ ID NO: 2410532 - RNA, 13 nt, Bordetella pertussis
acggcggcaggcc

SEQ ID NO: 2410533 - RNA, 20 nt, Bordetella pertussis
acggcggcaggccgcgccac

SEQ ID NO: 2410534 - RNA, 22 nt, Bordetella pertussis
acggcggcaggccgcgccacag

SEQ ID NO: 2410535 - RNA, 13 nt, Bordetella pertussis
acggcggccaggc

SEQ ID NO: 2410536 - RNA, 14 nt, Bordetella pertussis
acggcggccaggcc

SEQ ID NO: 2410537 - RNA, 20 nt, Bordetella pertussis
acggcggcgaucacgccguc

SEQ ID NO: 2410538 - RNA, 21 nt, Bordetella pertussis
acggcggcgaucacgccgucg

SEQ ID NO: 2410539 - RNA, 13 nt, Bordetella pertussis
acggcggcgcggc

SEQ ID NO: 2410540 - RNA, 18 nt, Bordetella pertussis
acggcggcgcggcgccag

SEQ ID NO: 2410541 - RNA, 15 nt, Bordetella pertussis
acggcggcggccauc

SEQ ID NO: 2410542 - RNA, 16 nt, Bordetella pertussis
acggcggcuucggccg

SEQ ID NO: 2410543 - RNA, 14 nt, Bordetella pertussis
acggcgggaccggc

SEQ ID NO: 2410544 - RNA, 15 nt, Bordetella pertussis
acggcgggaucgggc

SEQ ID NO: 2410545 - RNA, 18 nt, Bordetella pertussis
acggcgggaucgggcagc

SEQ ID NO: 2410546 - RNA, 17 nt, Bordetella pertussis
acggcgggccggcucgg

SEQ ID NO: 2410547 - RNA, 23 nt, Bordetella pertussis
acggcgggcgccccgaucggcgc

SEQ ID NO: 2410548 - RNA, 13 nt, Bordetella pertussis
acggcgggcgcgc

SEQ ID NO: 2410549 - RNA, 18 nt, Bordetella pertussis
acggcgggcgcgcaggcc

SEQ ID NO: 2410550 - RNA, 17 nt, Bordetella pertussis
acggcggugaccaccag

SEQ ID NO: 2410551 - RNA, 20 nt, Bordetella pertussis
acggcggugaucugcucgcc

SEQ ID NO: 2410552 - RNA, 13 nt, Bordetella pertussis
acggcggugccgc

SEQ ID NO: 2410553 - RNA, 19 nt, Bordetella pertussis
acggcggugccgcgcaccc

SEQ ID NO: 2410554 - RNA, 15 nt, Bordetella pertussis
acggcggugcugaac

SEQ ID NO: 2410555 - RNA, 20 nt, Bordetella pertussis
acggcguagccgaucuggcc

SEQ ID NO: 2410556 - RNA, 17 nt, Bordetella pertussis
acggcgucgaugcgcgc

SEQ ID NO: 2410557 - RNA, 18 nt, Bordetella pertussis
acggcgucgaugcgcgcg

SEQ ID NO: 2410558 - RNA, 13 nt, Bordetella pertussis
acggcgucggccu

SEQ ID NO: 2410559 - RNA, 21 nt, Bordetella pertussis
acgguggugucggcggccagc

SEQ ID NO: 2410560 - RNA, 18 nt, Bordetella pertussis
acgguucagcgcgccagc

SEQ ID NO: 2410561 - RNA, 18 nt, Bordetella pertussis
acgguucuggaucgcgcc

SEQ ID NO: 2410562 - RNA, 21 nt, Bordetella pertussis
acguaaucgagcuggcccacg

SEQ ID NO: 2410563 - RNA, 15 nt, Bordetella pertussis
acguacaaccgcgcc

SEQ ID NO: 2410564 - RNA, 19 nt, Bordetella pertussis
acguagaaauacgcgcgcg

SEQ ID NO: 2410565 - RNA, 16 nt, Bordetella pertussis
acguagccggccaggu

SEQ ID NO: 2410566 - RNA, 13 nt, Bordetella pertussis
acguagcgcagca

SEQ ID NO: 2410567 - RNA, 14 nt, Bordetella pertussis
acguagcgcagcac

SEQ ID NO: 2410568 - RNA, 23 nt, Bordetella pertussis
acguaggccauugaaagcgcgag

SEQ ID NO: 2410569 - RNA, 17 nt, Bordetella pertussis
acguagggcacaucggc

SEQ ID NO: 2410570 - RNA, 16 nt, Bordetella pertussis
acguagguggucagca

SEQ ID NO: 2410571 - RNA, 16 nt, Bordetella pertussis
acguagucggcgccca

SEQ ID NO: 2410572 - RNA, 18 nt, Bordetella pertussis
acgucaaggccugcccgg

SEQ ID NO: 2410573 - RNA, 19 nt, Bordetella pertussis
acgucaaggccugcccggg

SEQ ID NO: 2410574 - RNA, 23 nt, Bordetella pertussis
acgucaaggccugcccgggcacc

SEQ ID NO: 2410575 - RNA, 17 nt, Bordetella pertussis
acgucacggaucagccg

SEQ ID NO: 2410576 - RNA, 19 nt, Bordetella pertussis
acgucacggaucagccgcu

SEQ ID NO: 2410577 - RNA, 16 nt, Bordetella pertussis
acgucauccugggcgc

SEQ ID NO: 2410578 - RNA, 21 nt, Bordetella pertussis
acgucauccugggcgcgcgcc

SEQ ID NO: 2410579 - RNA, 22 nt, Bordetella pertussis
acgucauugcaucgcagcagaa

SEQ ID NO: 2410580 - RNA, 11 nt, Bordetella pertussis
acguccagcac

SEQ ID NO: 2410581 - RNA, 19 nt, Bordetella pertussis
acguccgccccauccacgg

SEQ ID NO: 2410582 - RNA, 17 nt, Bordetella pertussis
acguccggcgggccgcu

SEQ ID NO: 2410583 - RNA, 18 nt, Bordetella pertussis
acguccggcgggccgcug

SEQ ID NO: 2410584 - RNA, 18 nt, Bordetella pertussis
acguccuggggcgcgguc

SEQ ID NO: 2410585 - RNA, 14 nt, Bordetella pertussis
acgucgaacagcuu

SEQ ID NO: 2410586 - RNA, 18 nt, Bordetella pertussis
acgucgaccucgagcacc

SEQ ID NO: 2410587 - RNA, 22 nt, Bordetella pertussis
acgucgacguugcgcgacaggc

SEQ ID NO: 2410588 - RNA, 22 nt, Bordetella pertussis
acgucgcccuggauggcggccg

SEQ ID NO: 2410589 - RNA, 12 nt, Bordetella pertussis
acgucgccggcg

SEQ ID NO: 2410590 - RNA, 17 nt, Bordetella pertussis
acgucgccggcguucuu

SEQ ID NO: 2410591 - RNA, 21 nt, Bordetella pertussis
acgucgccggcguucuucagc

SEQ ID NO: 2410592 - RNA, 16 nt, Bordetella pertussis
acgucgcgaccgccgc

SEQ ID NO: 2410593 - RNA, 22 nt, Bordetella pertussis
acgucgcgcaauacgccgccgg

SEQ ID NO: 2410594 - RNA, 17 nt, Bordetella pertussis
acgucgcggcugggcaa

SEQ ID NO: 2410595 - RNA, 17 nt, Bordetella pertussis
acgucgcucggccuccc

SEQ ID NO: 2410596 - RNA, 13 nt, Bordetella pertussis
acgucggacaggg

SEQ ID NO: 2410597 - RNA, 16 nt, Bordetella pertussis
acgucggcggccgccu

SEQ ID NO: 2410598 - RNA, 23 nt, Bordetella pertussis
acgucggcggccgccuugacggu

SEQ ID NO: 2410599 - RNA, 14 nt, Bordetella pertussis
acgucggugacggc

SEQ ID NO: 2410600 - RNA, 16 nt, Bordetella pertussis
acgucguagcgcugca

SEQ ID NO: 2410601 - RNA, 13 nt, Bordetella pertussis
acgucgucgauga

SEQ ID NO: 2410602 - RNA, 15 nt, Bordetella pertussis
acgucugagcgccgg

SEQ ID NO: 2410603 - RNA, 13 nt, Bordetella pertussis
acgucuugcugcc

SEQ ID NO: 2410604 - RNA, 16 nt, Bordetella pertussis
acgugaagcgccgcgc

SEQ ID NO: 2410605 - RNA, 14 nt, Bordetella pertussis
acgugacgccggcg

SEQ ID NO: 2410606 - RNA, 19 nt, Bordetella pertussis
acgugccggauggcgcgga

SEQ ID NO: 2410607 - RNA, 17 nt, Bordetella pertussis
acgugcgcacgcguucg

SEQ ID NO: 2410608 - RNA, 21 nt, Bordetella pertussis
acgugcgccaggcaaaggccc

SEQ ID NO: 2410609 - RNA, 13 nt, Bordetella pertussis
acgugcgcgccag

SEQ ID NO: 2410610 - RNA, 16 nt, Bordetella pertussis
acgugcgcgccagcuc

SEQ ID NO: 2410611 - RNA, 23 nt, Bordetella pertussis
acgugcugacgguaagcaccagg

SEQ ID NO: 2410612 - RNA, 16 nt, Bordetella pertussis
acguggacaggcaccu

SEQ ID NO: 2410613 - RNA, 22 nt, Bordetella pertussis
acguggaccgcgcgguggccgc

SEQ ID NO: 2410614 - RNA, 17 nt, Bordetella pertussis
acguggacucgauggcg

SEQ ID NO: 2410615 - RNA, 21 nt, Bordetella pertussis
acguggaugaugcgcgagccg

SEQ ID NO: 2410616 - RNA, 23 nt, Bordetella pertussis
acguggcccgcgugacggccgcc

SEQ ID NO: 2410617 - RNA, 13 nt, Bordetella pertussis
acguggcgacguc

SEQ ID NO: 2410618 - RNA, 14 nt, Bordetella pertussis
acguggcgacgucg

SEQ ID NO: 2410619 - RNA, 16 nt, Bordetella pertussis
acguggcgcggcugcu

SEQ ID NO: 2410620 - RNA, 18 nt, Bordetella pertussis
acguggcgcuccaugcgg

SEQ ID NO: 2410621 - RNA, 23 nt, Bordetella pertussis
acguggcggcgauguggcgcgcc

SEQ ID NO: 2410622 - RNA, 16 nt, Bordetella pertussis
acgugggcacgccggc

SEQ ID NO: 2410623 - RNA, 22 nt, Bordetella pertussis
acgugggcacgccggccuugcu

SEQ ID NO: 2410624 - RNA, 17 nt, Bordetella pertussis
acgugguggugcgggcc

SEQ ID NO: 2410625 - RNA, 21 nt, Bordetella pertussis
acgugguggugcgggccgcgc

SEQ ID NO: 2410626 - RNA, 20 nt, Bordetella pertussis
acgugucggccaccacgaug

SEQ ID NO: 2410627 - RNA, 15 nt, Bordetella pertussis
acguguugccaggcg

SEQ ID NO: 2410628 - RNA, 18 nt, Bordetella pertussis
acguucagcgccggcaug

SEQ ID NO: 2410629 - RNA, 17 nt, Bordetella pertussis
acguucggggcgucgcu

SEQ ID NO: 2410630 - RNA, 17 nt, Bordetella pertussis
acguucuccagcgccgu

SEQ ID NO: 2410631 - RNA, 16 nt, Bordetella pertussis
acguugaagcgcagcc

SEQ ID NO: 2410632 - RNA, 16 nt, Bordetella pertussis
acguugaccuugccga

SEQ ID NO: 2410633 - RNA, 17 nt, Bordetella pertussis
acguugaccuugccgau

SEQ ID NO: 2410634 - RNA, 22 nt, Bordetella pertussis
acguugcauaccucgauggcgg

SEQ ID NO: 2410635 - RNA, 15 nt, Bordetella pertussis
acguugccgcgcgcg

SEQ ID NO: 2410636 - RNA, 20 nt, Bordetella pertussis
acguuggccgauacgcgugc

SEQ ID NO: 2410637 - RNA, 14 nt, Bordetella pertussis
acguuguucaggaa

SEQ ID NO: 2410638 - RNA, 21 nt, Bordetella pertussis
acuaagaugaaucgcaugcgg

SEQ ID NO: 2410639 - RNA, 15 nt, Bordetella pertussis
acuauggcgcgcgca

SEQ ID NO: 2410640 - RNA, 19 nt, Bordetella pertussis
acuauggcgcgcgcacgcu

SEQ ID NO: 2410641 - RNA, 14 nt, Bordetella pertussis
acucaccgccgccc

SEQ ID NO: 2410642 - RNA, 22 nt, Bordetella pertussis
acucaccgccgcccgcaggcau

SEQ ID NO: 2410643 - RNA, 14 nt, Bordetella pertussis
acucaugcgcugca

SEQ ID NO: 2410644 - RNA, 19 nt, Bordetella pertussis
acuccaggaaagcgccgcc

SEQ ID NO: 2410645 - RNA, 21 nt, Bordetella pertussis
acuccaggaaagcgccgccgc

SEQ ID NO: 2410646 - RNA, 19 nt, Bordetella pertussis
acuccaucuguucggcgcc

SEQ ID NO: 2410647 - RNA, 20 nt, Bordetella pertussis
acuccauuucgugcgugacc

SEQ ID NO: 2410648 - RNA, 21 nt, Bordetella pertussis
acuccauuucgugcgugacca

SEQ ID NO: 2410649 - RNA, 12 nt, Bordetella pertussis
acuccgcggcgu

SEQ ID NO: 2410650 - RNA, 14 nt, Bordetella pertussis
acuccggccgggcc

SEQ ID NO: 2410651 - RNA, 15 nt, Bordetella pertussis
acuccggccgggcca

SEQ ID NO: 2410652 - RNA, 13 nt, Bordetella pertussis
acuccggcggcgc

SEQ ID NO: 2410653 - RNA, 18 nt, Bordetella pertussis
acuccggcugcuugccca

SEQ ID NO: 2410654 - RNA, 21 nt, Bordetella pertussis
acuccggcugcuugcccagcg

SEQ ID NO: 2410655 - RNA, 19 nt, Bordetella pertussis
acuccguaaagaugcgcgc

SEQ ID NO: 2410656 - RNA, 16 nt, Bordetella pertussis
acuccgucauggcgcc

SEQ ID NO: 2410657 - RNA, 18 nt, Bordetella pertussis
acuccucgacgucgccca

SEQ ID NO: 2410658 - RNA, 19 nt, Bordetella pertussis
acuccugcagcacgcuggc

SEQ ID NO: 2410659 - RNA, 20 nt, Bordetella pertussis
acucgacgaacacgcgcgcc

SEQ ID NO: 2410660 - RNA, 15 nt, Bordetella pertussis
acucgagccggcucc

SEQ ID NO: 2410661 - RNA, 18 nt, Bordetella pertussis
acucgaggcggcgcagga

SEQ ID NO: 2410662 - RNA, 22 nt, Bordetella pertussis
acucgaugcccagcaccgccac

SEQ ID NO: 2410663 - RNA, 13 nt, Bordetella pertussis
acucgauggccuc

SEQ ID NO: 2410664 - RNA, 20 nt, Bordetella pertussis
acucgauggcgcaggcgcgc

SEQ ID NO: 2410665 - RNA, 21 nt, Bordetella pertussis
acucgauggcgcaggcgcgcc

SEQ ID NO: 2410666 - RNA, 17 nt, Bordetella pertussis
acucgaugggcgcgcgc

SEQ ID NO: 2410667 - RNA, 20 nt, Bordetella pertussis
acucgcacacgcgcugggcg

SEQ ID NO: 2410668 - RNA, 19 nt, Bordetella pertussis
acucgccgaacugccggcg

SEQ ID NO: 2410669 - RNA, 19 nt, Bordetella pertussis
acucgccggucgcggcguu

SEQ ID NO: 2410670 - RNA, 16 nt, Bordetella pertussis
acucgcgcucggccag

SEQ ID NO: 2410671 - RNA, 16 nt, Bordetella pertussis
acuucguggcgcagcu

SEQ ID NO: 2410672 - RNA, 19 nt, Bordetella pertussis
acuucguggcgcagcuccg

SEQ ID NO: 2410673 - RNA, 17 nt, Bordetella pertussis
acuugaacggcgcggcc

SEQ ID NO: 2410674 - RNA, 18 nt, Bordetella pertussis
acuugaacggcgcggccu

SEQ ID NO: 2410675 - RNA, 16 nt, Bordetella pertussis
acuugaccgcaugcug

SEQ ID NO: 2410676 - RNA, 17 nt, Bordetella pertussis
acuugaccgcaugcugc

SEQ ID NO: 2410677 - RNA, 16 nt, Bordetella pertussis
acuugaucagggccac

SEQ ID NO: 2410678 - RNA, 14 nt, Bordetella pertussis
acuugcaggccgcg

SEQ ID NO: 2410679 - RNA, 13 nt, Bordetella pertussis
acuugccggccgc

SEQ ID NO: 2410680 - RNA, 17 nt, Bordetella pertussis
acuugccggccgcccag

SEQ ID NO: 2410681 - RNA, 18 nt, Bordetella pertussis
acuugcgcagcgcggcgu

SEQ ID NO: 2410682 - RNA, 23 nt, Bordetella pertussis
acuugcgcagcgcggcguugacc

SEQ ID NO: 2410683 - RNA, 24 nt, Bordetella pertussis
acuuggccggcgauugcgccagcg

SEQ ID NO: 2410684 - RNA, 20 nt, Bordetella pertussis
acuuggcgcgguccacgccc

SEQ ID NO: 2410685 - RNA, 19 nt, Bordetella pertussis
acuugggaucggccaggcc

SEQ ID NO: 2410686 - RNA, 13 nt, Bordetella pertussis
acuugggcaggcc

SEQ ID NO: 2410687 - RNA, 15 nt, Bordetella pertussis
acuuggugggcaccu

SEQ ID NO: 2410688 - RNA, 13 nt, Bordetella pertussis
acuuguaaugaga

SEQ ID NO: 2410689 - RNA, 13 nt, Bordetella pertussis
acuuguucuuguu

SEQ ID NO: 2410690 - RNA, 18 nt, Bordetella pertussis
acuuguucuuguugcucu

SEQ ID NO: 2410691 - RNA, 21 nt, Bordetella pertussis
acuuguugcgugccgcccagg

SEQ ID NO: 2410692 - RNA, 20 nt, Bordetella pertussis
acuuuucgucgucguucugc

SEQ ID NO: 2410693 - RNA, 16 nt, Bordetella pertussis
agaaaccuggcccggc

SEQ ID NO: 2410694 - RNA, 19 nt, Bordetella pertussis
agaaacuggcgcugccgac

SEQ ID NO: 2410695 - RNA, 14 nt, Bordetella pertussis
agaaagcgcggccg

SEQ ID NO: 2410696 - RNA, 14 nt, Bordetella pertussis
agaaauacgcgcgc

SEQ ID NO: 2410697 - RNA, 15 nt, Bordetella pertussis
agaaauagcccgcgg

SEQ ID NO: 2410698 - RNA, 17 nt, Bordetella pertussis
agaaauagcccgcggcc

SEQ ID NO: 2410699 - RNA, 14 nt, Bordetella pertussis
agaaaucgccgccg

SEQ ID NO: 2410700 - RNA, 17 nt, Bordetella pertussis
agaacaccgccgcgccg

SEQ ID NO: 2410701 - RNA, 15 nt, Bordetella pertussis
agaacagcagauggc

SEQ ID NO: 2410702 - RNA, 12 nt, Bordetella pertussis
agaacagcagcg

SEQ ID NO: 2410703 - RNA, 17 nt, Bordetella pertussis
agaacagcggaucgccg

SEQ ID NO: 2410704 - RNA, 17 nt, Bordetella pertussis
agaacagggugccgccc

SEQ ID NO: 2410705 - RNA, 18 nt, Bordetella pertussis
agaacagggugccgcccu

SEQ ID NO: 2410706 - RNA, 21 nt, Bordetella pertussis
agaacccggccggcgccggca

SEQ ID NO: 2410707 - RNA, 16 nt, Bordetella pertussis
agaacgcaugcgugcg

SEQ ID NO: 2410708 - RNA, 12 nt, Bordetella pertussis
agaacgcggccg

SEQ ID NO: 2410709 - RNA, 18 nt, Bordetella pertussis
agaacgcguaggucaggc

SEQ ID NO: 2410710 - RNA, 14 nt, Bordetella pertussis
agaacgcgucgcuc

SEQ ID NO: 2410711 - RNA, 21 nt, Bordetella pertussis
agaacucggccgcauggcggc

SEQ ID NO: 2410712 - RNA, 15 nt, Bordetella pertussis
agaacuucacgccga

SEQ ID NO: 2410713 - RNA, 17 nt, Bordetella pertussis
agaacuucacgccgagg

SEQ ID NO: 2410714 - RNA, 15 nt, Bordetella pertussis
agaagaacagcagau

SEQ ID NO: 2410715 - RNA, 13 nt, Bordetella pertussis
agaagauuuccca

SEQ ID NO: 2410716 - RNA, 19 nt, Bordetella pertussis
agaagcagccgcgcggccg

SEQ ID NO: 2410717 - RNA, 15 nt, Bordetella pertussis
agaagcagccgcgcu

SEQ ID NO: 2410718 - RNA, 20 nt, Bordetella pertussis
agaagcccccgcgcugcgcc

SEQ ID NO: 2410719 - RNA, 23 nt, Bordetella pertussis
agaagcccccgcgcugcgcccgc

SEQ ID NO: 2410720 - RNA, 22 nt, Bordetella pertussis
agaagccgaugucgaacagcug

SEQ ID NO: 2410721 - RNA, 15 nt, Bordetella pertussis
agaaggcgaacuggg

SEQ ID NO: 2410722 - RNA, 18 nt, Bordetella pertussis
agaaggcgaacugggucu

SEQ ID NO: 2410723 - RNA, 15 nt, Bordetella pertussis
agaaguaggcggcca

SEQ ID NO: 2410724 - RNA, 18 nt, Bordetella pertussis
agaaguaggcggccaggc

SEQ ID NO: 2410725 - RNA, 13 nt, Bordetella pertussis
agaagucaucgau

SEQ ID NO: 2410726 - RNA, 18 nt, Bordetella pertussis
agaaguggucgcgcaggc

SEQ ID NO: 2410727 - RNA, 18 nt, Bordetella pertussis
agaauguauuggcccagu

SEQ ID NO: 2410728 - RNA, 22 nt, Bordetella pertussis
agaauguauuggcccaguugaa

SEQ ID NO: 2410729 - RNA, 14 nt, Bordetella pertussis
agacacgcuagggc

SEQ ID NO: 2410730 - RNA, 15 nt, Bordetella pertussis
agacagauguccgug

SEQ ID NO: 2410731 - RNA, 19 nt, Bordetella pertussis
agacaggcgcgccauccug

SEQ ID NO: 2410732 - RNA, 22 nt, Bordetella pertussis
agacaugcugcgacagcagggc

SEQ ID NO: 2410733 - RNA, 17 nt, Bordetella pertussis
agaccaagcgccacagc

SEQ ID NO: 2410734 - RNA, 16 nt, Bordetella pertussis
agaccaccagcaggau

SEQ ID NO: 2410735 - RNA, 18 nt, Bordetella pertussis
agaccacgauggccggcg

SEQ ID NO: 2410736 - RNA, 18 nt, Bordetella pertussis
agaccacgcaaaccccau

SEQ ID NO: 2410737 - RNA, 14 nt, Bordetella pertussis
agaccacgccggcg

SEQ ID NO: 2410738 - RNA, 17 nt, Bordetella pertussis
agaccacgcgcugcgcg

SEQ ID NO: 2410739 - RNA, 21 nt, Bordetella pertussis
agacccacagguuggccgcga

SEQ ID NO: 2410740 - RNA, 12 nt, Bordetella pertussis
agacccuccucg

SEQ ID NO: 2410741 - RNA, 20 nt, Bordetella pertussis
agaccgagcgcgcccgcuug

SEQ ID NO: 2410742 - RNA, 14 nt, Bordetella pertussis
agaccgccgcgccc

SEQ ID NO: 2410743 - RNA, 14 nt, Bordetella pertussis
agaccgcggccgcg

SEQ ID NO: 2410744 - RNA, 21 nt, Bordetella pertussis
agaccgcuuauuuccucagcc

SEQ ID NO: 2410745 - RNA, 17 nt, Bordetella pertussis
agaccggcgccugcggc

SEQ ID NO: 2410746 - RNA, 20 nt, Bordetella pertussis
agaccggcgccugcggcaug

SEQ ID NO: 2410747 - RNA, 17 nt, Bordetella pertussis
agaccggguuuccagcc

SEQ ID NO: 2410748 - RNA, 16 nt, Bordetella pertussis
agaccguagcgcaggc

SEQ ID NO: 2410749 - RNA, 14 nt, Bordetella pertussis
agaccgugaucggc

SEQ ID NO: 2410750 - RNA, 19 nt, Bordetella pertussis
agaccgugaucggcgcaac

SEQ ID NO: 2410751 - RNA, 18 nt, Bordetella pertussis
agaccguggaaaccgcgu

SEQ ID NO: 2410752 - RNA, 14 nt, Bordetella pertussis
agaccuaccaggcc

SEQ ID NO: 2410753 - RNA, 17 nt, Bordetella pertussis
agaccugcgcgccggca

SEQ ID NO: 2410754 - RNA, 18 nt, Bordetella pertussis
agaccugcgcgccggcau

SEQ ID NO: 2410755 - RNA, 16 nt, Bordetella pertussis
agaccugcgggccgca

SEQ ID NO: 2410756 - RNA, 16 nt, Bordetella pertussis
agacgaaggcgccggc

SEQ ID NO: 2410757 - RNA, 18 nt, Bordetella pertussis
agacgaaggcgccggcca

SEQ ID NO: 2410758 - RNA, 21 nt, Bordetella pertussis
agacgaaggcgccggccaggc

SEQ ID NO: 2410759 - RNA, 20 nt, Bordetella pertussis
agacgaagucccagccggcc

SEQ ID NO: 2410760 - RNA, 14 nt, Bordetella pertussis
agacgaugaagacg

SEQ ID NO: 2410761 - RNA, 16 nt, Bordetella pertussis
agacgauggugccggc

SEQ ID NO: 2410762 - RNA, 18 nt, Bordetella pertussis
agacgccaucuugcaggc

SEQ ID NO: 2410763 - RNA, 19 nt, Bordetella pertussis
agacgccaucuugcaggcg

SEQ ID NO: 2410764 - RNA, 20 nt, Bordetella pertussis
agacgccaucuugcaggcgc

SEQ ID NO: 2410765 - RNA, 21 nt, Bordetella pertussis
agacgccaucuugcaggcgcc

SEQ ID NO: 2410766 - RNA, 12 nt, Bordetella pertussis
agacgccgggac

SEQ ID NO: 2410767 - RNA, 23 nt, Bordetella pertussis
agacgcgagaccaugacgucgac

SEQ ID NO: 2410768 - RNA, 13 nt, Bordetella pertussis
agacgcgcagcgg

SEQ ID NO: 2410769 - RNA, 18 nt, Bordetella pertussis
agacgcgcagcggcaggc

SEQ ID NO: 2410770 - RNA, 17 nt, Bordetella pertussis
agacgcgcucgccgucg

SEQ ID NO: 2410771 - RNA, 18 nt, Bordetella pertussis
agacgcgcucgccgucga

SEQ ID NO: 2410772 - RNA, 15 nt, Bordetella pertussis
agacgcgcucgcgcg

SEQ ID NO: 2410773 - RNA, 14 nt, Bordetella pertussis
agacgcggcagggc

SEQ ID NO: 2410774 - RNA, 17 nt, Bordetella pertussis
agacgcggggacaggca

SEQ ID NO: 2410775 - RNA, 18 nt, Bordetella pertussis
agacgcggggacaggcac

SEQ ID NO: 2410776 - RNA, 16 nt, Bordetella pertussis
agacgcugucgcgccc

SEQ ID NO: 2410777 - RNA, 17 nt, Bordetella pertussis
agacggccagcgcgcgu

SEQ ID NO: 2410778 - RNA, 16 nt, Bordetella pertussis
agacggcgcucggccu

SEQ ID NO: 2410779 - RNA, 20 nt, Bordetella pertussis
agacggcuugaccacggcca

SEQ ID NO: 2410780 - RNA, 22 nt, Bordetella pertussis
agacgguaucuguccccgcggg

SEQ ID NO: 2410781 - RNA, 21 nt, Bordetella pertussis
agacgguaucugucccggcgg

SEQ ID NO: 2410782 - RNA, 14 nt, Bordetella pertussis
agacguggcccgcg

SEQ ID NO: 2410783 - RNA, 22 nt, Bordetella pertussis
agacguggcccgcgugacggcc

SEQ ID NO: 2410784 - RNA, 15 nt, Bordetella pertussis
agcaagcccaccggg

SEQ ID NO: 2410785 - RNA, 22 nt, Bordetella pertussis
agcaagcccaccgggccggccu

SEQ ID NO: 2410786 - RNA, 22 nt, Bordetella pertussis
agcaagccccaggcaggcgggc

SEQ ID NO: 2410787 - RNA, 21 nt, Bordetella pertussis
agcaagccgaucaaccugauc

SEQ ID NO: 2410788 - RNA, 16 nt, Bordetella pertussis
agcaagcgcuggaugg

SEQ ID NO: 2410789 - RNA, 13 nt, Bordetella pertussis
agcaagcugcugc

SEQ ID NO: 2410790 - RNA, 16 nt, Bordetella pertussis
agcaagcugcugcugg

SEQ ID NO: 2410791 - RNA, 17 nt, Bordetella pertussis
agcaaggcgcgccaccg

SEQ ID NO: 2410792 - RNA, 21 nt, Bordetella pertussis
agcaaggcggcaaacccggcg

SEQ ID NO: 2410793 - RNA, 13 nt, Bordetella pertussis
agcaaggcgucgg

SEQ ID NO: 2410794 - RNA, 21 nt, Bordetella pertussis
agcaaggcgucggccaggccg

SEQ ID NO: 2410795 - RNA, 23 nt, Bordetella pertussis
agcaaggcgucggccaggccgau

SEQ ID NO: 2410796 - RNA, 12 nt, Bordetella pertussis
agcaagggcaga

SEQ ID NO: 2410797 - RNA, 17 nt, Bordetella pertussis
agcaagggccccagcau

SEQ ID NO: 2410798 - RNA, 21 nt, Bordetella pertussis
agcaagggcgucuucgccgac

SEQ ID NO: 2410799 - RNA, 16 nt, Bordetella pertussis
agcaagucagcccgcg

SEQ ID NO: 2410800 - RNA, 18 nt, Bordetella pertussis
agcaaucaagggccuuuu

SEQ ID NO: 2410801 - RNA, 15 nt, Bordetella pertussis
agcaauccaucguga

SEQ ID NO: 2410802 - RNA, 14 nt, Bordetella pertussis
agcaauccgaggcc

SEQ ID NO: 2410803 - RNA, 22 nt, Bordetella pertussis
agcaauccgaggcccguuuugu

SEQ ID NO: 2410804 - RNA, 19 nt, Bordetella pertussis
agcaaugacgacgccggcu

SEQ ID NO: 2410805 - RNA, 20 nt, Bordetella pertussis
agcaauggauucgauugccu

SEQ ID NO: 2410806 - RNA, 17 nt, Bordetella pertussis
agcaauuaugcguggcc

SEQ ID NO: 2410807 - RNA, 17 nt, Bordetella pertussis
agcaauugccccagcac

SEQ ID NO: 2410808 - RNA, 22 nt, Bordetella pertussis
agcacacggucagcaaccccag

SEQ ID NO: 2410809 - RNA, 21 nt, Bordetella pertussis
agcacagugucuaucauggcc

SEQ ID NO: 2410810 - RNA, 15 nt, Bordetella pertussis
agcacauacgccgcc

SEQ ID NO: 2410811 - RNA, 16 nt, Bordetella pertussis
agcacauacgccgccg

SEQ ID NO: 2410812 - RNA, 19 nt, Bordetella pertussis
agcacauccgacagauggc

SEQ ID NO: 2410813 - RNA, 19 nt, Bordetella pertussis
agcacaucgacgucggccu

SEQ ID NO: 2410814 - RNA, 16 nt, Bordetella pertussis
agcacaucgcccggca

SEQ ID NO: 2410815 - RNA, 18 nt, Bordetella pertussis
agcacaugcccggccacc

SEQ ID NO: 2410816 - RNA, 21 nt, Bordetella pertussis
agcacaugcccggccaccagc

SEQ ID NO: 2410817 - RNA, 15 nt, Bordetella pertussis
agcacauggcgcgcc

SEQ ID NO: 2410818 - RNA, 13 nt, Bordetella pertussis
agcacaugggcgc

SEQ ID NO: 2410819 - RNA, 23 nt, Bordetella pertussis
agcacaugggcgcgguagcgccc

SEQ ID NO: 2410820 - RNA, 22 nt, Bordetella pertussis
agcaccacaucgccggcggcgu

SEQ ID NO: 2410821 - RNA, 12 nt, Bordetella pertussis
agcaccacggcg

SEQ ID NO: 2410822 - RNA, 14 nt, Bordetella pertussis
agcaccacggcgcg

SEQ ID NO: 2410823 - RNA, 16 nt, Bordetella pertussis
agcaccacggcggcca

SEQ ID NO: 2410824 - RNA, 15 nt, Bordetella pertussis
agcaccaggccgaac

SEQ ID NO: 2410825 - RNA, 14 nt, Bordetella pertussis
agcaccaggccgcc

SEQ ID NO: 2410826 - RNA, 19 nt, Bordetella pertussis
agcaccaggccgccggcca

SEQ ID NO: 2410827 - RNA, 20 nt, Bordetella pertussis
agcaccaggccgccggccag

SEQ ID NO: 2410828 - RNA, 12 nt, Bordetella pertussis
agcaccaggcuu

SEQ ID NO: 2410829 - RNA, 15 nt, Bordetella pertussis
agcaccagggcgcgc

SEQ ID NO: 2410830 - RNA, 22 nt, Bordetella pertussis
agcaccagggcgcgcagcaggc

SEQ ID NO: 2410831 - RNA, 23 nt, Bordetella pertussis
agcaccagggcgcgcagcaggcc

SEQ ID NO: 2410832 - RNA, 19 nt, Bordetella pertussis
agcacccagcguucgcgcu

SEQ ID NO: 2410833 - RNA, 14 nt, Bordetella pertussis
agcaccccgucggc

SEQ ID NO: 2410834 - RNA, 13 nt, Bordetella pertussis
agcacccgcaggc

SEQ ID NO: 2410835 - RNA, 16 nt, Bordetella pertussis
agcacccgcaggcggc

SEQ ID NO: 2410836 - RNA, 18 nt, Bordetella pertussis
agcaccgagcugccgccu

SEQ ID NO: 2410837 - RNA, 21 nt, Bordetella pertussis
agcaccgagcugccgccuucg

SEQ ID NO: 2410838 - RNA, 23 nt, Bordetella pertussis
agcaccgccacgcgguccagccc

SEQ ID NO: 2410839 - RNA, 16 nt, Bordetella pertussis
agcaccgccagcgcgu

SEQ ID NO: 2410840 - RNA, 17 nt, Bordetella pertussis
agcaccgccgccaguuc

SEQ ID NO: 2410841 - RNA, 12 nt, Bordetella pertussis
agcaccgccucg

SEQ ID NO: 2410842 - RNA, 16 nt, Bordetella pertussis
agcaccgcgaccaugc

SEQ ID NO: 2410843 - RNA, 21 nt, Bordetella pertussis
agcaccgcgaccaugcggccg

SEQ ID NO: 2410844 - RNA, 20 nt, Bordetella pertussis
agcaccggauccugcggcgc

SEQ ID NO: 2410845 - RNA, 22 nt, Bordetella pertussis
agcaccggauccugcggcgcgg

SEQ ID NO: 2410846 - RNA, 18 nt, Bordetella pertussis
agcaccggcacgcgccag

SEQ ID NO: 2410847 - RNA, 21 nt, Bordetella pertussis
agcaccggcacgcgccaggcg

SEQ ID NO: 2410848 - RNA, 19 nt, Bordetella pertussis
agcaccggccgccgcaugc

SEQ ID NO: 2410849 - RNA, 20 nt, Bordetella pertussis
agcaccggguaauggcgcuc

SEQ ID NO: 2410850 - RNA, 16 nt, Bordetella pertussis
agcaccgugccggcgu

SEQ ID NO: 2410851 - RNA, 22 nt, Bordetella pertussis
agcaccucggacgagacaggcg

SEQ ID NO: 2410852 - RNA, 15 nt, Bordetella pertussis
agcaccucggggcgc

SEQ ID NO: 2410853 - RNA, 20 nt, Bordetella pertussis
agcaccucggggcgcggccg

SEQ ID NO: 2410854 - RNA, 13 nt, Bordetella pertussis
agcaccugcaggc

SEQ ID NO: 2410855 - RNA, 14 nt, Bordetella pertussis
agcaccugcaggcc

SEQ ID NO: 2410856 - RNA, 15 nt, Bordetella pertussis
agcaccugcaggccg

SEQ ID NO: 2410857 - RNA, 17 nt, Bordetella pertussis
agcaccugcaggccgcc

SEQ ID NO: 2410858 - RNA, 20 nt, Bordetella pertussis
agcaccugcaggccgccggc

SEQ ID NO: 2410859 - RNA, 15 nt, Bordetella pertussis
agcaccugguggcgc

SEQ ID NO: 2410860 - RNA, 22 nt, Bordetella pertussis
agcaccuugaccuggucggccu

SEQ ID NO: 2410861 - RNA, 22 nt, Bordetella pertussis
agcacgaaccacaggguggcgc

SEQ ID NO: 2410862 - RNA, 15 nt, Bordetella pertussis
agcacgaaccaguug

SEQ ID NO: 2410863 - RNA, 20 nt, Bordetella pertussis
agcacgaagggcagcagcag

SEQ ID NO: 2410864 - RNA, 13 nt, Bordetella pertussis
agcacgacgacgg

SEQ ID NO: 2410865 - RNA, 18 nt, Bordetella pertussis
agcacgacgacggccggc

SEQ ID NO: 2410866 - RNA, 14 nt, Bordetella pertussis
agcacgagaugucc

SEQ ID NO: 2410867 - RNA, 22 nt, Bordetella pertussis
agcacgagauguccauggccug

SEQ ID NO: 2410868 - RNA, 14 nt, Bordetella pertussis
agcacgaucacgaa

SEQ ID NO: 2410869 - RNA, 18 nt, Bordetella pertussis
agcacgaucgcggcgcug

SEQ ID NO: 2410870 - RNA, 16 nt, Bordetella pertussis
agcacgaucuggcgcg

SEQ ID NO: 2410871 - RNA, 19 nt, Bordetella pertussis
agcacgaucuggcgcgcga

SEQ ID NO: 2410872 - RNA, 18 nt, Bordetella pertussis
agcacgaugagcaugauu

SEQ ID NO: 2410873 - RNA, 18 nt, Bordetella pertussis
agcacgauggggccaugg

SEQ ID NO: 2410874 - RNA, 14 nt, Bordetella pertussis
agcacgcaccaggc

SEQ ID NO: 2410875 - RNA, 17 nt, Bordetella pertussis
agcacgcaccaggcgca

SEQ ID NO: 2410876 - RNA, 22 nt, Bordetella pertussis
agcacgcaccaggcgcacggcg

SEQ ID NO: 2410877 - RNA, 21 nt, Bordetella pertussis
agcacgccauggucucgucca

SEQ ID NO: 2410878 - RNA, 16 nt, Bordetella pertussis
agcacgcccagauggc

SEQ ID NO: 2410879 - RNA, 22 nt, Bordetella pertussis
agcacgcccauggucaggacga

SEQ ID NO: 2410880 - RNA, 18 nt, Bordetella pertussis
agcacgcccgccagcagc

SEQ ID NO: 2410881 - RNA, 15 nt, Bordetella pertussis
agcacgccgaucgcg

SEQ ID NO: 2410882 - RNA, 21 nt, Bordetella pertussis
agcacgccgaucgcgcacagc

SEQ ID NO: 2410883 - RNA, 13 nt, Bordetella pertussis
agcacgccgcgcc

SEQ ID NO: 2410884 - RNA, 13 nt, Bordetella pertussis
agcacgccgcgcu

SEQ ID NO: 2410885 - RNA, 16 nt, Bordetella pertussis
agcacgccgcgcucgu

SEQ ID NO: 2410886 - RNA, 16 nt, Bordetella pertussis
agcacgccggccaggu

SEQ ID NO: 2410887 - RNA, 18 nt, Bordetella pertussis
agcacgcgcaccaggccu

SEQ ID NO: 2410888 - RNA, 22 nt, Bordetella pertussis
agcacgcgcaccaggccugccu

SEQ ID NO: 2410889 - RNA, 23 nt, Bordetella pertussis
agcacgcgcagcuugcccgcgcg

SEQ ID NO: 2410890 - RNA, 12 nt, Bordetella pertussis
agcacgcggcgc

SEQ ID NO: 2410891 - RNA, 16 nt, Bordetella pertussis
agcacgcggcgcagca

SEQ ID NO: 2410892 - RNA, 19 nt, Bordetella pertussis
agcacgcggcgcagcaucu

SEQ ID NO: 2410893 - RNA, 13 nt, Bordetella pertussis
agcacgcggcgcg

SEQ ID NO: 2410894 - RNA, 12 nt, Bordetella pertussis
agcacggccacg

SEQ ID NO: 2410895 - RNA, 19 nt, Bordetella pertussis
agcacggccacggccggca

SEQ ID NO: 2410896 - RNA, 12 nt, Bordetella pertussis
agcacggccgcg

SEQ ID NO: 2410897 - RNA, 22 nt, Bordetella pertussis
agcaggcucagcgggcugcugg

SEQ ID NO: 2410898 - RNA, 15 nt, Bordetella pertussis
agcaggcuggccacc

SEQ ID NO: 2410899 - RNA, 19 nt, Bordetella pertussis
agcagggacuugggcaggc

SEQ ID NO: 2410900 - RNA, 18 nt, Bordetella pertussis
agcagggccacgcccagg

SEQ ID NO: 2410901 - RNA, 13 nt, Bordetella pertussis
agcagggccaggc

SEQ ID NO: 2410902 - RNA, 14 nt, Bordetella pertussis
agcagggccaggcc

SEQ ID NO: 2410903 - RNA, 15 nt, Bordetella pertussis
agcagggccuggcag

SEQ ID NO: 2410904 - RNA, 13 nt, Bordetella pertussis
agcagggcgccga

SEQ ID NO: 2410905 - RNA, 12 nt, Bordetella pertussis
agcagggcggcg

SEQ ID NO: 2410906 - RNA, 13 nt, Bordetella pertussis
agcagggcggcgg

SEQ ID NO: 2410907 - RNA, 14 nt, Bordetella pertussis
agcagggcggcguc

SEQ ID NO: 2410908 - RNA, 15 nt, Bordetella pertussis
agcaggggcugccau

SEQ ID NO: 2410909 - RNA, 20 nt, Bordetella pertussis
agcagggggucgaucauggc

SEQ ID NO: 2410910 - RNA, 19 nt, Bordetella pertussis
agcagggucagcggccggc

SEQ ID NO: 2410911 - RNA, 17 nt, Bordetella pertussis
agcagggucgagaccag

SEQ ID NO: 2410912 - RNA, 22 nt, Bordetella pertussis
agcagggucgagaccagcagcg

SEQ ID NO: 2410913 - RNA, 23 nt, Bordetella pertussis
agcagguccauggccagucuggc

SEQ ID NO: 2410914 - RNA, 15 nt, Bordetella pertussis
agcagguccugcacg

SEQ ID NO: 2410915 - RNA, 21 nt, Bordetella pertussis
agcagguccugcacgcgggcc

SEQ ID NO: 2410916 - RNA, 15 nt, Bordetella pertussis
agcaggucgcgcacg

SEQ ID NO: 2410917 - RNA, 18 nt, Bordetella pertussis
agcaggucguuggccguc

SEQ ID NO: 2410918 - RNA, 20 nt, Bordetella pertussis
agcaggucugcacgaggcgc

SEQ ID NO: 2410919 - RNA, 21 nt, Bordetella pertussis
agcaggucugcacgaggcgcu

SEQ ID NO: 2410920 - RNA, 20 nt, Bordetella pertussis
agcaggugaugcgcgcggcc

SEQ ID NO: 2410921 - RNA, 13 nt, Bordetella pertussis
agcagguggaucg

SEQ ID NO: 2410922 - RNA, 14 nt, Bordetella pertussis
agcagguggaucga

SEQ ID NO: 2410923 - RNA, 22 nt, Bordetella pertussis
agcagguggaucgacgagaugc

SEQ ID NO: 2410924 - RNA, 22 nt, Bordetella pertussis
agcaguacacgcgcaacauggu

SEQ ID NO: 2410925 - RNA, 16 nt, Bordetella pertussis
agcaguguuucggccu

SEQ ID NO: 2410926 - RNA, 19 nt, Bordetella pertussis
agcaguucggccggcggcc

SEQ ID NO: 2410927 - RNA, 22 nt, Bordetella pertussis
agcaguucggucagcgcggcgc

SEQ ID NO: 2410928 - RNA, 16 nt, Bordetella pertussis
agcaguugcagcauga

SEQ ID NO: 2410929 - RNA, 20 nt, Bordetella pertussis
agcauacccugcgcgccgcc

SEQ ID NO: 2410930 - RNA, 19 nt, Bordetella pertussis
agcauaucgucgcugcggc

SEQ ID NO: 2410931 - RNA, 22 nt, Bordetella pertussis
agcaucaccagcucgcggcccu

SEQ ID NO: 2410932 - RNA, 18 nt, Bordetella pertussis
agcaucagcccuacccug

SEQ ID NO: 2410933 - RNA, 22 nt, Bordetella pertussis
agcaucagcccuacccugauca

SEQ ID NO: 2410934 - RNA, 16 nt, Bordetella pertussis
agcaucagcggcagca

SEQ ID NO: 2410935 - RNA, 17 nt, Bordetella pertussis
agcaucagcggcagcac

SEQ ID NO: 2410936 - RNA, 21 nt, Bordetella pertussis
agcaucauggcgcgcgccgcg

SEQ ID NO: 2410937 - RNA, 14 nt, Bordetella pertussis
agcauccgcgccag

SEQ ID NO: 2410938 - RNA, 19 nt, Bordetella pertussis
agcauccgcgccaggaugg

SEQ ID NO: 2410939 - RNA, 13 nt, Bordetella pertussis
agcaucgccgcca

SEQ ID NO: 2410940 - RNA, 15 nt, Bordetella pertussis
agcaucgccgccagc

SEQ ID NO: 2410941 - RNA, 15 nt, Bordetella pertussis
agcaucgcgccuucg

SEQ ID NO: 2410942 - RNA, 18 nt, Bordetella pertussis
agcaucggcacccagccg

SEQ ID NO: 2410943 - RNA, 18 nt, Bordetella pertussis
agcaucguaucgggcguc

SEQ ID NO: 2410944 - RNA, 13 nt, Bordetella pertussis
agcaucugcggca

SEQ ID NO: 2410945 - RNA, 15 nt, Bordetella pertussis
agcaucuuggccgcc

SEQ ID NO: 2410946 - RNA, 13 nt, Bordetella pertussis
agcaugaaaugcu

SEQ ID NO: 2410947 - RNA, 18 nt, Bordetella pertussis
agcaugaaaugcuggucg

SEQ ID NO: 2410948 - RNA, 16 nt, Bordetella pertussis
agcaugaacggcagcg

SEQ ID NO: 2410949 - RNA, 20 nt, Bordetella pertussis
agcaugaagcgguggcggcc

SEQ ID NO: 2410950 - RNA, 14 nt, Bordetella pertussis
agcaugaccgacag

SEQ ID NO: 2410951 - RNA, 17 nt, Bordetella pertussis
agcaugaccgacaggcg

SEQ ID NO: 2410952 - RNA, 20 nt, Bordetella pertussis
agcaugaccgacaggcggcu

SEQ ID NO: 2410953 - RNA, 23 nt, Bordetella pertussis
agcaugacggggucggggcaggc

SEQ ID NO: 2410954 - RNA, 22 nt, Bordetella pertussis
agcaugcgcagcgcgucggcgc

SEQ ID NO: 2410955 - RNA, 12 nt, Bordetella pertussis
agcaugcgcgcg

SEQ ID NO: 2410956 - RNA, 16 nt, Bordetella pertussis
agcaugcgcgcgacuu

SEQ ID NO: 2410957 - RNA, 15 nt, Bordetella pertussis
agcaugcgcuggucg

SEQ ID NO: 2410958 - RNA, 23 nt, Bordetella pertussis
agcaugcgcuggucgcgcagcac

SEQ ID NO: 2410959 - RNA, 20 nt, Bordetella pertussis
agcaugcggcccgcgcuguu

SEQ ID NO: 2410960 - RNA, 20 nt, Bordetella pertussis
agcauggcaugagcgccucg

SEQ ID NO: 2410961 - RNA, 21 nt, Bordetella pertussis
agcauggcgccaugcgacagc

SEQ ID NO: 2410962 - RNA, 18 nt, Bordetella pertussis
agcauggcggccaggcgc

SEQ ID NO: 2410963 - RNA, 19 nt, Bordetella pertussis
agcauggcggccaggcgcg

SEQ ID NO: 2410964 - RNA, 12 nt, Bordetella pertussis
agcauggcggcg

SEQ ID NO: 2410965 - RNA, 13 nt, Bordetella pertussis
agcauggcggcgc

SEQ ID NO: 2410966 - RNA, 12 nt, Bordetella pertussis
agcauggcgggc

SEQ ID NO: 2410967 - RNA, 22 nt, Bordetella pertussis
agcauggcgguggccagcgccu

SEQ ID NO: 2410968 - RNA, 13 nt, Bordetella pertussis
agcauggcgucga

SEQ ID NO: 2410969 - RNA, 15 nt, Bordetella pertussis
agcauggucgccucg

SEQ ID NO: 2410970 - RNA, 22 nt, Bordetella pertussis
agcauggucggcauggccagga

SEQ ID NO: 2410971 - RNA, 22 nt, Bordetella pertussis
agcaugucgacguuaugcucgc

SEQ ID NO: 2410972 - RNA, 16 nt, Bordetella pertussis
agcauuaccagcaacg

SEQ ID NO: 2410973 - RNA, 17 nt, Bordetella pertussis
agcauuucggcgccgcc

SEQ ID NO: 2410974 - RNA, 21 nt, Bordetella pertussis
agcauuugcgcgacggcggcc

SEQ ID NO: 2410975 - RNA, 13 nt, Bordetella pertussis
agccaagcagggc

SEQ ID NO: 2410976 - RNA, 19 nt, Bordetella pertussis
agccacacgaucagcgccc

SEQ ID NO: 2410977 - RNA, 20 nt, Bordetella pertussis
agccacacgaucagcgccca

SEQ ID NO: 2410978 - RNA, 13 nt, Bordetella pertussis
agccacacgcuga

SEQ ID NO: 2410979 - RNA, 21 nt, Bordetella pertussis
agccaccacugcaaggcccgc

SEQ ID NO: 2410980 - RNA, 21 nt, Bordetella pertussis
agccaccgguugcagcgcgcc

SEQ ID NO: 2410981 - RNA, 14 nt, Bordetella pertussis
agccacgccggcgc

SEQ ID NO: 2410982 - RNA, 17 nt, Bordetella pertussis
agccacgccggcgcgcc

SEQ ID NO: 2410983 - RNA, 22 nt, Bordetella pertussis
agccacgccggcgcgccggccg

SEQ ID NO: 2410984 - RNA, 22 nt, Bordetella pertussis
agccacgugaagcgccgcgccu

SEQ ID NO: 2410985 - RNA, 18 nt, Bordetella pertussis
agccacugcggcccgagc

SEQ ID NO: 2410986 - RNA, 21 nt, Bordetella pertussis
agccacugcggcccgagccaa

SEQ ID NO: 2410987 - RNA, 16 nt, Bordetella pertussis
agccagauaaaggccg

SEQ ID NO: 2410988 - RNA, 20 nt, Bordetella pertussis
agccagauaccguccuugag

SEQ ID NO: 2410989 - RNA, 17 nt, Bordetella pertussis
agccagauucccccgca

SEQ ID NO: 2410990 - RNA, 18 nt, Bordetella pertussis
agccagcccuggcccagc

SEQ ID NO: 2410991 - RNA, 19 nt, Bordetella pertussis
agccagccgccgcgcggcg

SEQ ID NO: 2410992 - RNA, 11 nt, Bordetella pertussis
agccagccgcu

SEQ ID NO: 2410993 - RNA, 16 nt, Bordetella pertussis
agccagccggcggcca

SEQ ID NO: 2410994 - RNA, 16 nt, Bordetella pertussis
agccagcgccgcagcg

SEQ ID NO: 2410995 - RNA, 11 nt, Bordetella pertussis
agccagcgccu

SEQ ID NO: 2410996 - RNA, 15 nt, Bordetella pertussis
agccagcgccugcgc

SEQ ID NO: 2410997 - RNA, 18 nt, Bordetella pertussis
agccagcgccugcgcggc

SEQ ID NO: 2410998 - RNA, 13 nt, Bordetella pertussis
agccagcggcgcg

SEQ ID NO: 2410999 - RNA, 15 nt, Bordetella pertussis
agccagcggcgcggc

SEQ ID NO: 2411000 - RNA, 17 nt, Bordetella pertussis
agccagcggcgcggcgc

SEQ ID NO: 2411001 - RNA, 14 nt, Bordetella pertussis
agccagcggugcgc

SEQ ID NO: 2411002 - RNA, 17 nt, Bordetella pertussis
agccagcggugcgcggc

SEQ ID NO: 2411003 - RNA, 17 nt, Bordetella pertussis
agccaggccagcgccag

SEQ ID NO: 2411004 - RNA, 20 nt, Bordetella pertussis
agccaggccgaucagcacca

SEQ ID NO: 2411005 - RNA, 14 nt, Bordetella pertussis
agccaggccucggc

SEQ ID NO: 2411006 - RNA, 16 nt, Bordetella pertussis
agccaggccucggcuc

SEQ ID NO: 2411007 - RNA, 17 nt, Bordetella pertussis
agccaggcgcccggcgu

SEQ ID NO: 2411008 - RNA, 19 nt, Bordetella pertussis
agccaggguuguccgaacc

SEQ ID NO: 2411009 - RNA, 16 nt, Bordetella pertussis
agccagguaagcuggc

SEQ ID NO: 2411010 - RNA, 21 nt, Bordetella pertussis
agccgaagaaccaguagcaca

SEQ ID NO: 2411011 - RNA, 16 nt, Bordetella pertussis
agccgaaguacacggc

SEQ ID NO: 2411012 - RNA, 20 nt, Bordetella pertussis
agccgaaguacacggccagc

SEQ ID NO: 2411013 - RNA, 22 nt, Bordetella pertussis
agccgaaguacacggccagcac

SEQ ID NO: 2411014 - RNA, 16 nt, Bordetella pertussis
agccgaauccggccag

SEQ ID NO: 2411015 - RNA, 22 nt, Bordetella pertussis
agccgaauccggccagcacgcc

SEQ ID NO: 2411016 - RNA, 12 nt, Bordetella pertussis
agccgacaggcg

SEQ ID NO: 2411017 - RNA, 14 nt, Bordetella pertussis
agccgacaggcgcg

SEQ ID NO: 2411018 - RNA, 15 nt, Bordetella pertussis
agccgacaggcgcgc

SEQ ID NO: 2411019 - RNA, 18 nt, Bordetella pertussis
agccgaccacccgcgcca

SEQ ID NO: 2411020 - RNA, 19 nt, Bordetella pertussis
agccgaccacccgcgccag

SEQ ID NO: 2411021 - RNA, 20 nt, Bordetella pertussis
agccgaccacccgcgccagg

SEQ ID NO: 2411022 - RNA, 14 nt, Bordetella pertussis
agccgaccgcgcgc

SEQ ID NO: 2411023 - RNA, 15 nt, Bordetella pertussis
agccgagccuggcgu

SEQ ID NO: 2411024 - RNA, 15 nt, Bordetella pertussis
agccgaguggcgggc

SEQ ID NO: 2411025 - RNA, 16 nt, Bordetella pertussis
agccgauacaggcgcu

SEQ ID NO: 2411026 - RNA, 22 nt, Bordetella pertussis
agccgauaguccuggaauacgc

SEQ ID NO: 2411027 - RNA, 18 nt, Bordetella pertussis
agccgaucagccggccau

SEQ ID NO: 2411028 - RNA, 21 nt, Bordetella pertussis
agccgaucagccggccauggc

SEQ ID NO: 2411029 - RNA, 13 nt, Bordetella pertussis
agccgauccgcga

SEQ ID NO: 2411030 - RNA, 19 nt, Bordetella pertussis
agccgauccgcgacgcccu

SEQ ID NO: 2411031 - RNA, 15 nt, Bordetella pertussis
agccgaucuggcccu

SEQ ID NO: 2411032 - RNA, 17 nt, Bordetella pertussis
agccgaucuggcccuug

SEQ ID NO: 2411033 - RNA, 20 nt, Bordetella pertussis
agccgaugaccggccaggcg

SEQ ID NO: 2411034 - RNA, 22 nt, Bordetella pertussis
agccgaugaccggccaggcgcg

SEQ ID NO: 2411035 - RNA, 18 nt, Bordetella pertussis
agccgaugccgcuucagg

SEQ ID NO: 2411036 - RNA, 13 nt, Bordetella pertussis
agccgaugcgccg

SEQ ID NO: 2411037 - RNA, 23 nt, Bordetella pertussis
agccgauggcauggggcaggcgc

SEQ ID NO: 2411038 - RNA, 20 nt, Bordetella pertussis
agccgaugucgaacagcugc

SEQ ID NO: 2411039 - RNA, 16 nt, Bordetella pertussis
agccgcaagcuggcgg

SEQ ID NO: 2411040 - RNA, 19 nt, Bordetella pertussis
agccgcaagcuggcggcgc

SEQ ID NO: 2411041 - RNA, 20 nt, Bordetella pertussis
agccgcaagcuggcggcgcg

SEQ ID NO: 2411042 - RNA, 22 nt, Bordetella pertussis
agccgcaauaccuucagcccgg

SEQ ID NO: 2411043 - RNA, 14 nt, Bordetella pertussis
agccgcacgcccgc

SEQ ID NO: 2411044 - RNA, 15 nt, Bordetella pertussis
agccgcacgcccgcc

SEQ ID NO: 2411045 - RNA, 18 nt, Bordetella pertussis
agccgcacgcccgccugc

SEQ ID NO: 2411046 - RNA, 19 nt, Bordetella pertussis
agccgcacgcccgccugca

SEQ ID NO: 2411047 - RNA, 15 nt, Bordetella pertussis
agccgcagaacagca

SEQ ID NO: 2411048 - RNA, 16 nt, Bordetella pertussis
agccgcagaacagcag

SEQ ID NO: 2411049 - RNA, 17 nt, Bordetella pertussis
agccgcagaacagcagc

SEQ ID NO: 2411050 - RNA, 21 nt, Bordetella pertussis
agccgcagaacagcagcguga

SEQ ID NO: 2411051 - RNA, 19 nt, Bordetella pertussis
agccgcagcaggcgcucgg

SEQ ID NO: 2411052 - RNA, 14 nt, Bordetella pertussis
agccgcagcggcag

SEQ ID NO: 2411053 - RNA, 19 nt, Bordetella pertussis
agccgcagcggcagcgcac

SEQ ID NO: 2411054 - RNA, 13 nt, Bordetella pertussis
agccgcaggucca

SEQ ID NO: 2411055 - RNA, 17 nt, Bordetella pertussis
agccgcaguauuccugc

SEQ ID NO: 2411056 - RNA, 14 nt, Bordetella pertussis
agccgcaugccggc

SEQ ID NO: 2411057 - RNA, 16 nt, Bordetella pertussis
agccgcaugccggcga

SEQ ID NO: 2411058 - RNA, 19 nt, Bordetella pertussis
agccgcaugccggcgauga

SEQ ID NO: 2411059 - RNA, 16 nt, Bordetella pertussis
agccgccagcgccugg

SEQ ID NO: 2411060 - RNA, 18 nt, Bordetella pertussis
agccgccagcgccuggac

SEQ ID NO: 2411061 - RNA, 21 nt, Bordetella pertussis
agccgccauaggcgcgcacca

SEQ ID NO: 2411062 - RNA, 15 nt, Bordetella pertussis
agccgccccagcagc

SEQ ID NO: 2411063 - RNA, 19 nt, Bordetella pertussis
agccgccccagcagcagcg

SEQ ID NO: 2411064 - RNA, 17 nt, Bordetella pertussis
agccgccccggcgcggc

SEQ ID NO: 2411065 - RNA, 20 nt, Bordetella pertussis
agccgccccggcgcggcgcg

SEQ ID NO: 2411066 - RNA, 12 nt, Bordetella pertussis
agccgcccgccg

SEQ ID NO: 2411067 - RNA, 19 nt, Bordetella pertussis
agccgcccgcggcggcccg

SEQ ID NO: 2411068 - RNA, 20 nt, Bordetella pertussis
agccgcccggaugggcggcc

SEQ ID NO: 2411069 - RNA, 21 nt, Bordetella pertussis
agccgcccggaugggcggccu

SEQ ID NO: 2411070 - RNA, 22 nt, Bordetella pertussis
agccgcccggccggcacggccg

SEQ ID NO: 2411071 - RNA, 23 nt, Bordetella pertussis
agccgccgacguagucgcgccag

SEQ ID NO: 2411072 - RNA, 14 nt, Bordetella pertussis
agccgccgcaggcu

SEQ ID NO: 2411073 - RNA, 14 nt, Bordetella pertussis
agccgccgccauag

SEQ ID NO: 2411074 - RNA, 16 nt, Bordetella pertussis
agccgccgcccucgcc

SEQ ID NO: 2411075 - RNA, 23 nt, Bordetella pertussis
agccgccgcgauugcagguggcc

SEQ ID NO: 2411076 - RNA, 13 nt, Bordetella pertussis
agccgccggcgcg

SEQ ID NO: 2411077 - RNA, 12 nt, Bordetella pertussis
agccgccgucga

SEQ ID NO: 2411078 - RNA, 18 nt, Bordetella pertussis
agccgccuggcgcggcgc

SEQ ID NO: 2411079 - RNA, 19 nt, Bordetella pertussis
agccgccuggcgcggcgcc

SEQ ID NO: 2411080 - RNA, 13 nt, Bordetella pertussis
agccgcgccagcg

SEQ ID NO: 2411081 - RNA, 20 nt, Bordetella pertussis
agccgcgccagcgccuccau

SEQ ID NO: 2411082 - RNA, 14 nt, Bordetella pertussis
agccgcgccagggc

SEQ ID NO: 2411083 - RNA, 15 nt, Bordetella pertussis
agccgcgccugcagc

SEQ ID NO: 2411084 - RNA, 16 nt, Bordetella pertussis
agccgcgccugcagca

SEQ ID NO: 2411085 - RNA, 17 nt, Bordetella pertussis
agccgcgccugcagcag

SEQ ID NO: 2411086 - RNA, 20 nt, Bordetella pertussis
agccgcgccugcagcagcgg

SEQ ID NO: 2411087 - RNA, 17 nt, Bordetella pertussis
agccgcgcgaccuuguc

SEQ ID NO: 2411088 - RNA, 19 nt, Bordetella pertussis
agccgcgcgcaugcgccuu

SEQ ID NO: 2411089 - RNA, 14 nt, Bordetella pertussis
agccgcgcgccugc

SEQ ID NO: 2411090 - RNA, 17 nt, Bordetella pertussis
agccgcgcgccugcagc

SEQ ID NO: 2411091 - RNA, 19 nt, Bordetella pertussis
agccgcgcgccugcagcag

SEQ ID NO: 2411092 - RNA, 21 nt, Bordetella pertussis
agccgcgcgccugcagcagcg

SEQ ID NO: 2411093 - RNA, 24 nt, Bordetella pertussis
agccgcgcgccugcagcagcgugg

SEQ ID NO: 2411094 - RNA, 20 nt, Bordetella pertussis
agccgcgcgcggccggcgcg

SEQ ID NO: 2411095 - RNA, 13 nt, Bordetella pertussis
agccgcggcgccg

SEQ ID NO: 2411096 - RNA, 20 nt, Bordetella pertussis
agccgcggcgguuucggccg

SEQ ID NO: 2411097 - RNA, 18 nt, Bordetella pertussis
agccgcuaugacgaccgc

SEQ ID NO: 2411098 - RNA, 22 nt, Bordetella pertussis
agccgcuaugacgaccgcuacc

SEQ ID NO: 2411099 - RNA, 22 nt, Bordetella pertussis
agccgcucagguagaccacgcg

SEQ ID NO: 2411100 - RNA, 19 nt, Bordetella pertussis
agccgcuccagccaccacu

SEQ ID NO: 2411101 - RNA, 15 nt, Bordetella pertussis
agccgcucgcgcgac

SEQ ID NO: 2411102 - RNA, 18 nt, Bordetella pertussis
agccgcucgcgcgaccac

SEQ ID NO: 2411103 - RNA, 23 nt, Bordetella pertussis
agccgcucgcgcgaccacuggca

SEQ ID NO: 2411104 - RNA, 15 nt, Bordetella pertussis
agccgcucggccacg

SEQ ID NO: 2411105 - RNA, 18 nt, Bordetella pertussis
agccgcugcagcacgcac

SEQ ID NO: 2411106 - RNA, 14 nt, Bordetella pertussis
agccgcugcgcgcg

SEQ ID NO: 2411107 - RNA, 18 nt, Bordetella pertussis
agccgcugcgcgcggccu

SEQ ID NO: 2411108 - RNA, 20 nt, Bordetella pertussis
agccgcugcgcgcggccugg

SEQ ID NO: 2411109 - RNA, 21 nt, Bordetella pertussis
agccgcugcgcgcggccuggc

SEQ ID NO: 2411110 - RNA, 22 nt, Bordetella pertussis
agccgcugcgcgcggccuggcg

SEQ ID NO: 2411111 - RNA, 20 nt, Bordetella pertussis
agccgcugcgcuggccgcga

SEQ ID NO: 2411112 - RNA, 22 nt, Bordetella pertussis
agccgcuggcgaucaggccgcc

SEQ ID NO: 2411113 - RNA, 15 nt, Bordetella pertussis
agccgcuggcgcgcc

SEQ ID NO: 2411114 - RNA, 19 nt, Bordetella pertussis
agccgcuggcgcgccgccu

SEQ ID NO: 2411115 - RNA, 19 nt, Bordetella pertussis
agccgcugucgcaggcgcu

SEQ ID NO: 2411116 - RNA, 14 nt, Bordetella pertussis
agccgcuugcccgu

SEQ ID NO: 2411117 - RNA, 23 nt, Bordetella pertussis
agccggaauccuggcgacggccu

SEQ ID NO: 2411118 - RNA, 15 nt, Bordetella pertussis
agccggaaugcacca

SEQ ID NO: 2411119 - RNA, 21 nt, Bordetella pertussis
agccggaaugcaccacggcca

SEQ ID NO: 2411120 - RNA, 22 nt, Bordetella pertussis
agccggacccgcgccgcaggcc

SEQ ID NO: 2411121 - RNA, 15 nt, Bordetella pertussis
agccggacucgucca

SEQ ID NO: 2411122 - RNA, 14 nt, Bordetella pertussis
agcgaacagggcgc

SEQ ID NO: 2411123 - RNA, 18 nt, Bordetella pertussis
agcgaacggcccacgcug

SEQ ID NO: 2411124 - RNA, 19 nt, Bordetella pertussis
agcgaacggcccacgcugu

SEQ ID NO: 2411125 - RNA, 13 nt, Bordetella pertussis
agcgaaggggcgc

SEQ ID NO: 2411126 - RNA, 15 nt, Bordetella pertussis
agcgaaggggcgcau

SEQ ID NO: 2411127 - RNA, 14 nt, Bordetella pertussis
agcgaaucgcccuu

SEQ ID NO: 2411128 - RNA, 19 nt, Bordetella pertussis
agcgacaacaggucguggc

SEQ ID NO: 2411129 - RNA, 16 nt, Bordetella pertussis
agcgacacccgcggcc

SEQ ID NO: 2411130 - RNA, 21 nt, Bordetella pertussis
agcgacagcagggucggcccc

SEQ ID NO: 2411131 - RNA, 13 nt, Bordetella pertussis
agcgacaucgugc

SEQ ID NO: 2411132 - RNA, 15 nt, Bordetella pertussis
agcgacaucgugcug

SEQ ID NO: 2411133 - RNA, 21 nt, Bordetella pertussis
agcgacccgcaaaaccgggcc

SEQ ID NO: 2411134 - RNA, 17 nt, Bordetella pertussis
agcgacgcgcgccggcg

SEQ ID NO: 2411135 - RNA, 23 nt, Bordetella pertussis
agcgacgcgcgccggcgcucgcg

SEQ ID NO: 2411136 - RNA, 21 nt, Bordetella pertussis
agcgacggcagauggacaaga

SEQ ID NO: 2411137 - RNA, 14 nt, Bordetella pertussis
agcgacuccggccg

SEQ ID NO: 2411138 - RNA, 18 nt, Bordetella pertussis
agcgacucgaacaccggc

SEQ ID NO: 2411139 - RNA, 19 nt, Bordetella pertussis
agcgacucgaacaccggcu

SEQ ID NO: 2411140 - RNA, 22 nt, Bordetella pertussis
agcgacuugucgcgcccgaagc

SEQ ID NO: 2411141 - RNA, 14 nt, Bordetella pertussis
agcgagagcgccac

SEQ ID NO: 2411142 - RNA, 14 nt, Bordetella pertussis
agcgagaucagcac

SEQ ID NO: 2411143 - RNA, 13 nt, Bordetella pertussis
agcgagccggcca

SEQ ID NO: 2411144 - RNA, 20 nt, Bordetella pertussis
agcgagccggccagcgccac

SEQ ID NO: 2411145 - RNA, 14 nt, Bordetella pertussis
agcgagcggggcug

SEQ ID NO: 2411146 - RNA, 17 nt, Bordetella pertussis
agcgaggcaucgaaggc

SEQ ID NO: 2411147 - RNA, 16 nt, Bordetella pertussis
agcgaggcggcaagcg

SEQ ID NO: 2411148 - RNA, 16 nt, Bordetella pertussis
agcgaguagacgcagc

SEQ ID NO: 2411149 - RNA, 22 nt, Bordetella pertussis
agcgaguagacgcagccgcagu

SEQ ID NO: 2411150 - RNA, 16 nt, Bordetella pertussis
agcgagucgaccaguu

SEQ ID NO: 2411151 - RNA, 12 nt, Bordetella pertussis
agcgagugcgcc

SEQ ID NO: 2411152 - RNA, 22 nt, Bordetella pertussis
agcgauacccgcuucgacggcu

SEQ ID NO: 2411153 - RNA, 17 nt, Bordetella pertussis
agcgauccgaugcccgg

SEQ ID NO: 2411154 - RNA, 12 nt, Bordetella pertussis
agcgaugcccug

SEQ ID NO: 2411155 - RNA, 15 nt, Bordetella pertussis
agcgaugcccuggau

SEQ ID NO: 2411156 - RNA, 19 nt, Bordetella pertussis
agcgauuucuucugcgcgu

SEQ ID NO: 2411157 - RNA, 16 nt, Bordetella pertussis
agcgcaaaacgcauga

SEQ ID NO: 2411158 - RNA, 13 nt, Bordetella pertussis
agcgcaagcaccg

SEQ ID NO: 2411159 - RNA, 15 nt, Bordetella pertussis
agcgcaagcaccgcc

SEQ ID NO: 2411160 - RNA, 19 nt, Bordetella pertussis
agcgcaagcaccgccugcu

SEQ ID NO: 2411161 - RNA, 14 nt, Bordetella pertussis
agcgcaagcccagg

SEQ ID NO: 2411162 - RNA, 20 nt, Bordetella pertussis
agcgcaagcccaggcggccc

SEQ ID NO: 2411163 - RNA, 18 nt, Bordetella pertussis
agcgcaaggguuguggcc

SEQ ID NO: 2411164 - RNA, 15 nt, Bordetella pertussis
agcgcaauggacaca

SEQ ID NO: 2411165 - RNA, 21 nt, Bordetella pertussis
agcgcaauggacacagcggcg

SEQ ID NO: 2411166 - RNA, 15 nt, Bordetella pertussis
agcgcacaggcggcg

SEQ ID NO: 2411167 - RNA, 18 nt, Bordetella pertussis
agcgcacaggcggcgccg

SEQ ID NO: 2411168 - RNA, 20 nt, Bordetella pertussis
agcgcaccaccagcaccgcc

SEQ ID NO: 2411169 - RNA, 21 nt, Bordetella pertussis
agcgcaccaguuucucggcca

SEQ ID NO: 2411170 - RNA, 22 nt, Bordetella pertussis
agcgcaccaguuucucggccac

SEQ ID NO: 2411171 - RNA, 14 nt, Bordetella pertussis
agcgcaccauggcg

SEQ ID NO: 2411172 - RNA, 17 nt, Bordetella pertussis
agcgcaccccggccgac

SEQ ID NO: 2411173 - RNA, 16 nt, Bordetella pertussis
agcgcaccgacggcag

SEQ ID NO: 2411174 - RNA, 21 nt, Bordetella pertussis
agcgcacgcaccgcgccagcg

SEQ ID NO: 2411175 - RNA, 17 nt, Bordetella pertussis
agcgcacgcagcgcuca

SEQ ID NO: 2411176 - RNA, 14 nt, Bordetella pertussis
agcgcacgcgcagc

SEQ ID NO: 2411177 - RNA, 18 nt, Bordetella pertussis
agcgcacgcgcagcacgc

SEQ ID NO: 2411178 - RNA, 14 nt, Bordetella pertussis
agcgcacgcugggc

SEQ ID NO: 2411179 - RNA, 20 nt, Bordetella pertussis
agcgcacgcugggcuacgac

SEQ ID NO: 2411180 - RNA, 15 nt, Bordetella pertussis
agcgcacgguccagg

SEQ ID NO: 2411181 - RNA, 20 nt, Bordetella pertussis
agcgcacgguccaggcggcc

SEQ ID NO: 2411182 - RNA, 18 nt, Bordetella pertussis
agcgcacugagaaaggcc

SEQ ID NO: 2411183 - RNA, 11 nt, Bordetella pertussis
agcgcacugau

SEQ ID NO: 2411184 - RNA, 18 nt, Bordetella pertussis
agcgcacugaucgccgcc

SEQ ID NO: 2411185 - RNA, 19 nt, Bordetella pertussis
agcgcagcaagcugcugcu

SEQ ID NO: 2411186 - RNA, 14 nt, Bordetella pertussis
agcgcagcaccagg

SEQ ID NO: 2411187 - RNA, 15 nt, Bordetella pertussis
agcgcagcaccggca

SEQ ID NO: 2411188 - RNA, 20 nt, Bordetella pertussis
agcgcagcaccggcagaugg

SEQ ID NO: 2411189 - RNA, 15 nt, Bordetella pertussis
agcgcagccacggga

SEQ ID NO: 2411190 - RNA, 14 nt, Bordetella pertussis
agcgcagccccguu

SEQ ID NO: 2411191 - RNA, 18 nt, Bordetella pertussis
agcgcagccgcuccagcc

SEQ ID NO: 2411192 - RNA, 21 nt, Bordetella pertussis
agcgcagccgcuccagccacc

SEQ ID NO: 2411193 - RNA, 14 nt, Bordetella pertussis
agcgcagcgccacg

SEQ ID NO: 2411194 - RNA, 12 nt, Bordetella pertussis
agcgcaggaugg

SEQ ID NO: 2411195 - RNA, 22 nt, Bordetella pertussis
agcgcaggaugggcagcucgcc

SEQ ID NO: 2411196 - RNA, 15 nt, Bordetella pertussis
agcgcaggcgcuuga

SEQ ID NO: 2411197 - RNA, 20 nt, Bordetella pertussis
agcgcagguucaucgagaac

SEQ ID NO: 2411198 - RNA, 17 nt, Bordetella pertussis
agcgcauagacccacag

SEQ ID NO: 2411199 - RNA, 15 nt, Bordetella pertussis
agcgcauaggacgcc

SEQ ID NO: 2411200 - RNA, 20 nt, Bordetella pertussis
agcgcauaggacgccaccag

SEQ ID NO: 2411201 - RNA, 21 nt, Bordetella pertussis
agcgcauaggacgccaccagu

SEQ ID NO: 2411202 - RNA, 17 nt, Bordetella pertussis
agcgcaucgagcuccug

SEQ ID NO: 2411203 - RNA, 22 nt, Bordetella pertussis
agcgcaucgagcuccugcagga

SEQ ID NO: 2411204 - RNA, 15 nt, Bordetella pertussis
agcgcaucgccgcag

SEQ ID NO: 2411205 - RNA, 17 nt, Bordetella pertussis
agcgcaucgccgcaggc

SEQ ID NO: 2411206 - RNA, 24 nt, Bordetella pertussis
agcgcaucgccgcaggcgugcccu

SEQ ID NO: 2411207 - RNA, 17 nt, Bordetella pertussis
agcgcaucgcgcgcgcc

SEQ ID NO: 2411208 - RNA, 18 nt, Bordetella pertussis
agcgcaugaugcugccgg

SEQ ID NO: 2411209 - RNA, 20 nt, Bordetella pertussis
agcgcaugccgucgagcgcg

SEQ ID NO: 2411210 - RNA, 17 nt, Bordetella pertussis
agcgcaugucgaagcag

SEQ ID NO: 2411211 - RNA, 14 nt, Bordetella pertussis
agcgccacagcgcc

SEQ ID NO: 2411212 - RNA, 23 nt, Bordetella pertussis
agcgccaccaccggcacgccggc

SEQ ID NO: 2411213 - RNA, 13 nt, Bordetella pertussis
agcgccaccagca

SEQ ID NO: 2411214 - RNA, 16 nt, Bordetella pertussis
agcgccaccagcagcg

SEQ ID NO: 2411215 - RNA, 14 nt, Bordetella pertussis
agcgccacgccagc

SEQ ID NO: 2411216 - RNA, 15 nt, Bordetella pertussis
agcgccacgccagcg

SEQ ID NO: 2411217 - RNA, 20 nt, Bordetella pertussis
agcgccacgccagcggcgag

SEQ ID NO: 2411218 - RNA, 14 nt, Bordetella pertussis
agcgccacgcccag

SEQ ID NO: 2411219 - RNA, 20 nt, Bordetella pertussis
agcgccacgcccaggccgcu

SEQ ID NO: 2411220 - RNA, 12 nt, Bordetella pertussis
agcgccacgccg

SEQ ID NO: 2411221 - RNA, 14 nt, Bordetella pertussis
agcgccacgccggc

SEQ ID NO: 2411222 - RNA, 13 nt, Bordetella pertussis
agcgccacgccgu

SEQ ID NO: 2411223 - RNA, 21 nt, Bordetella pertussis
agcgccacgcgagcccgcguc

SEQ ID NO: 2411224 - RNA, 16 nt, Bordetella pertussis
agcgccacggcgguga

SEQ ID NO: 2411225 - RNA, 20 nt, Bordetella pertussis
agcgccagaaagcgcggccg

SEQ ID NO: 2411226 - RNA, 17 nt, Bordetella pertussis
agcgccagcaccggcac

SEQ ID NO: 2411227 - RNA, 18 nt, Bordetella pertussis
agcgccagcaccggcacg

SEQ ID NO: 2411228 - RNA, 24 nt, Bordetella pertussis
agcgccagcaccggcacgcgccag

SEQ ID NO: 2411229 - RNA, 22 nt, Bordetella pertussis
agcgccagcacgaucacgaaca

SEQ ID NO: 2411230 - RNA, 14 nt, Bordetella pertussis
agcgccagcagcag

SEQ ID NO: 2411231 - RNA, 14 nt, Bordetella pertussis
agcgccagcagggu

SEQ ID NO: 2411232 - RNA, 13 nt, Bordetella pertussis
agcgccagcguca

SEQ ID NO: 2411233 - RNA, 15 nt, Bordetella pertussis
agcgccagcguggcc

SEQ ID NO: 2411234 - RNA, 17 nt, Bordetella pertussis
agcgccagcguggccga

SEQ ID NO: 2411235 - RNA, 21 nt, Bordetella pertussis
agcgccagcguucggccaccc

SEQ ID NO: 2411236 - RNA, 16 nt, Bordetella pertussis
agcgcgaugccaucgc

SEQ ID NO: 2411237 - RNA, 19 nt, Bordetella pertussis
agcgcgaugucgcccaugc

SEQ ID NO: 2411238 - RNA, 20 nt, Bordetella pertussis
agcgcgauucccuggcgcgc

SEQ ID NO: 2411239 - RNA, 21 nt, Bordetella pertussis
agcgcgauucccuggcgcgcc

SEQ ID NO: 2411240 - RNA, 23 nt, Bordetella pertussis
agcgcgauucccuggcgcgccag

SEQ ID NO: 2411241 - RNA, 15 nt, Bordetella pertussis
agcgcgcaacuccag

SEQ ID NO: 2411242 - RNA, 19 nt, Bordetella pertussis
agcgcgcaacuccagcaua

SEQ ID NO: 2411243 - RNA, 21 nt, Bordetella pertussis
agcgcgcacaaacgcacgauu

SEQ ID NO: 2411244 - RNA, 20 nt, Bordetella pertussis
agcgcgcaggacaaggcgcg

SEQ ID NO: 2411245 - RNA, 14 nt, Bordetella pertussis
agcgcgccagcagc

SEQ ID NO: 2411246 - RNA, 15 nt, Bordetella pertussis
agcgcgccagcagcg

SEQ ID NO: 2411247 - RNA, 17 nt, Bordetella pertussis
agcgcgccagcgcgcga

SEQ ID NO: 2411248 - RNA, 16 nt, Bordetella pertussis
agcgcgccaggcgcau

SEQ ID NO: 2411249 - RNA, 19 nt, Bordetella pertussis
agcgcgcccgaggcgcgca

SEQ ID NO: 2411250 - RNA, 19 nt, Bordetella pertussis
agcgcgcccgcuuccuugg

SEQ ID NO: 2411251 - RNA, 20 nt, Bordetella pertussis
agcgcgcccgcuuccuuggg

SEQ ID NO: 2411252 - RNA, 21 nt, Bordetella pertussis
agcgcgcccgcuugggccgcg

SEQ ID NO: 2411253 - RNA, 23 nt, Bordetella pertussis
agcgcgcccucguugacgccgac

SEQ ID NO: 2411254 - RNA, 21 nt, Bordetella pertussis
agcgcgccgaggaucuggccg

SEQ ID NO: 2411255 - RNA, 17 nt, Bordetella pertussis
agcgcgccgaucaccac

SEQ ID NO: 2411256 - RNA, 11 nt, Bordetella pertussis
agcgcgccgcc

SEQ ID NO: 2411257 - RNA, 15 nt, Bordetella pertussis
agcgcgccgccagcg

SEQ ID NO: 2411258 - RNA, 14 nt, Bordetella pertussis
agcgcgccgcccac

SEQ ID NO: 2411259 - RNA, 22 nt, Bordetella pertussis
agcgcgccgcccaccaccagcg

SEQ ID NO: 2411260 - RNA, 14 nt, Bordetella pertussis
agcgcgccgccgau

SEQ ID NO: 2411261 - RNA, 13 nt, Bordetella pertussis
agcgcgccgccgu

SEQ ID NO: 2411262 - RNA, 13 nt, Bordetella pertussis
agcgcgccgcgcc

SEQ ID NO: 2411263 - RNA, 14 nt, Bordetella pertussis
agcgcgccgcgcgc

SEQ ID NO: 2411264 - RNA, 15 nt, Bordetella pertussis
agcgcgccgcgcgca

SEQ ID NO: 2411265 - RNA, 14 nt, Bordetella pertussis
agcgcgccggccag

SEQ ID NO: 2411266 - RNA, 16 nt, Bordetella pertussis
agcgcgccggccaggg

SEQ ID NO: 2411267 - RNA, 17 nt, Bordetella pertussis
agcgcgccggccagggc

SEQ ID NO: 2411268 - RNA, 13 nt, Bordetella pertussis
agcgcgccgggcg

SEQ ID NO: 2411269 - RNA, 22 nt, Bordetella pertussis
agcgcgccgggcgggucggcga

SEQ ID NO: 2411270 - RNA, 15 nt, Bordetella pertussis
agcgcgccgggggcg

SEQ ID NO: 2411271 - RNA, 22 nt, Bordetella pertussis
agcgcgccugcccaggccagcg

SEQ ID NO: 2411272 - RNA, 23 nt, Bordetella pertussis
agcgcgccugcccaggccagcgc

SEQ ID NO: 2411273 - RNA, 22 nt, Bordetella pertussis
agcgcgcgauagauggccaggu

SEQ ID NO: 2411274 - RNA, 18 nt, Bordetella pertussis
agcgcgcgaucgccagca

SEQ ID NO: 2411275 - RNA, 20 nt, Bordetella pertussis
agcgcgcgaucgccagcagg

SEQ ID NO: 2411276 - RNA, 22 nt, Bordetella pertussis
agcgcgcgaucgccagcaggcg

SEQ ID NO: 2411277 - RNA, 20 nt, Bordetella pertussis
agcgcgcgcagccgcgccaa

SEQ ID NO: 2411278 - RNA, 13 nt, Bordetella pertussis
agcgcgcgccagu

SEQ ID NO: 2411279 - RNA, 10 nt, Bordetella pertussis
agcgcgcgcg

SEQ ID NO: 2411280 - RNA, 22 nt, Bordetella pertussis
agcgcgcgcgaggcggcggccg

SEQ ID NO: 2411281 - RNA, 14 nt, Bordetella pertussis
agcgcgcgcgccga

SEQ ID NO: 2411282 - RNA, 15 nt, Bordetella pertussis
agcgcgcgcgccgac

SEQ ID NO: 2411283 - RNA, 18 nt, Bordetella pertussis
agcgcgcggccggccgcg

SEQ ID NO: 2411284 - RNA, 19 nt, Bordetella pertussis
agcgcgcggccggccgcgc

SEQ ID NO: 2411285 - RNA, 18 nt, Bordetella pertussis
agcgcgcgggcgauggcc

SEQ ID NO: 2411286 - RNA, 21 nt, Bordetella pertussis
agcgcgcgggcgauggccacg

SEQ ID NO: 2411287 - RNA, 23 nt, Bordetella pertussis
agcgcgcgggcgauggccacgcg

SEQ ID NO: 2411288 - RNA, 17 nt, Bordetella pertussis
agcgcgcggugccgccu

SEQ ID NO: 2411289 - RNA, 20 nt, Bordetella pertussis
agcgcgcguccugcgccagu

SEQ ID NO: 2411290 - RNA, 23 nt, Bordetella pertussis
agcgcgcgugcagguaggacggc

SEQ ID NO: 2411291 - RNA, 14 nt, Bordetella pertussis
agcgcgcucuugga

SEQ ID NO: 2411292 - RNA, 21 nt, Bordetella pertussis
agcgcggcauagcccaggccg

SEQ ID NO: 2411293 - RNA, 22 nt, Bordetella pertussis
agcgcggcauagcccaggccgc

SEQ ID NO: 2411294 - RNA, 14 nt, Bordetella pertussis
agcgcggcaucggc

SEQ ID NO: 2411295 - RNA, 18 nt, Bordetella pertussis
agcgcggcaucggccaug

SEQ ID NO: 2411296 - RNA, 20 nt, Bordetella pertussis
agcgcggcaugcgcaugcug

SEQ ID NO: 2411297 - RNA, 21 nt, Bordetella pertussis
agcgcggcaugcgcaugcugg

SEQ ID NO: 2411298 - RNA, 16 nt, Bordetella pertussis
agcgcggccacggccu

SEQ ID NO: 2411299 - RNA, 20 nt, Bordetella pertussis
agcgcggccacggccugccc

SEQ ID NO: 2411300 - RNA, 13 nt, Bordetella pertussis
agcgcggccagca

SEQ ID NO: 2411301 - RNA, 17 nt, Bordetella pertussis
agcgcggccagcaccgg

SEQ ID NO: 2411302 - RNA, 21 nt, Bordetella pertussis
agcgcggccagcaccggccgc

SEQ ID NO: 2411303 - RNA, 19 nt, Bordetella pertussis
agcgcggccagcgcgucga

SEQ ID NO: 2411304 - RNA, 17 nt, Bordetella pertussis
agcgcggccaggcgcgu

SEQ ID NO: 2411305 - RNA, 20 nt, Bordetella pertussis
agcgcggccaggucggcguc

SEQ ID NO: 2411306 - RNA, 22 nt, Bordetella pertussis
agcgcggccaggucggcgucgu

SEQ ID NO: 2411307 - RNA, 13 nt, Bordetella pertussis
agcgcggccggca

SEQ ID NO: 2411308 - RNA, 12 nt, Bordetella pertussis
agcgcggccucg

SEQ ID NO: 2411309 - RNA, 16 nt, Bordetella pertussis
agcgcggccucgccgg

SEQ ID NO: 2411310 - RNA, 19 nt, Bordetella pertussis
agcgcggccucgccggccu

SEQ ID NO: 2411311 - RNA, 21 nt, Bordetella pertussis
agcgcggccucgccggccugg

SEQ ID NO: 2411312 - RNA, 22 nt, Bordetella pertussis
agcgcggccucgccggccuggc

SEQ ID NO: 2411313 - RNA, 23 nt, Bordetella pertussis
agcgcggccucgccggccuggcg

SEQ ID NO: 2411314 - RNA, 13 nt, Bordetella pertussis
agcgcggccuuuu

SEQ ID NO: 2411315 - RNA, 16 nt, Bordetella pertussis
agcgcggcgaaggcgc

SEQ ID NO: 2411316 - RNA, 12 nt, Bordetella pertussis
agcgcggcgcac

SEQ ID NO: 2411317 - RNA, 21 nt, Bordetella pertussis
agcgcggcgcacagggcgucg

SEQ ID NO: 2411318 - RNA, 12 nt, Bordetella pertussis
agcgcggcgcca

SEQ ID NO: 2411319 - RNA, 13 nt, Bordetella pertussis
agcgcggcgccgg

SEQ ID NO: 2411320 - RNA, 15 nt, Bordetella pertussis
agcgcggcgccggcc

SEQ ID NO: 2411321 - RNA, 18 nt, Bordetella pertussis
agcgcggcgccggccguc

SEQ ID NO: 2411322 - RNA, 16 nt, Bordetella pertussis
agcgcggcgccggccu

SEQ ID NO: 2411323 - RNA, 17 nt, Bordetella pertussis
agcgcggcgccggccuc

SEQ ID NO: 2411324 - RNA, 14 nt, Bordetella pertussis
agcgcggcgcgcga

SEQ ID NO: 2411325 - RNA, 16 nt, Bordetella pertussis
agcgcggcgcggccag

SEQ ID NO: 2411326 - RNA, 19 nt, Bordetella pertussis
agcgcggcgcggccagcag

SEQ ID NO: 2411327 - RNA, 20 nt, Bordetella pertussis
agcgcggcgcggccagcagc

SEQ ID NO: 2411328 - RNA, 21 nt, Bordetella pertussis
agcgcggcgcggccagcagcg

SEQ ID NO: 2411329 - RNA, 13 nt, Bordetella pertussis
agcgcggcgcugg

SEQ ID NO: 2411330 - RNA, 17 nt, Bordetella pertussis
agcgcggcggacugcgc

SEQ ID NO: 2411331 - RNA, 19 nt, Bordetella pertussis
agcgcggcggacugcgccg

SEQ ID NO: 2411332 - RNA, 15 nt, Bordetella pertussis
agcgcggcggcagcg

SEQ ID NO: 2411333 - RNA, 18 nt, Bordetella pertussis
agcgcggcggccaugccc

SEQ ID NO: 2411334 - RNA, 13 nt, Bordetella pertussis
agcgcggcggcga

SEQ ID NO: 2411335 - RNA, 15 nt, Bordetella pertussis
agcgcggcggcgacc

SEQ ID NO: 2411336 - RNA, 21 nt, Bordetella pertussis
agcgcggcggcgaccggcgcc

SEQ ID NO: 2411337 - RNA, 18 nt, Bordetella pertussis
agcgcggcgggcggcgcg

SEQ ID NO: 2411338 - RNA, 19 nt, Bordetella pertussis
agcgcggcgggcggcgcgg

SEQ ID NO: 2411339 - RNA, 14 nt, Bordetella pertussis
agcgcggcgggugc

SEQ ID NO: 2411340 - RNA, 14 nt, Bordetella pertussis
agcgcggcugcggg

SEQ ID NO: 2411341 - RNA, 22 nt, Bordetella pertussis
agcgcggcugcgggccggcgcc

SEQ ID NO: 2411342 - RNA, 13 nt, Bordetella pertussis
agcgcggcuuggu

SEQ ID NO: 2411343 - RNA, 13 nt, Bordetella pertussis
agcgcgggccgcc

SEQ ID NO: 2411344 - RNA, 22 nt, Bordetella pertussis
agcgcgggccgccgcacagcgu

SEQ ID NO: 2411345 - RNA, 19 nt, Bordetella pertussis
agcgcgguggccagcgaac

SEQ ID NO: 2411346 - RNA, 14 nt, Bordetella pertussis
agcgcgucacgcug

SEQ ID NO: 2411347 - RNA, 13 nt, Bordetella pertussis
agcgcguccaggu

SEQ ID NO: 2411348 - RNA, 14 nt, Bordetella pertussis
agcgcguccaggug

SEQ ID NO: 2411349 - RNA, 22 nt, Bordetella pertussis
acacgccgauugaggccagcac

SEQ ID NO: 2411350 - RNA, 19 nt, Bordetella pertussis
acacgccgcgcgaucgccg

SEQ ID NO: 2411351 - RNA, 12 nt, Bordetella pertussis
acacgcgcgccg

SEQ ID NO: 2411352 - RNA, 18 nt, Bordetella pertussis
acacgcgcgccgcgggcu

SEQ ID NO: 2411353 - RNA, 22 nt, Bordetella pertussis
acacgcgcugggcguggcgcgc

SEQ ID NO: 2411354 - RNA, 23 nt, Bordetella pertussis
acacgcgcugggcguggcgcgcg

SEQ ID NO: 2411355 - RNA, 21 nt, Bordetella pertussis
acacgcgguagguagcgcgca

SEQ ID NO: 2411356 - RNA, 20 nt, Bordetella pertussis
acacgcggugcaucucggca

SEQ ID NO: 2411357 - RNA, 17 nt, Bordetella pertussis
acacgcuggacgacgug

SEQ ID NO: 2411358 - RNA, 19 nt, Bordetella pertussis
acacgcuuugcgucuccac

SEQ ID NO: 2411359 - RNA, 20 nt, Bordetella pertussis
acacggcgcgggcggucggc

SEQ ID NO: 2411360 - RNA, 21 nt, Bordetella pertussis
acacggcgcgggcggucggcg

SEQ ID NO: 2411361 - RNA, 21 nt, Bordetella pertussis
acacggucaaccacgccaagg

SEQ ID NO: 2411362 - RNA, 22 nt, Bordetella pertussis
acacggucagcaaccccagcag

SEQ ID NO: 2411363 - RNA, 14 nt, Bordetella pertussis
acacguacaaccgc

SEQ ID NO: 2411364 - RNA, 18 nt, Bordetella pertussis
acacguccagcgccgcgc

SEQ ID NO: 2411365 - RNA, 15 nt, Bordetella pertussis
acacuggcccuggca

SEQ ID NO: 2411366 - RNA, 17 nt, Bordetella pertussis
acacuuggccggcgauu

SEQ ID NO: 2411367 - RNA, 21 nt, Bordetella pertussis
acagauacuguucgccgcacc

SEQ ID NO: 2411368 - RNA, 17 nt, Bordetella pertussis
acagauccagcgcggcc

SEQ ID NO: 2411369 - RNA, 23 nt, Bordetella pertussis
acagaugggcggccuagcuguga

SEQ ID NO: 2411370 - RNA, 18 nt, Bordetella pertussis
acagauugaacugcugga

SEQ ID NO: 2411371 - RNA, 17 nt, Bordetella pertussis
acagcaaggacaaggcg

SEQ ID NO: 2411372 - RNA, 19 nt, Bordetella pertussis
acagcaaggacaaggcgcg

SEQ ID NO: 2411373 - RNA, 21 nt, Bordetella pertussis
acagcaagggcgucuucgccg

SEQ ID NO: 2411374 - RNA, 17 nt, Bordetella pertussis
acagcacauggcgcgcc

SEQ ID NO: 2411375 - RNA, 15 nt, Bordetella pertussis
acagcaccagcaugc

SEQ ID NO: 2411376 - RNA, 14 nt, Bordetella pertussis
acagcacgcccgcc

SEQ ID NO: 2411377 - RNA, 21 nt, Bordetella pertussis
acagcacgcccgccagcagcu

SEQ ID NO: 2411378 - RNA, 13 nt, Bordetella pertussis
acagcacgugguc

SEQ ID NO: 2411379 - RNA, 21 nt, Bordetella pertussis
acagcacguggucgugcagga

SEQ ID NO: 2411380 - RNA, 12 nt, Bordetella pertussis
acagcagauggc

SEQ ID NO: 2411381 - RNA, 16 nt, Bordetella pertussis
acagcagcaugcggcc

SEQ ID NO: 2411382 - RNA, 18 nt, Bordetella pertussis
acagcagcccgcuggccg

SEQ ID NO: 2411383 - RNA, 17 nt, Bordetella pertussis
acagcagcgcgccgccg

SEQ ID NO: 2411384 - RNA, 23 nt, Bordetella pertussis
acagcagcgcgccgccgauguug

SEQ ID NO: 2411385 - RNA, 14 nt, Bordetella pertussis
acagcaggccgguc

SEQ ID NO: 2411386 - RNA, 20 nt, Bordetella pertussis
acagcaucagcggcagcacg

SEQ ID NO: 2411387 - RNA, 14 nt, Bordetella pertussis
acagcaucagcuug

SEQ ID NO: 2411388 - RNA, 16 nt, Bordetella pertussis
acagcaucuuggccgc

SEQ ID NO: 2411389 - RNA, 20 nt, Bordetella pertussis
acagcaucuuggccgccacg

SEQ ID NO: 2411390 - RNA, 22 nt, Bordetella pertussis
acagcaugaccucggccugcgg

SEQ ID NO: 2411391 - RNA, 15 nt, Bordetella pertussis
acagcauggccacca

SEQ ID NO: 2411392 - RNA, 16 nt, Bordetella pertussis
acagcauggcggcgcc

SEQ ID NO: 2411393 - RNA, 13 nt, Bordetella pertussis
acagccacgcgcg

SEQ ID NO: 2411394 - RNA, 15 nt, Bordetella pertussis
acagccacgcgcgau

SEQ ID NO: 2411395 - RNA, 20 nt, Bordetella pertussis
acagccacgcgcgauccgcg

SEQ ID NO: 2411396 - RNA, 22 nt, Bordetella pertussis
acagccacgcgcgauccgcgcc

SEQ ID NO: 2411397 - RNA, 16 nt, Bordetella pertussis
acagccaggccagcgc

SEQ ID NO: 2411398 - RNA, 17 nt, Bordetella pertussis
acagccagggcagggcg

SEQ ID NO: 2411399 - RNA, 14 nt, Bordetella pertussis
acagccccagcagc

SEQ ID NO: 2411400 - RNA, 15 nt, Bordetella pertussis
acagccccagcagca

SEQ ID NO: 2411401 - RNA, 21 nt, Bordetella pertussis
acagccccagcgccagcgugg

SEQ ID NO: 2411402 - RNA, 23 nt, Bordetella pertussis
acagcccgaacagaaggcgugcg

SEQ ID NO: 2411403 - RNA, 19 nt, Bordetella pertussis
acagcccgcgcuggcgcag

SEQ ID NO: 2411404 - RNA, 11 nt, Bordetella pertussis
acagcccggcc

SEQ ID NO: 2411405 - RNA, 19 nt, Bordetella pertussis
acagcccggcccccagccc

SEQ ID NO: 2411406 - RNA, 14 nt, Bordetella pertussis
acagccgccccagc

SEQ ID NO: 2411407 - RNA, 16 nt, Bordetella pertussis
acagccgccccagcag

SEQ ID NO: 2411408 - RNA, 20 nt, Bordetella pertussis
acagccgcgccagcgccucc

SEQ ID NO: 2411409 - RNA, 13 nt, Bordetella pertussis
acagccgcugcag

SEQ ID NO: 2411410 - RNA, 22 nt, Bordetella pertussis
acagccgcugcagaucaucggc

SEQ ID NO: 2411411 - RNA, 21 nt, Bordetella pertussis
acagccugcccugguggcaga

SEQ ID NO: 2411412 - RNA, 18 nt, Bordetella pertussis
acagccuggucagguugc

SEQ ID NO: 2411413 - RNA, 14 nt, Bordetella pertussis
acagcgaaggggcg

SEQ ID NO: 2411414 - RNA, 14 nt, Bordetella pertussis
acagcgacagccag

SEQ ID NO: 2411415 - RNA, 16 nt, Bordetella pertussis
acagcgccagcccgcu

SEQ ID NO: 2411416 - RNA, 19 nt, Bordetella pertussis
acagcgccagcccgcugcc

SEQ ID NO: 2411417 - RNA, 16 nt, Bordetella pertussis
agcggacgggccaggc

SEQ ID NO: 2411418 - RNA, 17 nt, Bordetella pertussis
agcggacgggccaggcc

SEQ ID NO: 2411419 - RNA, 14 nt, Bordetella pertussis
agcggagccgcgca

SEQ ID NO: 2411420 - RNA, 16 nt, Bordetella pertussis
agcggagccgcgcaca

SEQ ID NO: 2411421 - RNA, 16 nt, Bordetella pertussis
agcggaucgccgggca

SEQ ID NO: 2411422 - RNA, 18 nt, Bordetella pertussis
agcggaucgccgguagcg

SEQ ID NO: 2411423 - RNA, 15 nt, Bordetella pertussis
agcggaucgcggcgc

SEQ ID NO: 2411424 - RNA, 16 nt, Bordetella pertussis
agcggaucgcggcgcg

SEQ ID NO: 2411425 - RNA, 15 nt, Bordetella pertussis
agcggaugcgccgcc

SEQ ID NO: 2411426 - RNA, 17 nt, Bordetella pertussis
agcggauguccggcgcg

SEQ ID NO: 2411427 - RNA, 22 nt, Bordetella pertussis
agcggcaaaguagugcccccac

SEQ ID NO: 2411428 - RNA, 16 nt, Bordetella pertussis
agcggcacgacgucgu

SEQ ID NO: 2411429 - RNA, 14 nt, Bordetella pertussis
agcggcacgccggc

SEQ ID NO: 2411430 - RNA, 19 nt, Bordetella pertussis
agcggcacgccggcggccc

SEQ ID NO: 2411431 - RNA, 18 nt, Bordetella pertussis
agcggcagcacgauggcg

SEQ ID NO: 2411432 - RNA, 17 nt, Bordetella pertussis
agcggcagcagcagcgc

SEQ ID NO: 2411433 - RNA, 19 nt, Bordetella pertussis
agcggcagcagcagcgcgg

SEQ ID NO: 2411434 - RNA, 13 nt, Bordetella pertussis
agcggcagcgcac

SEQ ID NO: 2411435 - RNA, 14 nt, Bordetella pertussis
agcggcagcgcacc

SEQ ID NO: 2411436 - RNA, 23 nt, Bordetella pertussis
agcggcagcgcaccgucgccagg

SEQ ID NO: 2411437 - RNA, 13 nt, Bordetella pertussis
agcggcagcgcgc

SEQ ID NO: 2411438 - RNA, 15 nt, Bordetella pertussis
agcggcagcgcgcag

SEQ ID NO: 2411439 - RNA, 15 nt, Bordetella pertussis
agcggcagcucggcg

SEQ ID NO: 2411440 - RNA, 16 nt, Bordetella pertussis
agcggcaggcccagcu

SEQ ID NO: 2411441 - RNA, 13 nt, Bordetella pertussis
agcggcaggcggc

SEQ ID NO: 2411442 - RNA, 14 nt, Bordetella pertussis
agcggcaggcggcu

SEQ ID NO: 2411443 - RNA, 16 nt, Bordetella pertussis
agcggcaggcggcuga

SEQ ID NO: 2411444 - RNA, 14 nt, Bordetella pertussis
agcggcaggcuggc

SEQ ID NO: 2411445 - RNA, 16 nt, Bordetella pertussis
agcggcaggcuggccg

SEQ ID NO: 2411446 - RNA, 16 nt, Bordetella pertussis
agcggcaggucgggua

SEQ ID NO: 2411447 - RNA, 19 nt, Bordetella pertussis
agcggcauugcccagguug

SEQ ID NO: 2411448 - RNA, 17 nt, Bordetella pertussis
agcggccagcaagcgcg

SEQ ID NO: 2411449 - RNA, 17 nt, Bordetella pertussis
agcggccagccugccgc

SEQ ID NO: 2411450 - RNA, 18 nt, Bordetella pertussis
agcggccagccugccgcg

SEQ ID NO: 2411451 - RNA, 14 nt, Bordetella pertussis
agcggccagcgcgg

SEQ ID NO: 2411452 - RNA, 15 nt, Bordetella pertussis
agcggccagcgcggc

SEQ ID NO: 2411453 - RNA, 20 nt, Bordetella pertussis
agcggccagcgcggcggcag

SEQ ID NO: 2411454 - RNA, 20 nt, Bordetella pertussis
agcggccccagucgcugcuc

SEQ ID NO: 2411455 - RNA, 12 nt, Bordetella pertussis
agcggccgccca

SEQ ID NO: 2411456 - RNA, 16 nt, Bordetella pertussis
agcggccgcugccgcg

SEQ ID NO: 2411457 - RNA, 22 nt, Bordetella pertussis
agcggccgcugccgcgcgccgg

SEQ ID NO: 2411458 - RNA, 12 nt, Bordetella pertussis
agcggccggccc

SEQ ID NO: 2411459 - RNA, 12 nt, Bordetella pertussis
agcggccggccu

SEQ ID NO: 2411460 - RNA, 14 nt, Bordetella pertussis
agcggccggccugc

SEQ ID NO: 2411461 - RNA, 13 nt, Bordetella pertussis
agcggccggcgcg

SEQ ID NO: 2411462 - RNA, 16 nt, Bordetella pertussis
agcggccggcgcgcgc

SEQ ID NO: 2411463 - RNA, 15 nt, Bordetella pertussis
agcggccgucgccuu

SEQ ID NO: 2411464 - RNA, 13 nt, Bordetella pertussis
agcggccuggccc

SEQ ID NO: 2411465 - RNA, 14 nt, Bordetella pertussis
agcggcgacggcgc

SEQ ID NO: 2411466 - RNA, 16 nt, Bordetella pertussis
agcggcgacggcgccu

SEQ ID NO: 2411467 - RNA, 13 nt, Bordetella pertussis
agcggcgagcgcg

SEQ ID NO: 2411468 - RNA, 15 nt, Bordetella pertussis
agcggcgagcgcggc

SEQ ID NO: 2411469 - RNA, 12 nt, Bordetella pertussis
agcggcgauccg

SEQ ID NO: 2411470 - RNA, 19 nt, Bordetella pertussis
agcggcgcaacccggccuc

SEQ ID NO: 2411471 - RNA, 17 nt, Bordetella pertussis
agcggcgcagccggccg

SEQ ID NO: 2411472 - RNA, 12 nt, Bordetella pertussis
agcggcgccagu

SEQ ID NO: 2411473 - RNA, 12 nt, Bordetella pertussis
agcggcgccgcu

SEQ ID NO: 2411474 - RNA, 21 nt, Bordetella pertussis
agcggcgccgcuuccggcaug

SEQ ID NO: 2411475 - RNA, 21 nt, Bordetella pertussis
agcggcgccggaucggccggc

SEQ ID NO: 2411476 - RNA, 19 nt, Bordetella pertussis
agcggcgcgacgcgcuuga

SEQ ID NO: 2411477 - RNA, 15 nt, Bordetella pertussis
agcggcgcgagcgca

SEQ ID NO: 2411478 - RNA, 16 nt, Bordetella pertussis
agcggcgcgagcgcac

SEQ ID NO: 2411479 - RNA, 17 nt, Bordetella pertussis
agcggcgcgagcgcaca

SEQ ID NO: 2411480 - RNA, 23 nt, Bordetella pertussis
agcggcgcgcccaccagggugcc

SEQ ID NO: 2411481 - RNA, 18 nt, Bordetella pertussis
agcggcgcuuaccgcgcc

SEQ ID NO: 2411482 - RNA, 16 nt, Bordetella pertussis
agcggcggcacggugg

SEQ ID NO: 2411483 - RNA, 14 nt, Bordetella pertussis
agcggcggcgcggu

SEQ ID NO: 2411484 - RNA, 12 nt, Bordetella pertussis
agcggcgucgcg

SEQ ID NO: 2411485 - RNA, 22 nt, Bordetella pertussis
agcggcgugaugcccaggcccu

SEQ ID NO: 2411486 - RNA, 20 nt, Bordetella pertussis
agcggcgugcggcccagccg

SEQ ID NO: 2411487 - RNA, 16 nt, Bordetella pertussis
agcggcguggcgccga

SEQ ID NO: 2411488 - RNA, 17 nt, Bordetella pertussis
agcggcguggcggccag

SEQ ID NO: 2411489 - RNA, 18 nt, Bordetella pertussis
agcggcguggcggccagg

SEQ ID NO: 2411490 - RNA, 19 nt, Bordetella pertussis
agcggcguggcggccaggc

SEQ ID NO: 2411491 - RNA, 17 nt, Bordetella pertussis
agcggcguggggccggc

SEQ ID NO: 2411492 - RNA, 19 nt, Bordetella pertussis
agcggcguggggccggccg

SEQ ID NO: 2411493 - RNA, 20 nt, Bordetella pertussis
agcggcguggggccggccgc

SEQ ID NO: 2411494 - RNA, 22 nt, Bordetella pertussis
agcggcguggggccggccgcgc

SEQ ID NO: 2411495 - RNA, 23 nt, Bordetella pertussis
agcggcgugugcccagcaccagg

SEQ ID NO: 2411496 - RNA, 17 nt, Bordetella pertussis
agcggcguucugcagcg

SEQ ID NO: 2411497 - RNA, 17 nt, Bordetella pertussis
agcggcucaggcgcgga

SEQ ID NO: 2411498 - RNA, 21 nt, Bordetella pertussis
agcggcuccccuggucagggc

SEQ ID NO: 2411499 - RNA, 23 nt, Bordetella pertussis
agcggcuccccuggucagggcug

SEQ ID NO: 2411500 - RNA, 17 nt, Bordetella pertussis
agcggcucgacgccgua

SEQ ID NO: 2411501 - RNA, 20 nt, Bordetella pertussis
agcggcucgagcggcagcag

SEQ ID NO: 2411502 - RNA, 19 nt, Bordetella pertussis
agcggcucuggaucgugcc

SEQ ID NO: 2411503 - RNA, 22 nt, Bordetella pertussis
agcggcucuggaucgugcccag

SEQ ID NO: 2411504 - RNA, 23 nt, Bordetella pertussis
agcggcuggccacuggccgcgcu

SEQ ID NO: 2411505 - RNA, 15 nt, Bordetella pertussis
agcggcuggcgcacg

SEQ ID NO: 2411506 - RNA, 15 nt, Bordetella pertussis
agcggcuggcggugc

SEQ ID NO: 2411507 - RNA, 17 nt, Bordetella pertussis
agcggcuucaugccggc

SEQ ID NO: 2411508 - RNA, 16 nt, Bordetella pertussis
agcggcuucgagcgcg

SEQ ID NO: 2411509 - RNA, 22 nt, Bordetella pertussis
agcgggaauugggcgagcccag

SEQ ID NO: 2411510 - RNA, 23 nt, Bordetella pertussis
agcgggauggucgcggccgaggc

SEQ ID NO: 2411511 - RNA, 15 nt, Bordetella pertussis
agcgggcaugggccc

SEQ ID NO: 2411512 - RNA, 21 nt, Bordetella pertussis
agcgggccagcgcggccaggu

SEQ ID NO: 2411513 - RNA, 15 nt, Bordetella pertussis
agcgggcccgucgcg

SEQ ID NO: 2411514 - RNA, 17 nt, Bordetella pertussis
agcgggcccgucgcgcc

SEQ ID NO: 2411515 - RNA, 22 nt, Bordetella pertussis
agcgggcccgucgcgccaggcc

SEQ ID NO: 2411516 - RNA, 14 nt, Bordetella pertussis
agcgggccggcacc

SEQ ID NO: 2411517 - RNA, 18 nt, Bordetella pertussis
agcgggccggcaccacga

SEQ ID NO: 2411518 - RNA, 18 nt, Bordetella pertussis
agcgggccggucgcgauc

SEQ ID NO: 2411519 - RNA, 16 nt, Bordetella pertussis
agcgggccugcagcau

SEQ ID NO: 2411520 - RNA, 18 nt, Bordetella pertussis
agcgggccugcagcauga

SEQ ID NO: 2411521 - RNA, 23 nt, Bordetella pertussis
agcgggccugcagcaugaccgac

SEQ ID NO: 2411522 - RNA, 13 nt, Bordetella pertussis
agcgggcgccaga

SEQ ID NO: 2411523 - RNA, 13 nt, Bordetella pertussis
agcgggcggcggc

SEQ ID NO: 2411524 - RNA, 21 nt, Bordetella pertussis
agcgggcggcggcgcguucgc

SEQ ID NO: 2411525 - RNA, 11 nt, Bordetella pertussis
agcggggacag

SEQ ID NO: 2411526 - RNA, 14 nt, Bordetella pertussis
agcggggacaggca

SEQ ID NO: 2411527 - RNA, 14 nt, Bordetella pertussis
agcggggacaggcg

SEQ ID NO: 2411528 - RNA, 16 nt, Bordetella pertussis
agcggggacaggcgcc

SEQ ID NO: 2411529 - RNA, 18 nt, Bordetella pertussis
agcggggccgcgccggcu

SEQ ID NO: 2411530 - RNA, 19 nt, Bordetella pertussis
agcgggugaugcugcagcg

SEQ ID NO: 2411531 - RNA, 22 nt, Bordetella pertussis
agcggguugcggcagcgccgca

SEQ ID NO: 2411532 - RNA, 14 nt, Bordetella pertussis
agcgguagccggcg

SEQ ID NO: 2411533 - RNA, 18 nt, Bordetella pertussis
agcgguagggcgauggcg

SEQ ID NO: 2411534 - RNA, 22 nt, Bordetella pertussis
agcgguagggcgauggcgcguc

SEQ ID NO: 2411535 - RNA, 17 nt, Bordetella pertussis
agcgguaguccaucgcg

SEQ ID NO: 2411536 - RNA, 23 nt, Bordetella pertussis
agcgguaguccaucgcguccagg

SEQ ID NO: 2411537 - RNA, 19 nt, Bordetella pertussis
agcggucaaugaagggcug

SEQ ID NO: 2411538 - RNA, 12 nt, Bordetella pertussis
agcgguccagcu

SEQ ID NO: 2411539 - RNA, 20 nt, Bordetella pertussis
agcgguccagcugcgcgcga

SEQ ID NO: 2411540 - RNA, 21 nt, Bordetella pertussis
agcgguccagcugcgcgcgag

SEQ ID NO: 2411541 - RNA, 17 nt, Bordetella pertussis
agcgguccggggcgggc

SEQ ID NO: 2411542 - RNA, 18 nt, Bordetella pertussis
agcgguccggggcgggcg

SEQ ID NO: 2411543 - RNA, 22 nt, Bordetella pertussis
agcggucgauguccagcgccag

SEQ ID NO: 2411544 - RNA, 20 nt, Bordetella pertussis
agcggucgccgcggucgcag

SEQ ID NO: 2411545 - RNA, 15 nt, Bordetella pertussis
agcggugcgcggcgc

SEQ ID NO: 2411546 - RNA, 20 nt, Bordetella pertussis
agcggugcggauacgcguca

SEQ ID NO: 2411547 - RNA, 14 nt, Bordetella pertussis
agcgguggcggccg

SEQ ID NO: 2411548 - RNA, 15 nt, Bordetella pertussis
agcgguggcgggcca

SEQ ID NO: 2411549 - RNA, 16 nt, Bordetella pertussis
agcgguugaaauccuu

SEQ ID NO: 2411550 - RNA, 18 nt, Bordetella pertussis
agcgguugcgccagcuug

SEQ ID NO: 2411551 - RNA, 14 nt, Bordetella pertussis
agcguacgcacgcc

SEQ ID NO: 2411552 - RNA, 21 nt, Bordetella pertussis
agcguacguaccaggccgucg

SEQ ID NO: 2411553 - RNA, 14 nt, Bordetella pertussis
agcguaucgccgcc

SEQ ID NO: 2411554 - RNA, 16 nt, Bordetella pertussis
agcgucaauccgccgc

SEQ ID NO: 2411555 - RNA, 18 nt, Bordetella pertussis
agcgucaauccgccgcca

SEQ ID NO: 2411556 - RNA, 19 nt, Bordetella pertussis
agcgucaauccgccgccag

SEQ ID NO: 2411557 - RNA, 21 nt, Bordetella pertussis
agcgucaauccgccgccagca

SEQ ID NO: 2411558 - RNA, 23 nt, Bordetella pertussis
agcgucaauccgccgccagcacg

SEQ ID NO: 2411559 - RNA, 14 nt, Bordetella pertussis
agcgucaccagcag

SEQ ID NO: 2411560 - RNA, 17 nt, Bordetella pertussis
agcgucaccagcaggcg

SEQ ID NO: 2411561 - RNA, 22 nt, Bordetella pertussis
agcgucaccagcaggcggccga

SEQ ID NO: 2411562 - RNA, 21 nt, Bordetella pertussis
agcgucacggcaagacggcgc

SEQ ID NO: 2411563 - RNA, 17 nt, Bordetella pertussis
agcgucagcacaucgcc

SEQ ID NO: 2411564 - RNA, 14 nt, Bordetella pertussis
agcgucaugcgcac

SEQ ID NO: 2411565 - RNA, 16 nt, Bordetella pertussis
agcgucaugcgcaccu

SEQ ID NO: 2411566 - RNA, 22 nt, Bordetella pertussis
agcgucaugugcugcggcagcc

SEQ ID NO: 2411567 - RNA, 18 nt, Bordetella pertussis
agcguccagccgcccgug

SEQ ID NO: 2411568 - RNA, 17 nt, Bordetella pertussis
agcgucgauggcguaca

SEQ ID NO: 2411569 - RNA, 21 nt, Bordetella pertussis
agcgucgauggcguacagcag

SEQ ID NO: 2411570 - RNA, 20 nt, Bordetella pertussis
agcgucgcggcgucgaccgc

SEQ ID NO: 2411571 - RNA, 13 nt, Bordetella pertussis
agcgucggccugc

SEQ ID NO: 2411572 - RNA, 18 nt, Bordetella pertussis
agcgucggccugcacgcu

SEQ ID NO: 2411573 - RNA, 19 nt, Bordetella pertussis
agcgucggccugcacgcuc

SEQ ID NO: 2411574 - RNA, 10 nt, Bordetella pertussis
agcgucggcg

SEQ ID NO: 2411575 - RNA, 22 nt, Bordetella pertussis
agcugccaggcuaucguggcug

SEQ ID NO: 2411576 - RNA, 15 nt, Bordetella pertussis
agcugcccagcaauu

SEQ ID NO: 2411577 - RNA, 21 nt, Bordetella pertussis
agcugccgaaucggccccugc

SEQ ID NO: 2411578 - RNA, 12 nt, Bordetella pertussis
agcugccgccuu

SEQ ID NO: 2411579 - RNA, 13 nt, Bordetella pertussis
agcugccggcauu

SEQ ID NO: 2411580 - RNA, 14 nt, Bordetella pertussis
agcugccugagcac

SEQ ID NO: 2411581 - RNA, 15 nt, Bordetella pertussis
agcugcgcagcgacu

SEQ ID NO: 2411582 - RNA, 16 nt, Bordetella pertussis
agcugcgcagcgacuc

SEQ ID NO: 2411583 - RNA, 22 nt, Bordetella pertussis
agcugcgcagcgacucgaacac

SEQ ID NO: 2411584 - RNA, 18 nt, Bordetella pertussis
agcugcgcccccucuucu

SEQ ID NO: 2411585 - RNA, 12 nt, Bordetella pertussis
agcugcgccgca

SEQ ID NO: 2411586 - RNA, 13 nt, Bordetella pertussis
agcugcgcgagga

SEQ ID NO: 2411587 - RNA, 17 nt, Bordetella pertussis
agcugcggccccggcac

SEQ ID NO: 2411588 - RNA, 20 nt, Bordetella pertussis
agcugcucaccucgaucgcg

SEQ ID NO: 2411589 - RNA, 15 nt, Bordetella pertussis
agcugcucgagcaug

SEQ ID NO: 2411590 - RNA, 20 nt, Bordetella pertussis
agcugcucgagcaugcgggc

SEQ ID NO: 2411591 - RNA, 16 nt, Bordetella pertussis
agcugcuggccggccc

SEQ ID NO: 2411592 - RNA, 15 nt, Bordetella pertussis
agcugcuggcgcgcc

SEQ ID NO: 2411593 - RNA, 15 nt, Bordetella pertussis
agcugcuguuggccu

SEQ ID NO: 2411594 - RNA, 19 nt, Bordetella pertussis
agcugcuguuggccuucgg

SEQ ID NO: 2411595 - RNA, 19 nt, Bordetella pertussis
agcugcuugcccaggccgg

SEQ ID NO: 2411596 - RNA, 21 nt, Bordetella pertussis
agcugcuugcccaggccggcg

SEQ ID NO: 2411597 - RNA, 15 nt, Bordetella pertussis
agcuggaagcgcgcc

SEQ ID NO: 2411598 - RNA, 19 nt, Bordetella pertussis
agcuggagaagcgccgcgc

SEQ ID NO: 2411599 - RNA, 22 nt, Bordetella pertussis
agcuggcccaguucggcgacga

SEQ ID NO: 2411600 - RNA, 24 nt, Bordetella pertussis
agcuggcccaguucggcgacgauc

SEQ ID NO: 2411601 - RNA, 17 nt, Bordetella pertussis
agcuggccggcgacuuc

SEQ ID NO: 2411602 - RNA, 18 nt, Bordetella pertussis
agcuggcgcaccaggcug

SEQ ID NO: 2411603 - RNA, 20 nt, Bordetella pertussis
agcuggcgcguggccgccac

SEQ ID NO: 2411604 - RNA, 13 nt, Bordetella pertussis
agcuggcgcugcu

SEQ ID NO: 2411605 - RNA, 14 nt, Bordetella pertussis
agcuggcgcuuggc

SEQ ID NO: 2411606 - RNA, 16 nt, Bordetella pertussis
agcuggcgcuuggcca

SEQ ID NO: 2411607 - RNA, 18 nt, Bordetella pertussis
agcuggcgcuuggccagc

SEQ ID NO: 2411608 - RNA, 20 nt, Bordetella pertussis
agcuggcgcuuggccagcug

SEQ ID NO: 2411609 - RNA, 12 nt, Bordetella pertussis
agcuggcggcgc

SEQ ID NO: 2411610 - RNA, 20 nt, Bordetella pertussis
agcuggcggcgcagcaccag

SEQ ID NO: 2411611 - RNA, 23 nt, Bordetella pertussis
agcuggcggcgcagcaccaggcu

SEQ ID NO: 2411612 - RNA, 20 nt, Bordetella pertussis
agcuggcggcgcgcggcugg

SEQ ID NO: 2411613 - RNA, 22 nt, Bordetella pertussis
agcuggcggcgcgcuuggucag

SEQ ID NO: 2411614 - RNA, 13 nt, Bordetella pertussis
agcuggcguucgu

SEQ ID NO: 2411615 - RNA, 19 nt, Bordetella pertussis
agcuggcguucgucgccuc

SEQ ID NO: 2411616 - RNA, 16 nt, Bordetella pertussis
agcugggcaugcacga

SEQ ID NO: 2411617 - RNA, 14 nt, Bordetella pertussis
agcugggcggcgug

SEQ ID NO: 2411618 - RNA, 16 nt, Bordetella pertussis
agcuggggccgcgcgc

SEQ ID NO: 2411619 - RNA, 19 nt, Bordetella pertussis
agcuggggccgcgcgccaa

SEQ ID NO: 2411620 - RNA, 18 nt, Bordetella pertussis
agcuggugauggugucga

SEQ ID NO: 2411621 - RNA, 23 nt, Bordetella pertussis
agcuggugccgguugcgcgccga

SEQ ID NO: 2411622 - RNA, 18 nt, Bordetella pertussis
agcuguagcccuggcgcu

SEQ ID NO: 2411623 - RNA, 22 nt, Bordetella pertussis
agcuguagcgguagccggcgug

SEQ ID NO: 2411624 - RNA, 22 nt, Bordetella pertussis
agcugucggcgcuggccaucac

SEQ ID NO: 2411625 - RNA, 13 nt, Bordetella pertussis
agcuguugcagcg

SEQ ID NO: 2411626 - RNA, 17 nt, Bordetella pertussis
agcuucagccugggccu

SEQ ID NO: 2411627 - RNA, 12 nt, Bordetella pertussis
agcuuccaggua

SEQ ID NO: 2411628 - RNA, 22 nt, Bordetella pertussis
agcuucgcccccgauccccugc

SEQ ID NO: 2411629 - RNA, 19 nt, Bordetella pertussis
agcuucuaucugccgcgca

SEQ ID NO: 2411630 - RNA, 16 nt, Bordetella pertussis
agcuucugcgccugcu

SEQ ID NO: 2411631 - RNA, 20 nt, Bordetella pertussis
agcuucuggaucaccgccgg

SEQ ID NO: 2411632 - RNA, 17 nt, Bordetella pertussis
agcuucuugaacucggc

SEQ ID NO: 2411633 - RNA, 19 nt, Bordetella pertussis
agcuucuugaacucggcca

SEQ ID NO: 2411634 - RNA, 20 nt, Bordetella pertussis
agcuucuugaacucggccag

SEQ ID NO: 2411635 - RNA, 21 nt, Bordetella pertussis
agcuucuugaacucggccagc

SEQ ID NO: 2411636 - RNA, 16 nt, Bordetella pertussis
agcuugaccgccucca

SEQ ID NO: 2411637 - RNA, 17 nt, Bordetella pertussis
agcuugaccgccuccag

SEQ ID NO: 2411638 - RNA, 21 nt, Bordetella pertussis
agcuugaccgccuccaggaug

SEQ ID NO: 2411639 - RNA, 17 nt, Bordetella pertussis
agcuugacguccagcca

SEQ ID NO: 2411640 - RNA, 15 nt, Bordetella pertussis
agcuugaugccgccg

SEQ ID NO: 2411641 - RNA, 16 nt, Bordetella pertussis
agcuugaugccgccga

SEQ ID NO: 2411642 - RNA, 17 nt, Bordetella pertussis
agcuugaugggcgaggc

SEQ ID NO: 2411643 - RNA, 18 nt, Bordetella pertussis
agcuugaugggcgaggcg

SEQ ID NO: 2411644 - RNA, 14 nt, Bordetella pertussis
agcuugcaggcgcc

SEQ ID NO: 2411645 - RNA, 13 nt, Bordetella pertussis
agcuugcccacgc

SEQ ID NO: 2411646 - RNA, 20 nt, Bordetella pertussis
agcuugcccgcgcgcacgug

SEQ ID NO: 2411647 - RNA, 23 nt, Bordetella pertussis
agcuugccgcucaauucggccug

SEQ ID NO: 2411648 - RNA, 17 nt, Bordetella pertussis
agcuugcgcgccuuggc

SEQ ID NO: 2411649 - RNA, 18 nt, Bordetella pertussis
agcuugcgucccaccugc

SEQ ID NO: 2411650 - RNA, 19 nt, Bordetella pertussis
agcuuggacagcgcguugg

SEQ ID NO: 2411651 - RNA, 13 nt, Bordetella pertussis
agcuuggccaggc

SEQ ID NO: 2411652 - RNA, 14 nt, Bordetella pertussis
agcuuggccaggcu

SEQ ID NO: 2411653 - RNA, 10 nt, Bordetella pertussis
agcuuggccu

SEQ ID NO: 2411654 - RNA, 21 nt, Bordetella pertussis
agcuuggccugcggaugcagg

SEQ ID NO: 2411655 - RNA, 16 nt, Bordetella pertussis
agcuuggcgcgccgga

SEQ ID NO: 2411656 - RNA, 14 nt, Bordetella pertussis
agcuuggcgcgcgg

SEQ ID NO: 2411657 - RNA, 20 nt, Bordetella pertussis
agcuugggcuugauggccag

SEQ ID NO: 2411658 - RNA, 21 nt, Bordetella pertussis
agcuugggcuugauggccagc

SEQ ID NO: 2411659 - RNA, 21 nt, Bordetella pertussis
agcuuggucacggccucggca

SEQ ID NO: 2411660 - RNA, 15 nt, Bordetella pertussis
agcuuggugcucagu

SEQ ID NO: 2411661 - RNA, 20 nt, Bordetella pertussis
agcuuguagcccucggucgu

SEQ ID NO: 2411662 - RNA, 23 nt, Bordetella pertussis
agcuugucgaucgccaccagcgu

SEQ ID NO: 2411663 - RNA, 17 nt, Bordetella pertussis
agcuugucggccgcgcg

SEQ ID NO: 2411664 - RNA, 15 nt, Bordetella pertussis
aggaaaaagccucgc

SEQ ID NO: 2411665 - RNA, 19 nt, Bordetella pertussis
aggaaaaccggcgccuggc

SEQ ID NO: 2411666 - RNA, 18 nt, Bordetella pertussis
aggaaaaccuccuccgcg

SEQ ID NO: 2411667 - RNA, 16 nt, Bordetella pertussis
aggaaagaggccaggc

SEQ ID NO: 2411668 - RNA, 20 nt, Bordetella pertussis
aggaaagcccggccccaggc

SEQ ID NO: 2411669 - RNA, 13 nt, Bordetella pertussis
aggaaagccggcg

SEQ ID NO: 2411670 - RNA, 15 nt, Bordetella pertussis
aggaaaucaggcgca

SEQ ID NO: 2411671 - RNA, 15 nt, Bordetella pertussis
aggaacagccugccc

SEQ ID NO: 2411672 - RNA, 19 nt, Bordetella pertussis
aggaacagccugcccucgg

SEQ ID NO: 2411673 - RNA, 15 nt, Bordetella pertussis
aggaacaggcugcgc

SEQ ID NO: 2411674 - RNA, 17 nt, Bordetella pertussis
aggaacauguucacgcc

SEQ ID NO: 2411675 - RNA, 19 nt, Bordetella pertussis
aggaaccagcggcuggcgg

SEQ ID NO: 2411676 - RNA, 21 nt, Bordetella pertussis
aggaacgcaagcccggcacgg

SEQ ID NO: 2411677 - RNA, 16 nt, Bordetella pertussis
aggaacgccgcgcuca

SEQ ID NO: 2411678 - RNA, 14 nt, Bordetella pertussis
aggaacuccggcgg

SEQ ID NO: 2411679 - RNA, 19 nt, Bordetella pertussis
aggaacuccggcggcgcau

SEQ ID NO: 2411680 - RNA, 13 nt, Bordetella pertussis
aggaacuggacgg

SEQ ID NO: 2411681 - RNA, 16 nt, Bordetella pertussis
aggaacuggacggcgc

SEQ ID NO: 2411682 - RNA, 17 nt, Bordetella pertussis
aggaacugggcgccggc

SEQ ID NO: 2411683 - RNA, 19 nt, Bordetella pertussis
aggaacugggcgccggcca

SEQ ID NO: 2411684 - RNA, 21 nt, Bordetella pertussis
aggaacugggcgccggccagg

SEQ ID NO: 2411685 - RNA, 22 nt, Bordetella pertussis
aggaagacuuccgugccauaca

SEQ ID NO: 2411686 - RNA, 20 nt, Bordetella pertussis
aggaagaucggcccggcgcc

SEQ ID NO: 2411687 - RNA, 14 nt, Bordetella pertussis
aggaagccgugcgc

SEQ ID NO: 2411688 - RNA, 22 nt, Bordetella pertussis
aggccgauggcguccagcagca

SEQ ID NO: 2411689 - RNA, 17 nt, Bordetella pertussis
aggccgauucgccgugg

SEQ ID NO: 2411690 - RNA, 19 nt, Bordetella pertussis
aggccgauucgccguggcu

SEQ ID NO: 2411691 - RNA, 16 nt, Bordetella pertussis
aggccgauuucggccg

SEQ ID NO: 2411692 - RNA, 17 nt, Bordetella pertussis
aggccgauuucggccgc

SEQ ID NO: 2411693 - RNA, 22 nt, Bordetella pertussis
aggccgauuucggccgccggcg

SEQ ID NO: 2411694 - RNA, 14 nt, Bordetella pertussis
aggccgcaacccac

SEQ ID NO: 2411695 - RNA, 22 nt, Bordetella pertussis
aggccgcagcgggcccgucgcg

SEQ ID NO: 2411696 - RNA, 22 nt, Bordetella pertussis
aggccgcauacgacacgucauc

SEQ ID NO: 2411697 - RNA, 23 nt, Bordetella pertussis
aggccgcauacgacacgucaucg

SEQ ID NO: 2411698 - RNA, 20 nt, Bordetella pertussis
aggccgccacuugcggcagg

SEQ ID NO: 2411699 - RNA, 14 nt, Bordetella pertussis
aggccgcccagccg

SEQ ID NO: 2411700 - RNA, 20 nt, Bordetella pertussis
aggccgcccagccgcgccag

SEQ ID NO: 2411701 - RNA, 13 nt, Bordetella pertussis
aggccgcccgccc

SEQ ID NO: 2411702 - RNA, 10 nt, Bordetella pertussis
aggccgccgc

SEQ ID NO: 2411703 - RNA, 14 nt, Bordetella pertussis
aggccgccgccggu

SEQ ID NO: 2411704 - RNA, 12 nt, Bordetella pertussis
aggccgccggcc

SEQ ID NO: 2411705 - RNA, 13 nt, Bordetella pertussis
aggccgccggcca

SEQ ID NO: 2411706 - RNA, 14 nt, Bordetella pertussis
aggccgccggccag

SEQ ID NO: 2411707 - RNA, 15 nt, Bordetella pertussis
aggccgccggccagc

SEQ ID NO: 2411708 - RNA, 17 nt, Bordetella pertussis
aggccgccggccagcgc

SEQ ID NO: 2411709 - RNA, 13 nt, Bordetella pertussis
aggccgccggccu

SEQ ID NO: 2411710 - RNA, 13 nt, Bordetella pertussis
aggccgccggcgg

SEQ ID NO: 2411711 - RNA, 16 nt, Bordetella pertussis
aggccgccggcggcgu

SEQ ID NO: 2411712 - RNA, 18 nt, Bordetella pertussis
aggccgccggggaggccu

SEQ ID NO: 2411713 - RNA, 10 nt, Bordetella pertussis
aggccgccgu

SEQ ID NO: 2411714 - RNA, 20 nt, Bordetella pertussis
aggccgccuauguaggcgcc

SEQ ID NO: 2411715 - RNA, 16 nt, Bordetella pertussis
aggccgcgaacgcgcc

SEQ ID NO: 2411716 - RNA, 21 nt, Bordetella pertussis
aggccgcgaacgcgccggccc

SEQ ID NO: 2411717 - RNA, 18 nt, Bordetella pertussis
aggccgcgaugucgcgcg

SEQ ID NO: 2411718 - RNA, 19 nt, Bordetella pertussis
aggccgcgaugucgcgcgc

SEQ ID NO: 2411719 - RNA, 15 nt, Bordetella pertussis
aggccgcgcagggca

SEQ ID NO: 2411720 - RNA, 12 nt, Bordetella pertussis
aggccgcgccac

SEQ ID NO: 2411721 - RNA, 18 nt, Bordetella pertussis
aggccgcgccacaggcgc

SEQ ID NO: 2411722 - RNA, 19 nt, Bordetella pertussis
aggccgcgccacaggcgcu

SEQ ID NO: 2411723 - RNA, 23 nt, Bordetella pertussis
aggccgcgccgcggcaagccgcg

SEQ ID NO: 2411724 - RNA, 14 nt, Bordetella pertussis
aggccgcgccggcu

SEQ ID NO: 2411725 - RNA, 22 nt, Bordetella pertussis
aggccgcgccggcucccgcgcu

SEQ ID NO: 2411726 - RNA, 23 nt, Bordetella pertussis
aggccgcgccggcucccgcgcug

SEQ ID NO: 2411727 - RNA, 20 nt, Bordetella pertussis
aggccgcgccuauaucgacg

SEQ ID NO: 2411728 - RNA, 22 nt, Bordetella pertussis
aggccgcgccuauaucgacggc

SEQ ID NO: 2411729 - RNA, 15 nt, Bordetella pertussis
aggccgcgcgcaucc

SEQ ID NO: 2411730 - RNA, 19 nt, Bordetella pertussis
aggccgcgcgugcggggcg

SEQ ID NO: 2411731 - RNA, 13 nt, Bordetella pertussis
aggccgcgcugcc

SEQ ID NO: 2411732 - RNA, 17 nt, Bordetella pertussis
aggccgcgcugccagcc

SEQ ID NO: 2411733 - RNA, 17 nt, Bordetella pertussis
aggccgcgcuggugcug

SEQ ID NO: 2411734 - RNA, 23 nt, Bordetella pertussis
aggccgcgcuggugcuggccgaa

SEQ ID NO: 2411735 - RNA, 22 nt, Bordetella pertussis
aggccgcggcgcccggugcgcg

SEQ ID NO: 2411736 - RNA, 13 nt, Bordetella pertussis
aggccgcugggca

SEQ ID NO: 2411737 - RNA, 18 nt, Bordetella pertussis
aggccgcugggcacaucc

SEQ ID NO: 2411738 - RNA, 21 nt, Bordetella pertussis
aggccgcuucgaugcuggcgg

SEQ ID NO: 2411739 - RNA, 19 nt, Bordetella pertussis
aggccgcuucgugcggccg

SEQ ID NO: 2411740 - RNA, 23 nt, Bordetella pertussis
aggccgcuucgugcggccgcagc

SEQ ID NO: 2411741 - RNA, 19 nt, Bordetella pertussis
aggccggaaaugccgcgcg

SEQ ID NO: 2411742 - RNA, 21 nt, Bordetella pertussis
aggccggcaagaugccggccu

SEQ ID NO: 2411743 - RNA, 18 nt, Bordetella pertussis
aggccggcaugcgccggc

SEQ ID NO: 2411744 - RNA, 15 nt, Bordetella pertussis
aggccggccagcaag

SEQ ID NO: 2411745 - RNA, 13 nt, Bordetella pertussis
aggccggccaggg

SEQ ID NO: 2411746 - RNA, 14 nt, Bordetella pertussis
aggccggcccgccc

SEQ ID NO: 2411747 - RNA, 17 nt, Bordetella pertussis
aggccggcccgccccac

SEQ ID NO: 2411748 - RNA, 21 nt, Bordetella pertussis
aggccggccugcaaugcggcc

SEQ ID NO: 2411749 - RNA, 18 nt, Bordetella pertussis
aggccggccugcaggcuc

SEQ ID NO: 2411750 - RNA, 14 nt, Bordetella pertussis
aggccggcgaugga

SEQ ID NO: 2411751 - RNA, 15 nt, Bordetella pertussis
aggccggcgccagcc

SEQ ID NO: 2411752 - RNA, 18 nt, Bordetella pertussis
aggccggcgccagccgcu

SEQ ID NO: 2411753 - RNA, 18 nt, Bordetella pertussis
aggccggcgcgccggccc

SEQ ID NO: 2411754 - RNA, 17 nt, Bordetella pertussis
aggccggcgcgcgcgua

SEQ ID NO: 2411755 - RNA, 22 nt, Bordetella pertussis
aggccggcgcgcgcguacagcc

SEQ ID NO: 2411756 - RNA, 19 nt, Bordetella pertussis
aggccggcgcgcucggccu

SEQ ID NO: 2411757 - RNA, 22 nt, Bordetella pertussis
aggccggcggcacgcugcgcag

SEQ ID NO: 2411758 - RNA, 20 nt, Bordetella pertussis
aggccggcggccagcgcgcc

SEQ ID NO: 2411759 - RNA, 13 nt, Bordetella pertussis
aggccggcggcga

SEQ ID NO: 2411760 - RNA, 23 nt, Bordetella pertussis
aggccggcggcgagcgcggcgcg

SEQ ID NO: 2411761 - RNA, 18 nt, Bordetella pertussis
aggccggcgucuggagcg

SEQ ID NO: 2411762 - RNA, 22 nt, Bordetella pertussis
aggccggcgucuggagcggccu

SEQ ID NO: 2411763 - RNA, 19 nt, Bordetella pertussis
aggccggcgugcuguccgu

SEQ ID NO: 2411764 - RNA, 10 nt, Bordetella pertussis
aggccgggcg

SEQ ID NO: 2411765 - RNA, 17 nt, Bordetella pertussis
aggccggggccgcccag

SEQ ID NO: 2411766 - RNA, 16 nt, Bordetella pertussis
aggccgguggaccagg

SEQ ID NO: 2411767 - RNA, 18 nt, Bordetella pertussis
aggccguaaccggccagu

SEQ ID NO: 2411768 - RNA, 13 nt, Bordetella pertussis
aggccgucggcca

SEQ ID NO: 2411769 - RNA, 16 nt, Bordetella pertussis
aggccguggcccagcc

SEQ ID NO: 2411770 - RNA, 17 nt, Bordetella pertussis
aggccguggcgcaccag

SEQ ID NO: 2411771 - RNA, 19 nt, Bordetella pertussis
aggccguggcgcaccaggu

SEQ ID NO: 2411772 - RNA, 18 nt, Bordetella pertussis
aggccguuccaguccagc

SEQ ID NO: 2411773 - RNA, 23 nt, Bordetella pertussis
aggccguugccgcuguggcgcgc

SEQ ID NO: 2411774 - RNA, 14 nt, Bordetella pertussis
aggccguuggccgc

SEQ ID NO: 2411775 - RNA, 18 nt, Bordetella pertussis
aggccguuggccgcgcgg

SEQ ID NO: 2411776 - RNA, 14 nt, Bordetella pertussis
aggccguuggcgcg

SEQ ID NO: 2411777 - RNA, 23 nt, Bordetella pertussis
aggccguuguccuggcgcgccag

SEQ ID NO: 2411778 - RNA, 17 nt, Bordetella pertussis
aggccguuuccucugga

SEQ ID NO: 2411779 - RNA, 15 nt, Bordetella pertussis
aggccucggccaccu

SEQ ID NO: 2411780 - RNA, 20 nt, Bordetella pertussis
aggccucggcuccgccauug

SEQ ID NO: 2411781 - RNA, 13 nt, Bordetella pertussis
aggccucgggcca

SEQ ID NO: 2411782 - RNA, 14 nt, Bordetella pertussis
aggccucggucgcc

SEQ ID NO: 2411783 - RNA, 14 nt, Bordetella pertussis
aggccugcggcgcc

SEQ ID NO: 2411784 - RNA, 17 nt, Bordetella pertussis
aggccugcggcgccagc

SEQ ID NO: 2411785 - RNA, 13 nt, Bordetella pertussis
aggccugcgggug

SEQ ID NO: 2411786 - RNA, 19 nt, Bordetella pertussis
aggccugcugcagcgugau

SEQ ID NO: 2411787 - RNA, 14 nt, Bordetella pertussis
aggccugcugugcg

SEQ ID NO: 2411788 - RNA, 18 nt, Bordetella pertussis
aggccuggcuuggcggcc

SEQ ID NO: 2411789 - RNA, 19 nt, Bordetella pertussis
aggccuggcuuggcggcca

SEQ ID NO: 2411790 - RNA, 20 nt, Bordetella pertussis
aggccuggcuuggcggccag

SEQ ID NO: 2411791 - RNA, 22 nt, Bordetella pertussis
aggccuggcuuggcggccagga

SEQ ID NO: 2411792 - RNA, 12 nt, Bordetella pertussis
aggccuggucga

SEQ ID NO: 2411793 - RNA, 22 nt, Bordetella pertussis
aggccuggucggggucggccac

SEQ ID NO: 2411794 - RNA, 23 nt, Bordetella pertussis
aggccuggucggggucggccacc

SEQ ID NO: 2411795 - RNA, 16 nt, Bordetella pertussis
aggccuguucggccgg

SEQ ID NO: 2411796 - RNA, 17 nt, Bordetella pertussis
aggccuucgacguccag

SEQ ID NO: 2411797 - RNA, 19 nt, Bordetella pertussis
aggccuugccgccgccgcg

SEQ ID NO: 2411798 - RNA, 21 nt, Bordetella pertussis
aggccuugccgccgccgcgcg

SEQ ID NO: 2411799 - RNA, 17 nt, Bordetella pertussis
aggcgaacaggcacagg

SEQ ID NO: 2411800 - RNA, 17 nt, Bordetella pertussis
aggcgaacauggccgag

SEQ ID NO: 2411801 - RNA, 12 nt, Bordetella pertussis
aggcgcuggccg

SEQ ID NO: 2411802 - RNA, 17 nt, Bordetella pertussis
aggcgcuggccggcgug

SEQ ID NO: 2411803 - RNA, 20 nt, Bordetella pertussis
aggcgcuggccggcgugccc

SEQ ID NO: 2411804 - RNA, 17 nt, Bordetella pertussis
aggcgcuggcguccagc

SEQ ID NO: 2411805 - RNA, 22 nt, Bordetella pertussis
aggcgcugguaaagggcgcgga

SEQ ID NO: 2411806 - RNA, 20 nt, Bordetella pertussis
aggcgcugguaguaggccac

SEQ ID NO: 2411807 - RNA, 22 nt, Bordetella pertussis
aggcgcuguucgauacggccac

SEQ ID NO: 2411808 - RNA, 18 nt, Bordetella pertussis
aggcgcuugcgcagggcg

SEQ ID NO: 2411809 - RNA, 16 nt, Bordetella pertussis
aggcgcuugcgcucgg

SEQ ID NO: 2411810 - RNA, 21 nt, Bordetella pertussis
aggcggaucucuccgaacgcg

SEQ ID NO: 2411811 - RNA, 14 nt, Bordetella pertussis
aggcggaugcggua

SEQ ID NO: 2411812 - RNA, 14 nt, Bordetella pertussis
aggcggcaaacccg

SEQ ID NO: 2411813 - RNA, 16 nt, Bordetella pertussis
aggcggcaaacccggc

SEQ ID NO: 2411814 - RNA, 15 nt, Bordetella pertussis
aggcggcaagcggcg

SEQ ID NO: 2411815 - RNA, 15 nt, Bordetella pertussis
aggcggccagcaugc

SEQ ID NO: 2411816 - RNA, 16 nt, Bordetella pertussis
aggcggccagcaugcu

SEQ ID NO: 2411817 - RNA, 13 nt, Bordetella pertussis
aggcggccaggcc

SEQ ID NO: 2411818 - RNA, 14 nt, Bordetella pertussis
aggcggccaggccg

SEQ ID NO: 2411819 - RNA, 15 nt, Bordetella pertussis
aggcggccaggccga

SEQ ID NO: 2411820 - RNA, 13 nt, Bordetella pertussis
aggcggccaggcu

SEQ ID NO: 2411821 - RNA, 20 nt, Bordetella pertussis
aggcggccaggcucugggcg

SEQ ID NO: 2411822 - RNA, 11 nt, Bordetella pertussis
aggcggccagu

SEQ ID NO: 2411823 - RNA, 22 nt, Bordetella pertussis
aggcggccaucgccgccacgug

SEQ ID NO: 2411824 - RNA, 14 nt, Bordetella pertussis
aggcggcccaggcg

SEQ ID NO: 2411825 - RNA, 13 nt, Bordetella pertussis
aggcggcccggcc

SEQ ID NO: 2411826 - RNA, 15 nt, Bordetella pertussis
aggcggccgaccagc

SEQ ID NO: 2411827 - RNA, 15 nt, Bordetella pertussis
aggcggccgcgggcg

SEQ ID NO: 2411828 - RNA, 17 nt, Bordetella pertussis
aggcggccgcgggcggc

SEQ ID NO: 2411829 - RNA, 12 nt, Bordetella pertussis
aggcggccggca

SEQ ID NO: 2411830 - RNA, 14 nt, Bordetella pertussis
aggcggccggcagg

SEQ ID NO: 2411831 - RNA, 12 nt, Bordetella pertussis
aggcggcgacga

SEQ ID NO: 2411832 - RNA, 20 nt, Bordetella pertussis
aggcggcgacgcagcacggc

SEQ ID NO: 2411833 - RNA, 22 nt, Bordetella pertussis
aggcggcgcaggaugcgcuggc

SEQ ID NO: 2411834 - RNA, 16 nt, Bordetella pertussis
aggcggcgcaggccag

SEQ ID NO: 2411835 - RNA, 18 nt, Bordetella pertussis
aggcggcgcaggccagcg

SEQ ID NO: 2411836 - RNA, 19 nt, Bordetella pertussis
aggcggcgcaggccagcgc

SEQ ID NO: 2411837 - RNA, 19 nt, Bordetella pertussis
aggcggcgcaucagcgcgc

SEQ ID NO: 2411838 - RNA, 14 nt, Bordetella pertussis
aggcggcgccggca

SEQ ID NO: 2411839 - RNA, 13 nt, Bordetella pertussis
aggcggcgcgccc

SEQ ID NO: 2411840 - RNA, 18 nt, Bordetella pertussis
aggcggcgcgcccgccuu

SEQ ID NO: 2411841 - RNA, 20 nt, Bordetella pertussis
aggcggcgcucgaaggcgcc

SEQ ID NO: 2411842 - RNA, 22 nt, Bordetella pertussis
aggcggcggccggggccgcccu

SEQ ID NO: 2411843 - RNA, 12 nt, Bordetella pertussis
aggcggcggccu

SEQ ID NO: 2411844 - RNA, 14 nt, Bordetella pertussis
aggcggcggugcca

SEQ ID NO: 2411845 - RNA, 20 nt, Bordetella pertussis
aggcggcguaguucagccac

SEQ ID NO: 2411846 - RNA, 18 nt, Bordetella pertussis
aggcggcugcccaccuug

SEQ ID NO: 2411847 - RNA, 19 nt, Bordetella pertussis
aggcggcugcccaccuugc

SEQ ID NO: 2411848 - RNA, 22 nt, Bordetella pertussis
aggcggcugcccaccuugcgcg

SEQ ID NO: 2411849 - RNA, 22 nt, Bordetella pertussis
aggcggcuggugccgacggcgc

SEQ ID NO: 2411850 - RNA, 17 nt, Bordetella pertussis
aggcggcuguagucgcc

SEQ ID NO: 2411851 - RNA, 16 nt, Bordetella pertussis
aggcgggacuggcgag

SEQ ID NO: 2411852 - RNA, 20 nt, Bordetella pertussis
aggcgggcagcauggcgcca

SEQ ID NO: 2411853 - RNA, 16 nt, Bordetella pertussis
aggcgggcagcggcga

SEQ ID NO: 2411854 - RNA, 13 nt, Bordetella pertussis
aggcgggccaggc

SEQ ID NO: 2411855 - RNA, 14 nt, Bordetella pertussis
aggcgggccaggcc

SEQ ID NO: 2411856 - RNA, 21 nt, Bordetella pertussis
aggcgggcccgcaucgcgcgc

SEQ ID NO: 2411857 - RNA, 19 nt, Bordetella pertussis
aggcgggcgccgcgcccgg

SEQ ID NO: 2411858 - RNA, 21 nt, Bordetella pertussis
aggcgggcgcggcauggcgcc

SEQ ID NO: 2411859 - RNA, 16 nt, Bordetella pertussis
aggcgggcuggucgcg

SEQ ID NO: 2411860 - RNA, 23 nt, Bordetella pertussis
aggcgggcuggucgcgccgguca

SEQ ID NO: 2411861 - RNA, 18 nt, Bordetella pertussis
aggcggggcuggcgcggc

SEQ ID NO: 2411862 - RNA, 21 nt, Bordetella pertussis
aggcgggguggcacagccgca

SEQ ID NO: 2411863 - RNA, 23 nt, Bordetella pertussis
aggcggguguagaagaacagcag

SEQ ID NO: 2411864 - RNA, 17 nt, Bordetella pertussis
aggcgguacaggccggc

SEQ ID NO: 2411865 - RNA, 19 nt, Bordetella pertussis
aggcgguacaggccggcgg

SEQ ID NO: 2411866 - RNA, 22 nt, Bordetella pertussis
aggcggucauagacggcgucgg

SEQ ID NO: 2411867 - RNA, 17 nt, Bordetella pertussis
aggcggucgaggcgcag

SEQ ID NO: 2411868 - RNA, 18 nt, Bordetella pertussis
aggcggugcggaggcggc

SEQ ID NO: 2411869 - RNA, 16 nt, Bordetella pertussis
aggcggugcguccagg

SEQ ID NO: 2411870 - RNA, 15 nt, Bordetella pertussis
aggcgguggccagcg

SEQ ID NO: 2411871 - RNA, 22 nt, Bordetella pertussis
aggcgguguagaccaccagcag

SEQ ID NO: 2411872 - RNA, 20 nt, Bordetella pertussis
aggcgguuggccuugacggc

SEQ ID NO: 2411873 - RNA, 14 nt, Bordetella pertussis
aggcguacgaggac

SEQ ID NO: 2411874 - RNA, 19 nt, Bordetella pertussis
aggcguacgaggaccugug

SEQ ID NO: 2411875 - RNA, 17 nt, Bordetella pertussis
aggcguagaccaccugc

SEQ ID NO: 2411876 - RNA, 13 nt, Bordetella pertussis
aggcguccagccc

SEQ ID NO: 2411877 - RNA, 15 nt, Bordetella pertussis
aggcguccagccccu

SEQ ID NO: 2411878 - RNA, 23 nt, Bordetella pertussis
aggcguccagccccugcgggccg

SEQ ID NO: 2411879 - RNA, 13 nt, Bordetella pertussis
aggcguccaggcu

SEQ ID NO: 2411880 - RNA, 15 nt, Bordetella pertussis
aggcguccaggcugc

SEQ ID NO: 2411881 - RNA, 17 nt, Bordetella pertussis
aggcgucggccagcgcg

SEQ ID NO: 2411882 - RNA, 18 nt, Bordetella pertussis
aggcgucggcggcccaca

SEQ ID NO: 2411883 - RNA, 15 nt, Bordetella pertussis
aggcgucgggcacgu

SEQ ID NO: 2411884 - RNA, 18 nt, Bordetella pertussis
aggcgucgggcacguccg

SEQ ID NO: 2411885 - RNA, 19 nt, Bordetella pertussis
aggcgucgggcacguccgg

SEQ ID NO: 2411886 - RNA, 17 nt, Bordetella pertussis
aggcgucguuggccgcg

SEQ ID NO: 2411887 - RNA, 20 nt, Bordetella pertussis
aggcgugaacgccccggccg

SEQ ID NO: 2411888 - RNA, 21 nt, Bordetella pertussis
aggcgugaacgccccggccga

SEQ ID NO: 2411889 - RNA, 13 nt, Bordetella pertussis
aggcgugaggccc

SEQ ID NO: 2411890 - RNA, 22 nt, Bordetella pertussis
aggcgugcccgguucugcggcg

SEQ ID NO: 2411891 - RNA, 16 nt, Bordetella pertussis
aggcgugccgcgcagg

SEQ ID NO: 2411892 - RNA, 19 nt, Bordetella pertussis
aggcgugccgcgcaggucg

SEQ ID NO: 2411893 - RNA, 15 nt, Bordetella pertussis
aggcgugcugcaccu

SEQ ID NO: 2411894 - RNA, 14 nt, Bordetella pertussis
aggcguucggccac

SEQ ID NO: 2411895 - RNA, 15 nt, Bordetella pertussis
aggcguucggccacu

SEQ ID NO: 2411896 - RNA, 15 nt, Bordetella pertussis
aggcguugcgccgca

SEQ ID NO: 2411897 - RNA, 17 nt, Bordetella pertussis
aggcguugcgccgcaac

SEQ ID NO: 2411898 - RNA, 18 nt, Bordetella pertussis
aggcguugcgccgcaacg

SEQ ID NO: 2411899 - RNA, 19 nt, Bordetella pertussis
aggcguugcgccgcaacgc

SEQ ID NO: 2411900 - RNA, 22 nt, Bordetella pertussis
aggcuaucguggcuggcgagga

SEQ ID NO: 2411901 - RNA, 15 nt, Bordetella pertussis
aggcucaccucgcgc

SEQ ID NO: 2411902 - RNA, 19 nt, Bordetella pertussis
aggcucagcccggcgaggu

SEQ ID NO: 2411903 - RNA, 15 nt, Bordetella pertussis
aggcucagcgggcug

SEQ ID NO: 2411904 - RNA, 23 nt, Bordetella pertussis
aggcuccacagccacugcggccc

SEQ ID NO: 2411905 - RNA, 18 nt, Bordetella pertussis
aggcucccgcuggcggca

SEQ ID NO: 2411906 - RNA, 19 nt, Bordetella pertussis
aggcucccgcuggcggcac

SEQ ID NO: 2411907 - RNA, 22 nt, Bordetella pertussis
aggcuccgagggacaccgcagg

SEQ ID NO: 2411908 - RNA, 14 nt, Bordetella pertussis
aggcuccucgccac

SEQ ID NO: 2411909 - RNA, 22 nt, Bordetella pertussis
aggcucuuuuucccggcgcgga

SEQ ID NO: 2411910 - RNA, 20 nt, Bordetella pertussis
aggcucuuuuucgagccgca

SEQ ID NO: 2411911 - RNA, 19 nt, Bordetella pertussis
aggcugaaggggcuccccu

SEQ ID NO: 2411912 - RNA, 17 nt, Bordetella pertussis
aggcugaaugccgccgu

SEQ ID NO: 2411913 - RNA, 22 nt, Bordetella pertussis
aggcugacgcccggcucgcugu

SEQ ID NO: 2411914 - RNA, 13 nt, Bordetella pertussis
agggcgcgccagc

SEQ ID NO: 2411915 - RNA, 18 nt, Bordetella pertussis
agggcgcggauguggggg

SEQ ID NO: 2411916 - RNA, 19 nt, Bordetella pertussis
agggcgcggaugugggggu

SEQ ID NO: 2411917 - RNA, 13 nt, Bordetella pertussis
agggcgcggccag

SEQ ID NO: 2411918 - RNA, 15 nt, Bordetella pertussis
agggcggaaaacagc

SEQ ID NO: 2411919 - RNA, 17 nt, Bordetella pertussis
agggcggaaaacagcac

SEQ ID NO: 2411920 - RNA, 20 nt, Bordetella pertussis
agggcggaaaacagcaccag

SEQ ID NO: 2411921 - RNA, 14 nt, Bordetella pertussis
agggcggccaggcc

SEQ ID NO: 2411922 - RNA, 19 nt, Bordetella pertussis
agggcggccccggccgccc

SEQ ID NO: 2411923 - RNA, 14 nt, Bordetella pertussis
agggcggccggcac

SEQ ID NO: 2411924 - RNA, 21 nt, Bordetella pertussis
agggcggccucgacggccgcc

SEQ ID NO: 2411925 - RNA, 12 nt, Bordetella pertussis
agggcggcgcgg

SEQ ID NO: 2411926 - RNA, 18 nt, Bordetella pertussis
agggcggcgucgaucggc

SEQ ID NO: 2411927 - RNA, 22 nt, Bordetella pertussis
agggcggcgucgaucggcgcgc

SEQ ID NO: 2411928 - RNA, 13 nt, Bordetella pertussis
agggcgggcggga

SEQ ID NO: 2411929 - RNA, 22 nt, Bordetella pertussis
agggcggugggcagcgcgucga

SEQ ID NO: 2411930 - RNA, 18 nt, Bordetella pertussis
agggcgucgcgaugcgcc

SEQ ID NO: 2411931 - RNA, 20 nt, Bordetella pertussis
agggcgucgcgaugcgccag

SEQ ID NO: 2411932 - RNA, 20 nt, Bordetella pertussis
agggcgucggccgcgcccag

SEQ ID NO: 2411933 - RNA, 19 nt, Bordetella pertussis
agggcgucggcgacgugau

SEQ ID NO: 2411934 - RNA, 17 nt, Bordetella pertussis
agggcgucuucgccgac

SEQ ID NO: 2411935 - RNA, 17 nt, Bordetella pertussis
agggcgugcgggacggc

SEQ ID NO: 2411936 - RNA, 13 nt, Bordetella pertussis
agggcguggcgcg

SEQ ID NO: 2411937 - RNA, 18 nt, Bordetella pertussis
agggcguuuuccagcauc

SEQ ID NO: 2411938 - RNA, 21 nt, Bordetella pertussis
agggcuccaggcugagcguga

SEQ ID NO: 2411939 - RNA, 13 nt, Bordetella pertussis
agggcucgaccgc

SEQ ID NO: 2411940 - RNA, 16 nt, Bordetella pertussis
agggcucgaccgccgc

SEQ ID NO: 2411941 - RNA, 19 nt, Bordetella pertussis
agggcucgaccgccgccac

SEQ ID NO: 2411942 - RNA, 22 nt, Bordetella pertussis
agggcugaucuugaugcggccg

SEQ ID NO: 2411943 - RNA, 23 nt, Bordetella pertussis
agggcugcacgauguugccgccg

SEQ ID NO: 2411944 - RNA, 23 nt, Bordetella pertussis
agggcugcccucgcccgugcgcg

SEQ ID NO: 2411945 - RNA, 17 nt, Bordetella pertussis
agggcugcgaugcgggc

SEQ ID NO: 2411946 - RNA, 21 nt, Bordetella pertussis
agggcugcgugcgggacaggc

SEQ ID NO: 2411947 - RNA, 16 nt, Bordetella pertussis
agggcuucgacucccu

SEQ ID NO: 2411948 - RNA, 13 nt, Bordetella pertussis
agggcuugcggcg

SEQ ID NO: 2411949 - RNA, 14 nt, Bordetella pertussis
agggcuugcggcgc

SEQ ID NO: 2411950 - RNA, 12 nt, Bordetella pertussis
aggggacggcgc

SEQ ID NO: 2411951 - RNA, 15 nt, Bordetella pertussis
aggggaugacgggcg

SEQ ID NO: 2411952 - RNA, 23 nt, Bordetella pertussis
aggggaugcgguuuuugaggacc

SEQ ID NO: 2411953 - RNA, 16 nt, Bordetella pertussis
aggggauugccgcgcg

SEQ ID NO: 2411954 - RNA, 22 nt, Bordetella pertussis
aggggcagcucggugcagccca

SEQ ID NO: 2411955 - RNA, 21 nt, Bordetella pertussis
aggggcaggugccccacgccg

SEQ ID NO: 2411956 - RNA, 14 nt, Bordetella pertussis
aggggcaugccggc

SEQ ID NO: 2411957 - RNA, 15 nt, Bordetella pertussis
aggggcaugccggca

SEQ ID NO: 2411958 - RNA, 12 nt, Bordetella pertussis
aggggccagccu

SEQ ID NO: 2411959 - RNA, 23 nt, Bordetella pertussis
aggggccagccuggcgccaaccc

SEQ ID NO: 2411960 - RNA, 14 nt, Bordetella pertussis
aggggccgcacgcg

SEQ ID NO: 2411961 - RNA, 20 nt, Bordetella pertussis
aggggccggcgcgccgcgcc

SEQ ID NO: 2411962 - RNA, 21 nt, Bordetella pertussis
aggggccggcuuuggacaggc

SEQ ID NO: 2411963 - RNA, 20 nt, Bordetella pertussis
aggggcggcgcggcgcuggc

SEQ ID NO: 2411964 - RNA, 21 nt, Bordetella pertussis
aggggcggcuucaggcgcgcg

SEQ ID NO: 2411965 - RNA, 11 nt, Bordetella pertussis
aggggcucgcg

SEQ ID NO: 2411966 - RNA, 14 nt, Bordetella pertussis
aggggcucgcgccc

SEQ ID NO: 2411967 - RNA, 14 nt, Bordetella pertussis
aggggcucggccag

SEQ ID NO: 2411968 - RNA, 18 nt, Bordetella pertussis
aggggcucggccaggugc

SEQ ID NO: 2411969 - RNA, 14 nt, Bordetella pertussis
aggggcugccguga

SEQ ID NO: 2411970 - RNA, 16 nt, Bordetella pertussis
aggggcuguaccuggc

SEQ ID NO: 2411971 - RNA, 13 nt, Bordetella pertussis
agggggacuggca

SEQ ID NO: 2411972 - RNA, 19 nt, Bordetella pertussis
agggggacuggcaccggca

SEQ ID NO: 2411973 - RNA, 14 nt, Bordetella pertussis
agggggcgccccaa

SEQ ID NO: 2411974 - RNA, 22 nt, Bordetella pertussis
agggggcgccccaacgcggcca

SEQ ID NO: 2411975 - RNA, 23 nt, Bordetella pertussis
agggggcgccccaacgcggccag

SEQ ID NO: 2411976 - RNA, 20 nt, Bordetella pertussis
agggggcuuuuugccuuggg

SEQ ID NO: 2411977 - RNA, 21 nt, Bordetella pertussis
agggggcuuuuuugccuuggg

SEQ ID NO: 2411978 - RNA, 20 nt, Bordetella pertussis
agggguccguggcggccgcg

SEQ ID NO: 2411979 - RNA, 18 nt, Bordetella pertussis
agggucagcggccggccc

SEQ ID NO: 2411980 - RNA, 22 nt, Bordetella pertussis
agggucaggggcaggugcccca

SEQ ID NO: 2411981 - RNA, 17 nt, Bordetella pertussis
agggucgagaccagcag

SEQ ID NO: 2411982 - RNA, 14 nt, Bordetella pertussis
agggucucggccac

SEQ ID NO: 2411983 - RNA, 21 nt, Bordetella pertussis
agggucugcuggucgcgggcc

SEQ ID NO: 2411984 - RNA, 14 nt, Bordetella pertussis
agggucuggcggcc

SEQ ID NO: 2411985 - RNA, 15 nt, Bordetella pertussis
agggucuggcggccg

SEQ ID NO: 2411986 - RNA, 14 nt, Bordetella pertussis
agggugaccuggcg

SEQ ID NO: 2411987 - RNA, 17 nt, Bordetella pertussis
agggugagugcccaugg

SEQ ID NO: 2411988 - RNA, 15 nt, Bordetella pertussis
agggugcaccaggug

SEQ ID NO: 2411989 - RNA, 21 nt, Bordetella pertussis
agggugccgaaacccucguga

SEQ ID NO: 2411990 - RNA, 15 nt, Bordetella pertussis
agggugccgccuucg

SEQ ID NO: 2411991 - RNA, 16 nt, Bordetella pertussis
agggugccuguccccg

SEQ ID NO: 2411992 - RNA, 21 nt, Bordetella pertussis
agggugccuguccccgcgggg

SEQ ID NO: 2411993 - RNA, 14 nt, Bordetella pertussis
agggugcggcgcca

SEQ ID NO: 2411994 - RNA, 13 nt, Bordetella pertussis
agggugcggggug

SEQ ID NO: 2411995 - RNA, 21 nt, Bordetella pertussis
agggugcggggugccuguccc

SEQ ID NO: 2411996 - RNA, 23 nt, Bordetella pertussis
agggugcggggugccuguccccg

SEQ ID NO: 2411997 - RNA, 22 nt, Bordetella pertussis
agggugcuguucaggcgcucga

SEQ ID NO: 2411998 - RNA, 15 nt, Bordetella pertussis
aggguggccacgccc

SEQ ID NO: 2411999 - RNA, 15 nt, Bordetella pertussis
aggguggcgccggcc

SEQ ID NO: 2412000 - RNA, 23 nt, Bordetella pertussis
agggugucgccggggcgcaccgg

SEQ ID NO: 2412001 - RNA, 15 nt, Bordetella pertussis
agggugucggccagg

SEQ ID NO: 2412002 - RNA, 16 nt, Bordetella pertussis
agggugucggccaggg

SEQ ID NO: 2412003 - RNA, 22 nt, Bordetella pertussis
aggguugcaguucgccggcgcc

SEQ ID NO: 2412004 - RNA, 20 nt, Bordetella pertussis
aggguuggcgcgccguggcu

SEQ ID NO: 2412005 - RNA, 15 nt, Bordetella pertussis
aggguuucgacgccu

SEQ ID NO: 2412006 - RNA, 18 nt, Bordetella pertussis
aggguuuuauacggcgcg

SEQ ID NO: 2412007 - RNA, 20 nt, Bordetella pertussis
agguacccccagcggcgcac

SEQ ID NO: 2412008 - RNA, 17 nt, Bordetella pertussis
agguacccgcgccggcg

SEQ ID NO: 2412009 - RNA, 18 nt, Bordetella pertussis
agguacccgcgccggcgg

SEQ ID NO: 2412010 - RNA, 16 nt, Bordetella pertussis
agguagaccacgcgcu

SEQ ID NO: 2412011 - RNA, 22 nt, Bordetella pertussis
agguagaccacgcgcugcgcgc

SEQ ID NO: 2412012 - RNA, 23 nt, Bordetella pertussis
agguagaccacgcgcugcgcgcc

SEQ ID NO: 2412013 - RNA, 22 nt, Bordetella pertussis
agguagaucagccgcugcagca

SEQ ID NO: 2412014 - RNA, 15 nt, Bordetella pertussis
agguaggccggcgcg

SEQ ID NO: 2412015 - RNA, 13 nt, Bordetella pertussis
agguaggcggcgc

SEQ ID NO: 2412016 - RNA, 17 nt, Bordetella pertussis
agguaggcgggacuggc

SEQ ID NO: 2412017 - RNA, 19 nt, Bordetella pertussis
agguaggcgggacuggcga

SEQ ID NO: 2412018 - RNA, 16 nt, Bordetella pertussis
agguagggcgcggcca

SEQ ID NO: 2412019 - RNA, 22 nt, Bordetella pertussis
agguaguagccgaauccggcca

SEQ ID NO: 2412020 - RNA, 19 nt, Bordetella pertussis
agguagucgucgaaggcgc

SEQ ID NO: 2412021 - RNA, 18 nt, Bordetella pertussis
agguaucgacccaggccg

SEQ ID NO: 2412022 - RNA, 18 nt, Bordetella pertussis
agguaucggccagcacgu

SEQ ID NO: 2412023 - RNA, 16 nt, Bordetella pertussis
agguaucggcccgcgc

SEQ ID NO: 2412024 - RNA, 21 nt, Bordetella pertussis
agguaucguucgcgcgcgcgg

SEQ ID NO: 2412025 - RNA, 16 nt, Bordetella pertussis
agguauuccgccguca

SEQ ID NO: 2412026 - RNA, 19 nt, Bordetella pertussis
agguauugcggggcggcgu

SEQ ID NO: 2412027 - RNA, 21 nt, Bordetella pertussis
aguaggcggccaggccgaacg

SEQ ID NO: 2412028 - RNA, 14 nt, Bordetella pertussis
aguauucacgccgc

SEQ ID NO: 2412029 - RNA, 13 nt, Bordetella pertussis
agucagcccgcgu

SEQ ID NO: 2412030 - RNA, 19 nt, Bordetella pertussis
agucagccggugccagucc

SEQ ID NO: 2412031 - RNA, 14 nt, Bordetella pertussis
agucaggaaaaucg

SEQ ID NO: 2412032 - RNA, 15 nt, Bordetella pertussis
agucauguagcggcc

SEQ ID NO: 2412033 - RNA, 21 nt, Bordetella pertussis
aguccagcaccggcugccagg

SEQ ID NO: 2412034 - RNA, 15 nt, Bordetella pertussis
aguccagcagcagcg

SEQ ID NO: 2412035 - RNA, 16 nt, Bordetella pertussis
aguccagcgcgccgcg

SEQ ID NO: 2412036 - RNA, 21 nt, Bordetella pertussis
aguccaggccggccugcaaug

SEQ ID NO: 2412037 - RNA, 21 nt, Bordetella pertussis
aguccaggguguccuggucgg

SEQ ID NO: 2412038 - RNA, 14 nt, Bordetella pertussis
aguccaugccgccc

SEQ ID NO: 2412039 - RNA, 20 nt, Bordetella pertussis
agucccaggaucaccgccgc

SEQ ID NO: 2412040 - RNA, 19 nt, Bordetella pertussis
aguccccauguggggacag

SEQ ID NO: 2412041 - RNA, 20 nt, Bordetella pertussis
aguccccauguggggacagg

SEQ ID NO: 2412042 - RNA, 19 nt, Bordetella pertussis
agucccccgcggggacaga

SEQ ID NO: 2412043 - RNA, 19 nt, Bordetella pertussis
aguccccugcggggacagg

SEQ ID NO: 2412044 - RNA, 21 nt, Bordetella pertussis
aguccccugcggggacaggca

SEQ ID NO: 2412045 - RNA, 16 nt, Bordetella pertussis
agucccgcaccgggca

SEQ ID NO: 2412046 - RNA, 13 nt, Bordetella pertussis
aguccgacaggca

SEQ ID NO: 2412047 - RNA, 20 nt, Bordetella pertussis
aguccgacgacaaacccgac

SEQ ID NO: 2412048 - RNA, 16 nt, Bordetella pertussis
aguccgcagcgcagcg

SEQ ID NO: 2412049 - RNA, 22 nt, Bordetella pertussis
aguccgcagcgcagcgccacgc

SEQ ID NO: 2412050 - RNA, 18 nt, Bordetella pertussis
aguccgccgcguugaagu

SEQ ID NO: 2412051 - RNA, 12 nt, Bordetella pertussis
aguccgcgcgca

SEQ ID NO: 2412052 - RNA, 21 nt, Bordetella pertussis
aguccggaucccaggccggcu

SEQ ID NO: 2412053 - RNA, 13 nt, Bordetella pertussis
aguccggcgccgc

SEQ ID NO: 2412054 - RNA, 21 nt, Bordetella pertussis
aguccgguauccuggcgcgga

SEQ ID NO: 2412055 - RNA, 20 nt, Bordetella pertussis
aguccucaugcgggacaggc

SEQ ID NO: 2412056 - RNA, 23 nt, Bordetella pertussis
aguccucaugcgggacaggcgcc

SEQ ID NO: 2412057 - RNA, 15 nt, Bordetella pertussis
aguccuccugucaug

SEQ ID NO: 2412058 - RNA, 18 nt, Bordetella pertussis
aguccucguugcccgcgg

SEQ ID NO: 2412059 - RNA, 15 nt, Bordetella pertussis
aguccucuacuggcu

SEQ ID NO: 2412060 - RNA, 20 nt, Bordetella pertussis
agucgacccaccuggccaca

SEQ ID NO: 2412061 - RNA, 19 nt, Bordetella pertussis
agucgaguucggcgcgccc

SEQ ID NO: 2412062 - RNA, 16 nt, Bordetella pertussis
agucgaugaaggcgcc

SEQ ID NO: 2412063 - RNA, 18 nt, Bordetella pertussis
agucgaugaaggcgccga

SEQ ID NO: 2412064 - RNA, 17 nt, Bordetella pertussis
agucgaugauccacagu

SEQ ID NO: 2412065 - RNA, 12 nt, Bordetella pertussis
agucgccgcgcc

SEQ ID NO: 2412066 - RNA, 16 nt, Bordetella pertussis
agucgccgcgcccgcg

SEQ ID NO: 2412067 - RNA, 17 nt, Bordetella pertussis
agucgccgcgcccgcgg

SEQ ID NO: 2412068 - RNA, 17 nt, Bordetella pertussis
agucgcggaugcgcgcc

SEQ ID NO: 2412069 - RNA, 19 nt, Bordetella pertussis
agucggaguagggcagcga

SEQ ID NO: 2412070 - RNA, 14 nt, Bordetella pertussis
agucggcaggagcc

SEQ ID NO: 2412071 - RNA, 18 nt, Bordetella pertussis
agucggcaggagccuguc

SEQ ID NO: 2412072 - RNA, 12 nt, Bordetella pertussis
agucggccacca

SEQ ID NO: 2412073 - RNA, 15 nt, Bordetella pertussis
agucggccuggcgcu

SEQ ID NO: 2412074 - RNA, 19 nt, Bordetella pertussis
agucggccuggcgcuccuc

SEQ ID NO: 2412075 - RNA, 16 nt, Bordetella pertussis
agucggcgauggcgcg

SEQ ID NO: 2412076 - RNA, 15 nt, Bordetella pertussis
agucgggacggcgcg

SEQ ID NO: 2412077 - RNA, 16 nt, Bordetella pertussis
agucgggcaccagcac

SEQ ID NO: 2412078 - RNA, 16 nt, Bordetella pertussis
agucgggcagcgcccg

SEQ ID NO: 2412079 - RNA, 14 nt, Bordetella pertussis
agucggggcgccgg

SEQ ID NO: 2412080 - RNA, 18 nt, Bordetella pertussis
agucgucgauggcccgca

SEQ ID NO: 2412081 - RNA, 17 nt, Bordetella pertussis
agucguugccggccagc

SEQ ID NO: 2412082 - RNA, 24 nt, Bordetella pertussis
agucguugccggccagcacgggcg

SEQ ID NO: 2412083 - RNA, 19 nt, Bordetella pertussis
agucugcgccuuccgggcg

SEQ ID NO: 2412084 - RNA, 22 nt, Bordetella pertussis
agucuucuucagcauggagcug

SEQ ID NO: 2412085 - RNA, 18 nt, Bordetella pertussis
agugaaacgcgacgcgcc

SEQ ID NO: 2412086 - RNA, 21 nt, Bordetella pertussis
agugaaagguucggagcacgg

SEQ ID NO: 2412087 - RNA, 22 nt, Bordetella pertussis
agugaucaccgccauggcggcc

SEQ ID NO: 2412088 - RNA, 16 nt, Bordetella pertussis
agugaugccgccggcg

SEQ ID NO: 2412089 - RNA, 13 nt, Bordetella pertussis
agugcagcgcuca

SEQ ID NO: 2412090 - RNA, 12 nt, Bordetella pertussis
agugcaggcccg

SEQ ID NO: 2412091 - RNA, 13 nt, Bordetella pertussis
agugcaggccgcg

SEQ ID NO: 2412092 - RNA, 15 nt, Bordetella pertussis
agugcaggccgcgca

SEQ ID NO: 2412093 - RNA, 16 nt, Bordetella pertussis
agugcaggccgcgcag

SEQ ID NO: 2412094 - RNA, 20 nt, Bordetella pertussis
agugcaggggguggcggccg

SEQ ID NO: 2412095 - RNA, 22 nt, Bordetella pertussis
agugcaggggguggcggccguc

SEQ ID NO: 2412096 - RNA, 17 nt, Bordetella pertussis
agugcccaggcccgugc

SEQ ID NO: 2412097 - RNA, 13 nt, Bordetella pertussis
agugcccccacgc

SEQ ID NO: 2412098 - RNA, 16 nt, Bordetella pertussis
agugcccccacgcugc

SEQ ID NO: 2412099 - RNA, 19 nt, Bordetella pertussis
agugcccccacgcugcgcc

SEQ ID NO: 2412100 - RNA, 22 nt, Bordetella pertussis
agugcccccacgcugcgcccgc

SEQ ID NO: 2412101 - RNA, 23 nt, Bordetella pertussis
agugccuggacgcgcuggccgac

SEQ ID NO: 2412102 - RNA, 15 nt, Bordetella pertussis
agugcgccccgccac

SEQ ID NO: 2412103 - RNA, 17 nt, Bordetella pertussis
agugcgccccgccacgu

SEQ ID NO: 2412104 - RNA, 20 nt, Bordetella pertussis
agugcgccccgccacgucgc

SEQ ID NO: 2412105 - RNA, 16 nt, Bordetella pertussis
agugcgccggcggcgg

SEQ ID NO: 2412106 - RNA, 17 nt, Bordetella pertussis
aguggaaccgcgguacg

SEQ ID NO: 2412107 - RNA, 22 nt, Bordetella pertussis
aguggaugcgcuugccgcccac

SEQ ID NO: 2412108 - RNA, 17 nt, Bordetella pertussis
aguggcaggaggcggcg

SEQ ID NO: 2412109 - RNA, 17 nt, Bordetella pertussis
aguggcccaagcccgug

SEQ ID NO: 2412110 - RNA, 18 nt, Bordetella pertussis
aguggcgagggucaggcg

SEQ ID NO: 2412111 - RNA, 19 nt, Bordetella pertussis
agugggccaguucgcggcg

SEQ ID NO: 2412112 - RNA, 22 nt, Bordetella pertussis
agugguaugaccggcgcggccu

SEQ ID NO: 2412113 - RNA, 15 nt, Bordetella pertussis
aguggucgccggcgc

SEQ ID NO: 2412114 - RNA, 13 nt, Bordetella pertussis
aguggugcgcggu

SEQ ID NO: 2412115 - RNA, 18 nt, Bordetella pertussis
agugguggugcagcggca

SEQ ID NO: 2412116 - RNA, 19 nt, Bordetella pertussis
agugguggugcagcggcag

SEQ ID NO: 2412117 - RNA, 24 nt, Bordetella pertussis
agugguggugcagcggcagcaugg

SEQ ID NO: 2412118 - RNA, 23 nt, Bordetella pertussis
agugguucaugcguucggccagc

SEQ ID NO: 2412119 - RNA, 13 nt, Bordetella pertussis
aguguggcgcacc

SEQ ID NO: 2412120 - RNA, 18 nt, Bordetella pertussis
aguguggcgcaccgcgcu

SEQ ID NO: 2412121 - RNA, 20 nt, Bordetella pertussis
aguguucgauggcggccagg

SEQ ID NO: 2412122 - RNA, 14 nt, Bordetella pertussis
aguguuucggccug

SEQ ID NO: 2412123 - RNA, 16 nt, Bordetella pertussis
aguucagcagcucgca

SEQ ID NO: 2412124 - RNA, 21 nt, Bordetella pertussis
aguucagggcgaacugcucgu

SEQ ID NO: 2412125 - RNA, 19 nt, Bordetella pertussis
aguucaucaucgccgacgc

SEQ ID NO: 2412126 - RNA, 16 nt, Bordetella pertussis
aguucauccacagcca

SEQ ID NO: 2412127 - RNA, 15 nt, Bordetella pertussis
aguucgacgcccaug

SEQ ID NO: 2412128 - RNA, 16 nt, Bordetella pertussis
aguucgcgcgccggca

SEQ ID NO: 2412129 - RNA, 17 nt, Bordetella pertussis
aguucgcugccgggauc

SEQ ID NO: 2412130 - RNA, 16 nt, Bordetella pertussis
aguucgcuuuccaggg

SEQ ID NO: 2412131 - RNA, 13 nt, Bordetella pertussis
aguucggccagca

SEQ ID NO: 2412132 - RNA, 16 nt, Bordetella pertussis
aguucggccagcagcu

SEQ ID NO: 2412133 - RNA, 17 nt, Bordetella pertussis
aguucggccagcggcag

SEQ ID NO: 2412134 - RNA, 18 nt, Bordetella pertussis
aguucggccagcggcagg

SEQ ID NO: 2412135 - RNA, 14 nt, Bordetella pertussis
aguucggccgccag

SEQ ID NO: 2412136 - RNA, 19 nt, Bordetella pertussis
aguucggcgcggccuugca

SEQ ID NO: 2412137 - RNA, 14 nt, Bordetella pertussis
aguucggcgcgugc

SEQ ID NO: 2412138 - RNA, 18 nt, Bordetella pertussis
aguucggcgggaucugca

SEQ ID NO: 2412139 - RNA, 21 nt, Bordetella pertussis
aguucggcgucggugccgucc

SEQ ID NO: 2412140 - RNA, 20 nt, Bordetella pertussis
aucacaucgcuaugcagcug

SEQ ID NO: 2412141 - RNA, 13 nt, Bordetella pertussis
aucaccaccggca

SEQ ID NO: 2412142 - RNA, 17 nt, Bordetella pertussis
aucaccaccggcaaggc

SEQ ID NO: 2412143 - RNA, 24 nt, Bordetella pertussis
aucaccaggguggcgggcgccugc

SEQ ID NO: 2412144 - RNA, 16 nt, Bordetella pertussis
aucacccagcggcugg

SEQ ID NO: 2412145 - RNA, 18 nt, Bordetella pertussis
aucaccgagugggcggcc

SEQ ID NO: 2412146 - RNA, 14 nt, Bordetella pertussis
aucaccgccgcgcc

SEQ ID NO: 2412147 - RNA, 18 nt, Bordetella pertussis
aucaccgccgcggcgaug

SEQ ID NO: 2412148 - RNA, 20 nt, Bordetella pertussis
aucaccugggccaucgggau

SEQ ID NO: 2412149 - RNA, 17 nt, Bordetella pertussis
aucacgaacagcgccag

SEQ ID NO: 2412150 - RNA, 18 nt, Bordetella pertussis
aucacgaacagcgccagg

SEQ ID NO: 2412151 - RNA, 19 nt, Bordetella pertussis
aucacgccgaucuucugga

SEQ ID NO: 2412152 - RNA, 19 nt, Bordetella pertussis
aucacgcuaaauacgcugg

SEQ ID NO: 2412153 - RNA, 18 nt, Bordetella pertussis
aucacgggaaugaagcgc

SEQ ID NO: 2412154 - RNA, 14 nt, Bordetella pertussis
aucacgggcgccag

SEQ ID NO: 2412155 - RNA, 20 nt, Bordetella pertussis
aucacgggcgccagcagcgg

SEQ ID NO: 2412156 - RNA, 21 nt, Bordetella pertussis
aucacgggcgccagcagcggg

SEQ ID NO: 2412157 - RNA, 22 nt, Bordetella pertussis
aucacgggcuguucgcgcagca

SEQ ID NO: 2412158 - RNA, 18 nt, Bordetella pertussis
aucacggugccgccgauc

SEQ ID NO: 2412159 - RNA, 23 nt, Bordetella pertussis
aucacgugguccacgaagcaggu

SEQ ID NO: 2412160 - RNA, 20 nt, Bordetella pertussis
aucacuuucccauccuggcc

SEQ ID NO: 2412161 - RNA, 14 nt, Bordetella pertussis
aucagaaaggcagc

SEQ ID NO: 2412162 - RNA, 16 nt, Bordetella pertussis
aucagaaaggcagcgg

SEQ ID NO: 2412163 - RNA, 21 nt, Bordetella pertussis
aucagcaagggccccagcauc

SEQ ID NO: 2412164 - RNA, 21 nt, Bordetella pertussis
aucagcaccacggcggccagg

SEQ ID NO: 2412165 - RNA, 19 nt, Bordetella pertussis
aucagcaccgcgaccaugc

SEQ ID NO: 2412166 - RNA, 20 nt, Bordetella pertussis
aucagcacgaucuggcgcgc

SEQ ID NO: 2412167 - RNA, 16 nt, Bordetella pertussis
aucagcacgauggugu

SEQ ID NO: 2412168 - RNA, 23 nt, Bordetella pertussis
aucagcagacccuggcgcgcguu

SEQ ID NO: 2412169 - RNA, 12 nt, Bordetella pertussis
aucagcaggccc

SEQ ID NO: 2412170 - RNA, 18 nt, Bordetella pertussis
aucagcaggucggcgcgg

SEQ ID NO: 2412171 - RNA, 15 nt, Bordetella pertussis
aucagcauggcgugc

SEQ ID NO: 2412172 - RNA, 10 nt, Bordetella pertussis
aucagccacc

SEQ ID NO: 2412173 - RNA, 19 nt, Bordetella pertussis
aucagccacgugaagcgcc

SEQ ID NO: 2412174 - RNA, 14 nt, Bordetella pertussis
aucagccagccgcu

SEQ ID NO: 2412175 - RNA, 14 nt, Bordetella pertussis
aucagccagccggc

SEQ ID NO: 2412176 - RNA, 19 nt, Bordetella pertussis
aucagccccugccaugccc

SEQ ID NO: 2412177 - RNA, 16 nt, Bordetella pertussis
aucagccggccauggc

SEQ ID NO: 2412178 - RNA, 21 nt, Bordetella pertussis
aucagcgaaugcgacagcgac

SEQ ID NO: 2412179 - RNA, 15 nt, Bordetella pertussis
aucagcgccugcagg

SEQ ID NO: 2412180 - RNA, 16 nt, Bordetella pertussis
aucagcgccugcaggu

SEQ ID NO: 2412181 - RNA, 22 nt, Bordetella pertussis
aucagcgcgcccgcuuccuugg

SEQ ID NO: 2412182 - RNA, 14 nt, Bordetella pertussis
aucagcgcgccguc

SEQ ID NO: 2412183 - RNA, 16 nt, Bordetella pertussis
aucagcgcgucggcgc

SEQ ID NO: 2412184 - RNA, 19 nt, Bordetella pertussis
aucagcgcgucggcgccga

SEQ ID NO: 2412185 - RNA, 20 nt, Bordetella pertussis
aucagcggauugaccagcgc

SEQ ID NO: 2412186 - RNA, 19 nt, Bordetella pertussis
aucagcggcggcacgcgcg

SEQ ID NO: 2412187 - RNA, 15 nt, Bordetella pertussis
aucagcgggcuggcc

SEQ ID NO: 2412188 - RNA, 16 nt, Bordetella pertussis
aucagcgugccgccgg

SEQ ID NO: 2412189 - RNA, 17 nt, Bordetella pertussis
aucagcgugccgccggc

SEQ ID NO: 2412190 - RNA, 20 nt, Bordetella pertussis
aucagcucgaccacggcggc

SEQ ID NO: 2412191 - RNA, 16 nt, Bordetella pertussis
aucagcuuggccacca

SEQ ID NO: 2412192 - RNA, 22 nt, Bordetella pertussis
aucaggaugaacaucggcagcg

SEQ ID NO: 2412193 - RNA, 20 nt, Bordetella pertussis
aucaggaugggcgcggcgcg

SEQ ID NO: 2412194 - RNA, 22 nt, Bordetella pertussis
aucaggaugggcgcggcgcgcg

SEQ ID NO: 2412195 - RNA, 17 nt, Bordetella pertussis
aucaggcccacgaugcg

SEQ ID NO: 2412196 - RNA, 20 nt, Bordetella pertussis
aucaggcccacgaugcgggc

SEQ ID NO: 2412197 - RNA, 13 nt, Bordetella pertussis
aucaggcccagca

SEQ ID NO: 2412198 - RNA, 14 nt, Bordetella pertussis
aucaggccgcccca

SEQ ID NO: 2412199 - RNA, 18 nt, Bordetella pertussis
aucaggcgcaucgacagc

SEQ ID NO: 2412200 - RNA, 22 nt, Bordetella pertussis
aucaggcgcuccauggcgccgg

SEQ ID NO: 2412201 - RNA, 12 nt, Bordetella pertussis
aucaggcggcgc

SEQ ID NO: 2412202 - RNA, 14 nt, Bordetella pertussis
aucaggcggcgcgg

SEQ ID NO: 2412203 - RNA, 17 nt, Bordetella pertussis
aucaggcggcgcggcga

SEQ ID NO: 2412204 - RNA, 18 nt, Bordetella pertussis
aucaggcggcugcccacc

SEQ ID NO: 2412205 - RNA, 20 nt, Bordetella pertussis
aucaggggcucggccaggug

SEQ ID NO: 2412206 - RNA, 21 nt, Bordetella pertussis
aucagguccacuucaccgcug

SEQ ID NO: 2412207 - RNA, 13 nt, Bordetella pertussis
aucagguccauga

SEQ ID NO: 2412208 - RNA, 16 nt, Bordetella pertussis
aucagguccaugaacg

SEQ ID NO: 2412209 - RNA, 17 nt, Bordetella pertussis
aucaggucgaugccggc

SEQ ID NO: 2412210 - RNA, 15 nt, Bordetella pertussis
aucaggugaaacagc

SEQ ID NO: 2412211 - RNA, 13 nt, Bordetella pertussis
aucaggugcaggg

SEQ ID NO: 2412212 - RNA, 22 nt, Bordetella pertussis
aucaguucgcgcaggcgugcgc

SEQ ID NO: 2412213 - RNA, 14 nt, Bordetella pertussis
aucaucagcauggc

SEQ ID NO: 2412214 - RNA, 11 nt, Bordetella pertussis
aucaucaggau

SEQ ID NO: 2412215 - RNA, 17 nt, Bordetella pertussis
aucaucagguccacuuc

SEQ ID NO: 2412216 - RNA, 13 nt, Bordetella pertussis
aucauccgggccc

SEQ ID NO: 2412217 - RNA, 19 nt, Bordetella pertussis
aucaucgaccaccagcggc

SEQ ID NO: 2412218 - RNA, 16 nt, Bordetella pertussis
aucaucgccgacgcgc

SEQ ID NO: 2412219 - RNA, 14 nt, Bordetella pertussis
aucaucggcgccau

SEQ ID NO: 2412220 - RNA, 16 nt, Bordetella pertussis
aucaucggcgccauca

SEQ ID NO: 2412221 - RNA, 16 nt, Bordetella pertussis
aucaucgucggcgcca

SEQ ID NO: 2412222 - RNA, 19 nt, Bordetella pertussis
aucaugaccacgucgauca

SEQ ID NO: 2412223 - RNA, 14 nt, Bordetella pertussis
aucaugaggcggcg

SEQ ID NO: 2412224 - RNA, 23 nt, Bordetella pertussis
aucaugaugcgcugggccaggcc

SEQ ID NO: 2412225 - RNA, 22 nt, Bordetella pertussis
aucaugcaguacaggcgcgugg

SEQ ID NO: 2412226 - RNA, 14 nt, Bordetella pertussis
aucauggcgucggc

SEQ ID NO: 2412227 - RNA, 19 nt, Bordetella pertussis
aucauggcgucggccacgu

SEQ ID NO: 2412228 - RNA, 15 nt, Bordetella pertussis
aucaugggccugccc

SEQ ID NO: 2412229 - RNA, 21 nt, Bordetella pertussis
aucaugggcgaagccacggcc

SEQ ID NO: 2412230 - RNA, 23 nt, Bordetella pertussis
aucaugucguccucggccacguc

SEQ ID NO: 2412231 - RNA, 13 nt, Bordetella pertussis
aucauuggccagc

SEQ ID NO: 2412232 - RNA, 13 nt, Bordetella pertussis
auccaccggcgcg

SEQ ID NO: 2412233 - RNA, 20 nt, Bordetella pertussis
auccaccggcgcgcgcaugc

SEQ ID NO: 2412234 - RNA, 12 nt, Bordetella pertussis
auccacgccgcc

SEQ ID NO: 2412235 - RNA, 19 nt, Bordetella pertussis
auccacgccuucggcgcgc

SEQ ID NO: 2412236 - RNA, 22 nt, Bordetella pertussis
auccacgccuucggcgcgcgcc

SEQ ID NO: 2412237 - RNA, 13 nt, Bordetella pertussis
auccacggccggc

SEQ ID NO: 2412238 - RNA, 17 nt, Bordetella pertussis
auccacggccggcgcac

SEQ ID NO: 2412239 - RNA, 15 nt, Bordetella pertussis
auccacugcagcagu

SEQ ID NO: 2412240 - RNA, 19 nt, Bordetella pertussis
auccacugcagcaguucgg

SEQ ID NO: 2412241 - RNA, 22 nt, Bordetella pertussis
auccacuugcggguccagcagg

SEQ ID NO: 2412242 - RNA, 15 nt, Bordetella pertussis
auccagcccgcgggu

SEQ ID NO: 2412243 - RNA, 15 nt, Bordetella pertussis
auccagccgaucagc

SEQ ID NO: 2412244 - RNA, 16 nt, Bordetella pertussis
auccagccgaucagcc

SEQ ID NO: 2412245 - RNA, 22 nt, Bordetella pertussis
auccagccguuggcgcccagcg

SEQ ID NO: 2412246 - RNA, 14 nt, Bordetella pertussis
auccagcgaggcau

SEQ ID NO: 2412247 - RNA, 21 nt, Bordetella pertussis
auccagcgccagcaccggcac

SEQ ID NO: 2412248 - RNA, 13 nt, Bordetella pertussis
auccagcgccugg

SEQ ID NO: 2412249 - RNA, 14 nt, Bordetella pertussis
auccagcgcgccca

SEQ ID NO: 2412250 - RNA, 20 nt, Bordetella pertussis
auccagcgcgcgaucgccag

SEQ ID NO: 2412251 - RNA, 22 nt, Bordetella pertussis
auccagcgcgcgaucgccagca

SEQ ID NO: 2412252 - RNA, 17 nt, Bordetella pertussis
auccagcgcucgggcuc

SEQ ID NO: 2412253 - RNA, 14 nt, Bordetella pertussis
aucgauggccacga

SEQ ID NO: 2412254 - RNA, 14 nt, Bordetella pertussis
aucgauggccaggu

SEQ ID NO: 2412255 - RNA, 21 nt, Bordetella pertussis
aucgaugugcaugccgucgcg

SEQ ID NO: 2412256 - RNA, 16 nt, Bordetella pertussis
aucgauuucucgcugc

SEQ ID NO: 2412257 - RNA, 19 nt, Bordetella pertussis
aucgcacacaccgcgucau

SEQ ID NO: 2412258 - RNA, 17 nt, Bordetella pertussis
aucgcaucgcggcagcc

SEQ ID NO: 2412259 - RNA, 19 nt, Bordetella pertussis
aucgcaucgcggcagcccg

SEQ ID NO: 2412260 - RNA, 18 nt, Bordetella pertussis
aucgcauuucucggccug

SEQ ID NO: 2412261 - RNA, 20 nt, Bordetella pertussis
aucgccaccagcgucagcac

SEQ ID NO: 2412262 - RNA, 17 nt, Bordetella pertussis
aucgccaggaccaggau

SEQ ID NO: 2412263 - RNA, 20 nt, Bordetella pertussis
aucgccaggaccaggaugau

SEQ ID NO: 2412264 - RNA, 14 nt, Bordetella pertussis
aucgccaggcgcgu

SEQ ID NO: 2412265 - RNA, 22 nt, Bordetella pertussis
aucgccaggucggccagccggc

SEQ ID NO: 2412266 - RNA, 15 nt, Bordetella pertussis
aucgccauccaggua

SEQ ID NO: 2412267 - RNA, 15 nt, Bordetella pertussis
aucgccaucgaccgc

SEQ ID NO: 2412268 - RNA, 17 nt, Bordetella pertussis
aucgccaugacgcuggu

SEQ ID NO: 2412269 - RNA, 16 nt, Bordetella pertussis
aucgcccaccaugagc

SEQ ID NO: 2412270 - RNA, 18 nt, Bordetella pertussis
aucgcccaccaugagcac

SEQ ID NO: 2412271 - RNA, 16 nt, Bordetella pertussis
aucgcccauugcggcg

SEQ ID NO: 2412272 - RNA, 20 nt, Bordetella pertussis
aucgcccauugcggcgggcg

SEQ ID NO: 2412273 - RNA, 19 nt, Bordetella pertussis
aucgcccauuuccuguucg

SEQ ID NO: 2412274 - RNA, 19 nt, Bordetella pertussis
aucgcccgcgugcgugccg

SEQ ID NO: 2412275 - RNA, 14 nt, Bordetella pertussis
aucgcccggcaggu

SEQ ID NO: 2412276 - RNA, 16 nt, Bordetella pertussis
aucgcccgggcgccgg

SEQ ID NO: 2412277 - RNA, 17 nt, Bordetella pertussis
aucgcccgggcgccggc

SEQ ID NO: 2412278 - RNA, 17 nt, Bordetella pertussis
aucgccgaagucggcgc

SEQ ID NO: 2412279 - RNA, 20 nt, Bordetella pertussis
aucgccgacgcgccgggcca

SEQ ID NO: 2412280 - RNA, 13 nt, Bordetella pertussis
aucgccgcaggcg

SEQ ID NO: 2412281 - RNA, 16 nt, Bordetella pertussis
aucgccgccagcuugg

SEQ ID NO: 2412282 - RNA, 11 nt, Bordetella pertussis
aucgccgccgc

SEQ ID NO: 2412283 - RNA, 15 nt, Bordetella pertussis
aucgccgccgcccgc

SEQ ID NO: 2412284 - RNA, 13 nt, Bordetella pertussis
aucgccgccggca

SEQ ID NO: 2412285 - RNA, 13 nt, Bordetella pertussis
aucgccgcgggcg

SEQ ID NO: 2412286 - RNA, 24 nt, Bordetella pertussis
aucgccgcgucguucaucgcccau

SEQ ID NO: 2412287 - RNA, 19 nt, Bordetella pertussis
aucgccgcugcgcagcagc

SEQ ID NO: 2412288 - RNA, 17 nt, Bordetella pertussis
aucgccggcggcguggc

SEQ ID NO: 2412289 - RNA, 18 nt, Bordetella pertussis
aucgccggcuacggcaag

SEQ ID NO: 2412290 - RNA, 17 nt, Bordetella pertussis
aucgccgggcaggcauu

SEQ ID NO: 2412291 - RNA, 23 nt, Bordetella pertussis
aucgccggugggauaaggcgugc

SEQ ID NO: 2412292 - RNA, 20 nt, Bordetella pertussis
aucgccucgacgggauccuc

SEQ ID NO: 2412293 - RNA, 20 nt, Bordetella pertussis
aucgccuggggcaguuucca

SEQ ID NO: 2412294 - RNA, 16 nt, Bordetella pertussis
aucgccuggggcgggc

SEQ ID NO: 2412295 - RNA, 21 nt, Bordetella pertussis
aucgccuguaucugcgccgug

SEQ ID NO: 2412296 - RNA, 15 nt, Bordetella pertussis
aucgcgaaagcggcg

SEQ ID NO: 2412297 - RNA, 16 nt, Bordetella pertussis
aucgcgagugcuucca

SEQ ID NO: 2412298 - RNA, 13 nt, Bordetella pertussis
aucgcgaugcgca

SEQ ID NO: 2412299 - RNA, 20 nt, Bordetella pertussis
aucgcgcagcgugcggacca

SEQ ID NO: 2412300 - RNA, 17 nt, Bordetella pertussis
aucgcgccagcgccgcg

SEQ ID NO: 2412301 - RNA, 20 nt, Bordetella pertussis
aucgcgccagcgccgcgcgc

SEQ ID NO: 2412302 - RNA, 23 nt, Bordetella pertussis
aucgcgccagcgccgcgcgcgug

SEQ ID NO: 2412303 - RNA, 12 nt, Bordetella pertussis
aucgcgcccagc

SEQ ID NO: 2412304 - RNA, 14 nt, Bordetella pertussis
aucgcgccggccug

SEQ ID NO: 2412305 - RNA, 18 nt, Bordetella pertussis
aucgcgccuucggcgcgc

SEQ ID NO: 2412306 - RNA, 16 nt, Bordetella pertussis
aucgcgcugacagcgc

SEQ ID NO: 2412307 - RNA, 13 nt, Bordetella pertussis
aucgcgcuggacc

SEQ ID NO: 2412308 - RNA, 19 nt, Bordetella pertussis
aucgcgcuggcgcgcgacg

SEQ ID NO: 2412309 - RNA, 20 nt, Bordetella pertussis
aucgcgcuggcgcgcgacgg

SEQ ID NO: 2412310 - RNA, 23 nt, Bordetella pertussis
aucgcgcuggcgguggccgcgca

SEQ ID NO: 2412311 - RNA, 21 nt, Bordetella pertussis
aucgcgcuucucggugcgccg

SEQ ID NO: 2412312 - RNA, 23 nt, Bordetella pertussis
aucgcgcuucucggugcgccgcc

SEQ ID NO: 2412313 - RNA, 18 nt, Bordetella pertussis
aucgcggcagcccggcac

SEQ ID NO: 2412314 - RNA, 16 nt, Bordetella pertussis
aucgcggccagcggca

SEQ ID NO: 2412315 - RNA, 18 nt, Bordetella pertussis
aucgcggccagcggcagg

SEQ ID NO: 2412316 - RNA, 14 nt, Bordetella pertussis
aucgcggcgcggcg

SEQ ID NO: 2412317 - RNA, 19 nt, Bordetella pertussis
aucgcggcgcggcgcaggc

SEQ ID NO: 2412318 - RNA, 21 nt, Bordetella pertussis
aucgcggcgcggcgcaggccu

SEQ ID NO: 2412319 - RNA, 15 nt, Bordetella pertussis
aucgcggcgcggcuu

SEQ ID NO: 2412320 - RNA, 13 nt, Bordetella pertussis
aucgcggcgcugg

SEQ ID NO: 2412321 - RNA, 17 nt, Bordetella pertussis
aucgcggcgcugugcaa

SEQ ID NO: 2412322 - RNA, 17 nt, Bordetella pertussis
aucgcggcggguggccu

SEQ ID NO: 2412323 - RNA, 18 nt, Bordetella pertussis
aucgcggcggguggccuc

SEQ ID NO: 2412324 - RNA, 15 nt, Bordetella pertussis
aucgcggucaucggc

SEQ ID NO: 2412325 - RNA, 18 nt, Bordetella pertussis
aucgcgguccugaccggc

SEQ ID NO: 2412326 - RNA, 22 nt, Bordetella pertussis
aucgcgguccugaccggcggcg

SEQ ID NO: 2412327 - RNA, 20 nt, Bordetella pertussis
aucgcguccaggcccagcgc

SEQ ID NO: 2412328 - RNA, 22 nt, Bordetella pertussis
aucgcguccaggcccagcgcgu

SEQ ID NO: 2412329 - RNA, 22 nt, Bordetella pertussis
aucgcgucgacggugcgcgcca

SEQ ID NO: 2412330 - RNA, 17 nt, Bordetella pertussis
aucgcuaugcagcugcg

SEQ ID NO: 2412331 - RNA, 17 nt, Bordetella pertussis
aucgcuuccuuggucag

SEQ ID NO: 2412332 - RNA, 15 nt, Bordetella pertussis
aucggaauuggcggc

SEQ ID NO: 2412333 - RNA, 22 nt, Bordetella pertussis
aucggacgggccgaugaagacg

SEQ ID NO: 2412334 - RNA, 23 nt, Bordetella pertussis
aucggagaaaucgccgccggcgg

SEQ ID NO: 2412335 - RNA, 17 nt, Bordetella pertussis
aucggagguaugcacga

SEQ ID NO: 2412336 - RNA, 14 nt, Bordetella pertussis
aucggcaaggcgca

SEQ ID NO: 2412337 - RNA, 16 nt, Bordetella pertussis
aucggcacccagccgg

SEQ ID NO: 2412338 - RNA, 17 nt, Bordetella pertussis
aucggcacgggucaggc

SEQ ID NO: 2412339 - RNA, 12 nt, Bordetella pertussis
aucggcaggccg

SEQ ID NO: 2412340 - RNA, 14 nt, Bordetella pertussis
aucggcaggccggc

SEQ ID NO: 2412341 - RNA, 21 nt, Bordetella pertussis
aucggcauuucgcauaccggc

SEQ ID NO: 2412342 - RNA, 21 nt, Bordetella pertussis
aucggccacgcugcccugcug

SEQ ID NO: 2412343 - RNA, 23 nt, Bordetella pertussis
aucggccacgcugcccugcugcu

SEQ ID NO: 2412344 - RNA, 17 nt, Bordetella pertussis
aucggccaggccggccu

SEQ ID NO: 2412345 - RNA, 16 nt, Bordetella pertussis
aucggcccgcgccagc

SEQ ID NO: 2412346 - RNA, 22 nt, Bordetella pertussis
aucggcccgcgccagcgccacg

SEQ ID NO: 2412347 - RNA, 18 nt, Bordetella pertussis
aucggcccguuccacagg

SEQ ID NO: 2412348 - RNA, 21 nt, Bordetella pertussis
aucggcccguuccacaggcga

SEQ ID NO: 2412349 - RNA, 19 nt, Bordetella pertussis
aucggccggcggucgcgcu

SEQ ID NO: 2412350 - RNA, 18 nt, Bordetella pertussis
aucggcgacgaucccgac

SEQ ID NO: 2412351 - RNA, 11 nt, Bordetella pertussis
aucggcgccaa

SEQ ID NO: 2412352 - RNA, 18 nt, Bordetella pertussis
aucggcgccaagcggcag

SEQ ID NO: 2412353 - RNA, 20 nt, Bordetella pertussis
aucggcgccaagcggcaggc

SEQ ID NO: 2412354 - RNA, 13 nt, Bordetella pertussis
aucggcgccauga

SEQ ID NO: 2412355 - RNA, 15 nt, Bordetella pertussis
aucggcgccgcgcgc

SEQ ID NO: 2412356 - RNA, 22 nt, Bordetella pertussis
aucggcgccggcguccacggca

SEQ ID NO: 2412357 - RNA, 16 nt, Bordetella pertussis
aucggcgccuggccgc

SEQ ID NO: 2412358 - RNA, 23 nt, Bordetella pertussis
aucggcgccuggccgcccagcgc

SEQ ID NO: 2412359 - RNA, 15 nt, Bordetella pertussis
aucggcgcgagcgau

SEQ ID NO: 2412360 - RNA, 20 nt, Bordetella pertussis
aucggcgcgagcgaugcccu

SEQ ID NO: 2412361 - RNA, 18 nt, Bordetella pertussis
aucggcgcgcgcugcacg

SEQ ID NO: 2412362 - RNA, 17 nt, Bordetella pertussis
aucggcgcuggccuggc

SEQ ID NO: 2412363 - RNA, 18 nt, Bordetella pertussis
aucggcggccugggccau

SEQ ID NO: 2412364 - RNA, 17 nt, Bordetella pertussis
aucggcggcuugcgguc

SEQ ID NO: 2412365 - RNA, 22 nt, Bordetella pertussis
aucggcguaccaggcagccggc

SEQ ID NO: 2412366 - RNA, 22 nt, Bordetella pertussis
augaacggcagcgcgcgcguga

SEQ ID NO: 2412367 - RNA, 16 nt, Bordetella pertussis
augaagaugccgaacc

SEQ ID NO: 2412368 - RNA, 18 nt, Bordetella pertussis
augaagcccgagcggcgc

SEQ ID NO: 2412369 - RNA, 13 nt, Bordetella pertussis
augaagcgcagca

SEQ ID NO: 2412370 - RNA, 18 nt, Bordetella pertussis
augaagcgguggcggccg

SEQ ID NO: 2412371 - RNA, 16 nt, Bordetella pertussis
augaagcguucggccu

SEQ ID NO: 2412372 - RNA, 16 nt, Bordetella pertussis
augaagcugcccagca

SEQ ID NO: 2412373 - RNA, 19 nt, Bordetella pertussis
augaaggcggccagcaugc

SEQ ID NO: 2412374 - RNA, 22 nt, Bordetella pertussis
augaaggcggccagcaugcugg

SEQ ID NO: 2412375 - RNA, 12 nt, Bordetella pertussis
augaagggcugg

SEQ ID NO: 2412376 - RNA, 17 nt, Bordetella pertussis
augaagggcuggccggc

SEQ ID NO: 2412377 - RNA, 22 nt, Bordetella pertussis
augaagggcuggccggccaaca

SEQ ID NO: 2412378 - RNA, 23 nt, Bordetella pertussis
augaaggucucguagaccggcac

SEQ ID NO: 2412379 - RNA, 23 nt, Bordetella pertussis
augaaggugcgcagcagguggau

SEQ ID NO: 2412380 - RNA, 21 nt, Bordetella pertussis
augaaucgcaugcgguuucuc

SEQ ID NO: 2412381 - RNA, 20 nt, Bordetella pertussis
augaauugcgccacgcccac

SEQ ID NO: 2412382 - RNA, 16 nt, Bordetella pertussis
augacauggccacggc

SEQ ID NO: 2412383 - RNA, 20 nt, Bordetella pertussis
augaccacgucgaucaggcc

SEQ ID NO: 2412384 - RNA, 15 nt, Bordetella pertussis
augaccagccagccg

SEQ ID NO: 2412385 - RNA, 16 nt, Bordetella pertussis
augaccagggcgccga

SEQ ID NO: 2412386 - RNA, 18 nt, Bordetella pertussis
augaccagggcgccgacc

SEQ ID NO: 2412387 - RNA, 19 nt, Bordetella pertussis
augaccagggcgccgaccg

SEQ ID NO: 2412388 - RNA, 16 nt, Bordetella pertussis
augaccaucacgagca

SEQ ID NO: 2412389 - RNA, 12 nt, Bordetella pertussis
augaccaucgcg

SEQ ID NO: 2412390 - RNA, 17 nt, Bordetella pertussis
augaccgacaggcggcu

SEQ ID NO: 2412391 - RNA, 18 nt, Bordetella pertussis
augaccgacaggcggcug

SEQ ID NO: 2412392 - RNA, 13 nt, Bordetella pertussis
augaccgccggca

SEQ ID NO: 2412393 - RNA, 20 nt, Bordetella pertussis
augaccgccggcaccagcgc

SEQ ID NO: 2412394 - RNA, 20 nt, Bordetella pertussis
augaccgcguccgcgacgcu

SEQ ID NO: 2412395 - RNA, 19 nt, Bordetella pertussis
augaccggccaggcgcgga

SEQ ID NO: 2412396 - RNA, 21 nt, Bordetella pertussis
augaccgggucgucgggcggc

SEQ ID NO: 2412397 - RNA, 20 nt, Bordetella pertussis
augaccucgcgcugcagcau

SEQ ID NO: 2412398 - RNA, 23 nt, Bordetella pertussis
augaccucgcgcugcagcaugaa

SEQ ID NO: 2412399 - RNA, 14 nt, Bordetella pertussis
augaccucggccug

SEQ ID NO: 2412400 - RNA, 15 nt, Bordetella pertussis
augaccucggccugc

SEQ ID NO: 2412401 - RNA, 15 nt, Bordetella pertussis
augaccugcgacagc

SEQ ID NO: 2412402 - RNA, 12 nt, Bordetella pertussis
augaccugggcc

SEQ ID NO: 2412403 - RNA, 20 nt, Bordetella pertussis
augaccuugagaugccagcg

SEQ ID NO: 2412404 - RNA, 22 nt, Bordetella pertussis
augacgaccuugcggccgcgca

SEQ ID NO: 2412405 - RNA, 23 nt, Bordetella pertussis
augacgacgaaacccgggccguc

SEQ ID NO: 2412406 - RNA, 14 nt, Bordetella pertussis
augacgcagccgcc

SEQ ID NO: 2412407 - RNA, 22 nt, Bordetella pertussis
augacgccgggcgcggcccggc

SEQ ID NO: 2412408 - RNA, 13 nt, Bordetella pertussis
augacgcgccgcg

SEQ ID NO: 2412409 - RNA, 16 nt, Bordetella pertussis
augacgcgccgcgccu

SEQ ID NO: 2412410 - RNA, 22 nt, Bordetella pertussis
augacgcgcugaugcgcggcgg

SEQ ID NO: 2412411 - RNA, 14 nt, Bordetella pertussis
augacgggcggcgg

SEQ ID NO: 2412412 - RNA, 17 nt, Bordetella pertussis
augacgggcggcggcgc

SEQ ID NO: 2412413 - RNA, 20 nt, Bordetella pertussis
augacggggucggggcaggc

SEQ ID NO: 2412414 - RNA, 13 nt, Bordetella pertussis
augacggugccga

SEQ ID NO: 2412415 - RNA, 17 nt, Bordetella pertussis
augacguccagcgccac

SEQ ID NO: 2412416 - RNA, 21 nt, Bordetella pertussis
augacguucuccagcgccguc

SEQ ID NO: 2412417 - RNA, 16 nt, Bordetella pertussis
augacuugaccgcaug

SEQ ID NO: 2412418 - RNA, 17 nt, Bordetella pertussis
augacuugaccgcaugc

SEQ ID NO: 2412419 - RNA, 20 nt, Bordetella pertussis
augacuugaccgcaugcugc

SEQ ID NO: 2412420 - RNA, 15 nt, Bordetella pertussis
augagcacgccccaa

SEQ ID NO: 2412421 - RNA, 21 nt, Bordetella pertussis
augagccaugccgucuggcgg

SEQ ID NO: 2412422 - RNA, 14 nt, Bordetella pertussis
augagcccgaugcc

SEQ ID NO: 2412423 - RNA, 15 nt, Bordetella pertussis
augagcugcgcgugc

SEQ ID NO: 2412424 - RNA, 22 nt, Bordetella pertussis
augagcugcgcgugcacgaccu

SEQ ID NO: 2412425 - RNA, 14 nt, Bordetella pertussis
augaggaacggcac

SEQ ID NO: 2412426 - RNA, 12 nt, Bordetella pertussis
augaggcggcgg

SEQ ID NO: 2412427 - RNA, 13 nt, Bordetella pertussis
augaggcggcggu

SEQ ID NO: 2412428 - RNA, 23 nt, Bordetella pertussis
augaucaugaugaugauguucau

SEQ ID NO: 2412429 - RNA, 12 nt, Bordetella pertussis
augauccugcug

SEQ ID NO: 2412430 - RNA, 14 nt, Bordetella pertussis
augauccugcuggu

SEQ ID NO: 2412431 - RNA, 18 nt, Bordetella pertussis
augaucgccucggggcuc

SEQ ID NO: 2412432 - RNA, 15 nt, Bordetella pertussis
augaucuacgcgcgc

SEQ ID NO: 2412433 - RNA, 14 nt, Bordetella pertussis
augaucucgggcga

SEQ ID NO: 2412434 - RNA, 14 nt, Bordetella pertussis
augaugagcgcgcc

SEQ ID NO: 2412435 - RNA, 19 nt, Bordetella pertussis
augaugcgcugggccaggc

SEQ ID NO: 2412436 - RNA, 20 nt, Bordetella pertussis
augaugcggcgccacgcaga

SEQ ID NO: 2412437 - RNA, 21 nt, Bordetella pertussis
augaugcgguugaucagggcc

SEQ ID NO: 2412438 - RNA, 15 nt, Bordetella pertussis
augauggaggccagg

SEQ ID NO: 2412439 - RNA, 18 nt, Bordetella pertussis
augauggauucgcgccgg

SEQ ID NO: 2412440 - RNA, 19 nt, Bordetella pertussis
augauggauucgcgccggc

SEQ ID NO: 2412441 - RNA, 13 nt, Bordetella pertussis
augauggccaggu

SEQ ID NO: 2412442 - RNA, 14 nt, Bordetella pertussis
augauggccagguc

SEQ ID NO: 2412443 - RNA, 15 nt, Bordetella pertussis
augauggccgcgcgc

SEQ ID NO: 2412444 - RNA, 15 nt, Bordetella pertussis
augauggccggccug

SEQ ID NO: 2412445 - RNA, 22 nt, Bordetella pertussis
augauggccggccugccggcgc

SEQ ID NO: 2412446 - RNA, 14 nt, Bordetella pertussis
augauggugcugcc

SEQ ID NO: 2412447 - RNA, 17 nt, Bordetella pertussis
augauggugcugccgcu

SEQ ID NO: 2412448 - RNA, 17 nt, Bordetella pertussis
augaugguggggcuggc

SEQ ID NO: 2412449 - RNA, 15 nt, Bordetella pertussis
augaugucgcgggcc

SEQ ID NO: 2412450 - RNA, 19 nt, Bordetella pertussis
augauguucauacgcgcgc

SEQ ID NO: 2412451 - RNA, 15 nt, Bordetella pertussis
augcaacacgaccag

SEQ ID NO: 2412452 - RNA, 21 nt, Bordetella pertussis
augcaacacgaccagcaggcc

SEQ ID NO: 2412453 - RNA, 14 nt, Bordetella pertussis
augcaagacaggcc

SEQ ID NO: 2412454 - RNA, 13 nt, Bordetella pertussis
augcaauuucuca

SEQ ID NO: 2412455 - RNA, 15 nt, Bordetella pertussis
augcaccagcacauc

SEQ ID NO: 2412456 - RNA, 14 nt, Bordetella pertussis
augcaccggccagu

SEQ ID NO: 2412457 - RNA, 12 nt, Bordetella pertussis
augcaccgggcc

SEQ ID NO: 2412458 - RNA, 20 nt, Bordetella pertussis
augcaccugcagggucagcc

SEQ ID NO: 2412459 - RNA, 13 nt, Bordetella pertussis
augcacgaccagg

SEQ ID NO: 2412460 - RNA, 22 nt, Bordetella pertussis
augcacgaccaggccguggccc

SEQ ID NO: 2412461 - RNA, 17 nt, Bordetella pertussis
augcacgauauuggcgu

SEQ ID NO: 2412462 - RNA, 20 nt, Bordetella pertussis
augcacgauauuggcgucgg

SEQ ID NO: 2412463 - RNA, 19 nt, Bordetella pertussis
augcacggaacgugccguc

SEQ ID NO: 2412464 - RNA, 17 nt, Bordetella pertussis
augcacguagcgcagca

SEQ ID NO: 2412465 - RNA, 19 nt, Bordetella pertussis
augcagaacagggugccgc

SEQ ID NO: 2412466 - RNA, 21 nt, Bordetella pertussis
augcagaacagggugccgccc

SEQ ID NO: 2412467 - RNA, 17 nt, Bordetella pertussis
augcagcacacggucag

SEQ ID NO: 2412468 - RNA, 11 nt, Bordetella pertussis
augcagcagcg

SEQ ID NO: 2412469 - RNA, 19 nt, Bordetella pertussis
augcagccgcaccagcgca

SEQ ID NO: 2412470 - RNA, 11 nt, Bordetella pertussis
augcagccgcc

SEQ ID NO: 2412471 - RNA, 13 nt, Bordetella pertussis
augcagcugcgcc

SEQ ID NO: 2412472 - RNA, 16 nt, Bordetella pertussis
augcagcugcgccagc

SEQ ID NO: 2412473 - RNA, 18 nt, Bordetella pertussis
augcagcuggauggccug

SEQ ID NO: 2412474 - RNA, 20 nt, Bordetella pertussis
augcaggucggggcgcucga

SEQ ID NO: 2412475 - RNA, 16 nt, Bordetella pertussis
augcaguagcgcucga

SEQ ID NO: 2412476 - RNA, 19 nt, Bordetella pertussis
augcaugaaccgcagcgcc

SEQ ID NO: 2412477 - RNA, 15 nt, Bordetella pertussis
augcauucggcggcc

SEQ ID NO: 2412478 - RNA, 16 nt, Bordetella pertussis
augcauucggcggccg

SEQ ID NO: 2412479 - RNA, 20 nt, Bordetella pertussis
augccuugcgcgacagcagg

SEQ ID NO: 2412480 - RNA, 16 nt, Bordetella pertussis
augccuuggugggguc

SEQ ID NO: 2412481 - RNA, 16 nt, Bordetella pertussis
augcgaaagccggccu

SEQ ID NO: 2412482 - RNA, 17 nt, Bordetella pertussis
augcgaaagccggccuc

SEQ ID NO: 2412483 - RNA, 17 nt, Bordetella pertussis
augcgaaagcggccagc

SEQ ID NO: 2412484 - RNA, 19 nt, Bordetella pertussis
augcgaagaauuggccguc

SEQ ID NO: 2412485 - RNA, 21 nt, Bordetella pertussis
augcgacagcgacagccaggc

SEQ ID NO: 2412486 - RNA, 17 nt, Bordetella pertussis
augcgacaugagcugcg

SEQ ID NO: 2412487 - RNA, 19 nt, Bordetella pertussis
augcgacaugagcugcgcg

SEQ ID NO: 2412488 - RNA, 23 nt, Bordetella pertussis
augcgauagcgggccugcagcau

SEQ ID NO: 2412489 - RNA, 13 nt, Bordetella pertussis
augcgauaggcga

SEQ ID NO: 2412490 - RNA, 18 nt, Bordetella pertussis
augcgauaggcgaagcgc

SEQ ID NO: 2412491 - RNA, 14 nt, Bordetella pertussis
augcgaucggccuc

SEQ ID NO: 2412492 - RNA, 20 nt, Bordetella pertussis
augcgaugcugcagggccug

SEQ ID NO: 2412493 - RNA, 12 nt, Bordetella pertussis
augcgcaccagg

SEQ ID NO: 2412494 - RNA, 13 nt, Bordetella pertussis
augcgcaccaggc

SEQ ID NO: 2412495 - RNA, 18 nt, Bordetella pertussis
augcgcaccaugcgcagc

SEQ ID NO: 2412496 - RNA, 21 nt, Bordetella pertussis
augcgcaccaugcgcagcaac

SEQ ID NO: 2412497 - RNA, 18 nt, Bordetella pertussis
augcgcaccggccagggg

SEQ ID NO: 2412498 - RNA, 14 nt, Bordetella pertussis
augcgcaccuuguc

SEQ ID NO: 2412499 - RNA, 13 nt, Bordetella pertussis
augcgcacgccca

SEQ ID NO: 2412500 - RNA, 14 nt, Bordetella pertussis
augcgcacgcgcgu

SEQ ID NO: 2412501 - RNA, 16 nt, Bordetella pertussis
augcgcacgggcgagg

SEQ ID NO: 2412502 - RNA, 20 nt, Bordetella pertussis
augcgcacgggcgagggcug

SEQ ID NO: 2412503 - RNA, 19 nt, Bordetella pertussis
augcgcagcaggcgcgugc

SEQ ID NO: 2412504 - RNA, 13 nt, Bordetella pertussis
augcgcagcgcgu

SEQ ID NO: 2412505 - RNA, 14 nt, Bordetella pertussis
augcgcagcgcguc

SEQ ID NO: 2412506 - RNA, 21 nt, Bordetella pertussis
augcgcagcgcgucggcgcgg

SEQ ID NO: 2412507 - RNA, 18 nt, Bordetella pertussis
augcgcaggacggcgccg

SEQ ID NO: 2412508 - RNA, 19 nt, Bordetella pertussis
augcgcaggacggcgccgu

SEQ ID NO: 2412509 - RNA, 23 nt, Bordetella pertussis
augcgcaucgcgaccgccaagca

SEQ ID NO: 2412510 - RNA, 13 nt, Bordetella pertussis
augcgcaugcugg

SEQ ID NO: 2412511 - RNA, 14 nt, Bordetella pertussis
augcgcauggccag

SEQ ID NO: 2412512 - RNA, 15 nt, Bordetella pertussis
augcgcauggccagc

SEQ ID NO: 2412513 - RNA, 19 nt, Bordetella pertussis
augcgcauggccagcgcgc

SEQ ID NO: 2412514 - RNA, 17 nt, Bordetella pertussis
augcgcauuaucgcuag

SEQ ID NO: 2412515 - RNA, 13 nt, Bordetella pertussis
augcgccagcagg

SEQ ID NO: 2412516 - RNA, 21 nt, Bordetella pertussis
augcgccagcaggauguccac

SEQ ID NO: 2412517 - RNA, 15 nt, Bordetella pertussis
augcgccagccagcg

SEQ ID NO: 2412518 - RNA, 16 nt, Bordetella pertussis
augcgccagcgccugg

SEQ ID NO: 2412519 - RNA, 16 nt, Bordetella pertussis
augcgccaggccucgg

SEQ ID NO: 2412520 - RNA, 12 nt, Bordetella pertussis
augcgccaggcu

SEQ ID NO: 2412521 - RNA, 19 nt, Bordetella pertussis
augcgccaguccagcgcgc

SEQ ID NO: 2412522 - RNA, 20 nt, Bordetella pertussis
augcgcccgaugcucgccgg

SEQ ID NO: 2412523 - RNA, 14 nt, Bordetella pertussis
augcgcccggccac

SEQ ID NO: 2412524 - RNA, 15 nt, Bordetella pertussis
augcgccgcaccagc

SEQ ID NO: 2412525 - RNA, 20 nt, Bordetella pertussis
augcgccgcaccagcgccga

SEQ ID NO: 2412526 - RNA, 13 nt, Bordetella pertussis
augcgccgcacgu

SEQ ID NO: 2412527 - RNA, 13 nt, Bordetella pertussis
augcgccgcgcuu

SEQ ID NO: 2412528 - RNA, 15 nt, Bordetella pertussis
augcgccggcccggc

SEQ ID NO: 2412529 - RNA, 16 nt, Bordetella pertussis
augcgccggcccggca

SEQ ID NO: 2412530 - RNA, 13 nt, Bordetella pertussis
augcgccggccug

SEQ ID NO: 2412531 - RNA, 15 nt, Bordetella pertussis
augcgccggccuggc

SEQ ID NO: 2412532 - RNA, 18 nt, Bordetella pertussis
augcgccggccuggcgcg

SEQ ID NO: 2412533 - RNA, 17 nt, Bordetella pertussis
augcgccguccucaggc

SEQ ID NO: 2412534 - RNA, 23 nt, Bordetella pertussis
augcgccguccucaggcccgcgg

SEQ ID NO: 2412535 - RNA, 16 nt, Bordetella pertussis
augcgccugcgccaug

SEQ ID NO: 2412536 - RNA, 14 nt, Bordetella pertussis
augcgcgaagcgcc

SEQ ID NO: 2412537 - RNA, 18 nt, Bordetella pertussis
augcgcgaagcgcccugg

SEQ ID NO: 2412538 - RNA, 15 nt, Bordetella pertussis
augcgcgaaguggcc

SEQ ID NO: 2412539 - RNA, 14 nt, Bordetella pertussis
augcgcgagccgcc

SEQ ID NO: 2412540 - RNA, 16 nt, Bordetella pertussis
augcgcgagcgcgugg

SEQ ID NO: 2412541 - RNA, 14 nt, Bordetella pertussis
augcgcgccagcau

SEQ ID NO: 2412542 - RNA, 14 nt, Bordetella pertussis
augcgcgccaggcg

SEQ ID NO: 2412543 - RNA, 16 nt, Bordetella pertussis
augcgcgccaggcgcg

SEQ ID NO: 2412544 - RNA, 20 nt, Bordetella pertussis
augcgcgccccgucggccgu

SEQ ID NO: 2412545 - RNA, 18 nt, Bordetella pertussis
augcgcgccgcucuuggc

SEQ ID NO: 2412546 - RNA, 20 nt, Bordetella pertussis
augcgcgccguacagccgcg

SEQ ID NO: 2412547 - RNA, 22 nt, Bordetella pertussis
augcgcgccguacagccgcggc

SEQ ID NO: 2412548 - RNA, 18 nt, Bordetella pertussis
augcgcgcgacuuccucg

SEQ ID NO: 2412549 - RNA, 11 nt, Bordetella pertussis
augcgcgcgcg

SEQ ID NO: 2412550 - RNA, 22 nt, Bordetella pertussis
augcgcgcgcggaucgacgcga

SEQ ID NO: 2412551 - RNA, 19 nt, Bordetella pertussis
augcgcgcgcgggccagca

SEQ ID NO: 2412552 - RNA, 16 nt, Bordetella pertussis
augcgcgcggccagcg

SEQ ID NO: 2412553 - RNA, 23 nt, Bordetella pertussis
augcgcgcggccucgacgauggc

SEQ ID NO: 2412554 - RNA, 18 nt, Bordetella pertussis
augcgcgcgugcagcgcc

SEQ ID NO: 2412555 - RNA, 21 nt, Bordetella pertussis
augcgcggcgggcucgagcug

SEQ ID NO: 2412556 - RNA, 15 nt, Bordetella pertussis
augcgcggggccagg

SEQ ID NO: 2412557 - RNA, 20 nt, Bordetella pertussis
augcgcggggccaggcgcag

SEQ ID NO: 2412558 - RNA, 14 nt, Bordetella pertussis
augcgcggggccgg

SEQ ID NO: 2412559 - RNA, 15 nt, Bordetella pertussis
augcgcguggcgcga

SEQ ID NO: 2412560 - RNA, 21 nt, Bordetella pertussis
augcgcugcacgguggacagg

SEQ ID NO: 2412561 - RNA, 16 nt, Bordetella pertussis
augcgcugcgccuugg

SEQ ID NO: 2412562 - RNA, 23 nt, Bordetella pertussis
augcgcugcuggaggccggcgug

SEQ ID NO: 2412563 - RNA, 20 nt, Bordetella pertussis
augcgcuggccggccgcgug

SEQ ID NO: 2412564 - RNA, 21 nt, Bordetella pertussis
augcgcugggcaugggcggcc

SEQ ID NO: 2412565 - RNA, 15 nt, Bordetella pertussis
augcgcugggccagg

SEQ ID NO: 2412566 - RNA, 16 nt, Bordetella pertussis
augcgcugggccaggc

SEQ ID NO: 2412567 - RNA, 12 nt, Bordetella pertussis
augcgcuugccg

SEQ ID NO: 2412568 - RNA, 13 nt, Bordetella pertussis
augcgcuugccga

SEQ ID NO: 2412569 - RNA, 23 nt, Bordetella pertussis
augcgcuugccgcccacugccag

SEQ ID NO: 2412570 - RNA, 20 nt, Bordetella pertussis
augcgcuuggaccccguggu

SEQ ID NO: 2412571 - RNA, 15 nt, Bordetella pertussis
augcgcuugucgccg

SEQ ID NO: 2412572 - RNA, 13 nt, Bordetella pertussis
augcggacgccag

SEQ ID NO: 2412573 - RNA, 18 nt, Bordetella pertussis
augcggaugaacgaccag

SEQ ID NO: 2412574 - RNA, 15 nt, Bordetella pertussis
augcggcagcagggc

SEQ ID NO: 2412575 - RNA, 17 nt, Bordetella pertussis
augcggcagcagggcca

SEQ ID NO: 2412576 - RNA, 20 nt, Bordetella pertussis
augcggccuucgccggugaa

SEQ ID NO: 2412577 - RNA, 16 nt, Bordetella pertussis
augcggcgccacgcag

SEQ ID NO: 2412578 - RNA, 20 nt, Bordetella pertussis
augcggcgccggugcgcggc

SEQ ID NO: 2412579 - RNA, 21 nt, Bordetella pertussis
augcggcgccggugcgcggcg

SEQ ID NO: 2412580 - RNA, 15 nt, Bordetella pertussis
augcggcgcgccgcg

SEQ ID NO: 2412581 - RNA, 15 nt, Bordetella pertussis
augcggcggcgcugg

SEQ ID NO: 2412582 - RNA, 22 nt, Bordetella pertussis
augcggcggcgcuggccugccg

SEQ ID NO: 2412583 - RNA, 21 nt, Bordetella pertussis
augcggcggcgggcggccggc

SEQ ID NO: 2412584 - RNA, 23 nt, Bordetella pertussis
augcggcuggccgaucaccugca

SEQ ID NO: 2412585 - RNA, 14 nt, Bordetella pertussis
augcgggacaggcg

SEQ ID NO: 2412586 - RNA, 16 nt, Bordetella pertussis
augcgggacaggcgcc

SEQ ID NO: 2412587 - RNA, 18 nt, Bordetella pertussis
augcgggcaucgcccugc

SEQ ID NO: 2412588 - RNA, 17 nt, Bordetella pertussis
augcgggccaugucggc

SEQ ID NO: 2412589 - RNA, 22 nt, Bordetella pertussis
augcgggccaugucggcuucgg

SEQ ID NO: 2412590 - RNA, 12 nt, Bordetella pertussis
augcggggacag

SEQ ID NO: 2412591 - RNA, 19 nt, Bordetella pertussis
augcgggucaaggcggggc

SEQ ID NO: 2412592 - RNA, 22 nt, Bordetella pertussis
auggcgcaugacgaggugccug

SEQ ID NO: 2412593 - RNA, 13 nt, Bordetella pertussis
auggcgccagccc

SEQ ID NO: 2412594 - RNA, 17 nt, Bordetella pertussis
auggcgcccacggccug

SEQ ID NO: 2412595 - RNA, 17 nt, Bordetella pertussis
auggcgccgcgccgccg

SEQ ID NO: 2412596 - RNA, 20 nt, Bordetella pertussis
auggcgccgcgccgccgccu

SEQ ID NO: 2412597 - RNA, 14 nt, Bordetella pertussis
auggcgccgcgcgc

SEQ ID NO: 2412598 - RNA, 15 nt, Bordetella pertussis
auggcgccgcugucg

SEQ ID NO: 2412599 - RNA, 13 nt, Bordetella pertussis
auggcgccggcca

SEQ ID NO: 2412600 - RNA, 14 nt, Bordetella pertussis
auggcgccggccag

SEQ ID NO: 2412601 - RNA, 15 nt, Bordetella pertussis
auggcgccggccagc

SEQ ID NO: 2412602 - RNA, 20 nt, Bordetella pertussis
auggcgccggccagcgcgcc

SEQ ID NO: 2412603 - RNA, 21 nt, Bordetella pertussis
auggcgccgugaaugcgccug

SEQ ID NO: 2412604 - RNA, 13 nt, Bordetella pertussis
auggcgcgcagca

SEQ ID NO: 2412605 - RNA, 18 nt, Bordetella pertussis
auggcgcgcgcacgcugg

SEQ ID NO: 2412606 - RNA, 13 nt, Bordetella pertussis
auggcgcgcgcca

SEQ ID NO: 2412607 - RNA, 15 nt, Bordetella pertussis
auggcgcgcgccgcg

SEQ ID NO: 2412608 - RNA, 12 nt, Bordetella pertussis
auggcgcgcgcg

SEQ ID NO: 2412609 - RNA, 13 nt, Bordetella pertussis
auggcgcggauga

SEQ ID NO: 2412610 - RNA, 21 nt, Bordetella pertussis
auggcgcggccgccagcccga

SEQ ID NO: 2412611 - RNA, 20 nt, Bordetella pertussis
auggcgcggguaaugccggu

SEQ ID NO: 2412612 - RNA, 16 nt, Bordetella pertussis
auggcgcgucgccgcg

SEQ ID NO: 2412613 - RNA, 18 nt, Bordetella pertussis
auggcgcgugcgcgcgcc

SEQ ID NO: 2412614 - RNA, 15 nt, Bordetella pertussis
auggcgcuccagccc

SEQ ID NO: 2412615 - RNA, 20 nt, Bordetella pertussis
auggcgcuccagcccuucgc

SEQ ID NO: 2412616 - RNA, 21 nt, Bordetella pertussis
auggcggcaacgugcaggcca

SEQ ID NO: 2412617 - RNA, 17 nt, Bordetella pertussis
auggcggcaucuugccu

SEQ ID NO: 2412618 - RNA, 13 nt, Bordetella pertussis
auggcggccaggc

SEQ ID NO: 2412619 - RNA, 21 nt, Bordetella pertussis
auggcggccaggcgcgccgcg

SEQ ID NO: 2412620 - RNA, 17 nt, Bordetella pertussis
auggcggccgccagcgc

SEQ ID NO: 2412621 - RNA, 22 nt, Bordetella pertussis
auggcggccgccagcgccauga

SEQ ID NO: 2412622 - RNA, 14 nt, Bordetella pertussis
auggcggccgccgc

SEQ ID NO: 2412623 - RNA, 23 nt, Bordetella pertussis
auggcggccgccgccagcgcgcc

SEQ ID NO: 2412624 - RNA, 14 nt, Bordetella pertussis
auggcggccggcgu

SEQ ID NO: 2412625 - RNA, 18 nt, Bordetella pertussis
auggcggccucgggcaac

SEQ ID NO: 2412626 - RNA, 19 nt, Bordetella pertussis
auggcggcgcccgcugcgu

SEQ ID NO: 2412627 - RNA, 14 nt, Bordetella pertussis
auggcggcggccac

SEQ ID NO: 2412628 - RNA, 21 nt, Bordetella pertussis
auggcggggaauucgaccgga

SEQ ID NO: 2412629 - RNA, 17 nt, Bordetella pertussis
auggcgggguuggccgc

SEQ ID NO: 2412630 - RNA, 22 nt, Bordetella pertussis
auggcggugaaaucgacguggc

SEQ ID NO: 2412631 - RNA, 15 nt, Bordetella pertussis
auggcgguggccagc

SEQ ID NO: 2412632 - RNA, 22 nt, Bordetella pertussis
auggcguagagcagugugccug

SEQ ID NO: 2412633 - RNA, 21 nt, Bordetella pertussis
auggcguagcccuuguggccg

SEQ ID NO: 2412634 - RNA, 17 nt, Bordetella pertussis
auggcguaggcggccuu

SEQ ID NO: 2412635 - RNA, 23 nt, Bordetella pertussis
auggcguaggcggccuugagcau

SEQ ID NO: 2412636 - RNA, 15 nt, Bordetella pertussis
auggcguccagcagc

SEQ ID NO: 2412637 - RNA, 18 nt, Bordetella pertussis
auggcguccgcgucgccg

SEQ ID NO: 2412638 - RNA, 16 nt, Bordetella pertussis
auggcgucggccacgu

SEQ ID NO: 2412639 - RNA, 16 nt, Bordetella pertussis
auggcgucguccagcu

SEQ ID NO: 2412640 - RNA, 19 nt, Bordetella pertussis
auggcgucugcccgugcgu

SEQ ID NO: 2412641 - RNA, 22 nt, Bordetella pertussis
auggcgugcacgcguaugcccu

SEQ ID NO: 2412642 - RNA, 15 nt, Bordetella pertussis
auggcguugccggcc

SEQ ID NO: 2412643 - RNA, 16 nt, Bordetella pertussis
auggcguugccggccu

SEQ ID NO: 2412644 - RNA, 23 nt, Bordetella pertussis
auggcuauaccgucguccucggc

SEQ ID NO: 2412645 - RNA, 24 nt, Bordetella pertussis
auggcucgggcagcagcagggcca

SEQ ID NO: 2412646 - RNA, 16 nt, Bordetella pertussis
auggcugcaccugccu

SEQ ID NO: 2412647 - RNA, 17 nt, Bordetella pertussis
auggcugcaccugccug

SEQ ID NO: 2412648 - RNA, 15 nt, Bordetella pertussis
auggcugcgcgccgu

SEQ ID NO: 2412649 - RNA, 19 nt, Bordetella pertussis
auggcuggucccugcgcga

SEQ ID NO: 2412650 - RNA, 16 nt, Bordetella pertussis
auggcuuccugcaccu

SEQ ID NO: 2412651 - RNA, 20 nt, Bordetella pertussis
auggcuuucuaucaucaggc

SEQ ID NO: 2412652 - RNA, 21 nt, Bordetella pertussis
augggagaguucauccacagc

SEQ ID NO: 2412653 - RNA, 13 nt, Bordetella pertussis
augggcaagccga

SEQ ID NO: 2412654 - RNA, 18 nt, Bordetella pertussis
augggcagcucgccuucg

SEQ ID NO: 2412655 - RNA, 11 nt, Bordetella pertussis
augggccaggc

SEQ ID NO: 2412656 - RNA, 17 nt, Bordetella pertussis
augggccccaagagggc

SEQ ID NO: 2412657 - RNA, 21 nt, Bordetella pertussis
augggcccgggcaggcucagc

SEQ ID NO: 2412658 - RNA, 14 nt, Bordetella pertussis
augggccgcagcga

SEQ ID NO: 2412659 - RNA, 15 nt, Bordetella pertussis
augggccguccggcc

SEQ ID NO: 2412660 - RNA, 14 nt, Bordetella pertussis
augggccugcccau

SEQ ID NO: 2412661 - RNA, 20 nt, Bordetella pertussis
augggccugcccauggccug

SEQ ID NO: 2412662 - RNA, 14 nt, Bordetella pertussis
augggccugggcgc

SEQ ID NO: 2412663 - RNA, 20 nt, Bordetella pertussis
augggcgaagccacggcccg

SEQ ID NO: 2412664 - RNA, 22 nt, Bordetella pertussis
augggcgacgcgacacgcagca

SEQ ID NO: 2412665 - RNA, 13 nt, Bordetella pertussis
augggcgcgcccg

SEQ ID NO: 2412666 - RNA, 23 nt, Bordetella pertussis
augggcgcgguagcgccccucgc

SEQ ID NO: 2412667 - RNA, 21 nt, Bordetella pertussis
augggcggcccgcuccaggcg

SEQ ID NO: 2412668 - RNA, 21 nt, Bordetella pertussis
augggcggccuagcugugaac

SEQ ID NO: 2412669 - RNA, 19 nt, Bordetella pertussis
augggcggccucggccagc

SEQ ID NO: 2412670 - RNA, 22 nt, Bordetella pertussis
augggcggccucggccagcugg

SEQ ID NO: 2412671 - RNA, 23 nt, Bordetella pertussis
augggcggcgacgaacccgggcg

SEQ ID NO: 2412672 - RNA, 16 nt, Bordetella pertussis
augggcggggccacau

SEQ ID NO: 2412673 - RNA, 13 nt, Bordetella pertussis
augggcgucgucg

SEQ ID NO: 2412674 - RNA, 18 nt, Bordetella pertussis
augggcugucgcaacagc

SEQ ID NO: 2412675 - RNA, 16 nt, Bordetella pertussis
augggcuuugacgccg

SEQ ID NO: 2412676 - RNA, 18 nt, Bordetella pertussis
auggggccauggcacagg

SEQ ID NO: 2412677 - RNA, 20 nt, Bordetella pertussis
auggggucgggccgcgcgcg

SEQ ID NO: 2412678 - RNA, 20 nt, Bordetella pertussis
auggggugcuccugccaggc

SEQ ID NO: 2412679 - RNA, 16 nt, Bordetella pertussis
auggguacagcgcgcc

SEQ ID NO: 2412680 - RNA, 16 nt, Bordetella pertussis
auggguacgccggccu

SEQ ID NO: 2412681 - RNA, 17 nt, Bordetella pertussis
augguagaugcgcgcga

SEQ ID NO: 2412682 - RNA, 16 nt, Bordetella pertussis
augguagcgguccagc

SEQ ID NO: 2412683 - RNA, 17 nt, Bordetella pertussis
augguagcgguccagcu

SEQ ID NO: 2412684 - RNA, 20 nt, Bordetella pertussis
auggucaccacccgcacgcc

SEQ ID NO: 2412685 - RNA, 20 nt, Bordetella pertussis
auggucagcaugucgacguu

SEQ ID NO: 2412686 - RNA, 18 nt, Bordetella pertussis
auggucaguccgcccagc

SEQ ID NO: 2412687 - RNA, 13 nt, Bordetella pertussis
auggucgaccagc

SEQ ID NO: 2412688 - RNA, 17 nt, Bordetella pertussis
auggucgaccagcagcc

SEQ ID NO: 2412689 - RNA, 18 nt, Bordetella pertussis
auggucgaccagcagccg

SEQ ID NO: 2412690 - RNA, 18 nt, Bordetella pertussis
auggucgagcgccugcgc

SEQ ID NO: 2412691 - RNA, 15 nt, Bordetella pertussis
auggucgcgaccacc

SEQ ID NO: 2412692 - RNA, 20 nt, Bordetella pertussis
auggucgcgaccaccgugau

SEQ ID NO: 2412693 - RNA, 17 nt, Bordetella pertussis
auggucgcggccgaggc

SEQ ID NO: 2412694 - RNA, 18 nt, Bordetella pertussis
auggucggcauggccauc

SEQ ID NO: 2412695 - RNA, 12 nt, Bordetella pertussis
auggucggccuc

SEQ ID NO: 2412696 - RNA, 17 nt, Bordetella pertussis
auggucggugccgccga

SEQ ID NO: 2412697 - RNA, 20 nt, Bordetella pertussis
auggucgugcggcacgcaca

SEQ ID NO: 2412698 - RNA, 22 nt, Bordetella pertussis
auggucgugcggcacgcacagc

SEQ ID NO: 2412699 - RNA, 20 nt, Bordetella pertussis
auggucucccccucggccug

SEQ ID NO: 2412700 - RNA, 21 nt, Bordetella pertussis
auggucucccccucggccugc

SEQ ID NO: 2412701 - RNA, 15 nt, Bordetella pertussis
auggugaacgccacc

SEQ ID NO: 2412702 - RNA, 17 nt, Bordetella pertussis
auggugccgccgcccga

SEQ ID NO: 2412703 - RNA, 18 nt, Bordetella pertussis
auggugccgcgcaggccc

SEQ ID NO: 2412704 - RNA, 15 nt, Bordetella pertussis
auggugccggccguc

SEQ ID NO: 2412705 - RNA, 16 nt, Bordetella pertussis
auugaguucgcgcgcc

SEQ ID NO: 2412706 - RNA, 23 nt, Bordetella pertussis
auugaugcagcacgucggcgucg

SEQ ID NO: 2412707 - RNA, 22 nt, Bordetella pertussis
auugaugcccaugcgcugcgcc

SEQ ID NO: 2412708 - RNA, 16 nt, Bordetella pertussis
auugaugucgcgcacc

SEQ ID NO: 2412709 - RNA, 18 nt, Bordetella pertussis
auugcacggugccgcgcg

SEQ ID NO: 2412710 - RNA, 21 nt, Bordetella pertussis
auugcagggugucggccaggg

SEQ ID NO: 2412711 - RNA, 17 nt, Bordetella pertussis
auugcaugaccgccggc

SEQ ID NO: 2412712 - RNA, 18 nt, Bordetella pertussis
auugcaugaccgccggca

SEQ ID NO: 2412713 - RNA, 17 nt, Bordetella pertussis
auugccacggcgggccg

SEQ ID NO: 2412714 - RNA, 19 nt, Bordetella pertussis
auugccacggcgggccggc

SEQ ID NO: 2412715 - RNA, 20 nt, Bordetella pertussis
auugcccagcaccacgggcu

SEQ ID NO: 2412716 - RNA, 12 nt, Bordetella pertussis
auugccccagca

SEQ ID NO: 2412717 - RNA, 14 nt, Bordetella pertussis
auugccccagcacg

SEQ ID NO: 2412718 - RNA, 19 nt, Bordetella pertussis
auugccgccgcugccggcc

SEQ ID NO: 2412719 - RNA, 22 nt, Bordetella pertussis
auugccgcgcggcgcguucagc

SEQ ID NO: 2412720 - RNA, 18 nt, Bordetella pertussis
auugccggagcagcagcg

SEQ ID NO: 2412721 - RNA, 18 nt, Bordetella pertussis
auugccggaucagcgccu

SEQ ID NO: 2412722 - RNA, 21 nt, Bordetella pertussis
auugccguccuggcgaccggc

SEQ ID NO: 2412723 - RNA, 14 nt, Bordetella pertussis
auugccgucggccg

SEQ ID NO: 2412724 - RNA, 18 nt, Bordetella pertussis
auugccgucggccgcgcc

SEQ ID NO: 2412725 - RNA, 15 nt, Bordetella pertussis
auugcgccacgccca

SEQ ID NO: 2412726 - RNA, 18 nt, Bordetella pertussis
auugcgccagcgcugucc

SEQ ID NO: 2412727 - RNA, 23 nt, Bordetella pertussis
auugcgcggccagggcugcggcg

SEQ ID NO: 2412728 - RNA, 14 nt, Bordetella pertussis
auugcggcaccugc

SEQ ID NO: 2412729 - RNA, 16 nt, Bordetella pertussis
auugcggcaccugcug

SEQ ID NO: 2412730 - RNA, 21 nt, Bordetella pertussis
auugcggcccgcggccuuggu

SEQ ID NO: 2412731 - RNA, 16 nt, Bordetella pertussis
auugcggggcggcgua

SEQ ID NO: 2412732 - RNA, 16 nt, Bordetella pertussis
auugcggugcccuugc

SEQ ID NO: 2412733 - RNA, 12 nt, Bordetella pertussis
auugcugcugcu

SEQ ID NO: 2412734 - RNA, 15 nt, Bordetella pertussis
auugcugcugcuggc

SEQ ID NO: 2412735 - RNA, 13 nt, Bordetella pertussis
auugcuucuggua

SEQ ID NO: 2412736 - RNA, 22 nt, Bordetella pertussis
auugcuucugguaguuggccag

SEQ ID NO: 2412737 - RNA, 18 nt, Bordetella pertussis
auugcuugacgccgccga

SEQ ID NO: 2412738 - RNA, 19 nt, Bordetella pertussis
auugcuuuuccacgcccgc

SEQ ID NO: 2412739 - RNA, 22 nt, Bordetella pertussis
auuggagcucgcucagaagcug

SEQ ID NO: 2412740 - RNA, 21 nt, Bordetella pertussis
auuggcccugcugggguggag

SEQ ID NO: 2412741 - RNA, 17 nt, Bordetella pertussis
auuggcgcccaucgcgg

SEQ ID NO: 2412742 - RNA, 15 nt, Bordetella pertussis
auuggcggcggcguu

SEQ ID NO: 2412743 - RNA, 20 nt, Bordetella pertussis
auuggcgucggccgccguga

SEQ ID NO: 2412744 - RNA, 17 nt, Bordetella pertussis
auuggcuguaucuggcc

SEQ ID NO: 2412745 - RNA, 14 nt, Bordetella pertussis
auugggcguggcgg

SEQ ID NO: 2412746 - RNA, 19 nt, Bordetella pertussis
auugggcugguaggggaug

SEQ ID NO: 2412747 - RNA, 13 nt, Bordetella pertussis
auuggggccgccu

SEQ ID NO: 2412748 - RNA, 21 nt, Bordetella pertussis
auuggggccgccuggaccuga

SEQ ID NO: 2412749 - RNA, 16 nt, Bordetella pertussis
auugucaagcagcgcc

SEQ ID NO: 2412750 - RNA, 21 nt, Bordetella pertussis
auugucuuugaagggcggcgc

SEQ ID NO: 2412751 - RNA, 19 nt, Bordetella pertussis
auugugcaugacggccagg

SEQ ID NO: 2412752 - RNA, 16 nt, Bordetella pertussis
auugugcaugcgcgcc

SEQ ID NO: 2412753 - RNA, 19 nt, Bordetella pertussis
auuucgauuucggcggcca

SEQ ID NO: 2412754 - RNA, 13 nt, Bordetella pertussis
auuucgccgccgc

SEQ ID NO: 2412755 - RNA, 14 nt, Bordetella pertussis
auuucgcuggccau

SEQ ID NO: 2412756 - RNA, 19 nt, Bordetella pertussis
auuucggagcggcucugga

SEQ ID NO: 2412757 - RNA, 20 nt, Bordetella pertussis
auuucggcgcaucggcgcca

SEQ ID NO: 2412758 - RNA, 16 nt, Bordetella pertussis
auuucggcgccgccgg

SEQ ID NO: 2412759 - RNA, 15 nt, Bordetella pertussis
auuucggcgccgcgc

SEQ ID NO: 2412760 - RNA, 17 nt, Bordetella pertussis
auuucggcggccaggcc

SEQ ID NO: 2412761 - RNA, 17 nt, Bordetella pertussis
auuucguaaagccgcac

SEQ ID NO: 2412762 - RNA, 14 nt, Bordetella pertussis
auuucucggccagc

SEQ ID NO: 2412763 - RNA, 17 nt, Bordetella pertussis
auuucucggccugggcg

SEQ ID NO: 2412764 - RNA, 15 nt, Bordetella pertussis
auuucuucgccuggc

SEQ ID NO: 2412765 - RNA, 13 nt, Bordetella pertussis
auuugcagcagca

SEQ ID NO: 2412766 - RNA, 17 nt, Bordetella pertussis
auuugcagcggcggcac

SEQ ID NO: 2412767 - RNA, 14 nt, Bordetella pertussis
auuugccgccugaa

SEQ ID NO: 2412768 - RNA, 15 nt, Bordetella pertussis
auuuggcggccuggc

SEQ ID NO: 2412769 - RNA, 12 nt, Bordetella pertussis
auuuucaccauc

SEQ ID NO: 2412770 - RNA, 19 nt, Bordetella pertussis
auuuucugccacagcguga

SEQ ID NO: 2412771 - RNA, 21 nt, Bordetella pertussis
auuuuguggagcguucaugca

SEQ ID NO: 2412772 - RNA, 19 nt, Bordetella pertussis
auuuuguugauggcgaugg

SEQ ID NO: 2412773 - RNA, 19 nt, Bordetella pertussis
caaaaacggucugccgcug

SEQ ID NO: 2412774 - RNA, 13 nt, Bordetella pertussis
caaaacgcgcccc

SEQ ID NO: 2412775 - RNA, 20 nt, Bordetella pertussis
caaaacggugccuugcggcg

SEQ ID NO: 2412776 - RNA, 21 nt, Bordetella pertussis
caaaacggugccuugcggcgc

SEQ ID NO: 2412777 - RNA, 14 nt, Bordetella pertussis
caaaagcaacaacc

SEQ ID NO: 2412778 - RNA, 16 nt, Bordetella pertussis
caaaagcguuccagca

SEQ ID NO: 2412779 - RNA, 15 nt, Bordetella pertussis
caaaauuggugucau

SEQ ID NO: 2412780 - RNA, 20 nt, Bordetella pertussis
caaacccggcgaagccggca

SEQ ID NO: 2412781 - RNA, 20 nt, Bordetella pertussis
caaaccgucgaugaccagcg

SEQ ID NO: 2412782 - RNA, 23 nt, Bordetella pertussis
caaaccgucgaugaccagcgccg

SEQ ID NO: 2412783 - RNA, 17 nt, Bordetella pertussis
caaaccugaugccuguc

SEQ ID NO: 2412784 - RNA, 18 nt, Bordetella pertussis
caaaccugaugccugucc

SEQ ID NO: 2412785 - RNA, 22 nt, Bordetella pertussis
caaacgcacgauuucacccagg

SEQ ID NO: 2412786 - RNA, 14 nt, Bordetella pertussis
caaacgcggcgccg

SEQ ID NO: 2412787 - RNA, 21 nt, Bordetella pertussis
caaacggauugccgccgcgca

SEQ ID NO: 2412788 - RNA, 14 nt, Bordetella pertussis
caaacggcggcagg

SEQ ID NO: 2412789 - RNA, 19 nt, Bordetella pertussis
caaacggcggcaggccgcg

SEQ ID NO: 2412790 - RNA, 21 nt, Bordetella pertussis
caaagaaauugggcguggcgg

SEQ ID NO: 2412791 - RNA, 22 nt, Bordetella pertussis
caaagacggcuugaccacggcc

SEQ ID NO: 2412792 - RNA, 23 nt, Bordetella pertussis
caaagacggcuugaccacggcca

SEQ ID NO: 2412793 - RNA, 20 nt, Bordetella pertussis
caaagccggaauccuggcga

SEQ ID NO: 2412794 - RNA, 13 nt, Bordetella pertussis
caaagccugacgg

SEQ ID NO: 2412795 - RNA, 14 nt, Bordetella pertussis
caaagccugacggc

SEQ ID NO: 2412796 - RNA, 15 nt, Bordetella pertussis
caaagcgcgcguccu

SEQ ID NO: 2412797 - RNA, 22 nt, Bordetella pertussis
caaagcgguccccagauccgca

SEQ ID NO: 2412798 - RNA, 16 nt, Bordetella pertussis
caaaggcccaggcaau

SEQ ID NO: 2412799 - RNA, 22 nt, Bordetella pertussis
caaaguagugcccccacgcugc

SEQ ID NO: 2412800 - RNA, 17 nt, Bordetella pertussis
caacaagccgggcgccg

SEQ ID NO: 2412801 - RNA, 20 nt, Bordetella pertussis
caacaccaaccaacaugccg

SEQ ID NO: 2412802 - RNA, 16 nt, Bordetella pertussis
caacacgaccagcagg

SEQ ID NO: 2412803 - RNA, 14 nt, Bordetella pertussis
caacacgcuggacg

SEQ ID NO: 2412804 - RNA, 16 nt, Bordetella pertussis
caacacguacgaccgc

SEQ ID NO: 2412805 - RNA, 23 nt, Bordetella pertussis
caacacuuucaucaaacgcggcg

SEQ ID NO: 2412806 - RNA, 21 nt, Bordetella pertussis
caacagacccgggccgcuggc

SEQ ID NO: 2412807 - RNA, 12 nt, Bordetella pertussis
caacagcccccu

SEQ ID NO: 2412808 - RNA, 14 nt, Bordetella pertussis
caacagcucgcgcc

SEQ ID NO: 2412809 - RNA, 21 nt, Bordetella pertussis
caacagcuugcccacgcgcuc

SEQ ID NO: 2412810 - RNA, 14 nt, Bordetella pertussis
caacaggcagcugc

SEQ ID NO: 2412811 - RNA, 11 nt, Bordetella pertussis
caacaggucgu

SEQ ID NO: 2412812 - RNA, 19 nt, Bordetella pertussis
caacaggucguggcccagc

SEQ ID NO: 2412813 - RNA, 19 nt, Bordetella pertussis
caacaucaaugacauggcc

SEQ ID NO: 2412814 - RNA, 15 nt, Bordetella pertussis
caacaucgcccuguc

SEQ ID NO: 2412815 - RNA, 16 nt, Bordetella pertussis
caacaugccggacaag

SEQ ID NO: 2412816 - RNA, 22 nt, Bordetella pertussis
caacaugccggacaagccccuc

SEQ ID NO: 2412817 - RNA, 14 nt, Bordetella pertussis
caaccacgagcugc

SEQ ID NO: 2412818 - RNA, 22 nt, Bordetella pertussis
caagccagcacguaaucgaagc

SEQ ID NO: 2412819 - RNA, 14 nt, Bordetella pertussis
caagccagggcagg

SEQ ID NO: 2412820 - RNA, 15 nt, Bordetella pertussis
caagcccaccgggcc

SEQ ID NO: 2412821 - RNA, 17 nt, Bordetella pertussis
caagcccaggcggccca

SEQ ID NO: 2412822 - RNA, 19 nt, Bordetella pertussis
caagcccaggcggcccagc

SEQ ID NO: 2412823 - RNA, 23 nt, Bordetella pertussis
caagccccuccgauuuguccugu

SEQ ID NO: 2412824 - RNA, 21 nt, Bordetella pertussis
caagcccggcacggagggugc

SEQ ID NO: 2412825 - RNA, 14 nt, Bordetella pertussis
caagcccguggcgg

SEQ ID NO: 2412826 - RNA, 16 nt, Bordetella pertussis
caagccgauccgcgac

SEQ ID NO: 2412827 - RNA, 17 nt, Bordetella pertussis
caagccgauccgcgacg

SEQ ID NO: 2412828 - RNA, 20 nt, Bordetella pertussis
caagccgauccgcgacgccc

SEQ ID NO: 2412829 - RNA, 18 nt, Bordetella pertussis
caagccgcccgcggcggc

SEQ ID NO: 2412830 - RNA, 14 nt, Bordetella pertussis
caagccgcggcggu

SEQ ID NO: 2412831 - RNA, 15 nt, Bordetella pertussis
caagccggccgcgcg

SEQ ID NO: 2412832 - RNA, 13 nt, Bordetella pertussis
caagccgggcgcc

SEQ ID NO: 2412833 - RNA, 21 nt, Bordetella pertussis
caagccgggcgccggcggcaa

SEQ ID NO: 2412834 - RNA, 16 nt, Bordetella pertussis
caagccguacagcgaa

SEQ ID NO: 2412835 - RNA, 14 nt, Bordetella pertussis
caagccuugcggcc

SEQ ID NO: 2412836 - RNA, 21 nt, Bordetella pertussis
caagcgcacgcgcagcacgcu

SEQ ID NO: 2412837 - RNA, 15 nt, Bordetella pertussis
caagcgcucgccggc

SEQ ID NO: 2412838 - RNA, 19 nt, Bordetella pertussis
caagcgcucgccggcgcgc

SEQ ID NO: 2412839 - RNA, 14 nt, Bordetella pertussis
caagcgcucggcca

SEQ ID NO: 2412840 - RNA, 14 nt, Bordetella pertussis
caagcggccccagg

SEQ ID NO: 2412841 - RNA, 15 nt, Bordetella pertussis
caagcggccccaggu

SEQ ID NO: 2412842 - RNA, 14 nt, Bordetella pertussis
caagcggccggccu

SEQ ID NO: 2412843 - RNA, 23 nt, Bordetella pertussis
caagcggcguggggccggccgcg

SEQ ID NO: 2412844 - RNA, 20 nt, Bordetella pertussis
caagcggcugcccuugcugu

SEQ ID NO: 2412845 - RNA, 16 nt, Bordetella pertussis
caagcgucgauggcgu

SEQ ID NO: 2412846 - RNA, 18 nt, Bordetella pertussis
caagcgucgauggcguac

SEQ ID NO: 2412847 - RNA, 15 nt, Bordetella pertussis
caagcguucauggcg

SEQ ID NO: 2412848 - RNA, 17 nt, Bordetella pertussis
caagcguucauggcgca

SEQ ID NO: 2412849 - RNA, 22 nt, Bordetella pertussis
caagcguucauggcgcaugacg

SEQ ID NO: 2412850 - RNA, 20 nt, Bordetella pertussis
caagcucgcgcaugcagcga

SEQ ID NO: 2412851 - RNA, 20 nt, Bordetella pertussis
caagcugcugcuggaccugg

SEQ ID NO: 2412852 - RNA, 14 nt, Bordetella pertussis
caagcugcuggccg

SEQ ID NO: 2412853 - RNA, 18 nt, Bordetella pertussis
caagcuggagaagcgccg

SEQ ID NO: 2412854 - RNA, 19 nt, Bordetella pertussis
caagcuggagaagcgccgc

SEQ ID NO: 2412855 - RNA, 14 nt, Bordetella pertussis
caaggaaguggccg

SEQ ID NO: 2412856 - RNA, 16 nt, Bordetella pertussis
caaggaccaugcgcug

SEQ ID NO: 2412857 - RNA, 22 nt, Bordetella pertussis
caaggacgcguccucggccagc

SEQ ID NO: 2412858 - RNA, 17 nt, Bordetella pertussis
caaggauggacuggccg

SEQ ID NO: 2412859 - RNA, 15 nt, Bordetella pertussis
caaggauuucaccua

SEQ ID NO: 2412860 - RNA, 23 nt, Bordetella pertussis
caaggcaagcagcgagagcgcca

SEQ ID NO: 2412861 - RNA, 22 nt, Bordetella pertussis
caaggcaugcgccagcgccugg

SEQ ID NO: 2412862 - RNA, 18 nt, Bordetella pertussis
caaggcauuggcgccgcg

SEQ ID NO: 2412863 - RNA, 22 nt, Bordetella pertussis
caaggccacgaauuccucgccg

SEQ ID NO: 2412864 - RNA, 23 nt, Bordetella pertussis
caaggccacgaauuccucgccgc

SEQ ID NO: 2412865 - RNA, 19 nt, Bordetella pertussis
caaggccaugaucaggccg

SEQ ID NO: 2412866 - RNA, 23 nt, Bordetella pertussis
caaggccccgcgacccagaaccc

SEQ ID NO: 2412867 - RNA, 14 nt, Bordetella pertussis
caaggcccgcccgg

SEQ ID NO: 2412868 - RNA, 17 nt, Bordetella pertussis
caaggcccgccgcggca

SEQ ID NO: 2412869 - RNA, 22 nt, Bordetella pertussis
caaggccgaauugccgccgcug

SEQ ID NO: 2412870 - RNA, 16 nt, Bordetella pertussis
caaggccgacuggaug

SEQ ID NO: 2412871 - RNA, 21 nt, Bordetella pertussis
caaggccgacuggaugaagcg

SEQ ID NO: 2412872 - RNA, 20 nt, Bordetella pertussis
caaggccggcgcgucgcgcg

SEQ ID NO: 2412873 - RNA, 13 nt, Bordetella pertussis
caaggccggcggc

SEQ ID NO: 2412874 - RNA, 21 nt, Bordetella pertussis
caaggccggcggcacgcugcg

SEQ ID NO: 2412875 - RNA, 15 nt, Bordetella pertussis
caaggcgcgccaccg

SEQ ID NO: 2412876 - RNA, 12 nt, Bordetella pertussis
caaggcgcggca

SEQ ID NO: 2412877 - RNA, 12 nt, Bordetella pertussis
caaggcgcggcc

SEQ ID NO: 2412878 - RNA, 16 nt, Bordetella pertussis
caaggcggcaaacccg

SEQ ID NO: 2412879 - RNA, 19 nt, Bordetella pertussis
caaggcggcaaacccggcg

SEQ ID NO: 2412880 - RNA, 22 nt, Bordetella pertussis
caaggcggcaaacccggcgaag

SEQ ID NO: 2412881 - RNA, 19 nt, Bordetella pertussis
caaggcggcccggccgccg

SEQ ID NO: 2412882 - RNA, 20 nt, Bordetella pertussis
caaggcggcccggccgccgc

SEQ ID NO: 2412883 - RNA, 13 nt, Bordetella pertussis
caaggcggccgcg

SEQ ID NO: 2412884 - RNA, 20 nt, Bordetella pertussis
caagggccccccggcgcggc

SEQ ID NO: 2412885 - RNA, 21 nt, Bordetella pertussis
caagggcgccgcgccggggcg

SEQ ID NO: 2412886 - RNA, 17 nt, Bordetella pertussis
caagggcgccgggcgga

SEQ ID NO: 2412887 - RNA, 13 nt, Bordetella pertussis
caagggcgcgcca

SEQ ID NO: 2412888 - RNA, 12 nt, Bordetella pertussis
caagggcggcca

SEQ ID NO: 2412889 - RNA, 15 nt, Bordetella pertussis
caaggggcggaucgu

SEQ ID NO: 2412890 - RNA, 21 nt, Bordetella pertussis
caaggguuguggccguggcgg

SEQ ID NO: 2412891 - RNA, 23 nt, Bordetella pertussis
caaggguuuugggucauggaaaa

SEQ ID NO: 2412892 - RNA, 16 nt, Bordetella pertussis
caagguacccgcgccg

SEQ ID NO: 2412893 - RNA, 17 nt, Bordetella pertussis
caagguacccgcgccgg

SEQ ID NO: 2412894 - RNA, 19 nt, Bordetella pertussis
caagguacccgcgccggcg

SEQ ID NO: 2412895 - RNA, 12 nt, Bordetella pertussis
caagguccaggc

SEQ ID NO: 2412896 - RNA, 15 nt, Bordetella pertussis
caagguccaggcgcg

SEQ ID NO: 2412897 - RNA, 17 nt, Bordetella pertussis
caagguccaggcgcgca

SEQ ID NO: 2412898 - RNA, 23 nt, Bordetella pertussis
caaggugaaauagccaugcggac

SEQ ID NO: 2412899 - RNA, 17 nt, Bordetella pertussis
caaggugccuguccccg

SEQ ID NO: 2412900 - RNA, 20 nt, Bordetella pertussis
caagguggcgugcagcaggu

SEQ ID NO: 2412901 - RNA, 21 nt, Bordetella pertussis
caagguggcgugcagcaggua

SEQ ID NO: 2412902 - RNA, 21 nt, Bordetella pertussis
caaguaaacaugcgggucucg

SEQ ID NO: 2412903 - RNA, 14 nt, Bordetella pertussis
caagucagcccgcg

SEQ ID NO: 2412904 - RNA, 14 nt, Bordetella pertussis
caaguccggcgccg

SEQ ID NO: 2412905 - RNA, 19 nt, Bordetella pertussis
caagugcuggcccgccagc

SEQ ID NO: 2412906 - RNA, 21 nt, Bordetella pertussis
caauaacagaggaacgccgcg

SEQ ID NO: 2412907 - RNA, 23 nt, Bordetella pertussis
caauaacgccacuugcaggccgc

SEQ ID NO: 2412908 - RNA, 15 nt, Bordetella pertussis
caauaccuucagccc

SEQ ID NO: 2412909 - RNA, 19 nt, Bordetella pertussis
caauaccuucagcccggcg

SEQ ID NO: 2412910 - RNA, 20 nt, Bordetella pertussis
caauacgucgcgaccgccgc

SEQ ID NO: 2412911 - RNA, 18 nt, Bordetella pertussis
caauacuucguggcgcag

SEQ ID NO: 2412912 - RNA, 13 nt, Bordetella pertussis
caauagaucaucc

SEQ ID NO: 2412913 - RNA, 13 nt, Bordetella pertussis
caauagcgcccgc

SEQ ID NO: 2412914 - RNA, 18 nt, Bordetella pertussis
caauaggccgcgaugucg

SEQ ID NO: 2412915 - RNA, 17 nt, Bordetella pertussis
caaucagauggcgcagc

SEQ ID NO: 2412916 - RNA, 17 nt, Bordetella pertussis
caaucagccccaggcgc

SEQ ID NO: 2412917 - RNA, 23 nt, Bordetella pertussis
caaucauucgcgaagucauaaaa

SEQ ID NO: 2412918 - RNA, 19 nt, Bordetella pertussis
caauccccgcuuccugcug

SEQ ID NO: 2412919 - RNA, 22 nt, Bordetella pertussis
caaucccggcgacaccgcggcc

SEQ ID NO: 2412920 - RNA, 16 nt, Bordetella pertussis
caauccgcccguugcg

SEQ ID NO: 2412921 - RNA, 21 nt, Bordetella pertussis
caauccgcccguugcggcgcc

SEQ ID NO: 2412922 - RNA, 15 nt, Bordetella pertussis
caauccgccgccagc

SEQ ID NO: 2412923 - RNA, 16 nt, Bordetella pertussis
caauccgucaggcagc

SEQ ID NO: 2412924 - RNA, 14 nt, Bordetella pertussis
caauccuggcugau

SEQ ID NO: 2412925 - RNA, 18 nt, Bordetella pertussis
caaucgaaaagcccgccg

SEQ ID NO: 2412926 - RNA, 21 nt, Bordetella pertussis
caaucgaaaagcccgccgagu

SEQ ID NO: 2412927 - RNA, 22 nt, Bordetella pertussis
caaucggcgugcagcaagccca

SEQ ID NO: 2412928 - RNA, 18 nt, Bordetella pertussis
caaucgggguggcgccgu

SEQ ID NO: 2412929 - RNA, 19 nt, Bordetella pertussis
caaucgguuucggugcgga

SEQ ID NO: 2412930 - RNA, 13 nt, Bordetella pertussis
cacaguucggcca

SEQ ID NO: 2412931 - RNA, 18 nt, Bordetella pertussis
cacaguucggccagcggc

SEQ ID NO: 2412932 - RNA, 16 nt, Bordetella pertussis
cacaguuugucggcga

SEQ ID NO: 2412933 - RNA, 17 nt, Bordetella pertussis
cacauacaaggcgcggc

SEQ ID NO: 2412934 - RNA, 14 nt, Bordetella pertussis
cacauacgccgccg

SEQ ID NO: 2412935 - RNA, 15 nt, Bordetella pertussis
cacauagaccggcug

SEQ ID NO: 2412936 - RNA, 14 nt, Bordetella pertussis
cacauagcccggcg

SEQ ID NO: 2412937 - RNA, 15 nt, Bordetella pertussis
cacauagcccggcgc

SEQ ID NO: 2412938 - RNA, 17 nt, Bordetella pertussis
cacauagcccggcgcga

SEQ ID NO: 2412939 - RNA, 18 nt, Bordetella pertussis
cacauagcccggcgcgau

SEQ ID NO: 2412940 - RNA, 17 nt, Bordetella pertussis
cacauagcggccggcgc

SEQ ID NO: 2412941 - RNA, 19 nt, Bordetella pertussis
cacauagcggccggcgcgc

SEQ ID NO: 2412942 - RNA, 20 nt, Bordetella pertussis
cacauagcggccggcgcgcg

SEQ ID NO: 2412943 - RNA, 18 nt, Bordetella pertussis
cacaucagcgugccgccg

SEQ ID NO: 2412944 - RNA, 19 nt, Bordetella pertussis
cacaucagcgugccgccgg

SEQ ID NO: 2412945 - RNA, 22 nt, Bordetella pertussis
cacaucaggucgaccugcuugc

SEQ ID NO: 2412946 - RNA, 14 nt, Bordetella pertussis
cacaucaucgacca

SEQ ID NO: 2412947 - RNA, 14 nt, Bordetella pertussis
cacauccagccgau

SEQ ID NO: 2412948 - RNA, 12 nt, Bordetella pertussis
cacauccagcgc

SEQ ID NO: 2412949 - RNA, 13 nt, Bordetella pertussis
cacauccagcgcc

SEQ ID NO: 2412950 - RNA, 19 nt, Bordetella pertussis
cacauccagcgccagcacc

SEQ ID NO: 2412951 - RNA, 20 nt, Bordetella pertussis
cacauccagcgccagcaccg

SEQ ID NO: 2412952 - RNA, 16 nt, Bordetella pertussis
cacauccgacagaugg

SEQ ID NO: 2412953 - RNA, 21 nt, Bordetella pertussis
cacaucgaaggcaaucagccc

SEQ ID NO: 2412954 - RNA, 20 nt, Bordetella pertussis
cacaucgaauuugaacagcc

SEQ ID NO: 2412955 - RNA, 21 nt, Bordetella pertussis
cacaucgaauuugaacagccg

SEQ ID NO: 2412956 - RNA, 21 nt, Bordetella pertussis
cacaucgagggcgucaucggc

SEQ ID NO: 2412957 - RNA, 13 nt, Bordetella pertussis
cacaucgcccgug

SEQ ID NO: 2412958 - RNA, 19 nt, Bordetella pertussis
cacaucgccggcggcgugg

SEQ ID NO: 2412959 - RNA, 14 nt, Bordetella pertussis
cacaucggccaccc

SEQ ID NO: 2412960 - RNA, 16 nt, Bordetella pertussis
cacaucggcccuggca

SEQ ID NO: 2412961 - RNA, 17 nt, Bordetella pertussis
cacaucgucgacgucga

SEQ ID NO: 2412962 - RNA, 15 nt, Bordetella pertussis
cacaucgucgcgcug

SEQ ID NO: 2412963 - RNA, 18 nt, Bordetella pertussis
cacaucuguccugauuca

SEQ ID NO: 2412964 - RNA, 16 nt, Bordetella pertussis
cacaugaugcccagcg

SEQ ID NO: 2412965 - RNA, 16 nt, Bordetella pertussis
cacaugcccggccacc

SEQ ID NO: 2412966 - RNA, 17 nt, Bordetella pertussis
cacaugcccggccacca

SEQ ID NO: 2412967 - RNA, 15 nt, Bordetella pertussis
cacauggaaauccuu

SEQ ID NO: 2412968 - RNA, 18 nt, Bordetella pertussis
cacauggcggauggcaua

SEQ ID NO: 2412969 - RNA, 20 nt, Bordetella pertussis
cacauggggacuggcacccg

SEQ ID NO: 2412970 - RNA, 17 nt, Bordetella pertussis
cacauggucgcccagca

SEQ ID NO: 2412971 - RNA, 14 nt, Bordetella pertussis
caccaaccugcugg

SEQ ID NO: 2412972 - RNA, 22 nt, Bordetella pertussis
caccaacugguagugcggcgcc

SEQ ID NO: 2412973 - RNA, 14 nt, Bordetella pertussis
caccaagggcgccg

SEQ ID NO: 2412974 - RNA, 17 nt, Bordetella pertussis
caccaaucuugccaggc

SEQ ID NO: 2412975 - RNA, 18 nt, Bordetella pertussis
caccacaucgccggcggc

SEQ ID NO: 2412976 - RNA, 14 nt, Bordetella pertussis
caccaccaccaccu

SEQ ID NO: 2412977 - RNA, 14 nt, Bordetella pertussis
caccaccaccaugu

SEQ ID NO: 2412978 - RNA, 13 nt, Bordetella pertussis
caccaccaccgcc

SEQ ID NO: 2412979 - RNA, 15 nt, Bordetella pertussis
caccaccaccgcccg

SEQ ID NO: 2412980 - RNA, 17 nt, Bordetella pertussis
caccaccagcgcggcca

SEQ ID NO: 2412981 - RNA, 13 nt, Bordetella pertussis
caccaccagcggc

SEQ ID NO: 2412982 - RNA, 12 nt, Bordetella pertussis
caccaccaggcc

SEQ ID NO: 2412983 - RNA, 14 nt, Bordetella pertussis
caccaccaggccca

SEQ ID NO: 2412984 - RNA, 13 nt, Bordetella pertussis
caccaccaggccg

SEQ ID NO: 2412985 - RNA, 14 nt, Bordetella pertussis
caccaccaggccgg

SEQ ID NO: 2412986 - RNA, 15 nt, Bordetella pertussis
caccaccaggccggc

SEQ ID NO: 2412987 - RNA, 17 nt, Bordetella pertussis
caccaccaggccggcca

SEQ ID NO: 2412988 - RNA, 11 nt, Bordetella pertussis
caccaccaucu

SEQ ID NO: 2412989 - RNA, 20 nt, Bordetella pertussis
caccaccaugugcuugccgc

SEQ ID NO: 2412990 - RNA, 21 nt, Bordetella pertussis
caccaccaugugcuugccgca

SEQ ID NO: 2412991 - RNA, 13 nt, Bordetella pertussis
caccaccgagggc

SEQ ID NO: 2412992 - RNA, 13 nt, Bordetella pertussis
caccaccgcccgc

SEQ ID NO: 2412993 - RNA, 14 nt, Bordetella pertussis
caccaccggcaagg

SEQ ID NO: 2412994 - RNA, 16 nt, Bordetella pertussis
caccaccggcacgccg

SEQ ID NO: 2412995 - RNA, 23 nt, Bordetella pertussis
caccaccgucucgaacgccgcgu

SEQ ID NO: 2412996 - RNA, 14 nt, Bordetella pertussis
caccaccuccaccg

SEQ ID NO: 2412997 - RNA, 17 nt, Bordetella pertussis
caccaccuccaccgcca

SEQ ID NO: 2412998 - RNA, 16 nt, Bordetella pertussis
caccaccucggugccg

SEQ ID NO: 2412999 - RNA, 12 nt, Bordetella pertussis
caccaccuggcu

SEQ ID NO: 2413000 - RNA, 18 nt, Bordetella pertussis
caccaccuucagggcgcc

SEQ ID NO: 2413001 - RNA, 19 nt, Bordetella pertussis
caccaccuucagggcgccg

SEQ ID NO: 2413002 - RNA, 14 nt, Bordetella pertussis
caccacgaccggcu

SEQ ID NO: 2413003 - RNA, 16 nt, Bordetella pertussis
caccacgaccggcucg

SEQ ID NO: 2413004 - RNA, 18 nt, Bordetella pertussis
caccacgcccgcgccgca

SEQ ID NO: 2413005 - RNA, 20 nt, Bordetella pertussis
caccacgccuucgagcacca

SEQ ID NO: 2413006 - RNA, 21 nt, Bordetella pertussis
caccacgccuucgagcaccau

SEQ ID NO: 2413007 - RNA, 14 nt, Bordetella pertussis
caccacgcgcacca

SEQ ID NO: 2413008 - RNA, 20 nt, Bordetella pertussis
caccacgcgcaccagcuugg

SEQ ID NO: 2413009 - RNA, 14 nt, Bordetella pertussis
caccacgcgcucca

SEQ ID NO: 2413010 - RNA, 13 nt, Bordetella pertussis
caccacgcuggcu

SEQ ID NO: 2413011 - RNA, 18 nt, Bordetella pertussis
caccacggcaucggcgcc

SEQ ID NO: 2413012 - RNA, 13 nt, Bordetella pertussis
caccacggccacg

SEQ ID NO: 2413013 - RNA, 13 nt, Bordetella pertussis
caccacggcgcgc

SEQ ID NO: 2413014 - RNA, 14 nt, Bordetella pertussis
caccacggcgcgga

SEQ ID NO: 2413015 - RNA, 13 nt, Bordetella pertussis
caccacggcggcc

SEQ ID NO: 2413016 - RNA, 16 nt, Bordetella pertussis
caccacggcggccagg

SEQ ID NO: 2413017 - RNA, 17 nt, Bordetella pertussis
caccacggcggccaggc

SEQ ID NO: 2413018 - RNA, 19 nt, Bordetella pertussis
caccacggcggccaggccg

SEQ ID NO: 2413019 - RNA, 16 nt, Bordetella pertussis
caccacgggcacgaug

SEQ ID NO: 2413020 - RNA, 14 nt, Bordetella pertussis
caccacgggcucgc

SEQ ID NO: 2413021 - RNA, 16 nt, Bordetella pertussis
caccacgggcucgcug

SEQ ID NO: 2413022 - RNA, 20 nt, Bordetella pertussis
caccacugcaaggcccgccc

SEQ ID NO: 2413023 - RNA, 23 nt, Bordetella pertussis
caccacugcaaggcccgcccggg

SEQ ID NO: 2413024 - RNA, 15 nt, Bordetella pertussis
caccagcaagccggc

SEQ ID NO: 2413025 - RNA, 19 nt, Bordetella pertussis
caccagcaccaugccgaug

SEQ ID NO: 2413026 - RNA, 19 nt, Bordetella pertussis
caccagcaccgaugcgccg

SEQ ID NO: 2413027 - RNA, 13 nt, Bordetella pertussis
caccagcaccggc

SEQ ID NO: 2413028 - RNA, 12 nt, Bordetella pertussis
caccagcagccc

SEQ ID NO: 2413029 - RNA, 16 nt, Bordetella pertussis
caccagcagccccagc

SEQ ID NO: 2413030 - RNA, 23 nt, Bordetella pertussis
caccagcagccccagcguccagg

SEQ ID NO: 2413031 - RNA, 12 nt, Bordetella pertussis
caccagcagcgc

SEQ ID NO: 2413032 - RNA, 20 nt, Bordetella pertussis
caccagcagcgccaggauga

SEQ ID NO: 2413033 - RNA, 10 nt, Bordetella pertussis
caccagcagg

SEQ ID NO: 2413034 - RNA, 16 nt, Bordetella pertussis
caccagcaggcggccg

SEQ ID NO: 2413035 - RNA, 11 nt, Bordetella pertussis
caccagcaggu

SEQ ID NO: 2413036 - RNA, 18 nt, Bordetella pertussis
caccagcagguggcgcug

SEQ ID NO: 2413037 - RNA, 14 nt, Bordetella pertussis
caccagcaucgcgc

SEQ ID NO: 2413038 - RNA, 18 nt, Bordetella pertussis
caccagccauucgauggc

SEQ ID NO: 2413039 - RNA, 20 nt, Bordetella pertussis
caccagcccgaugcgccagg

SEQ ID NO: 2413040 - RNA, 13 nt, Bordetella pertussis
caccagcccgccc

SEQ ID NO: 2413041 - RNA, 20 nt, Bordetella pertussis
caccagcccgcccgcgccca

SEQ ID NO: 2413042 - RNA, 22 nt, Bordetella pertussis
caccagcccgcccgcgcccagc

SEQ ID NO: 2413043 - RNA, 23 nt, Bordetella pertussis
caccagcccgcccgcgcccagcu

SEQ ID NO: 2413044 - RNA, 13 nt, Bordetella pertussis
caccagccgcccg

SEQ ID NO: 2413045 - RNA, 19 nt, Bordetella pertussis
caccaucagcuggaucugg

SEQ ID NO: 2413046 - RNA, 18 nt, Bordetella pertussis
caccauccugccccagga

SEQ ID NO: 2413047 - RNA, 23 nt, Bordetella pertussis
caccauccugccccaggaaaccg

SEQ ID NO: 2413048 - RNA, 14 nt, Bordetella pertussis
caccaucgaugugg

SEQ ID NO: 2413049 - RNA, 18 nt, Bordetella pertussis
caccaucgccgagccgcu

SEQ ID NO: 2413050 - RNA, 19 nt, Bordetella pertussis
caccaucgccgagccgcug

SEQ ID NO: 2413051 - RNA, 13 nt, Bordetella pertussis
caccaucgccgcc

SEQ ID NO: 2413052 - RNA, 16 nt, Bordetella pertussis
caccaucgccgccugc

SEQ ID NO: 2413053 - RNA, 19 nt, Bordetella pertussis
caccaucguugccugggug

SEQ ID NO: 2413054 - RNA, 23 nt, Bordetella pertussis
caccaugauggccgcgcgcagcg

SEQ ID NO: 2413055 - RNA, 14 nt, Bordetella pertussis
caccaugcggugcg

SEQ ID NO: 2413056 - RNA, 16 nt, Bordetella pertussis
caccauggcgcccacg

SEQ ID NO: 2413057 - RNA, 17 nt, Bordetella pertussis
caccauggcgcccacgg

SEQ ID NO: 2413058 - RNA, 16 nt, Bordetella pertussis
caccaugggcucgugc

SEQ ID NO: 2413059 - RNA, 14 nt, Bordetella pertussis
caccaugucccugg

SEQ ID NO: 2413060 - RNA, 20 nt, Bordetella pertussis
caccaugucccuggccauuc

SEQ ID NO: 2413061 - RNA, 21 nt, Bordetella pertussis
caccaugugcuugccgcagcg

SEQ ID NO: 2413062 - RNA, 23 nt, Bordetella pertussis
caccaugugcuugccgcagcggc

SEQ ID NO: 2413063 - RNA, 17 nt, Bordetella pertussis
caccauucucgcccugc

SEQ ID NO: 2413064 - RNA, 14 nt, Bordetella pertussis
caccauugccggcg

SEQ ID NO: 2413065 - RNA, 17 nt, Bordetella pertussis
caccauugccggcgcgc

SEQ ID NO: 2413066 - RNA, 18 nt, Bordetella pertussis
caccauugccggcgcgca

SEQ ID NO: 2413067 - RNA, 18 nt, Bordetella pertussis
cacccacacuuggccggc

SEQ ID NO: 2413068 - RNA, 17 nt, Bordetella pertussis
cacccacagcagcgcgc

SEQ ID NO: 2413069 - RNA, 20 nt, Bordetella pertussis
cacccacagcagcgcgccgc

SEQ ID NO: 2413070 - RNA, 14 nt, Bordetella pertussis
cacccagccggacc

SEQ ID NO: 2413071 - RNA, 14 nt, Bordetella pertussis
cacccagcucagcg

SEQ ID NO: 2413072 - RNA, 15 nt, Bordetella pertussis
cacccaggcggcagg

SEQ ID NO: 2413073 - RNA, 16 nt, Bordetella pertussis
cacccaggcggcaggc

SEQ ID NO: 2413074 - RNA, 17 nt, Bordetella pertussis
cacccagggcuugacgc

SEQ ID NO: 2413075 - RNA, 20 nt, Bordetella pertussis
cacccagguaucggccagca

SEQ ID NO: 2413076 - RNA, 20 nt, Bordetella pertussis
cacccccagggcgcgccgga

SEQ ID NO: 2413077 - RNA, 17 nt, Bordetella pertussis
cacccccgaccgagcca

SEQ ID NO: 2413078 - RNA, 13 nt, Bordetella pertussis
cacccccuuggcu

SEQ ID NO: 2413079 - RNA, 20 nt, Bordetella pertussis
caccccgagauaggcggcca

SEQ ID NO: 2413080 - RNA, 16 nt, Bordetella pertussis
caccccgccaccgccc

SEQ ID NO: 2413081 - RNA, 20 nt, Bordetella pertussis
caccccgcccggcggcgcgc

SEQ ID NO: 2413082 - RNA, 13 nt, Bordetella pertussis
caccccgccgcug

SEQ ID NO: 2413083 - RNA, 19 nt, Bordetella pertussis
caccccggccgacggcaag

SEQ ID NO: 2413084 - RNA, 13 nt, Bordetella pertussis
caccccgggcggg

SEQ ID NO: 2413085 - RNA, 16 nt, Bordetella pertussis
caccccggucagcagg

SEQ ID NO: 2413086 - RNA, 21 nt, Bordetella pertussis
caccccggucagcagggcgcc

SEQ ID NO: 2413087 - RNA, 22 nt, Bordetella pertussis
caccccggucagcagggcgccg

SEQ ID NO: 2413088 - RNA, 20 nt, Bordetella pertussis
caccccggugucgccguggc

SEQ ID NO: 2413089 - RNA, 22 nt, Bordetella pertussis
caccccggugucgccguggcgg

SEQ ID NO: 2413090 - RNA, 18 nt, Bordetella pertussis
caccccguagcgcaucgc

SEQ ID NO: 2413091 - RNA, 16 nt, Bordetella pertussis
caccccgucaucgccg

SEQ ID NO: 2413092 - RNA, 20 nt, Bordetella pertussis
caccccgucaucgccgcggc

SEQ ID NO: 2413093 - RNA, 21 nt, Bordetella pertussis
caccccgucguccguccuggc

SEQ ID NO: 2413094 - RNA, 17 nt, Bordetella pertussis
caccccguugcagccca

SEQ ID NO: 2413095 - RNA, 20 nt, Bordetella pertussis
caccccguugcagcccagcg

SEQ ID NO: 2413096 - RNA, 15 nt, Bordetella pertussis
caccccucccugugg

SEQ ID NO: 2413097 - RNA, 18 nt, Bordetella pertussis
cacccgacagcucggacg

SEQ ID NO: 2413098 - RNA, 17 nt, Bordetella pertussis
cacccgauacgacacgc

SEQ ID NO: 2413099 - RNA, 23 nt, Bordetella pertussis
cacccgauacgacacgccgcgcg

SEQ ID NO: 2413100 - RNA, 19 nt, Bordetella pertussis
cacccgaugacggggcggc

SEQ ID NO: 2413101 - RNA, 21 nt, Bordetella pertussis
cacccgaugacggggcggcgc

SEQ ID NO: 2413102 - RNA, 20 nt, Bordetella pertussis
cacccgauggucacacuguc

SEQ ID NO: 2413103 - RNA, 23 nt, Bordetella pertussis
cacccgcaaaccugaugccuguc

SEQ ID NO: 2413104 - RNA, 14 nt, Bordetella pertussis
cacccgcacgccgg

SEQ ID NO: 2413105 - RNA, 15 nt, Bordetella pertussis
cacccgcacgccggc

SEQ ID NO: 2413106 - RNA, 17 nt, Bordetella pertussis
cacccgcacgccggccu

SEQ ID NO: 2413107 - RNA, 24 nt, Bordetella pertussis
cacccgcacgccggccugcgccag

SEQ ID NO: 2413108 - RNA, 13 nt, Bordetella pertussis
cacccgcacgggc

SEQ ID NO: 2413109 - RNA, 21 nt, Bordetella pertussis
cacccgcacgggcagacgcca

SEQ ID NO: 2413110 - RNA, 14 nt, Bordetella pertussis
cacccgcaggcggc

SEQ ID NO: 2413111 - RNA, 17 nt, Bordetella pertussis
cacccgcaggcggcugg

SEQ ID NO: 2413112 - RNA, 14 nt, Bordetella pertussis
cacccgcauggugg

SEQ ID NO: 2413113 - RNA, 16 nt, Bordetella pertussis
cacccgccuggacggc

SEQ ID NO: 2413114 - RNA, 18 nt, Bordetella pertussis
cacccgccuggacggcga

SEQ ID NO: 2413115 - RNA, 13 nt, Bordetella pertussis
cacccgcggcgca

SEQ ID NO: 2413116 - RNA, 22 nt, Bordetella pertussis
cacccgcggcgcaugcagccgc

SEQ ID NO: 2413117 - RNA, 17 nt, Bordetella pertussis
cacccgcuaccccggca

SEQ ID NO: 2413118 - RNA, 19 nt, Bordetella pertussis
cacccggaucgacaggaac

SEQ ID NO: 2413119 - RNA, 16 nt, Bordetella pertussis
cacccggcacgcgccg

SEQ ID NO: 2413120 - RNA, 19 nt, Bordetella pertussis
cacccggccaucgaagcca

SEQ ID NO: 2413121 - RNA, 12 nt, Bordetella pertussis
cacccggccgcu

SEQ ID NO: 2413122 - RNA, 14 nt, Bordetella pertussis
cacccggccgcugu

SEQ ID NO: 2413123 - RNA, 16 nt, Bordetella pertussis
cacccggcgcaugcug

SEQ ID NO: 2413124 - RNA, 23 nt, Bordetella pertussis
cacccggguacguggccccaggc

SEQ ID NO: 2413125 - RNA, 18 nt, Bordetella pertussis
cacccgguauccgcgcau

SEQ ID NO: 2413126 - RNA, 22 nt, Bordetella pertussis
cacccggugaucaugccgcuga

SEQ ID NO: 2413127 - RNA, 21 nt, Bordetella pertussis
cacccgucccugguccagcag

SEQ ID NO: 2413128 - RNA, 23 nt, Bordetella pertussis
cacccgucccugguccagcagcg

SEQ ID NO: 2413129 - RNA, 16 nt, Bordetella pertussis
cacccugcaggccggg

SEQ ID NO: 2413130 - RNA, 22 nt, Bordetella pertussis
cacccugccgugggacaggcac

SEQ ID NO: 2413131 - RNA, 23 nt, Bordetella pertussis
cacccuggaugccaugccgggca

SEQ ID NO: 2413132 - RNA, 15 nt, Bordetella pertussis
cacccuggcacgcug

SEQ ID NO: 2413133 - RNA, 21 nt, Bordetella pertussis
cacccugguacccaugcgggg

SEQ ID NO: 2413134 - RNA, 23 nt, Bordetella pertussis
cacccugguacccaugcggggcg

SEQ ID NO: 2413135 - RNA, 15 nt, Bordetella pertussis
cacccugucauacgc

SEQ ID NO: 2413136 - RNA, 14 nt, Bordetella pertussis
cacccuugccgcgg

SEQ ID NO: 2413137 - RNA, 16 nt, Bordetella pertussis
caccgaacccugccuc

SEQ ID NO: 2413138 - RNA, 13 nt, Bordetella pertussis
caccgaacgggcg

SEQ ID NO: 2413139 - RNA, 16 nt, Bordetella pertussis
caccgaacgggcgugg

SEQ ID NO: 2413140 - RNA, 19 nt, Bordetella pertussis
caccgaacgggcguggcgc

SEQ ID NO: 2413141 - RNA, 20 nt, Bordetella pertussis
caccgaacgggcguggcgca

SEQ ID NO: 2413142 - RNA, 14 nt, Bordetella pertussis
caccgaagcauccc

SEQ ID NO: 2413143 - RNA, 14 nt, Bordetella pertussis
caccgaagcggcgu

SEQ ID NO: 2413144 - RNA, 18 nt, Bordetella pertussis
caccgacaagccggucga

SEQ ID NO: 2413145 - RNA, 13 nt, Bordetella pertussis
caccgacacgcug

SEQ ID NO: 2413146 - RNA, 15 nt, Bordetella pertussis
caccgacacgcuggc

SEQ ID NO: 2413147 - RNA, 16 nt, Bordetella pertussis
caccgacacgcuggcg

SEQ ID NO: 2413148 - RNA, 18 nt, Bordetella pertussis
caccgacacgcuggcgga

SEQ ID NO: 2413149 - RNA, 16 nt, Bordetella pertussis
caccgacaggaugggc

SEQ ID NO: 2413150 - RNA, 19 nt, Bordetella pertussis
caccgacaggaugggcgcu

SEQ ID NO: 2413151 - RNA, 13 nt, Bordetella pertussis
caccgacaugacc

SEQ ID NO: 2413152 - RNA, 19 nt, Bordetella pertussis
caccgacaugaccgcgucc

SEQ ID NO: 2413153 - RNA, 16 nt, Bordetella pertussis
caccgaccagcgcgcg

SEQ ID NO: 2413154 - RNA, 22 nt, Bordetella pertussis
caccgaccagcgcgcgccggcc

SEQ ID NO: 2413155 - RNA, 18 nt, Bordetella pertussis
caccgacggcagccccgg

SEQ ID NO: 2413156 - RNA, 12 nt, Bordetella pertussis
caccgacggcgc

SEQ ID NO: 2413157 - RNA, 15 nt, Bordetella pertussis
caccgacggcgcggc

SEQ ID NO: 2413158 - RNA, 12 nt, Bordetella pertussis
caccggcaugcc

SEQ ID NO: 2413159 - RNA, 19 nt, Bordetella pertussis
caccggccaggggcgcugg

SEQ ID NO: 2413160 - RNA, 13 nt, Bordetella pertussis
caccggccgaccc

SEQ ID NO: 2413161 - RNA, 18 nt, Bordetella pertussis
caccggccgacccgcggc

SEQ ID NO: 2413162 - RNA, 13 nt, Bordetella pertussis
caccggccgccgc

SEQ ID NO: 2413163 - RNA, 14 nt, Bordetella pertussis
caccggccgccgca

SEQ ID NO: 2413164 - RNA, 16 nt, Bordetella pertussis
caccggccggccgggc

SEQ ID NO: 2413165 - RNA, 21 nt, Bordetella pertussis
caccggcgccacggcuugcgc

SEQ ID NO: 2413166 - RNA, 13 nt, Bordetella pertussis
caccggcgcgccu

SEQ ID NO: 2413167 - RNA, 15 nt, Bordetella pertussis
caccggcgcgccugg

SEQ ID NO: 2413168 - RNA, 19 nt, Bordetella pertussis
caccggcgugagcgccacc

SEQ ID NO: 2413169 - RNA, 20 nt, Bordetella pertussis
caccggcgugagcgccaccg

SEQ ID NO: 2413170 - RNA, 21 nt, Bordetella pertussis
caccggcuuggccucggccgg

SEQ ID NO: 2413171 - RNA, 22 nt, Bordetella pertussis
caccggcuuggccucggccggc

SEQ ID NO: 2413172 - RNA, 19 nt, Bordetella pertussis
caccggcuugggcgugccc

SEQ ID NO: 2413173 - RNA, 18 nt, Bordetella pertussis
caccggcuuggggcgcgc

SEQ ID NO: 2413174 - RNA, 19 nt, Bordetella pertussis
caccggcuuggggcgcgcc

SEQ ID NO: 2413175 - RNA, 20 nt, Bordetella pertussis
caccggcuuggggcgcgccg

SEQ ID NO: 2413176 - RNA, 16 nt, Bordetella pertussis
caccggcuugucgacc

SEQ ID NO: 2413177 - RNA, 15 nt, Bordetella pertussis
caccgggacaggcac

SEQ ID NO: 2413178 - RNA, 17 nt, Bordetella pertussis
caccgggacaggcaccc

SEQ ID NO: 2413179 - RNA, 13 nt, Bordetella pertussis
caccgggccggcc

SEQ ID NO: 2413180 - RNA, 23 nt, Bordetella pertussis
caccgggccggccugcgucgcca

SEQ ID NO: 2413181 - RNA, 15 nt, Bordetella pertussis
caccgggcggcccgg

SEQ ID NO: 2413182 - RNA, 16 nt, Bordetella pertussis
caccgggcugaacauc

SEQ ID NO: 2413183 - RNA, 14 nt, Bordetella pertussis
caccggggcagggc

SEQ ID NO: 2413184 - RNA, 22 nt, Bordetella pertussis
caccggggcagggcgggcggga

SEQ ID NO: 2413185 - RNA, 20 nt, Bordetella pertussis
caccggguaauggcgcucca

SEQ ID NO: 2413186 - RNA, 16 nt, Bordetella pertussis
caccggucuacgccau

SEQ ID NO: 2413187 - RNA, 19 nt, Bordetella pertussis
caccgguugcagcgcgcca

SEQ ID NO: 2413188 - RNA, 20 nt, Bordetella pertussis
caccgguugcagcgcgccag

SEQ ID NO: 2413189 - RNA, 20 nt, Bordetella pertussis
caccguauccucgaucagcg

SEQ ID NO: 2413190 - RNA, 14 nt, Bordetella pertussis
caccgucacgcgca

SEQ ID NO: 2413191 - RNA, 15 nt, Bordetella pertussis
caccgucccguagcg

SEQ ID NO: 2413192 - RNA, 20 nt, Bordetella pertussis
caccgucgacuucgacccgg

SEQ ID NO: 2413193 - RNA, 12 nt, Bordetella pertussis
caccgucgcgcg

SEQ ID NO: 2413194 - RNA, 14 nt, Bordetella pertussis
caccgucgcgcgca

SEQ ID NO: 2413195 - RNA, 17 nt, Bordetella pertussis
caccgucgcgcgcacgc

SEQ ID NO: 2413196 - RNA, 19 nt, Bordetella pertussis
caccgucgcgcgcacgcgc

SEQ ID NO: 2413197 - RNA, 21 nt, Bordetella pertussis
caccgucucgaacgccgcguc

SEQ ID NO: 2413198 - RNA, 19 nt, Bordetella pertussis
caccgucuggcguacgcug

SEQ ID NO: 2413199 - RNA, 16 nt, Bordetella pertussis
caccgucuugcccgcc

SEQ ID NO: 2413200 - RNA, 20 nt, Bordetella pertussis
caccgucuugcccgccagcg

SEQ ID NO: 2413201 - RNA, 21 nt, Bordetella pertussis
caccgucuugcccgccagcgc

SEQ ID NO: 2413202 - RNA, 16 nt, Bordetella pertussis
caccgugaccugcguc

SEQ ID NO: 2413203 - RNA, 22 nt, Bordetella pertussis
caccgugauauagaccagcagc

SEQ ID NO: 2413204 - RNA, 17 nt, Bordetella pertussis
caccgugaugcgcgccg

SEQ ID NO: 2413205 - RNA, 19 nt, Bordetella pertussis
caccgugaugcgcgccgcu

SEQ ID NO: 2413206 - RNA, 20 nt, Bordetella pertussis
caccgugaugcgcgccgcuc

SEQ ID NO: 2413207 - RNA, 16 nt, Bordetella pertussis
caccgugauggcgcgg

SEQ ID NO: 2413208 - RNA, 16 nt, Bordetella pertussis
caccgugaugucgccg

SEQ ID NO: 2413209 - RNA, 18 nt, Bordetella pertussis
caccgugaugucgccguc

SEQ ID NO: 2413210 - RNA, 23 nt, Bordetella pertussis
caccgugaugucgccgucggcau

SEQ ID NO: 2413211 - RNA, 14 nt, Bordetella pertussis
caccgugcuggccg

SEQ ID NO: 2413212 - RNA, 15 nt, Bordetella pertussis
caccgugcuggccga

SEQ ID NO: 2413213 - RNA, 19 nt, Bordetella pertussis
caccgugcuggccgacgcg

SEQ ID NO: 2413214 - RNA, 18 nt, Bordetella pertussis
caccguggcaugccaugc

SEQ ID NO: 2413215 - RNA, 19 nt, Bordetella pertussis
caccguggcaugccaugcg

SEQ ID NO: 2413216 - RNA, 19 nt, Bordetella pertussis
caccguguugucuuuuuuc

SEQ ID NO: 2413217 - RNA, 18 nt, Bordetella pertussis
caccguucccggugccag

SEQ ID NO: 2413218 - RNA, 13 nt, Bordetella pertussis
caccguucuuccg

SEQ ID NO: 2413219 - RNA, 19 nt, Bordetella pertussis
caccguucuuccgcacgcc

SEQ ID NO: 2413220 - RNA, 17 nt, Bordetella pertussis
caccguuuccaagcgca

SEQ ID NO: 2413221 - RNA, 20 nt, Bordetella pertussis
caccguuuccaagcgcacgc

SEQ ID NO: 2413222 - RNA, 21 nt, Bordetella pertussis
caccguuuccaagcgcacgcg

SEQ ID NO: 2413223 - RNA, 16 nt, Bordetella pertussis
caccguuuuggcaggc

SEQ ID NO: 2413224 - RNA, 19 nt, Bordetella pertussis
caccguuuuggcaggcugg

SEQ ID NO: 2413225 - RNA, 17 nt, Bordetella pertussis
caccuaccucagcaugg

SEQ ID NO: 2413226 - RNA, 18 nt, Bordetella pertussis
caccucaggaugcccggg

SEQ ID NO: 2413227 - RNA, 14 nt, Bordetella pertussis
caccuccaccgcca

SEQ ID NO: 2413228 - RNA, 19 nt, Bordetella pertussis
caccucgaacucgaacgcg

SEQ ID NO: 2413229 - RNA, 17 nt, Bordetella pertussis
caccucgaucaccaccg

SEQ ID NO: 2413230 - RNA, 19 nt, Bordetella pertussis
caccucgaucaccaccggc

SEQ ID NO: 2413231 - RNA, 14 nt, Bordetella pertussis
caccucgcuugccc

SEQ ID NO: 2413232 - RNA, 18 nt, Bordetella pertussis
caccucggacgagacagg

SEQ ID NO: 2413233 - RNA, 13 nt, Bordetella pertussis
caccucggccggg

SEQ ID NO: 2413234 - RNA, 15 nt, Bordetella pertussis
caccucggccggggc

SEQ ID NO: 2413235 - RNA, 16 nt, Bordetella pertussis
caccucggccucgcug

SEQ ID NO: 2413236 - RNA, 20 nt, Bordetella pertussis
caccucggccucgcuggcga

SEQ ID NO: 2413237 - RNA, 17 nt, Bordetella pertussis
caccucggcgcccagcu

SEQ ID NO: 2413238 - RNA, 14 nt, Bordetella pertussis
caccucggcgccgc

SEQ ID NO: 2413239 - RNA, 18 nt, Bordetella pertussis
caccucggcgccgcggcg

SEQ ID NO: 2413240 - RNA, 19 nt, Bordetella pertussis
caccucggcgccgcggcgc

SEQ ID NO: 2413241 - RNA, 19 nt, Bordetella pertussis
caccucggcgucgcccggg

SEQ ID NO: 2413242 - RNA, 13 nt, Bordetella pertussis
caccucggcgugg

SEQ ID NO: 2413243 - RNA, 18 nt, Bordetella pertussis
caccucggggcgcggccg

SEQ ID NO: 2413244 - RNA, 19 nt, Bordetella pertussis
caccucggggcgcggccgg

SEQ ID NO: 2413245 - RNA, 21 nt, Bordetella pertussis
caccucggggugcagcuucuu

SEQ ID NO: 2413246 - RNA, 19 nt, Bordetella pertussis
caccucguaaguggcggcg

SEQ ID NO: 2413247 - RNA, 23 nt, Bordetella pertussis
caccucguccguuucgucggcgc

SEQ ID NO: 2413248 - RNA, 17 nt, Bordetella pertussis
caccucgucguccagcg

SEQ ID NO: 2413249 - RNA, 19 nt, Bordetella pertussis
caccucgucguccagcguc

SEQ ID NO: 2413250 - RNA, 21 nt, Bordetella pertussis
caccucgucguccagcgucau

SEQ ID NO: 2413251 - RNA, 20 nt, Bordetella pertussis
caccucuucagcccggcgcg

SEQ ID NO: 2413252 - RNA, 21 nt, Bordetella pertussis
caccucuucagcccggcgcgc

SEQ ID NO: 2413253 - RNA, 19 nt, Bordetella pertussis
caccugaacaccggcgcgc

SEQ ID NO: 2413254 - RNA, 21 nt, Bordetella pertussis
caccugaacaccggcgcgccu

SEQ ID NO: 2413255 - RNA, 21 nt, Bordetella pertussis
caccugcaccgaagcauccca

SEQ ID NO: 2413256 - RNA, 13 nt, Bordetella pertussis
caccugcaccgcc

SEQ ID NO: 2413257 - RNA, 20 nt, Bordetella pertussis
caccugcaccgucaggugca

SEQ ID NO: 2413258 - RNA, 15 nt, Bordetella pertussis
caccugcagccagau

SEQ ID NO: 2413259 - RNA, 23 nt, Bordetella pertussis
caccugcaggcccaccggcaugc

SEQ ID NO: 2413260 - RNA, 16 nt, Bordetella pertussis
caccugcaggccgccg

SEQ ID NO: 2413261 - RNA, 19 nt, Bordetella pertussis
caccugcaggccgccggcc

SEQ ID NO: 2413262 - RNA, 23 nt, Bordetella pertussis
caccugcaggccgccggccagcg

SEQ ID NO: 2413263 - RNA, 14 nt, Bordetella pertussis
caccugcaggguca

SEQ ID NO: 2413264 - RNA, 20 nt, Bordetella pertussis
caccugcagggucagcccgc

SEQ ID NO: 2413265 - RNA, 22 nt, Bordetella pertussis
caccugcagggucagcccgcca

SEQ ID NO: 2413266 - RNA, 20 nt, Bordetella pertussis
caccugcaugcccauuucca

SEQ ID NO: 2413267 - RNA, 14 nt, Bordetella pertussis
caccugccugccgc

SEQ ID NO: 2413268 - RNA, 18 nt, Bordetella pertussis
caccugccugccgccugc

SEQ ID NO: 2413269 - RNA, 16 nt, Bordetella pertussis
caccugcgaccgagcc

SEQ ID NO: 2413270 - RNA, 22 nt, Bordetella pertussis
cacgaucggcgccuggccgccc

SEQ ID NO: 2413271 - RNA, 20 nt, Bordetella pertussis
cacgaucuggccgauggccu

SEQ ID NO: 2413272 - RNA, 16 nt, Bordetella pertussis
cacgaucuggcgcgcg

SEQ ID NO: 2413273 - RNA, 18 nt, Bordetella pertussis
cacgaucuggcgcgcgac

SEQ ID NO: 2413274 - RNA, 19 nt, Bordetella pertussis
cacgaugaacgcgcgcaac

SEQ ID NO: 2413275 - RNA, 23 nt, Bordetella pertussis
cacgaugaucgcgccgacgaccg

SEQ ID NO: 2413276 - RNA, 16 nt, Bordetella pertussis
cacgaugcccagggcc

SEQ ID NO: 2413277 - RNA, 18 nt, Bordetella pertussis
cacgaugccgucgccgcc

SEQ ID NO: 2413278 - RNA, 18 nt, Bordetella pertussis
cacgaugcgggcaucgcc

SEQ ID NO: 2413279 - RNA, 19 nt, Bordetella pertussis
cacgaugcgggcaucgccc

SEQ ID NO: 2413280 - RNA, 17 nt, Bordetella pertussis
cacgauggaaucgucga

SEQ ID NO: 2413281 - RNA, 15 nt, Bordetella pertussis
cacgauggccgcgcc

SEQ ID NO: 2413282 - RNA, 16 nt, Bordetella pertussis
cacgauggccgcgccc

SEQ ID NO: 2413283 - RNA, 16 nt, Bordetella pertussis
cacgauggccggcgcg

SEQ ID NO: 2413284 - RNA, 17 nt, Bordetella pertussis
cacgauggccggcgcga

SEQ ID NO: 2413285 - RNA, 23 nt, Bordetella pertussis
cacgauggcgcaauaggccgcga

SEQ ID NO: 2413286 - RNA, 13 nt, Bordetella pertussis
cacgauggcgccg

SEQ ID NO: 2413287 - RNA, 15 nt, Bordetella pertussis
cacgauggcgccggc

SEQ ID NO: 2413288 - RNA, 15 nt, Bordetella pertussis
cacgauggcgcgcga

SEQ ID NO: 2413289 - RNA, 23 nt, Bordetella pertussis
cacgauggggccauggcacaggc

SEQ ID NO: 2413290 - RNA, 16 nt, Bordetella pertussis
cacgauggggccgucg

SEQ ID NO: 2413291 - RNA, 19 nt, Bordetella pertussis
cacgaugguaucggccggg

SEQ ID NO: 2413292 - RNA, 20 nt, Bordetella pertussis
cacgaugguaucggccgggc

SEQ ID NO: 2413293 - RNA, 20 nt, Bordetella pertussis
cacgaugguguucagguguu

SEQ ID NO: 2413294 - RNA, 17 nt, Bordetella pertussis
cacgaugucguccagcu

SEQ ID NO: 2413295 - RNA, 19 nt, Bordetella pertussis
cacgauguugccgccggcc

SEQ ID NO: 2413296 - RNA, 22 nt, Bordetella pertussis
cacgauuccgccuacuggcgcg

SEQ ID NO: 2413297 - RNA, 14 nt, Bordetella pertussis
cacgauugucgucg

SEQ ID NO: 2413298 - RNA, 14 nt, Bordetella pertussis
cacgcacaccgccc

SEQ ID NO: 2413299 - RNA, 23 nt, Bordetella pertussis
cacgcacagcaccugguggcgcu

SEQ ID NO: 2413300 - RNA, 17 nt, Bordetella pertussis
cacgcacaugaugccca

SEQ ID NO: 2413301 - RNA, 20 nt, Bordetella pertussis
cacgcacaugaugcccagcg

SEQ ID NO: 2413302 - RNA, 13 nt, Bordetella pertussis
cacgcaccaggcg

SEQ ID NO: 2413303 - RNA, 22 nt, Bordetella pertussis
cacgcaccaggcgcacggcggc

SEQ ID NO: 2413304 - RNA, 17 nt, Bordetella pertussis
cacgcaccgcgccagcg

SEQ ID NO: 2413305 - RNA, 13 nt, Bordetella pertussis
cacgcacugagcu

SEQ ID NO: 2413306 - RNA, 16 nt, Bordetella pertussis
cacgcagacuccagga

SEQ ID NO: 2413307 - RNA, 14 nt, Bordetella pertussis
cacgcagcgcagga

SEQ ID NO: 2413308 - RNA, 19 nt, Bordetella pertussis
cacgcaggauaccggagcg

SEQ ID NO: 2413309 - RNA, 20 nt, Bordetella pertussis
cacgccacuacacucugccc

SEQ ID NO: 2413310 - RNA, 19 nt, Bordetella pertussis
cacgccagaacgcugaugc

SEQ ID NO: 2413311 - RNA, 14 nt, Bordetella pertussis
cacgccagcggcga

SEQ ID NO: 2413312 - RNA, 17 nt, Bordetella pertussis
cacgccagcggcgagca

SEQ ID NO: 2413313 - RNA, 15 nt, Bordetella pertussis
cacgccaucgaacuc

SEQ ID NO: 2413314 - RNA, 17 nt, Bordetella pertussis
cacgccauggacgccga

SEQ ID NO: 2413315 - RNA, 13 nt, Bordetella pertussis
cacgccauggucu

SEQ ID NO: 2413316 - RNA, 15 nt, Bordetella pertussis
cacgccauggucucg

SEQ ID NO: 2413317 - RNA, 19 nt, Bordetella pertussis
cacgccauucauccagcgc

SEQ ID NO: 2413318 - RNA, 23 nt, Bordetella pertussis
cacgccauucauccagcgcgcga

SEQ ID NO: 2413319 - RNA, 18 nt, Bordetella pertussis
cacgcccacgcgccgcca

SEQ ID NO: 2413320 - RNA, 23 nt, Bordetella pertussis
cacgcccacuuccucggcgcgcg

SEQ ID NO: 2413321 - RNA, 13 nt, Bordetella pertussis
cacgcccagacug

SEQ ID NO: 2413322 - RNA, 14 nt, Bordetella pertussis
cacgcccagauggc

SEQ ID NO: 2413323 - RNA, 17 nt, Bordetella pertussis
cacgcccagcaggcuuu

SEQ ID NO: 2413324 - RNA, 13 nt, Bordetella pertussis
cacgcccagccgc

SEQ ID NO: 2413325 - RNA, 14 nt, Bordetella pertussis
cacgcccagccgca

SEQ ID NO: 2413326 - RNA, 13 nt, Bordetella pertussis
cacgcccagcgcc

SEQ ID NO: 2413327 - RNA, 15 nt, Bordetella pertussis
cacgcccagcgccgg

SEQ ID NO: 2413328 - RNA, 13 nt, Bordetella pertussis
cacgcccaggccg

SEQ ID NO: 2413329 - RNA, 19 nt, Bordetella pertussis
cacgcccagucccaggccg

SEQ ID NO: 2413330 - RNA, 14 nt, Bordetella pertussis
cacgcccaucugcc

SEQ ID NO: 2413331 - RNA, 15 nt, Bordetella pertussis
cacgcccaucugcca

SEQ ID NO: 2413332 - RNA, 23 nt, Bordetella pertussis
cacgcccaucugguugagcagca

SEQ ID NO: 2413333 - RNA, 18 nt, Bordetella pertussis
cacgcccaugauggugcc

SEQ ID NO: 2413334 - RNA, 20 nt, Bordetella pertussis
cacgcccauggucaggacga

SEQ ID NO: 2413335 - RNA, 13 nt, Bordetella pertussis
cacgcccgccagc

SEQ ID NO: 2413336 - RNA, 22 nt, Bordetella pertussis
cacgcccgccagcagcucggcg

SEQ ID NO: 2413337 - RNA, 14 nt, Bordetella pertussis
cacgcccgccugca

SEQ ID NO: 2413338 - RNA, 18 nt, Bordetella pertussis
cacgcccgcgacgcuggc

SEQ ID NO: 2413339 - RNA, 15 nt, Bordetella pertussis
cacgcccgcggcgcc

SEQ ID NO: 2413340 - RNA, 23 nt, Bordetella pertussis
cacgcccggugccugccccugcg

SEQ ID NO: 2413341 - RNA, 23 nt, Bordetella pertussis
cacgcccgucccgacccccggcc

SEQ ID NO: 2413342 - RNA, 15 nt, Bordetella pertussis
cacgcccgucucgcg

SEQ ID NO: 2413343 - RNA, 16 nt, Bordetella pertussis
cacgcccgugucgccg

SEQ ID NO: 2413344 - RNA, 13 nt, Bordetella pertussis
cacgcccuggccg

SEQ ID NO: 2413345 - RNA, 13 nt, Bordetella pertussis
cacgcccuggcug

SEQ ID NO: 2413346 - RNA, 15 nt, Bordetella pertussis
cacgccgaccggacc

SEQ ID NO: 2413347 - RNA, 17 nt, Bordetella pertussis
cacgccgaccggaccgu

SEQ ID NO: 2413348 - RNA, 18 nt, Bordetella pertussis
cacgccgaccuggcgccc

SEQ ID NO: 2413349 - RNA, 22 nt, Bordetella pertussis
cacgccgaccuggcgcccgacg

SEQ ID NO: 2413350 - RNA, 22 nt, Bordetella pertussis
cacgccgaucgcgcacagcaug

SEQ ID NO: 2413351 - RNA, 18 nt, Bordetella pertussis
cacgccgaugaccagggc

SEQ ID NO: 2413352 - RNA, 21 nt, Bordetella pertussis
cacgccgaugaccagggcgcc

SEQ ID NO: 2413353 - RNA, 22 nt, Bordetella pertussis
cacgccgaugaccagggcgccg

SEQ ID NO: 2413354 - RNA, 17 nt, Bordetella pertussis
cacgccgaugcacaggu

SEQ ID NO: 2413355 - RNA, 16 nt, Bordetella pertussis
cacgccgaugccgcgc

SEQ ID NO: 2413356 - RNA, 17 nt, Bordetella pertussis
cacgccgaugccgcgca

SEQ ID NO: 2413357 - RNA, 18 nt, Bordetella pertussis
cacgccgaugccgcgcac

SEQ ID NO: 2413358 - RNA, 23 nt, Bordetella pertussis
cacgccgaugccgcgcaccuggg

SEQ ID NO: 2413359 - RNA, 19 nt, Bordetella pertussis
cacgccgauugaggccagc

SEQ ID NO: 2413360 - RNA, 22 nt, Bordetella pertussis
cacgccgauugaggccagcacg

SEQ ID NO: 2413361 - RNA, 13 nt, Bordetella pertussis
cacgccgccgaag

SEQ ID NO: 2413362 - RNA, 16 nt, Bordetella pertussis
cacgccgccggccagc

SEQ ID NO: 2413363 - RNA, 13 nt, Bordetella pertussis
cacgccgccuggc

SEQ ID NO: 2413364 - RNA, 16 nt, Bordetella pertussis
cacgccgccuggcccg

SEQ ID NO: 2413365 - RNA, 15 nt, Bordetella pertussis
cacgccgcgccaggc

SEQ ID NO: 2413366 - RNA, 18 nt, Bordetella pertussis
cacgccgcgccaggcauu

SEQ ID NO: 2413367 - RNA, 17 nt, Bordetella pertussis
cacgccgcgccggcgcg

SEQ ID NO: 2413368 - RNA, 17 nt, Bordetella pertussis
cacgccgcugauguggc

SEQ ID NO: 2413369 - RNA, 21 nt, Bordetella pertussis
cacgccggaccagucgaccca

SEQ ID NO: 2413370 - RNA, 13 nt, Bordetella pertussis
cacgccggccacg

SEQ ID NO: 2413371 - RNA, 19 nt, Bordetella pertussis
cacgccggccaggucggcg

SEQ ID NO: 2413372 - RNA, 11 nt, Bordetella pertussis
cacgccggccu

SEQ ID NO: 2413373 - RNA, 17 nt, Bordetella pertussis
cacgccggccugcgcca

SEQ ID NO: 2413374 - RNA, 22 nt, Bordetella pertussis
cacgccggccugcgccagcucc

SEQ ID NO: 2413375 - RNA, 20 nt, Bordetella pertussis
cacgccggccuugcugaacc

SEQ ID NO: 2413376 - RNA, 15 nt, Bordetella pertussis
cacgccggcgcgccg

SEQ ID NO: 2413377 - RNA, 16 nt, Bordetella pertussis
cacgccggcgcgccgg

SEQ ID NO: 2413378 - RNA, 17 nt, Bordetella pertussis
cacgccggcgcgccggg

SEQ ID NO: 2413379 - RNA, 11 nt, Bordetella pertussis
cacgccggcgg

SEQ ID NO: 2413380 - RNA, 14 nt, Bordetella pertussis
cacgccggcggcca

SEQ ID NO: 2413381 - RNA, 14 nt, Bordetella pertussis
cacgccggcggcgc

SEQ ID NO: 2413382 - RNA, 17 nt, Bordetella pertussis
cacgccggcgggcaggc

SEQ ID NO: 2413383 - RNA, 18 nt, Bordetella pertussis
cacgcuguuuucggccga

SEQ ID NO: 2413384 - RNA, 20 nt, Bordetella pertussis
cacggaaauccuagucaugc

SEQ ID NO: 2413385 - RNA, 15 nt, Bordetella pertussis
cacggaucagccgcu

SEQ ID NO: 2413386 - RNA, 21 nt, Bordetella pertussis
cacggcaaugucgcaggccgc

SEQ ID NO: 2413387 - RNA, 20 nt, Bordetella pertussis
cacggcacgccucgccggcc

SEQ ID NO: 2413388 - RNA, 19 nt, Bordetella pertussis
cacggcaggcgccugcccu

SEQ ID NO: 2413389 - RNA, 12 nt, Bordetella pertussis
cacggcaucgcc

SEQ ID NO: 2413390 - RNA, 22 nt, Bordetella pertussis
cacggccaacccucgcacggcc

SEQ ID NO: 2413391 - RNA, 23 nt, Bordetella pertussis
cacggccaacccucgcacggccg

SEQ ID NO: 2413392 - RNA, 14 nt, Bordetella pertussis
cacggccacggccg

SEQ ID NO: 2413393 - RNA, 17 nt, Bordetella pertussis
cacggccacggccggca

SEQ ID NO: 2413394 - RNA, 19 nt, Bordetella pertussis
cacggccacggccggcagc

SEQ ID NO: 2413395 - RNA, 14 nt, Bordetella pertussis
cacggccagcacgu

SEQ ID NO: 2413396 - RNA, 14 nt, Bordetella pertussis
cacggccagcagca

SEQ ID NO: 2413397 - RNA, 14 nt, Bordetella pertussis
cacggccauccguc

SEQ ID NO: 2413398 - RNA, 15 nt, Bordetella pertussis
cacggccgcggccgg

SEQ ID NO: 2413399 - RNA, 15 nt, Bordetella pertussis
cacggccggccaggc

SEQ ID NO: 2413400 - RNA, 13 nt, Bordetella pertussis
cacggccggcgca

SEQ ID NO: 2413401 - RNA, 16 nt, Bordetella pertussis
cacggccugcgcgccg

SEQ ID NO: 2413402 - RNA, 22 nt, Bordetella pertussis
cacggccugcgcgccgaccagg

SEQ ID NO: 2413403 - RNA, 19 nt, Bordetella pertussis
cacggcgaggaugccgcgc

SEQ ID NO: 2413404 - RNA, 17 nt, Bordetella pertussis
cacggcgcacaccauca

SEQ ID NO: 2413405 - RNA, 13 nt, Bordetella pertussis
cacggcgccaugc

SEQ ID NO: 2413406 - RNA, 12 nt, Bordetella pertussis
cacggcgcccga

SEQ ID NO: 2413407 - RNA, 12 nt, Bordetella pertussis
cacggcgcgccc

SEQ ID NO: 2413408 - RNA, 21 nt, Bordetella pertussis
cacggcgcgcccgcaggcggc

SEQ ID NO: 2413409 - RNA, 14 nt, Bordetella pertussis
cacggcgcgcgccu

SEQ ID NO: 2413410 - RNA, 21 nt, Bordetella pertussis
cacggcgcgcgccugcucgac

SEQ ID NO: 2413411 - RNA, 14 nt, Bordetella pertussis
cacggcgcggaugc

SEQ ID NO: 2413412 - RNA, 13 nt, Bordetella pertussis
cacggcgcggcug

SEQ ID NO: 2413413 - RNA, 16 nt, Bordetella pertussis
cacggcgcggcugccc

SEQ ID NO: 2413414 - RNA, 23 nt, Bordetella pertussis
cacggcgcggcugcccucgguca

SEQ ID NO: 2413415 - RNA, 15 nt, Bordetella pertussis
cacggcgcgggcggu

SEQ ID NO: 2413416 - RNA, 20 nt, Bordetella pertussis
cacggcgcgggcggucggcg

SEQ ID NO: 2413417 - RNA, 19 nt, Bordetella pertussis
cacggcggaaugcggcgac

SEQ ID NO: 2413418 - RNA, 23 nt, Bordetella pertussis
cacggcggaaugcggcgacaggg

SEQ ID NO: 2413419 - RNA, 20 nt, Bordetella pertussis
cacggcggccaggccggcga

SEQ ID NO: 2413420 - RNA, 15 nt, Bordetella pertussis
cacggcggcggcggu

SEQ ID NO: 2413421 - RNA, 13 nt, Bordetella pertussis
cacggcgggccgg

SEQ ID NO: 2413422 - RNA, 16 nt, Bordetella pertussis
cacggcgggccggcuc

SEQ ID NO: 2413423 - RNA, 22 nt, Bordetella pertussis
cacggcgggccggcucggcggc

SEQ ID NO: 2413424 - RNA, 17 nt, Bordetella pertussis
cacggcggugaccacca

SEQ ID NO: 2413425 - RNA, 20 nt, Bordetella pertussis
cacggcggugaccaccaggc

SEQ ID NO: 2413426 - RNA, 23 nt, Bordetella pertussis
cacggcggugaccaccaggccgc

SEQ ID NO: 2413427 - RNA, 17 nt, Bordetella pertussis
cacggcggugccgcgca

SEQ ID NO: 2413428 - RNA, 23 nt, Bordetella pertussis
cacggcggugcugaacgccucgg

SEQ ID NO: 2413429 - RNA, 19 nt, Bordetella pertussis
cacggcgucgaugcgcgcg

SEQ ID NO: 2413430 - RNA, 20 nt, Bordetella pertussis
cacggcgucgaugcgcgcgc

SEQ ID NO: 2413431 - RNA, 17 nt, Bordetella pertussis
cacggcgucgccggcca

SEQ ID NO: 2413432 - RNA, 22 nt, Bordetella pertussis
cacggcgucgccggccaggcaa

SEQ ID NO: 2413433 - RNA, 13 nt, Bordetella pertussis
cacggcguggcgc

SEQ ID NO: 2413434 - RNA, 16 nt, Bordetella pertussis
cacggcguggcgcgca

SEQ ID NO: 2413435 - RNA, 20 nt, Bordetella pertussis
cacggcguggcgcgcacacu

SEQ ID NO: 2413436 - RNA, 21 nt, Bordetella pertussis
cacggcuggaaagaccugcgc

SEQ ID NO: 2413437 - RNA, 21 nt, Bordetella pertussis
cacggcuggguucaggccugu

SEQ ID NO: 2413438 - RNA, 19 nt, Bordetella pertussis
cacggcuucguucaagcgu

SEQ ID NO: 2413439 - RNA, 22 nt, Bordetella pertussis
cacgggauguccgcgucggccg

SEQ ID NO: 2413440 - RNA, 20 nt, Bordetella pertussis
cacgggcacgauggccgcgc

SEQ ID NO: 2413441 - RNA, 15 nt, Bordetella pertussis
cacgggcccgcgcag

SEQ ID NO: 2413442 - RNA, 23 nt, Bordetella pertussis
cacgggcgaggcggggcuggcgc

SEQ ID NO: 2413443 - RNA, 21 nt, Bordetella pertussis
cacgggcgauguugaagccgu

SEQ ID NO: 2413444 - RNA, 13 nt, Bordetella pertussis
cacgggcgccagc

SEQ ID NO: 2413445 - RNA, 14 nt, Bordetella pertussis
cacgggcgccagca

SEQ ID NO: 2413446 - RNA, 13 nt, Bordetella pertussis
cacgggcgccugg

SEQ ID NO: 2413447 - RNA, 22 nt, Bordetella pertussis
cacgggcuguucgcgcagcagg

SEQ ID NO: 2413448 - RNA, 13 nt, Bordetella pertussis
cacggggacaggc

SEQ ID NO: 2413449 - RNA, 20 nt, Bordetella pertussis
cacggggacaggcaccucgu

SEQ ID NO: 2413450 - RNA, 17 nt, Bordetella pertussis
cacggggacaggcacgc

SEQ ID NO: 2413451 - RNA, 14 nt, Bordetella pertussis
cacggggacuggca

SEQ ID NO: 2413452 - RNA, 18 nt, Bordetella pertussis
cacggggacuggcaccgg

SEQ ID NO: 2413453 - RNA, 21 nt, Bordetella pertussis
cacggggacuggcacgcgcug

SEQ ID NO: 2413454 - RNA, 17 nt, Bordetella pertussis
cacggggagcgacccgu

SEQ ID NO: 2413455 - RNA, 19 nt, Bordetella pertussis
cacggggagcgacccgugg

SEQ ID NO: 2413456 - RNA, 16 nt, Bordetella pertussis
cacggggcaaccggcc

SEQ ID NO: 2413457 - RNA, 18 nt, Bordetella pertussis
cacggggcaaccggccuu

SEQ ID NO: 2413458 - RNA, 19 nt, Bordetella pertussis
cacggggcugucgcgcgca

SEQ ID NO: 2413459 - RNA, 15 nt, Bordetella pertussis
cacgguacgccgaac

SEQ ID NO: 2413460 - RNA, 16 nt, Bordetella pertussis
cacggucaaccacgcc

SEQ ID NO: 2413461 - RNA, 15 nt, Bordetella pertussis
cacggucgcgagcug

SEQ ID NO: 2413462 - RNA, 19 nt, Bordetella pertussis
cacggucgcgagcugcgcg

SEQ ID NO: 2413463 - RNA, 21 nt, Bordetella pertussis
cacggucgcgagcugcgcgac

SEQ ID NO: 2413464 - RNA, 14 nt, Bordetella pertussis
cacggucggcacgu

SEQ ID NO: 2413465 - RNA, 21 nt, Bordetella pertussis
cacggucggcacgucgggcag

SEQ ID NO: 2413466 - RNA, 15 nt, Bordetella pertussis
cacggucggcgcgua

SEQ ID NO: 2413467 - RNA, 19 nt, Bordetella pertussis
cacggucugcacgccgggc

SEQ ID NO: 2413468 - RNA, 20 nt, Bordetella pertussis
cacggucuggcccacgcgca

SEQ ID NO: 2413469 - RNA, 19 nt, Bordetella pertussis
cacggucuggcgcgacaga

SEQ ID NO: 2413470 - RNA, 16 nt, Bordetella pertussis
cacggugccgccgauc

SEQ ID NO: 2413471 - RNA, 20 nt, Bordetella pertussis
cacggugccgccgaucugcu

SEQ ID NO: 2413472 - RNA, 16 nt, Bordetella pertussis
cacggugccgcgcgcu

SEQ ID NO: 2413473 - RNA, 16 nt, Bordetella pertussis
cacgguggacaggcuc

SEQ ID NO: 2413474 - RNA, 17 nt, Bordetella pertussis
cacgguggcgaaggccg

SEQ ID NO: 2413475 - RNA, 21 nt, Bordetella pertussis
cacgguggcgaaggccgccgc

SEQ ID NO: 2413476 - RNA, 13 nt, Bordetella pertussis
cacgguggcgccg

SEQ ID NO: 2413477 - RNA, 16 nt, Bordetella pertussis
cacgguggcgccgucg

SEQ ID NO: 2413478 - RNA, 18 nt, Bordetella pertussis
cacgguggcggugcucga

SEQ ID NO: 2413479 - RNA, 23 nt, Bordetella pertussis
cacgguggcguaguagcccaggc

SEQ ID NO: 2413480 - RNA, 14 nt, Bordetella pertussis
cacggugggcagca

SEQ ID NO: 2413481 - RNA, 16 nt, Bordetella pertussis
cacggugggcagcagc

SEQ ID NO: 2413482 - RNA, 19 nt, Bordetella pertussis
cacggugggcgacgcggcg

SEQ ID NO: 2413483 - RNA, 14 nt, Bordetella pertussis
cacggugucgaugg

SEQ ID NO: 2413484 - RNA, 23 nt, Bordetella pertussis
cacggugucgaugggcccgggca

SEQ ID NO: 2413485 - RNA, 17 nt, Bordetella pertussis
cacgguguugaccacca

SEQ ID NO: 2413486 - RNA, 18 nt, Bordetella pertussis
cacgguguugaccaccac

SEQ ID NO: 2413487 - RNA, 14 nt, Bordetella pertussis
cacgguuuccaggu

SEQ ID NO: 2413488 - RNA, 18 nt, Bordetella pertussis
cacgguuucgccgugcug

SEQ ID NO: 2413489 - RNA, 19 nt, Bordetella pertussis
cacgguuucgccgugcugg

SEQ ID NO: 2413490 - RNA, 17 nt, Bordetella pertussis
cacguacaaccgcgccg

SEQ ID NO: 2413491 - RNA, 16 nt, Bordetella pertussis
cacguagccggccagg

SEQ ID NO: 2413492 - RNA, 14 nt, Bordetella pertussis
cacguagcgcagca

SEQ ID NO: 2413493 - RNA, 19 nt, Bordetella pertussis
cacguaggcaaagcgcggc

SEQ ID NO: 2413494 - RNA, 20 nt, Bordetella pertussis
cacguaggccauugaaagcg

SEQ ID NO: 2413495 - RNA, 18 nt, Bordetella pertussis
cacgucauaggcuucgcc

SEQ ID NO: 2413496 - RNA, 20 nt, Bordetella pertussis
cagaacggaaacgcccagcc

SEQ ID NO: 2413497 - RNA, 21 nt, Bordetella pertussis
cagaacggaaacgcccagccc

SEQ ID NO: 2413498 - RNA, 22 nt, Bordetella pertussis
cagaacggaaacgcccagcccu

SEQ ID NO: 2413499 - RNA, 15 nt, Bordetella pertussis
cagaacggcgcggga

SEQ ID NO: 2413500 - RNA, 23 nt, Bordetella pertussis
cagaagauauugggggucagcgc

SEQ ID NO: 2413501 - RNA, 22 nt, Bordetella pertussis
cagaagcgccauggcagggucc

SEQ ID NO: 2413502 - RNA, 21 nt, Bordetella pertussis
cagaagcugaccaccgucuug

SEQ ID NO: 2413503 - RNA, 20 nt, Bordetella pertussis
cagaaggucugggccagcag

SEQ ID NO: 2413504 - RNA, 16 nt, Bordetella pertussis
cagaaguggucgcgca

SEQ ID NO: 2413505 - RNA, 18 nt, Bordetella pertussis
cagaaguggucgcgcagg

SEQ ID NO: 2413506 - RNA, 14 nt, Bordetella pertussis
cagaaugcggcgga

SEQ ID NO: 2413507 - RNA, 19 nt, Bordetella pertussis
cagaauguauuggcccagu

SEQ ID NO: 2413508 - RNA, 14 nt, Bordetella pertussis
cagacaggccggca

SEQ ID NO: 2413509 - RNA, 15 nt, Bordetella pertussis
cagacaggccggcaa

SEQ ID NO: 2413510 - RNA, 20 nt, Bordetella pertussis
cagacauugucaagcagcgc

SEQ ID NO: 2413511 - RNA, 22 nt, Bordetella pertussis
cagacauugucaagcagcgccg

SEQ ID NO: 2413512 - RNA, 20 nt, Bordetella pertussis
cagaccacgacggucugggc

SEQ ID NO: 2413513 - RNA, 15 nt, Bordetella pertussis
cagaccaucuugucc

SEQ ID NO: 2413514 - RNA, 16 nt, Bordetella pertussis
cagacccgcgcccagc

SEQ ID NO: 2413515 - RNA, 13 nt, Bordetella pertussis
cagacccgggccg

SEQ ID NO: 2413516 - RNA, 14 nt, Bordetella pertussis
cagacccgggccgc

SEQ ID NO: 2413517 - RNA, 14 nt, Bordetella pertussis
cagaccgagcgcgc

SEQ ID NO: 2413518 - RNA, 16 nt, Bordetella pertussis
cagaccgagcgcgccc

SEQ ID NO: 2413519 - RNA, 19 nt, Bordetella pertussis
cagaccgagcgcgcccgcu

SEQ ID NO: 2413520 - RNA, 21 nt, Bordetella pertussis
cagaccgagcgcgcccgcuug

SEQ ID NO: 2413521 - RNA, 18 nt, Bordetella pertussis
cagaccuaccaggccgac

SEQ ID NO: 2413522 - RNA, 16 nt, Bordetella pertussis
cagaccugcgcgccgg

SEQ ID NO: 2413523 - RNA, 18 nt, Bordetella pertussis
cagaccuugcgcgacggc

SEQ ID NO: 2413524 - RNA, 20 nt, Bordetella pertussis
cagaccuugcgcgacggcga

SEQ ID NO: 2413525 - RNA, 14 nt, Bordetella pertussis
cagacgacgcagcg

SEQ ID NO: 2413526 - RNA, 19 nt, Bordetella pertussis
cagacgaucauccaggccg

SEQ ID NO: 2413527 - RNA, 22 nt, Bordetella pertussis
cagacgaucauccaggccguga

SEQ ID NO: 2413528 - RNA, 15 nt, Bordetella pertussis
cagacgcagaccacg

SEQ ID NO: 2413529 - RNA, 21 nt, Bordetella pertussis
cagacgccaucuugcaggcgc

SEQ ID NO: 2413530 - RNA, 21 nt, Bordetella pertussis
cagacgcgagaccaugacguc

SEQ ID NO: 2413531 - RNA, 24 nt, Bordetella pertussis
cagacgcgcucaggcggugacgcc

SEQ ID NO: 2413532 - RNA, 16 nt, Bordetella pertussis
cagacggccagcgcgc

SEQ ID NO: 2413533 - RNA, 17 nt, Bordetella pertussis
cagacggccagcgcgcg

SEQ ID NO: 2413534 - RNA, 14 nt, Bordetella pertussis
cagacggcggcugg

SEQ ID NO: 2413535 - RNA, 15 nt, Bordetella pertussis
cagacggcggcugga

SEQ ID NO: 2413536 - RNA, 15 nt, Bordetella pertussis
cagacgggcuggaag

SEQ ID NO: 2413537 - RNA, 16 nt, Bordetella pertussis
cagacgggcuggaaga

SEQ ID NO: 2413538 - RNA, 18 nt, Bordetella pertussis
cagacggucgacaccgug

SEQ ID NO: 2413539 - RNA, 16 nt, Bordetella pertussis
cagacuccaggagcuc

SEQ ID NO: 2413540 - RNA, 22 nt, Bordetella pertussis
cagacuccaggagcucgucccc

SEQ ID NO: 2413541 - RNA, 18 nt, Bordetella pertussis
cagacugcugccggauug

SEQ ID NO: 2413542 - RNA, 18 nt, Bordetella pertussis
cagacuguucagaaaccu

SEQ ID NO: 2413543 - RNA, 19 nt, Bordetella pertussis
cagagcaccacggcgcgcg

SEQ ID NO: 2413544 - RNA, 22 nt, Bordetella pertussis
cagagcccuucgacgcggcggc

SEQ ID NO: 2413545 - RNA, 22 nt, Bordetella pertussis
cagagcgggauggucgcggccg

SEQ ID NO: 2413546 - RNA, 12 nt, Bordetella pertussis
cagagcuggggc

SEQ ID NO: 2413547 - RNA, 18 nt, Bordetella pertussis
cagagcuggggcgucccg

SEQ ID NO: 2413548 - RNA, 23 nt, Bordetella pertussis
cagagcuugccguacgagugcag

SEQ ID NO: 2413549 - RNA, 16 nt, Bordetella pertussis
cagaggaacgccgcgc

SEQ ID NO: 2413550 - RNA, 24 nt, Bordetella pertussis
cagagggaaaacagcgcgggcgca

SEQ ID NO: 2413551 - RNA, 14 nt, Bordetella pertussis
cagagggcgacggc

SEQ ID NO: 2413552 - RNA, 17 nt, Bordetella pertussis
cagagggcgacggcggc

SEQ ID NO: 2413553 - RNA, 17 nt, Bordetella pertussis
cagagucugccuggcga

SEQ ID NO: 2413554 - RNA, 13 nt, Bordetella pertussis
cagauaaaggccg

SEQ ID NO: 2413555 - RNA, 23 nt, Bordetella pertussis
cagauaaaggccgcaacccaccc

SEQ ID NO: 2413556 - RNA, 21 nt, Bordetella pertussis
cagauaccgccuuggccguca

SEQ ID NO: 2413557 - RNA, 19 nt, Bordetella pertussis
cagauaccguccuugagcg

SEQ ID NO: 2413558 - RNA, 16 nt, Bordetella pertussis
cagauagcccaggcgg

SEQ ID NO: 2413559 - RNA, 16 nt, Bordetella pertussis
cagaucaucggcgcca

SEQ ID NO: 2413560 - RNA, 14 nt, Bordetella pertussis
cagauccacgcccg

SEQ ID NO: 2413561 - RNA, 20 nt, Bordetella pertussis
cagauccacgcccgcgccga

SEQ ID NO: 2413562 - RNA, 16 nt, Bordetella pertussis
cagauccagcgcggcc

SEQ ID NO: 2413563 - RNA, 14 nt, Bordetella pertussis
cagaucccaggcgc

SEQ ID NO: 2413564 - RNA, 15 nt, Bordetella pertussis
cagaucccaggcgcu

SEQ ID NO: 2413565 - RNA, 16 nt, Bordetella pertussis
cagauccgguaugccu

SEQ ID NO: 2413566 - RNA, 17 nt, Bordetella pertussis
cagauccgguaugccug

SEQ ID NO: 2413567 - RNA, 21 nt, Bordetella pertussis
cagauccgguaugccugccag

SEQ ID NO: 2413568 - RNA, 13 nt, Bordetella pertussis
cagaucgaacacg

SEQ ID NO: 2413569 - RNA, 19 nt, Bordetella pertussis
cagaucgccaacgucggca

SEQ ID NO: 2413570 - RNA, 13 nt, Bordetella pertussis
cagaucgccgccg

SEQ ID NO: 2413571 - RNA, 14 nt, Bordetella pertussis
cagaucgccgccgc

SEQ ID NO: 2413572 - RNA, 18 nt, Bordetella pertussis
cagaucgccgccgcccgc

SEQ ID NO: 2413573 - RNA, 15 nt, Bordetella pertussis
cagaucgccuggggg

SEQ ID NO: 2413574 - RNA, 14 nt, Bordetella pertussis
cagaucgcggcggg

SEQ ID NO: 2413575 - RNA, 16 nt, Bordetella pertussis
cagaucggcgcuggcc

SEQ ID NO: 2413576 - RNA, 18 nt, Bordetella pertussis
cagaucggcggccugggc

SEQ ID NO: 2413577 - RNA, 15 nt, Bordetella pertussis
cagaucugcacgcug

SEQ ID NO: 2413578 - RNA, 17 nt, Bordetella pertussis
cagaugagacacggcag

SEQ ID NO: 2413579 - RNA, 14 nt, Bordetella pertussis
cagaugcaccaguu

SEQ ID NO: 2413580 - RNA, 15 nt, Bordetella pertussis
cagaugcaccggcca

SEQ ID NO: 2413581 - RNA, 20 nt, Bordetella pertussis
cagaugcaccggccagucgc

SEQ ID NO: 2413582 - RNA, 17 nt, Bordetella pertussis
cagaugcgacuggcggc

SEQ ID NO: 2413583 - RNA, 13 nt, Bordetella pertussis
cagaugcgcagca

SEQ ID NO: 2413584 - RNA, 14 nt, Bordetella pertussis
cagaugcgcagcag

SEQ ID NO: 2413585 - RNA, 16 nt, Bordetella pertussis
cagaugcgcagcaggc

SEQ ID NO: 2413586 - RNA, 19 nt, Bordetella pertussis
cagaugcgcagcaggcgcg

SEQ ID NO: 2413587 - RNA, 20 nt, Bordetella pertussis
cagaugcgcagcaggcgcgu

SEQ ID NO: 2413588 - RNA, 13 nt, Bordetella pertussis
cagaugcgcgcca

SEQ ID NO: 2413589 - RNA, 16 nt, Bordetella pertussis
cagaugcgcgccaggc

SEQ ID NO: 2413590 - RNA, 18 nt, Bordetella pertussis
cagaugcgcgccaggcgc

SEQ ID NO: 2413591 - RNA, 21 nt, Bordetella pertussis
cagaugcgcgccaggcgcgca

SEQ ID NO: 2413592 - RNA, 15 nt, Bordetella pertussis
cagauggccagcagc

SEQ ID NO: 2413593 - RNA, 17 nt, Bordetella pertussis
cagauggccagcagcgc

SEQ ID NO: 2413594 - RNA, 18 nt, Bordetella pertussis
cagauggccagcagcgcc

SEQ ID NO: 2413595 - RNA, 21 nt, Bordetella pertussis
cagauggccagcagcgccgcc

SEQ ID NO: 2413596 - RNA, 15 nt, Bordetella pertussis
cagauggcccuugcc

SEQ ID NO: 2413597 - RNA, 20 nt, Bordetella pertussis
cagauggcccuugcccagcg

SEQ ID NO: 2413598 - RNA, 15 nt, Bordetella pertussis
cagaugggcggcgac

SEQ ID NO: 2413599 - RNA, 16 nt, Bordetella pertussis
cagauguccgugcugg

SEQ ID NO: 2413600 - RNA, 16 nt, Bordetella pertussis
cagauucaugggcggc

SEQ ID NO: 2413601 - RNA, 18 nt, Bordetella pertussis
cagauugaugcccaugcg

SEQ ID NO: 2413602 - RNA, 15 nt, Bordetella pertussis
cagauugccgcgcgg

SEQ ID NO: 2413603 - RNA, 17 nt, Bordetella pertussis
cagauugccgcgcggcg

SEQ ID NO: 2413604 - RNA, 21 nt, Bordetella pertussis
cagauugccuuccuugaccac

SEQ ID NO: 2413605 - RNA, 23 nt, Bordetella pertussis
cagauugccuuccuugaccaccu

SEQ ID NO: 2413606 - RNA, 16 nt, Bordetella pertussis
cagauuggccaccagg

SEQ ID NO: 2413607 - RNA, 23 nt, Bordetella pertussis
cagauuuccggaccggugcccuc

SEQ ID NO: 2413608 - RNA, 15 nt, Bordetella pertussis
cagcaaaugggccgc

SEQ ID NO: 2413609 - RNA, 17 nt, Bordetella pertussis
cagcaccucggcgccca

SEQ ID NO: 2413610 - RNA, 18 nt, Bordetella pertussis
cagcaccucggcgcccag

SEQ ID NO: 2413611 - RNA, 21 nt, Bordetella pertussis
cagcaccucggcgcccagcug

SEQ ID NO: 2413612 - RNA, 22 nt, Bordetella pertussis
cagcaccucggcgcccagcugc

SEQ ID NO: 2413613 - RNA, 14 nt, Bordetella pertussis
cagcaccucggggc

SEQ ID NO: 2413614 - RNA, 16 nt, Bordetella pertussis
cagcaccucggggcgc

SEQ ID NO: 2413615 - RNA, 19 nt, Bordetella pertussis
cagcaccucggggcgcggc

SEQ ID NO: 2413616 - RNA, 21 nt, Bordetella pertussis
cagcaccucggggcgcggccg

SEQ ID NO: 2413617 - RNA, 14 nt, Bordetella pertussis
cagcaccugcaggc

SEQ ID NO: 2413618 - RNA, 16 nt, Bordetella pertussis
cagcaccugcaggccg

SEQ ID NO: 2413619 - RNA, 21 nt, Bordetella pertussis
cagcaccugcaggccgccggc

SEQ ID NO: 2413620 - RNA, 13 nt, Bordetella pertussis
cagcaccugcuug

SEQ ID NO: 2413621 - RNA, 16 nt, Bordetella pertussis
cagcaccugguggcgc

SEQ ID NO: 2413622 - RNA, 20 nt, Bordetella pertussis
cagcaccuucugccgccagg

SEQ ID NO: 2413623 - RNA, 21 nt, Bordetella pertussis
cagcaccuucugccgccaggc

SEQ ID NO: 2413624 - RNA, 18 nt, Bordetella pertussis
cagcacgaucgcggcgcu

SEQ ID NO: 2413625 - RNA, 18 nt, Bordetella pertussis
cagcacgaucuggcgcgc

SEQ ID NO: 2413626 - RNA, 22 nt, Bordetella pertussis
cagcacgaucuggcgcgcgacc

SEQ ID NO: 2413627 - RNA, 15 nt, Bordetella pertussis
cagcacgaugagcau

SEQ ID NO: 2413628 - RNA, 16 nt, Bordetella pertussis
cagcacgauggcgccc

SEQ ID NO: 2413629 - RNA, 23 nt, Bordetella pertussis
cagcacgauggcgcccacggccu

SEQ ID NO: 2413630 - RNA, 17 nt, Bordetella pertussis
cagcacgauggggccau

SEQ ID NO: 2413631 - RNA, 13 nt, Bordetella pertussis
cagcacgauggug

SEQ ID NO: 2413632 - RNA, 19 nt, Bordetella pertussis
cagcacgaugguguucagg

SEQ ID NO: 2413633 - RNA, 17 nt, Bordetella pertussis
cagcacgcaccaggcgc

SEQ ID NO: 2413634 - RNA, 18 nt, Bordetella pertussis
cagcacgcaccaggcgca

SEQ ID NO: 2413635 - RNA, 22 nt, Bordetella pertussis
cagcacgcaccaggcgcacggc

SEQ ID NO: 2413636 - RNA, 14 nt, Bordetella pertussis
cagcacgcagaugu

SEQ ID NO: 2413637 - RNA, 17 nt, Bordetella pertussis
cagcacgcccaguaugg

SEQ ID NO: 2413638 - RNA, 14 nt, Bordetella pertussis
cagcacgcccaugg

SEQ ID NO: 2413639 - RNA, 12 nt, Bordetella pertussis
cagcacgcccgc

SEQ ID NO: 2413640 - RNA, 20 nt, Bordetella pertussis
cagcacgcccgccagcagcu

SEQ ID NO: 2413641 - RNA, 13 nt, Bordetella pertussis
cagcacgcccgcg

SEQ ID NO: 2413642 - RNA, 17 nt, Bordetella pertussis
cagcacgcccgcgcgcg

SEQ ID NO: 2413643 - RNA, 14 nt, Bordetella pertussis
cagcacgcccuggc

SEQ ID NO: 2413644 - RNA, 15 nt, Bordetella pertussis
cagcacgccgcgcca

SEQ ID NO: 2413645 - RNA, 18 nt, Bordetella pertussis
cagcacgccgcgccaggc

SEQ ID NO: 2413646 - RNA, 14 nt, Bordetella pertussis
cagcacgccuucga

SEQ ID NO: 2413647 - RNA, 13 nt, Bordetella pertussis
cagcacgcgcacc

SEQ ID NO: 2413648 - RNA, 17 nt, Bordetella pertussis
cagcacgcgcaccaggc

SEQ ID NO: 2413649 - RNA, 14 nt, Bordetella pertussis
cagcacgcgcagcu

SEQ ID NO: 2413650 - RNA, 19 nt, Bordetella pertussis
cagcacgcgcgccagcugg

SEQ ID NO: 2413651 - RNA, 22 nt, Bordetella pertussis
cagcacgcgcgccagcugggcg

SEQ ID NO: 2413652 - RNA, 12 nt, Bordetella pertussis
cagcacgcggcg

SEQ ID NO: 2413653 - RNA, 15 nt, Bordetella pertussis
cagcacgcggcgcag

SEQ ID NO: 2413654 - RNA, 18 nt, Bordetella pertussis
cagcacgcucagcaugcg

SEQ ID NO: 2413655 - RNA, 12 nt, Bordetella pertussis
cagcacgcugcg

SEQ ID NO: 2413656 - RNA, 16 nt, Bordetella pertussis
cagcacgcugcgcggc

SEQ ID NO: 2413657 - RNA, 17 nt, Bordetella pertussis
cagcacgcugcgcggcg

SEQ ID NO: 2413658 - RNA, 18 nt, Bordetella pertussis
cagcacgcugcgcggcgg

SEQ ID NO: 2413659 - RNA, 19 nt, Bordetella pertussis
cagcacggccacggccggc

SEQ ID NO: 2413660 - RNA, 19 nt, Bordetella pertussis
cagcacggccgcggccggc

SEQ ID NO: 2413661 - RNA, 14 nt, Bordetella pertussis
cagcacggcgcaca

SEQ ID NO: 2413662 - RNA, 15 nt, Bordetella pertussis
cagcacggcgcacac

SEQ ID NO: 2413663 - RNA, 19 nt, Bordetella pertussis
cagcacggcgcacaccauc

SEQ ID NO: 2413664 - RNA, 22 nt, Bordetella pertussis
cagcacggcgcacaccaucagc

SEQ ID NO: 2413665 - RNA, 19 nt, Bordetella pertussis
cagcacggcuugcgcgccu

SEQ ID NO: 2413666 - RNA, 16 nt, Bordetella pertussis
cagcacgggaugcucc

SEQ ID NO: 2413667 - RNA, 13 nt, Bordetella pertussis
cagcacgguggcg

SEQ ID NO: 2413668 - RNA, 20 nt, Bordetella pertussis
cagcacgguggcgcccggcg

SEQ ID NO: 2413669 - RNA, 21 nt, Bordetella pertussis
cagcacgguggcgcccggcgg

SEQ ID NO: 2413670 - RNA, 18 nt, Bordetella pertussis
cagcacguaaucgaagcc

SEQ ID NO: 2413671 - RNA, 17 nt, Bordetella pertussis
cagcacguagaaagugg

SEQ ID NO: 2413672 - RNA, 18 nt, Bordetella pertussis
cagcacgucauccugggc

SEQ ID NO: 2413673 - RNA, 14 nt, Bordetella pertussis
cagcacgucgcgca

SEQ ID NO: 2413674 - RNA, 19 nt, Bordetella pertussis
cagcacgucguagcgcugc

SEQ ID NO: 2413675 - RNA, 21 nt, Bordetella pertussis
cagcacgucguagcgcugcag

SEQ ID NO: 2413676 - RNA, 22 nt, Bordetella pertussis
cagcacgucguagcgcugcagc

SEQ ID NO: 2413677 - RNA, 23 nt, Bordetella pertussis
cagcacgucguagcgcugcagcc

SEQ ID NO: 2413678 - RNA, 22 nt, Bordetella pertussis
cagcacguggucgugcaggacc

SEQ ID NO: 2413679 - RNA, 16 nt, Bordetella pertussis
cagcacuaccugcgcu

SEQ ID NO: 2413680 - RNA, 15 nt, Bordetella pertussis
cagcacuugccggcc

SEQ ID NO: 2413681 - RNA, 19 nt, Bordetella pertussis
cagcacuugccggccgccc

SEQ ID NO: 2413682 - RNA, 18 nt, Bordetella pertussis
cagcagacccuggcgcgc

SEQ ID NO: 2413683 - RNA, 20 nt, Bordetella pertussis
cagcagacccuggcgcgcgu

SEQ ID NO: 2413684 - RNA, 19 nt, Bordetella pertussis
cagcagacgcuucaggccg

SEQ ID NO: 2413685 - RNA, 18 nt, Bordetella pertussis
cagcagauaccggcaugg

SEQ ID NO: 2413686 - RNA, 16 nt, Bordetella pertussis
cagcagaucgcggcgg

SEQ ID NO: 2413687 - RNA, 18 nt, Bordetella pertussis
cagcagaucggcggccug

SEQ ID NO: 2413688 - RNA, 23 nt, Bordetella pertussis
cagcagauggcccuugcccagcg

SEQ ID NO: 2413689 - RNA, 14 nt, Bordetella pertussis
cagcagauggcuuu

SEQ ID NO: 2413690 - RNA, 19 nt, Bordetella pertussis
cagcagauucaugggcggc

SEQ ID NO: 2413691 - RNA, 19 nt, Bordetella pertussis
cagcagauugccgcgcggc

SEQ ID NO: 2413692 - RNA, 20 nt, Bordetella pertussis
cagcagauugccgcgcggcg

SEQ ID NO: 2413693 - RNA, 21 nt, Bordetella pertussis
cagcagauugccgcgcggcgc

SEQ ID NO: 2413694 - RNA, 21 nt, Bordetella pertussis
cagcagcaauacggguaugcg

SEQ ID NO: 2413695 - RNA, 19 nt, Bordetella pertussis
cagcagcaccgugccggcg

SEQ ID NO: 2413696 - RNA, 21 nt, Bordetella pertussis
cagcagcaccgugccggcgua

SEQ ID NO: 2413697 - RNA, 19 nt, Bordetella pertussis
cagcagcaccuucugccgc

SEQ ID NO: 2413698 - RNA, 21 nt, Bordetella pertussis
cagcagcacgaucgcggcgcu

SEQ ID NO: 2413699 - RNA, 17 nt, Bordetella pertussis
cagcagcacgcccagua

SEQ ID NO: 2413700 - RNA, 16 nt, Bordetella pertussis
cagcagcacgcccaug

SEQ ID NO: 2413701 - RNA, 13 nt, Bordetella pertussis
cagcagcacgccu

SEQ ID NO: 2413702 - RNA, 17 nt, Bordetella pertussis
cagcagcacgccuucga

SEQ ID NO: 2413703 - RNA, 14 nt, Bordetella pertussis
cagcagcacggcca

SEQ ID NO: 2413704 - RNA, 18 nt, Bordetella pertussis
cagcagcacggccacgau

SEQ ID NO: 2413705 - RNA, 19 nt, Bordetella pertussis
cagcagcacguucuugccc

SEQ ID NO: 2413706 - RNA, 13 nt, Bordetella pertussis
cagcagcagcacg

SEQ ID NO: 2413707 - RNA, 14 nt, Bordetella pertussis
cagcagcagcacgg

SEQ ID NO: 2413708 - RNA, 17 nt, Bordetella pertussis
cagcagcagcacggcca

SEQ ID NO: 2413709 - RNA, 12 nt, Bordetella pertussis
cagcagcagcga

SEQ ID NO: 2413710 - RNA, 15 nt, Bordetella pertussis
cagcagcagcgagcc

SEQ ID NO: 2413711 - RNA, 16 nt, Bordetella pertussis
cagcagcagcgagccc

SEQ ID NO: 2413712 - RNA, 12 nt, Bordetella pertussis
cagcagcagcgc

SEQ ID NO: 2413713 - RNA, 16 nt, Bordetella pertussis
cagcagcagcgcaucg

SEQ ID NO: 2413714 - RNA, 17 nt, Bordetella pertussis
cagcagcagcgcaucga

SEQ ID NO: 2413715 - RNA, 13 nt, Bordetella pertussis
cagcagcagcgcc

SEQ ID NO: 2413716 - RNA, 14 nt, Bordetella pertussis
cagcagcagcgccg

SEQ ID NO: 2413717 - RNA, 15 nt, Bordetella pertussis
cagcagcagcgccgc

SEQ ID NO: 2413718 - RNA, 17 nt, Bordetella pertussis
cagcagcagcgccgcgc

SEQ ID NO: 2413719 - RNA, 22 nt, Bordetella pertussis
cagcagcaggcccuccggcgcc

SEQ ID NO: 2413720 - RNA, 13 nt, Bordetella pertussis
cagcagcaggccg

SEQ ID NO: 2413721 - RNA, 22 nt, Bordetella pertussis
cagcagcaggccguaaccggcc

SEQ ID NO: 2413722 - RNA, 19 nt, Bordetella pertussis
cagcaggguggccacgccc

SEQ ID NO: 2413723 - RNA, 16 nt, Bordetella pertussis
cagcaggucacgggcg

SEQ ID NO: 2413724 - RNA, 13 nt, Bordetella pertussis
cagcaggucgcgc

SEQ ID NO: 2413725 - RNA, 17 nt, Bordetella pertussis
cagcaggucgcgcacgc

SEQ ID NO: 2413726 - RNA, 19 nt, Bordetella pertussis
cagcaggucgcgcacgcug

SEQ ID NO: 2413727 - RNA, 21 nt, Bordetella pertussis
cagcaggucgcgcacgcuggc

SEQ ID NO: 2413728 - RNA, 23 nt, Bordetella pertussis
cagcaggucggagucggcgccgc

SEQ ID NO: 2413729 - RNA, 17 nt, Bordetella pertussis
cagcaggucggcgcggc

SEQ ID NO: 2413730 - RNA, 18 nt, Bordetella pertussis
cagcaggucggcgcggcc

SEQ ID NO: 2413731 - RNA, 20 nt, Bordetella pertussis
cagcaggucggucgccugua

SEQ ID NO: 2413732 - RNA, 17 nt, Bordetella pertussis
cagcagguggcgcuguc

SEQ ID NO: 2413733 - RNA, 16 nt, Bordetella pertussis
cagcaguucggccggc

SEQ ID NO: 2413734 - RNA, 16 nt, Bordetella pertussis
cagcaguucggcgucg

SEQ ID NO: 2413735 - RNA, 22 nt, Bordetella pertussis
cagcaguucggcgucggugccg

SEQ ID NO: 2413736 - RNA, 15 nt, Bordetella pertussis
cagcaguucggucag

SEQ ID NO: 2413737 - RNA, 19 nt, Bordetella pertussis
cagcaguucggucagcgcg

SEQ ID NO: 2413738 - RNA, 21 nt, Bordetella pertussis
cagcaguucggucagcgcggc

SEQ ID NO: 2413739 - RNA, 20 nt, Bordetella pertussis
cagcaguugcgccaguucgg

SEQ ID NO: 2413740 - RNA, 19 nt, Bordetella pertussis
cagcauacccugcgcgccg

SEQ ID NO: 2413741 - RNA, 20 nt, Bordetella pertussis
cagcauauccgcgugcguuu

SEQ ID NO: 2413742 - RNA, 18 nt, Bordetella pertussis
cagcauaucgucgcugcg

SEQ ID NO: 2413743 - RNA, 22 nt, Bordetella pertussis
cagcauaucgucgcugcggccg

SEQ ID NO: 2413744 - RNA, 15 nt, Bordetella pertussis
cagcaucagcggcag

SEQ ID NO: 2413745 - RNA, 16 nt, Bordetella pertussis
cagcaucagcggcagc

SEQ ID NO: 2413746 - RNA, 20 nt, Bordetella pertussis
cagcaucagcggcagcacga

SEQ ID NO: 2413747 - RNA, 14 nt, Bordetella pertussis
cagcaucagcuugg

SEQ ID NO: 2413748 - RNA, 14 nt, Bordetella pertussis
cagcauccagccga

SEQ ID NO: 2413749 - RNA, 14 nt, Bordetella pertussis
cagcauccgcgcca

SEQ ID NO: 2413750 - RNA, 14 nt, Bordetella pertussis
cagcauccucacgu

SEQ ID NO: 2413751 - RNA, 20 nt, Bordetella pertussis
cagcaucgccgccagcuugg

SEQ ID NO: 2413752 - RNA, 14 nt, Bordetella pertussis
cagcaucgcgccuu

SEQ ID NO: 2413753 - RNA, 16 nt, Bordetella pertussis
cagcaucggcacccag

SEQ ID NO: 2413754 - RNA, 18 nt, Bordetella pertussis
cagcaucuugcgccgcug

SEQ ID NO: 2413755 - RNA, 19 nt, Bordetella pertussis
cagcaucuugcgccgcugc

SEQ ID NO: 2413756 - RNA, 20 nt, Bordetella pertussis
cagcaucuuggccgccacgc

SEQ ID NO: 2413757 - RNA, 22 nt, Bordetella pertussis
cagcaugaaaugcuggucgcgc

SEQ ID NO: 2413758 - RNA, 16 nt, Bordetella pertussis
cagcaugaacggcagc

SEQ ID NO: 2413759 - RNA, 17 nt, Bordetella pertussis
cagcaugaacggcagcg

SEQ ID NO: 2413760 - RNA, 18 nt, Bordetella pertussis
cagcaugaacggcagcgc

SEQ ID NO: 2413761 - RNA, 21 nt, Bordetella pertussis
cagcaugaacggcagcgcgcg

SEQ ID NO: 2413762 - RNA, 22 nt, Bordetella pertussis
cagcaugaagcgguggcggccg

SEQ ID NO: 2413763 - RNA, 18 nt, Bordetella pertussis
cagcaugaagcugcccag

SEQ ID NO: 2413764 - RNA, 20 nt, Bordetella pertussis
cagcaugaccgacaggcggc

SEQ ID NO: 2413765 - RNA, 19 nt, Bordetella pertussis
cagcaugaccucggccugc

SEQ ID NO: 2413766 - RNA, 22 nt, Bordetella pertussis
cagcaugacggggucggggcag

SEQ ID NO: 2413767 - RNA, 21 nt, Bordetella pertussis
cagcaugagcugaugcucgcc

SEQ ID NO: 2413768 - RNA, 17 nt, Bordetella pertussis
cagcaugaucaugccgc

SEQ ID NO: 2413769 - RNA, 18 nt, Bordetella pertussis
cagcaugaucaugccgcu

SEQ ID NO: 2413770 - RNA, 23 nt, Bordetella pertussis
cagcaugaucuugccgaccgcgu

SEQ ID NO: 2413771 - RNA, 14 nt, Bordetella pertussis
cagcaugcacgacu

SEQ ID NO: 2413772 - RNA, 13 nt, Bordetella pertussis
cagcaugccgcgg

SEQ ID NO: 2413773 - RNA, 18 nt, Bordetella pertussis
cagcaugccgcgguggcg

SEQ ID NO: 2413774 - RNA, 20 nt, Bordetella pertussis
cagcaugccuucgacggcgg

SEQ ID NO: 2413775 - RNA, 22 nt, Bordetella pertussis
cagcaugccuucgacggcggga

SEQ ID NO: 2413776 - RNA, 16 nt, Bordetella pertussis
cagcaugcgcgcgacu

SEQ ID NO: 2413777 - RNA, 16 nt, Bordetella pertussis
cagcaugcgcgcggcc

SEQ ID NO: 2413778 - RNA, 17 nt, Bordetella pertussis
cagcaugcgcgcggccu

SEQ ID NO: 2413779 - RNA, 21 nt, Bordetella pertussis
cagcaugcgcgucuccagcgc

SEQ ID NO: 2413780 - RNA, 22 nt, Bordetella pertussis
cagcaugcgcgucuccagcgcc

SEQ ID NO: 2413781 - RNA, 23 nt, Bordetella pertussis
cagcaugcgcuggucgcgcagca

SEQ ID NO: 2413782 - RNA, 17 nt, Bordetella pertussis
cagcaugcggcccgcgc

SEQ ID NO: 2413783 - RNA, 21 nt, Bordetella pertussis
cagcauggacgagcucgucgg

SEQ ID NO: 2413784 - RNA, 23 nt, Bordetella pertussis
cagcauggagcuggggccgcgcg

SEQ ID NO: 2413785 - RNA, 13 nt, Bordetella pertussis
cagcauggccacc

SEQ ID NO: 2413786 - RNA, 15 nt, Bordetella pertussis
cagcauggccaccag

SEQ ID NO: 2413787 - RNA, 17 nt, Bordetella pertussis
cagcauggccaccaggu

SEQ ID NO: 2413788 - RNA, 16 nt, Bordetella pertussis
cagcauggccguggcg

SEQ ID NO: 2413789 - RNA, 17 nt, Bordetella pertussis
cagcauggccguggcgu

SEQ ID NO: 2413790 - RNA, 13 nt, Bordetella pertussis
cagcauggcgcca

SEQ ID NO: 2413791 - RNA, 18 nt, Bordetella pertussis
cagcauggcgccagcugg

SEQ ID NO: 2413792 - RNA, 19 nt, Bordetella pertussis
cagcauggcgccaugcgac

SEQ ID NO: 2413793 - RNA, 19 nt, Bordetella pertussis
cagcauggcggccaggcgc

SEQ ID NO: 2413794 - RNA, 23 nt, Bordetella pertussis
cagcauggcggccaggcgcgccg

SEQ ID NO: 2413795 - RNA, 15 nt, Bordetella pertussis
cagcauggcggcgcc

SEQ ID NO: 2413796 - RNA, 16 nt, Bordetella pertussis
cagcauggcggcgccc

SEQ ID NO: 2413797 - RNA, 17 nt, Bordetella pertussis
cagcauggcggcgcccg

SEQ ID NO: 2413798 - RNA, 18 nt, Bordetella pertussis
cagcauggcggcgcccgc

SEQ ID NO: 2413799 - RNA, 19 nt, Bordetella pertussis
cagcauggcggcgcccgcu

SEQ ID NO: 2413800 - RNA, 20 nt, Bordetella pertussis
cagcauggcggcgcccgcug

SEQ ID NO: 2413801 - RNA, 22 nt, Bordetella pertussis
cagcauggcggcgcccgcugcg

SEQ ID NO: 2413802 - RNA, 17 nt, Bordetella pertussis
cagcauggucgccucga

SEQ ID NO: 2413803 - RNA, 17 nt, Bordetella pertussis
cagcauggucggcaugg

SEQ ID NO: 2413804 - RNA, 20 nt, Bordetella pertussis
cagcauggucggcauggcca

SEQ ID NO: 2413805 - RNA, 14 nt, Bordetella pertussis
cagcauguacagcg

SEQ ID NO: 2413806 - RNA, 18 nt, Bordetella pertussis
cagcauguauucaucacg

SEQ ID NO: 2413807 - RNA, 21 nt, Bordetella pertussis
cagcauguauucaucacgggc

SEQ ID NO: 2413808 - RNA, 15 nt, Bordetella pertussis
cagcaugugcgcggc

SEQ ID NO: 2413809 - RNA, 16 nt, Bordetella pertussis
cagcaugugcgcggcg

SEQ ID NO: 2413810 - RNA, 20 nt, Bordetella pertussis
cagcaugugcgcggcguuga

SEQ ID NO: 2413811 - RNA, 12 nt, Bordetella pertussis
cagcaugugcuc

SEQ ID NO: 2413812 - RNA, 20 nt, Bordetella pertussis
cagcauucuggugcagcggc

SEQ ID NO: 2413813 - RNA, 15 nt, Bordetella pertussis
cagcauuucggcgcc

SEQ ID NO: 2413814 - RNA, 22 nt, Bordetella pertussis
cagccacaccagguugucggcg

SEQ ID NO: 2413815 - RNA, 13 nt, Bordetella pertussis
cagccacacgcug

SEQ ID NO: 2413816 - RNA, 14 nt, Bordetella pertussis
cagccacacgcuga

SEQ ID NO: 2413817 - RNA, 17 nt, Bordetella pertussis
cagccacacgcugaagc

SEQ ID NO: 2413818 - RNA, 19 nt, Bordetella pertussis
cagccacacgcugaagcgc

SEQ ID NO: 2413819 - RNA, 20 nt, Bordetella pertussis
cagccacacgcugaagcgcc

SEQ ID NO: 2413820 - RNA, 21 nt, Bordetella pertussis
cagccacacgcugaagcgccg

SEQ ID NO: 2413821 - RNA, 19 nt, Bordetella pertussis
cagccacaggcccaugccg

SEQ ID NO: 2413822 - RNA, 22 nt, Bordetella pertussis
cagccaccacugcaaggcccgc

SEQ ID NO: 2413823 - RNA, 19 nt, Bordetella pertussis
cagccaccaugucccuggc

SEQ ID NO: 2413824 - RNA, 13 nt, Bordetella pertussis
cagccaccgguug

SEQ ID NO: 2413825 - RNA, 18 nt, Bordetella pertussis
cagccaccgguugcagcg

SEQ ID NO: 2413826 - RNA, 20 nt, Bordetella pertussis
cagccaccgguugcagcgcg

SEQ ID NO: 2413827 - RNA, 21 nt, Bordetella pertussis
cagccaccgguugcagcgcgc

SEQ ID NO: 2413828 - RNA, 14 nt, Bordetella pertussis
cagccacgccggcg

SEQ ID NO: 2413829 - RNA, 16 nt, Bordetella pertussis
cagccacgccggcgcg

SEQ ID NO: 2413830 - RNA, 19 nt, Bordetella pertussis
cagccacgccggcgcgccg

SEQ ID NO: 2413831 - RNA, 19 nt, Bordetella pertussis
cagccacgccuggccgcgc

SEQ ID NO: 2413832 - RNA, 22 nt, Bordetella pertussis
cagccacgccuggccgcgcuca

SEQ ID NO: 2413833 - RNA, 14 nt, Bordetella pertussis
cagccacgcgcgcu

SEQ ID NO: 2413834 - RNA, 19 nt, Bordetella pertussis
cagcccggaucgcacccgu

SEQ ID NO: 2413835 - RNA, 23 nt, Bordetella pertussis
cagcccggccagagccuggaagu

SEQ ID NO: 2413836 - RNA, 16 nt, Bordetella pertussis
cagcccggcccccagc

SEQ ID NO: 2413837 - RNA, 18 nt, Bordetella pertussis
cagcccggcccccagccc

SEQ ID NO: 2413838 - RNA, 16 nt, Bordetella pertussis
cagcccggccgccagc

SEQ ID NO: 2413839 - RNA, 17 nt, Bordetella pertussis
cagcccggccgccagca

SEQ ID NO: 2413840 - RNA, 19 nt, Bordetella pertussis
cagcccggccgccagcaug

SEQ ID NO: 2413841 - RNA, 17 nt, Bordetella pertussis
cagcccggcgacguugc

SEQ ID NO: 2413842 - RNA, 16 nt, Bordetella pertussis
cagcccggcgcgccac

SEQ ID NO: 2413843 - RNA, 15 nt, Bordetella pertussis
cagcccggcggccau

SEQ ID NO: 2413844 - RNA, 21 nt, Bordetella pertussis
cagcccggcggugaccugggg

SEQ ID NO: 2413845 - RNA, 13 nt, Bordetella pertussis
cagcccggcgugc

SEQ ID NO: 2413846 - RNA, 16 nt, Bordetella pertussis
cagcccggcgugccca

SEQ ID NO: 2413847 - RNA, 19 nt, Bordetella pertussis
cagcccggcgugcccaggg

SEQ ID NO: 2413848 - RNA, 21 nt, Bordetella pertussis
cagcccggcgugcccagggcc

SEQ ID NO: 2413849 - RNA, 22 nt, Bordetella pertussis
cagcccgggcaugcgaaagccg

SEQ ID NO: 2413850 - RNA, 15 nt, Bordetella pertussis
cagcccggugaucga

SEQ ID NO: 2413851 - RNA, 16 nt, Bordetella pertussis
cagcccguccuggugc

SEQ ID NO: 2413852 - RNA, 12 nt, Bordetella pertussis
cagcccuggccc

SEQ ID NO: 2413853 - RNA, 16 nt, Bordetella pertussis
cagcccuggcccagcg

SEQ ID NO: 2413854 - RNA, 18 nt, Bordetella pertussis
cagcccuggcccagcgca

SEQ ID NO: 2413855 - RNA, 21 nt, Bordetella pertussis
cagcccuggcccagcgcauag

SEQ ID NO: 2413856 - RNA, 16 nt, Bordetella pertussis
cagcccuucgcccgca

SEQ ID NO: 2413857 - RNA, 21 nt, Bordetella pertussis
cagcccuucggagccaguccc

SEQ ID NO: 2413858 - RNA, 17 nt, Bordetella pertussis
cagccgacaggcgcgca

SEQ ID NO: 2413859 - RNA, 18 nt, Bordetella pertussis
cagccgacaggcgcgcag

SEQ ID NO: 2413860 - RNA, 19 nt, Bordetella pertussis
cagccgacaggcgcgcagg

SEQ ID NO: 2413861 - RNA, 13 nt, Bordetella pertussis
cagccgagccugg

SEQ ID NO: 2413862 - RNA, 17 nt, Bordetella pertussis
cagccgagccuggcgua

SEQ ID NO: 2413863 - RNA, 19 nt, Bordetella pertussis
cagccgaucagccggccau

SEQ ID NO: 2413864 - RNA, 23 nt, Bordetella pertussis
cagccgaucagccggccauggcc

SEQ ID NO: 2413865 - RNA, 23 nt, Bordetella pertussis
cagccgaugauggugaacgccac

SEQ ID NO: 2413866 - RNA, 18 nt, Bordetella pertussis
cagccgcaagcuggcggc

SEQ ID NO: 2413867 - RNA, 16 nt, Bordetella pertussis
cagccgcaccagcgca

SEQ ID NO: 2413868 - RNA, 14 nt, Bordetella pertussis
cagccgcagcaggc

SEQ ID NO: 2413869 - RNA, 17 nt, Bordetella pertussis
cagccgcagcaggcgcu

SEQ ID NO: 2413870 - RNA, 23 nt, Bordetella pertussis
cagccgcagcaggcgcucggcca

SEQ ID NO: 2413871 - RNA, 19 nt, Bordetella pertussis
cagccgcagccgucgcgcu

SEQ ID NO: 2413872 - RNA, 21 nt, Bordetella pertussis
cagccgcaguauuccugcugg

SEQ ID NO: 2413873 - RNA, 13 nt, Bordetella pertussis
cagccgcaugccg

SEQ ID NO: 2413874 - RNA, 14 nt, Bordetella pertussis
cagccgcaugccgg

SEQ ID NO: 2413875 - RNA, 17 nt, Bordetella pertussis
cagccgcaugccggcga

SEQ ID NO: 2413876 - RNA, 17 nt, Bordetella pertussis
cagccgccagcgccugg

SEQ ID NO: 2413877 - RNA, 18 nt, Bordetella pertussis
cagccgccagcgccugga

SEQ ID NO: 2413878 - RNA, 19 nt, Bordetella pertussis
cagccgccagcgccuggac

SEQ ID NO: 2413879 - RNA, 18 nt, Bordetella pertussis
cagccgccauaccgaucu

SEQ ID NO: 2413880 - RNA, 18 nt, Bordetella pertussis
cagccgccauaggcgcgc

SEQ ID NO: 2413881 - RNA, 19 nt, Bordetella pertussis
cagccgccauaggcgcgca

SEQ ID NO: 2413882 - RNA, 22 nt, Bordetella pertussis
cagccgccauaggcgcgcacca

SEQ ID NO: 2413883 - RNA, 15 nt, Bordetella pertussis
cagccgccccagcag

SEQ ID NO: 2413884 - RNA, 18 nt, Bordetella pertussis
cagccgccccagcagcag

SEQ ID NO: 2413885 - RNA, 19 nt, Bordetella pertussis
cagccgccccagcagcagc

SEQ ID NO: 2413886 - RNA, 21 nt, Bordetella pertussis
cagccgccccagcagcagcga

SEQ ID NO: 2413887 - RNA, 15 nt, Bordetella pertussis
cagccgcccgccggg

SEQ ID NO: 2413888 - RNA, 22 nt, Bordetella pertussis
cagccgcccgccgggccgucgu

SEQ ID NO: 2413889 - RNA, 13 nt, Bordetella pertussis
cagccgcccggca

SEQ ID NO: 2413890 - RNA, 13 nt, Bordetella pertussis
cagccgcccggcg

SEQ ID NO: 2413891 - RNA, 12 nt, Bordetella pertussis
cagccgccgcga

SEQ ID NO: 2413892 - RNA, 15 nt, Bordetella pertussis
cagccgccgcgcggc

SEQ ID NO: 2413893 - RNA, 16 nt, Bordetella pertussis
cagccgccugagcaca

SEQ ID NO: 2413894 - RNA, 12 nt, Bordetella pertussis
cagccgccuggc

SEQ ID NO: 2413895 - RNA, 17 nt, Bordetella pertussis
cagccgccuggcgcggc

SEQ ID NO: 2413896 - RNA, 18 nt, Bordetella pertussis
cagccgccuggcgcggcg

SEQ ID NO: 2413897 - RNA, 19 nt, Bordetella pertussis
cagccgccuggcgcggcgc

SEQ ID NO: 2413898 - RNA, 10 nt, Bordetella pertussis
cagccgcgcc

SEQ ID NO: 2413899 - RNA, 20 nt, Bordetella pertussis
cagccgcgccaagggcgugc

SEQ ID NO: 2413900 - RNA, 23 nt, Bordetella pertussis
cagccgcgccaagggcgugcgcu

SEQ ID NO: 2413901 - RNA, 14 nt, Bordetella pertussis
cagccgcgccaggg

SEQ ID NO: 2413902 - RNA, 14 nt, Bordetella pertussis
cagccgcgcgaaca

SEQ ID NO: 2413903 - RNA, 24 nt, Bordetella pertussis
cagccgcgcgccuuccugggcgcc

SEQ ID NO: 2413904 - RNA, 20 nt, Bordetella pertussis
cagccgcgcgcggccggcgc

SEQ ID NO: 2413905 - RNA, 22 nt, Bordetella pertussis
cagccgcgcgcggccggcgcgc

SEQ ID NO: 2413906 - RNA, 14 nt, Bordetella pertussis
cagccgcgcggccg

SEQ ID NO: 2413907 - RNA, 17 nt, Bordetella pertussis
cagccgcgcggccgggc

SEQ ID NO: 2413908 - RNA, 16 nt, Bordetella pertussis
cagccgcggcagaucu

SEQ ID NO: 2413909 - RNA, 14 nt, Bordetella pertussis
cagccgcuccagcc

SEQ ID NO: 2413910 - RNA, 17 nt, Bordetella pertussis
cagccgcuccagccacc

SEQ ID NO: 2413911 - RNA, 13 nt, Bordetella pertussis
cagccgcuccagg

SEQ ID NO: 2413912 - RNA, 14 nt, Bordetella pertussis
cagccgcucgcgcg

SEQ ID NO: 2413913 - RNA, 17 nt, Bordetella pertussis
cagccgcucgcgcgacc

SEQ ID NO: 2413914 - RNA, 18 nt, Bordetella pertussis
cagccgcucgcgcgacca

SEQ ID NO: 2413915 - RNA, 21 nt, Bordetella pertussis
cagccgcucgcgcgaccacug

SEQ ID NO: 2413916 - RNA, 22 nt, Bordetella pertussis
cagccgcucgcgcgaccacugg

SEQ ID NO: 2413917 - RNA, 16 nt, Bordetella pertussis
cagccgcucggccacg

SEQ ID NO: 2413918 - RNA, 20 nt, Bordetella pertussis
cagccgcucggccacgcgcu

SEQ ID NO: 2413919 - RNA, 23 nt, Bordetella pertussis
cagccgcucggccacgcgcugcu

SEQ ID NO: 2413920 - RNA, 19 nt, Bordetella pertussis
cagccgcugacugggcgga

SEQ ID NO: 2413921 - RNA, 14 nt, Bordetella pertussis
cagccgcugcagau

SEQ ID NO: 2413922 - RNA, 14 nt, Bordetella pertussis
cagccgcugcagcg

SEQ ID NO: 2413923 - RNA, 16 nt, Bordetella pertussis
cagccgcugcagcgac

SEQ ID NO: 2413924 - RNA, 21 nt, Bordetella pertussis
cagccgcuggcgaucaggccg

SEQ ID NO: 2413925 - RNA, 15 nt, Bordetella pertussis
cagccgcuggcgcgc

SEQ ID NO: 2413926 - RNA, 17 nt, Bordetella pertussis
cagccgcuggcgcgccg

SEQ ID NO: 2413927 - RNA, 16 nt, Bordetella pertussis
cagccgcuucacgcug

SEQ ID NO: 2413928 - RNA, 14 nt, Bordetella pertussis
cagccgcuugcccg

SEQ ID NO: 2413929 - RNA, 18 nt, Bordetella pertussis
cagccgcuuggccugcgc

SEQ ID NO: 2413930 - RNA, 19 nt, Bordetella pertussis
cagccgcuuggccugcgcc

SEQ ID NO: 2413931 - RNA, 14 nt, Bordetella pertussis
cagccggccauggc

SEQ ID NO: 2413932 - RNA, 21 nt, Bordetella pertussis
cagccggccauggcccuugcc

SEQ ID NO: 2413933 - RNA, 23 nt, Bordetella pertussis
cagccggccauggcccuugccgc

SEQ ID NO: 2413934 - RNA, 19 nt, Bordetella pertussis
cagccggccauggccgcca

SEQ ID NO: 2413935 - RNA, 13 nt, Bordetella pertussis
cagccggcccagc

SEQ ID NO: 2413936 - RNA, 18 nt, Bordetella pertussis
cagccggcccagcacgcc

SEQ ID NO: 2413937 - RNA, 16 nt, Bordetella pertussis
cagccggcccagcaug

SEQ ID NO: 2413938 - RNA, 13 nt, Bordetella pertussis
cagccggcccccu

SEQ ID NO: 2413939 - RNA, 13 nt, Bordetella pertussis
cagccggcccgac

SEQ ID NO: 2413940 - RNA, 22 nt, Bordetella pertussis
cagccggccgaugacaucgccg

SEQ ID NO: 2413941 - RNA, 17 nt, Bordetella pertussis
cagccggccgauggcau

SEQ ID NO: 2413942 - RNA, 13 nt, Bordetella pertussis
cagccggccgccg

SEQ ID NO: 2413943 - RNA, 14 nt, Bordetella pertussis
cagccggccgccga

SEQ ID NO: 2413944 - RNA, 16 nt, Bordetella pertussis
cagccggccgccgaac

SEQ ID NO: 2413945 - RNA, 14 nt, Bordetella pertussis
cagccgggcggcca

SEQ ID NO: 2413946 - RNA, 16 nt, Bordetella pertussis
cagccgggcugccggc

SEQ ID NO: 2413947 - RNA, 22 nt, Bordetella pertussis
acagggucaaggcgcggccguc

SEQ ID NO: 2413948 - RNA, 15 nt, Bordetella pertussis
acagggugccgcgcc

SEQ ID NO: 2413949 - RNA, 17 nt, Bordetella pertussis
acaggguggcgcccagg

SEQ ID NO: 2413950 - RNA, 19 nt, Bordetella pertussis
acagguaggcgccggucca

SEQ ID NO: 2413951 - RNA, 21 nt, Bordetella pertussis
acagguaggcgccgguccagc

SEQ ID NO: 2413952 - RNA, 18 nt, Bordetella pertussis
acaggucgccgaagggca

SEQ ID NO: 2413953 - RNA, 13 nt, Bordetella pertussis
acaggucggcgcc

SEQ ID NO: 2413954 - RNA, 22 nt, Bordetella pertussis
acaggucggcgcccacgccgaa

SEQ ID NO: 2413955 - RNA, 19 nt, Bordetella pertussis
acaggucguagaccgccgc

SEQ ID NO: 2413956 - RNA, 22 nt, Bordetella pertussis
acaggucguagaccgccgcgcc

SEQ ID NO: 2413957 - RNA, 19 nt, Bordetella pertussis
acaggucguuguggcaggc

SEQ ID NO: 2413958 - RNA, 21 nt, Bordetella pertussis
acaggugcgcggcgcgccguc

SEQ ID NO: 2413959 - RNA, 22 nt, Bordetella pertussis
acaggugcgcggcgcgccgucc

SEQ ID NO: 2413960 - RNA, 12 nt, Bordetella pertussis
acaggugcuggg

SEQ ID NO: 2413961 - RNA, 17 nt, Bordetella pertussis
acagugucuaucauggc

SEQ ID NO: 2413962 - RNA, 24 nt, Bordetella pertussis
acagugucuaucauggccuuggca

SEQ ID NO: 2413963 - RNA, 14 nt, Bordetella pertussis
acaguucggccagc

SEQ ID NO: 2413964 - RNA, 21 nt, Bordetella pertussis
acaguucggccagcggcaggc

SEQ ID NO: 2413965 - RNA, 14 nt, Bordetella pertussis
acauacaaggcgcg

SEQ ID NO: 2413966 - RNA, 18 nt, Bordetella pertussis
acauacgccgccgaggcg

SEQ ID NO: 2413967 - RNA, 13 nt, Bordetella pertussis
acauagcccggcg

SEQ ID NO: 2413968 - RNA, 14 nt, Bordetella pertussis
acauagcccggcgc

SEQ ID NO: 2413969 - RNA, 18 nt, Bordetella pertussis
acauagcggccggcgcgc

SEQ ID NO: 2413970 - RNA, 19 nt, Bordetella pertussis
acaucaaugacauggccac

SEQ ID NO: 2413971 - RNA, 16 nt, Bordetella pertussis
acaucagcgugccgcc

SEQ ID NO: 2413972 - RNA, 17 nt, Bordetella pertussis
acaucagcgugccgccg

SEQ ID NO: 2413973 - RNA, 18 nt, Bordetella pertussis
acaucaggucgaccugcu

SEQ ID NO: 2413974 - RNA, 20 nt, Bordetella pertussis
acaucauccccagcgccgcc

SEQ ID NO: 2413975 - RNA, 15 nt, Bordetella pertussis
acaucaucgaccacc

SEQ ID NO: 2413976 - RNA, 18 nt, Bordetella pertussis
acaucaucgaccaccagc

SEQ ID NO: 2413977 - RNA, 19 nt, Bordetella pertussis
acaucaugggcgaagccac

SEQ ID NO: 2413978 - RNA, 22 nt, Bordetella pertussis
acaucaugggcgaagccacggc

SEQ ID NO: 2413979 - RNA, 13 nt, Bordetella pertussis
acauccugaccgg

SEQ ID NO: 2413980 - RNA, 13 nt, Bordetella pertussis
acauccuggaugu

SEQ ID NO: 2413981 - RNA, 19 nt, Bordetella pertussis
acaucgagggcgucaucgg

SEQ ID NO: 2413982 - RNA, 12 nt, Bordetella pertussis
acaucgccgcug

SEQ ID NO: 2413983 - RNA, 14 nt, Bordetella pertussis
acaucgcgaaggug

SEQ ID NO: 2413984 - RNA, 14 nt, Bordetella pertussis
acaucgcgcauggc

SEQ ID NO: 2413985 - RNA, 22 nt, Bordetella pertussis
acaucgcuaugcagcugcgcca

SEQ ID NO: 2413986 - RNA, 17 nt, Bordetella pertussis
acaucggaauuggcggc

SEQ ID NO: 2413987 - RNA, 15 nt, Bordetella pertussis
cagccugggccugua

SEQ ID NO: 2413988 - RNA, 16 nt, Bordetella pertussis
cagccugggcgccugg

SEQ ID NO: 2413989 - RNA, 17 nt, Bordetella pertussis
cagccugggcgccuggc

SEQ ID NO: 2413990 - RNA, 19 nt, Bordetella pertussis
cagccuggggcaggcggcu

SEQ ID NO: 2413991 - RNA, 23 nt, Bordetella pertussis
cagccuguugcaggaucugguuc

SEQ ID NO: 2413992 - RNA, 17 nt, Bordetella pertussis
cagccuucguccugcca

SEQ ID NO: 2413993 - RNA, 14 nt, Bordetella pertussis
cagccuugcuccgg

SEQ ID NO: 2413994 - RNA, 16 nt, Bordetella pertussis
cagccuugcuccggcg

SEQ ID NO: 2413995 - RNA, 19 nt, Bordetella pertussis
cagccuugcuccggcguga

SEQ ID NO: 2413996 - RNA, 15 nt, Bordetella pertussis
cagccuuggucagcg

SEQ ID NO: 2413997 - RNA, 14 nt, Bordetella pertussis
cagccuugucgcgg

SEQ ID NO: 2413998 - RNA, 15 nt, Bordetella pertussis
cagccuuuccuccug

SEQ ID NO: 2413999 - RNA, 15 nt, Bordetella pertussis
cagcgaaagcacggc

SEQ ID NO: 2414000 - RNA, 18 nt, Bordetella pertussis
cagcgaaagcacggcgau

SEQ ID NO: 2414001 - RNA, 19 nt, Bordetella pertussis
cagcgaaaugccgaagcgc

SEQ ID NO: 2414002 - RNA, 21 nt, Bordetella pertussis
cagcgaacggauggucgugcg

SEQ ID NO: 2414003 - RNA, 16 nt, Bordetella pertussis
cagcgaacggcccacg

SEQ ID NO: 2414004 - RNA, 19 nt, Bordetella pertussis
cagcgacaacagcuugccc

SEQ ID NO: 2414005 - RNA, 22 nt, Bordetella pertussis
cagcgacaacagcuugcccggc

SEQ ID NO: 2414006 - RNA, 12 nt, Bordetella pertussis
cagcgacagcac

SEQ ID NO: 2414007 - RNA, 13 nt, Bordetella pertussis
cagcgacagcagg

SEQ ID NO: 2414008 - RNA, 14 nt, Bordetella pertussis
cagcgacagcaggg

SEQ ID NO: 2414009 - RNA, 17 nt, Bordetella pertussis
cagcgacagccaggcca

SEQ ID NO: 2414010 - RNA, 18 nt, Bordetella pertussis
cagcgacagccaggccag

SEQ ID NO: 2414011 - RNA, 22 nt, Bordetella pertussis
cagcgacagccaggccagcgcc

SEQ ID NO: 2414012 - RNA, 14 nt, Bordetella pertussis
cagcgacaggacgu

SEQ ID NO: 2414013 - RNA, 16 nt, Bordetella pertussis
cagcgacaucgugcug

SEQ ID NO: 2414014 - RNA, 17 nt, Bordetella pertussis
cagcgacaucgugcugu

SEQ ID NO: 2414015 - RNA, 23 nt, Bordetella pertussis
cagcgacccgcaaaaccgggccc

SEQ ID NO: 2414016 - RNA, 13 nt, Bordetella pertussis
cagcgaccgcggc

SEQ ID NO: 2414017 - RNA, 15 nt, Bordetella pertussis
cagcgaccgcggcgg

SEQ ID NO: 2414018 - RNA, 17 nt, Bordetella pertussis
cagcgacgagggcgcca

SEQ ID NO: 2414019 - RNA, 22 nt, Bordetella pertussis
cagcgacgcgcgccggcgcucg

SEQ ID NO: 2414020 - RNA, 12 nt, Bordetella pertussis
cagcgacggccc

SEQ ID NO: 2414021 - RNA, 22 nt, Bordetella pertussis
cagcgacggccccagcgccgcg

SEQ ID NO: 2414022 - RNA, 18 nt, Bordetella pertussis
cagcgacuccggccgggc

SEQ ID NO: 2414023 - RNA, 23 nt, Bordetella pertussis
cagcgacuccggccgggccagcg

SEQ ID NO: 2414024 - RNA, 13 nt, Bordetella pertussis
cagcgacucgccg

SEQ ID NO: 2414025 - RNA, 15 nt, Bordetella pertussis
cagcgacuugucgcg

SEQ ID NO: 2414026 - RNA, 18 nt, Bordetella pertussis
cagcgacuugucgcgccc

SEQ ID NO: 2414027 - RNA, 16 nt, Bordetella pertussis
cagcgagaacagccac

SEQ ID NO: 2414028 - RNA, 14 nt, Bordetella pertussis
cagcgagacggugu

SEQ ID NO: 2414029 - RNA, 22 nt, Bordetella pertussis
cagcgagagcgccacgccagcg

SEQ ID NO: 2414030 - RNA, 15 nt, Bordetella pertussis
cagcgagaucagcac

SEQ ID NO: 2414031 - RNA, 18 nt, Bordetella pertussis
cagcgagaucagcaccgc

SEQ ID NO: 2414032 - RNA, 20 nt, Bordetella pertussis
cagcgagaucagcaccgcga

SEQ ID NO: 2414033 - RNA, 20 nt, Bordetella pertussis
cagcgagcccgccaucgcca

SEQ ID NO: 2414034 - RNA, 21 nt, Bordetella pertussis
cagcgagcccgccaucgccag

SEQ ID NO: 2414035 - RNA, 17 nt, Bordetella pertussis
cagcgagccggccagcg

SEQ ID NO: 2414036 - RNA, 19 nt, Bordetella pertussis
cagcgagccggccagcgcc

SEQ ID NO: 2414037 - RNA, 23 nt, Bordetella pertussis
cagcgagccggccagcgccacca

SEQ ID NO: 2414038 - RNA, 16 nt, Bordetella pertussis
cagcgagcgaaagccg

SEQ ID NO: 2414039 - RNA, 21 nt, Bordetella pertussis
cagcgagcgaaagccgucggc

SEQ ID NO: 2414040 - RNA, 13 nt, Bordetella pertussis
cagcgagcggggc

SEQ ID NO: 2414041 - RNA, 16 nt, Bordetella pertussis
cagcgagcggggcugg

SEQ ID NO: 2414042 - RNA, 17 nt, Bordetella pertussis
cagcgagcugcgcugcu

SEQ ID NO: 2414043 - RNA, 18 nt, Bordetella pertussis
cagcgaggacacgcagcu

SEQ ID NO: 2414044 - RNA, 18 nt, Bordetella pertussis
cagcgaggcaucgaaggc

SEQ ID NO: 2414045 - RNA, 14 nt, Bordetella pertussis
cagcgaggccgcuu

SEQ ID NO: 2414046 - RNA, 20 nt, Bordetella pertussis
cagcgaggccucgugcugcu

SEQ ID NO: 2414047 - RNA, 21 nt, Bordetella pertussis
cagcgaggccucgugcugcug

SEQ ID NO: 2414048 - RNA, 23 nt, Bordetella pertussis
cagcgaggccucgugcugcugca

SEQ ID NO: 2414049 - RNA, 15 nt, Bordetella pertussis
cagcgaggcgcagcg

SEQ ID NO: 2414050 - RNA, 20 nt, Bordetella pertussis
cagcgaggcgcagcgcagcu

SEQ ID NO: 2414051 - RNA, 21 nt, Bordetella pertussis
cagcgaggcggcaagcggcgu

SEQ ID NO: 2414052 - RNA, 19 nt, Bordetella pertussis
cagcgagguggugacgaug

SEQ ID NO: 2414053 - RNA, 14 nt, Bordetella pertussis
cagcgagugaugga

SEQ ID NO: 2414054 - RNA, 20 nt, Bordetella pertussis
cagcgauacccgcuucgacg

SEQ ID NO: 2414055 - RNA, 18 nt, Bordetella pertussis
cagcgauuucuucugcgc

SEQ ID NO: 2414056 - RNA, 22 nt, Bordetella pertussis
cagcgcaccaccaccaugugcu

SEQ ID NO: 2414057 - RNA, 21 nt, Bordetella pertussis
cagcgcaccaccagcaccgcc

SEQ ID NO: 2414058 - RNA, 15 nt, Bordetella pertussis
cagcgcaccgacggc

SEQ ID NO: 2414059 - RNA, 22 nt, Bordetella pertussis
cagcgcaccgacggcagccccg

SEQ ID NO: 2414060 - RNA, 13 nt, Bordetella pertussis
cagcgccggcaug

SEQ ID NO: 2414061 - RNA, 14 nt, Bordetella pertussis
cagcgccggcauga

SEQ ID NO: 2414062 - RNA, 23 nt, Bordetella pertussis
cagcgccggcaugaagcgcagca

SEQ ID NO: 2414063 - RNA, 16 nt, Bordetella pertussis
cagcgccggcgcauga

SEQ ID NO: 2414064 - RNA, 18 nt, Bordetella pertussis
cagcgccggcgcaugagc

SEQ ID NO: 2414065 - RNA, 22 nt, Bordetella pertussis
cagcgccggcgcaugagccggc

SEQ ID NO: 2414066 - RNA, 16 nt, Bordetella pertussis
cagcgccggcgcgcgc

SEQ ID NO: 2414067 - RNA, 15 nt, Bordetella pertussis
cagcgccggcgcguc

SEQ ID NO: 2414068 - RNA, 14 nt, Bordetella pertussis
cagcgccggcuggg

SEQ ID NO: 2414069 - RNA, 14 nt, Bordetella pertussis
cagcgccggggggc

SEQ ID NO: 2414070 - RNA, 17 nt, Bordetella pertussis
cagcgccggggggcgca

SEQ ID NO: 2414071 - RNA, 19 nt, Bordetella pertussis
cagcgccggggucagcgcc

SEQ ID NO: 2414072 - RNA, 22 nt, Bordetella pertussis
cagcgccggggucagcgccggc

SEQ ID NO: 2414073 - RNA, 21 nt, Bordetella pertussis
cagcgccgucagcagcgcggc

SEQ ID NO: 2414074 - RNA, 19 nt, Bordetella pertussis
cagcgccgucaucugcgga

SEQ ID NO: 2414075 - RNA, 20 nt, Bordetella pertussis
cagcgccgucaucugcggaa

SEQ ID NO: 2414076 - RNA, 14 nt, Bordetella pertussis
cagcgccucgggau

SEQ ID NO: 2414077 - RNA, 17 nt, Bordetella pertussis
cagcgccucgucgcgca

SEQ ID NO: 2414078 - RNA, 22 nt, Bordetella pertussis
cagcgccucgucgcgcaacgcc

SEQ ID NO: 2414079 - RNA, 12 nt, Bordetella pertussis
cagcgccugcag

SEQ ID NO: 2414080 - RNA, 13 nt, Bordetella pertussis
cagcgccugcagg

SEQ ID NO: 2414081 - RNA, 16 nt, Bordetella pertussis
cagcgccugcaggcgg

SEQ ID NO: 2414082 - RNA, 14 nt, Bordetella pertussis
cagcgccugcaggu

SEQ ID NO: 2414083 - RNA, 16 nt, Bordetella pertussis
cagcgccugcaggucu

SEQ ID NO: 2414084 - RNA, 18 nt, Bordetella pertussis
cagcgccugcauccggcc

SEQ ID NO: 2414085 - RNA, 15 nt, Bordetella pertussis
cagcgccugccgcgu

SEQ ID NO: 2414086 - RNA, 16 nt, Bordetella pertussis
cagcgccugcgcggcc

SEQ ID NO: 2414087 - RNA, 19 nt, Bordetella pertussis
cagcgccugcucguagcug

SEQ ID NO: 2414088 - RNA, 21 nt, Bordetella pertussis
cagcgccugcucguagcuguc

SEQ ID NO: 2414089 - RNA, 12 nt, Bordetella pertussis
cagcgccuggac

SEQ ID NO: 2414090 - RNA, 13 nt, Bordetella pertussis
cagcgccuggacc

SEQ ID NO: 2414091 - RNA, 15 nt, Bordetella pertussis
cagcgccuggaccug

SEQ ID NO: 2414092 - RNA, 15 nt, Bordetella pertussis
cagcgccuggccgag

SEQ ID NO: 2414093 - RNA, 21 nt, Bordetella pertussis
cagcgccuggccgagcgcggc

SEQ ID NO: 2414094 - RNA, 22 nt, Bordetella pertussis
cagcgccuggccgagcgcggca

SEQ ID NO: 2414095 - RNA, 12 nt, Bordetella pertussis
cagcgccuggcg

SEQ ID NO: 2414096 - RNA, 17 nt, Bordetella pertussis
cagcgccuggcggcugg

SEQ ID NO: 2414097 - RNA, 20 nt, Bordetella pertussis
cagcgccuggcggcugguca

SEQ ID NO: 2414098 - RNA, 15 nt, Bordetella pertussis
cagcgccuggcgggc

SEQ ID NO: 2414099 - RNA, 17 nt, Bordetella pertussis
cagcgccuggcgggccu

SEQ ID NO: 2414100 - RNA, 19 nt, Bordetella pertussis
cagcgccuggcgggccugg

SEQ ID NO: 2414101 - RNA, 21 nt, Bordetella pertussis
cagcgccuggcgggccugggc

SEQ ID NO: 2414102 - RNA, 22 nt, Bordetella pertussis
cagcgccuggcgggccugggcg

SEQ ID NO: 2414103 - RNA, 21 nt, Bordetella pertussis
cagcgccugggguaggcgcgg

SEQ ID NO: 2414104 - RNA, 20 nt, Bordetella pertussis
cagcgccugggucaggucgg

SEQ ID NO: 2414105 - RNA, 12 nt, Bordetella pertussis
cagcgccuugcc

SEQ ID NO: 2414106 - RNA, 14 nt, Bordetella pertussis
cagcgccuugccgc

SEQ ID NO: 2414107 - RNA, 16 nt, Bordetella pertussis
cagcgccuugccgccg

SEQ ID NO: 2414108 - RNA, 20 nt, Bordetella pertussis
cagcgccuugccgccgugcg

SEQ ID NO: 2414109 - RNA, 21 nt, Bordetella pertussis
cagcgccuugccgccgugcga

SEQ ID NO: 2414110 - RNA, 14 nt, Bordetella pertussis
cagcgccuugccuu

SEQ ID NO: 2414111 - RNA, 15 nt, Bordetella pertussis
cagcgccuugcggcg

SEQ ID NO: 2414112 - RNA, 16 nt, Bordetella pertussis
cagcgccuugcggcgc

SEQ ID NO: 2414113 - RNA, 22 nt, Bordetella pertussis
cagcgcgaaaacccgcggcagu

SEQ ID NO: 2414114 - RNA, 20 nt, Bordetella pertussis
cagcgcgaacggcgggcgga

SEQ ID NO: 2414115 - RNA, 18 nt, Bordetella pertussis
cagcgcgaaguaccagcg

SEQ ID NO: 2414116 - RNA, 20 nt, Bordetella pertussis
cagcgcgaaguaccagcgca

SEQ ID NO: 2414117 - RNA, 16 nt, Bordetella pertussis
cagcgcgaccgggcaa

SEQ ID NO: 2414118 - RNA, 12 nt, Bordetella pertussis
cagcgcgacgaa

SEQ ID NO: 2414119 - RNA, 16 nt, Bordetella pertussis
cagcgcgacggccucg

SEQ ID NO: 2414120 - RNA, 18 nt, Bordetella pertussis
cagcgcgacggccucguc

SEQ ID NO: 2414121 - RNA, 23 nt, Bordetella pertussis
cagcgcgauucccuggcgcgcca

SEQ ID NO: 2414122 - RNA, 12 nt, Bordetella pertussis
cagcgcgcaacu

SEQ ID NO: 2414123 - RNA, 14 nt, Bordetella pertussis
cagcgcgcaacucc

SEQ ID NO: 2414124 - RNA, 17 nt, Bordetella pertussis
cagcgcgcaacuccagc

SEQ ID NO: 2414125 - RNA, 17 nt, Bordetella pertussis
cagcgcgcaggacaagg

SEQ ID NO: 2414126 - RNA, 22 nt, Bordetella pertussis
cagcgcgcaggacaaggcgcgc

SEQ ID NO: 2414127 - RNA, 23 nt, Bordetella pertussis
cagcgcgcaggacaaggcgcgcg

SEQ ID NO: 2414128 - RNA, 16 nt, Bordetella pertussis
cagcgcgcaggaucag

SEQ ID NO: 2414129 - RNA, 14 nt, Bordetella pertussis
cagcgcgccagcgc

SEQ ID NO: 2414130 - RNA, 17 nt, Bordetella pertussis
cagcgcgccagcgcgcg

SEQ ID NO: 2414131 - RNA, 18 nt, Bordetella pertussis
cagcgcgccagcgcgcga

SEQ ID NO: 2414132 - RNA, 16 nt, Bordetella pertussis
cagcgcgccaggcgcu

SEQ ID NO: 2414133 - RNA, 14 nt, Bordetella pertussis
cagcgcgccauggc

SEQ ID NO: 2414134 - RNA, 12 nt, Bordetella pertussis
cagcgcgcccga

SEQ ID NO: 2414135 - RNA, 13 nt, Bordetella pertussis
cagcgcgcccgau

SEQ ID NO: 2414136 - RNA, 12 nt, Bordetella pertussis
cagcgcgcccgc

SEQ ID NO: 2414137 - RNA, 15 nt, Bordetella pertussis
cagcgcgcccgcuug

SEQ ID NO: 2414138 - RNA, 11 nt, Bordetella pertussis
cagcgcgccga

SEQ ID NO: 2414139 - RNA, 19 nt, Bordetella pertussis
cagcgcgccgaggaucugg

SEQ ID NO: 2414140 - RNA, 11 nt, Bordetella pertussis
cagcgcgccgc

SEQ ID NO: 2414141 - RNA, 12 nt, Bordetella pertussis
cagcgcgccgcc

SEQ ID NO: 2414142 - RNA, 21 nt, Bordetella pertussis
cagcgcgccgccagcgcgcgc

SEQ ID NO: 2414143 - RNA, 13 nt, Bordetella pertussis
cagcgcgccgcga

SEQ ID NO: 2414144 - RNA, 16 nt, Bordetella pertussis
cagcgcgccgcgaaac

SEQ ID NO: 2414145 - RNA, 23 nt, Bordetella pertussis
cagcgcgccgcgaaacgucccca

SEQ ID NO: 2414146 - RNA, 16 nt, Bordetella pertussis
cagcgcgccgcgccgg

SEQ ID NO: 2414147 - RNA, 14 nt, Bordetella pertussis
cagcgcgccgcgcg

SEQ ID NO: 2414148 - RNA, 19 nt, Bordetella pertussis
cagcgcgccgcgcgcggcg

SEQ ID NO: 2414149 - RNA, 18 nt, Bordetella pertussis
cagcgcgccggccagggc

SEQ ID NO: 2414150 - RNA, 12 nt, Bordetella pertussis
cagcgcgccggg

SEQ ID NO: 2414151 - RNA, 15 nt, Bordetella pertussis
cagcgcgccgggggc

SEQ ID NO: 2414152 - RNA, 14 nt, Bordetella pertussis
cagcgcgccgucgg

SEQ ID NO: 2414153 - RNA, 15 nt, Bordetella pertussis
cagcgcgccugccca

SEQ ID NO: 2414154 - RNA, 19 nt, Bordetella pertussis
cagcgcgccugcccaggcc

SEQ ID NO: 2414155 - RNA, 20 nt, Bordetella pertussis
cagcgcgccugcccaggcca

SEQ ID NO: 2414156 - RNA, 20 nt, Bordetella pertussis
cagcgcgcgauagauggcca

SEQ ID NO: 2414157 - RNA, 21 nt, Bordetella pertussis
cagcgcgcgauagauggccag

SEQ ID NO: 2414158 - RNA, 15 nt, Bordetella pertussis
cagcgcgcgaucgcc

SEQ ID NO: 2414159 - RNA, 16 nt, Bordetella pertussis
cagcgcgcgaucgcca

SEQ ID NO: 2414160 - RNA, 20 nt, Bordetella pertussis
cagcgcgcgaucgccagcag

SEQ ID NO: 2414161 - RNA, 21 nt, Bordetella pertussis
cagcgcgcgaucgccagcagg

SEQ ID NO: 2414162 - RNA, 19 nt, Bordetella pertussis
cagcgcgcgcagccgcgcc

SEQ ID NO: 2414163 - RNA, 22 nt, Bordetella pertussis
cagcgcgcgccaguugcgcacc

SEQ ID NO: 2414164 - RNA, 14 nt, Bordetella pertussis
cagcgcgcgccggc

SEQ ID NO: 2414165 - RNA, 17 nt, Bordetella pertussis
cagcgcgcgccggccga

SEQ ID NO: 2414166 - RNA, 15 nt, Bordetella pertussis
cagcgcgcgcgccga

SEQ ID NO: 2414167 - RNA, 14 nt, Bordetella pertussis
cagcgcgcgcgcgc

SEQ ID NO: 2414168 - RNA, 13 nt, Bordetella pertussis
cagcgcgcggccg

SEQ ID NO: 2414169 - RNA, 14 nt, Bordetella pertussis
cagcgcgcggccgg

SEQ ID NO: 2414170 - RNA, 20 nt, Bordetella pertussis
cagcgcgcggccggccgcgc

SEQ ID NO: 2414171 - RNA, 22 nt, Bordetella pertussis
cagcgcgcggccggccgcgccc

SEQ ID NO: 2414172 - RNA, 13 nt, Bordetella pertussis
cagcgcgcggccu

SEQ ID NO: 2414173 - RNA, 14 nt, Bordetella pertussis
cagcgcgcggccuc

SEQ ID NO: 2414174 - RNA, 17 nt, Bordetella pertussis
cagcggcacgccggcgg

SEQ ID NO: 2414175 - RNA, 14 nt, Bordetella pertussis
cagcggcagcaugg

SEQ ID NO: 2414176 - RNA, 20 nt, Bordetella pertussis
cagcggcagcgcaccgucgc

SEQ ID NO: 2414177 - RNA, 22 nt, Bordetella pertussis
cagcggcagcgcaccgucgcca

SEQ ID NO: 2414178 - RNA, 14 nt, Bordetella pertussis
cagcggcagcgcgc

SEQ ID NO: 2414179 - RNA, 17 nt, Bordetella pertussis
cagcggcagcgcgcagg

SEQ ID NO: 2414180 - RNA, 13 nt, Bordetella pertussis
cagcggcagcggg

SEQ ID NO: 2414181 - RNA, 16 nt, Bordetella pertussis
cagcggcagcgggucg

SEQ ID NO: 2414182 - RNA, 16 nt, Bordetella pertussis
cagcggcagcucggcg

SEQ ID NO: 2414183 - RNA, 21 nt, Bordetella pertussis
cagcggcaggacggggaacag

SEQ ID NO: 2414184 - RNA, 13 nt, Bordetella pertussis
cagcggcaggccc

SEQ ID NO: 2414185 - RNA, 14 nt, Bordetella pertussis
cagcggcaggcccu

SEQ ID NO: 2414186 - RNA, 22 nt, Bordetella pertussis
cagcggcaggcccugccgccuc

SEQ ID NO: 2414187 - RNA, 19 nt, Bordetella pertussis
cagcggcaggggcucgcgc

SEQ ID NO: 2414188 - RNA, 22 nt, Bordetella pertussis
cagcggcaggggcucgcgcccg

SEQ ID NO: 2414189 - RNA, 23 nt, Bordetella pertussis
cagcggcaggggcucgcgcccga

SEQ ID NO: 2414190 - RNA, 13 nt, Bordetella pertussis
cagcggcauugcc

SEQ ID NO: 2414191 - RNA, 17 nt, Bordetella pertussis
cagcggcauugcccagg

SEQ ID NO: 2414192 - RNA, 18 nt, Bordetella pertussis
cagcggcauugcccaggu

SEQ ID NO: 2414193 - RNA, 15 nt, Bordetella pertussis
cagcggccagaucgg

SEQ ID NO: 2414194 - RNA, 17 nt, Bordetella pertussis
cagcggccagcgcggcg

SEQ ID NO: 2414195 - RNA, 20 nt, Bordetella pertussis
cagcggccagcgcggcggca

SEQ ID NO: 2414196 - RNA, 20 nt, Bordetella pertussis
cagcggccaguccaccuuga

SEQ ID NO: 2414197 - RNA, 23 nt, Bordetella pertussis
cagcggcccacccggcacgcgcc

SEQ ID NO: 2414198 - RNA, 14 nt, Bordetella pertussis
cagcggccgcugcc

SEQ ID NO: 2414199 - RNA, 15 nt, Bordetella pertussis
cagcggccgcugccg

SEQ ID NO: 2414200 - RNA, 18 nt, Bordetella pertussis
cagcggccgcugccgcgc

SEQ ID NO: 2414201 - RNA, 17 nt, Bordetella pertussis
cagcggccggcccgugc

SEQ ID NO: 2414202 - RNA, 18 nt, Bordetella pertussis
cagcggccggcccgugcg

SEQ ID NO: 2414203 - RNA, 22 nt, Bordetella pertussis
cagcggccggcccgugcgcaac

SEQ ID NO: 2414204 - RNA, 13 nt, Bordetella pertussis
cagcggccgucgc

SEQ ID NO: 2414205 - RNA, 15 nt, Bordetella pertussis
cagcggccgucgccu

SEQ ID NO: 2414206 - RNA, 16 nt, Bordetella pertussis
cagcggccgucgccuu

SEQ ID NO: 2414207 - RNA, 21 nt, Bordetella pertussis
cagcggccgucgccuucggcg

SEQ ID NO: 2414208 - RNA, 23 nt, Bordetella pertussis
cagcggccgucgccuucggcggc

SEQ ID NO: 2414209 - RNA, 20 nt, Bordetella pertussis
cagcggcgaaaugucgagcg

SEQ ID NO: 2414210 - RNA, 13 nt, Bordetella pertussis
cagcggcgacggc

SEQ ID NO: 2414211 - RNA, 14 nt, Bordetella pertussis
cagcggcgacggcg

SEQ ID NO: 2414212 - RNA, 20 nt, Bordetella pertussis
cagcggcgacggcgccuggc

SEQ ID NO: 2414213 - RNA, 23 nt, Bordetella pertussis
cagcggcgacggcgccuggcgca

SEQ ID NO: 2414214 - RNA, 19 nt, Bordetella pertussis
cagcggcgacugccccagc

SEQ ID NO: 2414215 - RNA, 18 nt, Bordetella pertussis
cagcggcgagcaauccgu

SEQ ID NO: 2414216 - RNA, 16 nt, Bordetella pertussis
cagcggcgagcgcggc

SEQ ID NO: 2414217 - RNA, 15 nt, Bordetella pertussis
cagcggcgcagccgg

SEQ ID NO: 2414218 - RNA, 14 nt, Bordetella pertussis
cagcggcgccagcg

SEQ ID NO: 2414219 - RNA, 23 nt, Bordetella pertussis
cagcggcgccaugcgcaccaccg

SEQ ID NO: 2414220 - RNA, 16 nt, Bordetella pertussis
cagcggcgcgacgcgc

SEQ ID NO: 2414221 - RNA, 13 nt, Bordetella pertussis
cagcggcgcgagc

SEQ ID NO: 2414222 - RNA, 14 nt, Bordetella pertussis
cagcggcgcgcgca

SEQ ID NO: 2414223 - RNA, 17 nt, Bordetella pertussis
cagcggcgcggcgcgcu

SEQ ID NO: 2414224 - RNA, 19 nt, Bordetella pertussis
cagcggcgcggcgcgcugg

SEQ ID NO: 2414225 - RNA, 15 nt, Bordetella pertussis
cagcggcggcacgcg

SEQ ID NO: 2414226 - RNA, 16 nt, Bordetella pertussis
cagcggcggcacgcgc

SEQ ID NO: 2414227 - RNA, 20 nt, Bordetella pertussis
cagcggcggcacgcgcgccg

SEQ ID NO: 2414228 - RNA, 13 nt, Bordetella pertussis
cagcggcggcgcg

SEQ ID NO: 2414229 - RNA, 23 nt, Bordetella pertussis
cagcggcggcgcggucagcauga

SEQ ID NO: 2414230 - RNA, 22 nt, Bordetella pertussis
cagcggcguauaggccaccccg

SEQ ID NO: 2414231 - RNA, 14 nt, Bordetella pertussis
cagcggcgugcggc

SEQ ID NO: 2414232 - RNA, 17 nt, Bordetella pertussis
cagcggcgugcggccca

SEQ ID NO: 2414233 - RNA, 23 nt, Bordetella pertussis
cagcggcgugcggcccagccgcu

SEQ ID NO: 2414234 - RNA, 15 nt, Bordetella pertussis
cagcggcguggcggc

SEQ ID NO: 2414235 - RNA, 17 nt, Bordetella pertussis
cagcggcguggcggcca

SEQ ID NO: 2414236 - RNA, 21 nt, Bordetella pertussis
cagcggcuccccuggucaggg

SEQ ID NO: 2414237 - RNA, 16 nt, Bordetella pertussis
cagcggcucgacgccg

SEQ ID NO: 2414238 - RNA, 17 nt, Bordetella pertussis
cagcggcucgacgccgu

SEQ ID NO: 2414239 - RNA, 19 nt, Bordetella pertussis
cagcggcucgagcggcagc

SEQ ID NO: 2414240 - RNA, 17 nt, Bordetella pertussis
cagcggcugauucucgg

SEQ ID NO: 2414241 - RNA, 23 nt, Bordetella pertussis
cagcggcugcuugagcagccacu

SEQ ID NO: 2414242 - RNA, 20 nt, Bordetella pertussis
cagcggcuggccacuggccg

SEQ ID NO: 2414243 - RNA, 16 nt, Bordetella pertussis
cagcggcuggcgcacg

SEQ ID NO: 2414244 - RNA, 16 nt, Bordetella pertussis
cagcggcuggcggugc

SEQ ID NO: 2414245 - RNA, 17 nt, Bordetella pertussis
cagcggcuggcggugcg

SEQ ID NO: 2414246 - RNA, 19 nt, Bordetella pertussis
cagcggcuucaugccggcg

SEQ ID NO: 2414247 - RNA, 21 nt, Bordetella pertussis
cagcgggcccgucgcgccagg

SEQ ID NO: 2414248 - RNA, 15 nt, Bordetella pertussis
cagcgggccggcacc

SEQ ID NO: 2414249 - RNA, 16 nt, Bordetella pertussis
cagcgggccggcacca

SEQ ID NO: 2414250 - RNA, 13 nt, Bordetella pertussis
cagcgggcgcgcc

SEQ ID NO: 2414251 - RNA, 20 nt, Bordetella pertussis
cagcgggcuggccagcgguu

SEQ ID NO: 2414252 - RNA, 18 nt, Bordetella pertussis
cagcgggcuggggcaggc

SEQ ID NO: 2414253 - RNA, 14 nt, Bordetella pertussis
cagcggggacaggc

SEQ ID NO: 2414254 - RNA, 20 nt, Bordetella pertussis
cagcggggacaggcgcccgu

SEQ ID NO: 2414255 - RNA, 23 nt, Bordetella pertussis
cagcggggccgugacgugcuuga

SEQ ID NO: 2414256 - RNA, 16 nt, Bordetella pertussis
cagcgggugaucacgg

SEQ ID NO: 2414257 - RNA, 20 nt, Bordetella pertussis
cagcgggugaucacggccgu

SEQ ID NO: 2414258 - RNA, 14 nt, Bordetella pertussis
cagcggugcgcggc

SEQ ID NO: 2414259 - RNA, 15 nt, Bordetella pertussis
cagcggugcgcggcg

SEQ ID NO: 2414260 - RNA, 16 nt, Bordetella pertussis
cagcggugcgcggcgc

SEQ ID NO: 2414261 - RNA, 17 nt, Bordetella pertussis
cagcggugcgcggcgca

SEQ ID NO: 2414262 - RNA, 17 nt, Bordetella pertussis
cagcgguucgucggcgc

SEQ ID NO: 2414263 - RNA, 22 nt, Bordetella pertussis
cagcgguugcgccagcuugcgc

SEQ ID NO: 2414264 - RNA, 15 nt, Bordetella pertussis
cagcguacgcacgcc

SEQ ID NO: 2414265 - RNA, 14 nt, Bordetella pertussis
cagcguaucgcccg

SEQ ID NO: 2414266 - RNA, 16 nt, Bordetella pertussis
cagcguaucgcccgcg

SEQ ID NO: 2414267 - RNA, 20 nt, Bordetella pertussis
cagcguaucgcccgcgcggu

SEQ ID NO: 2414268 - RNA, 17 nt, Bordetella pertussis
cagcguaucgccgccgc

SEQ ID NO: 2414269 - RNA, 20 nt, Bordetella pertussis
cagcguaucgccgccgccgg

SEQ ID NO: 2414270 - RNA, 23 nt, Bordetella pertussis
cagcguauuccccuucucggccg

SEQ ID NO: 2414271 - RNA, 16 nt, Bordetella pertussis
cagcgucaccagcagg

SEQ ID NO: 2414272 - RNA, 20 nt, Bordetella pertussis
cagcgucaccagcaggcggc

SEQ ID NO: 2414273 - RNA, 14 nt, Bordetella pertussis
cagcgucagcacau

SEQ ID NO: 2414274 - RNA, 13 nt, Bordetella pertussis
cagcgucagcugg

SEQ ID NO: 2414275 - RNA, 18 nt, Bordetella pertussis
cagcgucagcugggcaug

SEQ ID NO: 2414276 - RNA, 15 nt, Bordetella pertussis
cagcgucaugcgcac

SEQ ID NO: 2414277 - RNA, 17 nt, Bordetella pertussis
cagcgucaugcgcaccu

SEQ ID NO: 2414278 - RNA, 22 nt, Bordetella pertussis
cagcgucaugcgcaccuugucg

SEQ ID NO: 2414279 - RNA, 15 nt, Bordetella pertussis
cagcgucauggccug

SEQ ID NO: 2414280 - RNA, 16 nt, Bordetella pertussis
cagcgucauggccugg

SEQ ID NO: 2414281 - RNA, 23 nt, Bordetella pertussis
cagcgucauggccuggcccagcu

SEQ ID NO: 2414282 - RNA, 19 nt, Bordetella pertussis
cagcgucaugugcugcggc

SEQ ID NO: 2414283 - RNA, 20 nt, Bordetella pertussis
cagcgucaugugcugcggca

SEQ ID NO: 2414284 - RNA, 23 nt, Bordetella pertussis
cagcgucaugugcugcggcagcc

SEQ ID NO: 2414285 - RNA, 15 nt, Bordetella pertussis
cagcguccagccgcc

SEQ ID NO: 2414286 - RNA, 16 nt, Bordetella pertussis
cagcguccagccgccc

SEQ ID NO: 2414287 - RNA, 23 nt, Bordetella pertussis
cagcucggcgaucugcgcggcgg

SEQ ID NO: 2414288 - RNA, 19 nt, Bordetella pertussis
cagcucggcggccgccugc

SEQ ID NO: 2414289 - RNA, 23 nt, Bordetella pertussis
cagcucggcggccgccugcgccg

SEQ ID NO: 2414290 - RNA, 17 nt, Bordetella pertussis
cagcucggugcagccca

SEQ ID NO: 2414291 - RNA, 20 nt, Bordetella pertussis
cagcucggugcagcccagca

SEQ ID NO: 2414292 - RNA, 23 nt, Bordetella pertussis
cagcucggugcagcccagcacca

SEQ ID NO: 2414293 - RNA, 15 nt, Bordetella pertussis
cagcucgguggucaa

SEQ ID NO: 2414294 - RNA, 16 nt, Bordetella pertussis
cagcucgguggucaac

SEQ ID NO: 2414295 - RNA, 17 nt, Bordetella pertussis
cagcucguccagguugc

SEQ ID NO: 2414296 - RNA, 23 nt, Bordetella pertussis
cagcucguccagguugcccgagc

SEQ ID NO: 2414297 - RNA, 24 nt, Bordetella pertussis
cagcucguccagguugcccgagcg

SEQ ID NO: 2414298 - RNA, 16 nt, Bordetella pertussis
cagcucgucgccgcug

SEQ ID NO: 2414299 - RNA, 15 nt, Bordetella pertussis
cagcucguggcgcgc

SEQ ID NO: 2414300 - RNA, 17 nt, Bordetella pertussis
cagcucguggcgcgccu

SEQ ID NO: 2414301 - RNA, 22 nt, Bordetella pertussis
cagcucguggcgcgccuccagc

SEQ ID NO: 2414302 - RNA, 17 nt, Bordetella pertussis
cagcucuucgagcgcgg

SEQ ID NO: 2414303 - RNA, 22 nt, Bordetella pertussis
cagcucuucgagcgcggcgcgc

SEQ ID NO: 2414304 - RNA, 16 nt, Bordetella pertussis
cagcugaccucgccca

SEQ ID NO: 2414305 - RNA, 18 nt, Bordetella pertussis
cagcugaccucgcccagg

SEQ ID NO: 2414306 - RNA, 19 nt, Bordetella pertussis
cagcugaccucgcccaggc

SEQ ID NO: 2414307 - RNA, 14 nt, Bordetella pertussis
cagcugcagcgacu

SEQ ID NO: 2414308 - RNA, 15 nt, Bordetella pertussis
cagcugcaguaugca

SEQ ID NO: 2414309 - RNA, 20 nt, Bordetella pertussis
cagcugccugagcaccgccg

SEQ ID NO: 2414310 - RNA, 19 nt, Bordetella pertussis
cagcugcgaaagcgcgucg

SEQ ID NO: 2414311 - RNA, 20 nt, Bordetella pertussis
cagcugcgaaagcgcgucga

SEQ ID NO: 2414312 - RNA, 16 nt, Bordetella pertussis
cagcugcgcagcgacu

SEQ ID NO: 2414313 - RNA, 14 nt, Bordetella pertussis
cagcugcgccagcc

SEQ ID NO: 2414314 - RNA, 15 nt, Bordetella pertussis
cagcugcgccagccc

SEQ ID NO: 2414315 - RNA, 16 nt, Bordetella pertussis
cagcugcgcgcgagcg

SEQ ID NO: 2414316 - RNA, 20 nt, Bordetella pertussis
cagcugcgcgcgagcggcgg

SEQ ID NO: 2414317 - RNA, 19 nt, Bordetella pertussis
cagcugcgcgucgacagca

SEQ ID NO: 2414318 - RNA, 14 nt, Bordetella pertussis
cagcugcguggcga

SEQ ID NO: 2414319 - RNA, 23 nt, Bordetella pertussis
cagcugcguggcgacgcgcugcc

SEQ ID NO: 2414320 - RNA, 23 nt, Bordetella pertussis
cagcugcuguuggccuucggcga

SEQ ID NO: 2414321 - RNA, 16 nt, Bordetella pertussis
cagcugcuugcccagg

SEQ ID NO: 2414322 - RNA, 19 nt, Bordetella pertussis
cagcugcuugcccaggccg

SEQ ID NO: 2414323 - RNA, 20 nt, Bordetella pertussis
cagcugcuugcccaggccgg

SEQ ID NO: 2414324 - RNA, 23 nt, Bordetella pertussis
cagcugcuugcccaggccggcgc

SEQ ID NO: 2414325 - RNA, 13 nt, Bordetella pertussis
cagcuggaagcgc

SEQ ID NO: 2414326 - RNA, 20 nt, Bordetella pertussis
cagcuggaagcgcgccaggc

SEQ ID NO: 2414327 - RNA, 22 nt, Bordetella pertussis
cagcuggaagcgcgccaggcgc

SEQ ID NO: 2414328 - RNA, 17 nt, Bordetella pertussis
cagcuggauggccugcu

SEQ ID NO: 2414329 - RNA, 16 nt, Bordetella pertussis
cagcuggcaccgcgac

SEQ ID NO: 2414330 - RNA, 14 nt, Bordetella pertussis
cagcuggcccuggc

SEQ ID NO: 2414331 - RNA, 17 nt, Bordetella pertussis
cagcuggcccuggcaga

SEQ ID NO: 2414332 - RNA, 22 nt, Bordetella pertussis
cagcuggcccuggcagacguac

SEQ ID NO: 2414333 - RNA, 14 nt, Bordetella pertussis
cagcuggcgcacca

SEQ ID NO: 2414334 - RNA, 20 nt, Bordetella pertussis
cagcuggcgcaccaggcugg

SEQ ID NO: 2414335 - RNA, 18 nt, Bordetella pertussis
cagcuggcgcagcacgcc

SEQ ID NO: 2414336 - RNA, 19 nt, Bordetella pertussis
cagcuggcgcagcacgccg

SEQ ID NO: 2414337 - RNA, 14 nt, Bordetella pertussis
cagcuggcgccccu

SEQ ID NO: 2414338 - RNA, 15 nt, Bordetella pertussis
cagcuggcgccccuu

SEQ ID NO: 2414339 - RNA, 17 nt, Bordetella pertussis
cagcuggcgcgggcggc

SEQ ID NO: 2414340 - RNA, 14 nt, Bordetella pertussis
cagcuggcggcgca

SEQ ID NO: 2414341 - RNA, 18 nt, Bordetella pertussis
cagcuggcggcgcagcac

SEQ ID NO: 2414342 - RNA, 21 nt, Bordetella pertussis
cagcuggcggcgcagcaccag

SEQ ID NO: 2414343 - RNA, 14 nt, Bordetella pertussis
cagcugggaggcgu

SEQ ID NO: 2414344 - RNA, 20 nt, Bordetella pertussis
cagcugggaggcgugcugca

SEQ ID NO: 2414345 - RNA, 15 nt, Bordetella pertussis
cagcugggcaugcac

SEQ ID NO: 2414346 - RNA, 19 nt, Bordetella pertussis
cagcugggccacagggcga

SEQ ID NO: 2414347 - RNA, 19 nt, Bordetella pertussis
cagcugggccaguucggcu

SEQ ID NO: 2414348 - RNA, 15 nt, Bordetella pertussis
cagcugggcggcgug

SEQ ID NO: 2414349 - RNA, 23 nt, Bordetella pertussis
cagcuggugccgguugcgcgccg

SEQ ID NO: 2414350 - RNA, 17 nt, Bordetella pertussis
cagcuguaccgguagcc

SEQ ID NO: 2414351 - RNA, 15 nt, Bordetella pertussis
cagcuguagcccugg

SEQ ID NO: 2414352 - RNA, 23 nt, Bordetella pertussis
cagcuguagcccuggcgcugcag

SEQ ID NO: 2414353 - RNA, 16 nt, Bordetella pertussis
cagcuguccaagcgcg

SEQ ID NO: 2414354 - RNA, 19 nt, Bordetella pertussis
cagcuguccaagcgcgugg

SEQ ID NO: 2414355 - RNA, 15 nt, Bordetella pertussis
cagcugugguaggcc

SEQ ID NO: 2414356 - RNA, 21 nt, Bordetella pertussis
cagcuucaucaccuucccgcu

SEQ ID NO: 2414357 - RNA, 15 nt, Bordetella pertussis
cagcuuccagguaca

SEQ ID NO: 2414358 - RNA, 16 nt, Bordetella pertussis
cagcuucugcgccugc

SEQ ID NO: 2414359 - RNA, 21 nt, Bordetella pertussis
cagcuucuggaucaccgccgg

SEQ ID NO: 2414360 - RNA, 22 nt, Bordetella pertussis
cagcuucuggaucaccgccggc

SEQ ID NO: 2414361 - RNA, 16 nt, Bordetella pertussis
cagcuugaacaggcag

SEQ ID NO: 2414362 - RNA, 18 nt, Bordetella pertussis
cagcuugaccgccuccag

SEQ ID NO: 2414363 - RNA, 20 nt, Bordetella pertussis
cagcuugaccuugagcacgc

SEQ ID NO: 2414364 - RNA, 23 nt, Bordetella pertussis
cagcuugaccuugagcacgcugg

SEQ ID NO: 2414365 - RNA, 16 nt, Bordetella pertussis
cagcuugagcaggcgc

SEQ ID NO: 2414366 - RNA, 17 nt, Bordetella pertussis
cagcuugauaucgaagc

SEQ ID NO: 2414367 - RNA, 17 nt, Bordetella pertussis
cagcuugaugccgccga

SEQ ID NO: 2414368 - RNA, 16 nt, Bordetella pertussis
cagcuugaugccggcg

SEQ ID NO: 2414369 - RNA, 15 nt, Bordetella pertussis
cagcuugcccacgcg

SEQ ID NO: 2414370 - RNA, 17 nt, Bordetella pertussis
cagcuugcccacgcgcu

SEQ ID NO: 2414371 - RNA, 14 nt, Bordetella pertussis
cagcuugcccggcg

SEQ ID NO: 2414372 - RNA, 14 nt, Bordetella pertussis
cagcuugcgcgcca

SEQ ID NO: 2414373 - RNA, 14 nt, Bordetella pertussis
cagcuugcgcgccc

SEQ ID NO: 2414374 - RNA, 22 nt, Bordetella pertussis
cagcuugcgcgcccccacgccg

SEQ ID NO: 2414375 - RNA, 15 nt, Bordetella pertussis
cagcuugcgcgccgc

SEQ ID NO: 2414376 - RNA, 14 nt, Bordetella pertussis
cagcuugcgcgccu

SEQ ID NO: 2414377 - RNA, 15 nt, Bordetella pertussis
cagcuugcgcgccuu

SEQ ID NO: 2414378 - RNA, 19 nt, Bordetella pertussis
cagcuugcgcgccuuggcg

SEQ ID NO: 2414379 - RNA, 13 nt, Bordetella pertussis
cagcuugcgcugg

SEQ ID NO: 2414380 - RNA, 21 nt, Bordetella pertussis
cagcuugcgcuggcgcgcggc

SEQ ID NO: 2414381 - RNA, 20 nt, Bordetella pertussis
cagcuugcgucccaccugca

SEQ ID NO: 2414382 - RNA, 20 nt, Bordetella pertussis
cagcuuggccaccacgccca

SEQ ID NO: 2414383 - RNA, 12 nt, Bordetella pertussis
cagcuuggccag

SEQ ID NO: 2414384 - RNA, 15 nt, Bordetella pertussis
cagcuuggccaggcu

SEQ ID NO: 2414385 - RNA, 13 nt, Bordetella pertussis
cagcuuggcgcgc

SEQ ID NO: 2414386 - RNA, 15 nt, Bordetella pertussis
cagcuuggcgcgccg

SEQ ID NO: 2414387 - RNA, 21 nt, Bordetella pertussis
cagcuugggcauuucccagcc

SEQ ID NO: 2414388 - RNA, 23 nt, Bordetella pertussis
cagcuugggcuugauggccagcg

SEQ ID NO: 2414389 - RNA, 20 nt, Bordetella pertussis
cagcuuggucacggccucgg

SEQ ID NO: 2414390 - RNA, 14 nt, Bordetella pertussis
cagcuugucgacca

SEQ ID NO: 2414391 - RNA, 16 nt, Bordetella pertussis
cagcuugucgaucgcc

SEQ ID NO: 2414392 - RNA, 21 nt, Bordetella pertussis
cagcuugucgaucgccaccag

SEQ ID NO: 2414393 - RNA, 17 nt, Bordetella pertussis
cagcuugucggccgcgc

SEQ ID NO: 2414394 - RNA, 21 nt, Bordetella pertussis
caggaaaaucgauacgccggg

SEQ ID NO: 2414395 - RNA, 22 nt, Bordetella pertussis
caggaaaaucgauacgccgggc

SEQ ID NO: 2414396 - RNA, 23 nt, Bordetella pertussis
caggaaaaucgauacgccgggcg

SEQ ID NO: 2414397 - RNA, 17 nt, Bordetella pertussis
caggaaaccggcgacca

SEQ ID NO: 2414398 - RNA, 18 nt, Bordetella pertussis
caggaaagaggccaggcc

SEQ ID NO: 2414399 - RNA, 20 nt, Bordetella pertussis
caggcacccgggguuagagu

SEQ ID NO: 2414400 - RNA, 15 nt, Bordetella pertussis
caggcacccugcccc

SEQ ID NO: 2414401 - RNA, 16 nt, Bordetella pertussis
caggcacccugcccca

SEQ ID NO: 2414402 - RNA, 18 nt, Bordetella pertussis
caggcacccugucauacg

SEQ ID NO: 2414403 - RNA, 15 nt, Bordetella pertussis
caggcacccuugccg

SEQ ID NO: 2414404 - RNA, 20 nt, Bordetella pertussis
caggcacccuugccgcagcg

SEQ ID NO: 2414405 - RNA, 20 nt, Bordetella pertussis
caggcacccuugccgcagga

SEQ ID NO: 2414406 - RNA, 20 nt, Bordetella pertussis
caggcacccuugccgcgggu

SEQ ID NO: 2414407 - RNA, 22 nt, Bordetella pertussis
caggcacccuugcucagucggg

SEQ ID NO: 2414408 - RNA, 11 nt, Bordetella pertussis
caggcaccgaa

SEQ ID NO: 2414409 - RNA, 18 nt, Bordetella pertussis
caggcaccgaacgggcgu

SEQ ID NO: 2414410 - RNA, 19 nt, Bordetella pertussis
caggcaccgaauacgucag

SEQ ID NO: 2414411 - RNA, 14 nt, Bordetella pertussis
caggcaccgccgca

SEQ ID NO: 2414412 - RNA, 22 nt, Bordetella pertussis
caggcaccucguucaccccccg

SEQ ID NO: 2414413 - RNA, 21 nt, Bordetella pertussis
caggcaccugcgaccgagcca

SEQ ID NO: 2414414 - RNA, 21 nt, Bordetella pertussis
caggcaccugcggugucccuc

SEQ ID NO: 2414415 - RNA, 12 nt, Bordetella pertussis
caggcacgccgg

SEQ ID NO: 2414416 - RNA, 22 nt, Bordetella pertussis
caggcacuccggauaccgccgc

SEQ ID NO: 2414417 - RNA, 17 nt, Bordetella pertussis
caggcacuggcgcggcg

SEQ ID NO: 2414418 - RNA, 18 nt, Bordetella pertussis
caggcacuggcgcggcgc

SEQ ID NO: 2414419 - RNA, 19 nt, Bordetella pertussis
caggcacuggcgcggcgcu

SEQ ID NO: 2414420 - RNA, 20 nt, Bordetella pertussis
caggcagacgaugcccaggc

SEQ ID NO: 2414421 - RNA, 12 nt, Bordetella pertussis
caggcagcggcc

SEQ ID NO: 2414422 - RNA, 15 nt, Bordetella pertussis
caggcagcggccgcg

SEQ ID NO: 2414423 - RNA, 19 nt, Bordetella pertussis
caggcagcggccgcgcggg

SEQ ID NO: 2414424 - RNA, 18 nt, Bordetella pertussis
caggcagcugcgcgucga

SEQ ID NO: 2414425 - RNA, 12 nt, Bordetella pertussis
caggcaggcgcg

SEQ ID NO: 2414426 - RNA, 15 nt, Bordetella pertussis
caggcaggcgcgccg

SEQ ID NO: 2414427 - RNA, 16 nt, Bordetella pertussis
caggcaggcgcgccgg

SEQ ID NO: 2414428 - RNA, 13 nt, Bordetella pertussis
caggcaggcgggc

SEQ ID NO: 2414429 - RNA, 17 nt, Bordetella pertussis
caggcaggcgggcccgc

SEQ ID NO: 2414430 - RNA, 18 nt, Bordetella pertussis
caggcaguacgagcggcg

SEQ ID NO: 2414431 - RNA, 18 nt, Bordetella pertussis
caggcagugguggugcag

SEQ ID NO: 2414432 - RNA, 20 nt, Bordetella pertussis
caggcagugguggugcagcg

SEQ ID NO: 2414433 - RNA, 18 nt, Bordetella pertussis
caggcaguuggcggcgca

SEQ ID NO: 2414434 - RNA, 16 nt, Bordetella pertussis
caggcaucagguuugc

SEQ ID NO: 2414435 - RNA, 21 nt, Bordetella pertussis
caggcaucagguuugcgggug

SEQ ID NO: 2414436 - RNA, 15 nt, Bordetella pertussis
caggcaugcagcaug

SEQ ID NO: 2414437 - RNA, 19 nt, Bordetella pertussis
caggcauucccgcccagcg

SEQ ID NO: 2414438 - RNA, 21 nt, Bordetella pertussis
caggcauucgaacaacagcgc

SEQ ID NO: 2414439 - RNA, 19 nt, Bordetella pertussis
caggcauucgugaugcccc

SEQ ID NO: 2414440 - RNA, 16 nt, Bordetella pertussis
caggcauugcgccagc

SEQ ID NO: 2414441 - RNA, 23 nt, Bordetella pertussis
caggcauugcgccagccguugcg

SEQ ID NO: 2414442 - RNA, 22 nt, Bordetella pertussis
caggccaacgggauccggcagc

SEQ ID NO: 2414443 - RNA, 22 nt, Bordetella pertussis
caggccaccgacggcgcggcga

SEQ ID NO: 2414444 - RNA, 22 nt, Bordetella pertussis
caggccacguugauccagcgcu

SEQ ID NO: 2414445 - RNA, 24 nt, Bordetella pertussis
caggccacguugauccagcgcucg

SEQ ID NO: 2414446 - RNA, 15 nt, Bordetella pertussis
caggccagcauggcc

SEQ ID NO: 2414447 - RNA, 15 nt, Bordetella pertussis
caggccagcccgcgc

SEQ ID NO: 2414448 - RNA, 20 nt, Bordetella pertussis
caggccagcccgcgcgcguu

SEQ ID NO: 2414449 - RNA, 16 nt, Bordetella pertussis
caggccagcgccagaa

SEQ ID NO: 2414450 - RNA, 13 nt, Bordetella pertussis
caggccagcgccg

SEQ ID NO: 2414451 - RNA, 14 nt, Bordetella pertussis
caggccagcgccgc

SEQ ID NO: 2414452 - RNA, 14 nt, Bordetella pertussis
caggccagcugcgc

SEQ ID NO: 2414453 - RNA, 15 nt, Bordetella pertussis
caggccagcugcgcc

SEQ ID NO: 2414454 - RNA, 16 nt, Bordetella pertussis
caggccagcugcgccc

SEQ ID NO: 2414455 - RNA, 13 nt, Bordetella pertussis
caggccaggaagc

SEQ ID NO: 2414456 - RNA, 16 nt, Bordetella pertussis
caggccaggaagcggc

SEQ ID NO: 2414457 - RNA, 19 nt, Bordetella pertussis
caggccaggaagcggcgca

SEQ ID NO: 2414458 - RNA, 21 nt, Bordetella pertussis
caggccaggaagcggcgcacc

SEQ ID NO: 2414459 - RNA, 13 nt, Bordetella pertussis
caggccaggcuca

SEQ ID NO: 2414460 - RNA, 14 nt, Bordetella pertussis
caggccaggcucag

SEQ ID NO: 2414461 - RNA, 15 nt, Bordetella pertussis
caggccaggcucagc

SEQ ID NO: 2414462 - RNA, 23 nt, Bordetella pertussis
caggccaggcucagcagggucga

SEQ ID NO: 2414463 - RNA, 16 nt, Bordetella pertussis
caggccagugauggcc

SEQ ID NO: 2414464 - RNA, 15 nt, Bordetella pertussis
caggccagugccugg

SEQ ID NO: 2414465 - RNA, 16 nt, Bordetella pertussis
caggccagugccugga

SEQ ID NO: 2414466 - RNA, 18 nt, Bordetella pertussis
caggccagugccuggacg

SEQ ID NO: 2414467 - RNA, 20 nt, Bordetella pertussis
caggccaucgccgccgccgg

SEQ ID NO: 2414468 - RNA, 22 nt, Bordetella pertussis
caggccaucgccgccgccgggc

SEQ ID NO: 2414469 - RNA, 14 nt, Bordetella pertussis
caggccaucggcgc

SEQ ID NO: 2414470 - RNA, 16 nt, Bordetella pertussis
caggccaucggcgcca

SEQ ID NO: 2414471 - RNA, 15 nt, Bordetella pertussis
caggccaugcugggc

SEQ ID NO: 2414472 - RNA, 20 nt, Bordetella pertussis
caggccaugcugggccauca

SEQ ID NO: 2414473 - RNA, 19 nt, Bordetella pertussis
caggccauugcuggcgcga

SEQ ID NO: 2414474 - RNA, 19 nt, Bordetella pertussis
caggcccacaaugccccac

SEQ ID NO: 2414475 - RNA, 12 nt, Bordetella pertussis
caggcccaccag

SEQ ID NO: 2414476 - RNA, 14 nt, Bordetella pertussis
caggcccaccaggg

SEQ ID NO: 2414477 - RNA, 15 nt, Bordetella pertussis
caggcccaccagggc

SEQ ID NO: 2414478 - RNA, 17 nt, Bordetella pertussis
caggcccaccagggcca

SEQ ID NO: 2414479 - RNA, 20 nt, Bordetella pertussis
caggcccaccagggccagcu

SEQ ID NO: 2414480 - RNA, 19 nt, Bordetella pertussis
caggcccaccgcaucgcgc

SEQ ID NO: 2414481 - RNA, 16 nt, Bordetella pertussis
caggcccaccggcaug

SEQ ID NO: 2414482 - RNA, 22 nt, Bordetella pertussis
caggcccaccggcaugccgucc

SEQ ID NO: 2414483 - RNA, 11 nt, Bordetella pertussis
caggcccacga

SEQ ID NO: 2414484 - RNA, 16 nt, Bordetella pertussis
caggcccacgaugcgg

SEQ ID NO: 2414485 - RNA, 13 nt, Bordetella pertussis
caggcccacggca

SEQ ID NO: 2414486 - RNA, 11 nt, Bordetella pertussis
caggcccagca

SEQ ID NO: 2414487 - RNA, 12 nt, Bordetella pertussis
caggcccagcac

SEQ ID NO: 2414488 - RNA, 22 nt, Bordetella pertussis
caggcccagcacgcgcgccagc

SEQ ID NO: 2414489 - RNA, 22 nt, Bordetella pertussis
caggcccagcaucaggcccgac

SEQ ID NO: 2414490 - RNA, 13 nt, Bordetella pertussis
caggcccagccag

SEQ ID NO: 2414491 - RNA, 17 nt, Bordetella pertussis
caggcccagccagcccu

SEQ ID NO: 2414492 - RNA, 22 nt, Bordetella pertussis
caggcccagccagcccuggccc

SEQ ID NO: 2414493 - RNA, 14 nt, Bordetella pertussis
caggcccagcccgc

SEQ ID NO: 2414494 - RNA, 15 nt, Bordetella pertussis
caggcccagcccgcc

SEQ ID NO: 2414495 - RNA, 17 nt, Bordetella pertussis
caggcccagcccgccga

SEQ ID NO: 2414496 - RNA, 15 nt, Bordetella pertussis
caggcccagcgccag

SEQ ID NO: 2414497 - RNA, 13 nt, Bordetella pertussis
caggcccagcgcg

SEQ ID NO: 2414498 - RNA, 15 nt, Bordetella pertussis
caggcccagcgcgcc

SEQ ID NO: 2414499 - RNA, 14 nt, Bordetella pertussis
caggcccagcuuga

SEQ ID NO: 2414500 - RNA, 13 nt, Bordetella pertussis
caggcccaggcga

SEQ ID NO: 2414501 - RNA, 13 nt, Bordetella pertussis
caggcccagggcg

SEQ ID NO: 2414502 - RNA, 20 nt, Bordetella pertussis
caggcccaguacggccugca

SEQ ID NO: 2414503 - RNA, 18 nt, Bordetella pertussis
caggcccaguucggcgcg

SEQ ID NO: 2414504 - RNA, 19 nt, Bordetella pertussis
caggcccauaugccgccgg

SEQ ID NO: 2414505 - RNA, 23 nt, Bordetella pertussis
caggcccauaugccgccggccug

SEQ ID NO: 2414506 - RNA, 19 nt, Bordetella pertussis
caggcccaugacgaccuug

SEQ ID NO: 2414507 - RNA, 21 nt, Bordetella pertussis
caggcccaugacgaccuugcg

SEQ ID NO: 2414508 - RNA, 23 nt, Bordetella pertussis
caggcccaugacgaccuugcggc

SEQ ID NO: 2414509 - RNA, 18 nt, Bordetella pertussis
caggcccaugacgccggu

SEQ ID NO: 2414510 - RNA, 17 nt, Bordetella pertussis
caggcccaugauccgca

SEQ ID NO: 2414511 - RNA, 16 nt, Bordetella pertussis
caggcccaugccgccc

SEQ ID NO: 2414512 - RNA, 14 nt, Bordetella pertussis
caggccggccugca

SEQ ID NO: 2414513 - RNA, 15 nt, Bordetella pertussis
caggccggccugcaa

SEQ ID NO: 2414514 - RNA, 23 nt, Bordetella pertussis
caggccggccugcaaugcggcca

SEQ ID NO: 2414515 - RNA, 18 nt, Bordetella pertussis
caggccggccugcaggcu

SEQ ID NO: 2414516 - RNA, 15 nt, Bordetella pertussis
caggccggccugggg

SEQ ID NO: 2414517 - RNA, 14 nt, Bordetella pertussis
caggccggccuugg

SEQ ID NO: 2414518 - RNA, 18 nt, Bordetella pertussis
caggccggccuuggccau

SEQ ID NO: 2414519 - RNA, 23 nt, Bordetella pertussis
caggccggccuuggccauguccu

SEQ ID NO: 2414520 - RNA, 15 nt, Bordetella pertussis
caggccggcgccugg

SEQ ID NO: 2414521 - RNA, 18 nt, Bordetella pertussis
caggccggcgccuggggc

SEQ ID NO: 2414522 - RNA, 13 nt, Bordetella pertussis
caggccggcgcgc

SEQ ID NO: 2414523 - RNA, 15 nt, Bordetella pertussis
caggccggcgcgccg

SEQ ID NO: 2414524 - RNA, 17 nt, Bordetella pertussis
caggccggcgcgccggc

SEQ ID NO: 2414525 - RNA, 18 nt, Bordetella pertussis
caggccggcgcgccggcc

SEQ ID NO: 2414526 - RNA, 14 nt, Bordetella pertussis
caggccggcgcgcu

SEQ ID NO: 2414527 - RNA, 20 nt, Bordetella pertussis
caggccggcgcgcucggccu

SEQ ID NO: 2414528 - RNA, 14 nt, Bordetella pertussis
caggccggcggcca

SEQ ID NO: 2414529 - RNA, 20 nt, Bordetella pertussis
caggccggcggccagcgcgc

SEQ ID NO: 2414530 - RNA, 21 nt, Bordetella pertussis
caggccggcggccagcgcgcc

SEQ ID NO: 2414531 - RNA, 14 nt, Bordetella pertussis
caggccggcucgcc

SEQ ID NO: 2414532 - RNA, 13 nt, Bordetella pertussis
caggccgggcagc

SEQ ID NO: 2414533 - RNA, 17 nt, Bordetella pertussis
caggccgggcagcgaga

SEQ ID NO: 2414534 - RNA, 20 nt, Bordetella pertussis
caggccgggcagcgagaugg

SEQ ID NO: 2414535 - RNA, 17 nt, Bordetella pertussis
caggccgggcgagccga

SEQ ID NO: 2414536 - RNA, 19 nt, Bordetella pertussis
caggccggggaaacggcca

SEQ ID NO: 2414537 - RNA, 22 nt, Bordetella pertussis
caggccggggaaacggccaagc

SEQ ID NO: 2414538 - RNA, 23 nt, Bordetella pertussis
caggccggggaaacggccaagca

SEQ ID NO: 2414539 - RNA, 15 nt, Bordetella pertussis
caggccggggccgcc

SEQ ID NO: 2414540 - RNA, 16 nt, Bordetella pertussis
caggccggggccgccc

SEQ ID NO: 2414541 - RNA, 19 nt, Bordetella pertussis
caggccggggccgcccagc

SEQ ID NO: 2414542 - RNA, 20 nt, Bordetella pertussis
caggccggggccgcccagca

SEQ ID NO: 2414543 - RNA, 16 nt, Bordetella pertussis
caggccggggccgugg

SEQ ID NO: 2414544 - RNA, 16 nt, Bordetella pertussis
caggccgggucguucg

SEQ ID NO: 2414545 - RNA, 22 nt, Bordetella pertussis
caggccgggucguucgaacugg

SEQ ID NO: 2414546 - RNA, 14 nt, Bordetella pertussis
caggccggucagga

SEQ ID NO: 2414547 - RNA, 14 nt, Bordetella pertussis
caggccggugcgca

SEQ ID NO: 2414548 - RNA, 18 nt, Bordetella pertussis
caggccgguggaccaggg

SEQ ID NO: 2414549 - RNA, 23 nt, Bordetella pertussis
caggccgguggaccagggcacgg

SEQ ID NO: 2414550 - RNA, 23 nt, Bordetella pertussis
caggccggugggcgagaggggcu

SEQ ID NO: 2414551 - RNA, 17 nt, Bordetella pertussis
caggccguaaccggcca

SEQ ID NO: 2414552 - RNA, 20 nt, Bordetella pertussis
caggccguaaccggccaguc

SEQ ID NO: 2414553 - RNA, 22 nt, Bordetella pertussis
caggccguaaccggccaguccc

SEQ ID NO: 2414554 - RNA, 23 nt, Bordetella pertussis
caggccguaaccggccaguccca

SEQ ID NO: 2414555 - RNA, 16 nt, Bordetella pertussis
caggccgucgagccgg

SEQ ID NO: 2414556 - RNA, 18 nt, Bordetella pertussis
caggccgucgagccgggc

SEQ ID NO: 2414557 - RNA, 19 nt, Bordetella pertussis
caggccgucgagccgggcg

SEQ ID NO: 2414558 - RNA, 17 nt, Bordetella pertussis
caggccgucgauuucgg

SEQ ID NO: 2414559 - RNA, 14 nt, Bordetella pertussis
caggccgucggcca

SEQ ID NO: 2414560 - RNA, 12 nt, Bordetella pertussis
caggccgugagc

SEQ ID NO: 2414561 - RNA, 18 nt, Bordetella pertussis
caggccgugagcgccgcc

SEQ ID NO: 2414562 - RNA, 20 nt, Bordetella pertussis
caggccgugagcgccgccgc

SEQ ID NO: 2414563 - RNA, 22 nt, Bordetella pertussis
caggccgugagcgccgccgcca

SEQ ID NO: 2414564 - RNA, 16 nt, Bordetella pertussis
caggccguggcccagc

SEQ ID NO: 2414565 - RNA, 14 nt, Bordetella pertussis
caggccguggcgca

SEQ ID NO: 2414566 - RNA, 20 nt, Bordetella pertussis
caggccguuccaguccagcg

SEQ ID NO: 2414567 - RNA, 17 nt, Bordetella pertussis
caggccguuggccgcgc

SEQ ID NO: 2414568 - RNA, 18 nt, Bordetella pertussis
caggccguuggccgcgcg

SEQ ID NO: 2414569 - RNA, 22 nt, Bordetella pertussis
caggccguuggccgcgcgguac

SEQ ID NO: 2414570 - RNA, 18 nt, Bordetella pertussis
caggccguuggcgcgccu

SEQ ID NO: 2414571 - RNA, 19 nt, Bordetella pertussis
caggccguuggcgcgccuu

SEQ ID NO: 2414572 - RNA, 22 nt, Bordetella pertussis
caggccguuggcgcgccuugcg

SEQ ID NO: 2414573 - RNA, 18 nt, Bordetella pertussis
caggccguuguccuggcg

SEQ ID NO: 2414574 - RNA, 19 nt, Bordetella pertussis
caggccguuguccuggcgc

SEQ ID NO: 2414575 - RNA, 21 nt, Bordetella pertussis
caggccguuguccuggcgcgc

SEQ ID NO: 2414576 - RNA, 19 nt, Bordetella pertussis
caggccucgcccgaucggc

SEQ ID NO: 2414577 - RNA, 22 nt, Bordetella pertussis
caggccucgcccgaucggccgg

SEQ ID NO: 2414578 - RNA, 17 nt, Bordetella pertussis
caggccucggucgccuc

SEQ ID NO: 2414579 - RNA, 19 nt, Bordetella pertussis
caggccucggucgccucga

SEQ ID NO: 2414580 - RNA, 16 nt, Bordetella pertussis
caggccugcacguccc

SEQ ID NO: 2414581 - RNA, 14 nt, Bordetella pertussis
caggccugccugau

SEQ ID NO: 2414582 - RNA, 16 nt, Bordetella pertussis
caggccugccugaugg

SEQ ID NO: 2414583 - RNA, 17 nt, Bordetella pertussis
caggccugccugauggc

SEQ ID NO: 2414584 - RNA, 14 nt, Bordetella pertussis
caggccugcggcgc

SEQ ID NO: 2414585 - RNA, 15 nt, Bordetella pertussis
caggccugcggcgcc

SEQ ID NO: 2414586 - RNA, 17 nt, Bordetella pertussis
caggccugcggcgccag

SEQ ID NO: 2414587 - RNA, 15 nt, Bordetella pertussis
caggccugcugcagc

SEQ ID NO: 2414588 - RNA, 23 nt, Bordetella pertussis
caggccuggcuuggcggccagga

SEQ ID NO: 2414589 - RNA, 17 nt, Bordetella pertussis
caggccuggucgagcgg

SEQ ID NO: 2414590 - RNA, 20 nt, Bordetella pertussis
caggccuuucucaaggccga

SEQ ID NO: 2414591 - RNA, 21 nt, Bordetella pertussis
caggccuuucucaaggccgaa

SEQ ID NO: 2414592 - RNA, 15 nt, Bordetella pertussis
caggcgaaacgccag

SEQ ID NO: 2414593 - RNA, 16 nt, Bordetella pertussis
caggcgaaacgccagc

SEQ ID NO: 2414594 - RNA, 21 nt, Bordetella pertussis
caggcgaaacgccagcccgac

SEQ ID NO: 2414595 - RNA, 14 nt, Bordetella pertussis
caggcgacccagca

SEQ ID NO: 2414596 - RNA, 15 nt, Bordetella pertussis
caggcgagcgccgcg

SEQ ID NO: 2414597 - RNA, 16 nt, Bordetella pertussis
caggcgagcgccgcgc

SEQ ID NO: 2414598 - RNA, 20 nt, Bordetella pertussis
caggcgagcgccgcgcucca

SEQ ID NO: 2414599 - RNA, 14 nt, Bordetella pertussis
caggcgagcgcggc

SEQ ID NO: 2414600 - RNA, 15 nt, Bordetella pertussis
caggcgagcggcguc

SEQ ID NO: 2414601 - RNA, 23 nt, Bordetella pertussis
caggcgagcggcgucgcguccuu

SEQ ID NO: 2414602 - RNA, 17 nt, Bordetella pertussis
caggcgaggcuggcgcc

SEQ ID NO: 2414603 - RNA, 14 nt, Bordetella pertussis
caggcgaugcccag

SEQ ID NO: 2414604 - RNA, 19 nt, Bordetella pertussis
caggcgaugcccagcgccg

SEQ ID NO: 2414605 - RNA, 20 nt, Bordetella pertussis
caggcgaugcccagcgccgc

SEQ ID NO: 2414606 - RNA, 14 nt, Bordetella pertussis
caggcgcaccagcg

SEQ ID NO: 2414607 - RNA, 18 nt, Bordetella pertussis
caggcgcaccagcgcgcc

SEQ ID NO: 2414608 - RNA, 20 nt, Bordetella pertussis
caggcgcaccagcgcgccga

SEQ ID NO: 2414609 - RNA, 21 nt, Bordetella pertussis
caggcgcaccagcgcgccgau

SEQ ID NO: 2414610 - RNA, 14 nt, Bordetella pertussis
caggcgcacgccgc

SEQ ID NO: 2414611 - RNA, 13 nt, Bordetella pertussis
caggcgcacggcg

SEQ ID NO: 2414612 - RNA, 18 nt, Bordetella pertussis
caggcgcagcggcggcgc

SEQ ID NO: 2414613 - RNA, 14 nt, Bordetella pertussis
caggcgcagcucga

SEQ ID NO: 2414614 - RNA, 15 nt, Bordetella pertussis
caggcgcaggccgcg

SEQ ID NO: 2414615 - RNA, 16 nt, Bordetella pertussis
caggcgcaggccgcgc

SEQ ID NO: 2414616 - RNA, 17 nt, Bordetella pertussis
caggcgcaggccgcgcg

SEQ ID NO: 2414617 - RNA, 19 nt, Bordetella pertussis
caggcgcaggccgcgcgca

SEQ ID NO: 2414618 - RNA, 15 nt, Bordetella pertussis
caggcgcaggcgcga

SEQ ID NO: 2414619 - RNA, 19 nt, Bordetella pertussis
caggcgcaguaucuggugc

SEQ ID NO: 2414620 - RNA, 21 nt, Bordetella pertussis
caggcgcauauggagccaggc

SEQ ID NO: 2414621 - RNA, 22 nt, Bordetella pertussis
caggcgcauauggagccaggcg

SEQ ID NO: 2414622 - RNA, 23 nt, Bordetella pertussis
caggcgcauauggagccaggcgg

SEQ ID NO: 2414623 - RNA, 20 nt, Bordetella pertussis
caggcgcaucagcuuggcca

SEQ ID NO: 2414624 - RNA, 18 nt, Bordetella pertussis
caggcggcuuucaugggc

SEQ ID NO: 2414625 - RNA, 17 nt, Bordetella pertussis
caggcgggccaggccgg

SEQ ID NO: 2414626 - RNA, 13 nt, Bordetella pertussis
caggcgggcccgc

SEQ ID NO: 2414627 - RNA, 14 nt, Bordetella pertussis
caggcgggcccgca

SEQ ID NO: 2414628 - RNA, 18 nt, Bordetella pertussis
caggcgggcccgcaucgc

SEQ ID NO: 2414629 - RNA, 13 nt, Bordetella pertussis
caggcgggcgccg

SEQ ID NO: 2414630 - RNA, 23 nt, Bordetella pertussis
caggcggguguagaagaacagca

SEQ ID NO: 2414631 - RNA, 16 nt, Bordetella pertussis
caggcgguacaggccg

SEQ ID NO: 2414632 - RNA, 21 nt, Bordetella pertussis
caggcgguacaggccggcggc

SEQ ID NO: 2414633 - RNA, 17 nt, Bordetella pertussis
caggcggucgaggcgca

SEQ ID NO: 2414634 - RNA, 17 nt, Bordetella pertussis
caggcggugccccggcc

SEQ ID NO: 2414635 - RNA, 20 nt, Bordetella pertussis
caggcggugccccggccucg

SEQ ID NO: 2414636 - RNA, 17 nt, Bordetella pertussis
caggcggugcgcgcggc

SEQ ID NO: 2414637 - RNA, 20 nt, Bordetella pertussis
caggcggugcgcgcggccga

SEQ ID NO: 2414638 - RNA, 20 nt, Bordetella pertussis
caggcggugcguccaggacg

SEQ ID NO: 2414639 - RNA, 22 nt, Bordetella pertussis
caggcgguggccucguccacgu

SEQ ID NO: 2414640 - RNA, 15 nt, Bordetella pertussis
caggcgguuggccuu

SEQ ID NO: 2414641 - RNA, 19 nt, Bordetella pertussis
caggcgguuggccuugacg

SEQ ID NO: 2414642 - RNA, 17 nt, Bordetella pertussis
caggcgucggccagcgc

SEQ ID NO: 2414643 - RNA, 18 nt, Bordetella pertussis
caggcgucggccagcgcg

SEQ ID NO: 2414644 - RNA, 22 nt, Bordetella pertussis
caggcgucggcggcccacagcg

SEQ ID NO: 2414645 - RNA, 22 nt, Bordetella pertussis
caggcgucugcuacaccgugcu

SEQ ID NO: 2414646 - RNA, 21 nt, Bordetella pertussis
caggcgugaacgccccggccg

SEQ ID NO: 2414647 - RNA, 12 nt, Bordetella pertussis
caggcgugcgca

SEQ ID NO: 2414648 - RNA, 15 nt, Bordetella pertussis
caggcgugcgcagcu

SEQ ID NO: 2414649 - RNA, 18 nt, Bordetella pertussis
caggcgugcgcgggcgcc

SEQ ID NO: 2414650 - RNA, 15 nt, Bordetella pertussis
caggcguucgcacca

SEQ ID NO: 2414651 - RNA, 19 nt, Bordetella pertussis
caggcguugaccuggucga

SEQ ID NO: 2414652 - RNA, 16 nt, Bordetella pertussis
caggcguugcgccgca

SEQ ID NO: 2414653 - RNA, 22 nt, Bordetella pertussis
caggcguugcgccgcaacgccg

SEQ ID NO: 2414654 - RNA, 21 nt, Bordetella pertussis
caggcuaugcaggcuuugcug

SEQ ID NO: 2414655 - RNA, 14 nt, Bordetella pertussis
caggcucacgccua

SEQ ID NO: 2414656 - RNA, 15 nt, Bordetella pertussis
caggcucagcccggc

SEQ ID NO: 2414657 - RNA, 19 nt, Bordetella pertussis
caggcucaggcggccaggg

SEQ ID NO: 2414658 - RNA, 22 nt, Bordetella pertussis
caggcucaggcggccagggccu

SEQ ID NO: 2414659 - RNA, 14 nt, Bordetella pertussis
caggcuccacagcc

SEQ ID NO: 2414660 - RNA, 22 nt, Bordetella pertussis
caggcuccaguggugcucccag

SEQ ID NO: 2414661 - RNA, 23 nt, Bordetella pertussis
caggcuccaguggugcucccagg

SEQ ID NO: 2414662 - RNA, 18 nt, Bordetella pertussis
caggcuccgagggacacc

SEQ ID NO: 2414663 - RNA, 23 nt, Bordetella pertussis
caggcucuuuuucgagccgcaga

SEQ ID NO: 2414664 - RNA, 14 nt, Bordetella pertussis
caggcugaccagcg

SEQ ID NO: 2414665 - RNA, 15 nt, Bordetella pertussis
caggcugaccagcgc

SEQ ID NO: 2414666 - RNA, 22 nt, Bordetella pertussis
caggcugaucacccacagcagc

SEQ ID NO: 2414667 - RNA, 17 nt, Bordetella pertussis
caggcugcccuggccca

SEQ ID NO: 2414668 - RNA, 15 nt, Bordetella pertussis
caggcugccgccggc

SEQ ID NO: 2414669 - RNA, 14 nt, Bordetella pertussis
caggcugccggcgu

SEQ ID NO: 2414670 - RNA, 14 nt, Bordetella pertussis
caggcugccgucgg

SEQ ID NO: 2414671 - RNA, 16 nt, Bordetella pertussis
caggcugccgucggcc

SEQ ID NO: 2414672 - RNA, 17 nt, Bordetella pertussis
caggcugccgucggcca

SEQ ID NO: 2414673 - RNA, 20 nt, Bordetella pertussis
caggcugccgucggccagcu

SEQ ID NO: 2414674 - RNA, 22 nt, Bordetella pertussis
caggcugccgucgucguccagg

SEQ ID NO: 2414675 - RNA, 17 nt, Bordetella pertussis
caggcugcgcaggcgcc

SEQ ID NO: 2414676 - RNA, 19 nt, Bordetella pertussis
caggcugcgcgccggcgcc

SEQ ID NO: 2414677 - RNA, 14 nt, Bordetella pertussis
caggcugcggcgga

SEQ ID NO: 2414678 - RNA, 19 nt, Bordetella pertussis
caggcuggaagucagccgg

SEQ ID NO: 2414679 - RNA, 22 nt, Bordetella pertussis
caggcuggaagucagccggugc

SEQ ID NO: 2414680 - RNA, 17 nt, Bordetella pertussis
caggcuggccugcaggu

SEQ ID NO: 2414681 - RNA, 20 nt, Bordetella pertussis
caggcuggccugcaggucgu

SEQ ID NO: 2414682 - RNA, 19 nt, Bordetella pertussis
caggcugggagagccggcc

SEQ ID NO: 2414683 - RNA, 21 nt, Bordetella pertussis
caggcugggagagccggccac

SEQ ID NO: 2414684 - RNA, 15 nt, Bordetella pertussis
caggcugggcgaaac

SEQ ID NO: 2414685 - RNA, 20 nt, Bordetella pertussis
caggcugggcgaaacggcca

SEQ ID NO: 2414686 - RNA, 21 nt, Bordetella pertussis
caggcugggcgaaacggccag

SEQ ID NO: 2414687 - RNA, 22 nt, Bordetella pertussis
caggcugggcgaaacggccagc

SEQ ID NO: 2414688 - RNA, 23 nt, Bordetella pertussis
caggcugggcgaaacggccagcg

SEQ ID NO: 2414689 - RNA, 17 nt, Bordetella pertussis
caggcugucccagaugg

SEQ ID NO: 2414690 - RNA, 23 nt, Bordetella pertussis
caggcugucccagauggcgccuu

SEQ ID NO: 2414691 - RNA, 20 nt, Bordetella pertussis
caggcugucgucgucggcac

SEQ ID NO: 2414692 - RNA, 19 nt, Bordetella pertussis
caggcuguggccgcggccc

SEQ ID NO: 2414693 - RNA, 23 nt, Bordetella pertussis
caggcuguggccgcggcccagcg

SEQ ID NO: 2414694 - RNA, 18 nt, Bordetella pertussis
caggcuuucgaagccgcc

SEQ ID NO: 2414695 - RNA, 21 nt, Bordetella pertussis
caggcuuucgaagccgcccca

SEQ ID NO: 2414696 - RNA, 19 nt, Bordetella pertussis
caggcuuucgcacagccgg

SEQ ID NO: 2414697 - RNA, 22 nt, Bordetella pertussis
caggcuuucgcacagccggggc

SEQ ID NO: 2414698 - RNA, 17 nt, Bordetella pertussis
caggcuuugcgcgccau

SEQ ID NO: 2414699 - RNA, 22 nt, Bordetella pertussis
caggcuuugcuggccauagggc

SEQ ID NO: 2414700 - RNA, 18 nt, Bordetella pertussis
cagggacaggcaccccgg

SEQ ID NO: 2414701 - RNA, 13 nt, Bordetella pertussis
cagggacgggcca

SEQ ID NO: 2414702 - RNA, 18 nt, Bordetella pertussis
cagggagccguucuggca

SEQ ID NO: 2414703 - RNA, 21 nt, Bordetella pertussis
cagggagccguucuggcagug

SEQ ID NO: 2414704 - RNA, 16 nt, Bordetella pertussis
cagggaggaacugggc

SEQ ID NO: 2414705 - RNA, 23 nt, Bordetella pertussis
cagggaggaacugggcgccggcc

SEQ ID NO: 2414706 - RNA, 17 nt, Bordetella pertussis
cagggaggcuguccccg

SEQ ID NO: 2414707 - RNA, 21 nt, Bordetella pertussis
cagggaggcuguccccgcaug

SEQ ID NO: 2414708 - RNA, 22 nt, Bordetella pertussis
cagggcaaagaaauugggcgug

SEQ ID NO: 2414709 - RNA, 17 nt, Bordetella pertussis
cagggcagcggccagau

SEQ ID NO: 2414710 - RNA, 19 nt, Bordetella pertussis
cagggcaugggcccgggcg

SEQ ID NO: 2414711 - RNA, 15 nt, Bordetella pertussis
cagggccaccacgcc

SEQ ID NO: 2414712 - RNA, 17 nt, Bordetella pertussis
cagggccaccacgccga

SEQ ID NO: 2414713 - RNA, 24 nt, Bordetella pertussis
cagggccacgcccacgcgccgcca

SEQ ID NO: 2414714 - RNA, 17 nt, Bordetella pertussis
cagggccacgcccaggc

SEQ ID NO: 2414715 - RNA, 19 nt, Bordetella pertussis
cagggccacgcccaggccg

SEQ ID NO: 2414716 - RNA, 18 nt, Bordetella pertussis
cagggccacgccggccgc

SEQ ID NO: 2414717 - RNA, 20 nt, Bordetella pertussis
cagggccagcuugacgucca

SEQ ID NO: 2414718 - RNA, 19 nt, Bordetella pertussis
cagggccaggcccacggcg

SEQ ID NO: 2414719 - RNA, 13 nt, Bordetella pertussis
cagggccaggccg

SEQ ID NO: 2414720 - RNA, 14 nt, Bordetella pertussis
cagggccaggccga

SEQ ID NO: 2414721 - RNA, 14 nt, Bordetella pertussis
cagggccaggccgc

SEQ ID NO: 2414722 - RNA, 19 nt, Bordetella pertussis
cagggccauguggcgcagc

SEQ ID NO: 2414723 - RNA, 20 nt, Bordetella pertussis
cagggccauucucaauagcg

SEQ ID NO: 2414724 - RNA, 18 nt, Bordetella pertussis
cagggccccuccggcgcc

SEQ ID NO: 2414725 - RNA, 17 nt, Bordetella pertussis
cagggcccgcaucggcg

SEQ ID NO: 2414726 - RNA, 22 nt, Bordetella pertussis
cagggcccggacgcggccggca

SEQ ID NO: 2414727 - RNA, 15 nt, Bordetella pertussis
cagggccgcagcaau

SEQ ID NO: 2414728 - RNA, 16 nt, Bordetella pertussis
cagggccgcagcaccu

SEQ ID NO: 2414729 - RNA, 11 nt, Bordetella pertussis
cagggccgcca

SEQ ID NO: 2414730 - RNA, 12 nt, Bordetella pertussis
cagggccgccag

SEQ ID NO: 2414731 - RNA, 13 nt, Bordetella pertussis
cagggccgcccag

SEQ ID NO: 2414732 - RNA, 14 nt, Bordetella pertussis
cagggccgcccagu

SEQ ID NO: 2414733 - RNA, 20 nt, Bordetella pertussis
cagggccgcccagucgucca

SEQ ID NO: 2414734 - RNA, 17 nt, Bordetella pertussis
cagggccgccgcgccca

SEQ ID NO: 2414735 - RNA, 21 nt, Bordetella pertussis
cagggccgccgcgcccagccg

SEQ ID NO: 2414736 - RNA, 20 nt, Bordetella pertussis
caggguuuuauacggcgcga

SEQ ID NO: 2414737 - RNA, 21 nt, Bordetella pertussis
cagguacacgcuuugcgucuc

SEQ ID NO: 2414738 - RNA, 17 nt, Bordetella pertussis
cagguacaggccgccgg

SEQ ID NO: 2414739 - RNA, 19 nt, Bordetella pertussis
cagguacaucauccccagc

SEQ ID NO: 2414740 - RNA, 23 nt, Bordetella pertussis
cagguacaucauccccagcgccg

SEQ ID NO: 2414741 - RNA, 17 nt, Bordetella pertussis
cagguacccccagcggc

SEQ ID NO: 2414742 - RNA, 20 nt, Bordetella pertussis
cagguacccccagcggcgca

SEQ ID NO: 2414743 - RNA, 13 nt, Bordetella pertussis
cagguacccggcu

SEQ ID NO: 2414744 - RNA, 22 nt, Bordetella pertussis
cagguacccggcuucuggguca

SEQ ID NO: 2414745 - RNA, 15 nt, Bordetella pertussis
cagguagaccacgcg

SEQ ID NO: 2414746 - RNA, 17 nt, Bordetella pertussis
cagguagcggguggccg

SEQ ID NO: 2414747 - RNA, 17 nt, Bordetella pertussis
cagguagcggucgccgc

SEQ ID NO: 2414748 - RNA, 15 nt, Bordetella pertussis
cagguaggacggcgc

SEQ ID NO: 2414749 - RNA, 17 nt, Bordetella pertussis
cagguaggccggcgcga

SEQ ID NO: 2414750 - RNA, 15 nt, Bordetella pertussis
cagguaggcgccggu

SEQ ID NO: 2414751 - RNA, 18 nt, Bordetella pertussis
cagguaggcggcgcgccc

SEQ ID NO: 2414752 - RNA, 20 nt, Bordetella pertussis
cagguaguagccgaauccgg

SEQ ID NO: 2414753 - RNA, 23 nt, Bordetella pertussis
cagguagucguucugggagcgcg

SEQ ID NO: 2414754 - RNA, 15 nt, Bordetella pertussis
cagguaucgacccag

SEQ ID NO: 2414755 - RNA, 15 nt, Bordetella pertussis
cagguaucggccagc

SEQ ID NO: 2414756 - RNA, 21 nt, Bordetella pertussis
cagguauugcucggcggucag

SEQ ID NO: 2414757 - RNA, 15 nt, Bordetella pertussis
caggucacgacgggu

SEQ ID NO: 2414758 - RNA, 13 nt, Bordetella pertussis
caggucaucgcca

SEQ ID NO: 2414759 - RNA, 14 nt, Bordetella pertussis
caggucaucgccag

SEQ ID NO: 2414760 - RNA, 23 nt, Bordetella pertussis
caggucaucgccaggcgcgugca

SEQ ID NO: 2414761 - RNA, 22 nt, Bordetella pertussis
cagguccacauccgcgcugcug

SEQ ID NO: 2414762 - RNA, 17 nt, Bordetella pertussis
cagguccacuucaccgc

SEQ ID NO: 2414763 - RNA, 13 nt, Bordetella pertussis
cagguccaggccu

SEQ ID NO: 2414764 - RNA, 22 nt, Bordetella pertussis
cagguccaugaacgccgcgccc

SEQ ID NO: 2414765 - RNA, 23 nt, Bordetella pertussis
cagguccaugaacgccgcgcccg

SEQ ID NO: 2414766 - RNA, 14 nt, Bordetella pertussis
cagguccauggcca

SEQ ID NO: 2414767 - RNA, 15 nt, Bordetella pertussis
cagguccauggccag

SEQ ID NO: 2414768 - RNA, 20 nt, Bordetella pertussis
cagguccgaaccgaccgcca

SEQ ID NO: 2414769 - RNA, 14 nt, Bordetella pertussis
cagguccgccggca

SEQ ID NO: 2414770 - RNA, 23 nt, Bordetella pertussis
cagguccguguucgacgcggccg

SEQ ID NO: 2414771 - RNA, 17 nt, Bordetella pertussis
cagguccugcgccagcu

SEQ ID NO: 2414772 - RNA, 19 nt, Bordetella pertussis
cagguccuggcggccgccc

SEQ ID NO: 2414773 - RNA, 18 nt, Bordetella pertussis
cagguccuugagguacca

SEQ ID NO: 2414774 - RNA, 17 nt, Bordetella pertussis
caggucgaacaggcugg

SEQ ID NO: 2414775 - RNA, 19 nt, Bordetella pertussis
caggucgaacaggcuggug

SEQ ID NO: 2414776 - RNA, 21 nt, Bordetella pertussis
caggucgaacggauugcugau

SEQ ID NO: 2414777 - RNA, 18 nt, Bordetella pertussis
caggucgaccugcuugcc

SEQ ID NO: 2414778 - RNA, 19 nt, Bordetella pertussis
caggucgaccugcuugccc

SEQ ID NO: 2414779 - RNA, 18 nt, Bordetella pertussis
caggucgagguccugcuc

SEQ ID NO: 2414780 - RNA, 16 nt, Bordetella pertussis
caggucgaugccggcg

SEQ ID NO: 2414781 - RNA, 18 nt, Bordetella pertussis
caggucgaugccggcggc

SEQ ID NO: 2414782 - RNA, 13 nt, Bordetella pertussis
caggucgccagca

SEQ ID NO: 2414783 - RNA, 19 nt, Bordetella pertussis
caggucgccagcaggcccu

SEQ ID NO: 2414784 - RNA, 21 nt, Bordetella pertussis
caggucgccagcaggcccugg

SEQ ID NO: 2414785 - RNA, 18 nt, Bordetella pertussis
caggucgccgaagggcag

SEQ ID NO: 2414786 - RNA, 23 nt, Bordetella pertussis
caggucgccgccgcgcucggcgc

SEQ ID NO: 2414787 - RNA, 20 nt, Bordetella pertussis
caggucgccguucuggcugc

SEQ ID NO: 2414788 - RNA, 22 nt, Bordetella pertussis
caggucgccguucuggcugcgc

SEQ ID NO: 2414789 - RNA, 21 nt, Bordetella pertussis
caggucgcgcaccaggucgcg

SEQ ID NO: 2414790 - RNA, 16 nt, Bordetella pertussis
caggucgcgcacgcug

SEQ ID NO: 2414791 - RNA, 19 nt, Bordetella pertussis
caggucgcgcacgcuggca

SEQ ID NO: 2414792 - RNA, 17 nt, Bordetella pertussis
caggucgcugcccagca

SEQ ID NO: 2414793 - RNA, 15 nt, Bordetella pertussis
caggucggacgcgcc

SEQ ID NO: 2414794 - RNA, 18 nt, Bordetella pertussis
caggucggagucggcgcc

SEQ ID NO: 2414795 - RNA, 16 nt, Bordetella pertussis
caggucggccaccgcc

SEQ ID NO: 2414796 - RNA, 16 nt, Bordetella pertussis
caggucggccagccgg

SEQ ID NO: 2414797 - RNA, 19 nt, Bordetella pertussis
caggucggccagccggccg

SEQ ID NO: 2414798 - RNA, 14 nt, Bordetella pertussis
caggucggccagcg

SEQ ID NO: 2414799 - RNA, 22 nt, Bordetella pertussis
caggucggccagcgugccggug

SEQ ID NO: 2414800 - RNA, 13 nt, Bordetella pertussis
caggucggccagg

SEQ ID NO: 2414801 - RNA, 20 nt, Bordetella pertussis
caggucggccaggacggugu

SEQ ID NO: 2414802 - RNA, 15 nt, Bordetella pertussis
caggucggcgaugcg

SEQ ID NO: 2414803 - RNA, 16 nt, Bordetella pertussis
caggucggcgcccacg

SEQ ID NO: 2414804 - RNA, 18 nt, Bordetella pertussis
caggucggcgcccacgcc

SEQ ID NO: 2414805 - RNA, 15 nt, Bordetella pertussis
caggucggcgcggcc

SEQ ID NO: 2414806 - RNA, 16 nt, Bordetella pertussis
caggucggcggccagc

SEQ ID NO: 2414807 - RNA, 22 nt, Bordetella pertussis
caggucgggauaguccagcacc

SEQ ID NO: 2414808 - RNA, 18 nt, Bordetella pertussis
caggucgggcaggguggg

SEQ ID NO: 2414809 - RNA, 23 nt, Bordetella pertussis
caggucgggcagggugggcacgc

SEQ ID NO: 2414810 - RNA, 14 nt, Bordetella pertussis
caggucggggcgcu

SEQ ID NO: 2414811 - RNA, 15 nt, Bordetella pertussis
caggucggggcgcuc

SEQ ID NO: 2414812 - RNA, 13 nt, Bordetella pertussis
caggucggugcac

SEQ ID NO: 2414813 - RNA, 15 nt, Bordetella pertussis
caggucggugcacac

SEQ ID NO: 2414814 - RNA, 18 nt, Bordetella pertussis
caggucguagaccgccgc

SEQ ID NO: 2414815 - RNA, 17 nt, Bordetella pertussis
caggucgucgagccggg

SEQ ID NO: 2414816 - RNA, 20 nt, Bordetella pertussis
caggucgucgagccgggcca

SEQ ID NO: 2414817 - RNA, 21 nt, Bordetella pertussis
caggucgucgagccgggccac

SEQ ID NO: 2414818 - RNA, 16 nt, Bordetella pertussis
caggucguggcccagc

SEQ ID NO: 2414819 - RNA, 22 nt, Bordetella pertussis
caggucguuguggcaggcgucg

SEQ ID NO: 2414820 - RNA, 19 nt, Bordetella pertussis
caggucuacccgcgcgagc

SEQ ID NO: 2414821 - RNA, 14 nt, Bordetella pertussis
caggucugcacgag

SEQ ID NO: 2414822 - RNA, 18 nt, Bordetella pertussis
caggucuucgggcgugcg

SEQ ID NO: 2414823 - RNA, 18 nt, Bordetella pertussis
caggugaaacagcagcgg

SEQ ID NO: 2414824 - RNA, 22 nt, Bordetella pertussis
caggugaugcgcgcggccagcg

SEQ ID NO: 2414825 - RNA, 20 nt, Bordetella pertussis
caggugcacagcgucccagc

SEQ ID NO: 2414826 - RNA, 14 nt, Bordetella pertussis
caggugcacggugg

SEQ ID NO: 2414827 - RNA, 21 nt, Bordetella pertussis
caggugcagaaaccccagggg

SEQ ID NO: 2414828 - RNA, 23 nt, Bordetella pertussis
caggugcaggguuggcgcgccgu

SEQ ID NO: 2414829 - RNA, 15 nt, Bordetella pertussis
caggugccagauauc

SEQ ID NO: 2414830 - RNA, 14 nt, Bordetella pertussis
caggugccccacgc

SEQ ID NO: 2414831 - RNA, 17 nt, Bordetella pertussis
caggugccccacgccga

SEQ ID NO: 2414832 - RNA, 14 nt, Bordetella pertussis
caggugccgccggc

SEQ ID NO: 2414833 - RNA, 16 nt, Bordetella pertussis
caggugccgccggcgc

SEQ ID NO: 2414834 - RNA, 17 nt, Bordetella pertussis
caggugccgccggcgcg

SEQ ID NO: 2414835 - RNA, 19 nt, Bordetella pertussis
caggugccgccggcgcggc

SEQ ID NO: 2414836 - RNA, 23 nt, Bordetella pertussis
caggugccgccggcgcggcugcu

SEQ ID NO: 2414837 - RNA, 17 nt, Bordetella pertussis
caggugccuguccccac

SEQ ID NO: 2414838 - RNA, 22 nt, Bordetella pertussis
caggugccuguccccacgggga

SEQ ID NO: 2414839 - RNA, 14 nt, Bordetella pertussis
caggugcggccgca

SEQ ID NO: 2414840 - RNA, 16 nt, Bordetella pertussis
caggugcggccgcagc

SEQ ID NO: 2414841 - RNA, 22 nt, Bordetella pertussis
caggugcggccgcagcggacgu

SEQ ID NO: 2414842 - RNA, 15 nt, Bordetella pertussis
caggugcgggccgcu

SEQ ID NO: 2414843 - RNA, 16 nt, Bordetella pertussis
caggugcgggccgcuc

SEQ ID NO: 2414844 - RNA, 19 nt, Bordetella pertussis
caggugcgggccgcucagu

SEQ ID NO: 2414845 - RNA, 19 nt, Bordetella pertussis
caggugcgucacgcacagc

SEQ ID NO: 2414846 - RNA, 14 nt, Bordetella pertussis
caggugcuuggcgg

SEQ ID NO: 2414847 - RNA, 21 nt, Bordetella pertussis
caggugcuuggcggucugggc

SEQ ID NO: 2414848 - RNA, 16 nt, Bordetella pertussis
cagugcgccuggcuga

SEQ ID NO: 2414849 - RNA, 18 nt, Bordetella pertussis
cagugcgcgcgcccccag

SEQ ID NO: 2414850 - RNA, 18 nt, Bordetella pertussis
cagugcucgggcugcggc

SEQ ID NO: 2414851 - RNA, 21 nt, Bordetella pertussis
cagugcuucgagauccgccgg

SEQ ID NO: 2414852 - RNA, 17 nt, Bordetella pertussis
cagugucuaucauggcc

SEQ ID NO: 2414853 - RNA, 23 nt, Bordetella pertussis
cagugucuaucauggccuuggca

SEQ ID NO: 2414854 - RNA, 19 nt, Bordetella pertussis
cagugugccugucccagcg

SEQ ID NO: 2414855 - RNA, 17 nt, Bordetella pertussis
caguuccacgcggccgu

SEQ ID NO: 2414856 - RNA, 21 nt, Bordetella pertussis
caguuccacgcggccguggcg

SEQ ID NO: 2414857 - RNA, 22 nt, Bordetella pertussis
caguuccacgcggccguggcgg

SEQ ID NO: 2414858 - RNA, 14 nt, Bordetella pertussis
caguuccaggcgga

SEQ ID NO: 2414859 - RNA, 20 nt, Bordetella pertussis
caguucgacaccuacauccu

SEQ ID NO: 2414860 - RNA, 23 nt, Bordetella pertussis
caguucgaugcgcuugccgaccu

SEQ ID NO: 2414861 - RNA, 20 nt, Bordetella pertussis
caguucgcccggcuccaggc

SEQ ID NO: 2414862 - RNA, 14 nt, Bordetella pertussis
caguucgccggcgc

SEQ ID NO: 2414863 - RNA, 22 nt, Bordetella pertussis
caguucgcgcagaucccaggcg

SEQ ID NO: 2414864 - RNA, 14 nt, Bordetella pertussis
caguucgcgcagca

SEQ ID NO: 2414865 - RNA, 17 nt, Bordetella pertussis
caguucgcgcagcagcu

SEQ ID NO: 2414866 - RNA, 16 nt, Bordetella pertussis
caguucgcgcaggcgu

SEQ ID NO: 2414867 - RNA, 17 nt, Bordetella pertussis
caguucgcggccggccg

SEQ ID NO: 2414868 - RNA, 16 nt, Bordetella pertussis
caguucggccagcggc

SEQ ID NO: 2414869 - RNA, 17 nt, Bordetella pertussis
caguucggccagcggca

SEQ ID NO: 2414870 - RNA, 16 nt, Bordetella pertussis
caguucggccggcggc

SEQ ID NO: 2414871 - RNA, 17 nt, Bordetella pertussis
caguucggccggcggcc

SEQ ID NO: 2414872 - RNA, 23 nt, Bordetella pertussis
caguucggcgacgaucuccaccc

SEQ ID NO: 2414873 - RNA, 15 nt, Bordetella pertussis
caguucggcgcgcgu

SEQ ID NO: 2414874 - RNA, 23 nt, Bordetella pertussis
caguucggcgucggugccgucca

SEQ ID NO: 2414875 - RNA, 18 nt, Bordetella pertussis
caguucggucagcgcggc

SEQ ID NO: 2414876 - RNA, 22 nt, Bordetella pertussis
caguucggucagcgcggcgcac

SEQ ID NO: 2414877 - RNA, 20 nt, Bordetella pertussis
caguucggugcggugcgcga

SEQ ID NO: 2414878 - RNA, 20 nt, Bordetella pertussis
caguucgguuucccgaugcu

SEQ ID NO: 2414879 - RNA, 22 nt, Bordetella pertussis
caguucgucccagggggucagg

SEQ ID NO: 2414880 - RNA, 13 nt, Bordetella pertussis
caguucguccgcu

SEQ ID NO: 2414881 - RNA, 16 nt, Bordetella pertussis
caguucuuccauccug

SEQ ID NO: 2414882 - RNA, 15 nt, Bordetella pertussis
caguugaacacgcgg

SEQ ID NO: 2414883 - RNA, 21 nt, Bordetella pertussis
caguugaaccgcaacgccagc

SEQ ID NO: 2414884 - RNA, 21 nt, Bordetella pertussis
caguugacccauaccagcccg

SEQ ID NO: 2414885 - RNA, 18 nt, Bordetella pertussis
caguugacgaugcccagg

SEQ ID NO: 2414886 - RNA, 19 nt, Bordetella pertussis
caguugacgaugcccaggu

SEQ ID NO: 2414887 - RNA, 14 nt, Bordetella pertussis
caguugcaggccau

SEQ ID NO: 2414888 - RNA, 16 nt, Bordetella pertussis
caguugcgcaccgcuu

SEQ ID NO: 2414889 - RNA, 20 nt, Bordetella pertussis
caguugcgcgccgucggcgu

SEQ ID NO: 2414890 - RNA, 14 nt, Bordetella pertussis
caguugcgggcgca

SEQ ID NO: 2414891 - RNA, 19 nt, Bordetella pertussis
caguugcgggcgcaccugg

SEQ ID NO: 2414892 - RNA, 20 nt, Bordetella pertussis
caguugcggggcgcccagcg

SEQ ID NO: 2414893 - RNA, 16 nt, Bordetella pertussis
caguugcuggcccagg

SEQ ID NO: 2414894 - RNA, 14 nt, Bordetella pertussis
caguugcuggcggc

SEQ ID NO: 2414895 - RNA, 18 nt, Bordetella pertussis
caguuggcccuucuucag

SEQ ID NO: 2414896 - RNA, 17 nt, Bordetella pertussis
caguuggcggcgcagcc

SEQ ID NO: 2414897 - RNA, 19 nt, Bordetella pertussis
caguuggcggcgcagccgc

SEQ ID NO: 2414898 - RNA, 20 nt, Bordetella pertussis
caguuggcggcgcagccgcc

SEQ ID NO: 2414899 - RNA, 15 nt, Bordetella pertussis
caguugggcgcgccc

SEQ ID NO: 2414900 - RNA, 19 nt, Bordetella pertussis
caguugggcgcgcccagcc

SEQ ID NO: 2414901 - RNA, 21 nt, Bordetella pertussis
caguugggcgcgcccagcccc

SEQ ID NO: 2414902 - RNA, 21 nt, Bordetella pertussis
caguuguagguccaguacacc

SEQ ID NO: 2414903 - RNA, 21 nt, Bordetella pertussis
caguuuccaucggggggcagg

SEQ ID NO: 2414904 - RNA, 23 nt, Bordetella pertussis
caguuucgcgaccaccaggucgu

SEQ ID NO: 2414905 - RNA, 20 nt, Bordetella pertussis
caguuuucucauggccgcgc

SEQ ID NO: 2414906 - RNA, 22 nt, Bordetella pertussis
cauaauccguuggugccgaguu

SEQ ID NO: 2414907 - RNA, 15 nt, Bordetella pertussis
cauaaucggcccguu

SEQ ID NO: 2414908 - RNA, 15 nt, Bordetella pertussis
cauaaucgucggcaa

SEQ ID NO: 2414909 - RNA, 16 nt, Bordetella pertussis
cauacaaggcgcggca

SEQ ID NO: 2414910 - RNA, 22 nt, Bordetella pertussis
cauacacggcgcgggcggucgg

SEQ ID NO: 2414911 - RNA, 14 nt, Bordetella pertussis
cauacagcaaggac

SEQ ID NO: 2414912 - RNA, 20 nt, Bordetella pertussis
cauacagcggagccgcgcac

SEQ ID NO: 2414913 - RNA, 21 nt, Bordetella pertussis
cauacaggcuguggccgcggc

SEQ ID NO: 2414914 - RNA, 14 nt, Bordetella pertussis
cauaccagcccggc

SEQ ID NO: 2414915 - RNA, 14 nt, Bordetella pertussis
cauaccggccgcgg

SEQ ID NO: 2414916 - RNA, 19 nt, Bordetella pertussis
cauaccuuggcgcccagcu

SEQ ID NO: 2414917 - RNA, 18 nt, Bordetella pertussis
cauacgacgcggcaugcg

SEQ ID NO: 2414918 - RNA, 19 nt, Bordetella pertussis
cauacgacgcggcaugcga

SEQ ID NO: 2414919 - RNA, 19 nt, Bordetella pertussis
cauacgccgauggcgcggc

SEQ ID NO: 2414920 - RNA, 14 nt, Bordetella pertussis
cauacgccgccgag

SEQ ID NO: 2414921 - RNA, 16 nt, Bordetella pertussis
cauacgcgcgcuccuu

SEQ ID NO: 2414922 - RNA, 20 nt, Bordetella pertussis
cauacgcggguucgacgccg

SEQ ID NO: 2414923 - RNA, 17 nt, Bordetella pertussis
cauacguagaccgcgaa

SEQ ID NO: 2414924 - RNA, 20 nt, Bordetella pertussis
cauacucgaugcccagcacc

SEQ ID NO: 2414925 - RNA, 22 nt, Bordetella pertussis
cauacucggaagacauggcgcg

SEQ ID NO: 2414926 - RNA, 18 nt, Bordetella pertussis
cauagacccacagguugg

SEQ ID NO: 2414927 - RNA, 15 nt, Bordetella pertussis
cauagaccggcugca

SEQ ID NO: 2414928 - RNA, 14 nt, Bordetella pertussis
cauagacgcgcagc

SEQ ID NO: 2414929 - RNA, 15 nt, Bordetella pertussis
cauagacgcgcagcg

SEQ ID NO: 2414930 - RNA, 17 nt, Bordetella pertussis
cauagacgcgcagcggc

SEQ ID NO: 2414931 - RNA, 20 nt, Bordetella pertussis
cauagacggcgucgggcagc

SEQ ID NO: 2414932 - RNA, 16 nt, Bordetella pertussis
cauagagauuguccag

SEQ ID NO: 2414933 - RNA, 17 nt, Bordetella pertussis
cauagagauuguccagc

SEQ ID NO: 2414934 - RNA, 23 nt, Bordetella pertussis
cauagagauuguccagcggcagc

SEQ ID NO: 2414935 - RNA, 17 nt, Bordetella pertussis
cauagaucuccggcgcc

SEQ ID NO: 2414936 - RNA, 23 nt, Bordetella pertussis
cauagaucuccggcgccuggccg

SEQ ID NO: 2414937 - RNA, 19 nt, Bordetella pertussis
cauagcccaggccgccggc

SEQ ID NO: 2414938 - RNA, 17 nt, Bordetella pertussis
cauagcguucgguggcg

SEQ ID NO: 2414939 - RNA, 15 nt, Bordetella pertussis
cauaggacgccacca

SEQ ID NO: 2414940 - RNA, 16 nt, Bordetella pertussis
cauaggccagcgccuu

SEQ ID NO: 2414941 - RNA, 13 nt, Bordetella pertussis
cauaggccggcac

SEQ ID NO: 2414942 - RNA, 16 nt, Bordetella pertussis
cauaggcgcgcaccag

SEQ ID NO: 2414943 - RNA, 18 nt, Bordetella pertussis
cauaggcgcgcaccagcc

SEQ ID NO: 2414944 - RNA, 20 nt, Bordetella pertussis
cauagggcgacugcagcagg

SEQ ID NO: 2414945 - RNA, 18 nt, Bordetella pertussis
cauagguaucggcccgcg

SEQ ID NO: 2414946 - RNA, 18 nt, Bordetella pertussis
cauaguccucuacuggcu

SEQ ID NO: 2414947 - RNA, 21 nt, Bordetella pertussis
cauaguccucuacuggcugau

SEQ ID NO: 2414948 - RNA, 11 nt, Bordetella pertussis
cauauccacgc

SEQ ID NO: 2414949 - RNA, 13 nt, Bordetella pertussis
cauauccaggcgg

SEQ ID NO: 2414950 - RNA, 18 nt, Bordetella pertussis
cauauccaggcggcgcuc

SEQ ID NO: 2414951 - RNA, 14 nt, Bordetella pertussis
cauauucacagcca

SEQ ID NO: 2414952 - RNA, 15 nt, Bordetella pertussis
cauauucacagccau

SEQ ID NO: 2414953 - RNA, 14 nt, Bordetella pertussis
caucaaacgcggcg

SEQ ID NO: 2414954 - RNA, 15 nt, Bordetella pertussis
caucaaacgcggcgc

SEQ ID NO: 2414955 - RNA, 15 nt, Bordetella pertussis
caucaacgggccgcu

SEQ ID NO: 2414956 - RNA, 12 nt, Bordetella pertussis
caucaacguggc

SEQ ID NO: 2414957 - RNA, 13 nt, Bordetella pertussis
caucaacuucauc

SEQ ID NO: 2414958 - RNA, 14 nt, Bordetella pertussis
caucaagaugaacg

SEQ ID NO: 2414959 - RNA, 22 nt, Bordetella pertussis
caucaaggccaugaucaggccg

SEQ ID NO: 2414960 - RNA, 23 nt, Bordetella pertussis
caucgaacgugcugacgguaagc

SEQ ID NO: 2414961 - RNA, 19 nt, Bordetella pertussis
caucgaauuugaacagccg

SEQ ID NO: 2414962 - RNA, 20 nt, Bordetella pertussis
caucgacaagcgcuacgacg

SEQ ID NO: 2414963 - RNA, 21 nt, Bordetella pertussis
caucgacaugcccgccggcac

SEQ ID NO: 2414964 - RNA, 22 nt, Bordetella pertussis
caucgacaugcccgccggcacc

SEQ ID NO: 2414965 - RNA, 13 nt, Bordetella pertussis
caucgaccaccag

SEQ ID NO: 2414966 - RNA, 19 nt, Bordetella pertussis
caucgaccacgcgcgcgcc

SEQ ID NO: 2414967 - RNA, 14 nt, Bordetella pertussis
caucgaccagcgca

SEQ ID NO: 2414968 - RNA, 13 nt, Bordetella pertussis
caucgacgcggcg

SEQ ID NO: 2414969 - RNA, 17 nt, Bordetella pertussis
caucgacgcuugccggc

SEQ ID NO: 2414970 - RNA, 19 nt, Bordetella pertussis
caucgacgcuugccggcga

SEQ ID NO: 2414971 - RNA, 22 nt, Bordetella pertussis
caucgacgucggccucgcgcag

SEQ ID NO: 2414972 - RNA, 19 nt, Bordetella pertussis
caucgacuuggccugguug

SEQ ID NO: 2414973 - RNA, 20 nt, Bordetella pertussis
caucgagaaaccagccgccg

SEQ ID NO: 2414974 - RNA, 12 nt, Bordetella pertussis
caucgagcaccg

SEQ ID NO: 2414975 - RNA, 16 nt, Bordetella pertussis
caucgagcauugccgc

SEQ ID NO: 2414976 - RNA, 19 nt, Bordetella pertussis
caucgagcauugccgcggc

SEQ ID NO: 2414977 - RNA, 21 nt, Bordetella pertussis
caucgagcgccugggcggcca

SEQ ID NO: 2414978 - RNA, 15 nt, Bordetella pertussis
caucgagcuccugca

SEQ ID NO: 2414979 - RNA, 17 nt, Bordetella pertussis
caucgagcuccugcagg

SEQ ID NO: 2414980 - RNA, 18 nt, Bordetella pertussis
caucgagggcgucaucgg

SEQ ID NO: 2414981 - RNA, 22 nt, Bordetella pertussis
caucgauaugggcggccucggc

SEQ ID NO: 2414982 - RNA, 14 nt, Bordetella pertussis
caucgaugcgccgc

SEQ ID NO: 2414983 - RNA, 15 nt, Bordetella pertussis
caucgaugcgccgca

SEQ ID NO: 2414984 - RNA, 19 nt, Bordetella pertussis
caucgaugcgccgcaccag

SEQ ID NO: 2414985 - RNA, 22 nt, Bordetella pertussis
caucgauggccaggugcacagc

SEQ ID NO: 2414986 - RNA, 16 nt, Bordetella pertussis
caucgaugugcaugcc

SEQ ID NO: 2414987 - RNA, 19 nt, Bordetella pertussis
caucgauuucucgcugcug

SEQ ID NO: 2414988 - RNA, 21 nt, Bordetella pertussis
caucgauuucucgcugcugac

SEQ ID NO: 2414989 - RNA, 15 nt, Bordetella pertussis
caucgccaggaccag

SEQ ID NO: 2414990 - RNA, 20 nt, Bordetella pertussis
caucgccaggaccaggauga

SEQ ID NO: 2414991 - RNA, 15 nt, Bordetella pertussis
caucgccaugccggc

SEQ ID NO: 2414992 - RNA, 17 nt, Bordetella pertussis
caucgccauggccacga

SEQ ID NO: 2414993 - RNA, 16 nt, Bordetella pertussis
caucgcccaccaugag

SEQ ID NO: 2414994 - RNA, 17 nt, Bordetella pertussis
caucgcccugucgguga

SEQ ID NO: 2414995 - RNA, 12 nt, Bordetella pertussis
caucgccgacgc

SEQ ID NO: 2414996 - RNA, 19 nt, Bordetella pertussis
caucgccgacgcgccgggc

SEQ ID NO: 2414997 - RNA, 15 nt, Bordetella pertussis
caucgccgagccgcu

SEQ ID NO: 2414998 - RNA, 21 nt, Bordetella pertussis
caucgccgcaggcgugcccuu

SEQ ID NO: 2414999 - RNA, 15 nt, Bordetella pertussis
caucgccgcggcggg

SEQ ID NO: 2415000 - RNA, 14 nt, Bordetella pertussis
caucgccgcugcgc

SEQ ID NO: 2415001 - RNA, 17 nt, Bordetella pertussis
caucgccgcugcgcagc

SEQ ID NO: 2415002 - RNA, 19 nt, Bordetella pertussis
caucgccggcggcguggcc

SEQ ID NO: 2415003 - RNA, 17 nt, Bordetella pertussis
caucgccugcacgaccu

SEQ ID NO: 2415004 - RNA, 17 nt, Bordetella pertussis
caucgcgauccucgacc

SEQ ID NO: 2415005 - RNA, 16 nt, Bordetella pertussis
caucgcgaugcgcagc

SEQ ID NO: 2415006 - RNA, 18 nt, Bordetella pertussis
caucgcgaugcgcagcag

SEQ ID NO: 2415007 - RNA, 21 nt, Bordetella pertussis
caucgcgaugcgcagcagcag

SEQ ID NO: 2415008 - RNA, 20 nt, Bordetella pertussis
caucgcgccuucggcgcgca

SEQ ID NO: 2415009 - RNA, 22 nt, Bordetella pertussis
caucgcgccuucggcgcgcacg

SEQ ID NO: 2415010 - RNA, 24 nt, Bordetella pertussis
caucgcgccuucggcgcgcacgcu

SEQ ID NO: 2415011 - RNA, 13 nt, Bordetella pertussis
caucgcgcgccgc

SEQ ID NO: 2415012 - RNA, 15 nt, Bordetella pertussis
caucgcgcgcgccgg

SEQ ID NO: 2415013 - RNA, 12 nt, Bordetella pertussis
caucgcgcggca

SEQ ID NO: 2415014 - RNA, 18 nt, Bordetella pertussis
caucgcgcugacagcgcu

SEQ ID NO: 2415015 - RNA, 23 nt, Bordetella pertussis
caucgcgcuggcgguggccgcgc

SEQ ID NO: 2415016 - RNA, 17 nt, Bordetella pertussis
caucgcggcagcccggc

SEQ ID NO: 2415017 - RNA, 22 nt, Bordetella pertussis
caucgcggcagcccggcacguc

SEQ ID NO: 2415018 - RNA, 18 nt, Bordetella pertussis
caucgcggucaucggcga

SEQ ID NO: 2415019 - RNA, 21 nt, Bordetella pertussis
caucgcggucaucggcgacga

SEQ ID NO: 2415020 - RNA, 14 nt, Bordetella pertussis
caucgcguccaggc

SEQ ID NO: 2415021 - RNA, 16 nt, Bordetella pertussis
caucgcguccaggccc

SEQ ID NO: 2415022 - RNA, 23 nt, Bordetella pertussis
caucgcgugcagcgacuugucgc

SEQ ID NO: 2415023 - RNA, 18 nt, Bordetella pertussis
caucgcuaugcagcugcg

SEQ ID NO: 2415024 - RNA, 21 nt, Bordetella pertussis
caucgcuaugcagcugcgcca

SEQ ID NO: 2415025 - RNA, 12 nt, Bordetella pertussis
caucggcaggcc

SEQ ID NO: 2415026 - RNA, 18 nt, Bordetella pertussis
caucggcaggccggcgcg

SEQ ID NO: 2415027 - RNA, 20 nt, Bordetella pertussis
caucggcaggccggcgcgcg

SEQ ID NO: 2415028 - RNA, 14 nt, Bordetella pertussis
caucggccacccgg

SEQ ID NO: 2415029 - RNA, 15 nt, Bordetella pertussis
caucggccacgcugc

SEQ ID NO: 2415030 - RNA, 20 nt, Bordetella pertussis
caucggccacgcugcccugc

SEQ ID NO: 2415031 - RNA, 18 nt, Bordetella pertussis
caucggccaggcgccuga

SEQ ID NO: 2415032 - RNA, 13 nt, Bordetella pertussis
caucggccggcgg

SEQ ID NO: 2415033 - RNA, 19 nt, Bordetella pertussis
caucggccggcggucgcgc

SEQ ID NO: 2415034 - RNA, 15 nt, Bordetella pertussis
caucggccugcaccg

SEQ ID NO: 2415035 - RNA, 23 nt, Bordetella pertussis
caucggccugcaccggcgcgagu

SEQ ID NO: 2415036 - RNA, 17 nt, Bordetella pertussis
caucggcgccaagcggc

SEQ ID NO: 2415037 - RNA, 22 nt, Bordetella pertussis
caucggcgccaguagcgccggc

SEQ ID NO: 2415038 - RNA, 23 nt, Bordetella pertussis
caucggcgccaguagcgccggcu

SEQ ID NO: 2415039 - RNA, 11 nt, Bordetella pertussis
caucggcgccg

SEQ ID NO: 2415040 - RNA, 15 nt, Bordetella pertussis
caucggcgccgcgcg

SEQ ID NO: 2415041 - RNA, 17 nt, Bordetella pertussis
caucggcgccgcgcgcu

SEQ ID NO: 2415042 - RNA, 15 nt, Bordetella pertussis
caucggcgccggcgu

SEQ ID NO: 2415043 - RNA, 14 nt, Bordetella pertussis
caucggcgcgcagc

SEQ ID NO: 2415044 - RNA, 14 nt, Bordetella pertussis
caucggcgcgcgcu

SEQ ID NO: 2415045 - RNA, 14 nt, Bordetella pertussis
caucggcggcaggu

SEQ ID NO: 2415046 - RNA, 19 nt, Bordetella pertussis
caucggcucgagcaagggc

SEQ ID NO: 2415047 - RNA, 14 nt, Bordetella pertussis
caucggcuggcgca

SEQ ID NO: 2415048 - RNA, 16 nt, Bordetella pertussis
caucgggauaccgcug

SEQ ID NO: 2415049 - RNA, 23 nt, Bordetella pertussis
caucgggauccgugcggcgcgca

SEQ ID NO: 2415050 - RNA, 15 nt, Bordetella pertussis
caucgggccggcggc

SEQ ID NO: 2415051 - RNA, 19 nt, Bordetella pertussis
caucgggccggcggcagcc

SEQ ID NO: 2415052 - RNA, 15 nt, Bordetella pertussis
caucgggugcggcgc

SEQ ID NO: 2415053 - RNA, 20 nt, Bordetella pertussis
caucggucaacgccugcggg

SEQ ID NO: 2415054 - RNA, 21 nt, Bordetella pertussis
caucggugcggccgguggcga

SEQ ID NO: 2415055 - RNA, 21 nt, Bordetella pertussis
caucguaguugggcgccuugc

SEQ ID NO: 2415056 - RNA, 22 nt, Bordetella pertussis
caucgucaggcaggcgcgccgg

SEQ ID NO: 2415057 - RNA, 14 nt, Bordetella pertussis
caucgucaucacca

SEQ ID NO: 2415058 - RNA, 22 nt, Bordetella pertussis
caucgucaucaccaagggcgcc

SEQ ID NO: 2415059 - RNA, 20 nt, Bordetella pertussis
caucgucauuacccauggca

SEQ ID NO: 2415060 - RNA, 14 nt, Bordetella pertussis
caucgucgcgcugg

SEQ ID NO: 2415061 - RNA, 19 nt, Bordetella pertussis
caucgucggcgccaugcug

SEQ ID NO: 2415062 - RNA, 21 nt, Bordetella pertussis
caucgucggcgccaugcuggc

SEQ ID NO: 2415063 - RNA, 22 nt, Bordetella pertussis
caucgucggcgccaugcuggcc

SEQ ID NO: 2415064 - RNA, 18 nt, Bordetella pertussis
caucgucguagcgccagc

SEQ ID NO: 2415065 - RNA, 14 nt, Bordetella pertussis
caucguggccgcgc

SEQ ID NO: 2415066 - RNA, 15 nt, Bordetella pertussis
caucguggccgcgca

SEQ ID NO: 2415067 - RNA, 13 nt, Bordetella pertussis
caucguggcugcc

SEQ ID NO: 2415068 - RNA, 15 nt, Bordetella pertussis
caucguuacagcucc

SEQ ID NO: 2415069 - RNA, 18 nt, Bordetella pertussis
caucguugccugggugcu

SEQ ID NO: 2415070 - RNA, 17 nt, Bordetella pertussis
caucuacagcgccuggc

SEQ ID NO: 2415071 - RNA, 22 nt, Bordetella pertussis
caucuaccugucgggcggcggc

SEQ ID NO: 2415072 - RNA, 14 nt, Bordetella pertussis
accaccaccgcccg

SEQ ID NO: 2415073 - RNA, 12 nt, Bordetella pertussis
accaccagcacc

SEQ ID NO: 2415074 - RNA, 12 nt, Bordetella pertussis
accaccagcagg

SEQ ID NO: 2415075 - RNA, 21 nt, Bordetella pertussis
accaccagcgcggccagcacc

SEQ ID NO: 2415076 - RNA, 22 nt, Bordetella pertussis
accaccagcgucaccagcaggc

SEQ ID NO: 2415077 - RNA, 16 nt, Bordetella pertussis
accaccaggccgccua

SEQ ID NO: 2415078 - RNA, 14 nt, Bordetella pertussis
accaccaggccggc

SEQ ID NO: 2415079 - RNA, 15 nt, Bordetella pertussis
accaccaggccggcc

SEQ ID NO: 2415080 - RNA, 16 nt, Bordetella pertussis
accaccaggccggcca

SEQ ID NO: 2415081 - RNA, 22 nt, Bordetella pertussis
accaccaugugcuugccgcagc

SEQ ID NO: 2415082 - RNA, 13 nt, Bordetella pertussis
accacccgcacgc

SEQ ID NO: 2415083 - RNA, 23 nt, Bordetella pertussis
accacccgcacgccggccugcgc

SEQ ID NO: 2415084 - RNA, 13 nt, Bordetella pertussis
accacccgcgcca

SEQ ID NO: 2415085 - RNA, 15 nt, Bordetella pertussis
accacccgcgccagg

SEQ ID NO: 2415086 - RNA, 20 nt, Bordetella pertussis
accacccgcgccaggaacac

SEQ ID NO: 2415087 - RNA, 22 nt, Bordetella pertussis
accaccgagaaaccgauggugc

SEQ ID NO: 2415088 - RNA, 15 nt, Bordetella pertussis
accaccgauccgaug

SEQ ID NO: 2415089 - RNA, 17 nt, Bordetella pertussis
accaccgauccgaugau

SEQ ID NO: 2415090 - RNA, 12 nt, Bordetella pertussis
accaccgcccgc

SEQ ID NO: 2415091 - RNA, 22 nt, Bordetella pertussis
accaccggcacgccggcggcgc

SEQ ID NO: 2415092 - RNA, 22 nt, Bordetella pertussis
accaccgucucgaacgccgcgu

SEQ ID NO: 2415093 - RNA, 23 nt, Bordetella pertussis
accaccgucucgaacgccgcguc

SEQ ID NO: 2415094 - RNA, 18 nt, Bordetella pertussis
accaccgucuugcccgcc

SEQ ID NO: 2415095 - RNA, 21 nt, Bordetella pertussis
accaccgucuugcccgccagc

SEQ ID NO: 2415096 - RNA, 22 nt, Bordetella pertussis
accaccgucuugcccgccagcg

SEQ ID NO: 2415097 - RNA, 22 nt, Bordetella pertussis
accaccgugauauagaccagca

SEQ ID NO: 2415098 - RNA, 15 nt, Bordetella pertussis
accaccugcaccgcc

SEQ ID NO: 2415099 - RNA, 19 nt, Bordetella pertussis
accaccuucagggcgccgg

SEQ ID NO: 2415100 - RNA, 14 nt, Bordetella pertussis
accaccuugcccca

SEQ ID NO: 2415101 - RNA, 16 nt, Bordetella pertussis
accacgaccggcucgg

SEQ ID NO: 2415102 - RNA, 20 nt, Bordetella pertussis
accacgaccuuggcggccga

SEQ ID NO: 2415103 - RNA, 15 nt, Bordetella pertussis
accacgagcugcagc

SEQ ID NO: 2415104 - RNA, 22 nt, Bordetella pertussis
accacgagcugcagcccggcca

SEQ ID NO: 2415105 - RNA, 18 nt, Bordetella pertussis
accacgccaaggagacac

SEQ ID NO: 2415106 - RNA, 16 nt, Bordetella pertussis
accacgcccaucugcc

SEQ ID NO: 2415107 - RNA, 20 nt, Bordetella pertussis
accacgccgcccagcgcgug

SEQ ID NO: 2415108 - RNA, 21 nt, Bordetella pertussis
accacgccgcccagcgcgugg

SEQ ID NO: 2415109 - RNA, 15 nt, Bordetella pertussis
accacgccggcggcc

SEQ ID NO: 2415110 - RNA, 18 nt, Bordetella pertussis
accacgccuucgagcacc

SEQ ID NO: 2415111 - RNA, 22 nt, Bordetella pertussis
accacgcgcaccagcuuggccu

SEQ ID NO: 2415112 - RNA, 17 nt, Bordetella pertussis
accacgcgcgcgccgcc

SEQ ID NO: 2415113 - RNA, 14 nt, Bordetella pertussis
accacgcgcggcgg

SEQ ID NO: 2415114 - RNA, 14 nt, Bordetella pertussis
accacgcgcugcgc

SEQ ID NO: 2415115 - RNA, 17 nt, Bordetella pertussis
accacgcgcugcgcgcc

SEQ ID NO: 2415116 - RNA, 13 nt, Bordetella pertussis
accacgcugggcc

SEQ ID NO: 2415117 - RNA, 20 nt, Bordetella pertussis
accacgcugggccagaccgc

SEQ ID NO: 2415118 - RNA, 19 nt, Bordetella pertussis
accacggcaucggcgccgc

SEQ ID NO: 2415119 - RNA, 15 nt, Bordetella pertussis
accacggccagcagc

SEQ ID NO: 2415120 - RNA, 16 nt, Bordetella pertussis
accacggccagcagca

SEQ ID NO: 2415121 - RNA, 12 nt, Bordetella pertussis
accacggcgcgc

SEQ ID NO: 2415122 - RNA, 13 nt, Bordetella pertussis
accacggcgcgcc

SEQ ID NO: 2415123 - RNA, 21 nt, Bordetella pertussis
accacggcgcgcccgcaggcg

SEQ ID NO: 2415124 - RNA, 23 nt, Bordetella pertussis
accacggcgcgcccgcaggcggc

SEQ ID NO: 2415125 - RNA, 13 nt, Bordetella pertussis
accacggcgcgga

SEQ ID NO: 2415126 - RNA, 12 nt, Bordetella pertussis
accacggcggcc

SEQ ID NO: 2415127 - RNA, 16 nt, Bordetella pertussis
accacggcggccaggc

SEQ ID NO: 2415128 - RNA, 19 nt, Bordetella pertussis
accacggucuggcgcgaca

SEQ ID NO: 2415129 - RNA, 19 nt, Bordetella pertussis
accacguccuggggcgcgg

SEQ ID NO: 2415130 - RNA, 20 nt, Bordetella pertussis
accacguccuggggcgcggu

SEQ ID NO: 2415131 - RNA, 20 nt, Bordetella pertussis
accacgucgcggcugggcaa

SEQ ID NO: 2415132 - RNA, 13 nt, Bordetella pertussis
accacguggauga

SEQ ID NO: 2415133 - RNA, 17 nt, Bordetella pertussis
accacguggaugauggu

SEQ ID NO: 2415134 - RNA, 20 nt, Bordetella pertussis
accacuggaagcugcggccg

SEQ ID NO: 2415135 - RNA, 20 nt, Bordetella pertussis
accagaucaggucgaugccg

SEQ ID NO: 2415136 - RNA, 18 nt, Bordetella pertussis
accagcaagccggcgguc

SEQ ID NO: 2415137 - RNA, 14 nt, Bordetella pertussis
accagcaccagcgc

SEQ ID NO: 2415138 - RNA, 16 nt, Bordetella pertussis
accagcaccagcgccu

SEQ ID NO: 2415139 - RNA, 20 nt, Bordetella pertussis
accagcaccagcgccugccg

SEQ ID NO: 2415140 - RNA, 16 nt, Bordetella pertussis
accagcaccgaugcgc

SEQ ID NO: 2415141 - RNA, 17 nt, Bordetella pertussis
accagcaccgaugcgcc

SEQ ID NO: 2415142 - RNA, 20 nt, Bordetella pertussis
accagcaccgaugcgccggc

SEQ ID NO: 2415143 - RNA, 22 nt, Bordetella pertussis
accagcaccgaugcgccggccu

SEQ ID NO: 2415144 - RNA, 15 nt, Bordetella pertussis
accagcaccgccacg

SEQ ID NO: 2415145 - RNA, 15 nt, Bordetella pertussis
accagcaccggcagc

SEQ ID NO: 2415146 - RNA, 19 nt, Bordetella pertussis
accagcacgagauguccau

SEQ ID NO: 2415147 - RNA, 13 nt, Bordetella pertussis
accagcagcccca

SEQ ID NO: 2415148 - RNA, 15 nt, Bordetella pertussis
caugacggggugccu

SEQ ID NO: 2415149 - RNA, 13 nt, Bordetella pertussis
caugacguccagc

SEQ ID NO: 2415150 - RNA, 17 nt, Bordetella pertussis
caugacguccagcgcca

SEQ ID NO: 2415151 - RNA, 16 nt, Bordetella pertussis
caugacguccggcggg

SEQ ID NO: 2415152 - RNA, 20 nt, Bordetella pertussis
caugagcgccucguuccugu

SEQ ID NO: 2415153 - RNA, 19 nt, Bordetella pertussis
caugagcugaugcucgccc

SEQ ID NO: 2415154 - RNA, 18 nt, Bordetella pertussis
caugaggccccuguccuc

SEQ ID NO: 2415155 - RNA, 22 nt, Bordetella pertussis
caugaggcggcgguaccaggcc

SEQ ID NO: 2415156 - RNA, 19 nt, Bordetella pertussis
caugaguucuggcaucagg

SEQ ID NO: 2415157 - RNA, 15 nt, Bordetella pertussis
caugaucagggccgu

SEQ ID NO: 2415158 - RNA, 16 nt, Bordetella pertussis
caugaucccgcgccua

SEQ ID NO: 2415159 - RNA, 22 nt, Bordetella pertussis
caugauccgcaccggugggagc

SEQ ID NO: 2415160 - RNA, 15 nt, Bordetella pertussis
caugaucuggccgac

SEQ ID NO: 2415161 - RNA, 18 nt, Bordetella pertussis
caugaucuugccgaccgc

SEQ ID NO: 2415162 - RNA, 13 nt, Bordetella pertussis
caugaugcccagc

SEQ ID NO: 2415163 - RNA, 16 nt, Bordetella pertussis
caugaugcccagcgcc

SEQ ID NO: 2415164 - RNA, 17 nt, Bordetella pertussis
caugaugcgcugggcca

SEQ ID NO: 2415165 - RNA, 18 nt, Bordetella pertussis
caugaugcgcugggccag

SEQ ID NO: 2415166 - RNA, 20 nt, Bordetella pertussis
caugaugcgcugggccaggc

SEQ ID NO: 2415167 - RNA, 23 nt, Bordetella pertussis
caugaugcgcugggccaggccgg

SEQ ID NO: 2415168 - RNA, 14 nt, Bordetella pertussis
caugauggcccggg

SEQ ID NO: 2415169 - RNA, 18 nt, Bordetella pertussis
caugauggccgcgcgcag

SEQ ID NO: 2415170 - RNA, 15 nt, Bordetella pertussis
caugauggugcugcc

SEQ ID NO: 2415171 - RNA, 18 nt, Bordetella pertussis
caugauggugcugccgcu

SEQ ID NO: 2415172 - RNA, 15 nt, Bordetella pertussis
caugaugucgcgcgc

SEQ ID NO: 2415173 - RNA, 17 nt, Bordetella pertussis
caugaugucgcgcgccu

SEQ ID NO: 2415174 - RNA, 17 nt, Bordetella pertussis
caugaugucgcgggccc

SEQ ID NO: 2415175 - RNA, 14 nt, Bordetella pertussis
caugaugucgucga

SEQ ID NO: 2415176 - RNA, 18 nt, Bordetella pertussis
caugauuccaccuugccg

SEQ ID NO: 2415177 - RNA, 22 nt, Bordetella pertussis
caugauuuccaucgacuuggcc

SEQ ID NO: 2415178 - RNA, 23 nt, Bordetella pertussis
caugauuucgaucacggcgcgcg

SEQ ID NO: 2415179 - RNA, 14 nt, Bordetella pertussis
caugcaacacgacc

SEQ ID NO: 2415180 - RNA, 19 nt, Bordetella pertussis
caugcaacacgaccagcag

SEQ ID NO: 2415181 - RNA, 22 nt, Bordetella pertussis
caugcaacacgaccagcaggcc

SEQ ID NO: 2415182 - RNA, 17 nt, Bordetella pertussis
caugcaagacaggccgc

SEQ ID NO: 2415183 - RNA, 19 nt, Bordetella pertussis
caugcaagacaggccgcua

SEQ ID NO: 2415184 - RNA, 13 nt, Bordetella pertussis
caugcaccagcac

SEQ ID NO: 2415185 - RNA, 12 nt, Bordetella pertussis
caugcggcgcca

SEQ ID NO: 2415186 - RNA, 15 nt, Bordetella pertussis
caugcggcggcgggc

SEQ ID NO: 2415187 - RNA, 12 nt, Bordetella pertussis
caugcggcuggc

SEQ ID NO: 2415188 - RNA, 14 nt, Bordetella pertussis
caugcggcuggccg

SEQ ID NO: 2415189 - RNA, 14 nt, Bordetella pertussis
caugcgggacaggc

SEQ ID NO: 2415190 - RNA, 17 nt, Bordetella pertussis
caugcgggacaggcgcc

SEQ ID NO: 2415191 - RNA, 22 nt, Bordetella pertussis
caugcgggacaggcgccacagg

SEQ ID NO: 2415192 - RNA, 18 nt, Bordetella pertussis
caugcggggacaggcacu

SEQ ID NO: 2415193 - RNA, 13 nt, Bordetella pertussis
caugcggggcggc

SEQ ID NO: 2415194 - RNA, 17 nt, Bordetella pertussis
caugcgggucaggccgc

SEQ ID NO: 2415195 - RNA, 19 nt, Bordetella pertussis
caugcgggucaggccgccg

SEQ ID NO: 2415196 - RNA, 17 nt, Bordetella pertussis
caugcgggucucggagc

SEQ ID NO: 2415197 - RNA, 18 nt, Bordetella pertussis
caugcgguuucucagcgc

SEQ ID NO: 2415198 - RNA, 20 nt, Bordetella pertussis
caugcgucgaacggccgggc

SEQ ID NO: 2415199 - RNA, 16 nt, Bordetella pertussis
caugcgugcgcaucag

SEQ ID NO: 2415200 - RNA, 17 nt, Bordetella pertussis
caugcguucggccagcc

SEQ ID NO: 2415201 - RNA, 18 nt, Bordetella pertussis
caugcguucggccagccc

SEQ ID NO: 2415202 - RNA, 17 nt, Bordetella pertussis
caugcucagcagcaccg

SEQ ID NO: 2415203 - RNA, 17 nt, Bordetella pertussis
caugcucgcgcacagcg

SEQ ID NO: 2415204 - RNA, 20 nt, Bordetella pertussis
caugcucuugaacgccuugc

SEQ ID NO: 2415205 - RNA, 19 nt, Bordetella pertussis
caugcugaauugcgggccg

SEQ ID NO: 2415206 - RNA, 21 nt, Bordetella pertussis
caugcugaauugcgggccggc

SEQ ID NO: 2415207 - RNA, 23 nt, Bordetella pertussis
caugcugaauugcgggccggcga

SEQ ID NO: 2415208 - RNA, 16 nt, Bordetella pertussis
caugcugcagcugcuu

SEQ ID NO: 2415209 - RNA, 20 nt, Bordetella pertussis
caugcugcagcugcuugccc

SEQ ID NO: 2415210 - RNA, 21 nt, Bordetella pertussis
caugcugcagcugcuugccca

SEQ ID NO: 2415211 - RNA, 18 nt, Bordetella pertussis
caugcugccaaccgcgac

SEQ ID NO: 2415212 - RNA, 20 nt, Bordetella pertussis
caugcugccaaccgcgacgc

SEQ ID NO: 2415213 - RNA, 17 nt, Bordetella pertussis
caugcugcgacagcagg

SEQ ID NO: 2415214 - RNA, 19 nt, Bordetella pertussis
caugcugcgcgaggugggc

SEQ ID NO: 2415215 - RNA, 22 nt, Bordetella pertussis
caugcugcgcgaggugggcggc

SEQ ID NO: 2415216 - RNA, 21 nt, Bordetella pertussis
caugcuggauucgccggucgg

SEQ ID NO: 2415217 - RNA, 14 nt, Bordetella pertussis
caugcuggcccagc

SEQ ID NO: 2415218 - RNA, 15 nt, Bordetella pertussis
caugcuggcccagcu

SEQ ID NO: 2415219 - RNA, 18 nt, Bordetella pertussis
caugcuggcccagcuggg

SEQ ID NO: 2415220 - RNA, 14 nt, Bordetella pertussis
caugcugggcgggc

SEQ ID NO: 2415221 - RNA, 20 nt, Bordetella pertussis
caugcugggcgggcuggugg

SEQ ID NO: 2415222 - RNA, 21 nt, Bordetella pertussis
caugcuggucaucuacagcgc

SEQ ID NO: 2415223 - RNA, 19 nt, Bordetella pertussis
caugcugucgcucaugacc

SEQ ID NO: 2415224 - RNA, 23 nt, Bordetella pertussis
caugcugucgcucaugaccagcg

SEQ ID NO: 2415225 - RNA, 21 nt, Bordetella pertussis
cauggaaccgguuggccagcu

SEQ ID NO: 2415226 - RNA, 15 nt, Bordetella pertussis
cauggaagcggcaga

SEQ ID NO: 2415227 - RNA, 19 nt, Bordetella pertussis
cauggaccgccgccgucgc

SEQ ID NO: 2415228 - RNA, 19 nt, Bordetella pertussis
cauggaccggcguccauga

SEQ ID NO: 2415229 - RNA, 19 nt, Bordetella pertussis
cauggacgagggccggcgc

SEQ ID NO: 2415230 - RNA, 23 nt, Bordetella pertussis
cauggacgaguugcucggagccc

SEQ ID NO: 2415231 - RNA, 16 nt, Bordetella pertussis
cauggacugcaggcgc

SEQ ID NO: 2415232 - RNA, 20 nt, Bordetella pertussis
cauggaggcgcagcgcggca

SEQ ID NO: 2415233 - RNA, 16 nt, Bordetella pertussis
cauggaggggcgcagg

SEQ ID NO: 2415234 - RNA, 17 nt, Bordetella pertussis
cauggaggggcgcaggc

SEQ ID NO: 2415235 - RNA, 17 nt, Bordetella pertussis
cauggaucgacugcccc

SEQ ID NO: 2415236 - RNA, 15 nt, Bordetella pertussis
cauggcacagcgcgg

SEQ ID NO: 2415237 - RNA, 23 nt, Bordetella pertussis
cauggcacagcgcggcgaaggcg

SEQ ID NO: 2415238 - RNA, 12 nt, Bordetella pertussis
cauggcagcaga

SEQ ID NO: 2415239 - RNA, 16 nt, Bordetella pertussis
cauggcagcagaucgg

SEQ ID NO: 2415240 - RNA, 20 nt, Bordetella pertussis
cauggcagcagaucggcggc

SEQ ID NO: 2415241 - RNA, 21 nt, Bordetella pertussis
cauggcagcagaucggcggcc

SEQ ID NO: 2415242 - RNA, 12 nt, Bordetella pertussis
cauggcagggcg

SEQ ID NO: 2415243 - RNA, 15 nt, Bordetella pertussis
cauggcaugagcgcc

SEQ ID NO: 2415244 - RNA, 14 nt, Bordetella pertussis
cauggccaccaggu

SEQ ID NO: 2415245 - RNA, 23 nt, Bordetella pertussis
cauggccaccagguagggcagca

SEQ ID NO: 2415246 - RNA, 12 nt, Bordetella pertussis
cauggccagccg

SEQ ID NO: 2415247 - RNA, 14 nt, Bordetella pertussis
cauggccagccgcu

SEQ ID NO: 2415248 - RNA, 16 nt, Bordetella pertussis
cauggccagcgcgcag

SEQ ID NO: 2415249 - RNA, 20 nt, Bordetella pertussis
cauggccagguacaggccgc

SEQ ID NO: 2415250 - RNA, 19 nt, Bordetella pertussis
cauggccaucgcgguccug

SEQ ID NO: 2415251 - RNA, 14 nt, Bordetella pertussis
cauggccccgggcg

SEQ ID NO: 2415252 - RNA, 13 nt, Bordetella pertussis
cauggccgacagc

SEQ ID NO: 2415253 - RNA, 14 nt, Bordetella pertussis
cauggccgcgccca

SEQ ID NO: 2415254 - RNA, 16 nt, Bordetella pertussis
cauggccgcgcccagc

SEQ ID NO: 2415255 - RNA, 19 nt, Bordetella pertussis
cauggccgcgcccagcgcg

SEQ ID NO: 2415256 - RNA, 20 nt, Bordetella pertussis
cauggccgcgcccagcgcgg

SEQ ID NO: 2415257 - RNA, 14 nt, Bordetella pertussis
cauggccggccgcc

SEQ ID NO: 2415258 - RNA, 18 nt, Bordetella pertussis
cauggccggccgccgggc

SEQ ID NO: 2415259 - RNA, 21 nt, Bordetella pertussis
cauggccguggcgugcaggcc

SEQ ID NO: 2415260 - RNA, 23 nt, Bordetella pertussis
cauggccguggcgugcaggccgg

SEQ ID NO: 2415261 - RNA, 18 nt, Bordetella pertussis
cauggccucgucgaccac

SEQ ID NO: 2415262 - RNA, 23 nt, Bordetella pertussis
cauggccucgucgaccacgccgg

SEQ ID NO: 2415263 - RNA, 23 nt, Bordetella pertussis
cauggccugcaggaagccugcgc

SEQ ID NO: 2415264 - RNA, 16 nt, Bordetella pertussis
cauggccuggcccagc

SEQ ID NO: 2415265 - RNA, 18 nt, Bordetella pertussis
cauggccuggcccagcuc

SEQ ID NO: 2415266 - RNA, 21 nt, Bordetella pertussis
cauggcgccagcuggaccgcc

SEQ ID NO: 2415267 - RNA, 19 nt, Bordetella pertussis
cauggcgccaugcgacagc

SEQ ID NO: 2415268 - RNA, 16 nt, Bordetella pertussis
cauggcgcccacggcc

SEQ ID NO: 2415269 - RNA, 17 nt, Bordetella pertussis
cauggcgcccacggccg

SEQ ID NO: 2415270 - RNA, 18 nt, Bordetella pertussis
cauggcgcccacggccgc

SEQ ID NO: 2415271 - RNA, 12 nt, Bordetella pertussis
cauggcgccgcg

SEQ ID NO: 2415272 - RNA, 13 nt, Bordetella pertussis
cauggcgccgcgc

SEQ ID NO: 2415273 - RNA, 16 nt, Bordetella pertussis
cauggcgccgcgccgc

SEQ ID NO: 2415274 - RNA, 14 nt, Bordetella pertussis
cauggcgccgcgcg

SEQ ID NO: 2415275 - RNA, 19 nt, Bordetella pertussis
cauggcgccgcgcgccgcg

SEQ ID NO: 2415276 - RNA, 14 nt, Bordetella pertussis
cauggcgcgcagca

SEQ ID NO: 2415277 - RNA, 14 nt, Bordetella pertussis
cauggcgcgccggc

SEQ ID NO: 2415278 - RNA, 17 nt, Bordetella pertussis
cauggcgcgccggccgg

SEQ ID NO: 2415279 - RNA, 16 nt, Bordetella pertussis
cauggcgcgcgccagc

SEQ ID NO: 2415280 - RNA, 22 nt, Bordetella pertussis
cauggcgcgcgccagcggcugc

SEQ ID NO: 2415281 - RNA, 23 nt, Bordetella pertussis
cauggcgcgcgccagcggcugcu

SEQ ID NO: 2415282 - RNA, 14 nt, Bordetella pertussis
cauggcgcgcgccg

SEQ ID NO: 2415283 - RNA, 15 nt, Bordetella pertussis
cauggcgcgcgccgc

SEQ ID NO: 2415284 - RNA, 10 nt, Bordetella pertussis
cauggcgcgu

SEQ ID NO: 2415285 - RNA, 15 nt, Bordetella pertussis
cauggcgcgugcgcg

SEQ ID NO: 2415286 - RNA, 21 nt, Bordetella pertussis
cauggcgcgugcgcgcgccau

SEQ ID NO: 2415287 - RNA, 16 nt, Bordetella pertussis
cauggcgcuggcaggc

SEQ ID NO: 2415288 - RNA, 19 nt, Bordetella pertussis
cauggcgcuguuggccggc

SEQ ID NO: 2415289 - RNA, 21 nt, Bordetella pertussis
cauggcgcuguuggccggcgc

SEQ ID NO: 2415290 - RNA, 13 nt, Bordetella pertussis
cauggcggcaggc

SEQ ID NO: 2415291 - RNA, 15 nt, Bordetella pertussis
cauggcggcaggcgc

SEQ ID NO: 2415292 - RNA, 16 nt, Bordetella pertussis
cauggcggcaggcgcg

SEQ ID NO: 2415293 - RNA, 14 nt, Bordetella pertussis
cauggcggccagcu

SEQ ID NO: 2415294 - RNA, 19 nt, Bordetella pertussis
cauggcggccagcuugacc

SEQ ID NO: 2415295 - RNA, 14 nt, Bordetella pertussis
cauggcggccaggc

SEQ ID NO: 2415296 - RNA, 21 nt, Bordetella pertussis
cauggcggccaggcgcgccgc

SEQ ID NO: 2415297 - RNA, 23 nt, Bordetella pertussis
cauggcggccaggcgcgccgcga

SEQ ID NO: 2415298 - RNA, 19 nt, Bordetella pertussis
cauuacccauggcaccgau

SEQ ID NO: 2415299 - RNA, 14 nt, Bordetella pertussis
cauuagggcccagc

SEQ ID NO: 2415300 - RNA, 15 nt, Bordetella pertussis
cauuagggcccagcu

SEQ ID NO: 2415301 - RNA, 13 nt, Bordetella pertussis
cauucagcgcugc

SEQ ID NO: 2415302 - RNA, 15 nt, Bordetella pertussis
cauuccagcuccggc

SEQ ID NO: 2415303 - RNA, 18 nt, Bordetella pertussis
cauuccauaugcugaagg

SEQ ID NO: 2415304 - RNA, 18 nt, Bordetella pertussis
cauuccuuccgggcccgc

SEQ ID NO: 2415305 - RNA, 18 nt, Bordetella pertussis
cauucgaacaacagcgcc

SEQ ID NO: 2415306 - RNA, 19 nt, Bordetella pertussis
cauucgaacaacagcgccu

SEQ ID NO: 2415307 - RNA, 16 nt, Bordetella pertussis
cauucgauggcggcgc

SEQ ID NO: 2415308 - RNA, 17 nt, Bordetella pertussis
cauucgauggcggcgcu

SEQ ID NO: 2415309 - RNA, 22 nt, Bordetella pertussis
cauucgcagaaggucugggcca

SEQ ID NO: 2415310 - RNA, 16 nt, Bordetella pertussis
cauucgcgccugagcu

SEQ ID NO: 2415311 - RNA, 22 nt, Bordetella pertussis
cauucgguggucugccagucca

SEQ ID NO: 2415312 - RNA, 16 nt, Bordetella pertussis
cauucgucguagccgc

SEQ ID NO: 2415313 - RNA, 22 nt, Bordetella pertussis
cauucgucguagccgccgacgu

SEQ ID NO: 2415314 - RNA, 17 nt, Bordetella pertussis
cauugaagcuggcgccg

SEQ ID NO: 2415315 - RNA, 22 nt, Bordetella pertussis
cauugaucgaucagccagccgg

SEQ ID NO: 2415316 - RNA, 18 nt, Bordetella pertussis
cauugcacaacgggcagg

SEQ ID NO: 2415317 - RNA, 14 nt, Bordetella pertussis
cauugcccacagca

SEQ ID NO: 2415318 - RNA, 13 nt, Bordetella pertussis
cauugcccagcac

SEQ ID NO: 2415319 - RNA, 18 nt, Bordetella pertussis
cauugcccagcaccacgg

SEQ ID NO: 2415320 - RNA, 20 nt, Bordetella pertussis
cauugcccagcaccacgggc

SEQ ID NO: 2415321 - RNA, 23 nt, Bordetella pertussis
cauugccgcacgaucgcgccggc

SEQ ID NO: 2415322 - RNA, 20 nt, Bordetella pertussis
cauugccgccaacgcggcgc

SEQ ID NO: 2415323 - RNA, 18 nt, Bordetella pertussis
cauugccggagcagcagc

SEQ ID NO: 2415324 - RNA, 11 nt, Bordetella pertussis
cauugccggcg

SEQ ID NO: 2415325 - RNA, 21 nt, Bordetella pertussis
cauugccgucggccgcgccca

SEQ ID NO: 2415326 - RNA, 16 nt, Bordetella pertussis
cauugccucgcggcag

SEQ ID NO: 2415327 - RNA, 20 nt, Bordetella pertussis
cauugcgccguugcgggcug

SEQ ID NO: 2415328 - RNA, 12 nt, Bordetella pertussis
cauugcgcggcc

SEQ ID NO: 2415329 - RNA, 20 nt, Bordetella pertussis
cauugcggcaccugcugcuu

SEQ ID NO: 2415330 - RNA, 14 nt, Bordetella pertussis
cauugcggcgggcg

SEQ ID NO: 2415331 - RNA, 15 nt, Bordetella pertussis
cauugcgguccagga

SEQ ID NO: 2415332 - RNA, 20 nt, Bordetella pertussis
cauugcgguccaggaagcgc

SEQ ID NO: 2415333 - RNA, 12 nt, Bordetella pertussis
cauuggccagcg

SEQ ID NO: 2415334 - RNA, 14 nt, Bordetella pertussis
cauuggcccugcug

SEQ ID NO: 2415335 - RNA, 13 nt, Bordetella pertussis
cauuggcgccgcg

SEQ ID NO: 2415336 - RNA, 15 nt, Bordetella pertussis
cauuggcgccgcgcu

SEQ ID NO: 2415337 - RNA, 13 nt, Bordetella pertussis
cauuggcgcgcuu

SEQ ID NO: 2415338 - RNA, 14 nt, Bordetella pertussis
cauuggcggcggcg

SEQ ID NO: 2415339 - RNA, 17 nt, Bordetella pertussis
cauugggacgcggccuu

SEQ ID NO: 2415340 - RNA, 20 nt, Bordetella pertussis
cauugucaagcagcgccggc

SEQ ID NO: 2415341 - RNA, 19 nt, Bordetella pertussis
cauuuccagaacggcuugg

SEQ ID NO: 2415342 - RNA, 19 nt, Bordetella pertussis
cauuucccagccgucgcgc

SEQ ID NO: 2415343 - RNA, 19 nt, Bordetella pertussis
cauuuccucgaccagcgcg

SEQ ID NO: 2415344 - RNA, 21 nt, Bordetella pertussis
cauuuccugggccucuagcuc

SEQ ID NO: 2415345 - RNA, 23 nt, Bordetella pertussis
cauuuccugggccucuagcucau

SEQ ID NO: 2415346 - RNA, 21 nt, Bordetella pertussis
cauuucgaacaaggcgguggc

SEQ ID NO: 2415347 - RNA, 21 nt, Bordetella pertussis
cauuucgaugcgcaccaugcg

SEQ ID NO: 2415348 - RNA, 19 nt, Bordetella pertussis
cauuucgauuucggcggcc

SEQ ID NO: 2415349 - RNA, 20 nt, Bordetella pertussis
cauuucgcgugcguggucgc

SEQ ID NO: 2415350 - RNA, 16 nt, Bordetella pertussis
cauuucgcugggcgcg

SEQ ID NO: 2415351 - RNA, 18 nt, Bordetella pertussis
cauuucggcgccgccggc

SEQ ID NO: 2415352 - RNA, 15 nt, Bordetella pertussis
cauuucggcgccgcg

SEQ ID NO: 2415353 - RNA, 15 nt, Bordetella pertussis
cauuugccgcggcga

SEQ ID NO: 2415354 - RNA, 19 nt, Bordetella pertussis
cauuugcgaggugcccgcg

SEQ ID NO: 2415355 - RNA, 17 nt, Bordetella pertussis
cauuuucugccacagcg

SEQ ID NO: 2415356 - RNA, 18 nt, Bordetella pertussis
ccaaaaaaaaaccccgcc

SEQ ID NO: 2415357 - RNA, 18 nt, Bordetella pertussis
ccaaaaggcagcaggcug

SEQ ID NO: 2415358 - RNA, 22 nt, Bordetella pertussis
ccaaacaccaggaagagcuggc

SEQ ID NO: 2415359 - RNA, 18 nt, Bordetella pertussis
ccaacaugccggacaagc

SEQ ID NO: 2415360 - RNA, 14 nt, Bordetella pertussis
ccaacccaggucgc

SEQ ID NO: 2415361 - RNA, 13 nt, Bordetella pertussis
ccaaccccgaggg

SEQ ID NO: 2415362 - RNA, 19 nt, Bordetella pertussis
ccaacccggcgaggccgcc

SEQ ID NO: 2415363 - RNA, 22 nt, Bordetella pertussis
ccaacccggcgaggccgcccgc

SEQ ID NO: 2415364 - RNA, 16 nt, Bordetella pertussis
ccaacccucgcacggc

SEQ ID NO: 2415365 - RNA, 13 nt, Bordetella pertussis
ccaaccugaccgc

SEQ ID NO: 2415366 - RNA, 15 nt, Bordetella pertussis
ccaaccugaccgccu

SEQ ID NO: 2415367 - RNA, 17 nt, Bordetella pertussis
ccaaccugcuggccacc

SEQ ID NO: 2415368 - RNA, 22 nt, Bordetella pertussis
ccaaccugguauccggcgcacg

SEQ ID NO: 2415369 - RNA, 15 nt, Bordetella pertussis
ccaacgaggacaacc

SEQ ID NO: 2415370 - RNA, 18 nt, Bordetella pertussis
ccaacgccaagcugcugg

SEQ ID NO: 2415371 - RNA, 15 nt, Bordetella pertussis
ccaacgcggccagcg

SEQ ID NO: 2415372 - RNA, 14 nt, Bordetella pertussis
ccaacgcggcgcgu

SEQ ID NO: 2415373 - RNA, 21 nt, Bordetella pertussis
ccaacgcggcgucgacgcccg

SEQ ID NO: 2415374 - RNA, 22 nt, Bordetella pertussis
ccaacgcggcgucgacgcccgc

SEQ ID NO: 2415375 - RNA, 14 nt, Bordetella pertussis
ccaacggcgcaccg

SEQ ID NO: 2415376 - RNA, 12 nt, Bordetella pertussis
ccaacggcuggc

SEQ ID NO: 2415377 - RNA, 23 nt, Bordetella pertussis
ccaacggcuggcugggcgcgccg

SEQ ID NO: 2415378 - RNA, 20 nt, Bordetella pertussis
ccaacggggacgggcgcccg

SEQ ID NO: 2415379 - RNA, 12 nt, Bordetella pertussis
ccaacggggccg

SEQ ID NO: 2415380 - RNA, 15 nt, Bordetella pertussis
ccaacggggccgcca

SEQ ID NO: 2415381 - RNA, 16 nt, Bordetella pertussis
accagcagccccagcg

SEQ ID NO: 2415382 - RNA, 19 nt, Bordetella pertussis
accagcagccgguuggcgc

SEQ ID NO: 2415383 - RNA, 14 nt, Bordetella pertussis
accagcagcgccag

SEQ ID NO: 2415384 - RNA, 15 nt, Bordetella pertussis
accagcagcgccagg

SEQ ID NO: 2415385 - RNA, 13 nt, Bordetella pertussis
accagcagcgccg

SEQ ID NO: 2415386 - RNA, 13 nt, Bordetella pertussis
accagcaggaugg

SEQ ID NO: 2415387 - RNA, 17 nt, Bordetella pertussis
accagcaggauggaucc

SEQ ID NO: 2415388 - RNA, 20 nt, Bordetella pertussis
accagcaggcccaccagggc

SEQ ID NO: 2415389 - RNA, 14 nt, Bordetella pertussis
accagcaggccggu

SEQ ID NO: 2415390 - RNA, 18 nt, Bordetella pertussis
accagcaggcggccgacc

SEQ ID NO: 2415391 - RNA, 21 nt, Bordetella pertussis
accagcaggcggccgaccagc

SEQ ID NO: 2415392 - RNA, 19 nt, Bordetella pertussis
accagcauccucacguggc

SEQ ID NO: 2415393 - RNA, 14 nt, Bordetella pertussis
accagcaucgcgcc

SEQ ID NO: 2415394 - RNA, 16 nt, Bordetella pertussis
accagcaucgcgccuu

SEQ ID NO: 2415395 - RNA, 21 nt, Bordetella pertussis
accagcaucgcgccuucggcg

SEQ ID NO: 2415396 - RNA, 18 nt, Bordetella pertussis
accagcauguccgccaug

SEQ ID NO: 2415397 - RNA, 14 nt, Bordetella pertussis
accagccagccgcc

SEQ ID NO: 2415398 - RNA, 16 nt, Bordetella pertussis
accagcccagcccgcc

SEQ ID NO: 2415399 - RNA, 12 nt, Bordetella pertussis
accagcccaguu

SEQ ID NO: 2415400 - RNA, 20 nt, Bordetella pertussis
accagcccgaugcgccaggc

SEQ ID NO: 2415401 - RNA, 14 nt, Bordetella pertussis
accagcccgcccgc

SEQ ID NO: 2415402 - RNA, 14 nt, Bordetella pertussis
accagcccggccgc

SEQ ID NO: 2415403 - RNA, 16 nt, Bordetella pertussis
accagcccggccgcca

SEQ ID NO: 2415404 - RNA, 12 nt, Bordetella pertussis
accagcccggcg

SEQ ID NO: 2415405 - RNA, 17 nt, Bordetella pertussis
accagccggccgccgaa

SEQ ID NO: 2415406 - RNA, 19 nt, Bordetella pertussis
accagccggccgccgaacg

SEQ ID NO: 2415407 - RNA, 15 nt, Bordetella pertussis
accagccgggcggcc

SEQ ID NO: 2415408 - RNA, 15 nt, Bordetella pertussis
accagcgacagcacg

SEQ ID NO: 2415409 - RNA, 22 nt, Bordetella pertussis
accagcgaggcggcaagcggcg

SEQ ID NO: 2415410 - RNA, 24 nt, Bordetella pertussis
accagcgaggcggcaagcggcgug

SEQ ID NO: 2415411 - RNA, 14 nt, Bordetella pertussis
ccaagggcgccgcg

SEQ ID NO: 2415412 - RNA, 17 nt, Bordetella pertussis
ccaagggcgccgcgccg

SEQ ID NO: 2415413 - RNA, 16 nt, Bordetella pertussis
ccaagggcgccgggcg

SEQ ID NO: 2415414 - RNA, 17 nt, Bordetella pertussis
ccaagggcgcgccagca

SEQ ID NO: 2415415 - RNA, 18 nt, Bordetella pertussis
ccaagggcgcgccagcac

SEQ ID NO: 2415416 - RNA, 23 nt, Bordetella pertussis
ccaaguccgguauccuggcgcgg

SEQ ID NO: 2415417 - RNA, 19 nt, Bordetella pertussis
ccaauacaggaagcgcugg

SEQ ID NO: 2415418 - RNA, 22 nt, Bordetella pertussis
ccaauacccgccacagauuggc

SEQ ID NO: 2415419 - RNA, 22 nt, Bordetella pertussis
ccaauaccugaucucgcgcacc

SEQ ID NO: 2415420 - RNA, 14 nt, Bordetella pertussis
ccaauacgccgcca

SEQ ID NO: 2415421 - RNA, 15 nt, Bordetella pertussis
ccaauacgccgccau

SEQ ID NO: 2415422 - RNA, 19 nt, Bordetella pertussis
ccaauccgcgaagugccug

SEQ ID NO: 2415423 - RNA, 20 nt, Bordetella pertussis
ccaauccgcgaagugccugu

SEQ ID NO: 2415424 - RNA, 17 nt, Bordetella pertussis
ccaaucgggcagcacgc

SEQ ID NO: 2415425 - RNA, 14 nt, Bordetella pertussis
ccaaucugccgcug

SEQ ID NO: 2415426 - RNA, 19 nt, Bordetella pertussis
ccaaucugccgcugaccgg

SEQ ID NO: 2415427 - RNA, 17 nt, Bordetella pertussis
ccaaucuugccaggccc

SEQ ID NO: 2415428 - RNA, 19 nt, Bordetella pertussis
ccaaucuugccaggcccgg

SEQ ID NO: 2415429 - RNA, 20 nt, Bordetella pertussis
ccaaucuugccaggcccggc

SEQ ID NO: 2415430 - RNA, 20 nt, Bordetella pertussis
ccaaugccuauuggcuguau

SEQ ID NO: 2415431 - RNA, 17 nt, Bordetella pertussis
ccaauggccgcggcgug

SEQ ID NO: 2415432 - RNA, 16 nt, Bordetella pertussis
ccaaugugcugacggu

SEQ ID NO: 2415433 - RNA, 14 nt, Bordetella pertussis
ccaauucgagcagg

SEQ ID NO: 2415434 - RNA, 15 nt, Bordetella pertussis
ccacaagcggcccca

SEQ ID NO: 2415435 - RNA, 21 nt, Bordetella pertussis
ccacaaggauggacuggccgc

SEQ ID NO: 2415436 - RNA, 16 nt, Bordetella pertussis
ccacaauugccagccu

SEQ ID NO: 2415437 - RNA, 21 nt, Bordetella pertussis
ccacaccagguugucggcgcc

SEQ ID NO: 2415438 - RNA, 22 nt, Bordetella pertussis
ccacaccagguugucggcgcca

SEQ ID NO: 2415439 - RNA, 23 nt, Bordetella pertussis
ccacacgaggaccgcgaugcugc

SEQ ID NO: 2415440 - RNA, 18 nt, Bordetella pertussis
ccacacgaucgucagcag

SEQ ID NO: 2415441 - RNA, 21 nt, Bordetella pertussis
ccacacgaucgucagcagcac

SEQ ID NO: 2415442 - RNA, 13 nt, Bordetella pertussis
ccacacgcgcgca

SEQ ID NO: 2415443 - RNA, 23 nt, Bordetella pertussis
ccacacgcgcgcaaugcgcggcg

SEQ ID NO: 2415444 - RNA, 14 nt, Bordetella pertussis
ccacacgggcgccu

SEQ ID NO: 2415445 - RNA, 17 nt, Bordetella pertussis
ccacagcagcgcgccgc

SEQ ID NO: 2415446 - RNA, 13 nt, Bordetella pertussis
ccacagcaugacc

SEQ ID NO: 2415447 - RNA, 19 nt, Bordetella pertussis
ccacagcaugaccucggcc

SEQ ID NO: 2415448 - RNA, 13 nt, Bordetella pertussis
ccacagccacugc

SEQ ID NO: 2415449 - RNA, 13 nt, Bordetella pertussis
ccacagcccggcc

SEQ ID NO: 2415450 - RNA, 15 nt, Bordetella pertussis
ccacagcccggcccc

SEQ ID NO: 2415451 - RNA, 17 nt, Bordetella pertussis
ccacagcccggccccca

SEQ ID NO: 2415452 - RNA, 21 nt, Bordetella pertussis
ccacagcccggcccccagccc

SEQ ID NO: 2415453 - RNA, 15 nt, Bordetella pertussis
ccacagcgcccccag

SEQ ID NO: 2415454 - RNA, 16 nt, Bordetella pertussis
ccacagcgcccccagc

SEQ ID NO: 2415455 - RNA, 12 nt, Bordetella pertussis
ccacagcgccgc

SEQ ID NO: 2415456 - RNA, 15 nt, Bordetella pertussis
ccacagcgccgcggc

SEQ ID NO: 2415457 - RNA, 20 nt, Bordetella pertussis
ccacagcgugacggcggcgc

SEQ ID NO: 2415458 - RNA, 22 nt, Bordetella pertussis
ccacagcgugacggcggcgcgc

SEQ ID NO: 2415459 - RNA, 22 nt, Bordetella pertussis
ccacagcuggugccgguugcgc

SEQ ID NO: 2415460 - RNA, 20 nt, Bordetella pertussis
ccacaggagacuggcagugc

SEQ ID NO: 2415461 - RNA, 16 nt, Bordetella pertussis
ccacaggcccaugccg

SEQ ID NO: 2415462 - RNA, 23 nt, Bordetella pertussis
ccacaggccuucguugaccgcuu

SEQ ID NO: 2415463 - RNA, 23 nt, Bordetella pertussis
ccacaggcgcgcggcguugcggc

SEQ ID NO: 2415464 - RNA, 20 nt, Bordetella pertussis
ccacagggggacuggcaccc

SEQ ID NO: 2415465 - RNA, 14 nt, Bordetella pertussis
ccacaggguggcgc

SEQ ID NO: 2415466 - RNA, 21 nt, Bordetella pertussis
ccacaggguggcgcccaggua

SEQ ID NO: 2415467 - RNA, 22 nt, Bordetella pertussis
ccacagguauucgggaugggcc

SEQ ID NO: 2415468 - RNA, 15 nt, Bordetella pertussis
ccacaggugcgcggc

SEQ ID NO: 2415469 - RNA, 16 nt, Bordetella pertussis
ccacaggugcgcggcg

SEQ ID NO: 2415470 - RNA, 17 nt, Bordetella pertussis
ccacaggugcgcggcgc

SEQ ID NO: 2415471 - RNA, 19 nt, Bordetella pertussis
ccacaggugcgcggcgcgc

SEQ ID NO: 2415472 - RNA, 20 nt, Bordetella pertussis
ccacaggugcgcggcgcgcc

SEQ ID NO: 2415473 - RNA, 21 nt, Bordetella pertussis
ccacaggugcgcggcgcgccg

SEQ ID NO: 2415474 - RNA, 17 nt, Bordetella pertussis
ccacagguuggccgcga

SEQ ID NO: 2415475 - RNA, 14 nt, Bordetella pertussis
ccacagucggucgc

SEQ ID NO: 2415476 - RNA, 15 nt, Bordetella pertussis
ccacauagaccggcu

SEQ ID NO: 2415477 - RNA, 16 nt, Bordetella pertussis
ccacauagcggccggc

SEQ ID NO: 2415478 - RNA, 17 nt, Bordetella pertussis
ccacauagcggccggcg

SEQ ID NO: 2415479 - RNA, 12 nt, Bordetella pertussis
ccacaucaucga

SEQ ID NO: 2415480 - RNA, 21 nt, Bordetella pertussis
ccacauccgcgcugcugccgu

SEQ ID NO: 2415481 - RNA, 14 nt, Bordetella pertussis
ccacaucgaaggca

SEQ ID NO: 2415482 - RNA, 13 nt, Bordetella pertussis
ccacaucgccggc

SEQ ID NO: 2415483 - RNA, 18 nt, Bordetella pertussis
ccacaucgccggcggcgu

SEQ ID NO: 2415484 - RNA, 16 nt, Bordetella pertussis
ccacaugccgugccag

SEQ ID NO: 2415485 - RNA, 17 nt, Bordetella pertussis
ccacauggggacuggca

SEQ ID NO: 2415486 - RNA, 18 nt, Bordetella pertussis
ccacauggggacuggcac

SEQ ID NO: 2415487 - RNA, 21 nt, Bordetella pertussis
ccacauggggacuggcacccg

SEQ ID NO: 2415488 - RNA, 22 nt, Bordetella pertussis
ccacauggggacuggcacccgc

SEQ ID NO: 2415489 - RNA, 14 nt, Bordetella pertussis
ccaccaacgaaggc

SEQ ID NO: 2415490 - RNA, 12 nt, Bordetella pertussis
ccaccaccagcg

SEQ ID NO: 2415491 - RNA, 13 nt, Bordetella pertussis
ccaccaccagcgg

SEQ ID NO: 2415492 - RNA, 14 nt, Bordetella pertussis
ccaccaccaggccg

SEQ ID NO: 2415493 - RNA, 16 nt, Bordetella pertussis
ccaccaccaggccggc

SEQ ID NO: 2415494 - RNA, 15 nt, Bordetella pertussis
ccaccacccaggccc

SEQ ID NO: 2415495 - RNA, 14 nt, Bordetella pertussis
ccaccaccgcccgc

SEQ ID NO: 2415496 - RNA, 15 nt, Bordetella pertussis
ccaccaccgcccgca

SEQ ID NO: 2415497 - RNA, 19 nt, Bordetella pertussis
ccaccaccggcacgccggc

SEQ ID NO: 2415498 - RNA, 17 nt, Bordetella pertussis
ccaccacgauggcgcaa

SEQ ID NO: 2415499 - RNA, 17 nt, Bordetella pertussis
ccaccacgccgcccagc

SEQ ID NO: 2415500 - RNA, 14 nt, Bordetella pertussis
ccaccacgcgcacc

SEQ ID NO: 2415501 - RNA, 16 nt, Bordetella pertussis
ccaccacgcgcaccag

SEQ ID NO: 2415502 - RNA, 13 nt, Bordetella pertussis
ccaccacgcuggc

SEQ ID NO: 2415503 - RNA, 14 nt, Bordetella pertussis
ccaccacggcgcgg

SEQ ID NO: 2415504 - RNA, 21 nt, Bordetella pertussis
ccaccacgucgcggcugggca

SEQ ID NO: 2415505 - RNA, 23 nt, Bordetella pertussis
ccaccacugcaaggcccgcccgg

SEQ ID NO: 2415506 - RNA, 22 nt, Bordetella pertussis
ccaccagaucgauaccgucgcg

SEQ ID NO: 2415507 - RNA, 23 nt, Bordetella pertussis
ccaccagaucgauaccgucgcgc

SEQ ID NO: 2415508 - RNA, 22 nt, Bordetella pertussis
ccaccagcaccgaugcgccggc

SEQ ID NO: 2415509 - RNA, 18 nt, Bordetella pertussis
ccaccagcaccgccacgc

SEQ ID NO: 2415510 - RNA, 18 nt, Bordetella pertussis
ccaccagcaccggcagcg

SEQ ID NO: 2415511 - RNA, 19 nt, Bordetella pertussis
ccaccagcaccggcagcgu

SEQ ID NO: 2415512 - RNA, 14 nt, Bordetella pertussis
ccaccagcagcgcc

SEQ ID NO: 2415513 - RNA, 15 nt, Bordetella pertussis
ccaccagcaggaugg

SEQ ID NO: 2415514 - RNA, 14 nt, Bordetella pertussis
ccaccagccggccg

SEQ ID NO: 2415515 - RNA, 15 nt, Bordetella pertussis
ccaccagccggccgc

SEQ ID NO: 2415516 - RNA, 16 nt, Bordetella pertussis
ccaccagccggccgcc

SEQ ID NO: 2415517 - RNA, 22 nt, Bordetella pertussis
ccaccagccgggcggccacggc

SEQ ID NO: 2415518 - RNA, 11 nt, Bordetella pertussis
ccaccagcgcc

SEQ ID NO: 2415519 - RNA, 14 nt, Bordetella pertussis
ccaccagcgcgcca

SEQ ID NO: 2415520 - RNA, 16 nt, Bordetella pertussis
ccaccagcgcgccagc

SEQ ID NO: 2415521 - RNA, 14 nt, Bordetella pertussis
ccaccagcggcgug

SEQ ID NO: 2415522 - RNA, 23 nt, Bordetella pertussis
ccaccagcggcgugcggcccagc

SEQ ID NO: 2415523 - RNA, 20 nt, Bordetella pertussis
ccaccagcggcguggcggcc

SEQ ID NO: 2415524 - RNA, 19 nt, Bordetella pertussis
ccaccuugacgcgcaggcc

SEQ ID NO: 2415525 - RNA, 21 nt, Bordetella pertussis
ccaccuugacgcgcaggccau

SEQ ID NO: 2415526 - RNA, 18 nt, Bordetella pertussis
ccaccuugcccagcagcu

SEQ ID NO: 2415527 - RNA, 20 nt, Bordetella pertussis
ccacgaacacgaugaagaug

SEQ ID NO: 2415528 - RNA, 13 nt, Bordetella pertussis
ccacgaacgccac

SEQ ID NO: 2415529 - RNA, 18 nt, Bordetella pertussis
ccacgaacgccacgcccg

SEQ ID NO: 2415530 - RNA, 20 nt, Bordetella pertussis
ccacgaacgccacgcccguc

SEQ ID NO: 2415531 - RNA, 15 nt, Bordetella pertussis
ccacgaacggcgcga

SEQ ID NO: 2415532 - RNA, 15 nt, Bordetella pertussis
ccacgaagcgcagca

SEQ ID NO: 2415533 - RNA, 13 nt, Bordetella pertussis
ccacgaaggcagc

SEQ ID NO: 2415534 - RNA, 15 nt, Bordetella pertussis
ccacgaaggcagcac

SEQ ID NO: 2415535 - RNA, 15 nt, Bordetella pertussis
ccacgaaggcgaucu

SEQ ID NO: 2415536 - RNA, 21 nt, Bordetella pertussis
ccacgaaggcgaucugcggcg

SEQ ID NO: 2415537 - RNA, 20 nt, Bordetella pertussis
ccacgaauuccucgccgccc

SEQ ID NO: 2415538 - RNA, 12 nt, Bordetella pertussis
ccacgaccacca

SEQ ID NO: 2415539 - RNA, 13 nt, Bordetella pertussis
ccacgaccaccag

SEQ ID NO: 2415540 - RNA, 15 nt, Bordetella pertussis
ccacgaccaccagcg

SEQ ID NO: 2415541 - RNA, 14 nt, Bordetella pertussis
ccacgaccggcucg

SEQ ID NO: 2415542 - RNA, 22 nt, Bordetella pertussis
ccacgaccggcucgaucgccgc

SEQ ID NO: 2415543 - RNA, 17 nt, Bordetella pertussis
ccacgaccuuggcggcc

SEQ ID NO: 2415544 - RNA, 20 nt, Bordetella pertussis
ccacgacguagucggcgccc

SEQ ID NO: 2415545 - RNA, 22 nt, Bordetella pertussis
ccacgagcaguacacgcgcaac

SEQ ID NO: 2415546 - RNA, 22 nt, Bordetella pertussis
ccacgaucauggucaugcccuc

SEQ ID NO: 2415547 - RNA, 22 nt, Bordetella pertussis
ccacgaugcgggcaucgcccug

SEQ ID NO: 2415548 - RNA, 14 nt, Bordetella pertussis
ccacgauggccggc

SEQ ID NO: 2415549 - RNA, 15 nt, Bordetella pertussis
ccacgauggccggcg

SEQ ID NO: 2415550 - RNA, 14 nt, Bordetella pertussis
ccacgauggcgcaa

SEQ ID NO: 2415551 - RNA, 22 nt, Bordetella pertussis
ccacgauggcgcaauaggccgc

SEQ ID NO: 2415552 - RNA, 24 nt, Bordetella pertussis
ccacgauggcgcaauaggccgcga

SEQ ID NO: 2415553 - RNA, 15 nt, Bordetella pertussis
ccacgaugucggcgc

SEQ ID NO: 2415554 - RNA, 16 nt, Bordetella pertussis
ccacgaugucggcgca

SEQ ID NO: 2415555 - RNA, 18 nt, Bordetella pertussis
ccacgaugucggcgcaau

SEQ ID NO: 2415556 - RNA, 24 nt, Bordetella pertussis
ccacgaugucguacacaugcuugc

SEQ ID NO: 2415557 - RNA, 22 nt, Bordetella pertussis
ccacgaugucguccagcuccag

SEQ ID NO: 2415558 - RNA, 17 nt, Bordetella pertussis
ccacgauguugcgcagg

SEQ ID NO: 2415559 - RNA, 22 nt, Bordetella pertussis
ccacgauguugcgcaggcuguc

SEQ ID NO: 2415560 - RNA, 18 nt, Bordetella pertussis
ccacgcaggcgggcgccg

SEQ ID NO: 2415561 - RNA, 19 nt, Bordetella pertussis
ccacgcaggcgggcgccgc

SEQ ID NO: 2415562 - RNA, 20 nt, Bordetella pertussis
ccacgcaggcgggcgccgcg

SEQ ID NO: 2415563 - RNA, 13 nt, Bordetella pertussis
ccacgccaaggag

SEQ ID NO: 2415564 - RNA, 13 nt, Bordetella pertussis
ccacgccauggac

SEQ ID NO: 2415565 - RNA, 17 nt, Bordetella pertussis
ccacgccauggacgccg

SEQ ID NO: 2415566 - RNA, 16 nt, Bordetella pertussis
ccacgcccacgcgccg

SEQ ID NO: 2415567 - RNA, 17 nt, Bordetella pertussis
ccacgcccacgcgccgc

SEQ ID NO: 2415568 - RNA, 13 nt, Bordetella pertussis
ccacgcccacuuc

SEQ ID NO: 2415569 - RNA, 22 nt, Bordetella pertussis
ccacgcccacuuccucggcgcg

SEQ ID NO: 2415570 - RNA, 23 nt, Bordetella pertussis
ccacgcccacuuccucggcgcgc

SEQ ID NO: 2415571 - RNA, 16 nt, Bordetella pertussis
ccacgcccagcgccgg

SEQ ID NO: 2415572 - RNA, 19 nt, Bordetella pertussis
ccacgcccagcgccggcac

SEQ ID NO: 2415573 - RNA, 14 nt, Bordetella pertussis
ccacgcccaggccg

SEQ ID NO: 2415574 - RNA, 16 nt, Bordetella pertussis
ccacgcccaggccgcu

SEQ ID NO: 2415575 - RNA, 17 nt, Bordetella pertussis
ccacgcccaggccgugg

SEQ ID NO: 2415576 - RNA, 21 nt, Bordetella pertussis
ccacgcccaggccguggcgca

SEQ ID NO: 2415577 - RNA, 22 nt, Bordetella pertussis
ccacgcccauguagaacgccag

SEQ ID NO: 2415578 - RNA, 15 nt, Bordetella pertussis
ccacgcccgcgccga

SEQ ID NO: 2415579 - RNA, 15 nt, Bordetella pertussis
ccacgcccgcgccgc

SEQ ID NO: 2415580 - RNA, 23 nt, Bordetella pertussis
ccacgcccggugccugccccugc

SEQ ID NO: 2415581 - RNA, 14 nt, Bordetella pertussis
ccacgcccgucccg

SEQ ID NO: 2415582 - RNA, 17 nt, Bordetella pertussis
ccacgcccgucucgcgc

SEQ ID NO: 2415583 - RNA, 19 nt, Bordetella pertussis
ccacgcccgucucgcgcgc

SEQ ID NO: 2415584 - RNA, 21 nt, Bordetella pertussis
ccacgcccgucucgcgcgcca

SEQ ID NO: 2415585 - RNA, 23 nt, Bordetella pertussis
ccacgcccgucucgcgcgccagg

SEQ ID NO: 2415586 - RNA, 14 nt, Bordetella pertussis
ccacgcccuggauc

SEQ ID NO: 2415587 - RNA, 20 nt, Bordetella pertussis
ccacgcccuggcuggcggcc

SEQ ID NO: 2415588 - RNA, 14 nt, Bordetella pertussis
ccacgccgaagugg

SEQ ID NO: 2415589 - RNA, 17 nt, Bordetella pertussis
ccacgccgaugcacagg

SEQ ID NO: 2415590 - RNA, 17 nt, Bordetella pertussis
ccacgccgaugccgcgc

SEQ ID NO: 2415591 - RNA, 19 nt, Bordetella pertussis
ccacgccgaugccgcgcac

SEQ ID NO: 2415592 - RNA, 20 nt, Bordetella pertussis
ccacgccgaugccgcgcacc

SEQ ID NO: 2415593 - RNA, 13 nt, Bordetella pertussis
ccacgccgcccag

SEQ ID NO: 2415594 - RNA, 14 nt, Bordetella pertussis
ccacgccgcccagc

SEQ ID NO: 2415595 - RNA, 20 nt, Bordetella pertussis
ccacgccgcccagcgcgugg

SEQ ID NO: 2415596 - RNA, 23 nt, Bordetella pertussis
ccacgccgccgaaguaguugguc

SEQ ID NO: 2415597 - RNA, 17 nt, Bordetella pertussis
ccacgccgccgaccucg

SEQ ID NO: 2415598 - RNA, 13 nt, Bordetella pertussis
ccacgccgccgua

SEQ ID NO: 2415599 - RNA, 15 nt, Bordetella pertussis
ccacgccgccuggcc

SEQ ID NO: 2415600 - RNA, 14 nt, Bordetella pertussis
ccacgccgcgcgcg

SEQ ID NO: 2415601 - RNA, 18 nt, Bordetella pertussis
ccacgccgcgcgcgucgc

SEQ ID NO: 2415602 - RNA, 13 nt, Bordetella pertussis
ccacgccgcugau

SEQ ID NO: 2415603 - RNA, 14 nt, Bordetella pertussis
ccacgccggccagc

SEQ ID NO: 2415604 - RNA, 12 nt, Bordetella pertussis
ccacgccggccg

SEQ ID NO: 2415605 - RNA, 13 nt, Bordetella pertussis
ccacgccggccgg

SEQ ID NO: 2415606 - RNA, 16 nt, Bordetella pertussis
ccacgccggccggggu

SEQ ID NO: 2415607 - RNA, 14 nt, Bordetella pertussis
ccacgccggcgcgc

SEQ ID NO: 2415608 - RNA, 16 nt, Bordetella pertussis
ccacgccggcgcgccg

SEQ ID NO: 2415609 - RNA, 18 nt, Bordetella pertussis
ccacgccggcgcgccggc

SEQ ID NO: 2415610 - RNA, 22 nt, Bordetella pertussis
ccacgccggcgcgccggccgcg

SEQ ID NO: 2415611 - RNA, 13 nt, Bordetella pertussis
ccacgccggcggu

SEQ ID NO: 2415612 - RNA, 14 nt, Bordetella pertussis
ccacgccuuccggc

SEQ ID NO: 2415613 - RNA, 23 nt, Bordetella pertussis
ccacgccuucgagcaccaugccg

SEQ ID NO: 2415614 - RNA, 16 nt, Bordetella pertussis
ccacgccuucggcgcg

SEQ ID NO: 2415615 - RNA, 17 nt, Bordetella pertussis
ccacgccuucggcgcgc

SEQ ID NO: 2415616 - RNA, 23 nt, Bordetella pertussis
ccacgccuucggcgcgcgccggc

SEQ ID NO: 2415617 - RNA, 19 nt, Bordetella pertussis
ccacgccuuguucgcgcgc

SEQ ID NO: 2415618 - RNA, 17 nt, Bordetella pertussis
ccacgcgcaacgccgcc

SEQ ID NO: 2415619 - RNA, 18 nt, Bordetella pertussis
ccacgcgcaacgccgcca

SEQ ID NO: 2415620 - RNA, 11 nt, Bordetella pertussis
ccacgcgcaca

SEQ ID NO: 2415621 - RNA, 14 nt, Bordetella pertussis
ccacgcgcaccagc

SEQ ID NO: 2415622 - RNA, 18 nt, Bordetella pertussis
ccacgcgccgccaggcgc

SEQ ID NO: 2415623 - RNA, 14 nt, Bordetella pertussis
ccacgcgccgcccg

SEQ ID NO: 2415624 - RNA, 11 nt, Bordetella pertussis
ccacgcgccgu

SEQ ID NO: 2415625 - RNA, 22 nt, Bordetella pertussis
ccacgcgcgauccgcgccaggc

SEQ ID NO: 2415626 - RNA, 14 nt, Bordetella pertussis
ccacgcgcgcgccg

SEQ ID NO: 2415627 - RNA, 18 nt, Bordetella pertussis
ccacgcgcgcgccgccgg

SEQ ID NO: 2415628 - RNA, 21 nt, Bordetella pertussis
ccacgcgcgcgccgccggcca

SEQ ID NO: 2415629 - RNA, 14 nt, Bordetella pertussis
ccacgcgcggcggc

SEQ ID NO: 2415630 - RNA, 15 nt, Bordetella pertussis
ccacgcgcgggcugg

SEQ ID NO: 2415631 - RNA, 13 nt, Bordetella pertussis
ccacgcgcuccau

SEQ ID NO: 2415632 - RNA, 23 nt, Bordetella pertussis
ccacgcgcuccaugaucucgggc

SEQ ID NO: 2415633 - RNA, 15 nt, Bordetella pertussis
ccacgcgcuccugcu

SEQ ID NO: 2415634 - RNA, 17 nt, Bordetella pertussis
ccacgcgcugcagcagc

SEQ ID NO: 2415635 - RNA, 17 nt, Bordetella pertussis
ccacgcgcugcgcgccg

SEQ ID NO: 2415636 - RNA, 20 nt, Bordetella pertussis
ccacgcgcuguugcuggcca

SEQ ID NO: 2415637 - RNA, 14 nt, Bordetella pertussis
ccacugccaguagg

SEQ ID NO: 2415638 - RNA, 20 nt, Bordetella pertussis
ccacugccaguaggcgcccc

SEQ ID NO: 2415639 - RNA, 22 nt, Bordetella pertussis
ccacugccaguaggcgccccag

SEQ ID NO: 2415640 - RNA, 18 nt, Bordetella pertussis
ccacugcggcccgagcca

SEQ ID NO: 2415641 - RNA, 14 nt, Bordetella pertussis
ccacuggccuugug

SEQ ID NO: 2415642 - RNA, 21 nt, Bordetella pertussis
ccacuggccuugugcgccguc

SEQ ID NO: 2415643 - RNA, 15 nt, Bordetella pertussis
ccacuuccagcgccu

SEQ ID NO: 2415644 - RNA, 17 nt, Bordetella pertussis
ccacuuccucggcgcgc

SEQ ID NO: 2415645 - RNA, 19 nt, Bordetella pertussis
ccacuuccucggcgcgcgc

SEQ ID NO: 2415646 - RNA, 20 nt, Bordetella pertussis
ccacuuccuggugggcggca

SEQ ID NO: 2415647 - RNA, 16 nt, Bordetella pertussis
ccacuucgcggccgau

SEQ ID NO: 2415648 - RNA, 16 nt, Bordetella pertussis
ccacuugagcagcgcc

SEQ ID NO: 2415649 - RNA, 18 nt, Bordetella pertussis
ccacuugcggguccagca

SEQ ID NO: 2415650 - RNA, 23 nt, Bordetella pertussis
ccacuuggcgaucucguccugca

SEQ ID NO: 2415651 - RNA, 22 nt, Bordetella pertussis
ccacuuucgcgcgcgccugccc

SEQ ID NO: 2415652 - RNA, 15 nt, Bordetella pertussis
ccagaaacuggcgcu

SEQ ID NO: 2415653 - RNA, 18 nt, Bordetella pertussis
ccagaaacuggcgcugcc

SEQ ID NO: 2415654 - RNA, 19 nt, Bordetella pertussis
ccagaaacuggcgcugccg

SEQ ID NO: 2415655 - RNA, 16 nt, Bordetella pertussis
ccagaacccggccggc

SEQ ID NO: 2415656 - RNA, 17 nt, Bordetella pertussis
ccagaacccggccggcg

SEQ ID NO: 2415657 - RNA, 20 nt, Bordetella pertussis
ccagaacccggccggcgccg

SEQ ID NO: 2415658 - RNA, 17 nt, Bordetella pertussis
ccagaacgcugaugcgc

SEQ ID NO: 2415659 - RNA, 14 nt, Bordetella pertussis
ccagaacggcgcgg

SEQ ID NO: 2415660 - RNA, 23 nt, Bordetella pertussis
ccagaccaagcgccacagcgcca

SEQ ID NO: 2415661 - RNA, 13 nt, Bordetella pertussis
ccagaccgcgcgc

SEQ ID NO: 2415662 - RNA, 14 nt, Bordetella pertussis
ccagaccgcgcgca

SEQ ID NO: 2415663 - RNA, 17 nt, Bordetella pertussis
ccagaccgcgcgcacca

SEQ ID NO: 2415664 - RNA, 17 nt, Bordetella pertussis
ccagaccugcgcgccgg

SEQ ID NO: 2415665 - RNA, 18 nt, Bordetella pertussis
ccagaccugcgcgccggc

SEQ ID NO: 2415666 - RNA, 20 nt, Bordetella pertussis
ccagaccuggugaucgcgcg

SEQ ID NO: 2415667 - RNA, 20 nt, Bordetella pertussis
ccagaccuugcgcgacggcg

SEQ ID NO: 2415668 - RNA, 20 nt, Bordetella pertussis
ccagacgcagaccacgccgg

SEQ ID NO: 2415669 - RNA, 21 nt, Bordetella pertussis
ccagacgcagaccacgccggc

SEQ ID NO: 2415670 - RNA, 20 nt, Bordetella pertussis
ccagacggccagcgcgcgug

SEQ ID NO: 2415671 - RNA, 20 nt, Bordetella pertussis
ccagagcaccgagaccgggc

SEQ ID NO: 2415672 - RNA, 23 nt, Bordetella pertussis
ccagagcaccgagaccgggcggu

SEQ ID NO: 2415673 - RNA, 18 nt, Bordetella pertussis
ccagauagcccaggcggg

SEQ ID NO: 2415674 - RNA, 15 nt, Bordetella pertussis
ccagauaugccccuc

SEQ ID NO: 2415675 - RNA, 11 nt, Bordetella pertussis
ccagaucaggu

SEQ ID NO: 2415676 - RNA, 14 nt, Bordetella pertussis
ccagaucaggucga

SEQ ID NO: 2415677 - RNA, 18 nt, Bordetella pertussis
ccagaucaggucgaugcc

SEQ ID NO: 2415678 - RNA, 21 nt, Bordetella pertussis
ccagaucaggucgaugccggc

SEQ ID NO: 2415679 - RNA, 22 nt, Bordetella pertussis
ccagauccgcaaguucggcagc

SEQ ID NO: 2415680 - RNA, 17 nt, Bordetella pertussis
ccagauccgguaugccu

SEQ ID NO: 2415681 - RNA, 16 nt, Bordetella pertussis
ccagaucgaccaggac

SEQ ID NO: 2415682 - RNA, 18 nt, Bordetella pertussis
ccagaucgauaccgucgc

SEQ ID NO: 2415683 - RNA, 18 nt, Bordetella pertussis
ccagaucgauccagaaga

SEQ ID NO: 2415684 - RNA, 17 nt, Bordetella pertussis
ccagaucggacgggccg

SEQ ID NO: 2415685 - RNA, 12 nt, Bordetella pertussis
ccagaucgucga

SEQ ID NO: 2415686 - RNA, 23 nt, Bordetella pertussis
ccagaucguugaucucgcccagc

SEQ ID NO: 2415687 - RNA, 20 nt, Bordetella pertussis
ccagaugauggucggugccg

SEQ ID NO: 2415688 - RNA, 23 nt, Bordetella pertussis
ccagaugauggucggugccgccg

SEQ ID NO: 2415689 - RNA, 16 nt, Bordetella pertussis
ccagaugccggucagg

SEQ ID NO: 2415690 - RNA, 20 nt, Bordetella pertussis
ccagaugccggucaggaugc

SEQ ID NO: 2415691 - RNA, 13 nt, Bordetella pertussis
ccagaugcgcagc

SEQ ID NO: 2415692 - RNA, 23 nt, Bordetella pertussis
ccagaugcgccgcacgucggucg

SEQ ID NO: 2415693 - RNA, 13 nt, Bordetella pertussis
ccagauucccccg

SEQ ID NO: 2415694 - RNA, 16 nt, Bordetella pertussis
ccagcaaaugggccgc

SEQ ID NO: 2415695 - RNA, 17 nt, Bordetella pertussis
ccagcaaaugggccgca

SEQ ID NO: 2415696 - RNA, 19 nt, Bordetella pertussis
ccagcaaaugggccgcagc

SEQ ID NO: 2415697 - RNA, 22 nt, Bordetella pertussis
ccagcaaaugggccgcagcgaa

SEQ ID NO: 2415698 - RNA, 17 nt, Bordetella pertussis
ccagcaacuggugcccg

SEQ ID NO: 2415699 - RNA, 18 nt, Bordetella pertussis
ccagcaacuggugcccgu

SEQ ID NO: 2415700 - RNA, 12 nt, Bordetella pertussis
ccagcaagccgg

SEQ ID NO: 2415701 - RNA, 15 nt, Bordetella pertussis
ccagcaagccggcgg

SEQ ID NO: 2415702 - RNA, 15 nt, Bordetella pertussis
ccagcaagcgcgcca

SEQ ID NO: 2415703 - RNA, 21 nt, Bordetella pertussis
ccagcaagcgcucggccacgc

SEQ ID NO: 2415704 - RNA, 13 nt, Bordetella pertussis
ccagcaaggcggc

SEQ ID NO: 2415705 - RNA, 15 nt, Bordetella pertussis
ccagcaaggcgucgg

SEQ ID NO: 2415706 - RNA, 17 nt, Bordetella pertussis
ccagcaaggcgucggcc

SEQ ID NO: 2415707 - RNA, 21 nt, Bordetella pertussis
ccagcaaggcgucggccaggc

SEQ ID NO: 2415708 - RNA, 22 nt, Bordetella pertussis
ccagcaaggcgucggccaggcc

SEQ ID NO: 2415709 - RNA, 23 nt, Bordetella pertussis
ccagcaaggcgucggccaggccg

SEQ ID NO: 2415710 - RNA, 21 nt, Bordetella pertussis
ccagcaagggguccguggcgg

SEQ ID NO: 2415711 - RNA, 21 nt, Bordetella pertussis
ccagcaauuaugcguggccgc

SEQ ID NO: 2415712 - RNA, 23 nt, Bordetella pertussis
ccagcaauuaugcguggccgccg

SEQ ID NO: 2415713 - RNA, 16 nt, Bordetella pertussis
ccagcacauacgccgc

SEQ ID NO: 2415714 - RNA, 21 nt, Bordetella pertussis
ccagcacauacgccgccgagg

SEQ ID NO: 2415715 - RNA, 21 nt, Bordetella pertussis
ccagcacauagcgcaagcccg

SEQ ID NO: 2415716 - RNA, 15 nt, Bordetella pertussis
ccagcacaucgacgu

SEQ ID NO: 2415717 - RNA, 18 nt, Bordetella pertussis
ccagcacaucgacgucgg

SEQ ID NO: 2415718 - RNA, 12 nt, Bordetella pertussis
ccagcaccacgg

SEQ ID NO: 2415719 - RNA, 14 nt, Bordetella pertussis
ccagcaccacgggc

SEQ ID NO: 2415720 - RNA, 17 nt, Bordetella pertussis
ccagcaccacgggcucg

SEQ ID NO: 2415721 - RNA, 16 nt, Bordetella pertussis
ccagcaccagcgccug

SEQ ID NO: 2415722 - RNA, 17 nt, Bordetella pertussis
ccagcaccagcgccugc

SEQ ID NO: 2415723 - RNA, 13 nt, Bordetella pertussis
ccagcaccagggc

SEQ ID NO: 2415724 - RNA, 14 nt, Bordetella pertussis
ccagcaccagggcg

SEQ ID NO: 2415725 - RNA, 15 nt, Bordetella pertussis
ccagcaccagggcgc

SEQ ID NO: 2415726 - RNA, 17 nt, Bordetella pertussis
ccagcaccagggcgcgc

SEQ ID NO: 2415727 - RNA, 19 nt, Bordetella pertussis
ccagcaccagggcgcgcag

SEQ ID NO: 2415728 - RNA, 21 nt, Bordetella pertussis
ccagcaccagggcgcgcagca

SEQ ID NO: 2415729 - RNA, 17 nt, Bordetella pertussis
ccagcaccaugccgaug

SEQ ID NO: 2415730 - RNA, 12 nt, Bordetella pertussis
ccagcaccaugg

SEQ ID NO: 2415731 - RNA, 14 nt, Bordetella pertussis
ccagcaccaugggc

SEQ ID NO: 2415732 - RNA, 16 nt, Bordetella pertussis
ccagcaccccgucggc

SEQ ID NO: 2415733 - RNA, 19 nt, Bordetella pertussis
ccagcaccgaugcgccggc

SEQ ID NO: 2415734 - RNA, 20 nt, Bordetella pertussis
ccagcaccgaugcgccggcc

SEQ ID NO: 2415735 - RNA, 14 nt, Bordetella pertussis
ccagcaccgccacc

SEQ ID NO: 2415736 - RNA, 15 nt, Bordetella pertussis
ccagcaccgccacgc

SEQ ID NO: 2415737 - RNA, 18 nt, Bordetella pertussis
ccagcaccggcacgcgcc

SEQ ID NO: 2415738 - RNA, 21 nt, Bordetella pertussis
ccagcaccggcacgcgccagg

SEQ ID NO: 2415739 - RNA, 12 nt, Bordetella pertussis
ccagcaccggcc

SEQ ID NO: 2415740 - RNA, 13 nt, Bordetella pertussis
ccagcaccggccg

SEQ ID NO: 2415741 - RNA, 15 nt, Bordetella pertussis
ccagcaccggccgcc

SEQ ID NO: 2415742 - RNA, 17 nt, Bordetella pertussis
ccagcaccggccgccgc

SEQ ID NO: 2415743 - RNA, 22 nt, Bordetella pertussis
ccagcaccggccgccgcaugcc

SEQ ID NO: 2415744 - RNA, 12 nt, Bordetella pertussis
ccagcaccggcu

SEQ ID NO: 2415745 - RNA, 13 nt, Bordetella pertussis
ccagcaccggcug

SEQ ID NO: 2415746 - RNA, 16 nt, Bordetella pertussis
ccagcaccucgacgca

SEQ ID NO: 2415747 - RNA, 17 nt, Bordetella pertussis
ccagcaccugcaggccg

SEQ ID NO: 2415748 - RNA, 19 nt, Bordetella pertussis
ccagcaccugcaggccgcc

SEQ ID NO: 2415749 - RNA, 22 nt, Bordetella pertussis
ccagcaccugcaggccgccggc

SEQ ID NO: 2415750 - RNA, 13 nt, Bordetella pertussis
ccagcaugcgcgc

SEQ ID NO: 2415751 - RNA, 14 nt, Bordetella pertussis
ccagcaugcgcgcg

SEQ ID NO: 2415752 - RNA, 16 nt, Bordetella pertussis
ccagcaugcgcgcggc

SEQ ID NO: 2415753 - RNA, 17 nt, Bordetella pertussis
ccagcauggccguggcg

SEQ ID NO: 2415754 - RNA, 23 nt, Bordetella pertussis
ccagcauggccguggcgugcagg

SEQ ID NO: 2415755 - RNA, 19 nt, Bordetella pertussis
ccagcauggcggccaggcg

SEQ ID NO: 2415756 - RNA, 20 nt, Bordetella pertussis
ccagcauggcggccaggcgc

SEQ ID NO: 2415757 - RNA, 12 nt, Bordetella pertussis
ccagcauggcgu

SEQ ID NO: 2415758 - RNA, 21 nt, Bordetella pertussis
ccagcauggucggcauggcca

SEQ ID NO: 2415759 - RNA, 22 nt, Bordetella pertussis
ccagcauggucggcauggccag

SEQ ID NO: 2415760 - RNA, 14 nt, Bordetella pertussis
ccagcauguccgcc

SEQ ID NO: 2415761 - RNA, 19 nt, Bordetella pertussis
ccagcaugugcgcggcguu

SEQ ID NO: 2415762 - RNA, 20 nt, Bordetella pertussis
ccagcauuucgcgugcgugg

SEQ ID NO: 2415763 - RNA, 17 nt, Bordetella pertussis
ccagccacaccagguug

SEQ ID NO: 2415764 - RNA, 19 nt, Bordetella pertussis
ccagccacaccagguuguc

SEQ ID NO: 2415765 - RNA, 15 nt, Bordetella pertussis
ccagccaccacugca

SEQ ID NO: 2415766 - RNA, 22 nt, Bordetella pertussis
ccagccaccaugucccuggcca

SEQ ID NO: 2415767 - RNA, 20 nt, Bordetella pertussis
ccagccacgccggcgcgccg

SEQ ID NO: 2415768 - RNA, 23 nt, Bordetella pertussis
ccagccacgccggcgcgccggcc

SEQ ID NO: 2415769 - RNA, 13 nt, Bordetella pertussis
ccagccacgcgcg

SEQ ID NO: 2415770 - RNA, 14 nt, Bordetella pertussis
ccagccacgcgcgc

SEQ ID NO: 2415771 - RNA, 20 nt, Bordetella pertussis
ccagccacgcgcgcuggcgc

SEQ ID NO: 2415772 - RNA, 18 nt, Bordetella pertussis
ccagccagauaccguccu

SEQ ID NO: 2415773 - RNA, 16 nt, Bordetella pertussis
ccagccagccgccgcg

SEQ ID NO: 2415774 - RNA, 11 nt, Bordetella pertussis
ccagccagcgc

SEQ ID NO: 2415775 - RNA, 14 nt, Bordetella pertussis
ccagccagcgccgc

SEQ ID NO: 2415776 - RNA, 15 nt, Bordetella pertussis
ccagccagcgccgca

SEQ ID NO: 2415777 - RNA, 21 nt, Bordetella pertussis
ccagccagcggugcgcggcgc

SEQ ID NO: 2415778 - RNA, 16 nt, Bordetella pertussis
ccagccaggccucggc

SEQ ID NO: 2415779 - RNA, 15 nt, Bordetella pertussis
ccagccaggcgcgca

SEQ ID NO: 2415780 - RNA, 22 nt, Bordetella pertussis
ccagccaggguuguccgaacca

SEQ ID NO: 2415781 - RNA, 20 nt, Bordetella pertussis
ccagccaguacaggcugccg

SEQ ID NO: 2415782 - RNA, 20 nt, Bordetella pertussis
ccagccauggaagcggcaga

SEQ ID NO: 2415783 - RNA, 17 nt, Bordetella pertussis
ccagccauguucgacca

SEQ ID NO: 2415784 - RNA, 19 nt, Bordetella pertussis
ccagccauguucgaccagg

SEQ ID NO: 2415785 - RNA, 21 nt, Bordetella pertussis
ccagccauguucgaccaggaa

SEQ ID NO: 2415786 - RNA, 21 nt, Bordetella pertussis
ccagccauucgauggcggcgc

SEQ ID NO: 2415787 - RNA, 15 nt, Bordetella pertussis
ccagcccaccagcgc

SEQ ID NO: 2415788 - RNA, 22 nt, Bordetella pertussis
ccagcccaccgcgaaccaggcc

SEQ ID NO: 2415789 - RNA, 23 nt, Bordetella pertussis
ccagcccaccgcgaaccaggccu

SEQ ID NO: 2415790 - RNA, 12 nt, Bordetella pertussis
ccagcccagccc

SEQ ID NO: 2415791 - RNA, 13 nt, Bordetella pertussis
ccagcccagcccg

SEQ ID NO: 2415792 - RNA, 22 nt, Bordetella pertussis
ccagcccaguugcuggcccagg

SEQ ID NO: 2415793 - RNA, 15 nt, Bordetella pertussis
ccagccccaccuugc

SEQ ID NO: 2415794 - RNA, 14 nt, Bordetella pertussis
ccagccccacgccg

SEQ ID NO: 2415795 - RNA, 11 nt, Bordetella pertussis
ccagcccccug

SEQ ID NO: 2415796 - RNA, 13 nt, Bordetella pertussis
ccagcccccugcg

SEQ ID NO: 2415797 - RNA, 21 nt, Bordetella pertussis
ccagcccccugcggggucugc

SEQ ID NO: 2415798 - RNA, 17 nt, Bordetella pertussis
ccagccccgcggccgcg

SEQ ID NO: 2415799 - RNA, 15 nt, Bordetella pertussis
ccagccccggcgcgc

SEQ ID NO: 2415800 - RNA, 16 nt, Bordetella pertussis
ccagccccggcgcgcc

SEQ ID NO: 2415801 - RNA, 17 nt, Bordetella pertussis
ccagccccggcgcgccg

SEQ ID NO: 2415802 - RNA, 20 nt, Bordetella pertussis
ccagccccggcgcgccggcc

SEQ ID NO: 2415803 - RNA, 21 nt, Bordetella pertussis
ccagccccggcgcgccggccg

SEQ ID NO: 2415804 - RNA, 21 nt, Bordetella pertussis
ccagcccgauaugcagccgca

SEQ ID NO: 2415805 - RNA, 18 nt, Bordetella pertussis
ccagcccgaugcgccagg

SEQ ID NO: 2415806 - RNA, 22 nt, Bordetella pertussis
ccagcccgaugcgccaggccuc

SEQ ID NO: 2415807 - RNA, 23 nt, Bordetella pertussis
ccagcccgaugcgccaggccucg

SEQ ID NO: 2415808 - RNA, 13 nt, Bordetella pertussis
ccagcccgcccgc

SEQ ID NO: 2415809 - RNA, 14 nt, Bordetella pertussis
ccagcccgccgcug

SEQ ID NO: 2415810 - RNA, 15 nt, Bordetella pertussis
ccagcccgccgcugg

SEQ ID NO: 2415811 - RNA, 16 nt, Bordetella pertussis
ccagcccgccggcgcg

SEQ ID NO: 2415812 - RNA, 17 nt, Bordetella pertussis
ccagcccgccggcgcgc

SEQ ID NO: 2415813 - RNA, 14 nt, Bordetella pertussis
ccagcccgcgcgcg

SEQ ID NO: 2415814 - RNA, 21 nt, Bordetella pertussis
ccagcccgcggguucgcccgg

SEQ ID NO: 2415815 - RNA, 14 nt, Bordetella pertussis
ccagcccgcugccg

SEQ ID NO: 2415816 - RNA, 13 nt, Bordetella pertussis
ccagcccggccgc

SEQ ID NO: 2415817 - RNA, 13 nt, Bordetella pertussis
ccagcccggcgcg

SEQ ID NO: 2415818 - RNA, 14 nt, Bordetella pertussis
ccagcccggcgcga

SEQ ID NO: 2415819 - RNA, 17 nt, Bordetella pertussis
ccagcccggcgcgacag

SEQ ID NO: 2415820 - RNA, 22 nt, Bordetella pertussis
ccagcccggcuucgaucaugcc

SEQ ID NO: 2415821 - RNA, 23 nt, Bordetella pertussis
ccagcccguccuggugcacgccg

SEQ ID NO: 2415822 - RNA, 23 nt, Bordetella pertussis
ccagcccugcccgcaccaugccg

SEQ ID NO: 2415823 - RNA, 12 nt, Bordetella pertussis
ccagcccuggcc

SEQ ID NO: 2415824 - RNA, 13 nt, Bordetella pertussis
ccagcccuggccc

SEQ ID NO: 2415825 - RNA, 14 nt, Bordetella pertussis
ccagcccuggccca

SEQ ID NO: 2415826 - RNA, 16 nt, Bordetella pertussis
ccagcccuucgcccgc

SEQ ID NO: 2415827 - RNA, 17 nt, Bordetella pertussis
ccagcccuucgcccgca

SEQ ID NO: 2415828 - RNA, 21 nt, Bordetella pertussis
ccagcccuucgcccgcauaga

SEQ ID NO: 2415829 - RNA, 16 nt, Bordetella pertussis
ccagccgaucagccgg

SEQ ID NO: 2415830 - RNA, 17 nt, Bordetella pertussis
ccagccgaucagccggc

SEQ ID NO: 2415831 - RNA, 19 nt, Bordetella pertussis
ccagccgaucagccggcca

SEQ ID NO: 2415832 - RNA, 22 nt, Bordetella pertussis
ccagccgaucagccggccaugg

SEQ ID NO: 2415833 - RNA, 15 nt, Bordetella pertussis
ccagccgaugccgcu

SEQ ID NO: 2415834 - RNA, 13 nt, Bordetella pertussis
ccagccgcaggcu

SEQ ID NO: 2415835 - RNA, 19 nt, Bordetella pertussis
ccagccgcaugccggcgau

SEQ ID NO: 2415836 - RNA, 12 nt, Bordetella pertussis
ccagccgcccgg

SEQ ID NO: 2415837 - RNA, 13 nt, Bordetella pertussis
ccagccgcccggc

SEQ ID NO: 2415838 - RNA, 14 nt, Bordetella pertussis
ccagccgcccggcg

SEQ ID NO: 2415839 - RNA, 14 nt, Bordetella pertussis
ccagccgccgccau

SEQ ID NO: 2415840 - RNA, 16 nt, Bordetella pertussis
ccagccgccgcgcggc

SEQ ID NO: 2415841 - RNA, 13 nt, Bordetella pertussis
ccagccgcgccag

SEQ ID NO: 2415842 - RNA, 21 nt, Bordetella pertussis
ccagccgcgccagggcgcgga

SEQ ID NO: 2415843 - RNA, 14 nt, Bordetella pertussis
ccagccgcgccauc

SEQ ID NO: 2415844 - RNA, 19 nt, Bordetella pertussis
ccagccgcgccugcagcag

SEQ ID NO: 2415845 - RNA, 23 nt, Bordetella pertussis
ccagccgcgccugcagcagcggc

SEQ ID NO: 2415846 - RNA, 14 nt, Bordetella pertussis
ccagccgcgcgaac

SEQ ID NO: 2415847 - RNA, 13 nt, Bordetella pertussis
ccagccgcgcgac

SEQ ID NO: 2415848 - RNA, 16 nt, Bordetella pertussis
ccagccgcucgcgcga

SEQ ID NO: 2415849 - RNA, 20 nt, Bordetella pertussis
ccagccgcucggccacgcgc

SEQ ID NO: 2415850 - RNA, 13 nt, Bordetella pertussis
ccagccgcugcag

SEQ ID NO: 2415851 - RNA, 14 nt, Bordetella pertussis
ccagccgcuggcgc

SEQ ID NO: 2415852 - RNA, 19 nt, Bordetella pertussis
ccagccgcuggcgcgccgc

SEQ ID NO: 2415853 - RNA, 20 nt, Bordetella pertussis
ccagccgcuggcgcgccgcc

SEQ ID NO: 2415854 - RNA, 23 nt, Bordetella pertussis
ccagccgcuugcccgucaugcgc

SEQ ID NO: 2415855 - RNA, 23 nt, Bordetella pertussis
ccagccgcuugcggccaggcggg

SEQ ID NO: 2415856 - RNA, 15 nt, Bordetella pertussis
ccagccggacccgcg

SEQ ID NO: 2415857 - RNA, 20 nt, Bordetella pertussis
ccagccggacccgcgccgca

SEQ ID NO: 2415858 - RNA, 11 nt, Bordetella pertussis
ccagccggccc

SEQ ID NO: 2415859 - RNA, 12 nt, Bordetella pertussis
ccagccggccca

SEQ ID NO: 2415860 - RNA, 23 nt, Bordetella pertussis
ccagccggcccagcacgccgcgc

SEQ ID NO: 2415861 - RNA, 18 nt, Bordetella pertussis
ccagccggcccagcaugc

SEQ ID NO: 2415862 - RNA, 12 nt, Bordetella pertussis
ccagccggcccg

SEQ ID NO: 2415863 - RNA, 14 nt, Bordetella pertussis
ccagcgccuggacc

SEQ ID NO: 2415864 - RNA, 13 nt, Bordetella pertussis
ccagcgccuggcg

SEQ ID NO: 2415865 - RNA, 17 nt, Bordetella pertussis
ccagcgccugggcgcgg

SEQ ID NO: 2415866 - RNA, 18 nt, Bordetella pertussis
ccagcgccugggcgcgga

SEQ ID NO: 2415867 - RNA, 23 nt, Bordetella pertussis
ccagcgccugggguaggcgcggu

SEQ ID NO: 2415868 - RNA, 19 nt, Bordetella pertussis
ccagcgcgaaaugcccagc

SEQ ID NO: 2415869 - RNA, 17 nt, Bordetella pertussis
ccagcgcgaacgccugc

SEQ ID NO: 2415870 - RNA, 18 nt, Bordetella pertussis
ccagcgcgaacgccugcc

SEQ ID NO: 2415871 - RNA, 20 nt, Bordetella pertussis
ccagcgcgaacgccugccag

SEQ ID NO: 2415872 - RNA, 17 nt, Bordetella pertussis
ccagcgcgaucucgcgc

SEQ ID NO: 2415873 - RNA, 20 nt, Bordetella pertussis
ccagcgcgaucucgcgcagg

SEQ ID NO: 2415874 - RNA, 20 nt, Bordetella pertussis
ccagcgcgauucccuggcgc

SEQ ID NO: 2415875 - RNA, 22 nt, Bordetella pertussis
ccagcgcgauucccuggcgcgc

SEQ ID NO: 2415876 - RNA, 24 nt, Bordetella pertussis
ccagcgcgauucccuggcgcgcca

SEQ ID NO: 2415877 - RNA, 17 nt, Bordetella pertussis
ccagcgcgcaacccacg

SEQ ID NO: 2415878 - RNA, 12 nt, Bordetella pertussis
ccagcgcgccau

SEQ ID NO: 2415879 - RNA, 17 nt, Bordetella pertussis
ccagcgcgccauggccg

SEQ ID NO: 2415880 - RNA, 19 nt, Bordetella pertussis
ccagcgcgccauggccggc

SEQ ID NO: 2415881 - RNA, 13 nt, Bordetella pertussis
ccagcgcgcccag

SEQ ID NO: 2415882 - RNA, 20 nt, Bordetella pertussis
ccagcgcgcccagcgcgccg

SEQ ID NO: 2415883 - RNA, 13 nt, Bordetella pertussis
ccagcgcgcccga

SEQ ID NO: 2415884 - RNA, 15 nt, Bordetella pertussis
ccagcgcgcccgagg

SEQ ID NO: 2415885 - RNA, 12 nt, Bordetella pertussis
ccagcgcgccga

SEQ ID NO: 2415886 - RNA, 13 nt, Bordetella pertussis
ccagcgcgccgau

SEQ ID NO: 2415887 - RNA, 16 nt, Bordetella pertussis
ccagcgcgccgccagc

SEQ ID NO: 2415888 - RNA, 19 nt, Bordetella pertussis
ccagcgcgccgcccaccac

SEQ ID NO: 2415889 - RNA, 22 nt, Bordetella pertussis
ccagcgcgccgcccaccaccag

SEQ ID NO: 2415890 - RNA, 13 nt, Bordetella pertussis
ccagcgcgccgcg

SEQ ID NO: 2415891 - RNA, 15 nt, Bordetella pertussis
ccagcgcgccgcgcg

SEQ ID NO: 2415892 - RNA, 17 nt, Bordetella pertussis
ccagcgcgccggccagg

SEQ ID NO: 2415893 - RNA, 20 nt, Bordetella pertussis
ccagcgcgccggccagggcc

SEQ ID NO: 2415894 - RNA, 23 nt, Bordetella pertussis
ccagcgcgccggccagggccacc

SEQ ID NO: 2415895 - RNA, 16 nt, Bordetella pertussis
ccagcgcgccgggggc

SEQ ID NO: 2415896 - RNA, 18 nt, Bordetella pertussis
ccagcgcgccugcccagg

SEQ ID NO: 2415897 - RNA, 21 nt, Bordetella pertussis
ccagcgcgccugcccaggcca

SEQ ID NO: 2415898 - RNA, 23 nt, Bordetella pertussis
ccagcgcgccugcccaggccagc

SEQ ID NO: 2415899 - RNA, 16 nt, Bordetella pertussis
ccagcgcgcgaucgcc

SEQ ID NO: 2415900 - RNA, 18 nt, Bordetella pertussis
ccagcgcgcgaucgccag

SEQ ID NO: 2415901 - RNA, 13 nt, Bordetella pertussis
ccagcgcgcgcca

SEQ ID NO: 2415902 - RNA, 16 nt, Bordetella pertussis
ccagcgcgcgccggcc

SEQ ID NO: 2415903 - RNA, 17 nt, Bordetella pertussis
ccagcgcgcgccggccg

SEQ ID NO: 2415904 - RNA, 20 nt, Bordetella pertussis
ccagcgcgcgccggccgaca

SEQ ID NO: 2415905 - RNA, 22 nt, Bordetella pertussis
ccagcgcgcgccggccgacagg

SEQ ID NO: 2415906 - RNA, 22 nt, Bordetella pertussis
ccagcgcgcgcgaggcggcggc

SEQ ID NO: 2415907 - RNA, 17 nt, Bordetella pertussis
ccagcgcgcggccggcc

SEQ ID NO: 2415908 - RNA, 19 nt, Bordetella pertussis
ccagcgcgcggccggccgc

SEQ ID NO: 2415909 - RNA, 22 nt, Bordetella pertussis
ccagcgcgcggccggccgcgcc

SEQ ID NO: 2415910 - RNA, 17 nt, Bordetella pertussis
ccagcgcgcggcgcagc

SEQ ID NO: 2415911 - RNA, 18 nt, Bordetella pertussis
ccagcgcgcggcgcagcg

SEQ ID NO: 2415912 - RNA, 21 nt, Bordetella pertussis
ccagcgcgcggcgcagcgcac

SEQ ID NO: 2415913 - RNA, 22 nt, Bordetella pertussis
ccagcgcgcgggcgauggccac

SEQ ID NO: 2415914 - RNA, 22 nt, Bordetella pertussis
ccagcgcgcggugccgccuggc

SEQ ID NO: 2415915 - RNA, 16 nt, Bordetella pertussis
ccagcgcggcaugccg

SEQ ID NO: 2415916 - RNA, 12 nt, Bordetella pertussis
ccagcgcggcca

SEQ ID NO: 2415917 - RNA, 17 nt, Bordetella pertussis
ccagcgcggccacggcc

SEQ ID NO: 2415918 - RNA, 23 nt, Bordetella pertussis
ccagcgcggccacggccugcccg

SEQ ID NO: 2415919 - RNA, 15 nt, Bordetella pertussis
ccagcgcggccagca

SEQ ID NO: 2415920 - RNA, 16 nt, Bordetella pertussis
ccagcgcggccagcac

SEQ ID NO: 2415921 - RNA, 16 nt, Bordetella pertussis
ccagcgcggccagcgc

SEQ ID NO: 2415922 - RNA, 14 nt, Bordetella pertussis
ccagcgcggccagg

SEQ ID NO: 2415923 - RNA, 15 nt, Bordetella pertussis
ccagcgcggccaggu

SEQ ID NO: 2415924 - RNA, 17 nt, Bordetella pertussis
ccagcgcggccaggucg

SEQ ID NO: 2415925 - RNA, 22 nt, Bordetella pertussis
ccagcgcggccgucaccgccgc

SEQ ID NO: 2415926 - RNA, 17 nt, Bordetella pertussis
ccagcgcggcggacugc

SEQ ID NO: 2415927 - RNA, 18 nt, Bordetella pertussis
ccagcgcggcggcagcgc

SEQ ID NO: 2415928 - RNA, 19 nt, Bordetella pertussis
ccagcgcggcggcagcgcg

SEQ ID NO: 2415929 - RNA, 19 nt, Bordetella pertussis
ccagcgcggcggccaugcc

SEQ ID NO: 2415930 - RNA, 23 nt, Bordetella pertussis
ccagcgcggcggccaugcccagg

SEQ ID NO: 2415931 - RNA, 19 nt, Bordetella pertussis
ccagcgcggcgggcggcgc

SEQ ID NO: 2415932 - RNA, 14 nt, Bordetella pertussis
ccagcgcguccagg

SEQ ID NO: 2415933 - RNA, 16 nt, Bordetella pertussis
ccagcgcgucgagcag

SEQ ID NO: 2415934 - RNA, 17 nt, Bordetella pertussis
ccagcgcgucgagcagc

SEQ ID NO: 2415935 - RNA, 18 nt, Bordetella pertussis
ccagcgcgucgagcagcg

SEQ ID NO: 2415936 - RNA, 19 nt, Bordetella pertussis
ccagcgcgucgagcagcgc

SEQ ID NO: 2415937 - RNA, 22 nt, Bordetella pertussis
ccagcgcgucgcguagcgcggc

SEQ ID NO: 2415938 - RNA, 15 nt, Bordetella pertussis
ccagcgcgucggcca

SEQ ID NO: 2415939 - RNA, 18 nt, Bordetella pertussis
ccagcgcgucggccagcg

SEQ ID NO: 2415940 - RNA, 19 nt, Bordetella pertussis
ccagcgcgucggccagcgc

SEQ ID NO: 2415941 - RNA, 21 nt, Bordetella pertussis
ccagcgcgucggccagcgccg

SEQ ID NO: 2415942 - RNA, 17 nt, Bordetella pertussis
ccagcgcgucggccagg

SEQ ID NO: 2415943 - RNA, 19 nt, Bordetella pertussis
ccagcgcgucggccaggcg

SEQ ID NO: 2415944 - RNA, 20 nt, Bordetella pertussis
ccagcgcgucggccaggcgc

SEQ ID NO: 2415945 - RNA, 22 nt, Bordetella pertussis
ccagcgcgucggccaggcgcca

SEQ ID NO: 2415946 - RNA, 17 nt, Bordetella pertussis
ccagcgcgugggccagc

SEQ ID NO: 2415947 - RNA, 18 nt, Bordetella pertussis
ccagcgcgugggccagca

SEQ ID NO: 2415948 - RNA, 19 nt, Bordetella pertussis
ccagcgcucgggcucgcgc

SEQ ID NO: 2415949 - RNA, 22 nt, Bordetella pertussis
ccagcgcucgggcucgcgcgcg

SEQ ID NO: 2415950 - RNA, 15 nt, Bordetella pertussis
ccagcgcuucgggca

SEQ ID NO: 2415951 - RNA, 17 nt, Bordetella pertussis
ccagcgcuucgggcagc

SEQ ID NO: 2415952 - RNA, 20 nt, Bordetella pertussis
ccagcgcuucgggcagcucg

SEQ ID NO: 2415953 - RNA, 16 nt, Bordetella pertussis
ccagcgcuucgugcag

SEQ ID NO: 2415954 - RNA, 21 nt, Bordetella pertussis
ccagcgcuucgugcagcgcgu

SEQ ID NO: 2415955 - RNA, 23 nt, Bordetella pertussis
ccagcgcuucgugcagcgcgugg

SEQ ID NO: 2415956 - RNA, 18 nt, Bordetella pertussis
ccagcgcuugcacgccau

SEQ ID NO: 2415957 - RNA, 20 nt, Bordetella pertussis
ccagcggaaguauucgcgcg

SEQ ID NO: 2415958 - RNA, 19 nt, Bordetella pertussis
ccagcggaauggggcccgc

SEQ ID NO: 2415959 - RNA, 18 nt, Bordetella pertussis
ccagcggacgggccaggc

SEQ ID NO: 2415960 - RNA, 19 nt, Bordetella pertussis
ccagcggacgggccaggcc

SEQ ID NO: 2415961 - RNA, 20 nt, Bordetella pertussis
ccagcggacgggccaggccg

SEQ ID NO: 2415962 - RNA, 22 nt, Bordetella pertussis
ccagcggaugaugcggcgccac

SEQ ID NO: 2415963 - RNA, 24 nt, Bordetella pertussis
ccagcggaugaugcggcgccacgc

SEQ ID NO: 2415964 - RNA, 23 nt, Bordetella pertussis
ccagcggcaaaguagugccccca

SEQ ID NO: 2415965 - RNA, 12 nt, Bordetella pertussis
ccagcggcagcg

SEQ ID NO: 2415966 - RNA, 13 nt, Bordetella pertussis
ccagcggcagcgc

SEQ ID NO: 2415967 - RNA, 22 nt, Bordetella pertussis
ccagcggcagcgcgcaggacaa

SEQ ID NO: 2415968 - RNA, 15 nt, Bordetella pertussis
ccagcggcaggcugg

SEQ ID NO: 2415969 - RNA, 20 nt, Bordetella pertussis
ccagcggcaggcuggccggc

SEQ ID NO: 2415970 - RNA, 21 nt, Bordetella pertussis
ccagcggcaggcuggccggcg

SEQ ID NO: 2415971 - RNA, 20 nt, Bordetella pertussis
ccagcggcaggggcucgcgc

SEQ ID NO: 2415972 - RNA, 21 nt, Bordetella pertussis
ccagcggcaggggcucgcgcc

SEQ ID NO: 2415973 - RNA, 18 nt, Bordetella pertussis
ccagcggcgaaaugucga

SEQ ID NO: 2415974 - RNA, 20 nt, Bordetella pertussis
ccagcggcgacugccccagc

SEQ ID NO: 2415975 - RNA, 21 nt, Bordetella pertussis
ccagcugcuucaguuccaggc

SEQ ID NO: 2415976 - RNA, 23 nt, Bordetella pertussis
ccagcugcuucaguuccaggcgg

SEQ ID NO: 2415977 - RNA, 22 nt, Bordetella pertussis
ccagcugcuucaugcgcuccug

SEQ ID NO: 2415978 - RNA, 13 nt, Bordetella pertussis
ccagcuggcgcac

SEQ ID NO: 2415979 - RNA, 15 nt, Bordetella pertussis
ccagcuggcgcacca

SEQ ID NO: 2415980 - RNA, 12 nt, Bordetella pertussis
ccagcuggcgcc

SEQ ID NO: 2415981 - RNA, 19 nt, Bordetella pertussis
ccagcuggcgccccuucca

SEQ ID NO: 2415982 - RNA, 13 nt, Bordetella pertussis
ccagcuggcgcgu

SEQ ID NO: 2415983 - RNA, 20 nt, Bordetella pertussis
ccagcuggcgcguggccgcc

SEQ ID NO: 2415984 - RNA, 21 nt, Bordetella pertussis
ccagcuggcgcguggccgcca

SEQ ID NO: 2415985 - RNA, 18 nt, Bordetella pertussis
ccagcuggcggcgcagca

SEQ ID NO: 2415986 - RNA, 21 nt, Bordetella pertussis
ccagcuggcggcgcagcacca

SEQ ID NO: 2415987 - RNA, 15 nt, Bordetella pertussis
ccagcugggaggcgu

SEQ ID NO: 2415988 - RNA, 16 nt, Bordetella pertussis
ccagcugggccacagg

SEQ ID NO: 2415989 - RNA, 23 nt, Bordetella pertussis
ccagcugggcgaucuucagcacc

SEQ ID NO: 2415990 - RNA, 13 nt, Bordetella pertussis
ccagcugggcggc

SEQ ID NO: 2415991 - RNA, 18 nt, Bordetella pertussis
ccagcugggcggcgugac

SEQ ID NO: 2415992 - RNA, 21 nt, Bordetella pertussis
ccagcugggcggcgugaccgc

SEQ ID NO: 2415993 - RNA, 15 nt, Bordetella pertussis
ccagcuguccaagcg

SEQ ID NO: 2415994 - RNA, 14 nt, Bordetella pertussis
ccagcuucgggccc

SEQ ID NO: 2415995 - RNA, 21 nt, Bordetella pertussis
ccagcuucucgcaagugcugg

SEQ ID NO: 2415996 - RNA, 15 nt, Bordetella pertussis
ccagcuucugcgccu

SEQ ID NO: 2415997 - RNA, 19 nt, Bordetella pertussis
ccagcuucugcgccugcug

SEQ ID NO: 2415998 - RNA, 21 nt, Bordetella pertussis
ccagcuucugcgccugcuggu

SEQ ID NO: 2415999 - RNA, 17 nt, Bordetella pertussis
ccagcuugaccgccagc

SEQ ID NO: 2416000 - RNA, 20 nt, Bordetella pertussis
ccagcuugaccgccagcauc

SEQ ID NO: 2416001 - RNA, 20 nt, Bordetella pertussis
ccagcuugaccuugagcacg

SEQ ID NO: 2416002 - RNA, 21 nt, Bordetella pertussis
ccagcuugaccuugagcacgc

SEQ ID NO: 2416003 - RNA, 20 nt, Bordetella pertussis
ccagcuugacguccagccag

SEQ ID NO: 2416004 - RNA, 21 nt, Bordetella pertussis
ccagcuugagauagcccuuga

SEQ ID NO: 2416005 - RNA, 14 nt, Bordetella pertussis
ccagcuugagcagg

SEQ ID NO: 2416006 - RNA, 21 nt, Bordetella pertussis
ccagcuugagcaggcgcgagc

SEQ ID NO: 2416007 - RNA, 21 nt, Bordetella pertussis
ccagcuugcaggcgccuucgg

SEQ ID NO: 2416008 - RNA, 13 nt, Bordetella pertussis
ccagcuugcgcgc

SEQ ID NO: 2416009 - RNA, 16 nt, Bordetella pertussis
ccagcuugcgcgccgc

SEQ ID NO: 2416010 - RNA, 15 nt, Bordetella pertussis
ccagcuugcgcgccu

SEQ ID NO: 2416011 - RNA, 17 nt, Bordetella pertussis
ccagcuuggccaggcug

SEQ ID NO: 2416012 - RNA, 17 nt, Bordetella pertussis
ccagcuuggugcucagu

SEQ ID NO: 2416013 - RNA, 15 nt, Bordetella pertussis
ccagcuugucgacca

SEQ ID NO: 2416014 - RNA, 16 nt, Bordetella pertussis
ccagcuugucggccgc

SEQ ID NO: 2416015 - RNA, 20 nt, Bordetella pertussis
ccagcuugucggccgcgcgc

SEQ ID NO: 2416016 - RNA, 16 nt, Bordetella pertussis
ccaggaaaaccuccuc

SEQ ID NO: 2416017 - RNA, 16 nt, Bordetella pertussis
ccaggaaaccggcgac

SEQ ID NO: 2416018 - RNA, 17 nt, Bordetella pertussis
ccaggaaagaggccagg

SEQ ID NO: 2416019 - RNA, 18 nt, Bordetella pertussis
ccaggaaagaggccaggc

SEQ ID NO: 2416020 - RNA, 21 nt, Bordetella pertussis
ccaggaaagaggccaggcccu

SEQ ID NO: 2416021 - RNA, 16 nt, Bordetella pertussis
ccaggaaagcgccgcc

SEQ ID NO: 2416022 - RNA, 13 nt, Bordetella pertussis
ccaggaacagcaa

SEQ ID NO: 2416023 - RNA, 17 nt, Bordetella pertussis
ccaggaacagcgccggc

SEQ ID NO: 2416024 - RNA, 18 nt, Bordetella pertussis
ccaggaacagcgccggca

SEQ ID NO: 2416025 - RNA, 22 nt, Bordetella pertussis
ccaggaacagcgccggcagcgc

SEQ ID NO: 2416026 - RNA, 23 nt, Bordetella pertussis
ccaggaacagcgccggcagcgca

SEQ ID NO: 2416027 - RNA, 18 nt, Bordetella pertussis
ccaggaacgccagcagca

SEQ ID NO: 2416028 - RNA, 16 nt, Bordetella pertussis
ccaggaacuccaggaa

SEQ ID NO: 2416029 - RNA, 22 nt, Bordetella pertussis
ccaggaacuugaacggcgcggc

SEQ ID NO: 2416030 - RNA, 18 nt, Bordetella pertussis
ccaggaagagcuggcgcu

SEQ ID NO: 2416031 - RNA, 22 nt, Bordetella pertussis
ccaggaagagcuggcgcugcuc

SEQ ID NO: 2416032 - RNA, 20 nt, Bordetella pertussis
ccaggaagaucggcccggcg

SEQ ID NO: 2416033 - RNA, 22 nt, Bordetella pertussis
ccaggaagaucggcccggcgcc

SEQ ID NO: 2416034 - RNA, 13 nt, Bordetella pertussis
ccaggaagcagcc

SEQ ID NO: 2416035 - RNA, 16 nt, Bordetella pertussis
ccaggaagcagcccag

SEQ ID NO: 2416036 - RNA, 15 nt, Bordetella pertussis
ccaggaagccgugcg

SEQ ID NO: 2416037 - RNA, 22 nt, Bordetella pertussis
ccaggaagcggcgcaccagcga

SEQ ID NO: 2416038 - RNA, 19 nt, Bordetella pertussis
ccaggaagcgggccugccg

SEQ ID NO: 2416039 - RNA, 16 nt, Bordetella pertussis
ccaggacgacaggcau

SEQ ID NO: 2416040 - RNA, 20 nt, Bordetella pertussis
ccaggacgcgaagaucccgc

SEQ ID NO: 2416041 - RNA, 21 nt, Bordetella pertussis
ccaggacgggaaagcggcgau

SEQ ID NO: 2416042 - RNA, 20 nt, Bordetella pertussis
ccaggagcucguccccacgg

SEQ ID NO: 2416043 - RNA, 21 nt, Bordetella pertussis
ccaggaguucccagcgcgcga

SEQ ID NO: 2416044 - RNA, 16 nt, Bordetella pertussis
ccaggaucaccgccgc

SEQ ID NO: 2416045 - RNA, 18 nt, Bordetella pertussis
ccaggaucaccgccgcgc

SEQ ID NO: 2416046 - RNA, 17 nt, Bordetella pertussis
ccaggaucgcggccagc

SEQ ID NO: 2416047 - RNA, 18 nt, Bordetella pertussis
ccaggaucgcggccagcc

SEQ ID NO: 2416048 - RNA, 21 nt, Bordetella pertussis
ccaggaucgcggccagccggg

SEQ ID NO: 2416049 - RNA, 13 nt, Bordetella pertussis
ccaggaucgucgu

SEQ ID NO: 2416050 - RNA, 22 nt, Bordetella pertussis
ccaggaucgucgucaugaugua

SEQ ID NO: 2416051 - RNA, 12 nt, Bordetella pertussis
ccaggaugauga

SEQ ID NO: 2416052 - RNA, 14 nt, Bordetella pertussis
ccaggaugaugagg

SEQ ID NO: 2416053 - RNA, 22 nt, Bordetella pertussis
ccaggaugcccuuggcggcgau

SEQ ID NO: 2416054 - RNA, 14 nt, Bordetella pertussis
ccaggaugcgcacc

SEQ ID NO: 2416055 - RNA, 22 nt, Bordetella pertussis
ccaggaugcgcaccggccaggg

SEQ ID NO: 2416056 - RNA, 19 nt, Bordetella pertussis
ccaggauggagagggccug

SEQ ID NO: 2416057 - RNA, 14 nt, Bordetella pertussis
ccaggauggcgcca

SEQ ID NO: 2416058 - RNA, 17 nt, Bordetella pertussis
ccaggauggcgccagcc

SEQ ID NO: 2416059 - RNA, 21 nt, Bordetella pertussis
ccaggauggcgccagcccgcc

SEQ ID NO: 2416060 - RNA, 17 nt, Bordetella pertussis
ccaggauuucauggcau

SEQ ID NO: 2416061 - RNA, 16 nt, Bordetella pertussis
ccaggcaaaggcccag

SEQ ID NO: 2416062 - RNA, 19 nt, Bordetella pertussis
ccaggcaaaggcccaggca

SEQ ID NO: 2416063 - RNA, 18 nt, Bordetella pertussis
ccaggcaacaaaggaaau

SEQ ID NO: 2416064 - RNA, 19 nt, Bordetella pertussis
ccaggcaaucgaugaucac

SEQ ID NO: 2416065 - RNA, 15 nt, Bordetella pertussis
ccaggcaaugcgcag

SEQ ID NO: 2416066 - RNA, 18 nt, Bordetella pertussis
ccaggcaaugcgcaggcc

SEQ ID NO: 2416067 - RNA, 15 nt, Bordetella pertussis
ccaggcagccggccc

SEQ ID NO: 2416068 - RNA, 16 nt, Bordetella pertussis
ccaggcagccggcccc

SEQ ID NO: 2416069 - RNA, 16 nt, Bordetella pertussis
ccaggcaggcgggccc

SEQ ID NO: 2416070 - RNA, 21 nt, Bordetella pertussis
ccaggcaggcgggcccgcauc

SEQ ID NO: 2416071 - RNA, 21 nt, Bordetella pertussis
ccaggcauucccgcccagcga

SEQ ID NO: 2416072 - RNA, 21 nt, Bordetella pertussis
ccaggcauugaagcuggcgcc

SEQ ID NO: 2416073 - RNA, 22 nt, Bordetella pertussis
ccaggcauugaagcuggcgccg

SEQ ID NO: 2416074 - RNA, 14 nt, Bordetella pertussis
ccaggccaccgcgg

SEQ ID NO: 2416075 - RNA, 15 nt, Bordetella pertussis
ccaggccaccgcggc

SEQ ID NO: 2416076 - RNA, 16 nt, Bordetella pertussis
ccaggccagcagcucg

SEQ ID NO: 2416077 - RNA, 19 nt, Bordetella pertussis
ccaggccagcagcucggcc

SEQ ID NO: 2416078 - RNA, 20 nt, Bordetella pertussis
ccaggccagcagcucggcca

SEQ ID NO: 2416079 - RNA, 21 nt, Bordetella pertussis
ccaggccagcagcucggccac

SEQ ID NO: 2416080 - RNA, 17 nt, Bordetella pertussis
ccaggccagccaggugc

SEQ ID NO: 2416081 - RNA, 14 nt, Bordetella pertussis
ccaggccagcgccg

SEQ ID NO: 2416082 - RNA, 16 nt, Bordetella pertussis
ccaggccagcgccgcg

SEQ ID NO: 2416083 - RNA, 18 nt, Bordetella pertussis
ccaggccagcgccgcggc

SEQ ID NO: 2416084 - RNA, 17 nt, Bordetella pertussis
ccaggccagcugcgccc

SEQ ID NO: 2416085 - RNA, 14 nt, Bordetella pertussis
ccaggccauggcgc

SEQ ID NO: 2416086 - RNA, 15 nt, Bordetella pertussis
ccaggcccaccgcau

SEQ ID NO: 2416087 - RNA, 21 nt, Bordetella pertussis
ccaggcgcgcaucgcgcggca

SEQ ID NO: 2416088 - RNA, 16 nt, Bordetella pertussis
ccaggcgcgccagccg

SEQ ID NO: 2416089 - RNA, 20 nt, Bordetella pertussis
ccaggcgcgccagccgcugc

SEQ ID NO: 2416090 - RNA, 21 nt, Bordetella pertussis
ccaggcgcgccgcgauggcgc

SEQ ID NO: 2416091 - RNA, 12 nt, Bordetella pertussis
ccaggcgcgcgc

SEQ ID NO: 2416092 - RNA, 14 nt, Bordetella pertussis
ccaggcgcgcgcca

SEQ ID NO: 2416093 - RNA, 16 nt, Bordetella pertussis
ccaggcgcgcgccauc

SEQ ID NO: 2416094 - RNA, 22 nt, Bordetella pertussis
ccaggcgcgcgccaucgacggg

SEQ ID NO: 2416095 - RNA, 12 nt, Bordetella pertussis
ccaggcgcgcug

SEQ ID NO: 2416096 - RNA, 16 nt, Bordetella pertussis
ccaggcgcggaucucg

SEQ ID NO: 2416097 - RNA, 18 nt, Bordetella pertussis
ccaggcgcgugcgcaggc

SEQ ID NO: 2416098 - RNA, 19 nt, Bordetella pertussis
ccaggcgcgugcgcaggcg

SEQ ID NO: 2416099 - RNA, 17 nt, Bordetella pertussis
ccaggcgcguugcgcuu

SEQ ID NO: 2416100 - RNA, 23 nt, Bordetella pertussis
ccaggcgcucagccgugccgcgc

SEQ ID NO: 2416101 - RNA, 15 nt, Bordetella pertussis
ccaggcgcuccagca

SEQ ID NO: 2416102 - RNA, 12 nt, Bordetella pertussis
ccaggcgcucgc

SEQ ID NO: 2416103 - RNA, 14 nt, Bordetella pertussis
ccaggcgcucgcgc

SEQ ID NO: 2416104 - RNA, 18 nt, Bordetella pertussis
ccaggcgcucgcgcgcca

SEQ ID NO: 2416105 - RNA, 21 nt, Bordetella pertussis
ccaggcgcucgcgcgccagca

SEQ ID NO: 2416106 - RNA, 19 nt, Bordetella pertussis
ccaggcgcucggcguugcu

SEQ ID NO: 2416107 - RNA, 21 nt, Bordetella pertussis
ccaggcgcucggcguugcugg

SEQ ID NO: 2416108 - RNA, 16 nt, Bordetella pertussis
ccaggcgcugaccugc

SEQ ID NO: 2416109 - RNA, 13 nt, Bordetella pertussis
ccaggcgcugcgc

SEQ ID NO: 2416110 - RNA, 21 nt, Bordetella pertussis
ccaggcgcugcgcggucugcg

SEQ ID NO: 2416111 - RNA, 13 nt, Bordetella pertussis
ccaggcggaucug

SEQ ID NO: 2416112 - RNA, 20 nt, Bordetella pertussis
ccaggcggcaggcgccgccg

SEQ ID NO: 2416113 - RNA, 13 nt, Bordetella pertussis
ccaggcggccacc

SEQ ID NO: 2416114 - RNA, 15 nt, Bordetella pertussis
ccaggcggccaccac

SEQ ID NO: 2416115 - RNA, 20 nt, Bordetella pertussis
ccaggcggccaucgccgcca

SEQ ID NO: 2416116 - RNA, 15 nt, Bordetella pertussis
ccaggcggccgcgga

SEQ ID NO: 2416117 - RNA, 15 nt, Bordetella pertussis
ccaggcggcgcucga

SEQ ID NO: 2416118 - RNA, 16 nt, Bordetella pertussis
ccaggcggcgcucgaa

SEQ ID NO: 2416119 - RNA, 22 nt, Bordetella pertussis
ccaggcggcgcucgaaggcgcc

SEQ ID NO: 2416120 - RNA, 17 nt, Bordetella pertussis
ccaggcggcggugccag

SEQ ID NO: 2416121 - RNA, 24 nt, Bordetella pertussis
ccaggcggcggugccagcgcaagg

SEQ ID NO: 2416122 - RNA, 22 nt, Bordetella pertussis
ccaggcggcguaguucagccac

SEQ ID NO: 2416123 - RNA, 17 nt, Bordetella pertussis
ccaggcgggcaucgccc

SEQ ID NO: 2416124 - RNA, 20 nt, Bordetella pertussis
ccaggcgggcaucgcccacc

SEQ ID NO: 2416125 - RNA, 23 nt, Bordetella pertussis
ccaggcgggcaucgcccaccaug

SEQ ID NO: 2416126 - RNA, 16 nt, Bordetella pertussis
ccaggcgggcgugcug

SEQ ID NO: 2416127 - RNA, 18 nt, Bordetella pertussis
ccaggcggguguagaaga

SEQ ID NO: 2416128 - RNA, 20 nt, Bordetella pertussis
ccaggcggugcguccaggac

SEQ ID NO: 2416129 - RNA, 23 nt, Bordetella pertussis
ccaggcgguggccucguccacgu

SEQ ID NO: 2416130 - RNA, 19 nt, Bordetella pertussis
ccaggcguagaccaccugc

SEQ ID NO: 2416131 - RNA, 16 nt, Bordetella pertussis
ccaggcgucggcggcc

SEQ ID NO: 2416132 - RNA, 19 nt, Bordetella pertussis
ccaggcgugaacgccccgg

SEQ ID NO: 2416133 - RNA, 20 nt, Bordetella pertussis
ccaggcgugaacgccccggc

SEQ ID NO: 2416134 - RNA, 14 nt, Bordetella pertussis
ccaggcgugcccgg

SEQ ID NO: 2416135 - RNA, 18 nt, Bordetella pertussis
ccaggcuaucguggcugg

SEQ ID NO: 2416136 - RNA, 15 nt, Bordetella pertussis
ccaggcucagcaggg

SEQ ID NO: 2416137 - RNA, 19 nt, Bordetella pertussis
ccaggcucagcagggucga

SEQ ID NO: 2416138 - RNA, 17 nt, Bordetella pertussis
ccaggcucaggcggcca

SEQ ID NO: 2416139 - RNA, 20 nt, Bordetella pertussis
ccaggcucugggcggagucg

SEQ ID NO: 2416140 - RNA, 22 nt, Bordetella pertussis
ccaggcucuuuuucgagccgca

SEQ ID NO: 2416141 - RNA, 17 nt, Bordetella pertussis
ccaggcugaaugccgcc

SEQ ID NO: 2416142 - RNA, 16 nt, Bordetella pertussis
ccaggcugaccagcgc

SEQ ID NO: 2416143 - RNA, 18 nt, Bordetella pertussis
ccaggcugaccagcgcgu

SEQ ID NO: 2416144 - RNA, 20 nt, Bordetella pertussis
ccaggcugaccagcgcgucg

SEQ ID NO: 2416145 - RNA, 13 nt, Bordetella pertussis
ccaggcugaucac

SEQ ID NO: 2416146 - RNA, 14 nt, Bordetella pertussis
ccaggcugcccugg

SEQ ID NO: 2416147 - RNA, 21 nt, Bordetella pertussis
ccaggcugcccuggcccaggc

SEQ ID NO: 2416148 - RNA, 23 nt, Bordetella pertussis
ccaggcugcccuggcccaggccg

SEQ ID NO: 2416149 - RNA, 13 nt, Bordetella pertussis
ccaggcugccggc

SEQ ID NO: 2416150 - RNA, 15 nt, Bordetella pertussis
ccaggcugccggcgu

SEQ ID NO: 2416151 - RNA, 15 nt, Bordetella pertussis
ccaggcugcgcgccg

SEQ ID NO: 2416152 - RNA, 16 nt, Bordetella pertussis
ccaggcugcgcgccgg

SEQ ID NO: 2416153 - RNA, 17 nt, Bordetella pertussis
ccaggcugcgcgccggc

SEQ ID NO: 2416154 - RNA, 21 nt, Bordetella pertussis
ccaggcugcgcgccggcgccu

SEQ ID NO: 2416155 - RNA, 17 nt, Bordetella pertussis
ccaggcuggggccgagc

SEQ ID NO: 2416156 - RNA, 19 nt, Bordetella pertussis
ccaggcugucccagauggc

SEQ ID NO: 2416157 - RNA, 22 nt, Bordetella pertussis
ccaggcugucccagauggcgcc

SEQ ID NO: 2416158 - RNA, 21 nt, Bordetella pertussis
ccaggcuuucgaagccgcccc

SEQ ID NO: 2416159 - RNA, 21 nt, Bordetella pertussis
ccaggcuuugcgcgccaugca

SEQ ID NO: 2416160 - RNA, 18 nt, Bordetella pertussis
ccagggaaggggcggcuu

SEQ ID NO: 2416161 - RNA, 21 nt, Bordetella pertussis
ccagggaaggggcggcuucag

SEQ ID NO: 2416162 - RNA, 16 nt, Bordetella pertussis
ccagggaccaauacgc

SEQ ID NO: 2416163 - RNA, 20 nt, Bordetella pertussis
ccagggaccaauacgccgcc

SEQ ID NO: 2416164 - RNA, 21 nt, Bordetella pertussis
ccagggaccaauacgccgcca

SEQ ID NO: 2416165 - RNA, 15 nt, Bordetella pertussis
ccagggaggaacugg

SEQ ID NO: 2416166 - RNA, 21 nt, Bordetella pertussis
ccagggaggaacugggcgccg

SEQ ID NO: 2416167 - RNA, 15 nt, Bordetella pertussis
ccagggcagcggcca

SEQ ID NO: 2416168 - RNA, 15 nt, Bordetella pertussis
ccagggcagggcgcc

SEQ ID NO: 2416169 - RNA, 15 nt, Bordetella pertussis
ccagggccacgccgg

SEQ ID NO: 2416170 - RNA, 20 nt, Bordetella pertussis
ccagggccacgccggccgcc

SEQ ID NO: 2416171 - RNA, 21 nt, Bordetella pertussis
ccagggccacgccggccgccu

SEQ ID NO: 2416172 - RNA, 13 nt, Bordetella pertussis
ccagggccagcuu

SEQ ID NO: 2416173 - RNA, 12 nt, Bordetella pertussis
ccagggccaggc

SEQ ID NO: 2416174 - RNA, 16 nt, Bordetella pertussis
ccagggccccuccggc

SEQ ID NO: 2416175 - RNA, 22 nt, Bordetella pertussis
ccagggccccuccggcgccgcc

SEQ ID NO: 2416176 - RNA, 23 nt, Bordetella pertussis
ccagggccccuccggcgccgccu

SEQ ID NO: 2416177 - RNA, 21 nt, Bordetella pertussis
ccagggccgagccggauggcu

SEQ ID NO: 2416178 - RNA, 16 nt, Bordetella pertussis
ccagggccgcagcaau

SEQ ID NO: 2416179 - RNA, 12 nt, Bordetella pertussis
ccagggccgcca

SEQ ID NO: 2416180 - RNA, 17 nt, Bordetella pertussis
ccagggccgccagcacc

SEQ ID NO: 2416181 - RNA, 18 nt, Bordetella pertussis
ccagggccgccagcaccu

SEQ ID NO: 2416182 - RNA, 13 nt, Bordetella pertussis
ccagggccgccgc

SEQ ID NO: 2416183 - RNA, 19 nt, Bordetella pertussis
ccagggccgccgcgcccag

SEQ ID NO: 2416184 - RNA, 19 nt, Bordetella pertussis
ccagggccuccucggucgg

SEQ ID NO: 2416185 - RNA, 16 nt, Bordetella pertussis
ccagggccucgcgggc

SEQ ID NO: 2416186 - RNA, 17 nt, Bordetella pertussis
ccagggccugcgggccg

SEQ ID NO: 2416187 - RNA, 21 nt, Bordetella pertussis
ccagggccugcgggccgggca

SEQ ID NO: 2416188 - RNA, 22 nt, Bordetella pertussis
ccagggcgaucagcaccgcggc

SEQ ID NO: 2416189 - RNA, 13 nt, Bordetella pertussis
ccagggcgcccgc

SEQ ID NO: 2416190 - RNA, 15 nt, Bordetella pertussis
ccagggcgccgaccg

SEQ ID NO: 2416191 - RNA, 22 nt, Bordetella pertussis
ccagggcgccgaccgggccgac

SEQ ID NO: 2416192 - RNA, 19 nt, Bordetella pertussis
ccagggcgccugccccggc

SEQ ID NO: 2416193 - RNA, 20 nt, Bordetella pertussis
ccagggcgccugccccggca

SEQ ID NO: 2416194 - RNA, 15 nt, Bordetella pertussis
ccagggcgcgcagca

SEQ ID NO: 2416195 - RNA, 15 nt, Bordetella pertussis
ccagggcgcgccgca

SEQ ID NO: 2416196 - RNA, 21 nt, Bordetella pertussis
ccagggcgcgccgcagcgugg

SEQ ID NO: 2416197 - RNA, 15 nt, Bordetella pertussis
ccagggcgcgccgga

SEQ ID NO: 2416198 - RNA, 23 nt, Bordetella pertussis
ccagggcgcggaucaugggcucg

SEQ ID NO: 2416199 - RNA, 13 nt, Bordetella pertussis
ccaguccccugcg

SEQ ID NO: 2416200 - RNA, 20 nt, Bordetella pertussis
ccaguccccugcggggacag

SEQ ID NO: 2416201 - RNA, 18 nt, Bordetella pertussis
ccagucccgcaccgggca

SEQ ID NO: 2416202 - RNA, 17 nt, Bordetella pertussis
ccaguccgcagcgcagc

SEQ ID NO: 2416203 - RNA, 20 nt, Bordetella pertussis
ccaguccgcgcucgcccagc

SEQ ID NO: 2416204 - RNA, 22 nt, Bordetella pertussis
ccaguccgcgcucgcccagccg

SEQ ID NO: 2416205 - RNA, 21 nt, Bordetella pertussis
ccagucgaugcaaccgucggu

SEQ ID NO: 2416206 - RNA, 12 nt, Bordetella pertussis
ccagucgccgcg

SEQ ID NO: 2416207 - RNA, 13 nt, Bordetella pertussis
ccagucgccgcgc

SEQ ID NO: 2416208 - RNA, 14 nt, Bordetella pertussis
ccagucgccgcgcc

SEQ ID NO: 2416209 - RNA, 18 nt, Bordetella pertussis
ccagucgccgcgcccgcg

SEQ ID NO: 2416210 - RNA, 15 nt, Bordetella pertussis
ccagucgccgcggua

SEQ ID NO: 2416211 - RNA, 15 nt, Bordetella pertussis
ccagucgcggugcau

SEQ ID NO: 2416212 - RNA, 21 nt, Bordetella pertussis
ccagucguccagcacgcggcg

SEQ ID NO: 2416213 - RNA, 16 nt, Bordetella pertussis
ccagucuggauggcgu

SEQ ID NO: 2416214 - RNA, 21 nt, Bordetella pertussis
ccagucuggauggcguaugga

SEQ ID NO: 2416215 - RNA, 23 nt, Bordetella pertussis
ccagugaaacgcgacgcgccgga

SEQ ID NO: 2416216 - RNA, 18 nt, Bordetella pertussis
ccagugccuggacgcgcu

SEQ ID NO: 2416217 - RNA, 19 nt, Bordetella pertussis
ccagugccuggacgcgcug

SEQ ID NO: 2416218 - RNA, 20 nt, Bordetella pertussis
ccagugccuggacgcgcugg

SEQ ID NO: 2416219 - RNA, 13 nt, Bordetella pertussis
ccagugcgccggc

SEQ ID NO: 2416220 - RNA, 14 nt, Bordetella pertussis
ccagugcgccggcg

SEQ ID NO: 2416221 - RNA, 16 nt, Bordetella pertussis
ccagugcgccggcggc

SEQ ID NO: 2416222 - RNA, 17 nt, Bordetella pertussis
ccagugcgccggcggcg

SEQ ID NO: 2416223 - RNA, 22 nt, Bordetella pertussis
ccagugcgccggcggcggucag

SEQ ID NO: 2416224 - RNA, 23 nt, Bordetella pertussis
ccagugcgccggcggcggucagc

SEQ ID NO: 2416225 - RNA, 14 nt, Bordetella pertussis
ccaguggcgcggcg

SEQ ID NO: 2416226 - RNA, 17 nt, Bordetella pertussis
ccaguggugcucccagg

SEQ ID NO: 2416227 - RNA, 18 nt, Bordetella pertussis
ccaguggugcucccagga

SEQ ID NO: 2416228 - RNA, 19 nt, Bordetella pertussis
ccaguuccacgcggccgug

SEQ ID NO: 2416229 - RNA, 14 nt, Bordetella pertussis
ccaguuccagcacg

SEQ ID NO: 2416230 - RNA, 24 nt, Bordetella pertussis
ccaguuccagcacgacgacggccg

SEQ ID NO: 2416231 - RNA, 16 nt, Bordetella pertussis
ccaguucgacgcccau

SEQ ID NO: 2416232 - RNA, 17 nt, Bordetella pertussis
ccaguucgacgcccaug

SEQ ID NO: 2416233 - RNA, 13 nt, Bordetella pertussis
ccaguucgcgcag

SEQ ID NO: 2416234 - RNA, 17 nt, Bordetella pertussis
ccaguucgcgcagcgcc

SEQ ID NO: 2416235 - RNA, 14 nt, Bordetella pertussis
ccaguucgcggccg

SEQ ID NO: 2416236 - RNA, 16 nt, Bordetella pertussis
ccaguucgcggccggc

SEQ ID NO: 2416237 - RNA, 20 nt, Bordetella pertussis
ccaguucgcggccggccggg

SEQ ID NO: 2416238 - RNA, 13 nt, Bordetella pertussis
ccaguucgcggcg

SEQ ID NO: 2416239 - RNA, 15 nt, Bordetella pertussis
ccaguucgcggcgca

SEQ ID NO: 2416240 - RNA, 17 nt, Bordetella pertussis
ccaguucggcgcgcgug

SEQ ID NO: 2416241 - RNA, 20 nt, Bordetella pertussis
ccaguucggcgcgcgugccg

SEQ ID NO: 2416242 - RNA, 22 nt, Bordetella pertussis
ccaguucguccgcuucgucggg

SEQ ID NO: 2416243 - RNA, 15 nt, Bordetella pertussis
ccaguucugcagcgu

SEQ ID NO: 2416244 - RNA, 21 nt, Bordetella pertussis
ccaguugaaccgcaacgccag

SEQ ID NO: 2416245 - RNA, 20 nt, Bordetella pertussis
ccaguugacgaugcccaggu

SEQ ID NO: 2416246 - RNA, 23 nt, Bordetella pertussis
ccaguugagaaugcccaggaugc

SEQ ID NO: 2416247 - RNA, 16 nt, Bordetella pertussis
ccaguugccgccgccg

SEQ ID NO: 2416248 - RNA, 14 nt, Bordetella pertussis
ccaguugcgcgccg

SEQ ID NO: 2416249 - RNA, 15 nt, Bordetella pertussis
ccaguugcgcgccgu

SEQ ID NO: 2416250 - RNA, 18 nt, Bordetella pertussis
ccaguugcgcgccgucgg

SEQ ID NO: 2416251 - RNA, 20 nt, Bordetella pertussis
ccaguugcgcgccgucggcg

SEQ ID NO: 2416252 - RNA, 17 nt, Bordetella pertussis
ccaguugcgggccucga

SEQ ID NO: 2416253 - RNA, 18 nt, Bordetella pertussis
ccaguugcuggcccagga

SEQ ID NO: 2416254 - RNA, 15 nt, Bordetella pertussis
ccaguugggccaggg

SEQ ID NO: 2416255 - RNA, 21 nt, Bordetella pertussis
ccaguuuucucauggccgcgc

SEQ ID NO: 2416256 - RNA, 22 nt, Bordetella pertussis
ccaguuuucucauggccgcgcc

SEQ ID NO: 2416257 - RNA, 19 nt, Bordetella pertussis
ccauacaacgaguaccugc

SEQ ID NO: 2416258 - RNA, 21 nt, Bordetella pertussis
ccauacaacgaguaccugcug

SEQ ID NO: 2416259 - RNA, 15 nt, Bordetella pertussis
ccauaccagcccggc

SEQ ID NO: 2416260 - RNA, 14 nt, Bordetella pertussis
ccauacugcaugau

SEQ ID NO: 2416261 - RNA, 15 nt, Bordetella pertussis
ccauagcugcgccaa

SEQ ID NO: 2416262 - RNA, 16 nt, Bordetella pertussis
ccauagcugcgccaau

SEQ ID NO: 2416263 - RNA, 13 nt, Bordetella pertussis
ccauaggccagcg

SEQ ID NO: 2416264 - RNA, 14 nt, Bordetella pertussis
ccauaggccagcgc

SEQ ID NO: 2416265 - RNA, 13 nt, Bordetella pertussis
ccauaggcgcgca

SEQ ID NO: 2416266 - RNA, 17 nt, Bordetella pertussis
ccauaggcgcgcaccag

SEQ ID NO: 2416267 - RNA, 18 nt, Bordetella pertussis
ccauaggcgcgcaccagc

SEQ ID NO: 2416268 - RNA, 21 nt, Bordetella pertussis
ccauaggcgcgcaccagcccg

SEQ ID NO: 2416269 - RNA, 19 nt, Bordetella pertussis
ccauagggcgacugcagca

SEQ ID NO: 2416270 - RNA, 22 nt, Bordetella pertussis
ccauaucccugcggcagcgacu

SEQ ID NO: 2416271 - RNA, 13 nt, Bordetella pertussis
ccauaucuggcaa

SEQ ID NO: 2416272 - RNA, 15 nt, Bordetella pertussis
ccauaugccgccggc

SEQ ID NO: 2416273 - RNA, 15 nt, Bordetella pertussis
ccauauugaugcagc

SEQ ID NO: 2416274 - RNA, 18 nt, Bordetella pertussis
ccaucaacgggccgcugg

SEQ ID NO: 2416275 - RNA, 21 nt, Bordetella pertussis
ccaucaagaaggucgacgagg

SEQ ID NO: 2416276 - RNA, 13 nt, Bordetella pertussis
ccaucaccauggc

SEQ ID NO: 2416277 - RNA, 14 nt, Bordetella pertussis
ccaucacgagcagg

SEQ ID NO: 2416278 - RNA, 18 nt, Bordetella pertussis
ccaucacgagcagguugg

SEQ ID NO: 2416279 - RNA, 23 nt, Bordetella pertussis
ccaucacggugucgaugggcccg

SEQ ID NO: 2416280 - RNA, 22 nt, Bordetella pertussis
ccaucagcucgaccacggcggc

SEQ ID NO: 2416281 - RNA, 18 nt, Bordetella pertussis
ccaucaggaacggcaugg

SEQ ID NO: 2416282 - RNA, 23 nt, Bordetella pertussis
ccaucaggccgaugcguccgccg

SEQ ID NO: 2416283 - RNA, 20 nt, Bordetella pertussis
ccaucaggugaaacagcagc

SEQ ID NO: 2416284 - RNA, 21 nt, Bordetella pertussis
ccaucaggugaaacagcagcg

SEQ ID NO: 2416285 - RNA, 19 nt, Bordetella pertussis
ccaucagguuguccagcgc

SEQ ID NO: 2416286 - RNA, 20 nt, Bordetella pertussis
ccaucaucaacuucaucguc

SEQ ID NO: 2416287 - RNA, 15 nt, Bordetella pertussis
ccaucaucagcaugg

SEQ ID NO: 2416288 - RNA, 18 nt, Bordetella pertussis
ccaucaucagcauggcgu

SEQ ID NO: 2416289 - RNA, 19 nt, Bordetella pertussis
ccaucaucaucgucggcgc

SEQ ID NO: 2416290 - RNA, 12 nt, Bordetella pertussis
ccaucaucgcga

SEQ ID NO: 2416291 - RNA, 15 nt, Bordetella pertussis
ccaucauggccaggg

SEQ ID NO: 2416292 - RNA, 20 nt, Bordetella pertussis
ccauccacggcgccaugccg

SEQ ID NO: 2416293 - RNA, 16 nt, Bordetella pertussis
ccauccagccaggccg

SEQ ID NO: 2416294 - RNA, 19 nt, Bordetella pertussis
ccauccagccaggccgcau

SEQ ID NO: 2416295 - RNA, 21 nt, Bordetella pertussis
ccauccagcggacgggccagg

SEQ ID NO: 2416296 - RNA, 22 nt, Bordetella pertussis
ccauccagcggacgggccaggc

SEQ ID NO: 2416297 - RNA, 18 nt, Bordetella pertussis
ccauccagguacgaccac

SEQ ID NO: 2416298 - RNA, 17 nt, Bordetella pertussis
ccaucccauccgcgcca

SEQ ID NO: 2416299 - RNA, 12 nt, Bordetella pertussis
ccauccggccgc

SEQ ID NO: 2416300 - RNA, 22 nt, Bordetella pertussis
ccauccgucugguuccagauuu

SEQ ID NO: 2416301 - RNA, 15 nt, Bordetella pertussis
ccauccucgcccagc

SEQ ID NO: 2416302 - RNA, 17 nt, Bordetella pertussis
ccauccucgcccagcgg

SEQ ID NO: 2416303 - RNA, 10 nt, Bordetella pertussis
ccauccugaa

SEQ ID NO: 2416304 - RNA, 16 nt, Bordetella pertussis
ccauccugaacgccgc

SEQ ID NO: 2416305 - RNA, 17 nt, Bordetella pertussis
ccauccugaacgccgcg

SEQ ID NO: 2416306 - RNA, 18 nt, Bordetella pertussis
ccauccugaacgccgcgc

SEQ ID NO: 2416307 - RNA, 12 nt, Bordetella pertussis
ccauccuggccg

SEQ ID NO: 2416308 - RNA, 13 nt, Bordetella pertussis
ccauccuggccga

SEQ ID NO: 2416309 - RNA, 16 nt, Bordetella pertussis
ccauccuggccgccgc

SEQ ID NO: 2416310 - RNA, 22 nt, Bordetella pertussis
ccauccuggccgccgcgggcgc

SEQ ID NO: 2416311 - RNA, 16 nt, Bordetella pertussis
ccaucgacgggcggcu

SEQ ID NO: 2416312 - RNA, 21 nt, Bordetella pertussis
ccaugcggcggcgggcggccg

SEQ ID NO: 2416313 - RNA, 15 nt, Bordetella pertussis
ccaugcggggacagg

SEQ ID NO: 2416314 - RNA, 18 nt, Bordetella pertussis
ccaugcggggacaggcac

SEQ ID NO: 2416315 - RNA, 21 nt, Bordetella pertussis
ccaugcggggacuggcaccag

SEQ ID NO: 2416316 - RNA, 20 nt, Bordetella pertussis
ccaugcgggucaggccgccg

SEQ ID NO: 2416317 - RNA, 22 nt, Bordetella pertussis
ccaugcggugcgcccuuugcau

SEQ ID NO: 2416318 - RNA, 19 nt, Bordetella pertussis
ccaugcguaucggcagcgu

SEQ ID NO: 2416319 - RNA, 14 nt, Bordetella pertussis
ccaugcucagcagc

SEQ ID NO: 2416320 - RNA, 21 nt, Bordetella pertussis
ccaugcugaauugcgggccgg

SEQ ID NO: 2416321 - RNA, 22 nt, Bordetella pertussis
ccaugcugaauugcgggccggc

SEQ ID NO: 2416322 - RNA, 22 nt, Bordetella pertussis
ccaugcugccaaccgcgacgca

SEQ ID NO: 2416323 - RNA, 16 nt, Bordetella pertussis
ccaugcuggccgccgc

SEQ ID NO: 2416324 - RNA, 17 nt, Bordetella pertussis
ccaugcuggccgccgcg

SEQ ID NO: 2416325 - RNA, 13 nt, Bordetella pertussis
ccauggaagcggu

SEQ ID NO: 2416326 - RNA, 16 nt, Bordetella pertussis
ccauggacagcaccga

SEQ ID NO: 2416327 - RNA, 17 nt, Bordetella pertussis
ccauggacagcaccgac

SEQ ID NO: 2416328 - RNA, 19 nt, Bordetella pertussis
ccauggacagcaccgacag

SEQ ID NO: 2416329 - RNA, 22 nt, Bordetella pertussis
ccauggacgagggccggcgcca

SEQ ID NO: 2416330 - RNA, 15 nt, Bordetella pertussis
ccauggaggcgcagc

SEQ ID NO: 2416331 - RNA, 13 nt, Bordetella pertussis
ccauggcagggcg

SEQ ID NO: 2416332 - RNA, 14 nt, Bordetella pertussis
ccauggcagggcgc

SEQ ID NO: 2416333 - RNA, 18 nt, Bordetella pertussis
ccauggcagggcgccgcg

SEQ ID NO: 2416334 - RNA, 21 nt, Bordetella pertussis
ccauggcaguacguacgcccg

SEQ ID NO: 2416335 - RNA, 22 nt, Bordetella pertussis
ccauggcaguacguacgcccgg

SEQ ID NO: 2416336 - RNA, 16 nt, Bordetella pertussis
ccauggcaugcaccgc

SEQ ID NO: 2416337 - RNA, 23 nt, Bordetella pertussis
ccauggccagggaggaacugggc

SEQ ID NO: 2416338 - RNA, 15 nt, Bordetella pertussis
ccauggccgacagcg

SEQ ID NO: 2416339 - RNA, 18 nt, Bordetella pertussis
ccauggccggccgccggg

SEQ ID NO: 2416340 - RNA, 21 nt, Bordetella pertussis
ccauggccgugcgcccgacgc

SEQ ID NO: 2416341 - RNA, 19 nt, Bordetella pertussis
ccauggccugcaggaagcc

SEQ ID NO: 2416342 - RNA, 14 nt, Bordetella pertussis
ccauggcgcgcagc

SEQ ID NO: 2416343 - RNA, 16 nt, Bordetella pertussis
ccauggcgcgcagcac

SEQ ID NO: 2416344 - RNA, 21 nt, Bordetella pertussis
ccauggcgcuguuggccggcg

SEQ ID NO: 2416345 - RNA, 15 nt, Bordetella pertussis
ccauggcggccggcg

SEQ ID NO: 2416346 - RNA, 22 nt, Bordetella pertussis
ccauggcggggaauucgaccgg

SEQ ID NO: 2416347 - RNA, 13 nt, Bordetella pertussis
ccauggcgugcca

SEQ ID NO: 2416348 - RNA, 23 nt, Bordetella pertussis
ccaugggaaucugcuugccguuc

SEQ ID NO: 2416349 - RNA, 12 nt, Bordetella pertussis
ccaugggcgucg

SEQ ID NO: 2416350 - RNA, 18 nt, Bordetella pertussis
ccaugggcucgugcagca

SEQ ID NO: 2416351 - RNA, 21 nt, Bordetella pertussis
ccaugggcucgugcagcaggg

SEQ ID NO: 2416352 - RNA, 22 nt, Bordetella pertussis
ccaugggcucgugcagcagggg

SEQ ID NO: 2416353 - RNA, 18 nt, Bordetella pertussis
ccauggggugcuccugcc

SEQ ID NO: 2416354 - RNA, 19 nt, Bordetella pertussis
ccauggggugcuccugcca

SEQ ID NO: 2416355 - RNA, 12 nt, Bordetella pertussis
ccauggucgcga

SEQ ID NO: 2416356 - RNA, 21 nt, Bordetella pertussis
ccauggucgcgaccaccguga

SEQ ID NO: 2416357 - RNA, 11 nt, Bordetella pertussis
ccauggucucc

SEQ ID NO: 2416358 - RNA, 18 nt, Bordetella pertussis
ccauggugaacggccccg

SEQ ID NO: 2416359 - RNA, 21 nt, Bordetella pertussis
ccauggugccccaugcgcggu

SEQ ID NO: 2416360 - RNA, 18 nt, Bordetella pertussis
ccauguagauggccgccu

SEQ ID NO: 2416361 - RNA, 15 nt, Bordetella pertussis
ccauguccgcgccca

SEQ ID NO: 2416362 - RNA, 16 nt, Bordetella pertussis
ccauguccgcgcccau

SEQ ID NO: 2416363 - RNA, 18 nt, Bordetella pertussis
ccauguccuggcaggccg

SEQ ID NO: 2416364 - RNA, 13 nt, Bordetella pertussis
ccaugugcgccgc

SEQ ID NO: 2416365 - RNA, 14 nt, Bordetella pertussis
ccaugugcgccgcg

SEQ ID NO: 2416366 - RNA, 23 nt, Bordetella pertussis
ccaugugcgccgcgccguacagg

SEQ ID NO: 2416367 - RNA, 15 nt, Bordetella pertussis
ccauguggcagaugg

SEQ ID NO: 2416368 - RNA, 19 nt, Bordetella pertussis
ccauguggcgacgcccagc

SEQ ID NO: 2416369 - RNA, 14 nt, Bordetella pertussis
ccauguggcgcagc

SEQ ID NO: 2416370 - RNA, 15 nt, Bordetella pertussis
ccauguucagcuuca

SEQ ID NO: 2416371 - RNA, 21 nt, Bordetella pertussis
ccauguucagcuucagccugg

SEQ ID NO: 2416372 - RNA, 22 nt, Bordetella pertussis
ccauguucagcuucagccuggg

SEQ ID NO: 2416373 - RNA, 21 nt, Bordetella pertussis
ccauguugaacugcaggccgc

SEQ ID NO: 2416374 - RNA, 17 nt, Bordetella pertussis
ccauuagggcccagcug

SEQ ID NO: 2416375 - RNA, 19 nt, Bordetella pertussis
ccauucagaccggguuguc

SEQ ID NO: 2416376 - RNA, 16 nt, Bordetella pertussis
ccauuccggcuggucg

SEQ ID NO: 2416377 - RNA, 14 nt, Bordetella pertussis
ccauucggccaggu

SEQ ID NO: 2416378 - RNA, 16 nt, Bordetella pertussis
ccauugaaagcgcgag

SEQ ID NO: 2416379 - RNA, 16 nt, Bordetella pertussis
ccauugcccacagcac

SEQ ID NO: 2416380 - RNA, 18 nt, Bordetella pertussis
ccauugcgcggccagggc

SEQ ID NO: 2416381 - RNA, 18 nt, Bordetella pertussis
ccauugcggcaccugcug

SEQ ID NO: 2416382 - RNA, 20 nt, Bordetella pertussis
ccauugcggcaccugcugcu

SEQ ID NO: 2416383 - RNA, 14 nt, Bordetella pertussis
ccauuuccaccacg

SEQ ID NO: 2416384 - RNA, 16 nt, Bordetella pertussis
ccauuuguugggccac

SEQ ID NO: 2416385 - RNA, 16 nt, Bordetella pertussis
cccaaccagggccgcc

SEQ ID NO: 2416386 - RNA, 20 nt, Bordetella pertussis
cccaacccggcgaggccgcc

SEQ ID NO: 2416387 - RNA, 15 nt, Bordetella pertussis
cccaaccgggacagg

SEQ ID NO: 2416388 - RNA, 21 nt, Bordetella pertussis
cccaaccgggacaggcaccuu

SEQ ID NO: 2416389 - RNA, 13 nt, Bordetella pertussis
cccaacgcggcca

SEQ ID NO: 2416390 - RNA, 16 nt, Bordetella pertussis
cccaacgcggccagcg

SEQ ID NO: 2416391 - RNA, 21 nt, Bordetella pertussis
cccaacgcggcgucgacgccc

SEQ ID NO: 2416392 - RNA, 22 nt, Bordetella pertussis
cccaagucgaguucggcgcgcc

SEQ ID NO: 2416393 - RNA, 15 nt, Bordetella pertussis
cccaaucgggcagca

SEQ ID NO: 2416394 - RNA, 16 nt, Bordetella pertussis
cccaaugucaccgacg

SEQ ID NO: 2416395 - RNA, 14 nt, Bordetella pertussis
cccaauuggccgcc

SEQ ID NO: 2416396 - RNA, 23 nt, Bordetella pertussis
cccaauuggccgcccuggcgcga

SEQ ID NO: 2416397 - RNA, 18 nt, Bordetella pertussis
cccacacuuggccggcga

SEQ ID NO: 2416398 - RNA, 14 nt, Bordetella pertussis
cccacagcagcgcg

SEQ ID NO: 2416399 - RNA, 17 nt, Bordetella pertussis
cccacagcagcgcgccg

SEQ ID NO: 2416400 - RNA, 19 nt, Bordetella pertussis
cccacagcagcgcgccgcc

SEQ ID NO: 2416401 - RNA, 12 nt, Bordetella pertussis
cccacagcgccc

SEQ ID NO: 2416402 - RNA, 13 nt, Bordetella pertussis
cccacagcgcccc

SEQ ID NO: 2416403 - RNA, 15 nt, Bordetella pertussis
cccacagcgccccca

SEQ ID NO: 2416404 - RNA, 16 nt, Bordetella pertussis
cccacagcgcccccag

SEQ ID NO: 2416405 - RNA, 17 nt, Bordetella pertussis
cccacaggaacaggccg

SEQ ID NO: 2416406 - RNA, 12 nt, Bordetella pertussis
cccacaggcgcg

SEQ ID NO: 2416407 - RNA, 23 nt, Bordetella pertussis
cccacaggcgcgcggcguugcgg

SEQ ID NO: 2416408 - RNA, 17 nt, Bordetella pertussis
cccacagggggacuggc

SEQ ID NO: 2416409 - RNA, 24 nt, Bordetella pertussis
cccacagggggucuggcaccugcc

SEQ ID NO: 2416410 - RNA, 21 nt, Bordetella pertussis
cccacagguuggccgcgacga

SEQ ID NO: 2416411 - RNA, 15 nt, Bordetella pertussis
cccacauagaccggc

SEQ ID NO: 2416412 - RNA, 16 nt, Bordetella pertussis
cccacauagcggccgg

SEQ ID NO: 2416413 - RNA, 17 nt, Bordetella pertussis
cccacauagcggccggc

SEQ ID NO: 2416414 - RNA, 20 nt, Bordetella pertussis
cccacauagcggccggcgcg

SEQ ID NO: 2416415 - RNA, 18 nt, Bordetella pertussis
cccacaucgucgcgcugg

SEQ ID NO: 2416416 - RNA, 16 nt, Bordetella pertussis
cccacaugccgugcca

SEQ ID NO: 2416417 - RNA, 17 nt, Bordetella pertussis
cccacauggggacuggc

SEQ ID NO: 2416418 - RNA, 16 nt, Bordetella pertussis
cccaccaccagcgcgg

SEQ ID NO: 2416419 - RNA, 19 nt, Bordetella pertussis
cccaccaccagcgcggcca

SEQ ID NO: 2416420 - RNA, 14 nt, Bordetella pertussis
cccaccaccagcgg

SEQ ID NO: 2416421 - RNA, 18 nt, Bordetella pertussis
cccaccacgccgcccagc

SEQ ID NO: 2416422 - RNA, 15 nt, Bordetella pertussis
cccaccagccgcccg

SEQ ID NO: 2416423 - RNA, 16 nt, Bordetella pertussis
cccaccagccgggcgg

SEQ ID NO: 2416424 - RNA, 17 nt, Bordetella pertussis
cccaccagccgggcggc

SEQ ID NO: 2416425 - RNA, 13 nt, Bordetella pertussis
cccagcgagcugg

SEQ ID NO: 2416426 - RNA, 13 nt, Bordetella pertussis
cccagcgagucga

SEQ ID NO: 2416427 - RNA, 20 nt, Bordetella pertussis
cccagcgcauagacccacag

SEQ ID NO: 2416428 - RNA, 17 nt, Bordetella pertussis
cccagcgcauaggacgc

SEQ ID NO: 2416429 - RNA, 24 nt, Bordetella pertussis
cccagcgcauaggacgccaccagu

SEQ ID NO: 2416430 - RNA, 15 nt, Bordetella pertussis
cccagcgccagcgug

SEQ ID NO: 2416431 - RNA, 16 nt, Bordetella pertussis
cccagcgccagcgugg

SEQ ID NO: 2416432 - RNA, 17 nt, Bordetella pertussis
cccagcgccagggccgc

SEQ ID NO: 2416433 - RNA, 19 nt, Bordetella pertussis
cccagcgccagggccgccg

SEQ ID NO: 2416434 - RNA, 22 nt, Bordetella pertussis
cccagcgccaucaagagcaccg

SEQ ID NO: 2416435 - RNA, 14 nt, Bordetella pertussis
cccagcgcccaggc

SEQ ID NO: 2416436 - RNA, 13 nt, Bordetella pertussis
cccagcgccgcca

SEQ ID NO: 2416437 - RNA, 19 nt, Bordetella pertussis
cccagcgccgccauggcgg

SEQ ID NO: 2416438 - RNA, 20 nt, Bordetella pertussis
cccagcgccgccauggcggc

SEQ ID NO: 2416439 - RNA, 13 nt, Bordetella pertussis
cccagcgccgccg

SEQ ID NO: 2416440 - RNA, 12 nt, Bordetella pertussis
cccagcgccgcg

SEQ ID NO: 2416441 - RNA, 14 nt, Bordetella pertussis
cccagcgccgcgag

SEQ ID NO: 2416442 - RNA, 14 nt, Bordetella pertussis
cccagcgccggcac

SEQ ID NO: 2416443 - RNA, 18 nt, Bordetella pertussis
cccagcgccggcacgcug

SEQ ID NO: 2416444 - RNA, 18 nt, Bordetella pertussis
cccagcgccgucagcagc

SEQ ID NO: 2416445 - RNA, 23 nt, Bordetella pertussis
cccagcgccgucagcagcgcggc

SEQ ID NO: 2416446 - RNA, 12 nt, Bordetella pertussis
cccagcgcgccg

SEQ ID NO: 2416447 - RNA, 18 nt, Bordetella pertussis
cccagcgcgccgggggcg

SEQ ID NO: 2416448 - RNA, 15 nt, Bordetella pertussis
cccagcgcgccugcc

SEQ ID NO: 2416449 - RNA, 19 nt, Bordetella pertussis
cccagcgcgccugcccagg

SEQ ID NO: 2416450 - RNA, 22 nt, Bordetella pertussis
cccagcgcgucggccagcgccg

SEQ ID NO: 2416451 - RNA, 17 nt, Bordetella pertussis
cccagcgcucguccacg

SEQ ID NO: 2416452 - RNA, 18 nt, Bordetella pertussis
cccagcgcuugcacgcca

SEQ ID NO: 2416453 - RNA, 23 nt, Bordetella pertussis
cccagcgcuugcacgccauagcg

SEQ ID NO: 2416454 - RNA, 14 nt, Bordetella pertussis
cccagcggcaggcu

SEQ ID NO: 2416455 - RNA, 12 nt, Bordetella pertussis
cccagcggcgca

SEQ ID NO: 2416456 - RNA, 13 nt, Bordetella pertussis
cccagcggcgccg

SEQ ID NO: 2416457 - RNA, 17 nt, Bordetella pertussis
cccagcggcuggccacu

SEQ ID NO: 2416458 - RNA, 18 nt, Bordetella pertussis
cccagcggcuggcgcacg

SEQ ID NO: 2416459 - RNA, 17 nt, Bordetella pertussis
cccagcggggacaggca

SEQ ID NO: 2416460 - RNA, 20 nt, Bordetella pertussis
cccagcggggacaggcaccc

SEQ ID NO: 2416461 - RNA, 21 nt, Bordetella pertussis
cccagcggggacaggcacccc

SEQ ID NO: 2416462 - RNA, 22 nt, Bordetella pertussis
cccagcggggacaggcaccccu

SEQ ID NO: 2416463 - RNA, 14 nt, Bordetella pertussis
cccagcguccaggc

SEQ ID NO: 2416464 - RNA, 17 nt, Bordetella pertussis
cccagcguccaggcggc

SEQ ID NO: 2416465 - RNA, 22 nt, Bordetella pertussis
cccagcguccaggcggccaucg

SEQ ID NO: 2416466 - RNA, 19 nt, Bordetella pertussis
cccagcguguaggcggccg

SEQ ID NO: 2416467 - RNA, 23 nt, Bordetella pertussis
cccagcguucgcgcuugcggccg

SEQ ID NO: 2416468 - RNA, 23 nt, Bordetella pertussis
cccagcucauggcacagcgcggc

SEQ ID NO: 2416469 - RNA, 12 nt, Bordetella pertussis
cccagcuccagc

SEQ ID NO: 2416470 - RNA, 13 nt, Bordetella pertussis
cccagcuccagcu

SEQ ID NO: 2416471 - RNA, 15 nt, Bordetella pertussis
cccagcuccagcugg

SEQ ID NO: 2416472 - RNA, 19 nt, Bordetella pertussis
cccagcuccagcuggcgca

SEQ ID NO: 2416473 - RNA, 16 nt, Bordetella pertussis
cccagcugcuucaugc

SEQ ID NO: 2416474 - RNA, 16 nt, Bordetella pertussis
cccagcuggcgccccu

SEQ ID NO: 2416475 - RNA, 14 nt, Bordetella pertussis
cccagcugggccac

SEQ ID NO: 2416476 - RNA, 13 nt, Bordetella pertussis
cccagcugggcgg

SEQ ID NO: 2416477 - RNA, 20 nt, Bordetella pertussis
cccagcugggcggcgugacc

SEQ ID NO: 2416478 - RNA, 20 nt, Bordetella pertussis
cccagcuucucgcaagugcu

SEQ ID NO: 2416479 - RNA, 18 nt, Bordetella pertussis
cccagcuugaugccgccg

SEQ ID NO: 2416480 - RNA, 20 nt, Bordetella pertussis
cccagcuugaugccgccgaa

SEQ ID NO: 2416481 - RNA, 17 nt, Bordetella pertussis
cccagcuugucggccgc

SEQ ID NO: 2416482 - RNA, 18 nt, Bordetella pertussis
cccagcuugucggccgcg

SEQ ID NO: 2416483 - RNA, 22 nt, Bordetella pertussis
cccagcuugucggccgcgcgca

SEQ ID NO: 2416484 - RNA, 17 nt, Bordetella pertussis
cccaggaaaucaggcgc

SEQ ID NO: 2416485 - RNA, 18 nt, Bordetella pertussis
cccaggaaaucaggcgca

SEQ ID NO: 2416486 - RNA, 20 nt, Bordetella pertussis
cccaggaaaucaggcgcauc

SEQ ID NO: 2416487 - RNA, 20 nt, Bordetella pertussis
cccaggagcaacuggggcgc

SEQ ID NO: 2416488 - RNA, 17 nt, Bordetella pertussis
cccaggaucaccgccgc

SEQ ID NO: 2416489 - RNA, 19 nt, Bordetella pertussis
cccaggaucaccgccgcgc

SEQ ID NO: 2416490 - RNA, 22 nt, Bordetella pertussis
cccaggaucaccgccgcgccgc

SEQ ID NO: 2416491 - RNA, 19 nt, Bordetella pertussis
cccaggaucgucgucauga

SEQ ID NO: 2416492 - RNA, 11 nt, Bordetella pertussis
cccaggaugcc

SEQ ID NO: 2416493 - RNA, 14 nt, Bordetella pertussis
cccaggaugcgcac

SEQ ID NO: 2416494 - RNA, 18 nt, Bordetella pertussis
cccaggaugcgcaccggc

SEQ ID NO: 2416495 - RNA, 10 nt, Bordetella pertussis
cccaggcaau

SEQ ID NO: 2416496 - RNA, 23 nt, Bordetella pertussis
cccaggcaggcgggcccgcaucg

SEQ ID NO: 2416497 - RNA, 18 nt, Bordetella pertussis
cccaggcccaccgcaucg

SEQ ID NO: 2416498 - RNA, 13 nt, Bordetella pertussis
cccaggcccacgc

SEQ ID NO: 2416499 - RNA, 12 nt, Bordetella pertussis
cccaggcccagc

SEQ ID NO: 2416500 - RNA, 15 nt, Bordetella pertussis
cccaggcccagcauc

SEQ ID NO: 2416501 - RNA, 13 nt, Bordetella pertussis
cccaggcccgcca

SEQ ID NO: 2416502 - RNA, 15 nt, Bordetella pertussis
cccaggcccuggcug

SEQ ID NO: 2416503 - RNA, 16 nt, Bordetella pertussis
cccaggcccuggcugg

SEQ ID NO: 2416504 - RNA, 17 nt, Bordetella pertussis
cccaggcccuggcuggc

SEQ ID NO: 2416505 - RNA, 17 nt, Bordetella pertussis
cccaggccgaagccacc

SEQ ID NO: 2416506 - RNA, 16 nt, Bordetella pertussis
cccaggccgaucagcg

SEQ ID NO: 2416507 - RNA, 15 nt, Bordetella pertussis
cccaggccgccggcg

SEQ ID NO: 2416508 - RNA, 19 nt, Bordetella pertussis
cccaggccgccggcggcgu

SEQ ID NO: 2416509 - RNA, 12 nt, Bordetella pertussis
cccaggccggcg

SEQ ID NO: 2416510 - RNA, 15 nt, Bordetella pertussis
cccaggccggcgcca

SEQ ID NO: 2416511 - RNA, 18 nt, Bordetella pertussis
cccaggccgggcgagccg

SEQ ID NO: 2416512 - RNA, 22 nt, Bordetella pertussis
cccaggccgggcgagccgaacg

SEQ ID NO: 2416513 - RNA, 17 nt, Bordetella pertussis
cccaggccguggcgcac

SEQ ID NO: 2416514 - RNA, 22 nt, Bordetella pertussis
cccaggccguggcgcaccaggu

SEQ ID NO: 2416515 - RNA, 20 nt, Bordetella pertussis
cccaggcgacccagcaccga

SEQ ID NO: 2416516 - RNA, 21 nt, Bordetella pertussis
cccaggcgaggcuggcgccca

SEQ ID NO: 2416517 - RNA, 17 nt, Bordetella pertussis
cccaggcgaugcccagc

SEQ ID NO: 2416518 - RNA, 21 nt, Bordetella pertussis
cccaggcgaugcccagcgccg

SEQ ID NO: 2416519 - RNA, 14 nt, Bordetella pertussis
cccaggcgcagccg

SEQ ID NO: 2416520 - RNA, 15 nt, Bordetella pertussis
cccaggcgcagccgc

SEQ ID NO: 2416521 - RNA, 17 nt, Bordetella pertussis
cccaggcgcagccgcgc

SEQ ID NO: 2416522 - RNA, 21 nt, Bordetella pertussis
cccaggcgcagccgcgcgccu

SEQ ID NO: 2416523 - RNA, 12 nt, Bordetella pertussis
cccaggcgcgcu

SEQ ID NO: 2416524 - RNA, 14 nt, Bordetella pertussis
cccaggcgcgcugg

SEQ ID NO: 2416525 - RNA, 11 nt, Bordetella pertussis
cccaggcgcgu

SEQ ID NO: 2416526 - RNA, 21 nt, Bordetella pertussis
cccaggcgcguuucggucagg

SEQ ID NO: 2416527 - RNA, 18 nt, Bordetella pertussis
cccaggcgcucagccgug

SEQ ID NO: 2416528 - RNA, 14 nt, Bordetella pertussis
cccaggcggcaggc

SEQ ID NO: 2416529 - RNA, 19 nt, Bordetella pertussis
cccaggcggcaggcgccgc

SEQ ID NO: 2416530 - RNA, 14 nt, Bordetella pertussis
cccaggcggcccag

SEQ ID NO: 2416531 - RNA, 13 nt, Bordetella pertussis
cccaggcgggcca

SEQ ID NO: 2416532 - RNA, 18 nt, Bordetella pertussis
cccaggcguccaggcugc

SEQ ID NO: 2416533 - RNA, 14 nt, Bordetella pertussis
cccaggcgucggcg

SEQ ID NO: 2416534 - RNA, 23 nt, Bordetella pertussis
cccaggcgucggcggcccacagc

SEQ ID NO: 2416535 - RNA, 23 nt, Bordetella pertussis
cccaggcgugaacgccccggccg

SEQ ID NO: 2416536 - RNA, 19 nt, Bordetella pertussis
cccaggcugggccagaugg

SEQ ID NO: 2416537 - RNA, 14 nt, Bordetella pertussis
cccagggcagcggc

SEQ ID NO: 2416538 - RNA, 18 nt, Bordetella pertussis
cccauugccucgcggcag

SEQ ID NO: 2416539 - RNA, 15 nt, Bordetella pertussis
cccauugcgcggcca

SEQ ID NO: 2416540 - RNA, 20 nt, Bordetella pertussis
cccauugcggcaccugcugc

SEQ ID NO: 2416541 - RNA, 23 nt, Bordetella pertussis
cccauugcgggugggcauccagc

SEQ ID NO: 2416542 - RNA, 23 nt, Bordetella pertussis
cccauuuccgcuucggacagcag

SEQ ID NO: 2416543 - RNA, 18 nt, Bordetella pertussis
cccauuucgauggccagg

SEQ ID NO: 2416544 - RNA, 16 nt, Bordetella pertussis
ccccaacgcggccagc

SEQ ID NO: 2416545 - RNA, 21 nt, Bordetella pertussis
ccccaacggggacgggcgccc

SEQ ID NO: 2416546 - RNA, 21 nt, Bordetella pertussis
ccccacagggggacuggcacc

SEQ ID NO: 2416547 - RNA, 23 nt, Bordetella pertussis
ccccacagggggucuggcaccug

SEQ ID NO: 2416548 - RNA, 21 nt, Bordetella pertussis
ccccacauggggacuggcacc

SEQ ID NO: 2416549 - RNA, 17 nt, Bordetella pertussis
ccccaccgggacaggca

SEQ ID NO: 2416550 - RNA, 13 nt, Bordetella pertussis
ccccaccuccacc

SEQ ID NO: 2416551 - RNA, 20 nt, Bordetella pertussis
ccccacgccgaugccgcgca

SEQ ID NO: 2416552 - RNA, 12 nt, Bordetella pertussis
ccccacgccgcc

SEQ ID NO: 2416553 - RNA, 23 nt, Bordetella pertussis
ccccacgccgccguagccgcugc

SEQ ID NO: 2416554 - RNA, 12 nt, Bordetella pertussis
ccccacgccgcu

SEQ ID NO: 2416555 - RNA, 19 nt, Bordetella pertussis
ccccacggggacaggcacc

SEQ ID NO: 2416556 - RNA, 17 nt, Bordetella pertussis
ccccacguggacaggca

SEQ ID NO: 2416557 - RNA, 19 nt, Bordetella pertussis
ccccacguggacaggcacc

SEQ ID NO: 2416558 - RNA, 22 nt, Bordetella pertussis
ccccacguggacaggcaccugc

SEQ ID NO: 2416559 - RNA, 17 nt, Bordetella pertussis
ccccacugggggacugg

SEQ ID NO: 2416560 - RNA, 20 nt, Bordetella pertussis
ccccacugggggacuggcac

SEQ ID NO: 2416561 - RNA, 13 nt, Bordetella pertussis
ccccagacgcaga

SEQ ID NO: 2416562 - RNA, 13 nt, Bordetella pertussis
ccccagagcaccg

SEQ ID NO: 2416563 - RNA, 22 nt, Bordetella pertussis
ccccagagcaccgagaccgggc

SEQ ID NO: 2416564 - RNA, 19 nt, Bordetella pertussis
ccccagcacgaagggcagc

SEQ ID NO: 2416565 - RNA, 11 nt, Bordetella pertussis
ccccagcagca

SEQ ID NO: 2416566 - RNA, 12 nt, Bordetella pertussis
ccccagcagcag

SEQ ID NO: 2416567 - RNA, 19 nt, Bordetella pertussis
ccccagcagcauggcgggc

SEQ ID NO: 2416568 - RNA, 22 nt, Bordetella pertussis
ccccagcaugugcgcggcguug

SEQ ID NO: 2416569 - RNA, 20 nt, Bordetella pertussis
ccccagcgccagcguggccg

SEQ ID NO: 2416570 - RNA, 14 nt, Bordetella pertussis
ccccagcgcccagg

SEQ ID NO: 2416571 - RNA, 20 nt, Bordetella pertussis
ccccagcgccgucagcagcg

SEQ ID NO: 2416572 - RNA, 22 nt, Bordetella pertussis
ccccagcgcgccugcccaggcc

SEQ ID NO: 2416573 - RNA, 14 nt, Bordetella pertussis
ccccagcggcgcac

SEQ ID NO: 2416574 - RNA, 16 nt, Bordetella pertussis
ccccagcggcuggcgc

SEQ ID NO: 2416575 - RNA, 20 nt, Bordetella pertussis
ccccagcggcuggcgcacga

SEQ ID NO: 2416576 - RNA, 16 nt, Bordetella pertussis
ccccagcguccaggcg

SEQ ID NO: 2416577 - RNA, 20 nt, Bordetella pertussis
ccccagcuugucggccgcgc

SEQ ID NO: 2416578 - RNA, 23 nt, Bordetella pertussis
ccccaggccagcugcgcccccuc

SEQ ID NO: 2416579 - RNA, 12 nt, Bordetella pertussis
ccccaggcgccc

SEQ ID NO: 2416580 - RNA, 16 nt, Bordetella pertussis
ccccaggcgucggcgg

SEQ ID NO: 2416581 - RNA, 13 nt, Bordetella pertussis
ccccagggcgcgc

SEQ ID NO: 2416582 - RNA, 14 nt, Bordetella pertussis
ccccaggggacggc

SEQ ID NO: 2416583 - RNA, 17 nt, Bordetella pertussis
ccccaggggacggcgca

SEQ ID NO: 2416584 - RNA, 15 nt, Bordetella pertussis
ccccagguagaccac

SEQ ID NO: 2416585 - RNA, 17 nt, Bordetella pertussis
ccccagguccgccggca

SEQ ID NO: 2416586 - RNA, 18 nt, Bordetella pertussis
ccccagguccgccggcac

SEQ ID NO: 2416587 - RNA, 13 nt, Bordetella pertussis
ccccagucgcugc

SEQ ID NO: 2416588 - RNA, 15 nt, Bordetella pertussis
ccccagucgcugcuc

SEQ ID NO: 2416589 - RNA, 21 nt, Bordetella pertussis
ccccagucgcugcucgacagc

SEQ ID NO: 2416590 - RNA, 12 nt, Bordetella pertussis
ccccaguugcgc

SEQ ID NO: 2416591 - RNA, 21 nt, Bordetella pertussis
ccccaguugcgcguccaggcg

SEQ ID NO: 2416592 - RNA, 22 nt, Bordetella pertussis
ccccaguugcgcguccaggcgg

SEQ ID NO: 2416593 - RNA, 22 nt, Bordetella pertussis
ccccauaguccucuacuggcug

SEQ ID NO: 2416594 - RNA, 19 nt, Bordetella pertussis
ccccauccagcggacgggc

SEQ ID NO: 2416595 - RNA, 14 nt, Bordetella pertussis
ccccaugcgcggca

SEQ ID NO: 2416596 - RNA, 20 nt, Bordetella pertussis
ccccaugcggggacaggcac

SEQ ID NO: 2416597 - RNA, 20 nt, Bordetella pertussis
ccccaugcggggacuggcac

SEQ ID NO: 2416598 - RNA, 22 nt, Bordetella pertussis
ccccauggcaugcaccgcgugg

SEQ ID NO: 2416599 - RNA, 18 nt, Bordetella pertussis
ccccauggggacuggcac

SEQ ID NO: 2416600 - RNA, 23 nt, Bordetella pertussis
ccccauggggacuggcaccugca

SEQ ID NO: 2416601 - RNA, 23 nt, Bordetella pertussis
ccccaugucgaucuggcucacga

SEQ ID NO: 2416602 - RNA, 20 nt, Bordetella pertussis
ccccauguggggacaggcac

SEQ ID NO: 2416603 - RNA, 18 nt, Bordetella pertussis
ccccauugccucgcggca

SEQ ID NO: 2416604 - RNA, 15 nt, Bordetella pertussis
cccccacgccgccgu

SEQ ID NO: 2416605 - RNA, 11 nt, Bordetella pertussis
cccccagcagc

SEQ ID NO: 2416606 - RNA, 12 nt, Bordetella pertussis
cccccagcagcg

SEQ ID NO: 2416607 - RNA, 12 nt, Bordetella pertussis
cccccagcgccg

SEQ ID NO: 2416608 - RNA, 13 nt, Bordetella pertussis
cccccagcggcgc

SEQ ID NO: 2416609 - RNA, 15 nt, Bordetella pertussis
cccccagcggcgcac

SEQ ID NO: 2416610 - RNA, 15 nt, Bordetella pertussis
cccccaugcggggac

SEQ ID NO: 2416611 - RNA, 15 nt, Bordetella pertussis
ccccccaugccggaa

SEQ ID NO: 2416612 - RNA, 13 nt, Bordetella pertussis
cccccccccccuc

SEQ ID NO: 2416613 - RNA, 15 nt, Bordetella pertussis
cccccgauccccugc

SEQ ID NO: 2416614 - RNA, 13 nt, Bordetella pertussis
cccccgccacggc

SEQ ID NO: 2416615 - RNA, 18 nt, Bordetella pertussis
cccccgccgcacgggcgc

SEQ ID NO: 2416616 - RNA, 14 nt, Bordetella pertussis
cccccgccguggcg

SEQ ID NO: 2416617 - RNA, 12 nt, Bordetella pertussis
cccccgcgccgc

SEQ ID NO: 2416618 - RNA, 15 nt, Bordetella pertussis
cccccgcggcgcccc

SEQ ID NO: 2416619 - RNA, 20 nt, Bordetella pertussis
cccccgcggggacagauacc

SEQ ID NO: 2416620 - RNA, 22 nt, Bordetella pertussis
cccccgcgucggacgcgcgccg

SEQ ID NO: 2416621 - RNA, 23 nt, Bordetella pertussis
cccccgcgucggacgcgcgccgc

SEQ ID NO: 2416622 - RNA, 12 nt, Bordetella pertussis
cccccggcccgc

SEQ ID NO: 2416623 - RNA, 21 nt, Bordetella pertussis
cccccgggcgcaagcgcgccg

SEQ ID NO: 2416624 - RNA, 16 nt, Bordetella pertussis
cccccguaggcggccc

SEQ ID NO: 2416625 - RNA, 20 nt, Bordetella pertussis
cccccuacgaauccccgcuc

SEQ ID NO: 2416626 - RNA, 23 nt, Bordetella pertussis
cccccuacgaauccccgcucagg

SEQ ID NO: 2416627 - RNA, 13 nt, Bordetella pertussis
cccccuacugccc

SEQ ID NO: 2416628 - RNA, 14 nt, Bordetella pertussis
cccccuacugcccu

SEQ ID NO: 2416629 - RNA, 18 nt, Bordetella pertussis
cccccuacugcccucgcc

SEQ ID NO: 2416630 - RNA, 14 nt, Bordetella pertussis
cccccucggccugc

SEQ ID NO: 2416631 - RNA, 19 nt, Bordetella pertussis
ccccgaaacucaccgccgc

SEQ ID NO: 2416632 - RNA, 22 nt, Bordetella pertussis
ccccgaacggggacuggcacca

SEQ ID NO: 2416633 - RNA, 21 nt, Bordetella pertussis
ccccgaagcacagaugcacca

SEQ ID NO: 2416634 - RNA, 15 nt, Bordetella pertussis
ccccgaaggggacug

SEQ ID NO: 2416635 - RNA, 17 nt, Bordetella pertussis
ccccgaaggggacuggc

SEQ ID NO: 2416636 - RNA, 18 nt, Bordetella pertussis
ccccgagauaggcggcca

SEQ ID NO: 2416637 - RNA, 15 nt, Bordetella pertussis
ccccgaggccaccuu

SEQ ID NO: 2416638 - RNA, 15 nt, Bordetella pertussis
ccccgagggcgcggc

SEQ ID NO: 2416639 - RNA, 20 nt, Bordetella pertussis
ccccgagggcgcggcgccgc

SEQ ID NO: 2416640 - RNA, 22 nt, Bordetella pertussis
ccccgagggggcuuuuuugccu

SEQ ID NO: 2416641 - RNA, 19 nt, Bordetella pertussis
ccccgauacaaggugccug

SEQ ID NO: 2416642 - RNA, 21 nt, Bordetella pertussis
ccccgauacaaggugccuguc

SEQ ID NO: 2416643 - RNA, 21 nt, Bordetella pertussis
ccccgauccccugcccgccug

SEQ ID NO: 2416644 - RNA, 17 nt, Bordetella pertussis
ccccgauccgcgggcgg

SEQ ID NO: 2416645 - RNA, 19 nt, Bordetella pertussis
ccccgauccgcgggcgggc

SEQ ID NO: 2416646 - RNA, 15 nt, Bordetella pertussis
ccccgaucggcgccg

SEQ ID NO: 2416647 - RNA, 21 nt, Bordetella pertussis
ccccgaucgggagccucugga

SEQ ID NO: 2416648 - RNA, 24 nt, Bordetella pertussis
ccccgaugauggauucgcgccggc

SEQ ID NO: 2416649 - RNA, 18 nt, Bordetella pertussis
ccccgcaagggggacugg

SEQ ID NO: 2416650 - RNA, 22 nt, Bordetella pertussis
ccccgcaagggggacuggcacc

SEQ ID NO: 2416651 - RNA, 21 nt, Bordetella pertussis
cccgauaugcagccgcaccag

SEQ ID NO: 2416652 - RNA, 15 nt, Bordetella pertussis
cccgauccccugccc

SEQ ID NO: 2416653 - RNA, 15 nt, Bordetella pertussis
cccgauccgcgggcg

SEQ ID NO: 2416654 - RNA, 12 nt, Bordetella pertussis
cccgaucgacgg

SEQ ID NO: 2416655 - RNA, 13 nt, Bordetella pertussis
cccgaucgacggc

SEQ ID NO: 2416656 - RNA, 15 nt, Bordetella pertussis
cccgaucgacggccg

SEQ ID NO: 2416657 - RNA, 19 nt, Bordetella pertussis
cccgaucgcgauggcccga

SEQ ID NO: 2416658 - RNA, 14 nt, Bordetella pertussis
cccgaucggccggc

SEQ ID NO: 2416659 - RNA, 12 nt, Bordetella pertussis
cccgaucggcgc

SEQ ID NO: 2416660 - RNA, 19 nt, Bordetella pertussis
cccgaucuccgggagccug

SEQ ID NO: 2416661 - RNA, 21 nt, Bordetella pertussis
cccgaucuccgggagccuguc

SEQ ID NO: 2416662 - RNA, 23 nt, Bordetella pertussis
cccgaucuccgggagccuguccc

SEQ ID NO: 2416663 - RNA, 22 nt, Bordetella pertussis
cccgaugacggggcggcgccug

SEQ ID NO: 2416664 - RNA, 21 nt, Bordetella pertussis
cccgaugauggauucgcgccg

SEQ ID NO: 2416665 - RNA, 23 nt, Bordetella pertussis
cccgaugauggauucgcgccggc

SEQ ID NO: 2416666 - RNA, 13 nt, Bordetella pertussis
accagggcgccga

SEQ ID NO: 2416667 - RNA, 20 nt, Bordetella pertussis
accagggcgcgcagcaggcc

SEQ ID NO: 2416668 - RNA, 18 nt, Bordetella pertussis
accagggcggugggcagc

SEQ ID NO: 2416669 - RNA, 14 nt, Bordetella pertussis
accaggggcggcgc

SEQ ID NO: 2416670 - RNA, 20 nt, Bordetella pertussis
accaggggcggcgcggcgcu

SEQ ID NO: 2416671 - RNA, 21 nt, Bordetella pertussis
accaggggcggcgcggcgcug

SEQ ID NO: 2416672 - RNA, 22 nt, Bordetella pertussis
accaggggcggcgcggcgcugg

SEQ ID NO: 2416673 - RNA, 13 nt, Bordetella pertussis
accaggguggcgc

SEQ ID NO: 2416674 - RNA, 17 nt, Bordetella pertussis
accaggguggcgccggc

SEQ ID NO: 2416675 - RNA, 18 nt, Bordetella pertussis
accaggguggcgccggcc

SEQ ID NO: 2416676 - RNA, 15 nt, Bordetella pertussis
accaggguggcgggc

SEQ ID NO: 2416677 - RNA, 20 nt, Bordetella pertussis
accaggguggcgggcgccug

SEQ ID NO: 2416678 - RNA, 16 nt, Bordetella pertussis
accagguacgucgaga

SEQ ID NO: 2416679 - RNA, 19 nt, Bordetella pertussis
accagguacgucgagaagc

SEQ ID NO: 2416680 - RNA, 18 nt, Bordetella pertussis
accagguagggcagcagg

SEQ ID NO: 2416681 - RNA, 14 nt, Bordetella pertussis
accagguaucgacc

SEQ ID NO: 2416682 - RNA, 18 nt, Bordetella pertussis
accagguccuggcggccg

SEQ ID NO: 2416683 - RNA, 21 nt, Bordetella pertussis
accaggucgcggugcgccacg

SEQ ID NO: 2416684 - RNA, 20 nt, Bordetella pertussis
accaggucguacagcgccug

SEQ ID NO: 2416685 - RNA, 21 nt, Bordetella pertussis
accaggucgucguagcgggcg

SEQ ID NO: 2416686 - RNA, 13 nt, Bordetella pertussis
accaggugggcgc

SEQ ID NO: 2416687 - RNA, 22 nt, Bordetella pertussis
accagguugcauccggcccggu

SEQ ID NO: 2416688 - RNA, 20 nt, Bordetella pertussis
accagguuggcgauggcguc

SEQ ID NO: 2416689 - RNA, 21 nt, Bordetella pertussis
accagguuuuccacagccagg

SEQ ID NO: 2416690 - RNA, 19 nt, Bordetella pertussis
accaguacaccggcgugca

SEQ ID NO: 2416691 - RNA, 18 nt, Bordetella pertussis
accaguagcacacgccga

SEQ ID NO: 2416692 - RNA, 21 nt, Bordetella pertussis
accagugcaggggguggcggc

SEQ ID NO: 2416693 - RNA, 22 nt, Bordetella pertussis
accagugcaggggguggcggcc

SEQ ID NO: 2416694 - RNA, 18 nt, Bordetella pertussis
accaguucggccagcagc

SEQ ID NO: 2416695 - RNA, 15 nt, Bordetella pertussis
accaguuggcccuuc

SEQ ID NO: 2416696 - RNA, 13 nt, Bordetella pertussis
accauaucuggca

SEQ ID NO: 2416697 - RNA, 17 nt, Bordetella pertussis
accaucaacgggccgcu

SEQ ID NO: 2416698 - RNA, 22 nt, Bordetella pertussis
accaucaacgggccgcugguca

SEQ ID NO: 2416699 - RNA, 14 nt, Bordetella pertussis
accaucagccagcc

SEQ ID NO: 2416700 - RNA, 20 nt, Bordetella pertussis
accauccugccccaggaaac

SEQ ID NO: 2416701 - RNA, 17 nt, Bordetella pertussis
accaucgccgagccgcu

SEQ ID NO: 2416702 - RNA, 14 nt, Bordetella pertussis
accaucgccgccug

SEQ ID NO: 2416703 - RNA, 13 nt, Bordetella pertussis
accaucgcgcacu

SEQ ID NO: 2416704 - RNA, 17 nt, Bordetella pertussis
accaucgcgcacuugug

SEQ ID NO: 2416705 - RNA, 23 nt, Bordetella pertussis
accaucguugccugggugcuggu

SEQ ID NO: 2416706 - RNA, 15 nt, Bordetella pertussis
accaucucccgcagg

SEQ ID NO: 2416707 - RNA, 19 nt, Bordetella pertussis
accaucucccgcaggccca

SEQ ID NO: 2416708 - RNA, 23 nt, Bordetella pertussis
accaucuuguccuucagcacgcu

SEQ ID NO: 2416709 - RNA, 19 nt, Bordetella pertussis
accaugaccaugccggccu

SEQ ID NO: 2416710 - RNA, 16 nt, Bordetella pertussis
accaugccgauggcgg

SEQ ID NO: 2416711 - RNA, 17 nt, Bordetella pertussis
accaugccggccugcga

SEQ ID NO: 2416712 - RNA, 23 nt, Bordetella pertussis
accaugccuugcgcgacagcagg

SEQ ID NO: 2416713 - RNA, 16 nt, Bordetella pertussis
accaugcgcaccaggc

SEQ ID NO: 2416714 - RNA, 17 nt, Bordetella pertussis
accaugcgcagcaacag

SEQ ID NO: 2416715 - RNA, 22 nt, Bordetella pertussis
accaugcgcgagggcaucagcg

SEQ ID NO: 2416716 - RNA, 22 nt, Bordetella pertussis
accaugcgcugggcaugggcgg

SEQ ID NO: 2416717 - RNA, 22 nt, Bordetella pertussis
accaugcggccgucgccgccca

SEQ ID NO: 2416718 - RNA, 22 nt, Bordetella pertussis
accauggcgcccacggccgcau

SEQ ID NO: 2416719 - RNA, 22 nt, Bordetella pertussis
accaugggcgucgucgccgucg

SEQ ID NO: 2416720 - RNA, 21 nt, Bordetella pertussis
accaugggcucgugcagcagg

SEQ ID NO: 2416721 - RNA, 13 nt, Bordetella pertussis
accaugucccugg

SEQ ID NO: 2416722 - RNA, 19 nt, Bordetella pertussis
accaugucccuggccauuc

SEQ ID NO: 2416723 - RNA, 21 nt, Bordetella pertussis
accaugugcgagagcuccagc

SEQ ID NO: 2416724 - RNA, 16 nt, Bordetella pertussis
accaugugcuugccgc

SEQ ID NO: 2416725 - RNA, 21 nt, Bordetella pertussis
accauguugcuuggcgucagc

SEQ ID NO: 2416726 - RNA, 19 nt, Bordetella pertussis
accauugaaacguacucca

SEQ ID NO: 2416727 - RNA, 20 nt, Bordetella pertussis
accauuucgauuucggcggc

SEQ ID NO: 2416728 - RNA, 22 nt, Bordetella pertussis
accauuucgauuucggcggcca

SEQ ID NO: 2416729 - RNA, 17 nt, Bordetella pertussis
acccacacuuggccggc

SEQ ID NO: 2416730 - RNA, 18 nt, Bordetella pertussis
acccacacuuggccggcg

SEQ ID NO: 2416731 - RNA, 20 nt, Bordetella pertussis
acccacccccagcagcaugg

SEQ ID NO: 2416732 - RNA, 18 nt, Bordetella pertussis
acccacggcguggcgcgc

SEQ ID NO: 2416733 - RNA, 23 nt, Bordetella pertussis
acccacuucgaaacccuuguagc

SEQ ID NO: 2416734 - RNA, 15 nt, Bordetella pertussis
acccagaacccggcc

SEQ ID NO: 2416735 - RNA, 17 nt, Bordetella pertussis
acccagaacccggccgg

SEQ ID NO: 2416736 - RNA, 18 nt, Bordetella pertussis
acccagaacccggccggc

SEQ ID NO: 2416737 - RNA, 17 nt, Bordetella pertussis
acccagcagcggcagca

SEQ ID NO: 2416738 - RNA, 22 nt, Bordetella pertussis
acccagccggacccgcgccgca

SEQ ID NO: 2416739 - RNA, 24 nt, Bordetella pertussis
acccagccggacccgcgccgcagg

SEQ ID NO: 2416740 - RNA, 12 nt, Bordetella pertussis
acccaggcccau

SEQ ID NO: 2416741 - RNA, 20 nt, Bordetella pertussis
acccaggccggcgccagccg

SEQ ID NO: 2416742 - RNA, 14 nt, Bordetella pertussis
acccaggcgccgau

SEQ ID NO: 2416743 - RNA, 20 nt, Bordetella pertussis
acccaggcggcaggcgccgc

SEQ ID NO: 2416744 - RNA, 20 nt, Bordetella pertussis
acccagguaucggccagcac

SEQ ID NO: 2416745 - RNA, 17 nt, Bordetella pertussis
acccagucgcaguucgg

SEQ ID NO: 2416746 - RNA, 14 nt, Bordetella pertussis
acccauaccagccc

SEQ ID NO: 2416747 - RNA, 15 nt, Bordetella pertussis
acccauaccagcccg

SEQ ID NO: 2416748 - RNA, 18 nt, Bordetella pertussis
acccauaccagcccggcg

SEQ ID NO: 2416749 - RNA, 15 nt, Bordetella pertussis
accccaccggcaagc

SEQ ID NO: 2416750 - RNA, 18 nt, Bordetella pertussis
acccccggcaccaggaac

SEQ ID NO: 2416751 - RNA, 18 nt, Bordetella pertussis
accccgaagcacagaugc

SEQ ID NO: 2416752 - RNA, 19 nt, Bordetella pertussis
accccgagauaggcggcca

SEQ ID NO: 2416753 - RNA, 16 nt, Bordetella pertussis
accccgagggcgcggc

SEQ ID NO: 2416754 - RNA, 22 nt, Bordetella pertussis
accccgaguugaggaugcgcgc

SEQ ID NO: 2416755 - RNA, 14 nt, Bordetella pertussis
accccgccaccgcc

SEQ ID NO: 2416756 - RNA, 23 nt, Bordetella pertussis
accccgcccggcggcgcgccgcc

SEQ ID NO: 2416757 - RNA, 14 nt, Bordetella pertussis
accccgcccugccc

SEQ ID NO: 2416758 - RNA, 12 nt, Bordetella pertussis
accccgccgcug

SEQ ID NO: 2416759 - RNA, 16 nt, Bordetella pertussis
accccgccgugccggg

SEQ ID NO: 2416760 - RNA, 21 nt, Bordetella pertussis
accccgccgugccgggccugg

SEQ ID NO: 2416761 - RNA, 19 nt, Bordetella pertussis
accccggucagcagggcgc

SEQ ID NO: 2416762 - RNA, 23 nt, Bordetella pertussis
accccggucagcagggcgccgac

SEQ ID NO: 2416763 - RNA, 16 nt, Bordetella pertussis
cccgccucaggccgga

SEQ ID NO: 2416764 - RNA, 14 nt, Bordetella pertussis
cccgccugcagcag

SEQ ID NO: 2416765 - RNA, 15 nt, Bordetella pertussis
cccgccugcagcagc

SEQ ID NO: 2416766 - RNA, 13 nt, Bordetella pertussis
cccgccugccggc

SEQ ID NO: 2416767 - RNA, 13 nt, Bordetella pertussis
cccgccugcgcca

SEQ ID NO: 2416768 - RNA, 14 nt, Bordetella pertussis
cccgccugcgccag

SEQ ID NO: 2416769 - RNA, 21 nt, Bordetella pertussis
cccgccugcgccagccgcgcc

SEQ ID NO: 2416770 - RNA, 23 nt, Bordetella pertussis
cccgccugcgccagccgcgccug

SEQ ID NO: 2416771 - RNA, 18 nt, Bordetella pertussis
cccgccugcgccaggugg

SEQ ID NO: 2416772 - RNA, 20 nt, Bordetella pertussis
cccgccugcguggcgggccg

SEQ ID NO: 2416773 - RNA, 19 nt, Bordetella pertussis
cccgccuggacggcgagga

SEQ ID NO: 2416774 - RNA, 20 nt, Bordetella pertussis
cccgccuggcgccgcgcccg

SEQ ID NO: 2416775 - RNA, 22 nt, Bordetella pertussis
cccgccuucgucgaggucagcg

SEQ ID NO: 2416776 - RNA, 18 nt, Bordetella pertussis
cccgcgaagcagccggcc

SEQ ID NO: 2416777 - RNA, 21 nt, Bordetella pertussis
cccgcgagcggccagccugcc

SEQ ID NO: 2416778 - RNA, 13 nt, Bordetella pertussis
cccgcgcacgccc

SEQ ID NO: 2416779 - RNA, 14 nt, Bordetella pertussis
cccgcgcacgcccg

SEQ ID NO: 2416780 - RNA, 14 nt, Bordetella pertussis
cccgcgcacgcgcu

SEQ ID NO: 2416781 - RNA, 13 nt, Bordetella pertussis
cccgcgcaugcaa

SEQ ID NO: 2416782 - RNA, 19 nt, Bordetella pertussis
cccgcgccagcgccacgcc

SEQ ID NO: 2416783 - RNA, 15 nt, Bordetella pertussis
cccgcgcccagcugu

SEQ ID NO: 2416784 - RNA, 23 nt, Bordetella pertussis
cccgcgcccuggcgccgcggccg

SEQ ID NO: 2416785 - RNA, 20 nt, Bordetella pertussis
cccgcgccgagcggggccgc

SEQ ID NO: 2416786 - RNA, 15 nt, Bordetella pertussis
cccgcgccgcgcaga

SEQ ID NO: 2416787 - RNA, 15 nt, Bordetella pertussis
cccgcgccggcggca

SEQ ID NO: 2416788 - RNA, 21 nt, Bordetella pertussis
cccgcgccuaucaggccucga

SEQ ID NO: 2416789 - RNA, 12 nt, Bordetella pertussis
cccgcgccucgg

SEQ ID NO: 2416790 - RNA, 24 nt, Bordetella pertussis
cccgcgccucggcauccagcucgg

SEQ ID NO: 2416791 - RNA, 22 nt, Bordetella pertussis
cccgcgcgagcgcaagcaccgc

SEQ ID NO: 2416792 - RNA, 13 nt, Bordetella pertussis
cccgcgcgcacgu

SEQ ID NO: 2416793 - RNA, 12 nt, Bordetella pertussis
cccgcgcggcca

SEQ ID NO: 2416794 - RNA, 15 nt, Bordetella pertussis
cccgcgcggccagcg

SEQ ID NO: 2416795 - RNA, 22 nt, Bordetella pertussis
cccgcgcgguauugcgccaccc

SEQ ID NO: 2416796 - RNA, 23 nt, Bordetella pertussis
cccgcgcgguauugcgccacccc

SEQ ID NO: 2416797 - RNA, 16 nt, Bordetella pertussis
cccgcgcugccgcugc

SEQ ID NO: 2416798 - RNA, 20 nt, Bordetella pertussis
cccgcgcugccgcugcaggc

SEQ ID NO: 2416799 - RNA, 12 nt, Bordetella pertussis
cccgcgcugcgc

SEQ ID NO: 2416800 - RNA, 14 nt, Bordetella pertussis
cccgcgcugcgccc

SEQ ID NO: 2416801 - RNA, 22 nt, Bordetella pertussis
cccgcgcuguugcuccaggccg

SEQ ID NO: 2416802 - RNA, 23 nt, Bordetella pertussis
cccgcggaucggggcaacgacgc

SEQ ID NO: 2416803 - RNA, 12 nt, Bordetella pertussis
cccgcggccacc

SEQ ID NO: 2416804 - RNA, 18 nt, Bordetella pertussis
cccgcggccagccacgcc

SEQ ID NO: 2416805 - RNA, 20 nt, Bordetella pertussis
cccgcggcccuugcgcgaag

SEQ ID NO: 2416806 - RNA, 13 nt, Bordetella pertussis
cccgcggccgcgg

SEQ ID NO: 2416807 - RNA, 11 nt, Bordetella pertussis
cccgcggcgcc

SEQ ID NO: 2416808 - RNA, 12 nt, Bordetella pertussis
cccgcggcgcca

SEQ ID NO: 2416809 - RNA, 13 nt, Bordetella pertussis
cccgcggcgccag

SEQ ID NO: 2416810 - RNA, 17 nt, Bordetella pertussis
cccgcggcgccagcgcu

SEQ ID NO: 2416811 - RNA, 17 nt, Bordetella pertussis
cccgcggcgcccagcug

SEQ ID NO: 2416812 - RNA, 13 nt, Bordetella pertussis
cccgcggcgcccc

SEQ ID NO: 2416813 - RNA, 14 nt, Bordetella pertussis
cccgcggcgccccc

SEQ ID NO: 2416814 - RNA, 20 nt, Bordetella pertussis
cccgcggcgcccccgcggcg

SEQ ID NO: 2416815 - RNA, 19 nt, Bordetella pertussis
cccgcggggacaggcaccc

SEQ ID NO: 2416816 - RNA, 21 nt, Bordetella pertussis
cccgcggggacaggcacccug

SEQ ID NO: 2416817 - RNA, 21 nt, Bordetella pertussis
cccgcggggacaggcaccgcc

SEQ ID NO: 2416818 - RNA, 18 nt, Bordetella pertussis
cccgcggggacaggcucc

SEQ ID NO: 2416819 - RNA, 16 nt, Bordetella pertussis
cccgcgucggacgcgc

SEQ ID NO: 2416820 - RNA, 19 nt, Bordetella pertussis
cccgcgucggacgcgcgcc

SEQ ID NO: 2416821 - RNA, 20 nt, Bordetella pertussis
cccgcgucggacgcgcgccg

SEQ ID NO: 2416822 - RNA, 21 nt, Bordetella pertussis
cccgcgucggcgaagcugucc

SEQ ID NO: 2416823 - RNA, 16 nt, Bordetella pertussis
cccgcgucggcgcggu

SEQ ID NO: 2416824 - RNA, 13 nt, Bordetella pertussis
cccgcgucugggc

SEQ ID NO: 2416825 - RNA, 17 nt, Bordetella pertussis
cccgcgucuuggcgggc

SEQ ID NO: 2416826 - RNA, 20 nt, Bordetella pertussis
cccgcgucuuggcgggcacc

SEQ ID NO: 2416827 - RNA, 23 nt, Bordetella pertussis
cccgcgucuuggcgggcaccaug

SEQ ID NO: 2416828 - RNA, 14 nt, Bordetella pertussis
cccgcgugacggcc

SEQ ID NO: 2416829 - RNA, 22 nt, Bordetella pertussis
cccgcgugccuguccccgcaag

SEQ ID NO: 2416830 - RNA, 15 nt, Bordetella pertussis
cccgcgugcgugccg

SEQ ID NO: 2416831 - RNA, 21 nt, Bordetella pertussis
cccgcgugcgugccgacgaug

SEQ ID NO: 2416832 - RNA, 23 nt, Bordetella pertussis
cccgcguggaagguccacggcau

SEQ ID NO: 2416833 - RNA, 18 nt, Bordetella pertussis
cccgcuaccccggcagcg

SEQ ID NO: 2416834 - RNA, 21 nt, Bordetella pertussis
cccgcuaccccggcagcguca

SEQ ID NO: 2416835 - RNA, 21 nt, Bordetella pertussis
cccgcuacgcgggcuugcugc

SEQ ID NO: 2416836 - RNA, 21 nt, Bordetella pertussis
cccgcuaugcgggcuugcugc

SEQ ID NO: 2416837 - RNA, 23 nt, Bordetella pertussis
cccgcuaugcgggcuugcugccc

SEQ ID NO: 2416838 - RNA, 13 nt, Bordetella pertussis
cccgcucaggucg

SEQ ID NO: 2416839 - RNA, 14 nt, Bordetella pertussis
cccgcuccaccagc

SEQ ID NO: 2416840 - RNA, 13 nt, Bordetella pertussis
cccgcuccaggcg

SEQ ID NO: 2416841 - RNA, 14 nt, Bordetella pertussis
cccgcucggccacg

SEQ ID NO: 2416842 - RNA, 15 nt, Bordetella pertussis
cccgcucggccacgc

SEQ ID NO: 2416843 - RNA, 17 nt, Bordetella pertussis
cccgcucggccacgcgc

SEQ ID NO: 2416844 - RNA, 16 nt, Bordetella pertussis
cccgcugaaggaccuc

SEQ ID NO: 2416845 - RNA, 22 nt, Bordetella pertussis
cccgcugaaggaccucgcgccg

SEQ ID NO: 2416846 - RNA, 15 nt, Bordetella pertussis
cccgcugaccggccu

SEQ ID NO: 2416847 - RNA, 23 nt, Bordetella pertussis
cccgcugccgaauucguuggugc

SEQ ID NO: 2416848 - RNA, 12 nt, Bordetella pertussis
cccgcugccgag

SEQ ID NO: 2416849 - RNA, 22 nt, Bordetella pertussis
cccgcugccgagacggccgccg

SEQ ID NO: 2416850 - RNA, 16 nt, Bordetella pertussis
cccgcugcguccacca

SEQ ID NO: 2416851 - RNA, 19 nt, Bordetella pertussis
cccgcugcguccaccacca

SEQ ID NO: 2416852 - RNA, 20 nt, Bordetella pertussis
cccgcuggccgucgccgccc

SEQ ID NO: 2416853 - RNA, 21 nt, Bordetella pertussis
cccgcuggccgucgccgcccu

SEQ ID NO: 2416854 - RNA, 14 nt, Bordetella pertussis
cccgcuggcggcac

SEQ ID NO: 2416855 - RNA, 22 nt, Bordetella pertussis
cccgcuggcuggcagcgaccgc

SEQ ID NO: 2416856 - RNA, 14 nt, Bordetella pertussis
cccgcugggacagg

SEQ ID NO: 2416857 - RNA, 17 nt, Bordetella pertussis
cccgcugggacaggcac

SEQ ID NO: 2416858 - RNA, 18 nt, Bordetella pertussis
cccgcugggacaggcaca

SEQ ID NO: 2416859 - RNA, 18 nt, Bordetella pertussis
cccgcugggacaggcacu

SEQ ID NO: 2416860 - RNA, 19 nt, Bordetella pertussis
cccgcugggacaggcacuc

SEQ ID NO: 2416861 - RNA, 15 nt, Bordetella pertussis
cccgcugggccagca

SEQ ID NO: 2416862 - RNA, 15 nt, Bordetella pertussis
cccgcuuccugcugc

SEQ ID NO: 2416863 - RNA, 16 nt, Bordetella pertussis
cccgcuuccugcugcg

SEQ ID NO: 2416864 - RNA, 21 nt, Bordetella pertussis
cccgcuuccugcugcgccugg

SEQ ID NO: 2416865 - RNA, 12 nt, Bordetella pertussis
cccgcuucgggc

SEQ ID NO: 2416866 - RNA, 17 nt, Bordetella pertussis
cccgcuucgggccggau

SEQ ID NO: 2416867 - RNA, 21 nt, Bordetella pertussis
cccgcuucucacugcccgcgc

SEQ ID NO: 2416868 - RNA, 22 nt, Bordetella pertussis
cccgcuucucacugcccgcgcc

SEQ ID NO: 2416869 - RNA, 15 nt, Bordetella pertussis
cccgcuugggccgcg

SEQ ID NO: 2416870 - RNA, 19 nt, Bordetella pertussis
cccggaauaccgccagcuc

SEQ ID NO: 2416871 - RNA, 20 nt, Bordetella pertussis
cccggaauaccgccagcucg

SEQ ID NO: 2416872 - RNA, 17 nt, Bordetella pertussis
cccggacaacgcgcgcc

SEQ ID NO: 2416873 - RNA, 14 nt, Bordetella pertussis
cccggaccagcagu

SEQ ID NO: 2416874 - RNA, 18 nt, Bordetella pertussis
cccggauauggccggcgc

SEQ ID NO: 2416875 - RNA, 20 nt, Bordetella pertussis
cccggauauggccggcgcgc

SEQ ID NO: 2416876 - RNA, 18 nt, Bordetella pertussis
cccgggcgugaccagcug

SEQ ID NO: 2416877 - RNA, 11 nt, Bordetella pertussis
cccgggcugcu

SEQ ID NO: 2416878 - RNA, 16 nt, Bordetella pertussis
cccgggcuggccgccu

SEQ ID NO: 2416879 - RNA, 19 nt, Bordetella pertussis
cccgggcuggccgccugcu

SEQ ID NO: 2416880 - RNA, 21 nt, Bordetella pertussis
cccgggcuggccgccugcugc

SEQ ID NO: 2416881 - RNA, 22 nt, Bordetella pertussis
cccgggcuggccgccugcugcg

SEQ ID NO: 2416882 - RNA, 21 nt, Bordetella pertussis
cccggggcaggaagccggccc

SEQ ID NO: 2416883 - RNA, 18 nt, Bordetella pertussis
cccgggguucuggcaggu

SEQ ID NO: 2416884 - RNA, 22 nt, Bordetella pertussis
cccgggguugggaucgcgccag

SEQ ID NO: 2416885 - RNA, 15 nt, Bordetella pertussis
cccggguacguggcc

SEQ ID NO: 2416886 - RNA, 15 nt, Bordetella pertussis
cccgggugaucaguc

SEQ ID NO: 2416887 - RNA, 23 nt, Bordetella pertussis
cccgggugaucaguccgacgaca

SEQ ID NO: 2416888 - RNA, 21 nt, Bordetella pertussis
cccgggugccuguccccgccg

SEQ ID NO: 2416889 - RNA, 20 nt, Bordetella pertussis
cccggguuggcguccaggcg

SEQ ID NO: 2416890 - RNA, 14 nt, Bordetella pertussis
cccgguaggccugg

SEQ ID NO: 2416891 - RNA, 15 nt, Bordetella pertussis
cccgguagucgccgg

SEQ ID NO: 2416892 - RNA, 23 nt, Bordetella pertussis
cccgguauuccucgacgauggcg

SEQ ID NO: 2416893 - RNA, 18 nt, Bordetella pertussis
cccggucagcagggcgcc

SEQ ID NO: 2416894 - RNA, 19 nt, Bordetella pertussis
cccggucagcagggcgccg

SEQ ID NO: 2416895 - RNA, 14 nt, Bordetella pertussis
cccgguccaggccg

SEQ ID NO: 2416896 - RNA, 15 nt, Bordetella pertussis
cccgguccaggccga

SEQ ID NO: 2416897 - RNA, 12 nt, Bordetella pertussis
cccggucggccc

SEQ ID NO: 2416898 - RNA, 14 nt, Bordetella pertussis
acccgcacgccggc

SEQ ID NO: 2416899 - RNA, 15 nt, Bordetella pertussis
acccgcacgccggcc

SEQ ID NO: 2416900 - RNA, 21 nt, Bordetella pertussis
acccgcacgccggccugcgcc

SEQ ID NO: 2416901 - RNA, 20 nt, Bordetella pertussis
acccgcaggccguuggccgc

SEQ ID NO: 2416902 - RNA, 14 nt, Bordetella pertussis
acccgcaggcggcu

SEQ ID NO: 2416903 - RNA, 16 nt, Bordetella pertussis
acccgcaugguggcgc

SEQ ID NO: 2416904 - RNA, 20 nt, Bordetella pertussis
acccgcauugaucgaucagc

SEQ ID NO: 2416905 - RNA, 13 nt, Bordetella pertussis
acccgcccacgcg

SEQ ID NO: 2416906 - RNA, 19 nt, Bordetella pertussis
acccgccgcaccagccuga

SEQ ID NO: 2416907 - RNA, 16 nt, Bordetella pertussis
acccgccggccaucac

SEQ ID NO: 2416908 - RNA, 19 nt, Bordetella pertussis
acccgccggccaucacgcc

SEQ ID NO: 2416909 - RNA, 21 nt, Bordetella pertussis
acccgcgcccagcuguccaag

SEQ ID NO: 2416910 - RNA, 12 nt, Bordetella pertussis
acccgcgccggc

SEQ ID NO: 2416911 - RNA, 17 nt, Bordetella pertussis
acccgcgccggcggcaa

SEQ ID NO: 2416912 - RNA, 23 nt, Bordetella pertussis
acccgcggccagggugccccgcc

SEQ ID NO: 2416913 - RNA, 20 nt, Bordetella pertussis
acccgcggcccuugcgcgaa

SEQ ID NO: 2416914 - RNA, 20 nt, Bordetella pertussis
acccgcggcgcaugcagccg

SEQ ID NO: 2416915 - RNA, 19 nt, Bordetella pertussis
acccgcuaccccggcagcg

SEQ ID NO: 2416916 - RNA, 23 nt, Bordetella pertussis
acccgcuaccccggcagcgucaa

SEQ ID NO: 2416917 - RNA, 13 nt, Bordetella pertussis
acccgcucggcca

SEQ ID NO: 2416918 - RNA, 17 nt, Bordetella pertussis
acccggacaacgcgcgc

SEQ ID NO: 2416919 - RNA, 21 nt, Bordetella pertussis
acccggacaacgcgcgccacu

SEQ ID NO: 2416920 - RNA, 21 nt, Bordetella pertussis
acccggagcugccgaaucggc

SEQ ID NO: 2416921 - RNA, 23 nt, Bordetella pertussis
acccggaugccgaacugucgcgc

SEQ ID NO: 2416922 - RNA, 16 nt, Bordetella pertussis
acccggcacgcgccga

SEQ ID NO: 2416923 - RNA, 20 nt, Bordetella pertussis
acccggcccaugaccggcgu

SEQ ID NO: 2416924 - RNA, 14 nt, Bordetella pertussis
acccggccggcgcc

SEQ ID NO: 2416925 - RNA, 15 nt, Bordetella pertussis
acccggccggcgccg

SEQ ID NO: 2416926 - RNA, 16 nt, Bordetella pertussis
acccggccggcgccgg

SEQ ID NO: 2416927 - RNA, 19 nt, Bordetella pertussis
acccggccucgcugcgggc

SEQ ID NO: 2416928 - RNA, 18 nt, Bordetella pertussis
acccggcgaagccggcac

SEQ ID NO: 2416929 - RNA, 19 nt, Bordetella pertussis
acccggcgaagccggcacg

SEQ ID NO: 2416930 - RNA, 15 nt, Bordetella pertussis
acccggcgaggccgc

SEQ ID NO: 2416931 - RNA, 16 nt, Bordetella pertussis
acccggcgcaugcugg

SEQ ID NO: 2416932 - RNA, 18 nt, Bordetella pertussis
acccggcgcaugcuggag

SEQ ID NO: 2416933 - RNA, 21 nt, Bordetella pertussis
acccggcucagccucgaggug

SEQ ID NO: 2416934 - RNA, 22 nt, Bordetella pertussis
acccggguacguggccccaggc

SEQ ID NO: 2416935 - RNA, 21 nt, Bordetella pertussis
acccggucgaucagggcgcgg

SEQ ID NO: 2416936 - RNA, 15 nt, Bordetella pertussis
acccggucggcccag

SEQ ID NO: 2416937 - RNA, 16 nt, Bordetella pertussis
acccggucggcccagg

SEQ ID NO: 2416938 - RNA, 19 nt, Bordetella pertussis
acccggugcagcguggcgc

SEQ ID NO: 2416939 - RNA, 19 nt, Bordetella pertussis
acccguccuuggcguccgg

SEQ ID NO: 2416940 - RNA, 15 nt, Bordetella pertussis
acccucagcccgcac

SEQ ID NO: 2416941 - RNA, 19 nt, Bordetella pertussis
acccucgcacggccgucaa

SEQ ID NO: 2416942 - RNA, 21 nt, Bordetella pertussis
acccucgugaucgaccgccag

SEQ ID NO: 2416943 - RNA, 15 nt, Bordetella pertussis
acccugccccauccc

SEQ ID NO: 2416944 - RNA, 12 nt, Bordetella pertussis
acccugcccggc

SEQ ID NO: 2416945 - RNA, 15 nt, Bordetella pertussis
acccugcccggcagg

SEQ ID NO: 2416946 - RNA, 20 nt, Bordetella pertussis
acccugccgugcagauggcg

SEQ ID NO: 2416947 - RNA, 17 nt, Bordetella pertussis
acccugccgugggacag

SEQ ID NO: 2416948 - RNA, 22 nt, Bordetella pertussis
acccugccgugggacaggcacu

SEQ ID NO: 2416949 - RNA, 20 nt, Bordetella pertussis
acccugccucagaccacgac

SEQ ID NO: 2416950 - RNA, 16 nt, Bordetella pertussis
acccugcgcacccgcc

SEQ ID NO: 2416951 - RNA, 21 nt, Bordetella pertussis
acccugcgcacccgccuggac

SEQ ID NO: 2416952 - RNA, 15 nt, Bordetella pertussis
acccugcgcgccgcc

SEQ ID NO: 2416953 - RNA, 18 nt, Bordetella pertussis
acccuggccgaacgccgc

SEQ ID NO: 2416954 - RNA, 21 nt, Bordetella pertussis
acccuggccgaacgccgccgc

SEQ ID NO: 2416955 - RNA, 14 nt, Bordetella pertussis
acccuguacaagcg

SEQ ID NO: 2416956 - RNA, 21 nt, Bordetella pertussis
acccuguacaagcgcacgcug

SEQ ID NO: 2416957 - RNA, 22 nt, Bordetella pertussis
acccuugcucagucgggcagcg

SEQ ID NO: 2416958 - RNA, 20 nt, Bordetella pertussis
acccuuuuuacaugcagccg

SEQ ID NO: 2416959 - RNA, 15 nt, Bordetella pertussis
accgaacggccgguc

SEQ ID NO: 2416960 - RNA, 12 nt, Bordetella pertussis
accgaacgggcg

SEQ ID NO: 2416961 - RNA, 15 nt, Bordetella pertussis
accgaagcggcguuc

SEQ ID NO: 2416962 - RNA, 23 nt, Bordetella pertussis
accgaaucgaacuuggcgcgguc

SEQ ID NO: 2416963 - RNA, 15 nt, Bordetella pertussis
accgacaagccgguc

SEQ ID NO: 2416964 - RNA, 13 nt, Bordetella pertussis
accgacacgcugg

SEQ ID NO: 2416965 - RNA, 13 nt, Bordetella pertussis
accgacagcaagg

SEQ ID NO: 2416966 - RNA, 14 nt, Bordetella pertussis
accgacagcacaug

SEQ ID NO: 2416967 - RNA, 12 nt, Bordetella pertussis
accgacagcgcc

SEQ ID NO: 2416968 - RNA, 14 nt, Bordetella pertussis
accgacaggccugg

SEQ ID NO: 2416969 - RNA, 14 nt, Bordetella pertussis
accgacaugaccgc

SEQ ID NO: 2416970 - RNA, 16 nt, Bordetella pertussis
accgacaugaccgcgu

SEQ ID NO: 2416971 - RNA, 17 nt, Bordetella pertussis
accgaccagcgcgcgcc

SEQ ID NO: 2416972 - RNA, 21 nt, Bordetella pertussis
accgaccugaucgcgcagcgc

SEQ ID NO: 2416973 - RNA, 23 nt, Bordetella pertussis
accgacgcagcgcaccgacggca

SEQ ID NO: 2416974 - RNA, 20 nt, Bordetella pertussis
accgacgcggccagcggcgc

SEQ ID NO: 2416975 - RNA, 16 nt, Bordetella pertussis
accgacggcagccccg

SEQ ID NO: 2416976 - RNA, 13 nt, Bordetella pertussis
accgacggcgcgg

SEQ ID NO: 2416977 - RNA, 16 nt, Bordetella pertussis
accgacgugcgccgca

SEQ ID NO: 2416978 - RNA, 17 nt, Bordetella pertussis
accgacgugcugcugca

SEQ ID NO: 2416979 - RNA, 18 nt, Bordetella pertussis
accgagacgcugucgcgc

SEQ ID NO: 2416980 - RNA, 15 nt, Bordetella pertussis
accgagcacagcaac

SEQ ID NO: 2416981 - RNA, 14 nt, Bordetella pertussis
accgagcccggcac

SEQ ID NO: 2416982 - RNA, 15 nt, Bordetella pertussis
accgagccggccagc

SEQ ID NO: 2416983 - RNA, 19 nt, Bordetella pertussis
accgagccggccagcgccu

SEQ ID NO: 2416984 - RNA, 16 nt, Bordetella pertussis
accgagcgcgcccgcu

SEQ ID NO: 2416985 - RNA, 13 nt, Bordetella pertussis
accgagcugagca

SEQ ID NO: 2416986 - RNA, 15 nt, Bordetella pertussis
accgagcugagcacc

SEQ ID NO: 2416987 - RNA, 18 nt, Bordetella pertussis
accgagcugagcaccagc

SEQ ID NO: 2416988 - RNA, 21 nt, Bordetella pertussis
accgagcugagcaccagcagc

SEQ ID NO: 2416989 - RNA, 15 nt, Bordetella pertussis
cccucgucgcggccg

SEQ ID NO: 2416990 - RNA, 18 nt, Bordetella pertussis
cccucgugaucgaccgcc

SEQ ID NO: 2416991 - RNA, 21 nt, Bordetella pertussis
cccucgugaucgaccgccagc

SEQ ID NO: 2416992 - RNA, 21 nt, Bordetella pertussis
cccucuucggcggccagccgg

SEQ ID NO: 2416993 - RNA, 14 nt, Bordetella pertussis
cccucuucggcgua

SEQ ID NO: 2416994 - RNA, 18 nt, Bordetella pertussis
cccugaacuauggcgcgc

SEQ ID NO: 2416995 - RNA, 14 nt, Bordetella pertussis
cccugacccgcugg

SEQ ID NO: 2416996 - RNA, 20 nt, Bordetella pertussis
cccugaccggcggcgucugg

SEQ ID NO: 2416997 - RNA, 15 nt, Bordetella pertussis
cccugacgccugcgc

SEQ ID NO: 2416998 - RNA, 18 nt, Bordetella pertussis
cccugaucccggcgcugg

SEQ ID NO: 2416999 - RNA, 14 nt, Bordetella pertussis
cccugcagcggcca

SEQ ID NO: 2417000 - RNA, 12 nt, Bordetella pertussis
cccugcaugacc

SEQ ID NO: 2417001 - RNA, 17 nt, Bordetella pertussis
cccugcaugaccgccgc

SEQ ID NO: 2417002 - RNA, 19 nt, Bordetella pertussis
cccugcaugaccgccgcca

SEQ ID NO: 2417003 - RNA, 22 nt, Bordetella pertussis
cccugcaugaccgccgccagca

SEQ ID NO: 2417004 - RNA, 23 nt, Bordetella pertussis
cccugccaauagcgguggcgggc

SEQ ID NO: 2417005 - RNA, 21 nt, Bordetella pertussis
cccugccaugccccauccagc

SEQ ID NO: 2417006 - RNA, 17 nt, Bordetella pertussis
cccugcccauucccgcc

SEQ ID NO: 2417007 - RNA, 19 nt, Bordetella pertussis
cccugcccauucccgcccu

SEQ ID NO: 2417008 - RNA, 18 nt, Bordetella pertussis
cccugccccaucccaucc

SEQ ID NO: 2417009 - RNA, 15 nt, Bordetella pertussis
cccugcccgcaccau

SEQ ID NO: 2417010 - RNA, 12 nt, Bordetella pertussis
cccugcccggca

SEQ ID NO: 2417011 - RNA, 21 nt, Bordetella pertussis
cccugcccgucuauggccugc

SEQ ID NO: 2417012 - RNA, 14 nt, Bordetella pertussis
cccugcccugcggc

SEQ ID NO: 2417013 - RNA, 15 nt, Bordetella pertussis
cccugcccugcggcu

SEQ ID NO: 2417014 - RNA, 22 nt, Bordetella pertussis
cccugccgccaagggcgcgcca

SEQ ID NO: 2417015 - RNA, 23 nt, Bordetella pertussis
cccugccgccaagggcgcgccag

SEQ ID NO: 2417016 - RNA, 17 nt, Bordetella pertussis
cccugccgcccuggcgc

SEQ ID NO: 2417017 - RNA, 18 nt, Bordetella pertussis
cccugccgcccuggcgca

SEQ ID NO: 2417018 - RNA, 13 nt, Bordetella pertussis
cccugccgccuca

SEQ ID NO: 2417019 - RNA, 15 nt, Bordetella pertussis
cccugccgccucagc

SEQ ID NO: 2417020 - RNA, 19 nt, Bordetella pertussis
cccugccgugggacaggca

SEQ ID NO: 2417021 - RNA, 15 nt, Bordetella pertussis
cccugccucagacca

SEQ ID NO: 2417022 - RNA, 17 nt, Bordetella pertussis
cccugccuccaggcgca

SEQ ID NO: 2417023 - RNA, 19 nt, Bordetella pertussis
cccugcgaacccgccgcga

SEQ ID NO: 2417024 - RNA, 13 nt, Bordetella pertussis
cccugcgcacccg

SEQ ID NO: 2417025 - RNA, 19 nt, Bordetella pertussis
cccugcgcacccgccugga

SEQ ID NO: 2417026 - RNA, 14 nt, Bordetella pertussis
cccugcgccagcgc

SEQ ID NO: 2417027 - RNA, 19 nt, Bordetella pertussis
cccugcgccagcgccucgc

SEQ ID NO: 2417028 - RNA, 18 nt, Bordetella pertussis
cccugcgcgaggugccgg

SEQ ID NO: 2417029 - RNA, 14 nt, Bordetella pertussis
cccugcgcgccgcc

SEQ ID NO: 2417030 - RNA, 15 nt, Bordetella pertussis
cccugcgcgccgccg

SEQ ID NO: 2417031 - RNA, 19 nt, Bordetella pertussis
cccugcgcgccgccggugc

SEQ ID NO: 2417032 - RNA, 18 nt, Bordetella pertussis
cccugcgcguacguggcg

SEQ ID NO: 2417033 - RNA, 23 nt, Bordetella pertussis
cccugcgcguacguggcgcggcu

SEQ ID NO: 2417034 - RNA, 19 nt, Bordetella pertussis
cccugcgcguugagcagca

SEQ ID NO: 2417035 - RNA, 18 nt, Bordetella pertussis
cccugcgcugcauacgcc

SEQ ID NO: 2417036 - RNA, 22 nt, Bordetella pertussis
cccugcgcugcauacgccgcug

SEQ ID NO: 2417037 - RNA, 14 nt, Bordetella pertussis
cccugcggacccag

SEQ ID NO: 2417038 - RNA, 18 nt, Bordetella pertussis
cccugcggcgcggccagc

SEQ ID NO: 2417039 - RNA, 19 nt, Bordetella pertussis
cccugcggcgcggccagca

SEQ ID NO: 2417040 - RNA, 21 nt, Bordetella pertussis
cccugcggcgcggccagcacg

SEQ ID NO: 2417041 - RNA, 14 nt, Bordetella pertussis
cccugcgggccgcu

SEQ ID NO: 2417042 - RNA, 15 nt, Bordetella pertussis
cccugcggggacagg

SEQ ID NO: 2417043 - RNA, 20 nt, Bordetella pertussis
cccugcggggacaggcaccc

SEQ ID NO: 2417044 - RNA, 13 nt, Bordetella pertussis
cccugcgggggca

SEQ ID NO: 2417045 - RNA, 15 nt, Bordetella pertussis
cccugcgggggcagg

SEQ ID NO: 2417046 - RNA, 18 nt, Bordetella pertussis
cccugcgggggcaggcac

SEQ ID NO: 2417047 - RNA, 15 nt, Bordetella pertussis
cccugcgugugccug

SEQ ID NO: 2417048 - RNA, 20 nt, Bordetella pertussis
cccugcucccacgaacgcca

SEQ ID NO: 2417049 - RNA, 14 nt, Bordetella pertussis
cccugcucgcgcag

SEQ ID NO: 2417050 - RNA, 19 nt, Bordetella pertussis
cccugcugcccgccgccgc

SEQ ID NO: 2417051 - RNA, 13 nt, Bordetella pertussis
cccugcuggcgca

SEQ ID NO: 2417052 - RNA, 23 nt, Bordetella pertussis
cccugcuugagcgaaauggcggc

SEQ ID NO: 2417053 - RNA, 18 nt, Bordetella pertussis
cccugcuugcgcggaccu

SEQ ID NO: 2417054 - RNA, 23 nt, Bordetella pertussis
cccuggacgucugagcgccgggg

SEQ ID NO: 2417055 - RNA, 19 nt, Bordetella pertussis
cccuggagaucgccgccga

SEQ ID NO: 2417056 - RNA, 22 nt, Bordetella pertussis
cccuggagaucgccgccgaagc

SEQ ID NO: 2417057 - RNA, 22 nt, Bordetella pertussis
cccuggaucaggaugggcgcgg

SEQ ID NO: 2417058 - RNA, 20 nt, Bordetella pertussis
cccuggaugccaugccgggc

SEQ ID NO: 2417059 - RNA, 16 nt, Bordetella pertussis
cccuggauggcggccg

SEQ ID NO: 2417060 - RNA, 21 nt, Bordetella pertussis
cccuggcagcuggcgcgggcg

SEQ ID NO: 2417061 - RNA, 15 nt, Bordetella pertussis
cccuggccgaacgcc

SEQ ID NO: 2417062 - RNA, 17 nt, Bordetella pertussis
cccuggccgaacgccgc

SEQ ID NO: 2417063 - RNA, 19 nt, Bordetella pertussis
cccuggccgaacgccgccg

SEQ ID NO: 2417064 - RNA, 12 nt, Bordetella pertussis
cccuggccgcgc

SEQ ID NO: 2417065 - RNA, 18 nt, Bordetella pertussis
cccuggccguacauggcc

SEQ ID NO: 2417066 - RNA, 20 nt, Bordetella pertussis
cccuggccuucgaccugccc

SEQ ID NO: 2417067 - RNA, 19 nt, Bordetella pertussis
cccuggcgcaggccggcgg

SEQ ID NO: 2417068 - RNA, 16 nt, Bordetella pertussis
cccuggcgcgaggcgg

SEQ ID NO: 2417069 - RNA, 21 nt, Bordetella pertussis
cccuggcgcgaggcggcgacg

SEQ ID NO: 2417070 - RNA, 22 nt, Bordetella pertussis
cccuggcgcgaggcggcgacgc

SEQ ID NO: 2417071 - RNA, 14 nt, Bordetella pertussis
cccuggcgcgccag

SEQ ID NO: 2417072 - RNA, 16 nt, Bordetella pertussis
cccuggcgcugcagcg

SEQ ID NO: 2417073 - RNA, 13 nt, Bordetella pertussis
cccuggcgggccg

SEQ ID NO: 2417074 - RNA, 16 nt, Bordetella pertussis
cccuggcguggcgcgc

SEQ ID NO: 2417075 - RNA, 18 nt, Bordetella pertussis
cccuggcuggccagccgg

SEQ ID NO: 2417076 - RNA, 16 nt, Bordetella pertussis
cccuggcuggcggccc

SEQ ID NO: 2417077 - RNA, 15 nt, Bordetella pertussis
cccuggcuuggccga

SEQ ID NO: 2417078 - RNA, 13 nt, Bordetella pertussis
cccugggccagca

SEQ ID NO: 2417079 - RNA, 14 nt, Bordetella pertussis
cccugggccagcag

SEQ ID NO: 2417080 - RNA, 15 nt, Bordetella pertussis
cccugggccagcagc

SEQ ID NO: 2417081 - RNA, 13 nt, Bordetella pertussis
cccugggccagcc

SEQ ID NO: 2417082 - RNA, 18 nt, Bordetella pertussis
cccugggccagccagcgc

SEQ ID NO: 2417083 - RNA, 22 nt, Bordetella pertussis
cccugggccagccagcgccgca

SEQ ID NO: 2417084 - RNA, 23 nt, Bordetella pertussis
cccugggccagccagcgccgcag

SEQ ID NO: 2417085 - RNA, 22 nt, Bordetella pertussis
cccugggcgagguagggcgcgg

SEQ ID NO: 2417086 - RNA, 12 nt, Bordetella pertussis
cccuggggccgc

SEQ ID NO: 2417087 - RNA, 13 nt, Bordetella pertussis
cccuggggccgcg

SEQ ID NO: 2417088 - RNA, 18 nt, Bordetella pertussis
cccuggggccgcggcgcg

SEQ ID NO: 2417089 - RNA, 12 nt, Bordetella pertussis
cccugggugagc

SEQ ID NO: 2417090 - RNA, 15 nt, Bordetella pertussis
cccuggguggcgggg

SEQ ID NO: 2417091 - RNA, 16 nt, Bordetella pertussis
cccuggucaucgccau

SEQ ID NO: 2417092 - RNA, 13 nt, Bordetella pertussis
cccugguccagca

SEQ ID NO: 2417093 - RNA, 18 nt, Bordetella pertussis
cccuguacaagcgcacgc

SEQ ID NO: 2417094 - RNA, 21 nt, Bordetella pertussis
cccuguacaagcgcacgcugg

SEQ ID NO: 2417095 - RNA, 14 nt, Bordetella pertussis
cccugucggccgaa

SEQ ID NO: 2417096 - RNA, 19 nt, Bordetella pertussis
cccugugggggacaggcac

SEQ ID NO: 2417097 - RNA, 22 nt, Bordetella pertussis
cccugugggggacaggcacgcc

SEQ ID NO: 2417098 - RNA, 22 nt, Bordetella pertussis
cccuguguccacgaacgcgauu

SEQ ID NO: 2417099 - RNA, 13 nt, Bordetella pertussis
cccuucgacgcgg

SEQ ID NO: 2417100 - RNA, 20 nt, Bordetella pertussis
cccuucgcgcagcaacccgc

SEQ ID NO: 2417101 - RNA, 18 nt, Bordetella pertussis
cccuucggggcagcgaau

SEQ ID NO: 2417102 - RNA, 15 nt, Bordetella pertussis
ccgaccgagccgaag

SEQ ID NO: 2417103 - RNA, 20 nt, Bordetella pertussis
ccgaccgcaugggcgccgag

SEQ ID NO: 2417104 - RNA, 14 nt, Bordetella pertussis
ccgaccgccacgaa

SEQ ID NO: 2417105 - RNA, 12 nt, Bordetella pertussis
ccgaccgcgcgc

SEQ ID NO: 2417106 - RNA, 19 nt, Bordetella pertussis
ccgaccggaccguuccaga

SEQ ID NO: 2417107 - RNA, 18 nt, Bordetella pertussis
ccgaccggccccaccugg

SEQ ID NO: 2417108 - RNA, 20 nt, Bordetella pertussis
ccgaccggccccaccuggcg

SEQ ID NO: 2417109 - RNA, 24 nt, Bordetella pertussis
ccgaccggccccaccuggcggugc

SEQ ID NO: 2417110 - RNA, 15 nt, Bordetella pertussis
ccgaccggcgcgcgc

SEQ ID NO: 2417111 - RNA, 14 nt, Bordetella pertussis
ccgaccgggccgac

SEQ ID NO: 2417112 - RNA, 18 nt, Bordetella pertussis
ccgaccgggccgaccagg

SEQ ID NO: 2417113 - RNA, 20 nt, Bordetella pertussis
ccgaccgggccgaccaggcc

SEQ ID NO: 2417114 - RNA, 16 nt, Bordetella pertussis
ccgaccugaucgcgca

SEQ ID NO: 2417115 - RNA, 18 nt, Bordetella pertussis
ccgaccugaucgcgcagc

SEQ ID NO: 2417116 - RNA, 17 nt, Bordetella pertussis
ccgaccugcuggcgcgc

SEQ ID NO: 2417117 - RNA, 20 nt, Bordetella pertussis
ccgaccugcuggcgcgcacc

SEQ ID NO: 2417118 - RNA, 17 nt, Bordetella pertussis
ccgaccuggcgcccgac

SEQ ID NO: 2417119 - RNA, 17 nt, Bordetella pertussis
ccgacgaaaugccggcg

SEQ ID NO: 2417120 - RNA, 20 nt, Bordetella pertussis
ccgacgagaaugcgccgucc

SEQ ID NO: 2417121 - RNA, 19 nt, Bordetella pertussis
ccgacgaggagccggcggg

SEQ ID NO: 2417122 - RNA, 23 nt, Bordetella pertussis
ccgacgaggagccggcgggcggc

SEQ ID NO: 2417123 - RNA, 12 nt, Bordetella pertussis
ccgacgauccgc

SEQ ID NO: 2417124 - RNA, 22 nt, Bordetella pertussis
ccgacgaugaccaucacgagca

SEQ ID NO: 2417125 - RNA, 19 nt, Bordetella pertussis
ccgacgaugaucaugauga

SEQ ID NO: 2417126 - RNA, 14 nt, Bordetella pertussis
ccgacgaugccgcc

SEQ ID NO: 2417127 - RNA, 17 nt, Bordetella pertussis
ccgacgaugccgccgcc

SEQ ID NO: 2417128 - RNA, 16 nt, Bordetella pertussis
ccgacgaugccggucu

SEQ ID NO: 2417129 - RNA, 14 nt, Bordetella pertussis
ccgacgaugucgcc

SEQ ID NO: 2417130 - RNA, 16 nt, Bordetella pertussis
ccgacgaugucgccgc

SEQ ID NO: 2417131 - RNA, 21 nt, Bordetella pertussis
ccgacgaugucgccgccgcgc

SEQ ID NO: 2417132 - RNA, 18 nt, Bordetella pertussis
accgccagcucggccugc

SEQ ID NO: 2417133 - RNA, 23 nt, Bordetella pertussis
accgccaggaagaucggcccggc

SEQ ID NO: 2417134 - RNA, 13 nt, Bordetella pertussis
accgccaugcgca

SEQ ID NO: 2417135 - RNA, 16 nt, Bordetella pertussis
accgccaugugcgccg

SEQ ID NO: 2417136 - RNA, 24 nt, Bordetella pertussis
accgcccaggcgcagcccacucag

SEQ ID NO: 2417137 - RNA, 19 nt, Bordetella pertussis
accgcccccgccgccaugc

SEQ ID NO: 2417138 - RNA, 22 nt, Bordetella pertussis
accgcccccgccgccaugccau

SEQ ID NO: 2417139 - RNA, 21 nt, Bordetella pertussis
accgcccgcugcuaugcgugg

SEQ ID NO: 2417140 - RNA, 19 nt, Bordetella pertussis
accgccgauaccacgcgcg

SEQ ID NO: 2417141 - RNA, 21 nt, Bordetella pertussis
accgccgauaccacgcgcggc

SEQ ID NO: 2417142 - RNA, 20 nt, Bordetella pertussis
accgccgaugccgccaucau

SEQ ID NO: 2417143 - RNA, 15 nt, Bordetella pertussis
accgccgccagcagc

SEQ ID NO: 2417144 - RNA, 20 nt, Bordetella pertussis
accgccgcccgccaggccag

SEQ ID NO: 2417145 - RNA, 21 nt, Bordetella pertussis
accgccgccgccaccagcggc

SEQ ID NO: 2417146 - RNA, 14 nt, Bordetella pertussis
accgccgccggccc

SEQ ID NO: 2417147 - RNA, 14 nt, Bordetella pertussis
accgccgccugcgc

SEQ ID NO: 2417148 - RNA, 14 nt, Bordetella pertussis
accgccgcgccgcu

SEQ ID NO: 2417149 - RNA, 20 nt, Bordetella pertussis
accgccgcggcgaugccggc

SEQ ID NO: 2417150 - RNA, 23 nt, Bordetella pertussis
accgccgcggcgaugccggccag

SEQ ID NO: 2417151 - RNA, 17 nt, Bordetella pertussis
accgccgcggcuugccg

SEQ ID NO: 2417152 - RNA, 18 nt, Bordetella pertussis
accgccgcguccucggcc

SEQ ID NO: 2417153 - RNA, 20 nt, Bordetella pertussis
accgccgcguccucggccug

SEQ ID NO: 2417154 - RNA, 21 nt, Bordetella pertussis
accgccgcguccucggccugg

SEQ ID NO: 2417155 - RNA, 22 nt, Bordetella pertussis
accgccgcguccucggccuggc

SEQ ID NO: 2417156 - RNA, 23 nt, Bordetella pertussis
accgccgcguccucggccuggcc

SEQ ID NO: 2417157 - RNA, 17 nt, Bordetella pertussis
accgccggcaccagcgc

SEQ ID NO: 2417158 - RNA, 19 nt, Bordetella pertussis
accgccggcggcgugcccu

SEQ ID NO: 2417159 - RNA, 15 nt, Bordetella pertussis
accgccgggacaggc

SEQ ID NO: 2417160 - RNA, 18 nt, Bordetella pertussis
accgccgggacaggcacc

SEQ ID NO: 2417161 - RNA, 19 nt, Bordetella pertussis
accgccgguucggucgacg

SEQ ID NO: 2417162 - RNA, 14 nt, Bordetella pertussis
accgccuccagcgc

SEQ ID NO: 2417163 - RNA, 16 nt, Bordetella pertussis
accgccuccagcgcgg

SEQ ID NO: 2417164 - RNA, 17 nt, Bordetella pertussis
accgccuccagcgcggc

SEQ ID NO: 2417165 - RNA, 22 nt, Bordetella pertussis
accgccucgacgcccgggcggc

SEQ ID NO: 2417166 - RNA, 20 nt, Bordetella pertussis
accgccucgaucgccagguc

SEQ ID NO: 2417167 - RNA, 23 nt, Bordetella pertussis
accgccucgaugcccucgcgcac

SEQ ID NO: 2417168 - RNA, 13 nt, Bordetella pertussis
accgccugcugca

SEQ ID NO: 2417169 - RNA, 14 nt, Bordetella pertussis
accgccugcugcgc

SEQ ID NO: 2417170 - RNA, 16 nt, Bordetella pertussis
accgccugcugcgccu

SEQ ID NO: 2417171 - RNA, 21 nt, Bordetella pertussis
accgccugcugcgccuggccg

SEQ ID NO: 2417172 - RNA, 18 nt, Bordetella pertussis
accgccuugccuugcgcg

SEQ ID NO: 2417173 - RNA, 22 nt, Bordetella pertussis
accgccuugccuugcgcggcca

SEQ ID NO: 2417174 - RNA, 17 nt, Bordetella pertussis
accgcgaaccaggccug

SEQ ID NO: 2417175 - RNA, 19 nt, Bordetella pertussis
accgcgaaccaggccugcg

SEQ ID NO: 2417176 - RNA, 20 nt, Bordetella pertussis
accgcgaaccaggccugcgg

SEQ ID NO: 2417177 - RNA, 23 nt, Bordetella pertussis
accgcgaacuuggccaugccaac

SEQ ID NO: 2417178 - RNA, 14 nt, Bordetella pertussis
accgcgaagccgcc

SEQ ID NO: 2417179 - RNA, 15 nt, Bordetella pertussis
accgcgaagccgccc

SEQ ID NO: 2417180 - RNA, 15 nt, Bordetella pertussis
accgcgaagcgcgcc

SEQ ID NO: 2417181 - RNA, 20 nt, Bordetella pertussis
accgcgacccgauagccgcg

SEQ ID NO: 2417182 - RNA, 21 nt, Bordetella pertussis
accgcgacccgauagccgcgc

SEQ ID NO: 2417183 - RNA, 14 nt, Bordetella pertussis
accgcgaugcugcg

SEQ ID NO: 2417184 - RNA, 23 nt, Bordetella pertussis
accgcgcagcccggcgugcccag

SEQ ID NO: 2417185 - RNA, 15 nt, Bordetella pertussis
accgcgccagcgccg

SEQ ID NO: 2417186 - RNA, 17 nt, Bordetella pertussis
accgcgccagcgccggc

SEQ ID NO: 2417187 - RNA, 21 nt, Bordetella pertussis
accgcgcccagggugguggcc

SEQ ID NO: 2417188 - RNA, 19 nt, Bordetella pertussis
accgcgccgaguuuccgca

SEQ ID NO: 2417189 - RNA, 18 nt, Bordetella pertussis
accgcgccugggggcugg

SEQ ID NO: 2417190 - RNA, 19 nt, Bordetella pertussis
accgcgcgcacgaccacca

SEQ ID NO: 2417191 - RNA, 20 nt, Bordetella pertussis
accgcgcgcacgaccaccag

SEQ ID NO: 2417192 - RNA, 14 nt, Bordetella pertussis
accgcgcggcgcug

SEQ ID NO: 2417193 - RNA, 17 nt, Bordetella pertussis
accgcgcggcgcugcac

SEQ ID NO: 2417194 - RNA, 18 nt, Bordetella pertussis
accgcgcguaucggcgcg

SEQ ID NO: 2417195 - RNA, 21 nt, Bordetella pertussis
accgcgcguaucggcgcgagc

SEQ ID NO: 2417196 - RNA, 22 nt, Bordetella pertussis
accgcggacgccauggcggcgg

SEQ ID NO: 2417197 - RNA, 20 nt, Bordetella pertussis
accgcggccgcgcuggcgcu

SEQ ID NO: 2417198 - RNA, 23 nt, Bordetella pertussis
accgcggccgcgcuggcgcuggc

SEQ ID NO: 2417199 - RNA, 15 nt, Bordetella pertussis
accgcggcgacagcg

SEQ ID NO: 2417200 - RNA, 23 nt, Bordetella pertussis
accgcggcgaucucgucgaccgc

SEQ ID NO: 2417201 - RNA, 11 nt, Bordetella pertussis
accgcggcgca

SEQ ID NO: 2417202 - RNA, 18 nt, Bordetella pertussis
accgcggcgguccugcug

SEQ ID NO: 2417203 - RNA, 13 nt, Bordetella pertussis
accgcgggcgcgc

SEQ ID NO: 2417204 - RNA, 18 nt, Bordetella pertussis
accgcgggcgcgcgcccc

SEQ ID NO: 2417205 - RNA, 19 nt, Bordetella pertussis
accgcgggcgcgcgccccg

SEQ ID NO: 2417206 - RNA, 20 nt, Bordetella pertussis
accgcgggcgcgcgccccgc

SEQ ID NO: 2417207 - RNA, 16 nt, Bordetella pertussis
accgcggugccgcgcg

SEQ ID NO: 2417208 - RNA, 16 nt, Bordetella pertussis
accgcgucggccugcc

SEQ ID NO: 2417209 - RNA, 21 nt, Bordetella pertussis
accgcgucggccugccagccu

SEQ ID NO: 2417210 - RNA, 16 nt, Bordetella pertussis
accgcguggcgcugcg

SEQ ID NO: 2417211 - RNA, 22 nt, Bordetella pertussis
accgcguugaccggcuggcgca

SEQ ID NO: 2417212 - RNA, 13 nt, Bordetella pertussis
accgcugaucagg

SEQ ID NO: 2417213 - RNA, 21 nt, Bordetella pertussis
accgcugaucagguccaugaa

SEQ ID NO: 2417214 - RNA, 19 nt, Bordetella pertussis
ccgaggaucuggccggcgc

SEQ ID NO: 2417215 - RNA, 20 nt, Bordetella pertussis
ccgaggaucuggccggcgcu

SEQ ID NO: 2417216 - RNA, 16 nt, Bordetella pertussis
ccgaggcacaaggccg

SEQ ID NO: 2417217 - RNA, 18 nt, Bordetella pertussis
ccgaggcacaaggccgag

SEQ ID NO: 2417218 - RNA, 15 nt, Bordetella pertussis
ccgaggccaccuugg

SEQ ID NO: 2417219 - RNA, 17 nt, Bordetella pertussis
ccgaggccaccuuggcc

SEQ ID NO: 2417220 - RNA, 20 nt, Bordetella pertussis
ccgaggccagcgugcccagc

SEQ ID NO: 2417221 - RNA, 12 nt, Bordetella pertussis
ccgaggccaggu

SEQ ID NO: 2417222 - RNA, 14 nt, Bordetella pertussis
ccgaggccagguug

SEQ ID NO: 2417223 - RNA, 16 nt, Bordetella pertussis
ccgaggccgaguggcc

SEQ ID NO: 2417224 - RNA, 19 nt, Bordetella pertussis
ccgaggccgaguggccgcu

SEQ ID NO: 2417225 - RNA, 22 nt, Bordetella pertussis
ccgaggccugcugugcgauggc

SEQ ID NO: 2417226 - RNA, 21 nt, Bordetella pertussis
ccgaggccuugcucgcccaug

SEQ ID NO: 2417227 - RNA, 15 nt, Bordetella pertussis
ccgaggcgccccaga

SEQ ID NO: 2417228 - RNA, 18 nt, Bordetella pertussis
ccgaggcgccccagagca

SEQ ID NO: 2417229 - RNA, 21 nt, Bordetella pertussis
ccgaggcgccccagagcaccg

SEQ ID NO: 2417230 - RNA, 13 nt, Bordetella pertussis
ccgaggcgccgcc

SEQ ID NO: 2417231 - RNA, 19 nt, Bordetella pertussis
ccgaggcgccgccgugcgc

SEQ ID NO: 2417232 - RNA, 12 nt, Bordetella pertussis
ccgaggcgcgca

SEQ ID NO: 2417233 - RNA, 20 nt, Bordetella pertussis
ccgaggcgcgcagcacgccg

SEQ ID NO: 2417234 - RNA, 15 nt, Bordetella pertussis
ccgaggcggcgcggg

SEQ ID NO: 2417235 - RNA, 19 nt, Bordetella pertussis
ccgaggcgggcagcauggc

SEQ ID NO: 2417236 - RNA, 22 nt, Bordetella pertussis
ccgaggcgggcagcauggcgcc

SEQ ID NO: 2417237 - RNA, 16 nt, Bordetella pertussis
ccgaggcggucgauga

SEQ ID NO: 2417238 - RNA, 19 nt, Bordetella pertussis
ccgaggcggucgaugaagc

SEQ ID NO: 2417239 - RNA, 12 nt, Bordetella pertussis
ccgaggcugcgc

SEQ ID NO: 2417240 - RNA, 18 nt, Bordetella pertussis
ccgaggcugcgcgcgcca

SEQ ID NO: 2417241 - RNA, 21 nt, Bordetella pertussis
ccgagggccggacuggcgcgc

SEQ ID NO: 2417242 - RNA, 14 nt, Bordetella pertussis
ccgagggcgcggcg

SEQ ID NO: 2417243 - RNA, 15 nt, Bordetella pertussis
ccgagggcgcggcgc

SEQ ID NO: 2417244 - RNA, 19 nt, Bordetella pertussis
ccgagggcgcggcgccgcu

SEQ ID NO: 2417245 - RNA, 14 nt, Bordetella pertussis
ccgagggcgcgucc

SEQ ID NO: 2417246 - RNA, 15 nt, Bordetella pertussis
ccgagggcgcgucca

SEQ ID NO: 2417247 - RNA, 18 nt, Bordetella pertussis
ccgagggcgcguccaagc

SEQ ID NO: 2417248 - RNA, 15 nt, Bordetella pertussis
ccgaguagcggcgca

SEQ ID NO: 2417249 - RNA, 18 nt, Bordetella pertussis
ccgaguccuugacgccgc

SEQ ID NO: 2417250 - RNA, 23 nt, Bordetella pertussis
ccgagucgaacuuuucgucgucg

SEQ ID NO: 2417251 - RNA, 23 nt, Bordetella pertussis
ccgaguggaugcgcuugccgccc

SEQ ID NO: 2417252 - RNA, 14 nt, Bordetella pertussis
ccgaguggccgcug

SEQ ID NO: 2417253 - RNA, 24 nt, Bordetella pertussis
ccgaguggccgcuguucggcgagc

SEQ ID NO: 2417254 - RNA, 23 nt, Bordetella pertussis
ccgagugggcggccuugccggcc

SEQ ID NO: 2417255 - RNA, 19 nt, Bordetella pertussis
ccgaguucgacucucgggg

SEQ ID NO: 2417256 - RNA, 18 nt, Bordetella pertussis
ccgaguuuccgcacccgg

SEQ ID NO: 2417257 - RNA, 23 nt, Bordetella pertussis
ccgauacaaggugccuguccccg

SEQ ID NO: 2417258 - RNA, 16 nt, Bordetella pertussis
ccgauaccacgcgcgg

SEQ ID NO: 2417259 - RNA, 17 nt, Bordetella pertussis
ccgauaccacgcgcggc

SEQ ID NO: 2417260 - RNA, 18 nt, Bordetella pertussis
ccgauaccacgcgcggcg

SEQ ID NO: 2417261 - RNA, 13 nt, Bordetella pertussis
ccgauaccgcaaa

SEQ ID NO: 2417262 - RNA, 16 nt, Bordetella pertussis
ccgauacgacacgccg

SEQ ID NO: 2417263 - RNA, 19 nt, Bordetella pertussis
ccgauacgacacgccgcgc

SEQ ID NO: 2417264 - RNA, 20 nt, Bordetella pertussis
ccgauacgacacgccgcgcg

SEQ ID NO: 2417265 - RNA, 17 nt, Bordetella pertussis
ccgauacgggcgcggcg

SEQ ID NO: 2417266 - RNA, 14 nt, Bordetella pertussis
ccgauacgucgcag

SEQ ID NO: 2417267 - RNA, 16 nt, Bordetella pertussis
ccgauacgucgcagca

SEQ ID NO: 2417268 - RNA, 22 nt, Bordetella pertussis
ccgauacgucgcagcacgccca

SEQ ID NO: 2417269 - RNA, 14 nt, Bordetella pertussis
ccgauagccgcgcg

SEQ ID NO: 2417270 - RNA, 15 nt, Bordetella pertussis
ccgauagccgcgcgc

SEQ ID NO: 2417271 - RNA, 16 nt, Bordetella pertussis
ccgauaugccaaggau

SEQ ID NO: 2417272 - RNA, 18 nt, Bordetella pertussis
ccgaucaccacgggcacg

SEQ ID NO: 2417273 - RNA, 13 nt, Bordetella pertussis
ccgaucagcaagg

SEQ ID NO: 2417274 - RNA, 20 nt, Bordetella pertussis
ccgaucagcaccacggcggc

SEQ ID NO: 2417275 - RNA, 20 nt, Bordetella pertussis
ccgaucagcaggucggcgcg

SEQ ID NO: 2417276 - RNA, 16 nt, Bordetella pertussis
ccgaucagcugcggcc

SEQ ID NO: 2417277 - RNA, 12 nt, Bordetella pertussis
ccgauccagccc

SEQ ID NO: 2417278 - RNA, 15 nt, Bordetella pertussis
ccgauccagcccgcg

SEQ ID NO: 2417279 - RNA, 15 nt, Bordetella pertussis
ccgauccagcgccug

SEQ ID NO: 2417280 - RNA, 18 nt, Bordetella pertussis
ccgauccagggccgcagc

SEQ ID NO: 2417281 - RNA, 15 nt, Bordetella pertussis
ccgauccccugcccg

SEQ ID NO: 2417282 - RNA, 20 nt, Bordetella pertussis
ccgaucccuugugcgcgcca

SEQ ID NO: 2417283 - RNA, 14 nt, Bordetella pertussis
ccgauccgcgacgc

SEQ ID NO: 2417284 - RNA, 18 nt, Bordetella pertussis
ccgauccgcgacgcccug

SEQ ID NO: 2417285 - RNA, 20 nt, Bordetella pertussis
ccgauccgcgggcgggccgc

SEQ ID NO: 2417286 - RNA, 21 nt, Bordetella pertussis
ccgauccgcgggcgggccgcg

SEQ ID NO: 2417287 - RNA, 11 nt, Bordetella pertussis
ccgaucgagca

SEQ ID NO: 2417288 - RNA, 19 nt, Bordetella pertussis
ccgaucgccgacaggauga

SEQ ID NO: 2417289 - RNA, 22 nt, Bordetella pertussis
ccgaucgccgacaggaugaaga

SEQ ID NO: 2417290 - RNA, 13 nt, Bordetella pertussis
ccgaucggcgccg

SEQ ID NO: 2417291 - RNA, 16 nt, Bordetella pertussis
ccgaucggcgccgcgc

SEQ ID NO: 2417292 - RNA, 12 nt, Bordetella pertussis
ccgaucggcguc

SEQ ID NO: 2417293 - RNA, 13 nt, Bordetella pertussis
ccgaucggcgucu

SEQ ID NO: 2417294 - RNA, 20 nt, Bordetella pertussis
ccgaucggcuugccgcgcgg

SEQ ID NO: 2417295 - RNA, 17 nt, Bordetella pertussis
ccgaucgugcacgcccg

SEQ ID NO: 2417296 - RNA, 18 nt, Bordetella pertussis
ccgaucgugcacgcccgc

SEQ ID NO: 2417297 - RNA, 22 nt, Bordetella pertussis
ccgaucgugcacgcccgcggcg

SEQ ID NO: 2417298 - RNA, 21 nt, Bordetella pertussis
ccgaucuacgacgccuggacc

SEQ ID NO: 2417299 - RNA, 20 nt, Bordetella pertussis
ccgaucuccgggagccuguc

SEQ ID NO: 2417300 - RNA, 22 nt, Bordetella pertussis
ccgaucuccgggagccuguccc

SEQ ID NO: 2417301 - RNA, 16 nt, Bordetella pertussis
ccgaucugcugggccg

SEQ ID NO: 2417302 - RNA, 21 nt, Bordetella pertussis
ccgaucugcugggccggguga

SEQ ID NO: 2417303 - RNA, 12 nt, Bordetella pertussis
ccgaugaagacg

SEQ ID NO: 2417304 - RNA, 14 nt, Bordetella pertussis
ccgaugaagacgcc

SEQ ID NO: 2417305 - RNA, 15 nt, Bordetella pertussis
ccgaugacaucgccg

SEQ ID NO: 2417306 - RNA, 18 nt, Bordetella pertussis
ccgaugaccagcagcgcc

SEQ ID NO: 2417307 - RNA, 21 nt, Bordetella pertussis
ccgaugaccagcagcgccggg

SEQ ID NO: 2417308 - RNA, 15 nt, Bordetella pertussis
ccgaugaccagggcg

SEQ ID NO: 2417309 - RNA, 17 nt, Bordetella pertussis
ccgaugaccagggcgcc

SEQ ID NO: 2417310 - RNA, 21 nt, Bordetella pertussis
ccgaugaccagggcgccgacc

SEQ ID NO: 2417311 - RNA, 16 nt, Bordetella pertussis
ccgaugaccggccagg

SEQ ID NO: 2417312 - RNA, 17 nt, Bordetella pertussis
ccgaugaccggccaggc

SEQ ID NO: 2417313 - RNA, 17 nt, Bordetella pertussis
ccgaugacggggcggcg

SEQ ID NO: 2417314 - RNA, 21 nt, Bordetella pertussis
ccgaugauggauucgcgccgg

SEQ ID NO: 2417315 - RNA, 22 nt, Bordetella pertussis
ccgaugauggauucgcgccggc

SEQ ID NO: 2417316 - RNA, 13 nt, Bordetella pertussis
ccgaugccgaaca

SEQ ID NO: 2417317 - RNA, 17 nt, Bordetella pertussis
ccgaugccgccaucauc

SEQ ID NO: 2417318 - RNA, 13 nt, Bordetella pertussis
ccgaugccgcgca

SEQ ID NO: 2417319 - RNA, 18 nt, Bordetella pertussis
ccgaugccgcgcaccugg

SEQ ID NO: 2417320 - RNA, 15 nt, Bordetella pertussis
ccgaugcgccaggcc

SEQ ID NO: 2417321 - RNA, 18 nt, Bordetella pertussis
ccgaugcgccaggccucg

SEQ ID NO: 2417322 - RNA, 17 nt, Bordetella pertussis
ccgaugcgccggccugg

SEQ ID NO: 2417323 - RNA, 15 nt, Bordetella pertussis
ccgaugcgcugcugg

SEQ ID NO: 2417324 - RNA, 16 nt, Bordetella pertussis
ccgaugcgcugcugga

SEQ ID NO: 2417325 - RNA, 17 nt, Bordetella pertussis
ccgaugcggcgcaugcu

SEQ ID NO: 2417326 - RNA, 23 nt, Bordetella pertussis
ccgaugcggguacuggccgacgg

SEQ ID NO: 2417327 - RNA, 16 nt, Bordetella pertussis
ccgcacggggacuggc

SEQ ID NO: 2417328 - RNA, 17 nt, Bordetella pertussis
ccgcacggggacuggca

SEQ ID NO: 2417329 - RNA, 18 nt, Bordetella pertussis
ccgcacggggacuggcac

SEQ ID NO: 2417330 - RNA, 19 nt, Bordetella pertussis
ccgcacggggacuggcacg

SEQ ID NO: 2417331 - RNA, 23 nt, Bordetella pertussis
ccgcacggggacuggcacgcgcu

SEQ ID NO: 2417332 - RNA, 16 nt, Bordetella pertussis
ccgcacggggagcgac

SEQ ID NO: 2417333 - RNA, 23 nt, Bordetella pertussis
ccgcacggggagcgacccguggc

SEQ ID NO: 2417334 - RNA, 16 nt, Bordetella pertussis
ccgcacgguggcgccg

SEQ ID NO: 2417335 - RNA, 20 nt, Bordetella pertussis
ccgcacgguggcgccgucgc

SEQ ID NO: 2417336 - RNA, 20 nt, Bordetella pertussis
ccgcacugaucuuucagcgc

SEQ ID NO: 2417337 - RNA, 19 nt, Bordetella pertussis
ccgcacugggugacgcugg

SEQ ID NO: 2417338 - RNA, 17 nt, Bordetella pertussis
ccgcacuucgggccacc

SEQ ID NO: 2417339 - RNA, 22 nt, Bordetella pertussis
ccgcacuucgggccacccgccg

SEQ ID NO: 2417340 - RNA, 16 nt, Bordetella pertussis
ccgcagaacagcagcg

SEQ ID NO: 2417341 - RNA, 19 nt, Bordetella pertussis
ccgcagaagaacaccgugu

SEQ ID NO: 2417342 - RNA, 21 nt, Bordetella pertussis
ccgcagaagcagccgcgcggc

SEQ ID NO: 2417343 - RNA, 23 nt, Bordetella pertussis
ccgcagaagcagccgcgcggccg

SEQ ID NO: 2417344 - RNA, 16 nt, Bordetella pertussis
ccgcagagggagcgac

SEQ ID NO: 2417345 - RNA, 19 nt, Bordetella pertussis
ccgcagauggccagcagcg

SEQ ID NO: 2417346 - RNA, 20 nt, Bordetella pertussis
ccgcagauggccagcagcgc

SEQ ID NO: 2417347 - RNA, 21 nt, Bordetella pertussis
ccgcagauggccagcagcgcc

SEQ ID NO: 2417348 - RNA, 22 nt, Bordetella pertussis
ccgcagauggccagcagcgccg

SEQ ID NO: 2417349 - RNA, 18 nt, Bordetella pertussis
ccgcagauggcguaggcg

SEQ ID NO: 2417350 - RNA, 22 nt, Bordetella pertussis
ccgcagcaauugccccagcacg

SEQ ID NO: 2417351 - RNA, 18 nt, Bordetella pertussis
ccgcagcaccacaucgcc

SEQ ID NO: 2417352 - RNA, 19 nt, Bordetella pertussis
ccgcagcaccacaucgccg

SEQ ID NO: 2417353 - RNA, 20 nt, Bordetella pertussis
ccgcagcaccacaucgccgg

SEQ ID NO: 2417354 - RNA, 22 nt, Bordetella pertussis
ccgcagcaccucggcguggcgg

SEQ ID NO: 2417355 - RNA, 15 nt, Bordetella pertussis
ccgcagcaggcgcuc

SEQ ID NO: 2417356 - RNA, 21 nt, Bordetella pertussis
ccgcagcaguucggucagcgc

SEQ ID NO: 2417357 - RNA, 15 nt, Bordetella pertussis
ccgcagcauggcgcc

SEQ ID NO: 2417358 - RNA, 16 nt, Bordetella pertussis
ccgcagcauggcgcca

SEQ ID NO: 2417359 - RNA, 17 nt, Bordetella pertussis
ccgcagcauggcgccag

SEQ ID NO: 2417360 - RNA, 21 nt, Bordetella pertussis
ccgcagcauggcgccagcugg

SEQ ID NO: 2417361 - RNA, 17 nt, Bordetella pertussis
ccgcagcccgcgcgccu

SEQ ID NO: 2417362 - RNA, 16 nt, Bordetella pertussis
ccgcagccgccagcgc

SEQ ID NO: 2417363 - RNA, 13 nt, Bordetella pertussis
ccgcagccgucgc

SEQ ID NO: 2417364 - RNA, 14 nt, Bordetella pertussis
ccgcagccgucgcg

SEQ ID NO: 2417365 - RNA, 14 nt, Bordetella pertussis
ccgcagcgcagcgc

SEQ ID NO: 2417366 - RNA, 15 nt, Bordetella pertussis
ccgcagcgcagcgcc

SEQ ID NO: 2417367 - RNA, 12 nt, Bordetella pertussis
ccgcagcgccac

SEQ ID NO: 2417368 - RNA, 19 nt, Bordetella pertussis
ccgcagcgccaccggcugg

SEQ ID NO: 2417369 - RNA, 13 nt, Bordetella pertussis
ccgcagcggacgu

SEQ ID NO: 2417370 - RNA, 18 nt, Bordetella pertussis
ccgcagcggcagcgcacc

SEQ ID NO: 2417371 - RNA, 16 nt, Bordetella pertussis
ccgcagcgggcccguc

SEQ ID NO: 2417372 - RNA, 19 nt, Bordetella pertussis
ccgcagcgggcccgucgcg

SEQ ID NO: 2417373 - RNA, 23 nt, Bordetella pertussis
ccgcagcgggcccgucgcgccag

SEQ ID NO: 2417374 - RNA, 16 nt, Bordetella pertussis
ccgcagcggggacagg

SEQ ID NO: 2417375 - RNA, 19 nt, Bordetella pertussis
ccgcagcgucgcggcgucg

SEQ ID NO: 2417376 - RNA, 19 nt, Bordetella pertussis
ccgcaggcaagcugcuggc

SEQ ID NO: 2417377 - RNA, 23 nt, Bordetella pertussis
ccgcaggcaagcugcuggcgcgc

SEQ ID NO: 2417378 - RNA, 19 nt, Bordetella pertussis
ccgcaggcauugcgccagc

SEQ ID NO: 2417379 - RNA, 19 nt, Bordetella pertussis
ccgcaggcggcggccucca

SEQ ID NO: 2417380 - RNA, 14 nt, Bordetella pertussis
ccgcagggacaggc

SEQ ID NO: 2417381 - RNA, 20 nt, Bordetella pertussis
ccgcagggacaggcaccccg

SEQ ID NO: 2417382 - RNA, 22 nt, Bordetella pertussis
ccgcagggcgugcgggacggcc

SEQ ID NO: 2417383 - RNA, 17 nt, Bordetella pertussis
ccgcagguccaggccug

SEQ ID NO: 2417384 - RNA, 15 nt, Bordetella pertussis
ccgcaggugccuguc

SEQ ID NO: 2417385 - RNA, 17 nt, Bordetella pertussis
ccgcaggugccuguccc

SEQ ID NO: 2417386 - RNA, 16 nt, Bordetella pertussis
ccgcaguacccggugc

SEQ ID NO: 2417387 - RNA, 14 nt, Bordetella pertussis
ccgcaguauuccug

SEQ ID NO: 2417388 - RNA, 22 nt, Bordetella pertussis
ccgcaguauuccugcugguaga

SEQ ID NO: 2417389 - RNA, 13 nt, Bordetella pertussis
ccgcagugcgcgc

SEQ ID NO: 2417390 - RNA, 18 nt, Bordetella pertussis
ccgcauaccuuggcgccc

SEQ ID NO: 2417391 - RNA, 15 nt, Bordetella pertussis
ccgcauagacgccga

SEQ ID NO: 2417392 - RNA, 20 nt, Bordetella pertussis
ccgcauagcuggagaccggg

SEQ ID NO: 2417393 - RNA, 13 nt, Bordetella pertussis
ccgcaucccgccc

SEQ ID NO: 2417394 - RNA, 20 nt, Bordetella pertussis
ccgcaucgcgcaagggccag

SEQ ID NO: 2417395 - RNA, 14 nt, Bordetella pertussis
ccgcaucgcgcagc

SEQ ID NO: 2417396 - RNA, 15 nt, Bordetella pertussis
ccgcaucgcgcgccg

SEQ ID NO: 2417397 - RNA, 17 nt, Bordetella pertussis
ccgcaucgcgcgccgcc

SEQ ID NO: 2417398 - RNA, 19 nt, Bordetella pertussis
ccgcaucgcgcgccgccgc

SEQ ID NO: 2417399 - RNA, 22 nt, Bordetella pertussis
ccgcaucgcgcgccgccgcccg

SEQ ID NO: 2417400 - RNA, 23 nt, Bordetella pertussis
ccgcaucgcgcgccgccgcccgc

SEQ ID NO: 2417401 - RNA, 21 nt, Bordetella pertussis
ccgcaucggccaggcgccuga

SEQ ID NO: 2417402 - RNA, 13 nt, Bordetella pertussis
ccgcaucggcgua

SEQ ID NO: 2417403 - RNA, 18 nt, Bordetella pertussis
ccgcaucggcguaccagg

SEQ ID NO: 2417404 - RNA, 20 nt, Bordetella pertussis
ccgcaucggcuggcgcaaga

SEQ ID NO: 2417405 - RNA, 15 nt, Bordetella pertussis
ccgcaugccggcgau

SEQ ID NO: 2417406 - RNA, 20 nt, Bordetella pertussis
ccgcaugccgggcugcaugc

SEQ ID NO: 2417407 - RNA, 14 nt, Bordetella pertussis
ccgcaugcggcggc

SEQ ID NO: 2417408 - RNA, 23 nt, Bordetella pertussis
ccgcaugcgugaagcccauggcg

SEQ ID NO: 2417409 - RNA, 18 nt, Bordetella pertussis
ccgcauggaccgccgccg

SEQ ID NO: 2417410 - RNA, 17 nt, Bordetella pertussis
ccgcauggagaccggcg

SEQ ID NO: 2417411 - RNA, 14 nt, Bordetella pertussis
ccgcaugggccagg

SEQ ID NO: 2417412 - RNA, 16 nt, Bordetella pertussis
ccgcaugggccaggcg

SEQ ID NO: 2417413 - RNA, 17 nt, Bordetella pertussis
ccgcaugggccaggcgc

SEQ ID NO: 2417414 - RNA, 18 nt, Bordetella pertussis
ccgcaugggccaggcgcu

SEQ ID NO: 2417415 - RNA, 14 nt, Bordetella pertussis
ccgcaugggcgccg

SEQ ID NO: 2417416 - RNA, 19 nt, Bordetella pertussis
ccgcaugggcgccgagggc

SEQ ID NO: 2417417 - RNA, 17 nt, Bordetella pertussis
ccgcaugggcgcgcccg

SEQ ID NO: 2417418 - RNA, 19 nt, Bordetella pertussis
ccgcaugggcgcgcccggc

SEQ ID NO: 2417419 - RNA, 19 nt, Bordetella pertussis
ccgcauggggacuggcgcc

SEQ ID NO: 2417420 - RNA, 18 nt, Bordetella pertussis
ccgcaugguggcgcaggc

SEQ ID NO: 2417421 - RNA, 21 nt, Bordetella pertussis
ccgcauugaucgaucagccag

SEQ ID NO: 2417422 - RNA, 22 nt, Bordetella pertussis
ccgcauugaucgaucagccagc

SEQ ID NO: 2417423 - RNA, 19 nt, Bordetella pertussis
ccgcauuucguaaagccgc

SEQ ID NO: 2417424 - RNA, 14 nt, Bordetella pertussis
ccgccaacgccaag

SEQ ID NO: 2417425 - RNA, 20 nt, Bordetella pertussis
ccgccaacgcggcgcgugca

SEQ ID NO: 2417426 - RNA, 21 nt, Bordetella pertussis
ccgccaacucgcuccagcgga

SEQ ID NO: 2417427 - RNA, 15 nt, Bordetella pertussis
ccgccaagggcgcgc

SEQ ID NO: 2417428 - RNA, 16 nt, Bordetella pertussis
ccgccaagggcgcgcc

SEQ ID NO: 2417429 - RNA, 17 nt, Bordetella pertussis
ccgccaagggcgcgcca

SEQ ID NO: 2417430 - RNA, 20 nt, Bordetella pertussis
ccgccaagggcgcgccagca

SEQ ID NO: 2417431 - RNA, 13 nt, Bordetella pertussis
ccgccacagcgcc

SEQ ID NO: 2417432 - RNA, 16 nt, Bordetella pertussis
ccgccacagcgccgcg

SEQ ID NO: 2417433 - RNA, 17 nt, Bordetella pertussis
ccgccacagcgccgcgg

SEQ ID NO: 2417434 - RNA, 19 nt, Bordetella pertussis
ccgccacagcgccgcggcg

SEQ ID NO: 2417435 - RNA, 21 nt, Bordetella pertussis
ccgccacaggcugacgcccgg

SEQ ID NO: 2417436 - RNA, 15 nt, Bordetella pertussis
ccgccaccacgcgca

SEQ ID NO: 2417437 - RNA, 18 nt, Bordetella pertussis
ccgccaccagcggcgugg

SEQ ID NO: 2417438 - RNA, 15 nt, Bordetella pertussis
ccgccaccaggaacg

SEQ ID NO: 2417439 - RNA, 18 nt, Bordetella pertussis
ccgccauggugccgcgca

SEQ ID NO: 2417440 - RNA, 20 nt, Bordetella pertussis
ccgccauggugccgcgcagg

SEQ ID NO: 2417441 - RNA, 19 nt, Bordetella pertussis
ccgccauguauaacguggc

SEQ ID NO: 2417442 - RNA, 21 nt, Bordetella pertussis
ccgccauguauaacguggcgc

SEQ ID NO: 2417443 - RNA, 15 nt, Bordetella pertussis
ccgccaugugcgccg

SEQ ID NO: 2417444 - RNA, 16 nt, Bordetella pertussis
ccgccaugugcgccgc

SEQ ID NO: 2417445 - RNA, 18 nt, Bordetella pertussis
ccgccaugugcgccgcgc

SEQ ID NO: 2417446 - RNA, 19 nt, Bordetella pertussis
ccgccaugugcgccgcgcc

SEQ ID NO: 2417447 - RNA, 17 nt, Bordetella pertussis
ccgccauugcacgcgca

SEQ ID NO: 2417448 - RNA, 13 nt, Bordetella pertussis
ccgccauugcgcc

SEQ ID NO: 2417449 - RNA, 16 nt, Bordetella pertussis
ccgcccacauggcggc

SEQ ID NO: 2417450 - RNA, 17 nt, Bordetella pertussis
ccgcccacauggcggcg

SEQ ID NO: 2417451 - RNA, 21 nt, Bordetella pertussis
ccgcccacauggcggcgaaca

SEQ ID NO: 2417452 - RNA, 20 nt, Bordetella pertussis
ccgcccaccaccagcgcggc

SEQ ID NO: 2417453 - RNA, 24 nt, Bordetella pertussis
ccgcccaccaccagcgcggccagc

SEQ ID NO: 2417454 - RNA, 21 nt, Bordetella pertussis
ccgcccacgaucaccacgccc

SEQ ID NO: 2417455 - RNA, 22 nt, Bordetella pertussis
ccgcccacgaucaccacgcccg

SEQ ID NO: 2417456 - RNA, 19 nt, Bordetella pertussis
ccgcccacgccgccuggcc

SEQ ID NO: 2417457 - RNA, 13 nt, Bordetella pertussis
ccgcccacgcggc

SEQ ID NO: 2417458 - RNA, 14 nt, Bordetella pertussis
ccgcccacgcggcg

SEQ ID NO: 2417459 - RNA, 15 nt, Bordetella pertussis
ccgcccacgcggcgc

SEQ ID NO: 2417460 - RNA, 18 nt, Bordetella pertussis
ccgcccacgcggcgcugc

SEQ ID NO: 2417461 - RNA, 13 nt, Bordetella pertussis
ccgcccacggcga

SEQ ID NO: 2417462 - RNA, 14 nt, Bordetella pertussis
ccgcccacgggcgc

SEQ ID NO: 2417463 - RNA, 17 nt, Bordetella pertussis
ccgcccacugccaggcg

SEQ ID NO: 2417464 - RNA, 17 nt, Bordetella pertussis
ccgcccagaaugcggcg

SEQ ID NO: 2417465 - RNA, 12 nt, Bordetella pertussis
ccgcccagcacc

SEQ ID NO: 2417466 - RNA, 21 nt, Bordetella pertussis
ccgcccagcauccgcgccagg

SEQ ID NO: 2417467 - RNA, 15 nt, Bordetella pertussis
ccgcccagccaggcg

SEQ ID NO: 2417468 - RNA, 20 nt, Bordetella pertussis
ccgcccagccaggcgccagc

SEQ ID NO: 2417469 - RNA, 23 nt, Bordetella pertussis
ccgcccagccaggcgccagcggc

SEQ ID NO: 2417470 - RNA, 18 nt, Bordetella pertussis
ccgcccagccgcgccagg

SEQ ID NO: 2417471 - RNA, 13 nt, Bordetella pertussis
ccgcccagccggc

SEQ ID NO: 2417472 - RNA, 22 nt, Bordetella pertussis
ccgcccagcgacgagggcgcca

SEQ ID NO: 2417473 - RNA, 12 nt, Bordetella pertussis
ccgcccagcgag

SEQ ID NO: 2417474 - RNA, 13 nt, Bordetella pertussis
ccgcccagcgagu

SEQ ID NO: 2417475 - RNA, 16 nt, Bordetella pertussis
ccgcccagcgagucga

SEQ ID NO: 2417476 - RNA, 15 nt, Bordetella pertussis
ccgcccagcgcauag

SEQ ID NO: 2417477 - RNA, 12 nt, Bordetella pertussis
ccgcccaggcgc

SEQ ID NO: 2417478 - RNA, 18 nt, Bordetella pertussis
ccgcccaggucggacgcg

SEQ ID NO: 2417479 - RNA, 20 nt, Bordetella pertussis
ccgcccaggugcgggagccg

SEQ ID NO: 2417480 - RNA, 22 nt, Bordetella pertussis
ccgcccagucguccagcacgcg

SEQ ID NO: 2417481 - RNA, 21 nt, Bordetella pertussis
ccgcccaugcgcauggccagc

SEQ ID NO: 2417482 - RNA, 22 nt, Bordetella pertussis
ccgccccaguugcgcguccagg

SEQ ID NO: 2417483 - RNA, 22 nt, Bordetella pertussis
ccgccccccuacgaauccccgc

SEQ ID NO: 2417484 - RNA, 14 nt, Bordetella pertussis
ccgccccggcgcau

SEQ ID NO: 2417485 - RNA, 22 nt, Bordetella pertussis
ccgccccggcgcggcgcgcgcc

SEQ ID NO: 2417486 - RNA, 23 nt, Bordetella pertussis
ccgccccggcgcggcgcgcgccg

SEQ ID NO: 2417487 - RNA, 12 nt, Bordetella pertussis
ccgccccgggca

SEQ ID NO: 2417488 - RNA, 17 nt, Bordetella pertussis
ccgcccgaauccagggc

SEQ ID NO: 2417489 - RNA, 22 nt, Bordetella pertussis
ccgcccgaauccagggccacgc

SEQ ID NO: 2417490 - RNA, 17 nt, Bordetella pertussis
ccgcccgacagcacgcc

SEQ ID NO: 2417491 - RNA, 16 nt, Bordetella pertussis
ccgcccgacgaggagc

SEQ ID NO: 2417492 - RNA, 21 nt, Bordetella pertussis
ccgcccgcaaggaccaugcgc

SEQ ID NO: 2417493 - RNA, 13 nt, Bordetella pertussis
ccgcccgcaggca

SEQ ID NO: 2417494 - RNA, 14 nt, Bordetella pertussis
ccgcccgcaggcau

SEQ ID NO: 2417495 - RNA, 23 nt, Bordetella pertussis
ccgcccgcaggcauugcgccagc

SEQ ID NO: 2417496 - RNA, 18 nt, Bordetella pertussis
ccgcccgcaugucccagc

SEQ ID NO: 2417497 - RNA, 21 nt, Bordetella pertussis
ccgcccgcaugucccagcgcu

SEQ ID NO: 2417498 - RNA, 12 nt, Bordetella pertussis
ccgcccgccagg

SEQ ID NO: 2417499 - RNA, 12 nt, Bordetella pertussis
ccgcccgcccgc

SEQ ID NO: 2417500 - RNA, 16 nt, Bordetella pertussis
ccgcccgcccugggca

SEQ ID NO: 2417501 - RNA, 18 nt, Bordetella pertussis
ccgcccgcccugggcagc

SEQ ID NO: 2417502 - RNA, 15 nt, Bordetella pertussis
ccgcccgccgggccg

SEQ ID NO: 2417503 - RNA, 17 nt, Bordetella pertussis
ccgcccgccgggccguc

SEQ ID NO: 2417504 - RNA, 14 nt, Bordetella pertussis
ccgcccgccucagg

SEQ ID NO: 2417505 - RNA, 17 nt, Bordetella pertussis
ccgcccgcgagcggcca

SEQ ID NO: 2417506 - RNA, 19 nt, Bordetella pertussis
ccgcccgcgagcggccagc

SEQ ID NO: 2417507 - RNA, 13 nt, Bordetella pertussis
ccgcccgcgccca

SEQ ID NO: 2417508 - RNA, 13 nt, Bordetella pertussis
ccgcccgcggccu

SEQ ID NO: 2417509 - RNA, 14 nt, Bordetella pertussis
ccgcccgcggccug

SEQ ID NO: 2417510 - RNA, 23 nt, Bordetella pertussis
ccgcccgcuccaccagcaccggc

SEQ ID NO: 2417511 - RNA, 24 nt, Bordetella pertussis
ccgcccgcuccaccagcaccggca

SEQ ID NO: 2417512 - RNA, 13 nt, Bordetella pertussis
ccgcccgcugcua

SEQ ID NO: 2417513 - RNA, 21 nt, Bordetella pertussis
ccgcccggcaacccgcccacg

SEQ ID NO: 2417514 - RNA, 15 nt, Bordetella pertussis
ccgcccggcaugggc

SEQ ID NO: 2417515 - RNA, 22 nt, Bordetella pertussis
ccgcccggccggcacggccggc

SEQ ID NO: 2417516 - RNA, 23 nt, Bordetella pertussis
ccgcccggccggcccgcgcgccu

SEQ ID NO: 2417517 - RNA, 17 nt, Bordetella pertussis
ccgcccggcggcgcgcc

SEQ ID NO: 2417518 - RNA, 18 nt, Bordetella pertussis
ccgcccggcggcgcgccg

SEQ ID NO: 2417519 - RNA, 14 nt, Bordetella pertussis
ccgcccgggccggc

SEQ ID NO: 2417520 - RNA, 15 nt, Bordetella pertussis
ccgcccggggccaug

SEQ ID NO: 2417521 - RNA, 11 nt, Bordetella pertussis
ccgcccggggu

SEQ ID NO: 2417522 - RNA, 18 nt, Bordetella pertussis
ccgcccggguuggcgucc

SEQ ID NO: 2417523 - RNA, 23 nt, Bordetella pertussis
ccgcccggguuggcguccaggcg

SEQ ID NO: 2417524 - RNA, 15 nt, Bordetella pertussis
ccgcccguugcggcg

SEQ ID NO: 2417525 - RNA, 22 nt, Bordetella pertussis
ccgcccugacgccugcgccggg

SEQ ID NO: 2417526 - RNA, 16 nt, Bordetella pertussis
ccgcccugccgccaag

SEQ ID NO: 2417527 - RNA, 18 nt, Bordetella pertussis
ccgcccugccgccaaggg

SEQ ID NO: 2417528 - RNA, 23 nt, Bordetella pertussis
ccgcccugccgccaagggcgcgc

SEQ ID NO: 2417529 - RNA, 16 nt, Bordetella pertussis
ccgcccugcugcccgc

SEQ ID NO: 2417530 - RNA, 12 nt, Bordetella pertussis
ccgcccuggccg

SEQ ID NO: 2417531 - RNA, 16 nt, Bordetella pertussis
ccgcccuggccgcgcc

SEQ ID NO: 2417532 - RNA, 22 nt, Bordetella pertussis
ccgcccuggccgcgccguucgg

SEQ ID NO: 2417533 - RNA, 19 nt, Bordetella pertussis
ccgcccuggcgcgaggcgg

SEQ ID NO: 2417534 - RNA, 14 nt, Bordetella pertussis
ccgcccugggcagc

SEQ ID NO: 2417535 - RNA, 21 nt, Bordetella pertussis
ccgcccuugccagggccuggc

SEQ ID NO: 2417536 - RNA, 14 nt, Bordetella pertussis
ccgcccuugggcau

SEQ ID NO: 2417537 - RNA, 18 nt, Bordetella pertussis
ccgcccuuggucaccgag

SEQ ID NO: 2417538 - RNA, 19 nt, Bordetella pertussis
ccgccgaaccagcgcacca

SEQ ID NO: 2417539 - RNA, 16 nt, Bordetella pertussis
ccgccgaacgaggcgc

SEQ ID NO: 2417540 - RNA, 19 nt, Bordetella pertussis
ccgccgaacgaggcgcggu

SEQ ID NO: 2417541 - RNA, 15 nt, Bordetella pertussis
ccgccgaacggcagc

SEQ ID NO: 2417542 - RNA, 19 nt, Bordetella pertussis
ccgccgaacggcagcagcg

SEQ ID NO: 2417543 - RNA, 18 nt, Bordetella pertussis
ccgccgaacggggccgcc

SEQ ID NO: 2417544 - RNA, 23 nt, Bordetella pertussis
ccgccgaacggggccgccucggc

SEQ ID NO: 2417545 - RNA, 14 nt, Bordetella pertussis
ccgccgaagccgcc

SEQ ID NO: 2417546 - RNA, 18 nt, Bordetella pertussis
ccgccgaagccgccgccg

SEQ ID NO: 2417547 - RNA, 14 nt, Bordetella pertussis
ccgccgaagggcac

SEQ ID NO: 2417548 - RNA, 22 nt, Bordetella pertussis
ccgccgacguagucgcgccagc

SEQ ID NO: 2417549 - RNA, 12 nt, Bordetella pertussis
ccgccgagucgg

SEQ ID NO: 2417550 - RNA, 17 nt, Bordetella pertussis
ccgccgagucggcgaug

SEQ ID NO: 2417551 - RNA, 19 nt, Bordetella pertussis
ccgccgauaccacgcgcgg

SEQ ID NO: 2417552 - RNA, 19 nt, Bordetella pertussis
ccgccggcgcgguggccau

SEQ ID NO: 2417553 - RNA, 13 nt, Bordetella pertussis
ccgccggcgcguu

SEQ ID NO: 2417554 - RNA, 21 nt, Bordetella pertussis
ccgccggcggauuugcucgcg

SEQ ID NO: 2417555 - RNA, 15 nt, Bordetella pertussis
ccgccggcggccugg

SEQ ID NO: 2417556 - RNA, 17 nt, Bordetella pertussis
ccgccggcggccuggac

SEQ ID NO: 2417557 - RNA, 15 nt, Bordetella pertussis
ccgccggcggcgccg

SEQ ID NO: 2417558 - RNA, 21 nt, Bordetella pertussis
ccgccggcggcgccggccuca

SEQ ID NO: 2417559 - RNA, 15 nt, Bordetella pertussis
ccgccggcggcgucg

SEQ ID NO: 2417560 - RNA, 23 nt, Bordetella pertussis
ccgccggcggcgucggcgcccgg

SEQ ID NO: 2417561 - RNA, 14 nt, Bordetella pertussis
ccgccggcggcgug

SEQ ID NO: 2417562 - RNA, 16 nt, Bordetella pertussis
ccgccggcggcgugcc

SEQ ID NO: 2417563 - RNA, 15 nt, Bordetella pertussis
ccgccgggacaggca

SEQ ID NO: 2417564 - RNA, 16 nt, Bordetella pertussis
ccgccgggacaggcac

SEQ ID NO: 2417565 - RNA, 19 nt, Bordetella pertussis
ccgccgggcaugcaccagg

SEQ ID NO: 2417566 - RNA, 20 nt, Bordetella pertussis
ccgccgggcaugcaccaggc

SEQ ID NO: 2417567 - RNA, 13 nt, Bordetella pertussis
ccgccgggccaag

SEQ ID NO: 2417568 - RNA, 15 nt, Bordetella pertussis
ccgccgggccgcgac

SEQ ID NO: 2417569 - RNA, 16 nt, Bordetella pertussis
ccgccgggccgcgacc

SEQ ID NO: 2417570 - RNA, 18 nt, Bordetella pertussis
ccgccgggccgcgaccac

SEQ ID NO: 2417571 - RNA, 18 nt, Bordetella pertussis
ccgccgggccgucgugcg

SEQ ID NO: 2417572 - RNA, 17 nt, Bordetella pertussis
ccgccgggccugcccgc

SEQ ID NO: 2417573 - RNA, 18 nt, Bordetella pertussis
ccgccgggcgcgcgccgg

SEQ ID NO: 2417574 - RNA, 23 nt, Bordetella pertussis
ccgccgggcgcgcgccggcggcc

SEQ ID NO: 2417575 - RNA, 12 nt, Bordetella pertussis
ccgccgggcggc

SEQ ID NO: 2417576 - RNA, 13 nt, Bordetella pertussis
ccgccgggcggcg

SEQ ID NO: 2417577 - RNA, 14 nt, Bordetella pertussis
ccgccgggcggcgc

SEQ ID NO: 2417578 - RNA, 22 nt, Bordetella pertussis
ccgccgggcuggauccggcgcu

SEQ ID NO: 2417579 - RNA, 21 nt, Bordetella pertussis
ccgccggggaggccucgacgc

SEQ ID NO: 2417580 - RNA, 14 nt, Bordetella pertussis
ccgccggggcaggc

SEQ ID NO: 2417581 - RNA, 16 nt, Bordetella pertussis
ccgccggggcaggcuc

SEQ ID NO: 2417582 - RNA, 15 nt, Bordetella pertussis
ccgccggguuucucg

SEQ ID NO: 2417583 - RNA, 15 nt, Bordetella pertussis
ccgccggucaccgcc

SEQ ID NO: 2417584 - RNA, 13 nt, Bordetella pertussis
ccgccggucgaga

SEQ ID NO: 2417585 - RNA, 17 nt, Bordetella pertussis
ccgccggugauaugcgc

SEQ ID NO: 2417586 - RNA, 21 nt, Bordetella pertussis
ccgccggugauaugcgccagg

SEQ ID NO: 2417587 - RNA, 16 nt, Bordetella pertussis
ccgccggugcaccagg

SEQ ID NO: 2417588 - RNA, 17 nt, Bordetella pertussis
ccgccggugcaccaggc

SEQ ID NO: 2417589 - RNA, 19 nt, Bordetella pertussis
ccgccggugcaccaggcca

SEQ ID NO: 2417590 - RNA, 21 nt, Bordetella pertussis
ccgccggugcaccaggccacc

SEQ ID NO: 2417591 - RNA, 23 nt, Bordetella pertussis
ccgccggugcaccaggccacccg

SEQ ID NO: 2417592 - RNA, 13 nt, Bordetella pertussis
ccgccggugucgg

SEQ ID NO: 2417593 - RNA, 16 nt, Bordetella pertussis
ccgccggugucggggc

SEQ ID NO: 2417594 - RNA, 20 nt, Bordetella pertussis
ccgccggugucggggccggg

SEQ ID NO: 2417595 - RNA, 19 nt, Bordetella pertussis
ccgccgguucggucgacga

SEQ ID NO: 2417596 - RNA, 22 nt, Bordetella pertussis
ccgccgguucggucgacgacgg

SEQ ID NO: 2417597 - RNA, 18 nt, Bordetella pertussis
ccgccguaaucggcgucg

SEQ ID NO: 2417598 - RNA, 14 nt, Bordetella pertussis
ccgccguagcgcgc

SEQ ID NO: 2417599 - RNA, 22 nt, Bordetella pertussis
ccgccguaggacagccccagca

SEQ ID NO: 2417600 - RNA, 18 nt, Bordetella pertussis
ccgccgucaacgcccagg

SEQ ID NO: 2417601 - RNA, 19 nt, Bordetella pertussis
ccgccgucaacgcccaggu

SEQ ID NO: 2417602 - RNA, 21 nt, Bordetella pertussis
ccgccgucaacgcccagguug

SEQ ID NO: 2417603 - RNA, 14 nt, Bordetella pertussis
ccgccgucagcucg

SEQ ID NO: 2417604 - RNA, 15 nt, Bordetella pertussis
ccgccgucagcucga

SEQ ID NO: 2417605 - RNA, 16 nt, Bordetella pertussis
ccgccgucagcucgau

SEQ ID NO: 2417606 - RNA, 17 nt, Bordetella pertussis
ccgccgugacgcugaug

SEQ ID NO: 2417607 - RNA, 14 nt, Bordetella pertussis
ccgccgugacuucg

SEQ ID NO: 2417608 - RNA, 20 nt, Bordetella pertussis
ccgccgugacuucggccgcc

SEQ ID NO: 2417609 - RNA, 18 nt, Bordetella pertussis
ccgccgugcaggcccggg

SEQ ID NO: 2417610 - RNA, 16 nt, Bordetella pertussis
ccgccgugccgggccu

SEQ ID NO: 2417611 - RNA, 18 nt, Bordetella pertussis
ccgccgugccgggccugg

SEQ ID NO: 2417612 - RNA, 18 nt, Bordetella pertussis
ccgccgugcgagcacggc

SEQ ID NO: 2417613 - RNA, 15 nt, Bordetella pertussis
ccgccgugcgcgggc

SEQ ID NO: 2417614 - RNA, 21 nt, Bordetella pertussis
ccgccgugcgcgggcgcggca

SEQ ID NO: 2417615 - RNA, 14 nt, Bordetella pertussis
ccgccguggccggc

SEQ ID NO: 2417616 - RNA, 18 nt, Bordetella pertussis
ccgccguguaggcggucu

SEQ ID NO: 2417617 - RNA, 17 nt, Bordetella pertussis
ccgccguugcucgcgcg

SEQ ID NO: 2417618 - RNA, 18 nt, Bordetella pertussis
ccgccguugcucgcgcgc

SEQ ID NO: 2417619 - RNA, 19 nt, Bordetella pertussis
ccgccguugcucgcgcgca

SEQ ID NO: 2417620 - RNA, 18 nt, Bordetella pertussis
ccgccuacuggcgcgcgc

SEQ ID NO: 2417621 - RNA, 21 nt, Bordetella pertussis
ccgccuauguaggcgccgcgc

SEQ ID NO: 2417622 - RNA, 14 nt, Bordetella pertussis
ccgccucaccgcgc

SEQ ID NO: 2417623 - RNA, 22 nt, Bordetella pertussis
ccgccucagcguuuccagggcg

SEQ ID NO: 2417624 - RNA, 13 nt, Bordetella pertussis
ccgccucaggccg

SEQ ID NO: 2417625 - RNA, 14 nt, Bordetella pertussis
ccgccucaggccgg

SEQ ID NO: 2417626 - RNA, 18 nt, Bordetella pertussis
ccgccucaggccggcgcc

SEQ ID NO: 2417627 - RNA, 16 nt, Bordetella pertussis
ccgccuccagcgcggc

SEQ ID NO: 2417628 - RNA, 20 nt, Bordetella pertussis
ccgccuccaggaugagcgcc

SEQ ID NO: 2417629 - RNA, 13 nt, Bordetella pertussis
ccgccuccaggcg

SEQ ID NO: 2417630 - RNA, 16 nt, Bordetella pertussis
ccgccuccaggcggcg

SEQ ID NO: 2417631 - RNA, 13 nt, Bordetella pertussis
ccgccucgaccgg

SEQ ID NO: 2417632 - RNA, 14 nt, Bordetella pertussis
ccgccucgaccggc

SEQ ID NO: 2417633 - RNA, 17 nt, Bordetella pertussis
ccgccucgacgaugccc

SEQ ID NO: 2417634 - RNA, 21 nt, Bordetella pertussis
ccgccucgacgaugcccugcg

SEQ ID NO: 2417635 - RNA, 16 nt, Bordetella pertussis
ccgccucgacgcccgg

SEQ ID NO: 2417636 - RNA, 17 nt, Bordetella pertussis
ccgccucgaucgccagg

SEQ ID NO: 2417637 - RNA, 14 nt, Bordetella pertussis
ccgccucgaugccc

SEQ ID NO: 2417638 - RNA, 18 nt, Bordetella pertussis
ccgccucgaugucaucgc

SEQ ID NO: 2417639 - RNA, 16 nt, Bordetella pertussis
ccgccucgcgcuccag

SEQ ID NO: 2417640 - RNA, 13 nt, Bordetella pertussis
ccgccucggcggc

SEQ ID NO: 2417641 - RNA, 21 nt, Bordetella pertussis
ccgccucggcggccagcgcgc

SEQ ID NO: 2417642 - RNA, 14 nt, Bordetella pertussis
ccgccucgggcacg

SEQ ID NO: 2417643 - RNA, 16 nt, Bordetella pertussis
ccgccugagcacaugc

SEQ ID NO: 2417644 - RNA, 22 nt, Bordetella pertussis
ccgccugagcacaugcccggcc

SEQ ID NO: 2417645 - RNA, 16 nt, Bordetella pertussis
ccgccugcagcagcgc

SEQ ID NO: 2417646 - RNA, 14 nt, Bordetella pertussis
ccgccugcgccagc

SEQ ID NO: 2417647 - RNA, 15 nt, Bordetella pertussis
ccgccugcgccagcc

SEQ ID NO: 2417648 - RNA, 18 nt, Bordetella pertussis
ccgccugcgccagccgcg

SEQ ID NO: 2417649 - RNA, 15 nt, Bordetella pertussis
ccgccugcgccaggu

SEQ ID NO: 2417650 - RNA, 15 nt, Bordetella pertussis
ccgccugcgccgagg

SEQ ID NO: 2417651 - RNA, 22 nt, Bordetella pertussis
ccgccugcgccgucugcgccgc

SEQ ID NO: 2417652 - RNA, 14 nt, Bordetella pertussis
ccgccugcggacgg

SEQ ID NO: 2417653 - RNA, 21 nt, Bordetella pertussis
ccgccugcggacggcgggcgc

SEQ ID NO: 2417654 - RNA, 23 nt, Bordetella pertussis
ccgccugcggacggcgggcgccc

SEQ ID NO: 2417655 - RNA, 15 nt, Bordetella pertussis
ccgccugcguggcgg

SEQ ID NO: 2417656 - RNA, 17 nt, Bordetella pertussis
ccgccugcguggcgggc

SEQ ID NO: 2417657 - RNA, 12 nt, Bordetella pertussis
ccgccugcugcg

SEQ ID NO: 2417658 - RNA, 14 nt, Bordetella pertussis
ccgccugcugcgcc

SEQ ID NO: 2417659 - RNA, 17 nt, Bordetella pertussis
ccgccugcugcgccugg

SEQ ID NO: 2417660 - RNA, 18 nt, Bordetella pertussis
ccgccugcugcgccuggc

SEQ ID NO: 2417661 - RNA, 20 nt, Bordetella pertussis
ccgccugcugcgccuggccg

SEQ ID NO: 2417662 - RNA, 21 nt, Bordetella pertussis
ccgccugcugggccgcgcucg

SEQ ID NO: 2417663 - RNA, 22 nt, Bordetella pertussis
ccgccugcugggccgcgcucga

SEQ ID NO: 2417664 - RNA, 22 nt, Bordetella pertussis
ccgccuggcccacaucgucgcg

SEQ ID NO: 2417665 - RNA, 16 nt, Bordetella pertussis
ccgcgccaagggcgug

SEQ ID NO: 2417666 - RNA, 22 nt, Bordetella pertussis
ccgcgccacacgggcgccugcc

SEQ ID NO: 2417667 - RNA, 23 nt, Bordetella pertussis
ccgcgccacacgggcgccugccg

SEQ ID NO: 2417668 - RNA, 15 nt, Bordetella pertussis
ccgcgccacaggcgc

SEQ ID NO: 2417669 - RNA, 15 nt, Bordetella pertussis
ccgcgccagcgccac

SEQ ID NO: 2417670 - RNA, 18 nt, Bordetella pertussis
ccgcgccagcgccacgcc

SEQ ID NO: 2417671 - RNA, 16 nt, Bordetella pertussis
ccgcgccagcgccggc

SEQ ID NO: 2417672 - RNA, 14 nt, Bordetella pertussis
ccgcgccagcgccu

SEQ ID NO: 2417673 - RNA, 17 nt, Bordetella pertussis
ccgcgccagcgccucca

SEQ ID NO: 2417674 - RNA, 15 nt, Bordetella pertussis
ccgcgccagcugcgc

SEQ ID NO: 2417675 - RNA, 22 nt, Bordetella pertussis
ccgcgccaggcgguacaggccg

SEQ ID NO: 2417676 - RNA, 20 nt, Bordetella pertussis
ccgcgccaucgcgucgacgg

SEQ ID NO: 2417677 - RNA, 22 nt, Bordetella pertussis
ccgcgccaucuaccugucgggc

SEQ ID NO: 2417678 - RNA, 14 nt, Bordetella pertussis
ccgcgcccacagga

SEQ ID NO: 2417679 - RNA, 22 nt, Bordetella pertussis
ccgcgcccacaggaacaggccg

SEQ ID NO: 2417680 - RNA, 12 nt, Bordetella pertussis
ccgcgcccagca

SEQ ID NO: 2417681 - RNA, 15 nt, Bordetella pertussis
ccgcgcccagcaugg

SEQ ID NO: 2417682 - RNA, 14 nt, Bordetella pertussis
ccgcgcccagcgug

SEQ ID NO: 2417683 - RNA, 15 nt, Bordetella pertussis
ccgcgcccagcuguc

SEQ ID NO: 2417684 - RNA, 14 nt, Bordetella pertussis
ccgcgcccagcuug

SEQ ID NO: 2417685 - RNA, 12 nt, Bordetella pertussis
ccgcgcccaggg

SEQ ID NO: 2417686 - RNA, 12 nt, Bordetella pertussis
ccgcgcccaggu

SEQ ID NO: 2417687 - RNA, 15 nt, Bordetella pertussis
ccgcgcccagguccu

SEQ ID NO: 2417688 - RNA, 22 nt, Bordetella pertussis
ccgcgcccagguccugcgccag

SEQ ID NO: 2417689 - RNA, 21 nt, Bordetella pertussis
ccgcgcccaguuccacgcggc

SEQ ID NO: 2417690 - RNA, 22 nt, Bordetella pertussis
ccgcgcccaugcgcuggcgcaa

SEQ ID NO: 2417691 - RNA, 19 nt, Bordetella pertussis
ccgcgcccauuucgauggc

SEQ ID NO: 2417692 - RNA, 23 nt, Bordetella pertussis
ccgcgcccauuuucugccacagc

SEQ ID NO: 2417693 - RNA, 19 nt, Bordetella pertussis
ccgcgccccuagcgccgcg

SEQ ID NO: 2417694 - RNA, 22 nt, Bordetella pertussis
ccgcgccccuagcgccgcgcca

SEQ ID NO: 2417695 - RNA, 21 nt, Bordetella pertussis
ccgcgcccgcaacgggccggc

SEQ ID NO: 2417696 - RNA, 14 nt, Bordetella pertussis
ccgcgcccgccgcg

SEQ ID NO: 2417697 - RNA, 17 nt, Bordetella pertussis
ccgcgcccgccgcgcca

SEQ ID NO: 2417698 - RNA, 20 nt, Bordetella pertussis
ccgcgcccggaucaguccgg

SEQ ID NO: 2417699 - RNA, 13 nt, Bordetella pertussis
ccgcgcccggccg

SEQ ID NO: 2417700 - RNA, 15 nt, Bordetella pertussis
ccgcgcccggccggc

SEQ ID NO: 2417701 - RNA, 16 nt, Bordetella pertussis
ccgcgcccggccggcc

SEQ ID NO: 2417702 - RNA, 12 nt, Bordetella pertussis
ccgcgcccggcg

SEQ ID NO: 2417703 - RNA, 17 nt, Bordetella pertussis
ccgcgcccggcggccag

SEQ ID NO: 2417704 - RNA, 18 nt, Bordetella pertussis
ccgcgcccggcggccagg

SEQ ID NO: 2417705 - RNA, 21 nt, Bordetella pertussis
ccgcgcccggcggccaggccg

SEQ ID NO: 2417706 - RNA, 23 nt, Bordetella pertussis
ccgcgcccggcggccaggccggc

SEQ ID NO: 2417707 - RNA, 13 nt, Bordetella pertussis
ccgcgcccgucca

SEQ ID NO: 2417708 - RNA, 22 nt, Bordetella pertussis
ccgcgcccuggcgccgcggccg

SEQ ID NO: 2417709 - RNA, 18 nt, Bordetella pertussis
ccgcgcccuggcgcggcg

SEQ ID NO: 2417710 - RNA, 23 nt, Bordetella pertussis
ccgcgccgaacgacuuggcgcaa

SEQ ID NO: 2417711 - RNA, 17 nt, Bordetella pertussis
ccgcgccgaaggcgugc

SEQ ID NO: 2417712 - RNA, 19 nt, Bordetella pertussis
ccgcgccgaaggcgugcug

SEQ ID NO: 2417713 - RNA, 23 nt, Bordetella pertussis
ccgcgccgaaggcgugcugaacg

SEQ ID NO: 2417714 - RNA, 22 nt, Bordetella pertussis
ccgcgccgaccacgcugggcca

SEQ ID NO: 2417715 - RNA, 17 nt, Bordetella pertussis
ccgcgccgaccggcccc

SEQ ID NO: 2417716 - RNA, 19 nt, Bordetella pertussis
ccgcgccgaccggccccac

SEQ ID NO: 2417717 - RNA, 19 nt, Bordetella pertussis
ccgcgccgagcggggccgc

SEQ ID NO: 2417718 - RNA, 21 nt, Bordetella pertussis
ccgcgccgagcggggccgcgc

SEQ ID NO: 2417719 - RNA, 22 nt, Bordetella pertussis
ccgcgccgaguuuccgcacccg

SEQ ID NO: 2417720 - RNA, 10 nt, Bordetella pertussis
ccgcgccgcc

SEQ ID NO: 2417721 - RNA, 11 nt, Bordetella pertussis
ccgcgccgccc

SEQ ID NO: 2417722 - RNA, 15 nt, Bordetella pertussis
ccgcgccgcccacgc

SEQ ID NO: 2417723 - RNA, 16 nt, Bordetella pertussis
ccgcgccgcccacgcc

SEQ ID NO: 2417724 - RNA, 17 nt, Bordetella pertussis
ccgcgccgcccacgccg

SEQ ID NO: 2417725 - RNA, 19 nt, Bordetella pertussis
ccgcgccgcccccgcccag

SEQ ID NO: 2417726 - RNA, 13 nt, Bordetella pertussis
ccgcgccgcccgc

SEQ ID NO: 2417727 - RNA, 17 nt, Bordetella pertussis
ccgcgccgccgcccugg

SEQ ID NO: 2417728 - RNA, 14 nt, Bordetella pertussis
ccgcgccgccgcgc

SEQ ID NO: 2417729 - RNA, 19 nt, Bordetella pertussis
ccgcgccgccgcgcccugg

SEQ ID NO: 2417730 - RNA, 14 nt, Bordetella pertussis
ccgcgccgccuagg

SEQ ID NO: 2417731 - RNA, 12 nt, Bordetella pertussis
ccgcgccgcgca

SEQ ID NO: 2417732 - RNA, 13 nt, Bordetella pertussis
ccgcgccgcgccg

SEQ ID NO: 2417733 - RNA, 15 nt, Bordetella pertussis
ccgcgccgcgccggu

SEQ ID NO: 2417734 - RNA, 13 nt, Bordetella pertussis
ccgcgccgcggca

SEQ ID NO: 2417735 - RNA, 16 nt, Bordetella pertussis
ccgcgccgcggcacgg

SEQ ID NO: 2417736 - RNA, 17 nt, Bordetella pertussis
ccgcgccgcgucauggc

SEQ ID NO: 2417737 - RNA, 21 nt, Bordetella pertussis
ccgcgccgcguugcagccaca

SEQ ID NO: 2417738 - RNA, 16 nt, Bordetella pertussis
ccgcgccgcuggcggc

SEQ ID NO: 2417739 - RNA, 18 nt, Bordetella pertussis
ccgcgccgcuggcggccg

SEQ ID NO: 2417740 - RNA, 20 nt, Bordetella pertussis
ccgcgccgcuggcguccagg

SEQ ID NO: 2417741 - RNA, 15 nt, Bordetella pertussis
ccgcgccggcgcgcg

SEQ ID NO: 2417742 - RNA, 16 nt, Bordetella pertussis
ccgcgccggcucccgc

SEQ ID NO: 2417743 - RNA, 14 nt, Bordetella pertussis
ccgcgccggcucgu

SEQ ID NO: 2417744 - RNA, 17 nt, Bordetella pertussis
ccgcgccgggcgcgccg

SEQ ID NO: 2417745 - RNA, 19 nt, Bordetella pertussis
ccgcgccgggcgcgccggc

SEQ ID NO: 2417746 - RNA, 22 nt, Bordetella pertussis
ccgcgccgggcgcgccggcggg

SEQ ID NO: 2417747 - RNA, 15 nt, Bordetella pertussis
ccgcgccggggcggc

SEQ ID NO: 2417748 - RNA, 17 nt, Bordetella pertussis
ccgcgccggggcggcgc

SEQ ID NO: 2417749 - RNA, 12 nt, Bordetella pertussis
ccgcgccggggu

SEQ ID NO: 2417750 - RNA, 16 nt, Bordetella pertussis
ccgcgccggucaggcg

SEQ ID NO: 2417751 - RNA, 18 nt, Bordetella pertussis
ccgcgccguacagggccg

SEQ ID NO: 2417752 - RNA, 21 nt, Bordetella pertussis
ccgcgccguaccugcagcagg

SEQ ID NO: 2417753 - RNA, 12 nt, Bordetella pertussis
ccgcgccgucga

SEQ ID NO: 2417754 - RNA, 18 nt, Bordetella pertussis
ccgcgccuauaucgacgg

SEQ ID NO: 2417755 - RNA, 21 nt, Bordetella pertussis
ccgcgccuauaucgacggcgc

SEQ ID NO: 2417756 - RNA, 20 nt, Bordetella pertussis
ccgcgccuaucaggccucga

SEQ ID NO: 2417757 - RNA, 17 nt, Bordetella pertussis
ccgcgccucggacgccu

SEQ ID NO: 2417758 - RNA, 22 nt, Bordetella pertussis
ccgcgccucggacgccuggcgc

SEQ ID NO: 2417759 - RNA, 16 nt, Bordetella pertussis
ccgcgccugcagcagc

SEQ ID NO: 2417760 - RNA, 17 nt, Bordetella pertussis
ccgcgccugcagcagcg

SEQ ID NO: 2417761 - RNA, 21 nt, Bordetella pertussis
ccgcgccugcagcagcggcag

SEQ ID NO: 2417762 - RNA, 17 nt, Bordetella pertussis
ccgcgccugggggcugg

SEQ ID NO: 2417763 - RNA, 23 nt, Bordetella pertussis
ccgcgccugggggcuggaggcgc

SEQ ID NO: 2417764 - RNA, 17 nt, Bordetella pertussis
ccgcgccuucgaggccg

SEQ ID NO: 2417765 - RNA, 12 nt, Bordetella pertussis
ccgcgccuugcc

SEQ ID NO: 2417766 - RNA, 17 nt, Bordetella pertussis
ccgcgcgacagccgcgc

SEQ ID NO: 2417767 - RNA, 20 nt, Bordetella pertussis
ccgcgcgacagccgcgccag

SEQ ID NO: 2417768 - RNA, 12 nt, Bordetella pertussis
ccgcgcgagcgc

SEQ ID NO: 2417769 - RNA, 18 nt, Bordetella pertussis
ccgcgcgagcggcgugcg

SEQ ID NO: 2417770 - RNA, 20 nt, Bordetella pertussis
ccgcgcgauccuggggcagg

SEQ ID NO: 2417771 - RNA, 19 nt, Bordetella pertussis
ccgcgcgaucgccgcaugg

SEQ ID NO: 2417772 - RNA, 13 nt, Bordetella pertussis
ccgcgcgaugcgc

SEQ ID NO: 2417773 - RNA, 16 nt, Bordetella pertussis
ccgcgcgaugcgcggc

SEQ ID NO: 2417774 - RNA, 17 nt, Bordetella pertussis
ccgcgcgcacgaccacc

SEQ ID NO: 2417775 - RNA, 17 nt, Bordetella pertussis
ccgcgcgcacguggacc

SEQ ID NO: 2417776 - RNA, 20 nt, Bordetella pertussis
ccgcgcgcacguggaccagg

SEQ ID NO: 2417777 - RNA, 21 nt, Bordetella pertussis
ccgcgcgcacguggaccaggg

SEQ ID NO: 2417778 - RNA, 15 nt, Bordetella pertussis
ccgcggcaagccgcg

SEQ ID NO: 2417779 - RNA, 15 nt, Bordetella pertussis
ccgcggcaggccccg

SEQ ID NO: 2417780 - RNA, 19 nt, Bordetella pertussis
ccgcggcaggccccggccc

SEQ ID NO: 2417781 - RNA, 14 nt, Bordetella pertussis
ccgcggcaugcugg

SEQ ID NO: 2417782 - RNA, 14 nt, Bordetella pertussis
ccgcggccaccagg

SEQ ID NO: 2417783 - RNA, 17 nt, Bordetella pertussis
ccgcggccaccaggcug

SEQ ID NO: 2417784 - RNA, 19 nt, Bordetella pertussis
ccgcggccagccacgccgg

SEQ ID NO: 2417785 - RNA, 17 nt, Bordetella pertussis
ccgcggccagcgccgcg

SEQ ID NO: 2417786 - RNA, 20 nt, Bordetella pertussis
ccgcggccagggugccccgc

SEQ ID NO: 2417787 - RNA, 15 nt, Bordetella pertussis
ccgcggcccgcccgc

SEQ ID NO: 2417788 - RNA, 23 nt, Bordetella pertussis
ccgcggccgcccccagcgcgccu

SEQ ID NO: 2417789 - RNA, 12 nt, Bordetella pertussis
ccgcggccgccg

SEQ ID NO: 2417790 - RNA, 12 nt, Bordetella pertussis
ccgcggccgcgc

SEQ ID NO: 2417791 - RNA, 15 nt, Bordetella pertussis
ccgcggccgcgcugg

SEQ ID NO: 2417792 - RNA, 20 nt, Bordetella pertussis
ccgcggccgcggucagccag

SEQ ID NO: 2417793 - RNA, 11 nt, Bordetella pertussis
ccgcggccggc

SEQ ID NO: 2417794 - RNA, 12 nt, Bordetella pertussis
ccgcggccggca

SEQ ID NO: 2417795 - RNA, 13 nt, Bordetella pertussis
ccgcggccggcac

SEQ ID NO: 2417796 - RNA, 19 nt, Bordetella pertussis
ccgcggccggguggccgcg

SEQ ID NO: 2417797 - RNA, 17 nt, Bordetella pertussis
ccgcggccugcgcgucc

SEQ ID NO: 2417798 - RNA, 16 nt, Bordetella pertussis
ccgcggccuggccggg

SEQ ID NO: 2417799 - RNA, 18 nt, Bordetella pertussis
ccgcggccuucaccccgc

SEQ ID NO: 2417800 - RNA, 19 nt, Bordetella pertussis
ccgcggcgagcucggcaug

SEQ ID NO: 2417801 - RNA, 12 nt, Bordetella pertussis
ccgcggcgcagg

SEQ ID NO: 2417802 - RNA, 16 nt, Bordetella pertussis
ccgcggcgcaggucca

SEQ ID NO: 2417803 - RNA, 16 nt, Bordetella pertussis
ccgcggcgcaugcagc

SEQ ID NO: 2417804 - RNA, 14 nt, Bordetella pertussis
ccgcggcgccagcg

SEQ ID NO: 2417805 - RNA, 13 nt, Bordetella pertussis
ccgcggcgcccag

SEQ ID NO: 2417806 - RNA, 18 nt, Bordetella pertussis
ccgcggcgcccagcuggc

SEQ ID NO: 2417807 - RNA, 13 nt, Bordetella pertussis
ccgcggcgccccg

SEQ ID NO: 2417808 - RNA, 14 nt, Bordetella pertussis
ccgcggcgcgcgcg

SEQ ID NO: 2417809 - RNA, 16 nt, Bordetella pertussis
ccgcggcgcggcccgc

SEQ ID NO: 2417810 - RNA, 16 nt, Bordetella pertussis
ccgcggcgcggccuuc

SEQ ID NO: 2417811 - RNA, 16 nt, Bordetella pertussis
ccgcggcgcuggaugg

SEQ ID NO: 2417812 - RNA, 20 nt, Bordetella pertussis
ccgcggcgcuggauggcucg

SEQ ID NO: 2417813 - RNA, 15 nt, Bordetella pertussis
ccgcggcgggcuugg

SEQ ID NO: 2417814 - RNA, 18 nt, Bordetella pertussis
ccgcggcgguccugcuga

SEQ ID NO: 2417815 - RNA, 20 nt, Bordetella pertussis
ccgcggcgguuucggccggg

SEQ ID NO: 2417816 - RNA, 23 nt, Bordetella pertussis
ccgcggcguccgaauacgccacg

SEQ ID NO: 2417817 - RNA, 16 nt, Bordetella pertussis
ccgcggcguccgcgcc

SEQ ID NO: 2417818 - RNA, 17 nt, Bordetella pertussis
ccgcggcguccgcgccg

SEQ ID NO: 2417819 - RNA, 18 nt, Bordetella pertussis
ccgcggcguccgcgccga

SEQ ID NO: 2417820 - RNA, 13 nt, Bordetella pertussis
ccgcggcgugcug

SEQ ID NO: 2417821 - RNA, 14 nt, Bordetella pertussis
ccgcggcgugcugc

SEQ ID NO: 2417822 - RNA, 19 nt, Bordetella pertussis
ccgcggcuugccgcggcgc

SEQ ID NO: 2417823 - RNA, 14 nt, Bordetella pertussis
ccgcgggccgcugg

SEQ ID NO: 2417824 - RNA, 20 nt, Bordetella pertussis
ccgcgggccuacuugccggc

SEQ ID NO: 2417825 - RNA, 23 nt, Bordetella pertussis
ccgcgggccuacuugccggcgcu

SEQ ID NO: 2417826 - RNA, 13 nt, Bordetella pertussis
ccgcgggccugcu

SEQ ID NO: 2417827 - RNA, 19 nt, Bordetella pertussis
ccgcgggcgcccggccggc

SEQ ID NO: 2417828 - RNA, 16 nt, Bordetella pertussis
ccgcgggcgcgcgccc

SEQ ID NO: 2417829 - RNA, 18 nt, Bordetella pertussis
ccgcgggcgcgcgccccg

SEQ ID NO: 2417830 - RNA, 15 nt, Bordetella pertussis
ccgcgggcggcgccg

SEQ ID NO: 2417831 - RNA, 17 nt, Bordetella pertussis
ccgcgggcggcgcgccc

SEQ ID NO: 2417832 - RNA, 14 nt, Bordetella pertussis
ccgcgggcgggccg

SEQ ID NO: 2417833 - RNA, 22 nt, Bordetella pertussis
ccgcgggcgugcuggcacuguc

SEQ ID NO: 2417834 - RNA, 22 nt, Bordetella pertussis
ccgcgggcugcgacaggcgcag

SEQ ID NO: 2417835 - RNA, 16 nt, Bordetella pertussis
ccgcggggacaggcac

SEQ ID NO: 2417836 - RNA, 18 nt, Bordetella pertussis
ccgcggggacaggcaccc

SEQ ID NO: 2417837 - RNA, 20 nt, Bordetella pertussis
ccgcggggacaggcaccccg

SEQ ID NO: 2417838 - RNA, 23 nt, Bordetella pertussis
ccgcggggacaggcaccccguca

SEQ ID NO: 2417839 - RNA, 21 nt, Bordetella pertussis
ccgcggggacaggcacccgca

SEQ ID NO: 2417840 - RNA, 19 nt, Bordetella pertussis
ccgcggggacaggcacccu

SEQ ID NO: 2417841 - RNA, 20 nt, Bordetella pertussis
ccgcggggacaggcaccgcc

SEQ ID NO: 2417842 - RNA, 22 nt, Bordetella pertussis
ccgcggggacaggcaccgccgc

SEQ ID NO: 2417843 - RNA, 19 nt, Bordetella pertussis
ccgcggggacaggcucccg

SEQ ID NO: 2417844 - RNA, 11 nt, Bordetella pertussis
ccgcggggcug

SEQ ID NO: 2417845 - RNA, 14 nt, Bordetella pertussis
ccgcggggcuggcc

SEQ ID NO: 2417846 - RNA, 16 nt, Bordetella pertussis
ccgcggggcuggccag

SEQ ID NO: 2417847 - RNA, 17 nt, Bordetella pertussis
ccgcggggguggacgcc

SEQ ID NO: 2417848 - RNA, 20 nt, Bordetella pertussis
ccgcggggguggacgccaag

SEQ ID NO: 2417849 - RNA, 16 nt, Bordetella pertussis
ccgcggguggccgcuc

SEQ ID NO: 2417850 - RNA, 18 nt, Bordetella pertussis
ccgcggguucgcccggug

SEQ ID NO: 2417851 - RNA, 18 nt, Bordetella pertussis
ccgcgguaaugacgcagc

SEQ ID NO: 2417852 - RNA, 17 nt, Bordetella pertussis
ccgcgguacgcgggcau

SEQ ID NO: 2417853 - RNA, 14 nt, Bordetella pertussis
ccgcggucagccag

SEQ ID NO: 2417854 - RNA, 14 nt, Bordetella pertussis
ccgcgguccagcac

SEQ ID NO: 2417855 - RNA, 17 nt, Bordetella pertussis
ccgcgguccagcacggc

SEQ ID NO: 2417856 - RNA, 16 nt, Bordetella pertussis
ccgcgguccgggccau

SEQ ID NO: 2417857 - RNA, 22 nt, Bordetella pertussis
ccgcgguccgggccauccgucc

SEQ ID NO: 2417858 - RNA, 17 nt, Bordetella pertussis
ccgcggucgagacgaug

SEQ ID NO: 2417859 - RNA, 24 nt, Bordetella pertussis
ccgcggucgagacgauggccgaau

SEQ ID NO: 2417860 - RNA, 13 nt, Bordetella pertussis
ccgcggucgcaga

SEQ ID NO: 2417861 - RNA, 15 nt, Bordetella pertussis
ccgcggugccgcgcg

SEQ ID NO: 2417862 - RNA, 22 nt, Bordetella pertussis
ccgcggugcugggcuuugccug

SEQ ID NO: 2417863 - RNA, 14 nt, Bordetella pertussis
ccgcgguggcgggc

SEQ ID NO: 2417864 - RNA, 19 nt, Bordetella pertussis
ccgcgguggcgggcgugcg

SEQ ID NO: 2417865 - RNA, 23 nt, Bordetella pertussis
ccgcgguggggcaguugaccaug

SEQ ID NO: 2417866 - RNA, 19 nt, Bordetella pertussis
ccgcggugguccagauugc

SEQ ID NO: 2417867 - RNA, 16 nt, Bordetella pertussis
ccgcguacaacgccgc

SEQ ID NO: 2417868 - RNA, 18 nt, Bordetella pertussis
ccgcguacuuccucgacc

SEQ ID NO: 2417869 - RNA, 23 nt, Bordetella pertussis
ccgcguacuuccucgaccagccc

SEQ ID NO: 2417870 - RNA, 19 nt, Bordetella pertussis
ccgcguaggccuucaccuu

SEQ ID NO: 2417871 - RNA, 18 nt, Bordetella pertussis
ccgcguaggcggucagcu

SEQ ID NO: 2417872 - RNA, 13 nt, Bordetella pertussis
ccgcguaguuguc

SEQ ID NO: 2417873 - RNA, 18 nt, Bordetella pertussis
ccgcguaguugucggcgc

SEQ ID NO: 2417874 - RNA, 21 nt, Bordetella pertussis
ccgcguaguugucggcgcaga

SEQ ID NO: 2417875 - RNA, 16 nt, Bordetella pertussis
ccgcguaugcggcagc

SEQ ID NO: 2417876 - RNA, 15 nt, Bordetella pertussis
ccgcgucagacgcgc

SEQ ID NO: 2417877 - RNA, 22 nt, Bordetella pertussis
ccgcgucauggcgugcgcgacc

SEQ ID NO: 2417878 - RNA, 19 nt, Bordetella pertussis
ccgcgucccgugccggccg

SEQ ID NO: 2417879 - RNA, 14 nt, Bordetella pertussis
ccgcguccgcccgc

SEQ ID NO: 2417880 - RNA, 15 nt, Bordetella pertussis
ccgcguccgcccgcu

SEQ ID NO: 2417881 - RNA, 17 nt, Bordetella pertussis
ccgcguccggcgcccgc

SEQ ID NO: 2417882 - RNA, 15 nt, Bordetella pertussis
ccgcguccucggccu

SEQ ID NO: 2417883 - RNA, 18 nt, Bordetella pertussis
ccgcguccucggccuggc

SEQ ID NO: 2417884 - RNA, 20 nt, Bordetella pertussis
ccgcgucgaaauaggauccc

SEQ ID NO: 2417885 - RNA, 12 nt, Bordetella pertussis
ccgcgucgagcg

SEQ ID NO: 2417886 - RNA, 21 nt, Bordetella pertussis
ccgcgucgagcgcgacgcgcu

SEQ ID NO: 2417887 - RNA, 18 nt, Bordetella pertussis
ccgcgucgaucagcgcgg

SEQ ID NO: 2417888 - RNA, 19 nt, Bordetella pertussis
ccgcgucgaucagcgcggg

SEQ ID NO: 2417889 - RNA, 16 nt, Bordetella pertussis
ccgcgucgauccggca

SEQ ID NO: 2417890 - RNA, 14 nt, Bordetella pertussis
ccgcgucgcuggcc

SEQ ID NO: 2417891 - RNA, 19 nt, Bordetella pertussis
ccgcuggccgaucugcugg

SEQ ID NO: 2417892 - RNA, 16 nt, Bordetella pertussis
ccgcuggccgucgccg

SEQ ID NO: 2417893 - RNA, 22 nt, Bordetella pertussis
ccgcuggccgucgccgcccugc

SEQ ID NO: 2417894 - RNA, 19 nt, Bordetella pertussis
ccgcuggcgaucaggccgc

SEQ ID NO: 2417895 - RNA, 21 nt, Bordetella pertussis
ccgcuggcgaucaggccgccc

SEQ ID NO: 2417896 - RNA, 23 nt, Bordetella pertussis
ccgcuggcgaucaggccgcccca

SEQ ID NO: 2417897 - RNA, 14 nt, Bordetella pertussis
ccgcuggcgcgccg

SEQ ID NO: 2417898 - RNA, 12 nt, Bordetella pertussis
ccgcuggcggca

SEQ ID NO: 2417899 - RNA, 18 nt, Bordetella pertussis
ccgcuggcggcacacgca

SEQ ID NO: 2417900 - RNA, 16 nt, Bordetella pertussis
ccgcuggcggccgcgg

SEQ ID NO: 2417901 - RNA, 23 nt, Bordetella pertussis
ccgcuggcggccgcgggcgugcu

SEQ ID NO: 2417902 - RNA, 19 nt, Bordetella pertussis
ccgcuggcgucgcgcuucu

SEQ ID NO: 2417903 - RNA, 13 nt, Bordetella pertussis
ccgcugggacagg

SEQ ID NO: 2417904 - RNA, 15 nt, Bordetella pertussis
ccgcugggacaggca

SEQ ID NO: 2417905 - RNA, 18 nt, Bordetella pertussis
ccgcugggacaggcacac

SEQ ID NO: 2417906 - RNA, 19 nt, Bordetella pertussis
ccgcugggacaggcacacc

SEQ ID NO: 2417907 - RNA, 21 nt, Bordetella pertussis
ccgcugggacaggcacacccu

SEQ ID NO: 2417908 - RNA, 20 nt, Bordetella pertussis
ccgcugggacaggcacaccg

SEQ ID NO: 2417909 - RNA, 19 nt, Bordetella pertussis
ccgcugggacaggcacucu

SEQ ID NO: 2417910 - RNA, 21 nt, Bordetella pertussis
ccgcugggcacauccagcgcc

SEQ ID NO: 2417911 - RNA, 14 nt, Bordetella pertussis
ccgcugggccagca

SEQ ID NO: 2417912 - RNA, 23 nt, Bordetella pertussis
ccgcugggggcgguaccguccug

SEQ ID NO: 2417913 - RNA, 15 nt, Bordetella pertussis
ccgcuggucaccgcc

SEQ ID NO: 2417914 - RNA, 16 nt, Bordetella pertussis
ccgcuggucaccgccc

SEQ ID NO: 2417915 - RNA, 18 nt, Bordetella pertussis
ccgcuggucaccgccccg

SEQ ID NO: 2417916 - RNA, 17 nt, Bordetella pertussis
ccgcuggucguaucgcc

SEQ ID NO: 2417917 - RNA, 18 nt, Bordetella pertussis
ccgcuggugaucugcugc

SEQ ID NO: 2417918 - RNA, 22 nt, Bordetella pertussis
ccgcuggugaucugcugcgugg

SEQ ID NO: 2417919 - RNA, 13 nt, Bordetella pertussis
ccgcuggugcuga

SEQ ID NO: 2417920 - RNA, 16 nt, Bordetella pertussis
ccgcuguaccguucgc

SEQ ID NO: 2417921 - RNA, 13 nt, Bordetella pertussis
ccgcugucgcagg

SEQ ID NO: 2417922 - RNA, 22 nt, Bordetella pertussis
ccgcugucgcugaucugcuuga

SEQ ID NO: 2417923 - RNA, 21 nt, Bordetella pertussis
ccgcugugcgcguuccggccg

SEQ ID NO: 2417924 - RNA, 16 nt, Bordetella pertussis
ccgcuguggacgccgc

SEQ ID NO: 2417925 - RNA, 17 nt, Bordetella pertussis
ccgcuguggacgccgcc

SEQ ID NO: 2417926 - RNA, 18 nt, Bordetella pertussis
ccgcuguggacgccgccg

SEQ ID NO: 2417927 - RNA, 21 nt, Bordetella pertussis
ccgcuguggacgccgccggcc

SEQ ID NO: 2417928 - RNA, 14 nt, Bordetella pertussis
ccgcuguggcgcgc

SEQ ID NO: 2417929 - RNA, 16 nt, Bordetella pertussis
ccgcuguggcgcgcca

SEQ ID NO: 2417930 - RNA, 21 nt, Bordetella pertussis
ccgcuguucggcgagccgggc

SEQ ID NO: 2417931 - RNA, 23 nt, Bordetella pertussis
ccgcuguucggcgagccgggcac

SEQ ID NO: 2417932 - RNA, 17 nt, Bordetella pertussis
ccgcuguugcccaccag

SEQ ID NO: 2417933 - RNA, 23 nt, Bordetella pertussis
ccgcuguugcccaccagccgggc

SEQ ID NO: 2417934 - RNA, 15 nt, Bordetella pertussis
ccgcuuccaccgucu

SEQ ID NO: 2417935 - RNA, 21 nt, Bordetella pertussis
ccgcuuccgccaccgcgccgc

SEQ ID NO: 2417936 - RNA, 22 nt, Bordetella pertussis
ccgcuuccggcaugaccgcgga

SEQ ID NO: 2417937 - RNA, 16 nt, Bordetella pertussis
ccgcuuccggccgggc

SEQ ID NO: 2417938 - RNA, 18 nt, Bordetella pertussis
ccgcuuccggccgggcca

SEQ ID NO: 2417939 - RNA, 19 nt, Bordetella pertussis
ccgcuuccggccgggccag

SEQ ID NO: 2417940 - RNA, 14 nt, Bordetella pertussis
ccgcuuccugcugc

SEQ ID NO: 2417941 - RNA, 16 nt, Bordetella pertussis
ccgcuuccugcugcgc

SEQ ID NO: 2417942 - RNA, 21 nt, Bordetella pertussis
ccgcuucgaugcuggcggcau

SEQ ID NO: 2417943 - RNA, 15 nt, Bordetella pertussis
ccgcuucggacagca

SEQ ID NO: 2417944 - RNA, 13 nt, Bordetella pertussis
ccgcuucggcggc

SEQ ID NO: 2417945 - RNA, 14 nt, Bordetella pertussis
ccgcuucggcggcc

SEQ ID NO: 2417946 - RNA, 16 nt, Bordetella pertussis
ccgcuucggcggccgc

SEQ ID NO: 2417947 - RNA, 17 nt, Bordetella pertussis
ccgcuucggcggccgcg

SEQ ID NO: 2417948 - RNA, 14 nt, Bordetella pertussis
ccgcuucgggccgg

SEQ ID NO: 2417949 - RNA, 14 nt, Bordetella pertussis
ccgcuucgucgggc

SEQ ID NO: 2417950 - RNA, 16 nt, Bordetella pertussis
ccgcuucgucgggcag

SEQ ID NO: 2417951 - RNA, 21 nt, Bordetella pertussis
ccgcuucuucgucgcgccaga

SEQ ID NO: 2417952 - RNA, 19 nt, Bordetella pertussis
ccgcuugcguucaugccgg

SEQ ID NO: 2417953 - RNA, 18 nt, Bordetella pertussis
ccgcuugggccgcgccug

SEQ ID NO: 2417954 - RNA, 19 nt, Bordetella pertussis
ccgcuugggccgcgccugc

SEQ ID NO: 2417955 - RNA, 22 nt, Bordetella pertussis
ccgcuugucgaugacgcgccgc

SEQ ID NO: 2417956 - RNA, 15 nt, Bordetella pertussis
ccgcuuucgaccagc

SEQ ID NO: 2417957 - RNA, 21 nt, Bordetella pertussis
ccggaaagcuguccacgccga

SEQ ID NO: 2417958 - RNA, 22 nt, Bordetella pertussis
ccggaaagcuguccacgccgaa

SEQ ID NO: 2417959 - RNA, 16 nt, Bordetella pertussis
ccggaaaucacgaucu

SEQ ID NO: 2417960 - RNA, 13 nt, Bordetella pertussis
ccggaacaccagc

SEQ ID NO: 2417961 - RNA, 23 nt, Bordetella pertussis
ccggaacagcguccagccgcccg

SEQ ID NO: 2417962 - RNA, 13 nt, Bordetella pertussis
ccggaacauggcg

SEQ ID NO: 2417963 - RNA, 17 nt, Bordetella pertussis
ccggaauaccgccagcu

SEQ ID NO: 2417964 - RNA, 20 nt, Bordetella pertussis
ccggaauagauaugggccug

SEQ ID NO: 2417965 - RNA, 22 nt, Bordetella pertussis
ccggaauagauaugggccugau

SEQ ID NO: 2417966 - RNA, 23 nt, Bordetella pertussis
ccggaauagauaugggccugauc

SEQ ID NO: 2417967 - RNA, 23 nt, Bordetella pertussis
ccggaaucaccgccgcgaccggg

SEQ ID NO: 2417968 - RNA, 13 nt, Bordetella pertussis
ccggaauccacag

SEQ ID NO: 2417969 - RNA, 14 nt, Bordetella pertussis
ccggacaacgcgcg

SEQ ID NO: 2417970 - RNA, 13 nt, Bordetella pertussis
ccggacaagcccc

SEQ ID NO: 2417971 - RNA, 18 nt, Bordetella pertussis
ccggacaagccccuccga

SEQ ID NO: 2417972 - RNA, 22 nt, Bordetella pertussis
ccggacacguacaaccgcgccg

SEQ ID NO: 2417973 - RNA, 23 nt, Bordetella pertussis
ccggacacguacaaccgcgccga

SEQ ID NO: 2417974 - RNA, 16 nt, Bordetella pertussis
ccggacccgcgccgca

SEQ ID NO: 2417975 - RNA, 23 nt, Bordetella pertussis
ccggaccgcgcugcggucagcug

SEQ ID NO: 2417976 - RNA, 11 nt, Bordetella pertussis
ccggaccggug

SEQ ID NO: 2417977 - RNA, 17 nt, Bordetella pertussis
ccggaccggugcccucg

SEQ ID NO: 2417978 - RNA, 15 nt, Bordetella pertussis
ccggacgcggccggc

SEQ ID NO: 2417979 - RNA, 22 nt, Bordetella pertussis
ccggacggcgccuugacgcugc

SEQ ID NO: 2417980 - RNA, 13 nt, Bordetella pertussis
ccggacgugggcg

SEQ ID NO: 2417981 - RNA, 21 nt, Bordetella pertussis
ccggacgugggcgccuacggc

SEQ ID NO: 2417982 - RNA, 20 nt, Bordetella pertussis
ccggacuggauauggcgccg

SEQ ID NO: 2417983 - RNA, 21 nt, Bordetella pertussis
ccggacuggauauggcgccgc

SEQ ID NO: 2417984 - RNA, 19 nt, Bordetella pertussis
ccggacugggcgucgcucu

SEQ ID NO: 2417985 - RNA, 20 nt, Bordetella pertussis
ccggacugggcgucgcucug

SEQ ID NO: 2417986 - RNA, 14 nt, Bordetella pertussis
ccggagcagcagcg

SEQ ID NO: 2417987 - RNA, 15 nt, Bordetella pertussis
ccggagcagcagcgg

SEQ ID NO: 2417988 - RNA, 20 nt, Bordetella pertussis
ccggagcagucgcgcagcca

SEQ ID NO: 2417989 - RNA, 21 nt, Bordetella pertussis
ccggagcauggcaugagcgcc

SEQ ID NO: 2417990 - RNA, 12 nt, Bordetella pertussis
ccggagcggcuc

SEQ ID NO: 2417991 - RNA, 16 nt, Bordetella pertussis
ccggagcggcucgccg

SEQ ID NO: 2417992 - RNA, 14 nt, Bordetella pertussis
ccggaggccgccca

SEQ ID NO: 2417993 - RNA, 12 nt, Bordetella pertussis
ccggaggcgccg

SEQ ID NO: 2417994 - RNA, 14 nt, Bordetella pertussis
ccggaggcgccgcg

SEQ ID NO: 2417995 - RNA, 15 nt, Bordetella pertussis
ccggaggcgccgcgg

SEQ ID NO: 2417996 - RNA, 13 nt, Bordetella pertussis
ccggaggcgcgca

SEQ ID NO: 2417997 - RNA, 15 nt, Bordetella pertussis
ccggaggcgcgcagc

SEQ ID NO: 2417998 - RNA, 16 nt, Bordetella pertussis
ccggaggggacagagu

SEQ ID NO: 2417999 - RNA, 14 nt, Bordetella pertussis
ccggaggucggcgc

SEQ ID NO: 2418000 - RNA, 14 nt, Bordetella pertussis
ccggauaccgccgc

SEQ ID NO: 2418001 - RNA, 15 nt, Bordetella pertussis
ccggauaccgccgcc

SEQ ID NO: 2418002 - RNA, 16 nt, Bordetella pertussis
ccggauaccgccgccg

SEQ ID NO: 2418003 - RNA, 18 nt, Bordetella pertussis
ccggauaccgccgccgcu

SEQ ID NO: 2418004 - RNA, 20 nt, Bordetella pertussis
ccggcagggugacgggcugg

SEQ ID NO: 2418005 - RNA, 22 nt, Bordetella pertussis
ccggcaggucgaucuccacgaa

SEQ ID NO: 2418006 - RNA, 23 nt, Bordetella pertussis
ccggcagugccugcgaacgcccg

SEQ ID NO: 2418007 - RNA, 15 nt, Bordetella pertussis
ccggcauaggcggcg

SEQ ID NO: 2418008 - RNA, 16 nt, Bordetella pertussis
ccggcauaggcggcgc

SEQ ID NO: 2418009 - RNA, 14 nt, Bordetella pertussis
ccggcaugaagcgc

SEQ ID NO: 2418010 - RNA, 21 nt, Bordetella pertussis
ccggcaugaccgcggacgcca

SEQ ID NO: 2418011 - RNA, 23 nt, Bordetella pertussis
ccggcaugccguccacgcccagc

SEQ ID NO: 2418012 - RNA, 18 nt, Bordetella pertussis
ccggcaugcgccggcccg

SEQ ID NO: 2418013 - RNA, 14 nt, Bordetella pertussis
ccggcaugggcgug

SEQ ID NO: 2418014 - RNA, 17 nt, Bordetella pertussis
ccggcaugggcgugccg

SEQ ID NO: 2418015 - RNA, 23 nt, Bordetella pertussis
ccggcaugggcgugccgcgcugg

SEQ ID NO: 2418016 - RNA, 21 nt, Bordetella pertussis
ccggcaugguguaccgggccg

SEQ ID NO: 2418017 - RNA, 23 nt, Bordetella pertussis
ccggcaugguguaccgggccgac

SEQ ID NO: 2418018 - RNA, 18 nt, Bordetella pertussis
ccggcauguugccgcugg

SEQ ID NO: 2418019 - RNA, 24 nt, Bordetella pertussis
ccggcauguugccgcuggugcuga

SEQ ID NO: 2418020 - RNA, 17 nt, Bordetella pertussis
ccggcauugcccaccac

SEQ ID NO: 2418021 - RNA, 22 nt, Bordetella pertussis
ccggcauuucgcugggcgcgca

SEQ ID NO: 2418022 - RNA, 15 nt, Bordetella pertussis
ccggccaagcuccag

SEQ ID NO: 2418023 - RNA, 21 nt, Bordetella pertussis
ccggccaagcuggagaagcgc

SEQ ID NO: 2418024 - RNA, 17 nt, Bordetella pertussis
ccggccaaggcaagcag

SEQ ID NO: 2418025 - RNA, 12 nt, Bordetella pertussis
ccggccaccagc

SEQ ID NO: 2418026 - RNA, 15 nt, Bordetella pertussis
ccggccaccagcggc

SEQ ID NO: 2418027 - RNA, 19 nt, Bordetella pertussis
ccggccaccucuucagccc

SEQ ID NO: 2418028 - RNA, 20 nt, Bordetella pertussis
ccggccaccucuucagcccg

SEQ ID NO: 2418029 - RNA, 21 nt, Bordetella pertussis
ccggccacgcgcugcagcagc

SEQ ID NO: 2418030 - RNA, 22 nt, Bordetella pertussis
ccggccacgcgcugcagcagca

SEQ ID NO: 2418031 - RNA, 15 nt, Bordetella pertussis
ccggccacggccggg

SEQ ID NO: 2418032 - RNA, 14 nt, Bordetella pertussis
ccggccacgugugg

SEQ ID NO: 2418033 - RNA, 18 nt, Bordetella pertussis
ccggccagagccuggaag

SEQ ID NO: 2418034 - RNA, 12 nt, Bordetella pertussis
ccggccagcacg

SEQ ID NO: 2418035 - RNA, 13 nt, Bordetella pertussis
ccggccagcacgc

SEQ ID NO: 2418036 - RNA, 16 nt, Bordetella pertussis
ccggccagcacgccgg

SEQ ID NO: 2418037 - RNA, 19 nt, Bordetella pertussis
ccggccagcacgccggcgg

SEQ ID NO: 2418038 - RNA, 14 nt, Bordetella pertussis
ccggccagcacggg

SEQ ID NO: 2418039 - RNA, 11 nt, Bordetella pertussis
ccggccagcca

SEQ ID NO: 2418040 - RNA, 18 nt, Bordetella pertussis
ccggccagccauugccgc

SEQ ID NO: 2418041 - RNA, 14 nt, Bordetella pertussis
ccggccagccugcc

SEQ ID NO: 2418042 - RNA, 18 nt, Bordetella pertussis
ccggccagccugcccguc

SEQ ID NO: 2418043 - RNA, 17 nt, Bordetella pertussis
ccggccagcgccaccac

SEQ ID NO: 2418044 - RNA, 14 nt, Bordetella pertussis
ccggccagcgccug

SEQ ID NO: 2418045 - RNA, 17 nt, Bordetella pertussis
ccggccagcgccugggc

SEQ ID NO: 2418046 - RNA, 18 nt, Bordetella pertussis
ccggccagcgccugggcg

SEQ ID NO: 2418047 - RNA, 16 nt, Bordetella pertussis
ccggccagcgcgccgg

SEQ ID NO: 2418048 - RNA, 17 nt, Bordetella pertussis
ccggccagcgcgccggc

SEQ ID NO: 2418049 - RNA, 21 nt, Bordetella pertussis
ccggccagcgcgccggccagg

SEQ ID NO: 2418050 - RNA, 18 nt, Bordetella pertussis
ccggccagcgcggcaucg

SEQ ID NO: 2418051 - RNA, 14 nt, Bordetella pertussis
ccggccagcgcggu

SEQ ID NO: 2418052 - RNA, 15 nt, Bordetella pertussis
ccggccagcggcagg

SEQ ID NO: 2418053 - RNA, 12 nt, Bordetella pertussis
ccggccagcugc

SEQ ID NO: 2418054 - RNA, 12 nt, Bordetella pertussis
ccggccagcuug

SEQ ID NO: 2418055 - RNA, 18 nt, Bordetella pertussis
ccggccagcuugagcagg

SEQ ID NO: 2418056 - RNA, 20 nt, Bordetella pertussis
ccggccaggacgaucccggc

SEQ ID NO: 2418057 - RNA, 21 nt, Bordetella pertussis
ccggccaggacgaucccggcc

SEQ ID NO: 2418058 - RNA, 13 nt, Bordetella pertussis
ccggccaggauga

SEQ ID NO: 2418059 - RNA, 16 nt, Bordetella pertussis
ccggccaggcgccggc

SEQ ID NO: 2418060 - RNA, 18 nt, Bordetella pertussis
ccggccaggcgccggcgg

SEQ ID NO: 2418061 - RNA, 13 nt, Bordetella pertussis
ccggccaggcgcg

SEQ ID NO: 2418062 - RNA, 16 nt, Bordetella pertussis
ccggccagggccacgc

SEQ ID NO: 2418063 - RNA, 23 nt, Bordetella pertussis
ccggccagggccacgccggccgc

SEQ ID NO: 2418064 - RNA, 22 nt, Bordetella pertussis
ccggccagggcgaugcggcggc

SEQ ID NO: 2418065 - RNA, 16 nt, Bordetella pertussis
accggccccaccuggc

SEQ ID NO: 2418066 - RNA, 17 nt, Bordetella pertussis
accggccccaccuggcg

SEQ ID NO: 2418067 - RNA, 20 nt, Bordetella pertussis
accggccccaucauguugua

SEQ ID NO: 2418068 - RNA, 12 nt, Bordetella pertussis
accggccgccgc

SEQ ID NO: 2418069 - RNA, 21 nt, Bordetella pertussis
accggccgcggguggccgcuc

SEQ ID NO: 2418070 - RNA, 14 nt, Bordetella pertussis
accggccuggucau

SEQ ID NO: 2418071 - RNA, 14 nt, Bordetella pertussis
accggcgaccaccg

SEQ ID NO: 2418072 - RNA, 16 nt, Bordetella pertussis
accggcgccugcggca

SEQ ID NO: 2418073 - RNA, 16 nt, Bordetella pertussis
accggcgccuggccca

SEQ ID NO: 2418074 - RNA, 18 nt, Bordetella pertussis
accggcgccuggcccaga

SEQ ID NO: 2418075 - RNA, 18 nt, Bordetella pertussis
accggcgcgccuggcgcg

SEQ ID NO: 2418076 - RNA, 19 nt, Bordetella pertussis
accggcgcgccuggcgcgc

SEQ ID NO: 2418077 - RNA, 19 nt, Bordetella pertussis
accggcgcgcgcggccagu

SEQ ID NO: 2418078 - RNA, 20 nt, Bordetella pertussis
accggcgcgcgcggccaguu

SEQ ID NO: 2418079 - RNA, 11 nt, Bordetella pertussis
accggcgcggc

SEQ ID NO: 2418080 - RNA, 12 nt, Bordetella pertussis
accggcggcacc

SEQ ID NO: 2418081 - RNA, 14 nt, Bordetella pertussis
accggcggcaccau

SEQ ID NO: 2418082 - RNA, 23 nt, Bordetella pertussis
accggcggcaccauugccggcgc

SEQ ID NO: 2418083 - RNA, 18 nt, Bordetella pertussis
accggcguauggcccgcc

SEQ ID NO: 2418084 - RNA, 16 nt, Bordetella pertussis
accggcgugacgcgcg

SEQ ID NO: 2418085 - RNA, 20 nt, Bordetella pertussis
accggcgugcgcuggcuggg

SEQ ID NO: 2418086 - RNA, 22 nt, Bordetella pertussis
accggcgugcgcuggcugggcc

SEQ ID NO: 2418087 - RNA, 23 nt, Bordetella pertussis
accggcgugcgcuggcugggccu

SEQ ID NO: 2418088 - RNA, 20 nt, Bordetella pertussis
accggcguguccagcggcgc

SEQ ID NO: 2418089 - RNA, 17 nt, Bordetella pertussis
accggcguucuggcgca

SEQ ID NO: 2418090 - RNA, 15 nt, Bordetella pertussis
accggcuacgaccug

SEQ ID NO: 2418091 - RNA, 15 nt, Bordetella pertussis
accggcucgaucgcc

SEQ ID NO: 2418092 - RNA, 23 nt, Bordetella pertussis
accggcucgaucgccgccggcac

SEQ ID NO: 2418093 - RNA, 19 nt, Bordetella pertussis
accggcucgggcucgagcc

SEQ ID NO: 2418094 - RNA, 18 nt, Bordetella pertussis
accggcugcaugcgcgaa

SEQ ID NO: 2418095 - RNA, 19 nt, Bordetella pertussis
accggcuuggccucggccg

SEQ ID NO: 2418096 - RNA, 21 nt, Bordetella pertussis
accggcuuggccucggccggc

SEQ ID NO: 2418097 - RNA, 15 nt, Bordetella pertussis
accggcuuggggcgc

SEQ ID NO: 2418098 - RNA, 17 nt, Bordetella pertussis
accggcuuggggcgcgc

SEQ ID NO: 2418099 - RNA, 18 nt, Bordetella pertussis
accggcuuggggcgcgcc

SEQ ID NO: 2418100 - RNA, 18 nt, Bordetella pertussis
accgggaauggcgccgug

SEQ ID NO: 2418101 - RNA, 12 nt, Bordetella pertussis
accgggacaggc

SEQ ID NO: 2418102 - RNA, 13 nt, Bordetella pertussis
accgggacaggca

SEQ ID NO: 2418103 - RNA, 22 nt, Bordetella pertussis
accgggcccggaucauccgggc

SEQ ID NO: 2418104 - RNA, 22 nt, Bordetella pertussis
accgggccgaccaggccggcgg

SEQ ID NO: 2418105 - RNA, 16 nt, Bordetella pertussis
accgggccgacgcgcc

SEQ ID NO: 2418106 - RNA, 16 nt, Bordetella pertussis
accgggccggccugcg

SEQ ID NO: 2418107 - RNA, 13 nt, Bordetella pertussis
accgggcggcccg

SEQ ID NO: 2418108 - RNA, 21 nt, Bordetella pertussis
accggggcguccaccgccgau

SEQ ID NO: 2418109 - RNA, 14 nt, Bordetella pertussis
accgggucgggcgu

SEQ ID NO: 2418110 - RNA, 22 nt, Bordetella pertussis
accggguuuccagcccguggac

SEQ ID NO: 2418111 - RNA, 14 nt, Bordetella pertussis
accgguagcccgcg

SEQ ID NO: 2418112 - RNA, 14 nt, Bordetella pertussis
accggucggccggc

SEQ ID NO: 2418113 - RNA, 18 nt, Bordetella pertussis
accggucggccggcagcg

SEQ ID NO: 2418114 - RNA, 20 nt, Bordetella pertussis
accggugaucagcaggccca

SEQ ID NO: 2418115 - RNA, 19 nt, Bordetella pertussis
accgguggccauggacagc

SEQ ID NO: 2418116 - RNA, 16 nt, Bordetella pertussis
accgguugcagcgcgc

SEQ ID NO: 2418117 - RNA, 22 nt, Bordetella pertussis
ccggccgauggcaucgccccgg

SEQ ID NO: 2418118 - RNA, 22 nt, Bordetella pertussis
ccggccgcacugggugacgcug

SEQ ID NO: 2418119 - RNA, 14 nt, Bordetella pertussis
ccggccgccagcau

SEQ ID NO: 2418120 - RNA, 13 nt, Bordetella pertussis
ccggccgccaugg

SEQ ID NO: 2418121 - RNA, 19 nt, Bordetella pertussis
ccggccgccauggccggcg

SEQ ID NO: 2418122 - RNA, 15 nt, Bordetella pertussis
ccggccgcccaggcg

SEQ ID NO: 2418123 - RNA, 16 nt, Bordetella pertussis
ccggccgcccaggcgc

SEQ ID NO: 2418124 - RNA, 19 nt, Bordetella pertussis
ccggccgcccaggcgcagc

SEQ ID NO: 2418125 - RNA, 23 nt, Bordetella pertussis
ccggccgcccaggcgcagccgcg

SEQ ID NO: 2418126 - RNA, 17 nt, Bordetella pertussis
ccggccgcccgccugcc

SEQ ID NO: 2418127 - RNA, 15 nt, Bordetella pertussis
ccggccgccgaacga

SEQ ID NO: 2418128 - RNA, 14 nt, Bordetella pertussis
ccggccgccgccgg

SEQ ID NO: 2418129 - RNA, 14 nt, Bordetella pertussis
ccggccgccucacc

SEQ ID NO: 2418130 - RNA, 13 nt, Bordetella pertussis
ccggccgccucca

SEQ ID NO: 2418131 - RNA, 18 nt, Bordetella pertussis
ccggccgccuccaggcgg

SEQ ID NO: 2418132 - RNA, 19 nt, Bordetella pertussis
ccggccgccuccaggcggc

SEQ ID NO: 2418133 - RNA, 15 nt, Bordetella pertussis
ccggccgccuggccc

SEQ ID NO: 2418134 - RNA, 16 nt, Bordetella pertussis
ccggccgcgcaaggcg

SEQ ID NO: 2418135 - RNA, 19 nt, Bordetella pertussis
ccggccgcgcggccgucag

SEQ ID NO: 2418136 - RNA, 15 nt, Bordetella pertussis
ccggccgcggggcug

SEQ ID NO: 2418137 - RNA, 19 nt, Bordetella pertussis
ccggccgcggggcuggcca

SEQ ID NO: 2418138 - RNA, 15 nt, Bordetella pertussis
ccggccgcguggccg

SEQ ID NO: 2418139 - RNA, 13 nt, Bordetella pertussis
ccggccggcacgg

SEQ ID NO: 2418140 - RNA, 16 nt, Bordetella pertussis
ccggccggcacggccg

SEQ ID NO: 2418141 - RNA, 20 nt, Bordetella pertussis
ccggccggcacggccggcca

SEQ ID NO: 2418142 - RNA, 14 nt, Bordetella pertussis
ccggccggccagua

SEQ ID NO: 2418143 - RNA, 15 nt, Bordetella pertussis
ccggccggcccugcg

SEQ ID NO: 2418144 - RNA, 13 nt, Bordetella pertussis
ccggccggcgccg

SEQ ID NO: 2418145 - RNA, 15 nt, Bordetella pertussis
ccggccggcgccggc

SEQ ID NO: 2418146 - RNA, 18 nt, Bordetella pertussis
ccggccggcgccggcaaa

SEQ ID NO: 2418147 - RNA, 14 nt, Bordetella pertussis
ccggccgggccagc

SEQ ID NO: 2418148 - RNA, 15 nt, Bordetella pertussis
ccggccgggccagua

SEQ ID NO: 2418149 - RNA, 21 nt, Bordetella pertussis
ccggccgggcgcggcgcccgc

SEQ ID NO: 2418150 - RNA, 17 nt, Bordetella pertussis
ccggccggugggugugg

SEQ ID NO: 2418151 - RNA, 22 nt, Bordetella pertussis
ccggccgguuccugcaaggccg

SEQ ID NO: 2418152 - RNA, 12 nt, Bordetella pertussis
ccggccgugccg

SEQ ID NO: 2418153 - RNA, 15 nt, Bordetella pertussis
ccggccgugccgccc

SEQ ID NO: 2418154 - RNA, 21 nt, Bordetella pertussis
ccggccguggccgggcccggc

SEQ ID NO: 2418155 - RNA, 16 nt, Bordetella pertussis
ccggccucaaccgcgc

SEQ ID NO: 2418156 - RNA, 14 nt, Bordetella pertussis
ccggccucagcggc

SEQ ID NO: 2418157 - RNA, 16 nt, Bordetella pertussis
ccggccucagcggccg

SEQ ID NO: 2418158 - RNA, 17 nt, Bordetella pertussis
ccggccucagcggccgc

SEQ ID NO: 2418159 - RNA, 18 nt, Bordetella pertussis
ccggccucagcggccgcu

SEQ ID NO: 2418160 - RNA, 20 nt, Bordetella pertussis
ccggccucagcggccgcugc

SEQ ID NO: 2418161 - RNA, 21 nt, Bordetella pertussis
ccggccuccagcaucgccgcc

SEQ ID NO: 2418162 - RNA, 13 nt, Bordetella pertussis
ccggccucccgga

SEQ ID NO: 2418163 - RNA, 16 nt, Bordetella pertussis
ccggccucccggacca

SEQ ID NO: 2418164 - RNA, 15 nt, Bordetella pertussis
ccggccucgcggcgc

SEQ ID NO: 2418165 - RNA, 21 nt, Bordetella pertussis
ccggccugcaaugcggccagg

SEQ ID NO: 2418166 - RNA, 12 nt, Bordetella pertussis
ccggccugcagg

SEQ ID NO: 2418167 - RNA, 23 nt, Bordetella pertussis
ccggccugcaggcucuugaccag

SEQ ID NO: 2418168 - RNA, 21 nt, Bordetella pertussis
ccggccugcaggugccgccgg

SEQ ID NO: 2418169 - RNA, 16 nt, Bordetella pertussis
ccggccugccggcgca

SEQ ID NO: 2418170 - RNA, 17 nt, Bordetella pertussis
ccggccugccggcgcac

SEQ ID NO: 2418171 - RNA, 15 nt, Bordetella pertussis
ccggccugcgccagc

SEQ ID NO: 2418172 - RNA, 15 nt, Bordetella pertussis
ccggccugcgccggg

SEQ ID NO: 2418173 - RNA, 19 nt, Bordetella pertussis
ccggccugcgugucaggcg

SEQ ID NO: 2418174 - RNA, 14 nt, Bordetella pertussis
ccggccugcucgcc

SEQ ID NO: 2418175 - RNA, 21 nt, Bordetella pertussis
ccggccugcucgccggccagc

SEQ ID NO: 2418176 - RNA, 19 nt, Bordetella pertussis
ccggccugcuuggccgcgu

SEQ ID NO: 2418177 - RNA, 20 nt, Bordetella pertussis
ccggccugcuuggccgcgua

SEQ ID NO: 2418178 - RNA, 14 nt, Bordetella pertussis
ccggccuggcgcgc

SEQ ID NO: 2418179 - RNA, 15 nt, Bordetella pertussis
ccggccuggcgcgca

SEQ ID NO: 2418180 - RNA, 20 nt, Bordetella pertussis
ccggccuggcgcgcaucggc

SEQ ID NO: 2418181 - RNA, 15 nt, Bordetella pertussis
ccggccuggcgcgcg

SEQ ID NO: 2418182 - RNA, 17 nt, Bordetella pertussis
ccggccuggcgcgcggc

SEQ ID NO: 2418183 - RNA, 22 nt, Bordetella pertussis
ccggccuggcucagucggccug

SEQ ID NO: 2418184 - RNA, 13 nt, Bordetella pertussis
ccggccuggggac

SEQ ID NO: 2418185 - RNA, 20 nt, Bordetella pertussis
ccggccuggggacgggcgca

SEQ ID NO: 2418186 - RNA, 16 nt, Bordetella pertussis
ccggccuugcugaacc

SEQ ID NO: 2418187 - RNA, 20 nt, Bordetella pertussis
ccggccuugcugaaccugcu

SEQ ID NO: 2418188 - RNA, 22 nt, Bordetella pertussis
ccggccuugcugaaccugcugg

SEQ ID NO: 2418189 - RNA, 14 nt, Bordetella pertussis
ccggccuuggccau

SEQ ID NO: 2418190 - RNA, 13 nt, Bordetella pertussis
ccggccuuggccu

SEQ ID NO: 2418191 - RNA, 16 nt, Bordetella pertussis
ccggcgaaagcgucgg

SEQ ID NO: 2418192 - RNA, 17 nt, Bordetella pertussis
ccggcgaaagcgucggc

SEQ ID NO: 2418193 - RNA, 14 nt, Bordetella pertussis
ccggcgaagccggc

SEQ ID NO: 2418194 - RNA, 15 nt, Bordetella pertussis
ccggcgacaccgcgg

SEQ ID NO: 2418195 - RNA, 17 nt, Bordetella pertussis
ccggcgacaccgcggcc

SEQ ID NO: 2418196 - RNA, 18 nt, Bordetella pertussis
ccggcgacauagaucucc

SEQ ID NO: 2418197 - RNA, 14 nt, Bordetella pertussis
ccggcgaccgacgg

SEQ ID NO: 2418198 - RNA, 17 nt, Bordetella pertussis
ccggcgaccgacggcau

SEQ ID NO: 2418199 - RNA, 19 nt, Bordetella pertussis
ccggcgaccgacggcaucg

SEQ ID NO: 2418200 - RNA, 20 nt, Bordetella pertussis
ccggcgaccgacggcaucgu

SEQ ID NO: 2418201 - RNA, 16 nt, Bordetella pertussis
ccggcgacgccgcggu

SEQ ID NO: 2418202 - RNA, 22 nt, Bordetella pertussis
ccggcgacgccgcggugcuggg

SEQ ID NO: 2418203 - RNA, 16 nt, Bordetella pertussis
ccggcgacguggcgcu

SEQ ID NO: 2418204 - RNA, 18 nt, Bordetella pertussis
ccggcgacguggugugcg

SEQ ID NO: 2418205 - RNA, 18 nt, Bordetella pertussis
ccggcgagaacgcggccg

SEQ ID NO: 2418206 - RNA, 20 nt, Bordetella pertussis
ccggcgagaacgcggccgcg

SEQ ID NO: 2418207 - RNA, 21 nt, Bordetella pertussis
ccggcgagacgucggcgaugg

SEQ ID NO: 2418208 - RNA, 14 nt, Bordetella pertussis
ccggcgagcauggc

SEQ ID NO: 2418209 - RNA, 15 nt, Bordetella pertussis
ccggcgagccgaugg

SEQ ID NO: 2418210 - RNA, 16 nt, Bordetella pertussis
ccggcgagccgauggc

SEQ ID NO: 2418211 - RNA, 15 nt, Bordetella pertussis
ccggcgaggccgccc

SEQ ID NO: 2418212 - RNA, 16 nt, Bordetella pertussis
ccggcgaggccgcccg

SEQ ID NO: 2418213 - RNA, 17 nt, Bordetella pertussis
ccggcgaggccgcccgc

SEQ ID NO: 2418214 - RNA, 21 nt, Bordetella pertussis
ccggcgaggccgcccgccccg

SEQ ID NO: 2418215 - RNA, 14 nt, Bordetella pertussis
ccggcgaucacgcc

SEQ ID NO: 2418216 - RNA, 14 nt, Bordetella pertussis
ccggcgaucaugcc

SEQ ID NO: 2418217 - RNA, 18 nt, Bordetella pertussis
ccggcgaucaugccgccg

SEQ ID NO: 2418218 - RNA, 19 nt, Bordetella pertussis
ccggcgaucaugccgccga

SEQ ID NO: 2418219 - RNA, 17 nt, Bordetella pertussis
ccggcgauugcgccagc

SEQ ID NO: 2418220 - RNA, 21 nt, Bordetella pertussis
ccggcgauugcgccagcgcug

SEQ ID NO: 2418221 - RNA, 23 nt, Bordetella pertussis
ccggcgcacaaucugcgucgccu

SEQ ID NO: 2418222 - RNA, 23 nt, Bordetella pertussis
ccggcgcacccggugaucaugcc

SEQ ID NO: 2418223 - RNA, 15 nt, Bordetella pertussis
ccggcgcacgccccg

SEQ ID NO: 2418224 - RNA, 20 nt, Bordetella pertussis
ccggcgcacgccccgacgcg

SEQ ID NO: 2418225 - RNA, 17 nt, Bordetella pertussis
ccggcgcaugagccggc

SEQ ID NO: 2418226 - RNA, 19 nt, Bordetella pertussis
ccggcgcaugauggccggc

SEQ ID NO: 2418227 - RNA, 14 nt, Bordetella pertussis
ccggcgcaugcugg

SEQ ID NO: 2418228 - RNA, 13 nt, Bordetella pertussis
ccggcgccacccc

SEQ ID NO: 2418229 - RNA, 14 nt, Bordetella pertussis
ccggcgccaccccg

SEQ ID NO: 2418230 - RNA, 12 nt, Bordetella pertussis
ccggcgccagcc

SEQ ID NO: 2418231 - RNA, 13 nt, Bordetella pertussis
ccggcggcgcgcc

SEQ ID NO: 2418232 - RNA, 15 nt, Bordetella pertussis
ccggcggcgcgccgc

SEQ ID NO: 2418233 - RNA, 18 nt, Bordetella pertussis
ccggcggcgcgccgccgg

SEQ ID NO: 2418234 - RNA, 13 nt, Bordetella pertussis
ccggcggcgcgcu

SEQ ID NO: 2418235 - RNA, 13 nt, Bordetella pertussis
ccggcggcgcggc

SEQ ID NO: 2418236 - RNA, 14 nt, Bordetella pertussis
ccggcggcgcggcg

SEQ ID NO: 2418237 - RNA, 18 nt, Bordetella pertussis
ccggcggcgcggcgagca

SEQ ID NO: 2418238 - RNA, 14 nt, Bordetella pertussis
ccggcggcgggcgu

SEQ ID NO: 2418239 - RNA, 14 nt, Bordetella pertussis
ccggcggcgucggc

SEQ ID NO: 2418240 - RNA, 17 nt, Bordetella pertussis
ccggcggcgucggcgcc

SEQ ID NO: 2418241 - RNA, 14 nt, Bordetella pertussis
ccggcggcgucugg

SEQ ID NO: 2418242 - RNA, 16 nt, Bordetella pertussis
ccggcggcgucuggua

SEQ ID NO: 2418243 - RNA, 11 nt, Bordetella pertussis
ccggcggcgug

SEQ ID NO: 2418244 - RNA, 14 nt, Bordetella pertussis
ccggcggcgugccc

SEQ ID NO: 2418245 - RNA, 21 nt, Bordetella pertussis
ccggcggcgugcgccugcugg

SEQ ID NO: 2418246 - RNA, 18 nt, Bordetella pertussis
ccggcggcguggccgugc

SEQ ID NO: 2418247 - RNA, 16 nt, Bordetella pertussis
ccggcgggcaggcucc

SEQ ID NO: 2418248 - RNA, 17 nt, Bordetella pertussis
ccggcgggcaggcucca

SEQ ID NO: 2418249 - RNA, 12 nt, Bordetella pertussis
ccggcgggccgc

SEQ ID NO: 2418250 - RNA, 13 nt, Bordetella pertussis
ccggcgggccgca

SEQ ID NO: 2418251 - RNA, 20 nt, Bordetella pertussis
ccggcgggccgcgccccuag

SEQ ID NO: 2418252 - RNA, 14 nt, Bordetella pertussis
ccggcgggcggcug

SEQ ID NO: 2418253 - RNA, 21 nt, Bordetella pertussis
ccggcgggcggcugcccgggc

SEQ ID NO: 2418254 - RNA, 22 nt, Bordetella pertussis
ccggcgggcggcugcccgggcu

SEQ ID NO: 2418255 - RNA, 23 nt, Bordetella pertussis
ccggcgggcggcugcccgggcug

SEQ ID NO: 2418256 - RNA, 17 nt, Bordetella pertussis
ccggcggggcaggcgcc

SEQ ID NO: 2418257 - RNA, 12 nt, Bordetella pertussis
ccggcgggggcg

SEQ ID NO: 2418258 - RNA, 20 nt, Bordetella pertussis
ccggcgguaagcguccgcgc

SEQ ID NO: 2418259 - RNA, 15 nt, Bordetella pertussis
ccggcggucacgccg

SEQ ID NO: 2418260 - RNA, 17 nt, Bordetella pertussis
ccggcggucacgccgau

SEQ ID NO: 2418261 - RNA, 12 nt, Bordetella pertussis
ccggcggucccg

SEQ ID NO: 2418262 - RNA, 23 nt, Bordetella pertussis
ccggcggucccgagcgcucccgc

SEQ ID NO: 2418263 - RNA, 14 nt, Bordetella pertussis
ccggcggucgcgcu

SEQ ID NO: 2418264 - RNA, 15 nt, Bordetella pertussis
ccggcggucgcgcug

SEQ ID NO: 2418265 - RNA, 19 nt, Bordetella pertussis
ccggcggucgcgcuggccc

SEQ ID NO: 2418266 - RNA, 20 nt, Bordetella pertussis
ccggcguagucguugccggc

SEQ ID NO: 2418267 - RNA, 16 nt, Bordetella pertussis
ccggcguauggcccgc

SEQ ID NO: 2418268 - RNA, 18 nt, Bordetella pertussis
ccggcguauggcccgcca

SEQ ID NO: 2418269 - RNA, 20 nt, Bordetella pertussis
ccggcguauggcccgccacc

SEQ ID NO: 2418270 - RNA, 21 nt, Bordetella pertussis
ccggcguauggcccgccacca

SEQ ID NO: 2418271 - RNA, 13 nt, Bordetella pertussis
ccggcgucacgcg

SEQ ID NO: 2418272 - RNA, 17 nt, Bordetella pertussis
ccggcgucacgcggccg

SEQ ID NO: 2418273 - RNA, 19 nt, Bordetella pertussis
ccggcgucacgcggccggg

SEQ ID NO: 2418274 - RNA, 16 nt, Bordetella pertussis
ccggcguccacggcau

SEQ ID NO: 2418275 - RNA, 20 nt, Bordetella pertussis
ccggcguccacggcaucggc

SEQ ID NO: 2418276 - RNA, 18 nt, Bordetella pertussis
ccggcgucgcucagggua

SEQ ID NO: 2418277 - RNA, 21 nt, Bordetella pertussis
ccggcgucuggagcggccugg

SEQ ID NO: 2418278 - RNA, 16 nt, Bordetella pertussis
ccggcgugacgcgcgg

SEQ ID NO: 2418279 - RNA, 14 nt, Bordetella pertussis
ccggcgugacgcug

SEQ ID NO: 2418280 - RNA, 15 nt, Bordetella pertussis
ccggcgugacgcuga

SEQ ID NO: 2418281 - RNA, 13 nt, Bordetella pertussis
ccggcgugacgug

SEQ ID NO: 2418282 - RNA, 14 nt, Bordetella pertussis
ccggcgugagcgcc

SEQ ID NO: 2418283 - RNA, 17 nt, Bordetella pertussis
ccggcgugagcgccacc

SEQ ID NO: 2418284 - RNA, 20 nt, Bordetella pertussis
ccggcgugcagagcaccacg

SEQ ID NO: 2418285 - RNA, 17 nt, Bordetella pertussis
ccggcgugccauggacg

SEQ ID NO: 2418286 - RNA, 23 nt, Bordetella pertussis
ccggcgugccauggacgccggua

SEQ ID NO: 2418287 - RNA, 14 nt, Bordetella pertussis
ccggcgugcccagg

SEQ ID NO: 2418288 - RNA, 14 nt, Bordetella pertussis
ccggcgugcccagu

SEQ ID NO: 2418289 - RNA, 14 nt, Bordetella pertussis
ccggcguggccugc

SEQ ID NO: 2418290 - RNA, 15 nt, Bordetella pertussis
ccggcguggccugcc

SEQ ID NO: 2418291 - RNA, 16 nt, Bordetella pertussis
ccggcguggccugccc

SEQ ID NO: 2418292 - RNA, 17 nt, Bordetella pertussis
ccggcguggccugcccg

SEQ ID NO: 2418293 - RNA, 12 nt, Bordetella pertussis
ccggcguggcgc

SEQ ID NO: 2418294 - RNA, 13 nt, Bordetella pertussis
ccggcguggcgcg

SEQ ID NO: 2418295 - RNA, 14 nt, Bordetella pertussis
ccggcguggcgcgc

SEQ ID NO: 2418296 - RNA, 15 nt, Bordetella pertussis
ccggcgugguaucgc

SEQ ID NO: 2418297 - RNA, 21 nt, Bordetella pertussis
ccggcgugguaucgcgccagc

SEQ ID NO: 2418298 - RNA, 22 nt, Bordetella pertussis
ccggcgugguaucgcgccagcg

SEQ ID NO: 2418299 - RNA, 19 nt, Bordetella pertussis
ccggcguguccagcggcgc

SEQ ID NO: 2418300 - RNA, 16 nt, Bordetella pertussis
ccggcguguucagcgc

SEQ ID NO: 2418301 - RNA, 24 nt, Bordetella pertussis
ccggcguguucagcgcgcgcgccg

SEQ ID NO: 2418302 - RNA, 21 nt, Bordetella pertussis
ccggcguucaccaggaagcgc

SEQ ID NO: 2418303 - RNA, 18 nt, Bordetella pertussis
ccggcguucuggcgcagc

SEQ ID NO: 2418304 - RNA, 19 nt, Bordetella pertussis
ccggcguucuggcgcagca

SEQ ID NO: 2418305 - RNA, 18 nt, Bordetella pertussis
ccggcguucuggucagcc

SEQ ID NO: 2418306 - RNA, 21 nt, Bordetella pertussis
ccggcguucuggucagccgug

SEQ ID NO: 2418307 - RNA, 20 nt, Bordetella pertussis
ccggcguucuucagcgcgcu

SEQ ID NO: 2418308 - RNA, 17 nt, Bordetella pertussis
ccggcguuggugacgau

SEQ ID NO: 2418309 - RNA, 24 nt, Bordetella pertussis
ccggcuacagcucgccggcgaugg

SEQ ID NO: 2418310 - RNA, 15 nt, Bordetella pertussis
ccggcuacggcaagg

SEQ ID NO: 2418311 - RNA, 18 nt, Bordetella pertussis
ccggcuauaccgggcugg

SEQ ID NO: 2418312 - RNA, 13 nt, Bordetella pertussis
ccggcucagcccc

SEQ ID NO: 2418313 - RNA, 23 nt, Bordetella pertussis
ccggcucagccucgagguggcgc

SEQ ID NO: 2418314 - RNA, 17 nt, Bordetella pertussis
ccggcucaggccagcga

SEQ ID NO: 2418315 - RNA, 16 nt, Bordetella pertussis
ccggcucauucggcgc

SEQ ID NO: 2418316 - RNA, 23 nt, Bordetella pertussis
ccggcucauucggcgcgcucggc

SEQ ID NO: 2418317 - RNA, 14 nt, Bordetella pertussis
ccggcuccaguccc

SEQ ID NO: 2418318 - RNA, 22 nt, Bordetella pertussis
ccggcuccagucccgcaccggg

SEQ ID NO: 2418319 - RNA, 14 nt, Bordetella pertussis
ccggcucccgcgcu

SEQ ID NO: 2418320 - RNA, 15 nt, Bordetella pertussis
ccggcucccgcgcug

SEQ ID NO: 2418321 - RNA, 18 nt, Bordetella pertussis
ccggcucccgcgcugccg

SEQ ID NO: 2418322 - RNA, 23 nt, Bordetella pertussis
ccggcucccgcgcugccgcugca

SEQ ID NO: 2418323 - RNA, 23 nt, Bordetella pertussis
ccggcucgaacaggcuggcaugg

SEQ ID NO: 2418324 - RNA, 15 nt, Bordetella pertussis
ccggcucgccgagcc

SEQ ID NO: 2418325 - RNA, 18 nt, Bordetella pertussis
ccggcucgccgagccggg

SEQ ID NO: 2418326 - RNA, 19 nt, Bordetella pertussis
ccggcucgccgagccgggc

SEQ ID NO: 2418327 - RNA, 15 nt, Bordetella pertussis
ccggcucggaccugg

SEQ ID NO: 2418328 - RNA, 14 nt, Bordetella pertussis
ccggcucggcggca

SEQ ID NO: 2418329 - RNA, 16 nt, Bordetella pertussis
ccggcucggcggcauc

SEQ ID NO: 2418330 - RNA, 15 nt, Bordetella pertussis
ccggcucguacggcg

SEQ ID NO: 2418331 - RNA, 19 nt, Bordetella pertussis
ccggcucguacggcgucgg

SEQ ID NO: 2418332 - RNA, 21 nt, Bordetella pertussis
ccggcucguacggcgucgggc

SEQ ID NO: 2418333 - RNA, 20 nt, Bordetella pertussis
ccggcucuaccaacccugcc

SEQ ID NO: 2418334 - RNA, 20 nt, Bordetella pertussis
ccggcugcaccagcgcgccg

SEQ ID NO: 2418335 - RNA, 21 nt, Bordetella pertussis
ccggcugcaccagcgcgccgc

SEQ ID NO: 2418336 - RNA, 23 nt, Bordetella pertussis
ccggcugcaccagcgcgccgcgc

SEQ ID NO: 2418337 - RNA, 14 nt, Bordetella pertussis
ccggcugcaugcgc

SEQ ID NO: 2418338 - RNA, 15 nt, Bordetella pertussis
ccggcugccagggcc

SEQ ID NO: 2418339 - RNA, 21 nt, Bordetella pertussis
ccggcugcgcgcgcagccagg

SEQ ID NO: 2418340 - RNA, 14 nt, Bordetella pertussis
ccggcugcgcggcc

SEQ ID NO: 2418341 - RNA, 15 nt, Bordetella pertussis
ccggcugcgcggccg

SEQ ID NO: 2418342 - RNA, 23 nt, Bordetella pertussis
ccggcugcucguucugcgcgccc

SEQ ID NO: 2418343 - RNA, 17 nt, Bordetella pertussis
ccggcugcuugcccagc

SEQ ID NO: 2418344 - RNA, 18 nt, Bordetella pertussis
ccgggcgcggcgcccgcc

SEQ ID NO: 2418345 - RNA, 13 nt, Bordetella pertussis
ccgggcgcugcgc

SEQ ID NO: 2418346 - RNA, 18 nt, Bordetella pertussis
ccgggcgcugcgccggcg

SEQ ID NO: 2418347 - RNA, 21 nt, Bordetella pertussis
ccgggcgcugcgccggcggca

SEQ ID NO: 2418348 - RNA, 17 nt, Bordetella pertussis
ccgggcggcccggcgga

SEQ ID NO: 2418349 - RNA, 19 nt, Bordetella pertussis
ccgggcggcgcgggcggcu

SEQ ID NO: 2418350 - RNA, 12 nt, Bordetella pertussis
ccgggcggcguu

SEQ ID NO: 2418351 - RNA, 21 nt, Bordetella pertussis
ccgggcgggaauucgcugaag

SEQ ID NO: 2418352 - RNA, 13 nt, Bordetella pertussis
ccgggcgggcaca

SEQ ID NO: 2418353 - RNA, 23 nt, Bordetella pertussis
ccgggcgggcacaacccgcccgg

SEQ ID NO: 2418354 - RNA, 19 nt, Bordetella pertussis
ccgggcgggucggcgaaca

SEQ ID NO: 2418355 - RNA, 14 nt, Bordetella pertussis
ccgggcgguacagg

SEQ ID NO: 2418356 - RNA, 18 nt, Bordetella pertussis
ccgggcgguacaggucga

SEQ ID NO: 2418357 - RNA, 18 nt, Bordetella pertussis
ccgggcgguccgguucgc

SEQ ID NO: 2418358 - RNA, 20 nt, Bordetella pertussis
ccgggcgugaacucggggug

SEQ ID NO: 2418359 - RNA, 23 nt, Bordetella pertussis
ccgggcuaucccaacccguuccc

SEQ ID NO: 2418360 - RNA, 22 nt, Bordetella pertussis
ccgggcuccggucguggccagc

SEQ ID NO: 2418361 - RNA, 15 nt, Bordetella pertussis
ccgggcuccucgccc

SEQ ID NO: 2418362 - RNA, 19 nt, Bordetella pertussis
ccgggcuccucgcccgacc

SEQ ID NO: 2418363 - RNA, 18 nt, Bordetella pertussis
ccgggcucgaugaccagc

SEQ ID NO: 2418364 - RNA, 15 nt, Bordetella pertussis
ccgggcucgcugacc

SEQ ID NO: 2418365 - RNA, 13 nt, Bordetella pertussis
ccgggcucggcca

SEQ ID NO: 2418366 - RNA, 15 nt, Bordetella pertussis
ccgggcucggccacc

SEQ ID NO: 2418367 - RNA, 19 nt, Bordetella pertussis
ccgggcucggccaccaugc

SEQ ID NO: 2418368 - RNA, 18 nt, Bordetella pertussis
ccgggcugauccgcaccg

SEQ ID NO: 2418369 - RNA, 16 nt, Bordetella pertussis
ccgggcugccggcagc

SEQ ID NO: 2418370 - RNA, 17 nt, Bordetella pertussis
ccgggcugccggcagca

SEQ ID NO: 2418371 - RNA, 15 nt, Bordetella pertussis
ccgggcugcugcacg

SEQ ID NO: 2418372 - RNA, 17 nt, Bordetella pertussis
ccgggcugcugcacgcg

SEQ ID NO: 2418373 - RNA, 20 nt, Bordetella pertussis
ccgggcugcugcacgcgcgc

SEQ ID NO: 2418374 - RNA, 14 nt, Bordetella pertussis
ccgggcuggccgcc

SEQ ID NO: 2418375 - RNA, 15 nt, Bordetella pertussis
ccgggcuggccgccu

SEQ ID NO: 2418376 - RNA, 17 nt, Bordetella pertussis
ccgggcuggccgccugc

SEQ ID NO: 2418377 - RNA, 13 nt, Bordetella pertussis
ccgggcuggucag

SEQ ID NO: 2418378 - RNA, 15 nt, Bordetella pertussis
ccgggcuggucagcc

SEQ ID NO: 2418379 - RNA, 18 nt, Bordetella pertussis
ccgggcuggucagccugg

SEQ ID NO: 2418380 - RNA, 23 nt, Bordetella pertussis
ccgggcuuucggucucgcgcggc

SEQ ID NO: 2418381 - RNA, 24 nt, Bordetella pertussis
ccgggcuuucggucucgcgcggcc

SEQ ID NO: 2418382 - RNA, 16 nt, Bordetella pertussis
ccggggaagccgccgg

SEQ ID NO: 2418383 - RNA, 17 nt, Bordetella pertussis
ccggggaagccgccggc

SEQ ID NO: 2418384 - RNA, 19 nt, Bordetella pertussis
ccggggaagccgccggcgu

SEQ ID NO: 2418385 - RNA, 14 nt, Bordetella pertussis
ccggggagccugcc

SEQ ID NO: 2418386 - RNA, 18 nt, Bordetella pertussis
ccggggagccugccccga

SEQ ID NO: 2418387 - RNA, 20 nt, Bordetella pertussis
ccggggaggccucgacgcug

SEQ ID NO: 2418388 - RNA, 22 nt, Bordetella pertussis
ccggggcacccaggcgggcugg

SEQ ID NO: 2418389 - RNA, 19 nt, Bordetella pertussis
ccggggcaggaagccggcc

SEQ ID NO: 2418390 - RNA, 20 nt, Bordetella pertussis
ccggggcaggaagccggccc

SEQ ID NO: 2418391 - RNA, 13 nt, Bordetella pertussis
ccggggcagggcg

SEQ ID NO: 2418392 - RNA, 11 nt, Bordetella pertussis
ccggggccgcc

SEQ ID NO: 2418393 - RNA, 12 nt, Bordetella pertussis
ccggggccgccc

SEQ ID NO: 2418394 - RNA, 13 nt, Bordetella pertussis
ccggggccgccca

SEQ ID NO: 2418395 - RNA, 22 nt, Bordetella pertussis
ccggggcgccggugucggccca

SEQ ID NO: 2418396 - RNA, 16 nt, Bordetella pertussis
ccggggcggcgcagca

SEQ ID NO: 2418397 - RNA, 17 nt, Bordetella pertussis
ccggggcgggcgcggua

SEQ ID NO: 2418398 - RNA, 20 nt, Bordetella pertussis
ccggggcggucaaugcggcg

SEQ ID NO: 2418399 - RNA, 22 nt, Bordetella pertussis
ccggggcggucaaugcggcggc

SEQ ID NO: 2418400 - RNA, 16 nt, Bordetella pertussis
ccggggcguggccgca

SEQ ID NO: 2418401 - RNA, 21 nt, Bordetella pertussis
ccggggggcgcacgccgcgcc

SEQ ID NO: 2418402 - RNA, 13 nt, Bordetella pertussis
ccggggucagcgc

SEQ ID NO: 2418403 - RNA, 16 nt, Bordetella pertussis
ccggggucagcgccgg

SEQ ID NO: 2418404 - RNA, 22 nt, Bordetella pertussis
ccggggucagcgccggcacgcu

SEQ ID NO: 2418405 - RNA, 22 nt, Bordetella pertussis
ccggggucuugccgcgcagcgu

SEQ ID NO: 2418406 - RNA, 22 nt, Bordetella pertussis
ccgggguugggaucgcgccagg

SEQ ID NO: 2418407 - RNA, 21 nt, Bordetella pertussis
ccggguacggcagaugaucua

SEQ ID NO: 2418408 - RNA, 16 nt, Bordetella pertussis
ccgggucaucgaggug

SEQ ID NO: 2418409 - RNA, 17 nt, Bordetella pertussis
ccgggucaucgaggugg

SEQ ID NO: 2418410 - RNA, 13 nt, Bordetella pertussis
ccggguccagccc

SEQ ID NO: 2418411 - RNA, 23 nt, Bordetella pertussis
ccggguccagccccacgccgacc

SEQ ID NO: 2418412 - RNA, 15 nt, Bordetella pertussis
ccgggucccuggccc

SEQ ID NO: 2418413 - RNA, 14 nt, Bordetella pertussis
ccggguccggccgc

SEQ ID NO: 2418414 - RNA, 15 nt, Bordetella pertussis
ccggguccggccgcg

SEQ ID NO: 2418415 - RNA, 22 nt, Bordetella pertussis
ccggguccggccgcgcaaggcg

SEQ ID NO: 2418416 - RNA, 17 nt, Bordetella pertussis
ccgggucgagcgccgaa

SEQ ID NO: 2418417 - RNA, 12 nt, Bordetella pertussis
ccgggucgccgg

SEQ ID NO: 2418418 - RNA, 15 nt, Bordetella pertussis
ccgggucgccggugg

SEQ ID NO: 2418419 - RNA, 14 nt, Bordetella pertussis
ccgggucgcgcagc

SEQ ID NO: 2418420 - RNA, 13 nt, Bordetella pertussis
ccgggucgcggca

SEQ ID NO: 2418421 - RNA, 13 nt, Bordetella pertussis
ccgggucgggcgu

SEQ ID NO: 2418422 - RNA, 21 nt, Bordetella pertussis
ccgggucgggcgucugcccgc

SEQ ID NO: 2418423 - RNA, 18 nt, Bordetella pertussis
ccgggucuggccggccgc

SEQ ID NO: 2418424 - RNA, 14 nt, Bordetella pertussis
ccggguggccgcgg

SEQ ID NO: 2418425 - RNA, 15 nt, Bordetella pertussis
ccggguggccgcggu

SEQ ID NO: 2418426 - RNA, 14 nt, Bordetella pertussis
ccgggugggcggca

SEQ ID NO: 2418427 - RNA, 19 nt, Bordetella pertussis
ccgggugggcggcaucgac

SEQ ID NO: 2418428 - RNA, 19 nt, Bordetella pertussis
ccggguggguucgggcguu

SEQ ID NO: 2418429 - RNA, 15 nt, Bordetella pertussis
ccgggugguccaugc

SEQ ID NO: 2418430 - RNA, 19 nt, Bordetella pertussis
ccgggugguccaugcgaau

SEQ ID NO: 2418431 - RNA, 14 nt, Bordetella pertussis
ccggguggucgcgc

SEQ ID NO: 2418432 - RNA, 17 nt, Bordetella pertussis
ccggguggucgcgcccg

SEQ ID NO: 2418433 - RNA, 20 nt, Bordetella pertussis
ccggguggucgcgcccgccg

SEQ ID NO: 2418434 - RNA, 23 nt, Bordetella pertussis
ccggguugcaggaugcgcggcac

SEQ ID NO: 2418435 - RNA, 16 nt, Bordetella pertussis
ccggguuggcgaugcu

SEQ ID NO: 2418436 - RNA, 22 nt, Bordetella pertussis
ccggguuggcgaugcucacgcc

SEQ ID NO: 2418437 - RNA, 23 nt, Bordetella pertussis
ccggguuggcguccaggcgcgcc

SEQ ID NO: 2418438 - RNA, 15 nt, Bordetella pertussis
ccggguugucgccca

SEQ ID NO: 2418439 - RNA, 22 nt, Bordetella pertussis
ccggguugucgcccaccacgcc

SEQ ID NO: 2418440 - RNA, 23 nt, Bordetella pertussis
ccggguuucucgacgcaaucggc

SEQ ID NO: 2418441 - RNA, 22 nt, Bordetella pertussis
ccggguuuuuacaugccgcgcg

SEQ ID NO: 2418442 - RNA, 15 nt, Bordetella pertussis
ccgguacagccaggc

SEQ ID NO: 2418443 - RNA, 12 nt, Bordetella pertussis
ccgguacgccug

SEQ ID NO: 2418444 - RNA, 16 nt, Bordetella pertussis
ccgguacgccugcacc

SEQ ID NO: 2418445 - RNA, 19 nt, Bordetella pertussis
ccgguacgccugcaccgcc

SEQ ID NO: 2418446 - RNA, 21 nt, Bordetella pertussis
ccgguacgccugcaccgccgc

SEQ ID NO: 2418447 - RNA, 13 nt, Bordetella pertussis
ccgguacgcgcag

SEQ ID NO: 2418448 - RNA, 16 nt, Bordetella pertussis
ccgguagcccgcgugg

SEQ ID NO: 2418449 - RNA, 22 nt, Bordetella pertussis
ccgguagcgcugggcgccagca

SEQ ID NO: 2418450 - RNA, 13 nt, Bordetella pertussis
ccgguaggccacg

SEQ ID NO: 2418451 - RNA, 22 nt, Bordetella pertussis
ccgguaggccuggucggggucg

SEQ ID NO: 2418452 - RNA, 15 nt, Bordetella pertussis
ccgguagucgccggc

SEQ ID NO: 2418453 - RNA, 18 nt, Bordetella pertussis
ccgguauccgcgcaugga

SEQ ID NO: 2418454 - RNA, 15 nt, Bordetella pertussis
ccgguauccuggcgc

SEQ ID NO: 2418455 - RNA, 14 nt, Bordetella pertussis
ccgguaucgcggcg

SEQ ID NO: 2418456 - RNA, 20 nt, Bordetella pertussis
ccgguaucgcggcgcaggcg

SEQ ID NO: 2418457 - RNA, 14 nt, Bordetella pertussis
ccguaagcgcugga

SEQ ID NO: 2418458 - RNA, 22 nt, Bordetella pertussis
ccguaagcgcuggacgcccugg

SEQ ID NO: 2418459 - RNA, 16 nt, Bordetella pertussis
ccguacagccgcggca

SEQ ID NO: 2418460 - RNA, 17 nt, Bordetella pertussis
ccguacagccgcggcag

SEQ ID NO: 2418461 - RNA, 17 nt, Bordetella pertussis
ccguaccagcgcgaacg

SEQ ID NO: 2418462 - RNA, 21 nt, Bordetella pertussis
ccguaccaguacaccggcgug

SEQ ID NO: 2418463 - RNA, 18 nt, Bordetella pertussis
ccguaccccagcaugugc

SEQ ID NO: 2418464 - RNA, 16 nt, Bordetella pertussis
ccguaccgccacaccg

SEQ ID NO: 2418465 - RNA, 19 nt, Bordetella pertussis
ccguacgcggcgcccgcgc

SEQ ID NO: 2418466 - RNA, 14 nt, Bordetella pertussis
ccguacgucaaggc

SEQ ID NO: 2418467 - RNA, 20 nt, Bordetella pertussis
ccguacucgccggucgcggc

SEQ ID NO: 2418468 - RNA, 20 nt, Bordetella pertussis
ccguacuugcuccgguacgc

SEQ ID NO: 2418469 - RNA, 14 nt, Bordetella pertussis
ccguacuuggcgau

SEQ ID NO: 2418470 - RNA, 15 nt, Bordetella pertussis
ccguagagggucugg

SEQ ID NO: 2418471 - RNA, 13 nt, Bordetella pertussis
ccguagcccaggu

SEQ ID NO: 2418472 - RNA, 17 nt, Bordetella pertussis
ccguagccgcugcgcgc

SEQ ID NO: 2418473 - RNA, 14 nt, Bordetella pertussis
ccguagcgcaggcg

SEQ ID NO: 2418474 - RNA, 23 nt, Bordetella pertussis
ccguagcgcaucgcgaugcgcag

SEQ ID NO: 2418475 - RNA, 19 nt, Bordetella pertussis
ccguagcgcgccagccgcg

SEQ ID NO: 2418476 - RNA, 22 nt, Bordetella pertussis
ccguagcgcgccagccgcgcga

SEQ ID NO: 2418477 - RNA, 20 nt, Bordetella pertussis
ccguagcgguccggggcggg

SEQ ID NO: 2418478 - RNA, 21 nt, Bordetella pertussis
ccguagcgguccggggcgggc

SEQ ID NO: 2418479 - RNA, 12 nt, Bordetella pertussis
ccguagcguugg

SEQ ID NO: 2418480 - RNA, 20 nt, Bordetella pertussis
ccguagcguuggcggccggc

SEQ ID NO: 2418481 - RNA, 22 nt, Bordetella pertussis
ccguagcguuggcggccggcca

SEQ ID NO: 2418482 - RNA, 20 nt, Bordetella pertussis
ccguaggacagccccagcag

SEQ ID NO: 2418483 - RNA, 14 nt, Bordetella pertussis
ccguaggcgccggc

SEQ ID NO: 2418484 - RNA, 17 nt, Bordetella pertussis
ccguaggcggcccaggc

SEQ ID NO: 2418485 - RNA, 16 nt, Bordetella pertussis
ccguaggugcgcgcca

SEQ ID NO: 2418486 - RNA, 24 nt, Bordetella pertussis
ccguaguccagcagcagcgccgcg

SEQ ID NO: 2418487 - RNA, 22 nt, Bordetella pertussis
ccguaguucggcgggaucugca

SEQ ID NO: 2418488 - RNA, 23 nt, Bordetella pertussis
ccguaguugaugcuugcuugcca

SEQ ID NO: 2418489 - RNA, 21 nt, Bordetella pertussis
ccguauagcgguacucgcgcg

SEQ ID NO: 2418490 - RNA, 22 nt, Bordetella pertussis
ccguauagcgguacucgcgcgg

SEQ ID NO: 2418491 - RNA, 14 nt, Bordetella pertussis
ccguaucgcggccg

SEQ ID NO: 2418492 - RNA, 16 nt, Bordetella pertussis
ccgucaccgacgccag

SEQ ID NO: 2418493 - RNA, 13 nt, Bordetella pertussis
ccgucaccgccgc

SEQ ID NO: 2418494 - RNA, 15 nt, Bordetella pertussis
ccgucaccgccgccg

SEQ ID NO: 2418495 - RNA, 17 nt, Bordetella pertussis
ccgucacgcgcaaggcg

SEQ ID NO: 2418496 - RNA, 18 nt, Bordetella pertussis
ccgucacgcgcaaggcgg

SEQ ID NO: 2418497 - RNA, 21 nt, Bordetella pertussis
ccgucacgcgcaaggcgggcu

SEQ ID NO: 2418498 - RNA, 12 nt, Bordetella pertussis
ccgucagcacgg

SEQ ID NO: 2418499 - RNA, 15 nt, Bordetella pertussis
ccgucagcacggucg

SEQ ID NO: 2418500 - RNA, 20 nt, Bordetella pertussis
ccgucagcacggucggcgcg

SEQ ID NO: 2418501 - RNA, 12 nt, Bordetella pertussis
ccgucagcagca

SEQ ID NO: 2418502 - RNA, 16 nt, Bordetella pertussis
ccgucagcagcgcggc

SEQ ID NO: 2418503 - RNA, 14 nt, Bordetella pertussis
ccgucagcaugccg

SEQ ID NO: 2418504 - RNA, 19 nt, Bordetella pertussis
ccgucagcgacaucgugcu

SEQ ID NO: 2418505 - RNA, 16 nt, Bordetella pertussis
ccgucagcggcgcgcc

SEQ ID NO: 2418506 - RNA, 17 nt, Bordetella pertussis
ccgucagcucgaucagg

SEQ ID NO: 2418507 - RNA, 21 nt, Bordetella pertussis
ccgucagcucgaucaggcgcu

SEQ ID NO: 2418508 - RNA, 16 nt, Bordetella pertussis
ccgucaggaucaggcc

SEQ ID NO: 2418509 - RNA, 20 nt, Bordetella pertussis
ccgucaggaucaggccggcg

SEQ ID NO: 2418510 - RNA, 22 nt, Bordetella pertussis
ccgucaggaucaggccggcgau

SEQ ID NO: 2418511 - RNA, 17 nt, Bordetella pertussis
ccgucaggcagcaaccg

SEQ ID NO: 2418512 - RNA, 13 nt, Bordetella pertussis
ccgucaucgccgc

SEQ ID NO: 2418513 - RNA, 14 nt, Bordetella pertussis
ccgucaucgccgcg

SEQ ID NO: 2418514 - RNA, 13 nt, Bordetella pertussis
ccgucaucgggug

SEQ ID NO: 2418515 - RNA, 18 nt, Bordetella pertussis
ccgucaucgggugcggcg

SEQ ID NO: 2418516 - RNA, 14 nt, Bordetella pertussis
ccgucaugcgccgc

SEQ ID NO: 2418517 - RNA, 22 nt, Bordetella pertussis
ccguccaaaacagacaggccgg

SEQ ID NO: 2418518 - RNA, 14 nt, Bordetella pertussis
ccguccacgaaggc

SEQ ID NO: 2418519 - RNA, 14 nt, Bordetella pertussis
ccguccacgcccag

SEQ ID NO: 2418520 - RNA, 19 nt, Bordetella pertussis
ccguccacgcccagcgccg

SEQ ID NO: 2418521 - RNA, 14 nt, Bordetella pertussis
ccguccacgccgcg

SEQ ID NO: 2418522 - RNA, 15 nt, Bordetella pertussis
ccguccacgccgcgc

SEQ ID NO: 2418523 - RNA, 18 nt, Bordetella pertussis
ccguccacgccgcgcgcg

SEQ ID NO: 2418524 - RNA, 20 nt, Bordetella pertussis
ccguccacgccgcgcgcguc

SEQ ID NO: 2418525 - RNA, 15 nt, Bordetella pertussis
ccguccacggccugc

SEQ ID NO: 2418526 - RNA, 23 nt, Bordetella pertussis
ccguccagcauuucucgggcgca

SEQ ID NO: 2418527 - RNA, 15 nt, Bordetella pertussis
ccguccagcgcggca

SEQ ID NO: 2418528 - RNA, 16 nt, Bordetella pertussis
ccguccaggaagcagc

SEQ ID NO: 2418529 - RNA, 21 nt, Bordetella pertussis
ccguccaggcgccgcacgccg

SEQ ID NO: 2418530 - RNA, 19 nt, Bordetella pertussis
ccguccaugcggaggcuuu

SEQ ID NO: 2418531 - RNA, 16 nt, Bordetella pertussis
ccguccauggcgugcc

SEQ ID NO: 2418532 - RNA, 19 nt, Bordetella pertussis
ccgucccgacccccggccc

SEQ ID NO: 2418533 - RNA, 21 nt, Bordetella pertussis
ccgucccgacccccggcccgc

SEQ ID NO: 2418534 - RNA, 16 nt, Bordetella pertussis
ccgucccugguccagc

SEQ ID NO: 2418535 - RNA, 17 nt, Bordetella pertussis
ccgucccugguccagca

SEQ ID NO: 2418536 - RNA, 19 nt, Bordetella pertussis
ccgucccugguccagcagc

SEQ ID NO: 2418537 - RNA, 18 nt, Bordetella pertussis
ccguccgagcccgacgcg

SEQ ID NO: 2418538 - RNA, 21 nt, Bordetella pertussis
ccguccgagcccgacgcgagg

SEQ ID NO: 2418539 - RNA, 14 nt, Bordetella pertussis
ccguccggccgugc

SEQ ID NO: 2418540 - RNA, 16 nt, Bordetella pertussis
ccguccggccgugccg

SEQ ID NO: 2418541 - RNA, 20 nt, Bordetella pertussis
ccguccggccgugccgcccg

SEQ ID NO: 2418542 - RNA, 14 nt, Bordetella pertussis
ccguccgucgggca

SEQ ID NO: 2418543 - RNA, 19 nt, Bordetella pertussis
ccguccgugagugcagcgc

SEQ ID NO: 2418544 - RNA, 15 nt, Bordetella pertussis
ccguccucaggcccg

SEQ ID NO: 2418545 - RNA, 19 nt, Bordetella pertussis
ccguccucgcgggccuggc

SEQ ID NO: 2418546 - RNA, 13 nt, Bordetella pertussis
ccguccugcugcg

SEQ ID NO: 2418547 - RNA, 15 nt, Bordetella pertussis
ccguccugcugcggc

SEQ ID NO: 2418548 - RNA, 21 nt, Bordetella pertussis
ccguccuggcgaccggcggca

SEQ ID NO: 2418549 - RNA, 22 nt, Bordetella pertussis
ccguccuggcgaccggcggcac

SEQ ID NO: 2418550 - RNA, 18 nt, Bordetella pertussis
ccguccuggugcacgccg

SEQ ID NO: 2418551 - RNA, 21 nt, Bordetella pertussis
ccguccuggugcacgccgaug

SEQ ID NO: 2418552 - RNA, 21 nt, Bordetella pertussis
ccguccuuacuugcgcacggc

SEQ ID NO: 2418553 - RNA, 17 nt, Bordetella pertussis
ccguccuugagcgccag

SEQ ID NO: 2418554 - RNA, 23 nt, Bordetella pertussis
ccguccuugagcgccagcucggc

SEQ ID NO: 2418555 - RNA, 17 nt, Bordetella pertussis
ccguccuuggcgccggc

SEQ ID NO: 2418556 - RNA, 18 nt, Bordetella pertussis
ccguccuuggcguccggc

SEQ ID NO: 2418557 - RNA, 21 nt, Bordetella pertussis
ccguccuuggcguccggcccc

SEQ ID NO: 2418558 - RNA, 14 nt, Bordetella pertussis
ccgucgaacuccug

SEQ ID NO: 2418559 - RNA, 18 nt, Bordetella pertussis
ccgucgaagccggcgcca

SEQ ID NO: 2418560 - RNA, 21 nt, Bordetella pertussis
ccgucgaaggccgcaaccagg

SEQ ID NO: 2418561 - RNA, 22 nt, Bordetella pertussis
ccgucgaccgcgaagcgcgcca

SEQ ID NO: 2418562 - RNA, 14 nt, Bordetella pertussis
ccgucgaccgcggc

SEQ ID NO: 2418563 - RNA, 16 nt, Bordetella pertussis
ccgucgaccggcccgc

SEQ ID NO: 2418564 - RNA, 13 nt, Bordetella pertussis
ccgucgacgcagc

SEQ ID NO: 2418565 - RNA, 16 nt, Bordetella pertussis
ccgucgacgcagcagc

SEQ ID NO: 2418566 - RNA, 18 nt, Bordetella pertussis
ccgucgacuucgacccgg

SEQ ID NO: 2418567 - RNA, 20 nt, Bordetella pertussis
ccgucgacuucgacccggac

SEQ ID NO: 2418568 - RNA, 18 nt, Bordetella pertussis
ccgucgagaaugacggug

SEQ ID NO: 2418569 - RNA, 13 nt, Bordetella pertussis
ccgucgagccggg

SEQ ID NO: 2418570 - RNA, 21 nt, Bordetella pertussis
ccgugcugaucgacaugcugg

SEQ ID NO: 2418571 - RNA, 21 nt, Bordetella pertussis
ccgugcuggaggugccguccg

SEQ ID NO: 2418572 - RNA, 21 nt, Bordetella pertussis
ccgugcuggccgacgcgcugg

SEQ ID NO: 2418573 - RNA, 13 nt, Bordetella pertussis
ccgugcuggccgc

SEQ ID NO: 2418574 - RNA, 14 nt, Bordetella pertussis
ccgugcuggccgcg

SEQ ID NO: 2418575 - RNA, 15 nt, Bordetella pertussis
ccgugcuggccgcgg

SEQ ID NO: 2418576 - RNA, 20 nt, Bordetella pertussis
ccguggaggcggcggccguc

SEQ ID NO: 2418577 - RNA, 14 nt, Bordetella pertussis
ccguggcaugccau

SEQ ID NO: 2418578 - RNA, 15 nt, Bordetella pertussis
ccguggccaagggcg

SEQ ID NO: 2418579 - RNA, 21 nt, Bordetella pertussis
ccguggccaagggcgccgcgc

SEQ ID NO: 2418580 - RNA, 14 nt, Bordetella pertussis
ccguggccaagugg

SEQ ID NO: 2418581 - RNA, 20 nt, Bordetella pertussis
ccguggccaagugggcauag

SEQ ID NO: 2418582 - RNA, 15 nt, Bordetella pertussis
ccguggccacggccg

SEQ ID NO: 2418583 - RNA, 17 nt, Bordetella pertussis
ccguggccacggccgcg

SEQ ID NO: 2418584 - RNA, 18 nt, Bordetella pertussis
ccguggccacggccgcga

SEQ ID NO: 2418585 - RNA, 20 nt, Bordetella pertussis
ccguggcccagccgcaugcc

SEQ ID NO: 2418586 - RNA, 15 nt, Bordetella pertussis
ccguggccggcaucg

SEQ ID NO: 2418587 - RNA, 19 nt, Bordetella pertussis
ccguggccggcaucgcgcu

SEQ ID NO: 2418588 - RNA, 20 nt, Bordetella pertussis
ccguggccggcaucgcgcug

SEQ ID NO: 2418589 - RNA, 20 nt, Bordetella pertussis
ccguggcgauccagggccgc

SEQ ID NO: 2418590 - RNA, 21 nt, Bordetella pertussis
ccguggcgcaaggcaugcgcc

SEQ ID NO: 2418591 - RNA, 14 nt, Bordetella pertussis
ccguggcgcaccag

SEQ ID NO: 2418592 - RNA, 15 nt, Bordetella pertussis
ccguggcggccgcgg

SEQ ID NO: 2418593 - RNA, 19 nt, Bordetella pertussis
ccguggcgggaggaagggu

SEQ ID NO: 2418594 - RNA, 15 nt, Bordetella pertussis
ccguggcguccaugc

SEQ ID NO: 2418595 - RNA, 22 nt, Bordetella pertussis
ccguggcguccaugcagguggc

SEQ ID NO: 2418596 - RNA, 21 nt, Bordetella pertussis
ccguggcgugcaggccggcgg

SEQ ID NO: 2418597 - RNA, 24 nt, Bordetella pertussis
ccgugggcggcguagagcgccgcg

SEQ ID NO: 2418598 - RNA, 19 nt, Bordetella pertussis
ccguggggacgagcuccug

SEQ ID NO: 2418599 - RNA, 16 nt, Bordetella pertussis
ccguggucgccagcac

SEQ ID NO: 2418600 - RNA, 17 nt, Bordetella pertussis
ccguggucgccagcacg

SEQ ID NO: 2418601 - RNA, 16 nt, Bordetella pertussis
ccgugguggggccggg

SEQ ID NO: 2418602 - RNA, 17 nt, Bordetella pertussis
ccgugguggggccgggc

SEQ ID NO: 2418603 - RNA, 19 nt, Bordetella pertussis
ccgugucggcaaccugcac

SEQ ID NO: 2418604 - RNA, 17 nt, Bordetella pertussis
ccguguucgacgcggcc

SEQ ID NO: 2418605 - RNA, 20 nt, Bordetella pertussis
ccguguucgagcaggcgcgc

SEQ ID NO: 2418606 - RNA, 21 nt, Bordetella pertussis
ccguuaugguucggccucgcc

SEQ ID NO: 2418607 - RNA, 17 nt, Bordetella pertussis
ccguuccaguccagcgu

SEQ ID NO: 2418608 - RNA, 15 nt, Bordetella pertussis
ccguuccccaucauc

SEQ ID NO: 2418609 - RNA, 19 nt, Bordetella pertussis
ccguucggccagcgcgcgg

SEQ ID NO: 2418610 - RNA, 21 nt, Bordetella pertussis
ccguucggccagcgcgcggcg

SEQ ID NO: 2418611 - RNA, 15 nt, Bordetella pertussis
ccguucggggacagg

SEQ ID NO: 2418612 - RNA, 18 nt, Bordetella pertussis
ccguucggggacaggcac

SEQ ID NO: 2418613 - RNA, 19 nt, Bordetella pertussis
ccguucggggacaggcacc

SEQ ID NO: 2418614 - RNA, 14 nt, Bordetella pertussis
ccguucucaggccg

SEQ ID NO: 2418615 - RNA, 12 nt, Bordetella pertussis
ccguucuggcag

SEQ ID NO: 2418616 - RNA, 20 nt, Bordetella pertussis
ccguucuggcugcgcgccug

SEQ ID NO: 2418617 - RNA, 18 nt, Bordetella pertussis
ccguucuucgaucgccug

SEQ ID NO: 2418618 - RNA, 18 nt, Bordetella pertussis
ccguugcagcccagcgcg

SEQ ID NO: 2418619 - RNA, 13 nt, Bordetella pertussis
ccguugccgcgcg

SEQ ID NO: 2418620 - RNA, 15 nt, Bordetella pertussis
ccguugccgcgcgcg

SEQ ID NO: 2418621 - RNA, 18 nt, Bordetella pertussis
ccguugccgcgcgcgacu

SEQ ID NO: 2418622 - RNA, 14 nt, Bordetella pertussis
ccguugcuccagcc

SEQ ID NO: 2418623 - RNA, 15 nt, Bordetella pertussis
ccguuggcaggccag

SEQ ID NO: 2418624 - RNA, 20 nt, Bordetella pertussis
ccguuggcaggccagcaugg

SEQ ID NO: 2418625 - RNA, 21 nt, Bordetella pertussis
ccguuggcaggccagcauggc

SEQ ID NO: 2418626 - RNA, 15 nt, Bordetella pertussis
ccguuggccagcgcc

SEQ ID NO: 2418627 - RNA, 15 nt, Bordetella pertussis
ccguuggccgcgcgg

SEQ ID NO: 2418628 - RNA, 18 nt, Bordetella pertussis
ccguuggcgauggcgcgg

SEQ ID NO: 2418629 - RNA, 15 nt, Bordetella pertussis
ccguuguccgccugc

SEQ ID NO: 2418630 - RNA, 17 nt, Bordetella pertussis
ccguuguccuggcgcgc

SEQ ID NO: 2418631 - RNA, 22 nt, Bordetella pertussis
ccguugucggucaucacgcggu

SEQ ID NO: 2418632 - RNA, 21 nt, Bordetella pertussis
ccguuuacuccccagacgcag

SEQ ID NO: 2418633 - RNA, 18 nt, Bordetella pertussis
ccguuucgucggcgcgcg

SEQ ID NO: 2418634 - RNA, 17 nt, Bordetella pertussis
ccguuucucaacccgcc

SEQ ID NO: 2418635 - RNA, 20 nt, Bordetella pertussis
ccguuugccccucggcgggc

SEQ ID NO: 2418636 - RNA, 14 nt, Bordetella pertussis
ccguuugcgcagcu

SEQ ID NO: 2418637 - RNA, 18 nt, Bordetella pertussis
ccguuuucagcgcaggcu

SEQ ID NO: 2418638 - RNA, 13 nt, Bordetella pertussis
ccguuuugcagga

SEQ ID NO: 2418639 - RNA, 19 nt, Bordetella pertussis
ccguuuugcaggaccgucc

SEQ ID NO: 2418640 - RNA, 23 nt, Bordetella pertussis
ccguuuuggcaggcuggcauuga

SEQ ID NO: 2418641 - RNA, 21 nt, Bordetella pertussis
ccuaccaggugggcgcgcuca

SEQ ID NO: 2418642 - RNA, 14 nt, Bordetella pertussis
ccuacccgccgggc

SEQ ID NO: 2418643 - RNA, 13 nt, Bordetella pertussis
ccuaccggcgccg

SEQ ID NO: 2418644 - RNA, 22 nt, Bordetella pertussis
ccuaccggcgccgacgcgcugg

SEQ ID NO: 2418645 - RNA, 16 nt, Bordetella pertussis
ccuacggcggcggcca

SEQ ID NO: 2418646 - RNA, 14 nt, Bordetella pertussis
ccuacuggcgcgcg

SEQ ID NO: 2418647 - RNA, 15 nt, Bordetella pertussis
ccuacuggcgcgcgc

SEQ ID NO: 2418648 - RNA, 20 nt, Bordetella pertussis
ccuacuugcgggacuggacg

SEQ ID NO: 2418649 - RNA, 14 nt, Bordetella pertussis
ccuagcccggcgcc

SEQ ID NO: 2418650 - RNA, 12 nt, Bordetella pertussis
ccuagcgccgcg

SEQ ID NO: 2418651 - RNA, 15 nt, Bordetella pertussis
ccuagcgccgcgcca

SEQ ID NO: 2418652 - RNA, 16 nt, Bordetella pertussis
ccuagcgccgcgccag

SEQ ID NO: 2418653 - RNA, 21 nt, Bordetella pertussis
ccuagcgccgcgccagguagg

SEQ ID NO: 2418654 - RNA, 14 nt, Bordetella pertussis
ccuaggcugcagcc

SEQ ID NO: 2418655 - RNA, 22 nt, Bordetella pertussis
ccuaggcugcagccaguugggc

SEQ ID NO: 2418656 - RNA, 17 nt, Bordetella pertussis
ccuauguaggcgccgcg

SEQ ID NO: 2418657 - RNA, 19 nt, Bordetella pertussis
ccuauguaggcgccgcgcc

SEQ ID NO: 2418658 - RNA, 16 nt, Bordetella pertussis
ccuauugcgacgccgc

SEQ ID NO: 2418659 - RNA, 18 nt, Bordetella pertussis
ccuauugcgacgccgccg

SEQ ID NO: 2418660 - RNA, 15 nt, Bordetella pertussis
ccucaaccuucucga

SEQ ID NO: 2418661 - RNA, 17 nt, Bordetella pertussis
ccucaaccuucucgaug

SEQ ID NO: 2418662 - RNA, 23 nt, Bordetella pertussis
ccucaaccuucucgaugcgcgcc

SEQ ID NO: 2418663 - RNA, 14 nt, Bordetella pertussis
ccucaccgcgccgg

SEQ ID NO: 2418664 - RNA, 23 nt, Bordetella pertussis
ccucacuccauagcgccgcucga

SEQ ID NO: 2418665 - RNA, 14 nt, Bordetella pertussis
ccucagaccacgac

SEQ ID NO: 2418666 - RNA, 21 nt, Bordetella pertussis
ccucagcccgcaccgcccgca

SEQ ID NO: 2418667 - RNA, 21 nt, Bordetella pertussis
ccucagccugguauugccugu

SEQ ID NO: 2418668 - RNA, 14 nt, Bordetella pertussis
ccucagcggccgcu

SEQ ID NO: 2418669 - RNA, 20 nt, Bordetella pertussis
ccucagcguuuccagggcgc

SEQ ID NO: 2418670 - RNA, 17 nt, Bordetella pertussis
ccucaggcccgcggcgc

SEQ ID NO: 2418671 - RNA, 13 nt, Bordetella pertussis
ccucaggccggcg

SEQ ID NO: 2418672 - RNA, 16 nt, Bordetella pertussis
ccucaggccggcgccu

SEQ ID NO: 2418673 - RNA, 17 nt, Bordetella pertussis
ccucaguccagcuggcc

SEQ ID NO: 2418674 - RNA, 19 nt, Bordetella pertussis
ccucaguccagcuggcccu

SEQ ID NO: 2418675 - RNA, 23 nt, Bordetella pertussis
ccucaucgagcgccugggcggcc

SEQ ID NO: 2418676 - RNA, 24 nt, Bordetella pertussis
ccucaucguucugcgucaaggcaa

SEQ ID NO: 2418677 - RNA, 20 nt, Bordetella pertussis
ccucaugcgggacaggcgcc

SEQ ID NO: 2418678 - RNA, 11 nt, Bordetella pertussis
ccuccagcagg

SEQ ID NO: 2418679 - RNA, 22 nt, Bordetella pertussis
ccuccagcagggacuugggcag

SEQ ID NO: 2418680 - RNA, 19 nt, Bordetella pertussis
ccuccagcaucgccgccag

SEQ ID NO: 2418681 - RNA, 22 nt, Bordetella pertussis
ccuccagcaucgccgccagcuu

SEQ ID NO: 2418682 - RNA, 12 nt, Bordetella pertussis
ccuccagcucca

SEQ ID NO: 2418683 - RNA, 23 nt, Bordetella pertussis
ccucggacgagacaggcgcgcca

SEQ ID NO: 2418684 - RNA, 15 nt, Bordetella pertussis
ccucggacgccuggc

SEQ ID NO: 2418685 - RNA, 20 nt, Bordetella pertussis
ccucggaggauacggccagc

SEQ ID NO: 2418686 - RNA, 21 nt, Bordetella pertussis
ccucggaggauacggccagcg

SEQ ID NO: 2418687 - RNA, 17 nt, Bordetella pertussis
ccucggcaccgaggccg

SEQ ID NO: 2418688 - RNA, 19 nt, Bordetella pertussis
ccucggccagcugggaggc

SEQ ID NO: 2418689 - RNA, 18 nt, Bordetella pertussis
ccucggccagcugggcca

SEQ ID NO: 2418690 - RNA, 17 nt, Bordetella pertussis
ccucggccaggucgcgc

SEQ ID NO: 2418691 - RNA, 12 nt, Bordetella pertussis
ccucggccggca

SEQ ID NO: 2418692 - RNA, 11 nt, Bordetella pertussis
ccucggccugc

SEQ ID NO: 2418693 - RNA, 15 nt, Bordetella pertussis
ccucggccugccggc

SEQ ID NO: 2418694 - RNA, 19 nt, Bordetella pertussis
ccucggccugccggcgcgc

SEQ ID NO: 2418695 - RNA, 14 nt, Bordetella pertussis
ccucggccuggccc

SEQ ID NO: 2418696 - RNA, 17 nt, Bordetella pertussis
ccucggccuggccccag

SEQ ID NO: 2418697 - RNA, 22 nt, Bordetella pertussis
ccucggccuggccccaggcgcc

SEQ ID NO: 2418698 - RNA, 19 nt, Bordetella pertussis
ccucggcgaagugcccgcu

SEQ ID NO: 2418699 - RNA, 12 nt, Bordetella pertussis
ccucggcgagcg

SEQ ID NO: 2418700 - RNA, 13 nt, Bordetella pertussis
ccucggcgccgcg

SEQ ID NO: 2418701 - RNA, 12 nt, Bordetella pertussis
ccucggcgcgcg

SEQ ID NO: 2418702 - RNA, 13 nt, Bordetella pertussis
ccucggcgcgcgc

SEQ ID NO: 2418703 - RNA, 13 nt, Bordetella pertussis
ccucggcggccag

SEQ ID NO: 2418704 - RNA, 14 nt, Bordetella pertussis
ccucggcggccucc

SEQ ID NO: 2418705 - RNA, 16 nt, Bordetella pertussis
ccucggcggccuccgg

SEQ ID NO: 2418706 - RNA, 17 nt, Bordetella pertussis
ccucggcggccuccggc

SEQ ID NO: 2418707 - RNA, 19 nt, Bordetella pertussis
ccucggcggcgucgcuggc

SEQ ID NO: 2418708 - RNA, 22 nt, Bordetella pertussis
ccucggcggcgucgcuggcagc

SEQ ID NO: 2418709 - RNA, 16 nt, Bordetella pertussis
ccucggcgggcggcgc

SEQ ID NO: 2418710 - RNA, 18 nt, Bordetella pertussis
ccucggcgggcggcgcca

SEQ ID NO: 2418711 - RNA, 19 nt, Bordetella pertussis
ccucggcgggcggcgccag

SEQ ID NO: 2418712 - RNA, 20 nt, Bordetella pertussis
ccucgggcgacuccagcccg

SEQ ID NO: 2418713 - RNA, 22 nt, Bordetella pertussis
ccucgggcgacuccagcccgau

SEQ ID NO: 2418714 - RNA, 16 nt, Bordetella pertussis
ccucggggcgcggccg

SEQ ID NO: 2418715 - RNA, 17 nt, Bordetella pertussis
ccucggggcgcggccgg

SEQ ID NO: 2418716 - RNA, 14 nt, Bordetella pertussis
ccucggggugcagc

SEQ ID NO: 2418717 - RNA, 15 nt, Bordetella pertussis
ccucggggugcagcu

SEQ ID NO: 2418718 - RNA, 20 nt, Bordetella pertussis
ccucgggugccuguccccac

SEQ ID NO: 2418719 - RNA, 17 nt, Bordetella pertussis
ccucggucagcgccagg

SEQ ID NO: 2418720 - RNA, 22 nt, Bordetella pertussis
ccucggucagcgccagggugcc

SEQ ID NO: 2418721 - RNA, 12 nt, Bordetella pertussis
ccucgguccagc

SEQ ID NO: 2418722 - RNA, 15 nt, Bordetella pertussis
ccucgguccagcgga

SEQ ID NO: 2418723 - RNA, 19 nt, Bordetella pertussis
ccucggucgucagcacgcc

SEQ ID NO: 2418724 - RNA, 22 nt, Bordetella pertussis
ccucggucgucagcacgcccug

SEQ ID NO: 2418725 - RNA, 24 nt, Bordetella pertussis
ccucggucgucagcacgcccuggc

SEQ ID NO: 2418726 - RNA, 16 nt, Bordetella pertussis
ccucguaaguggcggc

SEQ ID NO: 2418727 - RNA, 14 nt, Bordetella pertussis
ccucguaggccauc

SEQ ID NO: 2418728 - RNA, 18 nt, Bordetella pertussis
ccucguccucgucggcga

SEQ ID NO: 2418729 - RNA, 15 nt, Bordetella pertussis
ccucguccugcaggc

SEQ ID NO: 2418730 - RNA, 16 nt, Bordetella pertussis
ccucguccugcaggcg

SEQ ID NO: 2418731 - RNA, 17 nt, Bordetella pertussis
ccucguccugcaggcgg

SEQ ID NO: 2418732 - RNA, 20 nt, Bordetella pertussis
ccucguccugcaggcggcgc

SEQ ID NO: 2418733 - RNA, 16 nt, Bordetella pertussis
ccucgucgaccacgcc

SEQ ID NO: 2418734 - RNA, 20 nt, Bordetella pertussis
ccucgucgcgcaacgccggg

SEQ ID NO: 2418735 - RNA, 17 nt, Bordetella pertussis
ccucgucggccaugcgc

SEQ ID NO: 2418736 - RNA, 19 nt, Bordetella pertussis
ccucgucggccaugcgcgc

SEQ ID NO: 2418737 - RNA, 19 nt, Bordetella pertussis
ccucgucggcgaagccuug

SEQ ID NO: 2418738 - RNA, 19 nt, Bordetella pertussis
ccucgugaucgaccgccag

SEQ ID NO: 2418739 - RNA, 21 nt, Bordetella pertussis
ccucgugaucgaccgccagca

SEQ ID NO: 2418740 - RNA, 18 nt, Bordetella pertussis
ccucgugcugcugcaggc

SEQ ID NO: 2418741 - RNA, 15 nt, Bordetella pertussis
ccucguugacgccga

SEQ ID NO: 2418742 - RNA, 13 nt, Bordetella pertussis
ccucguugcccgc

SEQ ID NO: 2418743 - RNA, 15 nt, Bordetella pertussis
ccucuucagcccggc

SEQ ID NO: 2418744 - RNA, 22 nt, Bordetella pertussis
ccucuucagcccggcgcgccac

SEQ ID NO: 2418745 - RNA, 21 nt, Bordetella pertussis
ccucuugcgugacccggggca

SEQ ID NO: 2418746 - RNA, 17 nt, Bordetella pertussis
ccugaacaccggcgcgc

SEQ ID NO: 2418747 - RNA, 14 nt, Bordetella pertussis
ccugaaccaggccg

SEQ ID NO: 2418748 - RNA, 16 nt, Bordetella pertussis
ccugaaccaggccgcc

SEQ ID NO: 2418749 - RNA, 17 nt, Bordetella pertussis
ccugaaccaggccgcca

SEQ ID NO: 2418750 - RNA, 23 nt, Bordetella pertussis
ccugaaccaggccgccagggccg

SEQ ID NO: 2418751 - RNA, 18 nt, Bordetella pertussis
ccugaacgccgggccgug

SEQ ID NO: 2418752 - RNA, 23 nt, Bordetella pertussis
ccugaauccguaagcgcuggacg

SEQ ID NO: 2418753 - RNA, 17 nt, Bordetella pertussis
ccugaaucgcccgggcg

SEQ ID NO: 2418754 - RNA, 19 nt, Bordetella pertussis
ccugaaucgcccgggcgcc

SEQ ID NO: 2418755 - RNA, 18 nt, Bordetella pertussis
ccugaccaucaucaacuu

SEQ ID NO: 2418756 - RNA, 11 nt, Bordetella pertussis
ccugaccggcg

SEQ ID NO: 2418757 - RNA, 12 nt, Bordetella pertussis
ccugaccggcgg

SEQ ID NO: 2418758 - RNA, 14 nt, Bordetella pertussis
ccugaccggcggcg

SEQ ID NO: 2418759 - RNA, 16 nt, Bordetella pertussis
ccugacgaccaaccug

SEQ ID NO: 2418760 - RNA, 18 nt, Bordetella pertussis
ccugacgaccaaccugac

SEQ ID NO: 2418761 - RNA, 23 nt, Bordetella pertussis
ccugacgaccaaccugaccgccu

SEQ ID NO: 2418762 - RNA, 16 nt, Bordetella pertussis
ccugacgccugcgccg

SEQ ID NO: 2418763 - RNA, 21 nt, Bordetella pertussis
ccugacgcgcaagcggcccca

SEQ ID NO: 2418764 - RNA, 21 nt, Bordetella pertussis
ccugacgcucauccaggcgcg

SEQ ID NO: 2418765 - RNA, 19 nt, Bordetella pertussis
ccugacggcuacacccugc

SEQ ID NO: 2418766 - RNA, 22 nt, Bordetella pertussis
ccugacggcuacacccugcucu

SEQ ID NO: 2418767 - RNA, 15 nt, Bordetella pertussis
ccugagcaccgccgc

SEQ ID NO: 2418768 - RNA, 20 nt, Bordetella pertussis
ccugagccgauacaggcgcu

SEQ ID NO: 2418769 - RNA, 15 nt, Bordetella pertussis
ccugaggccaggccg

SEQ ID NO: 2418770 - RNA, 19 nt, Bordetella pertussis
ccugaucaaucugaucauc

SEQ ID NO: 2418771 - RNA, 20 nt, Bordetella pertussis
ccugaucaaucugaucaucu

SEQ ID NO: 2418772 - RNA, 21 nt, Bordetella pertussis
ccugaucgaauaccugcgccg

SEQ ID NO: 2418773 - RNA, 15 nt, Bordetella pertussis
ccugaucgaggagcu

SEQ ID NO: 2418774 - RNA, 21 nt, Bordetella pertussis
ccugaucgaggagcugcugug

SEQ ID NO: 2418775 - RNA, 14 nt, Bordetella pertussis
ccugaucgccucgg

SEQ ID NO: 2418776 - RNA, 12 nt, Bordetella pertussis
ccugaucgcgca

SEQ ID NO: 2418777 - RNA, 14 nt, Bordetella pertussis
ccugaucgcgcagc

SEQ ID NO: 2418778 - RNA, 15 nt, Bordetella pertussis
ccugaucgcgcagcg

SEQ ID NO: 2418779 - RNA, 22 nt, Bordetella pertussis
ccugaucgcgcagcgccuggcc

SEQ ID NO: 2418780 - RNA, 15 nt, Bordetella pertussis
ccugaucggggccaa

SEQ ID NO: 2418781 - RNA, 22 nt, Bordetella pertussis
ccugaucggggccaagauccag

SEQ ID NO: 2418782 - RNA, 13 nt, Bordetella pertussis
ccugaugccuguc

SEQ ID NO: 2418783 - RNA, 12 nt, Bordetella pertussis
ccugauggcgcg

SEQ ID NO: 2418784 - RNA, 14 nt, Bordetella pertussis
ccugauucccaggc

SEQ ID NO: 2418785 - RNA, 22 nt, Bordetella pertussis
ccugauucccaggcccggccgc

SEQ ID NO: 2418786 - RNA, 23 nt, Bordetella pertussis
ccugcaaaaaacaagcucgcgca

SEQ ID NO: 2418787 - RNA, 24 nt, Bordetella pertussis
ccugcaacuggugcacgaugccca

SEQ ID NO: 2418788 - RNA, 16 nt, Bordetella pertussis
ccugcaagauggcguc

SEQ ID NO: 2418789 - RNA, 17 nt, Bordetella pertussis
ccugcaagauuucaugg

SEQ ID NO: 2418790 - RNA, 13 nt, Bordetella pertussis
ccugcaaggccgg

SEQ ID NO: 2418791 - RNA, 14 nt, Bordetella pertussis
ccugcaaggccggc

SEQ ID NO: 2418792 - RNA, 13 nt, Bordetella pertussis
ccugcaaugcggc

SEQ ID NO: 2418793 - RNA, 14 nt, Bordetella pertussis
ccugcaccgccgcg

SEQ ID NO: 2418794 - RNA, 15 nt, Bordetella pertussis
ccugcaccgccgcgc

SEQ ID NO: 2418795 - RNA, 16 nt, Bordetella pertussis
ccugcaccgccgcgcg

SEQ ID NO: 2418796 - RNA, 17 nt, Bordetella pertussis
ccugccgcgcccggcgg

SEQ ID NO: 2418797 - RNA, 20 nt, Bordetella pertussis
ccugccgcgcccggcggcca

SEQ ID NO: 2418798 - RNA, 23 nt, Bordetella pertussis
ccugccgcgcccggcggccaggc

SEQ ID NO: 2418799 - RNA, 15 nt, Bordetella pertussis
ccugccgcgccgacc

SEQ ID NO: 2418800 - RNA, 13 nt, Bordetella pertussis
ccugccgcgcgua

SEQ ID NO: 2418801 - RNA, 21 nt, Bordetella pertussis
ccugccgcgcguacgcggcgc

SEQ ID NO: 2418802 - RNA, 13 nt, Bordetella pertussis
ccugccgcggccg

SEQ ID NO: 2418803 - RNA, 15 nt, Bordetella pertussis
ccugccgcggccgcc

SEQ ID NO: 2418804 - RNA, 16 nt, Bordetella pertussis
ccugccgcggccgccc

SEQ ID NO: 2418805 - RNA, 14 nt, Bordetella pertussis
ccugccgcgugccc

SEQ ID NO: 2418806 - RNA, 23 nt, Bordetella pertussis
ccugccgcgugcccgcguccacc

SEQ ID NO: 2418807 - RNA, 15 nt, Bordetella pertussis
ccugccggccggcca

SEQ ID NO: 2418808 - RNA, 14 nt, Bordetella pertussis
ccugccggcgcaca

SEQ ID NO: 2418809 - RNA, 13 nt, Bordetella pertussis
ccugccggcgcgc

SEQ ID NO: 2418810 - RNA, 14 nt, Bordetella pertussis
ccugccggcgcgcc

SEQ ID NO: 2418811 - RNA, 15 nt, Bordetella pertussis
ccugccggcgcgccu

SEQ ID NO: 2418812 - RNA, 15 nt, Bordetella pertussis
ccugccggcggacga

SEQ ID NO: 2418813 - RNA, 20 nt, Bordetella pertussis
ccugccggggcacccaggcg

SEQ ID NO: 2418814 - RNA, 17 nt, Bordetella pertussis
ccugccguucgcgcugc

SEQ ID NO: 2418815 - RNA, 22 nt, Bordetella pertussis
ccugccguucgcgcugcccacc

SEQ ID NO: 2418816 - RNA, 12 nt, Bordetella pertussis
ccugccucagac

SEQ ID NO: 2418817 - RNA, 14 nt, Bordetella pertussis
ccugccuccaggcg

SEQ ID NO: 2418818 - RNA, 19 nt, Bordetella pertussis
ccugccugccgagcgcugc

SEQ ID NO: 2418819 - RNA, 14 nt, Bordetella pertussis
ccugccugccgccu

SEQ ID NO: 2418820 - RNA, 19 nt, Bordetella pertussis
ccugcgaacccgccgcgau

SEQ ID NO: 2418821 - RNA, 16 nt, Bordetella pertussis
ccugcgaacgcccggc

SEQ ID NO: 2418822 - RNA, 17 nt, Bordetella pertussis
ccugcgaacgcccggcc

SEQ ID NO: 2418823 - RNA, 22 nt, Bordetella pertussis
ccugcgaacgcccggcccaggc

SEQ ID NO: 2418824 - RNA, 21 nt, Bordetella pertussis
ccugcgagagauagcccagca

SEQ ID NO: 2418825 - RNA, 23 nt, Bordetella pertussis
ccugcgagagauagcccagcacc

SEQ ID NO: 2418826 - RNA, 24 nt, Bordetella pertussis
ccugcgagagauagcccagcaccu

SEQ ID NO: 2418827 - RNA, 14 nt, Bordetella pertussis
ccugcgaggacagg

SEQ ID NO: 2418828 - RNA, 22 nt, Bordetella pertussis
ccugcgaggacaggggccucau

SEQ ID NO: 2418829 - RNA, 23 nt, Bordetella pertussis
ccugcgaggacaggggccucaug

SEQ ID NO: 2418830 - RNA, 20 nt, Bordetella pertussis
ccugcgaucaguucggcaug

SEQ ID NO: 2418831 - RNA, 21 nt, Bordetella pertussis
ccugcgaugccggcguggcgc

SEQ ID NO: 2418832 - RNA, 19 nt, Bordetella pertussis
ccugcgcacccgccuggac

SEQ ID NO: 2418833 - RNA, 20 nt, Bordetella pertussis
ccugcgcacccgccuggacg

SEQ ID NO: 2418834 - RNA, 15 nt, Bordetella pertussis
ccugcgcaccggccg

SEQ ID NO: 2418835 - RNA, 16 nt, Bordetella pertussis
ccugcgcaccggccgg

SEQ ID NO: 2418836 - RNA, 17 nt, Bordetella pertussis
ccugcgcaccggccggc

SEQ ID NO: 2418837 - RNA, 18 nt, Bordetella pertussis
ccugcgcaccggccggcc

SEQ ID NO: 2418838 - RNA, 21 nt, Bordetella pertussis
ccugcgcaccggccggccggg

SEQ ID NO: 2418839 - RNA, 22 nt, Bordetella pertussis
ccugcgcaucgaucagcgcgcc

SEQ ID NO: 2418840 - RNA, 23 nt, Bordetella pertussis
ccugcgcaucgaucagcgcgccg

SEQ ID NO: 2418841 - RNA, 13 nt, Bordetella pertussis
ccugcgccaccag

SEQ ID NO: 2418842 - RNA, 14 nt, Bordetella pertussis
ccugcgccaccagc

SEQ ID NO: 2418843 - RNA, 17 nt, Bordetella pertussis
ccugcgccaccagcuug

SEQ ID NO: 2418844 - RNA, 22 nt, Bordetella pertussis
ccugcgccaccuggcgcccggc

SEQ ID NO: 2418845 - RNA, 20 nt, Bordetella pertussis
ccugcgccagccgcgccugc

SEQ ID NO: 2418846 - RNA, 18 nt, Bordetella pertussis
ccugcgccagcgccucgc

SEQ ID NO: 2418847 - RNA, 15 nt, Bordetella pertussis
ccugcgccagcucca

SEQ ID NO: 2418848 - RNA, 20 nt, Bordetella pertussis
ccugcgccagcuccagccgc

SEQ ID NO: 2418849 - RNA, 16 nt, Bordetella pertussis
ccugcgccagcuuggc

SEQ ID NO: 2418850 - RNA, 15 nt, Bordetella pertussis
ccugcgccaggugcu

SEQ ID NO: 2418851 - RNA, 18 nt, Bordetella pertussis
ccugcgccauggcgcgca

SEQ ID NO: 2418852 - RNA, 19 nt, Bordetella pertussis
ccugcgccauggcgcgcag

SEQ ID NO: 2418853 - RNA, 21 nt, Bordetella pertussis
ccugcgccauguggcgacgcc

SEQ ID NO: 2418854 - RNA, 20 nt, Bordetella pertussis
ccugcgccgaggcgggcagc

SEQ ID NO: 2418855 - RNA, 11 nt, Bordetella pertussis
ccugcgccgcc

SEQ ID NO: 2418856 - RNA, 14 nt, Bordetella pertussis
ccugcgccgccgcg

SEQ ID NO: 2418857 - RNA, 16 nt, Bordetella pertussis
ccugcgccgccgcgcg

SEQ ID NO: 2418858 - RNA, 19 nt, Bordetella pertussis
ccugcgccgccgcgcgcug

SEQ ID NO: 2418859 - RNA, 20 nt, Bordetella pertussis
ccugcgccggcauggccaau

SEQ ID NO: 2418860 - RNA, 20 nt, Bordetella pertussis
ccugcgccgggcgcggccag

SEQ ID NO: 2418861 - RNA, 20 nt, Bordetella pertussis
ccugcgccggguccggccgc

SEQ ID NO: 2418862 - RNA, 23 nt, Bordetella pertussis
ccugcgccggguccggccgcgca

SEQ ID NO: 2418863 - RNA, 16 nt, Bordetella pertussis
ccugcgccgucugcgc

SEQ ID NO: 2418864 - RNA, 17 nt, Bordetella pertussis
ccugcgccgucugcgcc

SEQ ID NO: 2418865 - RNA, 23 nt, Bordetella pertussis
ccugcgccgucugcgccgccgcg

SEQ ID NO: 2418866 - RNA, 16 nt, Bordetella pertussis
ccugcgcgaccgccgc

SEQ ID NO: 2418867 - RNA, 17 nt, Bordetella pertussis
ccugcgcgaccgccgcg

SEQ ID NO: 2418868 - RNA, 22 nt, Bordetella pertussis
ccugcgcgaggugccggacgcc

SEQ ID NO: 2418869 - RNA, 18 nt, Bordetella pertussis
ccugcgcgaugcgcgcgc

SEQ ID NO: 2418870 - RNA, 19 nt, Bordetella pertussis
ccugcgcgaugcgcgcgcg

SEQ ID NO: 2418871 - RNA, 12 nt, Bordetella pertussis
ccugcgcgccga

SEQ ID NO: 2418872 - RNA, 16 nt, Bordetella pertussis
ccugcgcgccgaccag

SEQ ID NO: 2418873 - RNA, 21 nt, Bordetella pertussis
ccugcgcgccgaccaggucgg

SEQ ID NO: 2418874 - RNA, 14 nt, Bordetella pertussis
ccugcgcgccgccg

SEQ ID NO: 2418875 - RNA, 14 nt, Bordetella pertussis
ccugcgcgccgccu

SEQ ID NO: 2418876 - RNA, 23 nt, Bordetella pertussis
ccugcgcgccgccucgauugacc

SEQ ID NO: 2418877 - RNA, 13 nt, Bordetella pertussis
ccugcgcgccggc

SEQ ID NO: 2418878 - RNA, 16 nt, Bordetella pertussis
ccugcgcgccggcaug

SEQ ID NO: 2418879 - RNA, 17 nt, Bordetella pertussis
ccugcgcgccggcaugg

SEQ ID NO: 2418880 - RNA, 21 nt, Bordetella pertussis
ccugcgcgcgagcagucgacc

SEQ ID NO: 2418881 - RNA, 16 nt, Bordetella pertussis
ccugcgcgucccggua

SEQ ID NO: 2418882 - RNA, 19 nt, Bordetella pertussis
ccugcgcugcauacgccgc

SEQ ID NO: 2418883 - RNA, 23 nt, Bordetella pertussis
ccugcgcugcauacgccgcugau

SEQ ID NO: 2418884 - RNA, 18 nt, Bordetella pertussis
ccugcggacccaguucgg

SEQ ID NO: 2418885 - RNA, 22 nt, Bordetella pertussis
ccugcggacggcgggcgccccg

SEQ ID NO: 2418886 - RNA, 14 nt, Bordetella pertussis
ccugcggcagcgac

SEQ ID NO: 2418887 - RNA, 18 nt, Bordetella pertussis
ccugcggcagcgacucgc

SEQ ID NO: 2418888 - RNA, 23 nt, Bordetella pertussis
ccugcggcaggccgcagcgggcc

SEQ ID NO: 2418889 - RNA, 22 nt, Bordetella pertussis
ccugcggcauggugugccuguc

SEQ ID NO: 2418890 - RNA, 12 nt, Bordetella pertussis
ccugcggcgcca

SEQ ID NO: 2418891 - RNA, 20 nt, Bordetella pertussis
ccugcggcgccagcgccgcg

SEQ ID NO: 2418892 - RNA, 18 nt, Bordetella pertussis
ccugcggcgcggccagca

SEQ ID NO: 2418893 - RNA, 20 nt, Bordetella pertussis
ccugcggcgcggccagcacg

SEQ ID NO: 2418894 - RNA, 18 nt, Bordetella pertussis
ccugcggcuugggcccgg

SEQ ID NO: 2418895 - RNA, 16 nt, Bordetella pertussis
ccugcgggaacugcgu

SEQ ID NO: 2418896 - RNA, 12 nt, Bordetella pertussis
ccugcgggccgc

SEQ ID NO: 2418897 - RNA, 14 nt, Bordetella pertussis
ccugcgggccgcac

SEQ ID NO: 2418898 - RNA, 16 nt, Bordetella pertussis
ccugcgggccgcacag

SEQ ID NO: 2418899 - RNA, 12 nt, Bordetella pertussis
ccugcgggccgg

SEQ ID NO: 2418900 - RNA, 14 nt, Bordetella pertussis
ccugcgggccgggc

SEQ ID NO: 2418901 - RNA, 19 nt, Bordetella pertussis
ccugcgggccgggcaggcc

SEQ ID NO: 2418902 - RNA, 22 nt, Bordetella pertussis
ccugcgggccgggcaggccgcg

SEQ ID NO: 2418903 - RNA, 17 nt, Bordetella pertussis
ccugcgggcgcagcgcc

SEQ ID NO: 2418904 - RNA, 18 nt, Bordetella pertussis
ccugcgggcgcagcgccg

SEQ ID NO: 2418905 - RNA, 15 nt, Bordetella pertussis
ccugcgggcgccgcg

SEQ ID NO: 2418906 - RNA, 22 nt, Bordetella pertussis
ccugcgggcugaugcaggccug

SEQ ID NO: 2418907 - RNA, 14 nt, Bordetella pertussis
ccugcggggacagg

SEQ ID NO: 2418908 - RNA, 13 nt, Bordetella pertussis
ccuggccggcgcc

SEQ ID NO: 2418909 - RNA, 15 nt, Bordetella pertussis
ccuggccugcgccgc

SEQ ID NO: 2418910 - RNA, 16 nt, Bordetella pertussis
ccuggccugcgccgcc

SEQ ID NO: 2418911 - RNA, 18 nt, Bordetella pertussis
ccuggccugcgccgccgc

SEQ ID NO: 2418912 - RNA, 17 nt, Bordetella pertussis
ccuggccuucgaccugc

SEQ ID NO: 2418913 - RNA, 17 nt, Bordetella pertussis
ccuggccuucgcugccc

SEQ ID NO: 2418914 - RNA, 15 nt, Bordetella pertussis
ccuggcgaccggcgg

SEQ ID NO: 2418915 - RNA, 18 nt, Bordetella pertussis
ccuggcgaccggcggcac

SEQ ID NO: 2418916 - RNA, 18 nt, Bordetella pertussis
ccuggcgacggccugcca

SEQ ID NO: 2418917 - RNA, 15 nt, Bordetella pertussis
ccuggcgcaggccgg

SEQ ID NO: 2418918 - RNA, 16 nt, Bordetella pertussis
ccuggcgcaggccggc

SEQ ID NO: 2418919 - RNA, 23 nt, Bordetella pertussis
ccuggcgcaggccggcggccagc

SEQ ID NO: 2418920 - RNA, 14 nt, Bordetella pertussis
ccuggcgcccgacg

SEQ ID NO: 2418921 - RNA, 16 nt, Bordetella pertussis
ccuggcgcccggcggc

SEQ ID NO: 2418922 - RNA, 13 nt, Bordetella pertussis
ccuggcgccgcgg

SEQ ID NO: 2418923 - RNA, 16 nt, Bordetella pertussis
ccuggcgcgacgccug

SEQ ID NO: 2418924 - RNA, 21 nt, Bordetella pertussis
ccuggcgcgacgccugcgcca

SEQ ID NO: 2418925 - RNA, 15 nt, Bordetella pertussis
ccuggcgcgagacca

SEQ ID NO: 2418926 - RNA, 11 nt, Bordetella pertussis
ccuggcgcgcg

SEQ ID NO: 2418927 - RNA, 17 nt, Bordetella pertussis
ccuggcgcgcgaacggg

SEQ ID NO: 2418928 - RNA, 18 nt, Bordetella pertussis
ccuggcgcgcgaacgggg

SEQ ID NO: 2418929 - RNA, 15 nt, Bordetella pertussis
ccuggcgcgcggccu

SEQ ID NO: 2418930 - RNA, 13 nt, Bordetella pertussis
ccuggcgcgcguu

SEQ ID NO: 2418931 - RNA, 15 nt, Bordetella pertussis
ccuggcgcggcccca

SEQ ID NO: 2418932 - RNA, 22 nt, Bordetella pertussis
ccuggcgcggccccaugcgcgg

SEQ ID NO: 2418933 - RNA, 24 nt, Bordetella pertussis
ccuggcgcggcgccugcgcgcgcu

SEQ ID NO: 2418934 - RNA, 16 nt, Bordetella pertussis
ccuggcgcugcagcgu

SEQ ID NO: 2418935 - RNA, 16 nt, Bordetella pertussis
ccuggcggacgauggc

SEQ ID NO: 2418936 - RNA, 21 nt, Bordetella pertussis
ccuggcggaucucggccagca

SEQ ID NO: 2418937 - RNA, 14 nt, Bordetella pertussis
ccuggcggccgccc

SEQ ID NO: 2418938 - RNA, 16 nt, Bordetella pertussis
ccuggcggccgcccag

SEQ ID NO: 2418939 - RNA, 18 nt, Bordetella pertussis
ccuggcggccgcccagca

SEQ ID NO: 2418940 - RNA, 18 nt, Bordetella pertussis
ccuggcggcgcaguucgg

SEQ ID NO: 2418941 - RNA, 13 nt, Bordetella pertussis
ccuggcgggccga

SEQ ID NO: 2418942 - RNA, 13 nt, Bordetella pertussis
ccuggcgggccgg

SEQ ID NO: 2418943 - RNA, 18 nt, Bordetella pertussis
ccuggcgguaugcggcgc

SEQ ID NO: 2418944 - RNA, 22 nt, Bordetella pertussis
ccuggcgguaugcggcgcccag

SEQ ID NO: 2418945 - RNA, 13 nt, Bordetella pertussis
ccuggcggugcgc

SEQ ID NO: 2418946 - RNA, 22 nt, Bordetella pertussis
ccuggcguagggcugcacgaug

SEQ ID NO: 2418947 - RNA, 19 nt, Bordetella pertussis
ccuggcguaugcccacucc

SEQ ID NO: 2418948 - RNA, 18 nt, Bordetella pertussis
ccuggcguggcgcgcgcc

SEQ ID NO: 2418949 - RNA, 20 nt, Bordetella pertussis
ccuggcguucaaucgcgcuu

SEQ ID NO: 2418950 - RNA, 15 nt, Bordetella pertussis
ccuggcguucgcgcg

SEQ ID NO: 2418951 - RNA, 13 nt, Bordetella pertussis
ccuggcucaggcc

SEQ ID NO: 2418952 - RNA, 15 nt, Bordetella pertussis
ccuggcucaggccug

SEQ ID NO: 2418953 - RNA, 22 nt, Bordetella pertussis
ccuggcucagucggccuggcgc

SEQ ID NO: 2418954 - RNA, 18 nt, Bordetella pertussis
ccuggcucugaucgcgcu

SEQ ID NO: 2418955 - RNA, 20 nt, Bordetella pertussis
ccuggcucugaucgcgcugg

SEQ ID NO: 2418956 - RNA, 15 nt, Bordetella pertussis
ccuggcucuugccgu

SEQ ID NO: 2418957 - RNA, 20 nt, Bordetella pertussis
ccuggcugagcgacaugucg

SEQ ID NO: 2418958 - RNA, 16 nt, Bordetella pertussis
ccuggcuggccagccg

SEQ ID NO: 2418959 - RNA, 15 nt, Bordetella pertussis
ccuggcuuacaggcc

SEQ ID NO: 2418960 - RNA, 16 nt, Bordetella pertussis
ccuggcuucccggucc

SEQ ID NO: 2418961 - RNA, 16 nt, Bordetella pertussis
ccuggcuuggcggcca

SEQ ID NO: 2418962 - RNA, 17 nt, Bordetella pertussis
ccuggcuuggcggccag

SEQ ID NO: 2418963 - RNA, 17 nt, Bordetella pertussis
ccugggaggcgcugaug

SEQ ID NO: 2418964 - RNA, 17 nt, Bordetella pertussis
ccugggaggggccggcu

SEQ ID NO: 2418965 - RNA, 22 nt, Bordetella pertussis
ccugggcaaccgccacgugcug

SEQ ID NO: 2418966 - RNA, 20 nt, Bordetella pertussis
ccugggcaucaacacgcugg

SEQ ID NO: 2418967 - RNA, 17 nt, Bordetella pertussis
ccugggccagcagcugg

SEQ ID NO: 2418968 - RNA, 15 nt, Bordetella pertussis
ccugggccagccagc

SEQ ID NO: 2418969 - RNA, 18 nt, Bordetella pertussis
ccugggccagccagcgcc

SEQ ID NO: 2418970 - RNA, 20 nt, Bordetella pertussis
ccugggccagccagcgccgc

SEQ ID NO: 2418971 - RNA, 14 nt, Bordetella pertussis
ccugggccgagcgc

SEQ ID NO: 2418972 - RNA, 18 nt, Bordetella pertussis
ccugggccgagcgcgcca

SEQ ID NO: 2418973 - RNA, 14 nt, Bordetella pertussis
ccugggccgccugc

SEQ ID NO: 2418974 - RNA, 18 nt, Bordetella pertussis
ccugggccgccugcuggg

SEQ ID NO: 2418975 - RNA, 18 nt, Bordetella pertussis
ccugggccgucaugcgcc

SEQ ID NO: 2418976 - RNA, 15 nt, Bordetella pertussis
ccugggccugcggcg

SEQ ID NO: 2418977 - RNA, 21 nt, Bordetella pertussis
ccugggcgcgaugggccugcc

SEQ ID NO: 2418978 - RNA, 23 nt, Bordetella pertussis
ccugggcgcgaugggccugccca

SEQ ID NO: 2418979 - RNA, 15 nt, Bordetella pertussis
ccugggcgcgcgccc

SEQ ID NO: 2418980 - RNA, 17 nt, Bordetella pertussis
ccugggcgcgcgcccag

SEQ ID NO: 2418981 - RNA, 13 nt, Bordetella pertussis
ccugggcggccac

SEQ ID NO: 2418982 - RNA, 13 nt, Bordetella pertussis
ccugggcggcgcg

SEQ ID NO: 2418983 - RNA, 15 nt, Bordetella pertussis
ccugggcggcgcgcu

SEQ ID NO: 2418984 - RNA, 21 nt, Bordetella pertussis
ccugggcggcgcgcucuccga

SEQ ID NO: 2418985 - RNA, 22 nt, Bordetella pertussis
ccugggcgggccguugcgccug

SEQ ID NO: 2418986 - RNA, 13 nt, Bordetella pertussis
ccuggggcgcggu

SEQ ID NO: 2418987 - RNA, 18 nt, Bordetella pertussis
ccuggggcgggcgcugcg

SEQ ID NO: 2418988 - RNA, 15 nt, Bordetella pertussis
ccuggggcgugcccu

SEQ ID NO: 2418989 - RNA, 20 nt, Bordetella pertussis
ccuggggggucaaccaggua

SEQ ID NO: 2418990 - RNA, 23 nt, Bordetella pertussis
ccuggggggucaaccagguaccc

SEQ ID NO: 2418991 - RNA, 22 nt, Bordetella pertussis
ccugggugccuguccccgaacg

SEQ ID NO: 2418992 - RNA, 13 nt, Bordetella pertussis
ccugggugcgcca

SEQ ID NO: 2418993 - RNA, 17 nt, Bordetella pertussis
ccugggugcugccgccg

SEQ ID NO: 2418994 - RNA, 15 nt, Bordetella pertussis
ccuggguggccagcu

SEQ ID NO: 2418995 - RNA, 20 nt, Bordetella pertussis
ccugguaagaaaccuggccc

SEQ ID NO: 2418996 - RNA, 13 nt, Bordetella pertussis
ccugguacgacag

SEQ ID NO: 2418997 - RNA, 15 nt, Bordetella pertussis
ccugguacgacagcu

SEQ ID NO: 2418998 - RNA, 19 nt, Bordetella pertussis
ccugguacgacagcucggg

SEQ ID NO: 2418999 - RNA, 14 nt, Bordetella pertussis
ccugguacggcauc

SEQ ID NO: 2419000 - RNA, 15 nt, Bordetella pertussis
ccugguacggcaucc

SEQ ID NO: 2419001 - RNA, 23 nt, Bordetella pertussis
ccugguaucccucgcccagcgag

SEQ ID NO: 2419002 - RNA, 15 nt, Bordetella pertussis
ccugguauccggcgc

SEQ ID NO: 2419003 - RNA, 16 nt, Bordetella pertussis
ccugguauccggcgca

SEQ ID NO: 2419004 - RNA, 20 nt, Bordetella pertussis
ccugguauccggcgcacgcc

SEQ ID NO: 2419005 - RNA, 20 nt, Bordetella pertussis
ccugguauugccuguggaua

SEQ ID NO: 2419006 - RNA, 17 nt, Bordetella pertussis
ccuggucaagggcggcc

SEQ ID NO: 2419007 - RNA, 18 nt, Bordetella pertussis
ccuggucaagggcggcca

SEQ ID NO: 2419008 - RNA, 20 nt, Bordetella pertussis
ccuggucaagggcggccaug

SEQ ID NO: 2419009 - RNA, 23 nt, Bordetella pertussis
ccuggucaagggcggccaugccg

SEQ ID NO: 2419010 - RNA, 13 nt, Bordetella pertussis
ccuggucagcgcc

SEQ ID NO: 2419011 - RNA, 17 nt, Bordetella pertussis
ccuggucagcgccgacg

SEQ ID NO: 2419012 - RNA, 18 nt, Bordetella pertussis
ccuggucagguugcgccg

SEQ ID NO: 2419013 - RNA, 20 nt, Bordetella pertussis
ccuggucagguugcgccggc

SEQ ID NO: 2419014 - RNA, 19 nt, Bordetella pertussis
ccuggucaugacgggcggc

SEQ ID NO: 2419015 - RNA, 13 nt, Bordetella pertussis
ccugguccagcag

SEQ ID NO: 2419016 - RNA, 16 nt, Bordetella pertussis
ccugguccagcagcgu

SEQ ID NO: 2419017 - RNA, 14 nt, Bordetella pertussis
ccugguccgccgcg

SEQ ID NO: 2419018 - RNA, 20 nt, Bordetella pertussis
ccugguccgccgcgaccacc

SEQ ID NO: 2419019 - RNA, 19 nt, Bordetella pertussis
ccuggucgaacguggcggc

SEQ ID NO: 2419020 - RNA, 17 nt, Bordetella pertussis
ccuggucgaccaggccg

SEQ ID NO: 2419021 - RNA, 20 nt, Bordetella pertussis
ccuucgaucuucucgccgcg

SEQ ID NO: 2419022 - RNA, 22 nt, Bordetella pertussis
ccuucgcccgcauagacgccga

SEQ ID NO: 2419023 - RNA, 13 nt, Bordetella pertussis
ccuucgcgcagca

SEQ ID NO: 2419024 - RNA, 20 nt, Bordetella pertussis
ccuucgcgcagcggcgcgcg

SEQ ID NO: 2419025 - RNA, 21 nt, Bordetella pertussis
ccuucgcgcagcggcgcgcgc

SEQ ID NO: 2419026 - RNA, 14 nt, Bordetella pertussis
ccuucgcggcuggu

SEQ ID NO: 2419027 - RNA, 21 nt, Bordetella pertussis
ccuucggagccaguccccgca

SEQ ID NO: 2419028 - RNA, 22 nt, Bordetella pertussis
ccuucggcaggcgccggcuggc

SEQ ID NO: 2419029 - RNA, 16 nt, Bordetella pertussis
ccuucggccaaucggc

SEQ ID NO: 2419030 - RNA, 21 nt, Bordetella pertussis
ccuucggccggcugcgcgccg

SEQ ID NO: 2419031 - RNA, 22 nt, Bordetella pertussis
ccuucggcgacuucggcggcca

SEQ ID NO: 2419032 - RNA, 13 nt, Bordetella pertussis
ccuucggcgcgca

SEQ ID NO: 2419033 - RNA, 20 nt, Bordetella pertussis
ccuucggcgcgcacgcucug

SEQ ID NO: 2419034 - RNA, 19 nt, Bordetella pertussis
ccuucggcgcgcgccggcu

SEQ ID NO: 2419035 - RNA, 14 nt, Bordetella pertussis
ccuucggcgcggcg

SEQ ID NO: 2419036 - RNA, 15 nt, Bordetella pertussis
ccuucggcggcgcgc

SEQ ID NO: 2419037 - RNA, 18 nt, Bordetella pertussis
ccuucggguugcaaauuc

SEQ ID NO: 2419038 - RNA, 23 nt, Bordetella pertussis
ccuucguccugccauugcgcggc

SEQ ID NO: 2419039 - RNA, 23 nt, Bordetella pertussis
ccuucgucggcgggacgcaggcc

SEQ ID NO: 2419040 - RNA, 12 nt, Bordetella pertussis
ccuucguggcgc

SEQ ID NO: 2419041 - RNA, 19 nt, Bordetella pertussis
ccuucucgaugcgcgccac

SEQ ID NO: 2419042 - RNA, 20 nt, Bordetella pertussis
ccuucugcaaggccugcugc

SEQ ID NO: 2419043 - RNA, 14 nt, Bordetella pertussis
ccuucugccgccag

SEQ ID NO: 2419044 - RNA, 18 nt, Bordetella pertussis
ccuucugccgccaggcau

SEQ ID NO: 2419045 - RNA, 20 nt, Bordetella pertussis
ccuucugccgccaggcauug

SEQ ID NO: 2419046 - RNA, 21 nt, Bordetella pertussis
ccuucuuccaggcgcccgcca

SEQ ID NO: 2419047 - RNA, 18 nt, Bordetella pertussis
ccuugaaccccggcugcg

SEQ ID NO: 2419048 - RNA, 14 nt, Bordetella pertussis
ccuugaccaccuug

SEQ ID NO: 2419049 - RNA, 17 nt, Bordetella pertussis
ccuugaccaccuugccc

SEQ ID NO: 2419050 - RNA, 21 nt, Bordetella pertussis
ccuugaccaguucgcgcagcg

SEQ ID NO: 2419051 - RNA, 18 nt, Bordetella pertussis
ccuugaccgacgugcugc

SEQ ID NO: 2419052 - RNA, 21 nt, Bordetella pertussis
ccuugaccgacgugcugcugc

SEQ ID NO: 2419053 - RNA, 15 nt, Bordetella pertussis
ccuugaccuggucgg

SEQ ID NO: 2419054 - RNA, 18 nt, Bordetella pertussis
ccuugaccuggucggccu

SEQ ID NO: 2419055 - RNA, 21 nt, Bordetella pertussis
ccuugacgaauuucucggcca

SEQ ID NO: 2419056 - RNA, 13 nt, Bordetella pertussis
ccuugacgccgcc

SEQ ID NO: 2419057 - RNA, 14 nt, Bordetella pertussis
ccuugacgcgcgcg

SEQ ID NO: 2419058 - RNA, 15 nt, Bordetella pertussis
ccuugagaugccagc

SEQ ID NO: 2419059 - RNA, 18 nt, Bordetella pertussis
ccuugagaugccagcggc

SEQ ID NO: 2419060 - RNA, 19 nt, Bordetella pertussis
ccuugagcacguccagcgg

SEQ ID NO: 2419061 - RNA, 17 nt, Bordetella pertussis
ccuugagcaucugcggc

SEQ ID NO: 2419062 - RNA, 21 nt, Bordetella pertussis
ccuugagcgccagcucggcca

SEQ ID NO: 2419063 - RNA, 20 nt, Bordetella pertussis
ccuugagggcgcgggccagc

SEQ ID NO: 2419064 - RNA, 17 nt, Bordetella pertussis
ccuugaucagcggcggc

SEQ ID NO: 2419065 - RNA, 23 nt, Bordetella pertussis
ccuugauggccgggccguggcga

SEQ ID NO: 2419066 - RNA, 24 nt, Bordetella pertussis
ccuugauguauggcugcaccugcc

SEQ ID NO: 2419067 - RNA, 16 nt, Bordetella pertussis
ccuugcaugcgccgca

SEQ ID NO: 2419068 - RNA, 20 nt, Bordetella pertussis
ccuugcaugcgccgcaccag

SEQ ID NO: 2419069 - RNA, 16 nt, Bordetella pertussis
ccuugccauccagcca

SEQ ID NO: 2419070 - RNA, 18 nt, Bordetella pertussis
ccuugccauccagccagg

SEQ ID NO: 2419071 - RNA, 17 nt, Bordetella pertussis
ccuugcccaacgcggcg

SEQ ID NO: 2419072 - RNA, 19 nt, Bordetella pertussis
ccuugcccaacgcggcguc

SEQ ID NO: 2419073 - RNA, 16 nt, Bordetella pertussis
ccuugcccacgccauc

SEQ ID NO: 2419074 - RNA, 19 nt, Bordetella pertussis
ccuugcccacgccaucgaa

SEQ ID NO: 2419075 - RNA, 14 nt, Bordetella pertussis
ccuugcccagcagc

SEQ ID NO: 2419076 - RNA, 23 nt, Bordetella pertussis
ccuugcccagcagcuccucggcc

SEQ ID NO: 2419077 - RNA, 15 nt, Bordetella pertussis
ccuugcccaggcugg

SEQ ID NO: 2419078 - RNA, 19 nt, Bordetella pertussis
ccuugcccaggcugggcca

SEQ ID NO: 2419079 - RNA, 11 nt, Bordetella pertussis
ccuugcccggg

SEQ ID NO: 2419080 - RNA, 22 nt, Bordetella pertussis
ccuugcccgggcuggccgccug

SEQ ID NO: 2419081 - RNA, 23 nt, Bordetella pertussis
ccuugcccgggcuggccgccugc

SEQ ID NO: 2419082 - RNA, 18 nt, Bordetella pertussis
ccuugccgauccagcgcc

SEQ ID NO: 2419083 - RNA, 22 nt, Bordetella pertussis
ccuugccgauccagcgccuggg

SEQ ID NO: 2419084 - RNA, 19 nt, Bordetella pertussis
ccuugccgcagcggggaca

SEQ ID NO: 2419085 - RNA, 14 nt, Bordetella pertussis
ccuugccgccgccg

SEQ ID NO: 2419086 - RNA, 16 nt, Bordetella pertussis
ccuugccgccgccgcg

SEQ ID NO: 2419087 - RNA, 18 nt, Bordetella pertussis
ccuugccgccgccgcgcg

SEQ ID NO: 2419088 - RNA, 16 nt, Bordetella pertussis
ccuugccgccgcgcag

SEQ ID NO: 2419089 - RNA, 21 nt, Bordetella pertussis
ccuugccgccgugcgagcacg

SEQ ID NO: 2419090 - RNA, 21 nt, Bordetella pertussis
ccuugccgccuucccaggcga

SEQ ID NO: 2419091 - RNA, 11 nt, Bordetella pertussis
ccuugccguag

SEQ ID NO: 2419092 - RNA, 21 nt, Bordetella pertussis
ccuugccguugagcacggugu

SEQ ID NO: 2419093 - RNA, 19 nt, Bordetella pertussis
ccuugccugcaaaaaacaa

SEQ ID NO: 2419094 - RNA, 20 nt, Bordetella pertussis
ccuugcgcgaaggccgcccc

SEQ ID NO: 2419095 - RNA, 21 nt, Bordetella pertussis
ccuugcgcgaaggccgccccc

SEQ ID NO: 2419096 - RNA, 15 nt, Bordetella pertussis
ccuugcgcgacagca

SEQ ID NO: 2419097 - RNA, 18 nt, Bordetella pertussis
ccuugcgcgacagcaggc

SEQ ID NO: 2419098 - RNA, 22 nt, Bordetella pertussis
ccuugcgcgacagcaggccggu

SEQ ID NO: 2419099 - RNA, 13 nt, Bordetella pertussis
ccuugcgcggcca

SEQ ID NO: 2419100 - RNA, 14 nt, Bordetella pertussis
ccuugcgcggccag

SEQ ID NO: 2419101 - RNA, 15 nt, Bordetella pertussis
ccuugcgcggccagc

SEQ ID NO: 2419102 - RNA, 16 nt, Bordetella pertussis
ccuugcgcggcgagcg

SEQ ID NO: 2419103 - RNA, 21 nt, Bordetella pertussis
ccuugcgcggcgagcgccgcc

SEQ ID NO: 2419104 - RNA, 22 nt, Bordetella pertussis
ccuugcgcggcgagcgccgcca

SEQ ID NO: 2419105 - RNA, 23 nt, Bordetella pertussis
ccuugcgcggcgagcgccgccag

SEQ ID NO: 2419106 - RNA, 15 nt, Bordetella pertussis
ccuugcgcucgccca

SEQ ID NO: 2419107 - RNA, 23 nt, Bordetella pertussis
ccuugcgcucgcccagcaccucg

SEQ ID NO: 2419108 - RNA, 14 nt, Bordetella pertussis
ccuugcggccgcgc

SEQ ID NO: 2419109 - RNA, 16 nt, Bordetella pertussis
ccuugcggccgcgcac

SEQ ID NO: 2419110 - RNA, 13 nt, Bordetella pertussis
ccuugcggcgccg

SEQ ID NO: 2419111 - RNA, 14 nt, Bordetella pertussis
ccuugcucagucgg

SEQ ID NO: 2419112 - RNA, 22 nt, Bordetella pertussis
ccuugcucagucgggcagcgcc

SEQ ID NO: 2419113 - RNA, 24 nt, Bordetella pertussis
ccuugcucagucgggcagcgcccg

SEQ ID NO: 2419114 - RNA, 21 nt, Bordetella pertussis
ccuugcucccaguucugcagc

SEQ ID NO: 2419115 - RNA, 17 nt, Bordetella pertussis
ccuugcucgaccagguc

SEQ ID NO: 2419116 - RNA, 13 nt, Bordetella pertussis
ccuugcucgccca

SEQ ID NO: 2419117 - RNA, 19 nt, Bordetella pertussis
ccuugcugaaccugcuggc

SEQ ID NO: 2419118 - RNA, 20 nt, Bordetella pertussis
ccuugcugaaccugcuggcc

SEQ ID NO: 2419119 - RNA, 20 nt, Bordetella pertussis
ccuuggaguucuucuuggcc

SEQ ID NO: 2419120 - RNA, 13 nt, Bordetella pertussis
ccuuggccagcag

SEQ ID NO: 2419121 - RNA, 23 nt, Bordetella pertussis
ccuuggccagcagcgcaucgcgc

SEQ ID NO: 2419122 - RNA, 22 nt, Bordetella pertussis
ccuuggccauguccuggcaggc

SEQ ID NO: 2419123 - RNA, 13 nt, Bordetella pertussis
ccuuggcccacuc

SEQ ID NO: 2419124 - RNA, 16 nt, Bordetella pertussis
ccuuggccgcagccgg

SEQ ID NO: 2419125 - RNA, 16 nt, Bordetella pertussis
ccuuggccuuggcggc

SEQ ID NO: 2419126 - RNA, 12 nt, Bordetella pertussis
ccuuggcgcgca

SEQ ID NO: 2419127 - RNA, 16 nt, Bordetella pertussis
ccuuggcgcgcagacg

SEQ ID NO: 2419128 - RNA, 13 nt, Bordetella pertussis
ccuuggcggcccc

SEQ ID NO: 2419129 - RNA, 16 nt, Bordetella pertussis
ccuuggcggccgacag

SEQ ID NO: 2419130 - RNA, 14 nt, Bordetella pertussis
ccuuggcggcuggc

SEQ ID NO: 2419131 - RNA, 16 nt, Bordetella pertussis
ccuuggcggcuggcgc

SEQ ID NO: 2419132 - RNA, 19 nt, Bordetella pertussis
ccuuggcggcuggcgcggc

SEQ ID NO: 2419133 - RNA, 12 nt, Bordetella pertussis
cgaacgccgcgu

SEQ ID NO: 2419134 - RNA, 16 nt, Bordetella pertussis
cgaacgccgcgucgcu

SEQ ID NO: 2419135 - RNA, 14 nt, Bordetella pertussis
cgaacgccugccag

SEQ ID NO: 2419136 - RNA, 17 nt, Bordetella pertussis
cgaacgcgacagcgcug

SEQ ID NO: 2419137 - RNA, 13 nt, Bordetella pertussis
cgaacgcgcagcg

SEQ ID NO: 2419138 - RNA, 17 nt, Bordetella pertussis
cgaacgcgcgccggcca

SEQ ID NO: 2419139 - RNA, 18 nt, Bordetella pertussis
cgaacgcgcgccggccag

SEQ ID NO: 2419140 - RNA, 20 nt, Bordetella pertussis
cgaacgcggccagaccuugc

SEQ ID NO: 2419141 - RNA, 18 nt, Bordetella pertussis
cgaacgcgugcaccagcc

SEQ ID NO: 2419142 - RNA, 23 nt, Bordetella pertussis
cgaacggaaacccuucgcgcagc

SEQ ID NO: 2419143 - RNA, 24 nt, Bordetella pertussis
cgaacggaaacccuucgcgcagca

SEQ ID NO: 2419144 - RNA, 17 nt, Bordetella pertussis
cgaacggcacgucgcgc

SEQ ID NO: 2419145 - RNA, 15 nt, Bordetella pertussis
cgaacggcagcagcg

SEQ ID NO: 2419146 - RNA, 12 nt, Bordetella pertussis
cgaacggccgcc

SEQ ID NO: 2419147 - RNA, 17 nt, Bordetella pertussis
cgaacggccgcccggca

SEQ ID NO: 2419148 - RNA, 22 nt, Bordetella pertussis
cgaacggccgcccggcaugggc

SEQ ID NO: 2419149 - RNA, 14 nt, Bordetella pertussis
cgaacggccgggcg

SEQ ID NO: 2419150 - RNA, 17 nt, Bordetella pertussis
cgaacgggaauggcgga

SEQ ID NO: 2419151 - RNA, 22 nt, Bordetella pertussis
cgaacgggccgcaagcaagccc

SEQ ID NO: 2419152 - RNA, 16 nt, Bordetella pertussis
cgaacggggacuggca

SEQ ID NO: 2419153 - RNA, 22 nt, Bordetella pertussis
cgaacggggccgccucggcggc

SEQ ID NO: 2419154 - RNA, 22 nt, Bordetella pertussis
cgaacgggguggccggcgcgcg

SEQ ID NO: 2419155 - RNA, 15 nt, Bordetella pertussis
cgaacgugcgcgcca

SEQ ID NO: 2419156 - RNA, 18 nt, Bordetella pertussis
cgaacgugcgcgccagcu

SEQ ID NO: 2419157 - RNA, 19 nt, Bordetella pertussis
cgaacgugcgcgccagcuc

SEQ ID NO: 2419158 - RNA, 15 nt, Bordetella pertussis
cgaacguggcggcga

SEQ ID NO: 2419159 - RNA, 14 nt, Bordetella pertussis
cgaacuccauuucg

SEQ ID NO: 2419160 - RNA, 14 nt, Bordetella pertussis
cgaacuccugcaac

SEQ ID NO: 2419161 - RNA, 15 nt, Bordetella pertussis
cgaacuccugcagca

SEQ ID NO: 2419162 - RNA, 18 nt, Bordetella pertussis
cgaacucgauccgggccu

SEQ ID NO: 2419163 - RNA, 22 nt, Bordetella pertussis
cgaacucgauggccucggcaug

SEQ ID NO: 2419164 - RNA, 13 nt, Bordetella pertussis
cgaacugccggcg

SEQ ID NO: 2419165 - RNA, 16 nt, Bordetella pertussis
cgaacugccggcgcgg

SEQ ID NO: 2419166 - RNA, 17 nt, Bordetella pertussis
cgaacugucgcgccacg

SEQ ID NO: 2419167 - RNA, 19 nt, Bordetella pertussis
cgaacugucgcgccacggc

SEQ ID NO: 2419168 - RNA, 15 nt, Bordetella pertussis
cgaacuucagcccgg

SEQ ID NO: 2419169 - RNA, 16 nt, Bordetella pertussis
cgaacuucagcccggg

SEQ ID NO: 2419170 - RNA, 17 nt, Bordetella pertussis
cgaacuuggccaugcca

SEQ ID NO: 2419171 - RNA, 18 nt, Bordetella pertussis
cgaacuuggccaugccaa

SEQ ID NO: 2419172 - RNA, 15 nt, Bordetella pertussis
cgaacuuuucgucgu

SEQ ID NO: 2419173 - RNA, 20 nt, Bordetella pertussis
cgaagaacaccaucaaggcc

SEQ ID NO: 2419174 - RNA, 20 nt, Bordetella pertussis
cgaagaacaccgccgcgccg

SEQ ID NO: 2419175 - RNA, 21 nt, Bordetella pertussis
cgaagaacaccgccgcgccgc

SEQ ID NO: 2419176 - RNA, 14 nt, Bordetella pertussis
cgaagaagcagccg

SEQ ID NO: 2419177 - RNA, 18 nt, Bordetella pertussis
cgaagaagcagccgcgcu

SEQ ID NO: 2419178 - RNA, 22 nt, Bordetella pertussis
cgaagaauuggccguccacgaa

SEQ ID NO: 2419179 - RNA, 18 nt, Bordetella pertussis
cgaagacaugcugcgaca

SEQ ID NO: 2419180 - RNA, 20 nt, Bordetella pertussis
cgaagacaugcugcgacagc

SEQ ID NO: 2419181 - RNA, 23 nt, Bordetella pertussis
cgaagacgaucucacagacgauc

SEQ ID NO: 2419182 - RNA, 23 nt, Bordetella pertussis
cgaagaggagcugcacaaggucc

SEQ ID NO: 2419183 - RNA, 22 nt, Bordetella pertussis
cgaagaggguuauuuccggccg

SEQ ID NO: 2419184 - RNA, 23 nt, Bordetella pertussis
cgaagaggguuauuuccggccgc

SEQ ID NO: 2419185 - RNA, 20 nt, Bordetella pertussis
cgaagauuuccucgcgcacc

SEQ ID NO: 2419186 - RNA, 17 nt, Bordetella pertussis
cgaagcaaugcagcgcg

SEQ ID NO: 2419187 - RNA, 16 nt, Bordetella pertussis
cgaagcacugcaggcc

SEQ ID NO: 2419188 - RNA, 20 nt, Bordetella pertussis
cgaagcacugcaggccaucg

SEQ ID NO: 2419189 - RNA, 15 nt, Bordetella pertussis
cgaagcagccggcca

SEQ ID NO: 2419190 - RNA, 23 nt, Bordetella pertussis
cgaagccaccgucucgcccauga

SEQ ID NO: 2419191 - RNA, 18 nt, Bordetella pertussis
cgaagccacggcccgcca

SEQ ID NO: 2419192 - RNA, 15 nt, Bordetella pertussis
cgaagcccaguucgg

SEQ ID NO: 2419193 - RNA, 12 nt, Bordetella pertussis
cgaagcccggca

SEQ ID NO: 2419194 - RNA, 14 nt, Bordetella pertussis
cgaagccgaugcgc

SEQ ID NO: 2419195 - RNA, 19 nt, Bordetella pertussis
cgaagccgcagcggcagcg

SEQ ID NO: 2419196 - RNA, 14 nt, Bordetella pertussis
cgaagccgccccac

SEQ ID NO: 2419197 - RNA, 12 nt, Bordetella pertussis
cgaagccggcac

SEQ ID NO: 2419198 - RNA, 17 nt, Bordetella pertussis
cgaagccggcacgccug

SEQ ID NO: 2419199 - RNA, 13 nt, Bordetella pertussis
cgaagccggugau

SEQ ID NO: 2419200 - RNA, 17 nt, Bordetella pertussis
cgaagccuaggcugcag

SEQ ID NO: 2419201 - RNA, 22 nt, Bordetella pertussis
cgaagccuaggcugcagccagu

SEQ ID NO: 2419202 - RNA, 16 nt, Bordetella pertussis
cgaagccuugcgcggc

SEQ ID NO: 2419203 - RNA, 18 nt, Bordetella pertussis
cgaagccuugcgcggcca

SEQ ID NO: 2419204 - RNA, 16 nt, Bordetella pertussis
cgaagcgagugcgccc

SEQ ID NO: 2419205 - RNA, 20 nt, Bordetella pertussis
cgaagcgagugcgccccgcc

SEQ ID NO: 2419206 - RNA, 12 nt, Bordetella pertussis
cgaagcgcagca

SEQ ID NO: 2419207 - RNA, 16 nt, Bordetella pertussis
cgaagcgcagcaccgc

SEQ ID NO: 2419208 - RNA, 17 nt, Bordetella pertussis
cgaagcgcaggccuucg

SEQ ID NO: 2419209 - RNA, 14 nt, Bordetella pertussis
cgaagcgcgccagc

SEQ ID NO: 2419210 - RNA, 15 nt, Bordetella pertussis
cgaagcgcgcgugca

SEQ ID NO: 2419211 - RNA, 21 nt, Bordetella pertussis
cgaagcggaccuggucgucca

SEQ ID NO: 2419212 - RNA, 15 nt, Bordetella pertussis
cgaagcggaugcgcc

SEQ ID NO: 2419213 - RNA, 17 nt, Bordetella pertussis
cgaagcggaugcgccgc

SEQ ID NO: 2419214 - RNA, 18 nt, Bordetella pertussis
cgaagcggaugcgccgcc

SEQ ID NO: 2419215 - RNA, 19 nt, Bordetella pertussis
cgaagcggaugcgccgccc

SEQ ID NO: 2419216 - RNA, 23 nt, Bordetella pertussis
cgaagcggcccgggugggcggca

SEQ ID NO: 2419217 - RNA, 17 nt, Bordetella pertussis
cgaagcggcucaggcgc

SEQ ID NO: 2419218 - RNA, 18 nt, Bordetella pertussis
cgaagcggcucaggcgcg

SEQ ID NO: 2419219 - RNA, 19 nt, Bordetella pertussis
cgaagcggcucaggcgcgg

SEQ ID NO: 2419220 - RNA, 14 nt, Bordetella pertussis
cgaagcgucggccu

SEQ ID NO: 2419221 - RNA, 22 nt, Bordetella pertussis
cgaagcugccgugguacgugga

SEQ ID NO: 2419222 - RNA, 13 nt, Bordetella pertussis
cgaaggaccaagu

SEQ ID NO: 2419223 - RNA, 15 nt, Bordetella pertussis
cgaaggaccaagucg

SEQ ID NO: 2419224 - RNA, 16 nt, Bordetella pertussis
cgaaggcaaucagccc

SEQ ID NO: 2419225 - RNA, 18 nt, Bordetella pertussis
cgaaggcaaucagcccgg

SEQ ID NO: 2419226 - RNA, 14 nt, Bordetella pertussis
cgaaggcagcgcgg

SEQ ID NO: 2419227 - RNA, 18 nt, Bordetella pertussis
cgaaggcagcgcggccgg

SEQ ID NO: 2419228 - RNA, 14 nt, Bordetella pertussis
cgaaggcagcggca

SEQ ID NO: 2419229 - RNA, 20 nt, Bordetella pertussis
cgaaggccgccgcgcccagc

SEQ ID NO: 2419230 - RNA, 21 nt, Bordetella pertussis
cgaaggccgccgcgcccagca

SEQ ID NO: 2419231 - RNA, 18 nt, Bordetella pertussis
cgaaggcgaccggcaccu

SEQ ID NO: 2419232 - RNA, 18 nt, Bordetella pertussis
cgaaggcgccgacggcgc

SEQ ID NO: 2419233 - RNA, 13 nt, Bordetella pertussis
cgaaggcgccggc

SEQ ID NO: 2419234 - RNA, 13 nt, Bordetella pertussis
cgaaggcgcgcuc

SEQ ID NO: 2419235 - RNA, 21 nt, Bordetella pertussis
cgaaggcgcgcuccagcaugu

SEQ ID NO: 2419236 - RNA, 13 nt, Bordetella pertussis
cgaaggcgcggcu

SEQ ID NO: 2419237 - RNA, 16 nt, Bordetella pertussis
cgaaggcggccggcag

SEQ ID NO: 2419238 - RNA, 17 nt, Bordetella pertussis
cgaaggcggccggcagg

SEQ ID NO: 2419239 - RNA, 18 nt, Bordetella pertussis
cgaaggcggccggcaggc

SEQ ID NO: 2419240 - RNA, 21 nt, Bordetella pertussis
cgaaggcgucggccauggcgc

SEQ ID NO: 2419241 - RNA, 19 nt, Bordetella pertussis
cgaaggcgugaggcccagc

SEQ ID NO: 2419242 - RNA, 17 nt, Bordetella pertussis
cgaagggauagcgccgu

SEQ ID NO: 2419243 - RNA, 23 nt, Bordetella pertussis
cgaagggauagcgccguaccagc

SEQ ID NO: 2419244 - RNA, 13 nt, Bordetella pertussis
cgaagggcagcag

SEQ ID NO: 2419245 - RNA, 14 nt, Bordetella pertussis
cgaagggcagcagc

SEQ ID NO: 2419246 - RNA, 16 nt, Bordetella pertussis
cgacaggcgcgcccgc

SEQ ID NO: 2419247 - RNA, 16 nt, Bordetella pertussis
cgacagggcgucgucg

SEQ ID NO: 2419248 - RNA, 23 nt, Bordetella pertussis
cgacauacgcgaugccgaucgcc

SEQ ID NO: 2419249 - RNA, 24 nt, Bordetella pertussis
cgacauacgcgaugccgaucgccg

SEQ ID NO: 2419250 - RNA, 21 nt, Bordetella pertussis
cgacauagagauuguccagcg

SEQ ID NO: 2419251 - RNA, 23 nt, Bordetella pertussis
cgacauagagauuguccagcggc

SEQ ID NO: 2419252 - RNA, 14 nt, Bordetella pertussis
cgacauagcgcugg

SEQ ID NO: 2419253 - RNA, 22 nt, Bordetella pertussis
cgacauagcgcuggaacguuug

SEQ ID NO: 2419254 - RNA, 17 nt, Bordetella pertussis
cgacaugaccgcguccg

SEQ ID NO: 2419255 - RNA, 14 nt, Bordetella pertussis
cgacaugcccgccg

SEQ ID NO: 2419256 - RNA, 17 nt, Bordetella pertussis
cgacaugcccgccggca

SEQ ID NO: 2419257 - RNA, 19 nt, Bordetella pertussis
cgacaugccgccccaggcg

SEQ ID NO: 2419258 - RNA, 17 nt, Bordetella pertussis
cgacaugcuggcccagc

SEQ ID NO: 2419259 - RNA, 13 nt, Bordetella pertussis
cgacaugucgccg

SEQ ID NO: 2419260 - RNA, 15 nt, Bordetella pertussis
cgaccaaccugaccg

SEQ ID NO: 2419261 - RNA, 18 nt, Bordetella pertussis
cgaccaacucgaggcggc

SEQ ID NO: 2419262 - RNA, 19 nt, Bordetella pertussis
cgaccaacucgaggcggcg

SEQ ID NO: 2419263 - RNA, 23 nt, Bordetella pertussis
cgaccaacucgaggcggcgcagg

SEQ ID NO: 2419264 - RNA, 13 nt, Bordetella pertussis
cgaccaccagcac

SEQ ID NO: 2419265 - RNA, 16 nt, Bordetella pertussis
cgaccaccagcaccau

SEQ ID NO: 2419266 - RNA, 15 nt, Bordetella pertussis
cgaccaccagcaccg

SEQ ID NO: 2419267 - RNA, 21 nt, Bordetella pertussis
cgaccaccagcaucgcgccuu

SEQ ID NO: 2419268 - RNA, 15 nt, Bordetella pertussis
cgaccaccagcgcac

SEQ ID NO: 2419269 - RNA, 14 nt, Bordetella pertussis
cgaccaccagcggc

SEQ ID NO: 2419270 - RNA, 22 nt, Bordetella pertussis
cgaccaccagcgucaccagcag

SEQ ID NO: 2419271 - RNA, 22 nt, Bordetella pertussis
cgaccaccaggucguacagcgc

SEQ ID NO: 2419272 - RNA, 13 nt, Bordetella pertussis
cgaccacccgcgc

SEQ ID NO: 2419273 - RNA, 14 nt, Bordetella pertussis
cgaccacccgcgcc

SEQ ID NO: 2419274 - RNA, 17 nt, Bordetella pertussis
cgaccacccgcgccagg

SEQ ID NO: 2419275 - RNA, 18 nt, Bordetella pertussis
cgaccacccgcgccagga

SEQ ID NO: 2419276 - RNA, 13 nt, Bordetella pertussis
cgaccaccggcuu

SEQ ID NO: 2419277 - RNA, 14 nt, Bordetella pertussis
cgaccacgccggcg

SEQ ID NO: 2419278 - RNA, 17 nt, Bordetella pertussis
cgaccacgccggcggcc

SEQ ID NO: 2419279 - RNA, 14 nt, Bordetella pertussis
cgaccacgcgcgcg

SEQ ID NO: 2419280 - RNA, 17 nt, Bordetella pertussis
cgaccacgcgcgcgccg

SEQ ID NO: 2419281 - RNA, 22 nt, Bordetella pertussis
cgaccacgcgcgcgccgccggc

SEQ ID NO: 2419282 - RNA, 15 nt, Bordetella pertussis
cgaccacgcggcggu

SEQ ID NO: 2419283 - RNA, 15 nt, Bordetella pertussis
cgaccacgcugggcc

SEQ ID NO: 2419284 - RNA, 18 nt, Bordetella pertussis
cgaccacggaauguugau

SEQ ID NO: 2419285 - RNA, 13 nt, Bordetella pertussis
cgaccacggcggc

SEQ ID NO: 2419286 - RNA, 17 nt, Bordetella pertussis
cgaccacuaucagcgcg

SEQ ID NO: 2419287 - RNA, 20 nt, Bordetella pertussis
cgaccacuggaagcugcggc

SEQ ID NO: 2419288 - RNA, 22 nt, Bordetella pertussis
cgaccacuggaagcugcggccg

SEQ ID NO: 2419289 - RNA, 12 nt, Bordetella pertussis
cgaccacuggca

SEQ ID NO: 2419290 - RNA, 16 nt, Bordetella pertussis
cgaccacuggcagacc

SEQ ID NO: 2419291 - RNA, 21 nt, Bordetella pertussis
cgaccacuggcagaccgagcg

SEQ ID NO: 2419292 - RNA, 22 nt, Bordetella pertussis
cgaccacuggcagaccgagcgc

SEQ ID NO: 2419293 - RNA, 18 nt, Bordetella pertussis
cgaccagcacgauccagc

SEQ ID NO: 2419294 - RNA, 20 nt, Bordetella pertussis
cgaccagcagcacguucuug

SEQ ID NO: 2419295 - RNA, 15 nt, Bordetella pertussis
cgaccagcaggccca

SEQ ID NO: 2419296 - RNA, 13 nt, Bordetella pertussis
cgaccagcccggc

SEQ ID NO: 2419297 - RNA, 14 nt, Bordetella pertussis
cgaccagcccggcc

SEQ ID NO: 2419298 - RNA, 16 nt, Bordetella pertussis
cgaccagcccggccgc

SEQ ID NO: 2419299 - RNA, 18 nt, Bordetella pertussis
cgaccagcccggccgcca

SEQ ID NO: 2419300 - RNA, 20 nt, Bordetella pertussis
cgaccagcccggccgccagc

SEQ ID NO: 2419301 - RNA, 14 nt, Bordetella pertussis
cgaccagcgcacgg

SEQ ID NO: 2419302 - RNA, 12 nt, Bordetella pertussis
cgaccagcgcgc

SEQ ID NO: 2419303 - RNA, 13 nt, Bordetella pertussis
cgaccagcgcgcg

SEQ ID NO: 2419304 - RNA, 15 nt, Bordetella pertussis
cgaccagcgcgcgcc

SEQ ID NO: 2419305 - RNA, 19 nt, Bordetella pertussis
cgaccagcgcgcgccggcc

SEQ ID NO: 2419306 - RNA, 15 nt, Bordetella pertussis
cgaccagcucgacgc

SEQ ID NO: 2419307 - RNA, 16 nt, Bordetella pertussis
cgaccagcucgacgcc

SEQ ID NO: 2419308 - RNA, 18 nt, Bordetella pertussis
cgaccagcucgacgccau

SEQ ID NO: 2419309 - RNA, 19 nt, Bordetella pertussis
cgaccagcucgacgccauc

SEQ ID NO: 2419310 - RNA, 14 nt, Bordetella pertussis
cgaccagcuucugc

SEQ ID NO: 2419311 - RNA, 21 nt, Bordetella pertussis
cgaccagcuucugcgccugcu

SEQ ID NO: 2419312 - RNA, 16 nt, Bordetella pertussis
cgaccaggcccacgac

SEQ ID NO: 2419313 - RNA, 17 nt, Bordetella pertussis
cgaccaggcccacgacg

SEQ ID NO: 2419314 - RNA, 13 nt, Bordetella pertussis
cgaccaggcccgc

SEQ ID NO: 2419315 - RNA, 19 nt, Bordetella pertussis
cgaccaggcccgccacggc

SEQ ID NO: 2419316 - RNA, 14 nt, Bordetella pertussis
cgaccaggccggcg

SEQ ID NO: 2419317 - RNA, 16 nt, Bordetella pertussis
cgaccaggccggcggc

SEQ ID NO: 2419318 - RNA, 17 nt, Bordetella pertussis
cgaccaggccggcggcg

SEQ ID NO: 2419319 - RNA, 19 nt, Bordetella pertussis
cgaccaggccggcggcggg

SEQ ID NO: 2419320 - RNA, 13 nt, Bordetella pertussis
cgaccaggccggu

SEQ ID NO: 2419321 - RNA, 20 nt, Bordetella pertussis
cgaccaggccggugcgcaca

SEQ ID NO: 2419322 - RNA, 21 nt, Bordetella pertussis
cgaccaggccggugcgcacau

SEQ ID NO: 2419323 - RNA, 20 nt, Bordetella pertussis
cgaccaggccguggcccagc

SEQ ID NO: 2419324 - RNA, 21 nt, Bordetella pertussis
cgaccaggccguggcccagcc

SEQ ID NO: 2419325 - RNA, 22 nt, Bordetella pertussis
cgaccaggccguggcccagccg

SEQ ID NO: 2419326 - RNA, 12 nt, Bordetella pertussis
cgaccaggcggg

SEQ ID NO: 2419327 - RNA, 20 nt, Bordetella pertussis
cgaccaggcgggcaucgccc

SEQ ID NO: 2419328 - RNA, 22 nt, Bordetella pertussis
cgaccaggcgggcaucgcccac

SEQ ID NO: 2419329 - RNA, 18 nt, Bordetella pertussis
cgaccaggcugcgcgccg

SEQ ID NO: 2419330 - RNA, 21 nt, Bordetella pertussis
cgaccaggcugcgcgccggcg

SEQ ID NO: 2419331 - RNA, 12 nt, Bordetella pertussis
cgaccaggcugg

SEQ ID NO: 2419332 - RNA, 14 nt, Bordetella pertussis
cgaccaggcuggag

SEQ ID NO: 2419333 - RNA, 14 nt, Bordetella pertussis
cgaccagguaucga

SEQ ID NO: 2419334 - RNA, 21 nt, Bordetella pertussis
cgaccagguaucgacccaggc

SEQ ID NO: 2419335 - RNA, 12 nt, Bordetella pertussis
cgaccaggucga

SEQ ID NO: 2419336 - RNA, 14 nt, Bordetella pertussis
cgaccaggucgggc

SEQ ID NO: 2419337 - RNA, 15 nt, Bordetella pertussis
cgaccaggugcgggc

SEQ ID NO: 2419338 - RNA, 16 nt, Bordetella pertussis
cgaccaggugcgggcc

SEQ ID NO: 2419339 - RNA, 17 nt, Bordetella pertussis
cgaccaggugcgggccg

SEQ ID NO: 2419340 - RNA, 19 nt, Bordetella pertussis
cgaccaggugcgggccgcu

SEQ ID NO: 2419341 - RNA, 22 nt, Bordetella pertussis
cgaccaggugcgggccgcucag

SEQ ID NO: 2419342 - RNA, 15 nt, Bordetella pertussis
cgaccaguucggcca

SEQ ID NO: 2419343 - RNA, 18 nt, Bordetella pertussis
cgaccaguucggccagca

SEQ ID NO: 2419344 - RNA, 19 nt, Bordetella pertussis
cgaccaguucggccagcag

SEQ ID NO: 2419345 - RNA, 18 nt, Bordetella pertussis
cgaccaugcggccgucgc

SEQ ID NO: 2419346 - RNA, 15 nt, Bordetella pertussis
cgaccauguccgcgc

SEQ ID NO: 2419347 - RNA, 20 nt, Bordetella pertussis
cgaccauguggcagauggcg

SEQ ID NO: 2419348 - RNA, 23 nt, Bordetella pertussis
cgaccauuucgauuucggcggcc

SEQ ID NO: 2419349 - RNA, 16 nt, Bordetella pertussis
cgacccaccuggccac

SEQ ID NO: 2419350 - RNA, 20 nt, Bordetella pertussis
cgacccacuugagcagcgcc

SEQ ID NO: 2419351 - RNA, 19 nt, Bordetella pertussis
cgacccagaacccggccgg

SEQ ID NO: 2419352 - RNA, 20 nt, Bordetella pertussis
cgacccagaacccggccggc

SEQ ID NO: 2419353 - RNA, 23 nt, Bordetella pertussis
cgacccagaacccggccggcgcc

SEQ ID NO: 2419354 - RNA, 13 nt, Bordetella pertussis
cgacccaggccgg

SEQ ID NO: 2419355 - RNA, 14 nt, Bordetella pertussis
cgacccaggccggc

SEQ ID NO: 2419356 - RNA, 20 nt, Bordetella pertussis
cgacccaggccggcgccagc

SEQ ID NO: 2419357 - RNA, 21 nt, Bordetella pertussis
cgacccaggccggcgccagcc

SEQ ID NO: 2419358 - RNA, 18 nt, Bordetella pertussis
cgacccauaguugcauga

SEQ ID NO: 2419359 - RNA, 17 nt, Bordetella pertussis
cgacgaacccgggcgug

SEQ ID NO: 2419360 - RNA, 20 nt, Bordetella pertussis
cgacgaacugaucggcaagg

SEQ ID NO: 2419361 - RNA, 22 nt, Bordetella pertussis
cgacgaagguguugaccacgcc

SEQ ID NO: 2419362 - RNA, 18 nt, Bordetella pertussis
cgacgacaaacccgacga

SEQ ID NO: 2419363 - RNA, 19 nt, Bordetella pertussis
cgacgacaacccgaacucc

SEQ ID NO: 2419364 - RNA, 13 nt, Bordetella pertussis
cgacgacagcggc

SEQ ID NO: 2419365 - RNA, 19 nt, Bordetella pertussis
cgacgaccccgccgugccg

SEQ ID NO: 2419366 - RNA, 23 nt, Bordetella pertussis
cgacgaccccgccgugccgggcc

SEQ ID NO: 2419367 - RNA, 12 nt, Bordetella pertussis
cgacgacggcaa

SEQ ID NO: 2419368 - RNA, 14 nt, Bordetella pertussis
cgacgacggccggc

SEQ ID NO: 2419369 - RNA, 15 nt, Bordetella pertussis
cgacgacggccggcg

SEQ ID NO: 2419370 - RNA, 15 nt, Bordetella pertussis
cgacgacuacuggca

SEQ ID NO: 2419371 - RNA, 17 nt, Bordetella pertussis
cgacgagaucgcgccua

SEQ ID NO: 2419372 - RNA, 14 nt, Bordetella pertussis
cgacgagcgcacca

SEQ ID NO: 2419373 - RNA, 22 nt, Bordetella pertussis
cgacgaggagccggcgggcggc

SEQ ID NO: 2419374 - RNA, 14 nt, Bordetella pertussis
cgacgagggcgcca

SEQ ID NO: 2419375 - RNA, 17 nt, Bordetella pertussis
cgacgaggggguguucu

SEQ ID NO: 2419376 - RNA, 20 nt, Bordetella pertussis
cgacgaucaggaggaacagg

SEQ ID NO: 2419377 - RNA, 13 nt, Bordetella pertussis
cgacgauccggcg

SEQ ID NO: 2419378 - RNA, 14 nt, Bordetella pertussis
cgacgauccggcga

SEQ ID NO: 2419379 - RNA, 19 nt, Bordetella pertussis
cgacgauccggcgaccgac

SEQ ID NO: 2419380 - RNA, 14 nt, Bordetella pertussis
cgacgaucuggucc

SEQ ID NO: 2419381 - RNA, 21 nt, Bordetella pertussis
cgacgaucugguccugggccg

SEQ ID NO: 2419382 - RNA, 21 nt, Bordetella pertussis
cgacgaugcccugcgccagcg

SEQ ID NO: 2419383 - RNA, 23 nt, Bordetella pertussis
cgacgaugcccugcgccagcgcc

SEQ ID NO: 2419384 - RNA, 22 nt, Bordetella pertussis
cgacgaugccgcccacgccaug

SEQ ID NO: 2419385 - RNA, 14 nt, Bordetella pertussis
cgacgaugccgccg

SEQ ID NO: 2419386 - RNA, 15 nt, Bordetella pertussis
cgacgaugccggucu

SEQ ID NO: 2419387 - RNA, 21 nt, Bordetella pertussis
cgacgaugccggucuccagcg

SEQ ID NO: 2419388 - RNA, 22 nt, Bordetella pertussis
cgacgaugccggucuccagcgc

SEQ ID NO: 2419389 - RNA, 23 nt, Bordetella pertussis
cgacgauggccggggcgucgucg

SEQ ID NO: 2419390 - RNA, 24 nt, Bordetella pertussis
cgacgauggcgggguuggccgcca

SEQ ID NO: 2419391 - RNA, 15 nt, Bordetella pertussis
cgacgaugucgccgc

SEQ ID NO: 2419392 - RNA, 17 nt, Bordetella pertussis
cgacgaugucgccgccg

SEQ ID NO: 2419393 - RNA, 21 nt, Bordetella pertussis
cgacgcaacagacccgggccg

SEQ ID NO: 2419394 - RNA, 23 nt, Bordetella pertussis
cgacgcaacagacccgggccgcu

SEQ ID NO: 2419395 - RNA, 17 nt, Bordetella pertussis
cgacgcaaucggcgaag

SEQ ID NO: 2419396 - RNA, 15 nt, Bordetella pertussis
cgacgcagcagccgc

SEQ ID NO: 2419397 - RNA, 19 nt, Bordetella pertussis
cgacgcagccuucguccug

SEQ ID NO: 2419398 - RNA, 14 nt, Bordetella pertussis
cgacgcagcgugcg

SEQ ID NO: 2419399 - RNA, 12 nt, Bordetella pertussis
cgacgcaggcgc

SEQ ID NO: 2419400 - RNA, 17 nt, Bordetella pertussis
cgacgcauauccaggcg

SEQ ID NO: 2419401 - RNA, 19 nt, Bordetella pertussis
cgacgcauauccaggcggc

SEQ ID NO: 2419402 - RNA, 20 nt, Bordetella pertussis
cgacgcaugucagcgccugg

SEQ ID NO: 2419403 - RNA, 14 nt, Bordetella pertussis
cgacgccagcauga

SEQ ID NO: 2419404 - RNA, 18 nt, Bordetella pertussis
cgacgccaucucgcgcgc

SEQ ID NO: 2419405 - RNA, 19 nt, Bordetella pertussis
cgacgccaucucgcgcgcu

SEQ ID NO: 2419406 - RNA, 19 nt, Bordetella pertussis
cgacgcccagccugccggc

SEQ ID NO: 2419407 - RNA, 22 nt, Bordetella pertussis
cgacgcccagccugccggcggc

SEQ ID NO: 2419408 - RNA, 23 nt, Bordetella pertussis
cgacgcccaugcgaucggccucg

SEQ ID NO: 2419409 - RNA, 16 nt, Bordetella pertussis
cgacgcccgcgcccag

SEQ ID NO: 2419410 - RNA, 16 nt, Bordetella pertussis
cgacgcccgggcggcu

SEQ ID NO: 2419411 - RNA, 14 nt, Bordetella pertussis
cgacgcccuggccu

SEQ ID NO: 2419412 - RNA, 16 nt, Bordetella pertussis
cgacgccgccacgcug

SEQ ID NO: 2419413 - RNA, 20 nt, Bordetella pertussis
cgacgccgccacgcuggccg

SEQ ID NO: 2419414 - RNA, 21 nt, Bordetella pertussis
cgacgccgccacgcuggccgc

SEQ ID NO: 2419415 - RNA, 13 nt, Bordetella pertussis
cgacgccgcgcgc

SEQ ID NO: 2419416 - RNA, 14 nt, Bordetella pertussis
cgacgccgcgcgcg

SEQ ID NO: 2419417 - RNA, 15 nt, Bordetella pertussis
cgacgccgcgcgcga

SEQ ID NO: 2419418 - RNA, 19 nt, Bordetella pertussis
cgacgccgcggugcugggc

SEQ ID NO: 2419419 - RNA, 21 nt, Bordetella pertussis
cgacgccgcggugcugggcuu

SEQ ID NO: 2419420 - RNA, 13 nt, Bordetella pertussis
cgacgccggcagc

SEQ ID NO: 2419421 - RNA, 14 nt, Bordetella pertussis
cgacgccggcagcg

SEQ ID NO: 2419422 - RNA, 13 nt, Bordetella pertussis
cgacgccggcgac

SEQ ID NO: 2419423 - RNA, 14 nt, Bordetella pertussis
cgacgccggcgacg

SEQ ID NO: 2419424 - RNA, 19 nt, Bordetella pertussis
cgacgccggcucaggccag

SEQ ID NO: 2419425 - RNA, 12 nt, Bordetella pertussis
cgacgccggcuu

SEQ ID NO: 2419426 - RNA, 21 nt, Bordetella pertussis
cgacgccggcuuucagcgccg

SEQ ID NO: 2419427 - RNA, 14 nt, Bordetella pertussis
cgacgccgugcuga

SEQ ID NO: 2419428 - RNA, 19 nt, Bordetella pertussis
cgacgccugcgccauggcg

SEQ ID NO: 2419429 - RNA, 21 nt, Bordetella pertussis
cgacgccugcgccauggcgcg

SEQ ID NO: 2419430 - RNA, 22 nt, Bordetella pertussis
cgacgccugcgccauggcgcgc

SEQ ID NO: 2419431 - RNA, 13 nt, Bordetella pertussis
cgacgccuggacc

SEQ ID NO: 2419432 - RNA, 17 nt, Bordetella pertussis
cgacgcgaaccaggcca

SEQ ID NO: 2419433 - RNA, 22 nt, Bordetella pertussis
cgacgcgaaccaggccaccgcg

SEQ ID NO: 2419434 - RNA, 17 nt, Bordetella pertussis
cgacgcgacacgcagca

SEQ ID NO: 2419435 - RNA, 13 nt, Bordetella pertussis
cgacgcgacgcga

SEQ ID NO: 2419436 - RNA, 15 nt, Bordetella pertussis
cgacgcgacgcgggc

SEQ ID NO: 2419437 - RNA, 18 nt, Bordetella pertussis
cgacgcgacgcgggcggc

SEQ ID NO: 2419438 - RNA, 15 nt, Bordetella pertussis
cgacgcgaugcccgc

SEQ ID NO: 2419439 - RNA, 18 nt, Bordetella pertussis
cgacgcgaugcccgcgca

SEQ ID NO: 2419440 - RNA, 21 nt, Bordetella pertussis
cgacgcgaugcccgcgcacca

SEQ ID NO: 2419441 - RNA, 17 nt, Bordetella pertussis
cgacgcgauguccagcu

SEQ ID NO: 2419442 - RNA, 20 nt, Bordetella pertussis
cgacgcgauguccagcucca

SEQ ID NO: 2419443 - RNA, 20 nt, Bordetella pertussis
cgacgcgcauuucgaccugc

SEQ ID NO: 2419444 - RNA, 12 nt, Bordetella pertussis
cgacgcgccggg

SEQ ID NO: 2419445 - RNA, 14 nt, Bordetella pertussis
cgacgcgccgggcc

SEQ ID NO: 2419446 - RNA, 23 nt, Bordetella pertussis
cgacgcgccgggccacgagcagu

SEQ ID NO: 2419447 - RNA, 14 nt, Bordetella pertussis
cgacgcgcgccggc

SEQ ID NO: 2419448 - RNA, 21 nt, Bordetella pertussis
cgacgcgcgucgugcccgcca

SEQ ID NO: 2419449 - RNA, 12 nt, Bordetella pertussis
cgacgcgcugcc

SEQ ID NO: 2419450 - RNA, 16 nt, Bordetella pertussis
cgacgcgcugguccgc

SEQ ID NO: 2419451 - RNA, 14 nt, Bordetella pertussis
cgacgcgcuugacg

SEQ ID NO: 2419452 - RNA, 13 nt, Bordetella pertussis
cgacgcggcaugc

SEQ ID NO: 2419453 - RNA, 18 nt, Bordetella pertussis
cgacgcggccagcggcgc

SEQ ID NO: 2419454 - RNA, 20 nt, Bordetella pertussis
cgacgcggccagcggcgcuu

SEQ ID NO: 2419455 - RNA, 15 nt, Bordetella pertussis
cgacgcggccgaccc

SEQ ID NO: 2419456 - RNA, 13 nt, Bordetella pertussis
cgacgcggccgug

SEQ ID NO: 2419457 - RNA, 14 nt, Bordetella pertussis
cgacgcggccgugg

SEQ ID NO: 2419458 - RNA, 15 nt, Bordetella pertussis
cgacgcggccgugga

SEQ ID NO: 2419459 - RNA, 22 nt, Bordetella pertussis
cgacgcggcguacuggcgcggc

SEQ ID NO: 2419460 - RNA, 17 nt, Bordetella pertussis
cgacgcgggcggccgac

SEQ ID NO: 2419461 - RNA, 23 nt, Bordetella pertussis
cgacgcggucgcccaacccggcg

SEQ ID NO: 2419462 - RNA, 17 nt, Bordetella pertussis
cgacgcguuguucgggc

SEQ ID NO: 2419463 - RNA, 20 nt, Bordetella pertussis
cgacgcguuguucgggccgg

SEQ ID NO: 2419464 - RNA, 19 nt, Bordetella pertussis
cgacgcugaucggccgacu

SEQ ID NO: 2419465 - RNA, 16 nt, Bordetella pertussis
cgacgcugaucucggc

SEQ ID NO: 2419466 - RNA, 22 nt, Bordetella pertussis
cgacgcugaucucggccugccc

SEQ ID NO: 2419467 - RNA, 17 nt, Bordetella pertussis
cgacgcuggcgaugccc

SEQ ID NO: 2419468 - RNA, 18 nt, Bordetella pertussis
cgacgcuguuggucaggu

SEQ ID NO: 2419469 - RNA, 15 nt, Bordetella pertussis
cgacgcuugccggcg

SEQ ID NO: 2419470 - RNA, 17 nt, Bordetella pertussis
cgacgcuugccggcgau

SEQ ID NO: 2419471 - RNA, 12 nt, Bordetella pertussis
cgacggacuggc

SEQ ID NO: 2419472 - RNA, 14 nt, Bordetella pertussis
cgacuggcggcugc

SEQ ID NO: 2419473 - RNA, 21 nt, Bordetella pertussis
cgacugggugcgccugaccca

SEQ ID NO: 2419474 - RNA, 21 nt, Bordetella pertussis
cgacuucaccgugaugggcgc

SEQ ID NO: 2419475 - RNA, 19 nt, Bordetella pertussis
cgacuuccgcuuccggccg

SEQ ID NO: 2419476 - RNA, 21 nt, Bordetella pertussis
cgacuuccucgacccgcgccu

SEQ ID NO: 2419477 - RNA, 16 nt, Bordetella pertussis
cgacuuccugggugcg

SEQ ID NO: 2419478 - RNA, 14 nt, Bordetella pertussis
cgacuucgacccgg

SEQ ID NO: 2419479 - RNA, 15 nt, Bordetella pertussis
cgacuucgccgauga

SEQ ID NO: 2419480 - RNA, 20 nt, Bordetella pertussis
cgacuucgcgaaagcgcugc

SEQ ID NO: 2419481 - RNA, 16 nt, Bordetella pertussis
cgacuucggccgacau

SEQ ID NO: 2419482 - RNA, 15 nt, Bordetella pertussis
cgacuucggcggcca

SEQ ID NO: 2419483 - RNA, 17 nt, Bordetella pertussis
cgacuucggcggccaug

SEQ ID NO: 2419484 - RNA, 22 nt, Bordetella pertussis
cgacuucggcggccugcuuggc

SEQ ID NO: 2419485 - RNA, 17 nt, Bordetella pertussis
cgacuucguccggcgcg

SEQ ID NO: 2419486 - RNA, 17 nt, Bordetella pertussis
cgacuucgucgggcucg

SEQ ID NO: 2419487 - RNA, 20 nt, Bordetella pertussis
cgacuucuggggugccuguc

SEQ ID NO: 2419488 - RNA, 14 nt, Bordetella pertussis
cgacuugaucaggg

SEQ ID NO: 2419489 - RNA, 23 nt, Bordetella pertussis
cgacuuggccugguuggccgccu

SEQ ID NO: 2419490 - RNA, 22 nt, Bordetella pertussis
cgacuugggcaguucgcccggc

SEQ ID NO: 2419491 - RNA, 17 nt, Bordetella pertussis
cgacuuggugggcaccu

SEQ ID NO: 2419492 - RNA, 18 nt, Bordetella pertussis
cgacuugucgcgcccgaa

SEQ ID NO: 2419493 - RNA, 13 nt, Bordetella pertussis
cgagaacagccac

SEQ ID NO: 2419494 - RNA, 14 nt, Bordetella pertussis
cgagaaccaggcca

SEQ ID NO: 2419495 - RNA, 21 nt, Bordetella pertussis
cgagaagauuucccagagcug

SEQ ID NO: 2419496 - RNA, 21 nt, Bordetella pertussis
cgagaagucaucgauggccag

SEQ ID NO: 2419497 - RNA, 23 nt, Bordetella pertussis
cgagaaugacgguggugucggcg

SEQ ID NO: 2419498 - RNA, 22 nt, Bordetella pertussis
cgagaauggcgcgauccagucg

SEQ ID NO: 2419499 - RNA, 15 nt, Bordetella pertussis
cgagacaggcgcgcc

SEQ ID NO: 2419500 - RNA, 18 nt, Bordetella pertussis
cgagacaggcgcgccauc

SEQ ID NO: 2419501 - RNA, 19 nt, Bordetella pertussis
cgagaccacgauggccggc

SEQ ID NO: 2419502 - RNA, 21 nt, Bordetella pertussis
cgagaccacgauggccggcgc

SEQ ID NO: 2419503 - RNA, 13 nt, Bordetella pertussis
cgagaccagcagc

SEQ ID NO: 2419504 - RNA, 13 nt, Bordetella pertussis
cgagaccaugacg

SEQ ID NO: 2419505 - RNA, 13 nt, Bordetella pertussis
cgagaccgcccgc

SEQ ID NO: 2419506 - RNA, 19 nt, Bordetella pertussis
cgagaccgggcgguacagg

SEQ ID NO: 2419507 - RNA, 22 nt, Bordetella pertussis
cgagaccuucggccaaucggcc

SEQ ID NO: 2419508 - RNA, 23 nt, Bordetella pertussis
cgagacgaaggcgccggccaggc

SEQ ID NO: 2419509 - RNA, 19 nt, Bordetella pertussis
cgagacgcgcucgcgcgcg

SEQ ID NO: 2419510 - RNA, 17 nt, Bordetella pertussis
cgagacgcugucgcgcc

SEQ ID NO: 2419511 - RNA, 13 nt, Bordetella pertussis
cgagacggccgcc

SEQ ID NO: 2419512 - RNA, 23 nt, Bordetella pertussis
cgagacgucggcgauggcccggu

SEQ ID NO: 2419513 - RNA, 16 nt, Bordetella pertussis
cgagagauagcccagc

SEQ ID NO: 2419514 - RNA, 16 nt, Bordetella pertussis
cgagagcuccagccgg

SEQ ID NO: 2419515 - RNA, 17 nt, Bordetella pertussis
cgagagcuccagccggg

SEQ ID NO: 2419516 - RNA, 19 nt, Bordetella pertussis
cgagagcugcgucuugagc

SEQ ID NO: 2419517 - RNA, 19 nt, Bordetella pertussis
cgagaguuucggcgacgac

SEQ ID NO: 2419518 - RNA, 17 nt, Bordetella pertussis
cgagauaggcggccagg

SEQ ID NO: 2419519 - RNA, 23 nt, Bordetella pertussis
cgagaucagcaccgcgaccaugc

SEQ ID NO: 2419520 - RNA, 14 nt, Bordetella pertussis
cgagaucagccacc

SEQ ID NO: 2419521 - RNA, 13 nt, Bordetella pertussis
cgagauccgccgg

SEQ ID NO: 2419522 - RNA, 14 nt, Bordetella pertussis
cgagauccgccggc

SEQ ID NO: 2419523 - RNA, 19 nt, Bordetella pertussis
cgagaugccgaugauggcc

SEQ ID NO: 2419524 - RNA, 18 nt, Bordetella pertussis
cgagaugccgucgaaggc

SEQ ID NO: 2419525 - RNA, 22 nt, Bordetella pertussis
cgagaugccguucuugcccgag

SEQ ID NO: 2419526 - RNA, 22 nt, Bordetella pertussis
cgagauggccuuuuccaggcgu

SEQ ID NO: 2419527 - RNA, 17 nt, Bordetella pertussis
cgagauggcgcaggcgc

SEQ ID NO: 2419528 - RNA, 20 nt, Bordetella pertussis
cgagauguccauggccugca

SEQ ID NO: 2419529 - RNA, 21 nt, Bordetella pertussis
cgagcaaaggacacgcgcgag

SEQ ID NO: 2419530 - RNA, 17 nt, Bordetella pertussis
cgagcaagggccagaca

SEQ ID NO: 2419531 - RNA, 19 nt, Bordetella pertussis
cgagcaauccgucaggcag

SEQ ID NO: 2419532 - RNA, 20 nt, Bordetella pertussis
cgagcaauugccggaucagc

SEQ ID NO: 2419533 - RNA, 15 nt, Bordetella pertussis
cgagcacccgcaggc

SEQ ID NO: 2419534 - RNA, 24 nt, Bordetella pertussis
cgagcacccgcaggcggcuggugc

SEQ ID NO: 2419535 - RNA, 14 nt, Bordetella pertussis
cgagcaccgccucg

SEQ ID NO: 2419536 - RNA, 14 nt, Bordetella pertussis
cgagcaccgcgcgg

SEQ ID NO: 2419537 - RNA, 18 nt, Bordetella pertussis
cgagcacgcggcgcggca

SEQ ID NO: 2419538 - RNA, 15 nt, Bordetella pertussis
cgagcacggccugcu

SEQ ID NO: 2419539 - RNA, 13 nt, Bordetella pertussis
cgagcacggggcu

SEQ ID NO: 2419540 - RNA, 19 nt, Bordetella pertussis
cgagcacuucgagcgacgg

SEQ ID NO: 2419541 - RNA, 21 nt, Bordetella pertussis
cgagcagaugcgacuggcggc

SEQ ID NO: 2419542 - RNA, 15 nt, Bordetella pertussis
cgagcagcgcaucga

SEQ ID NO: 2419543 - RNA, 14 nt, Bordetella pertussis
cgagcaggccgccg

SEQ ID NO: 2419544 - RNA, 18 nt, Bordetella pertussis
cgagcaggccgccgccgg

SEQ ID NO: 2419545 - RNA, 21 nt, Bordetella pertussis
cgagcaggccgccggggaggc

SEQ ID NO: 2419546 - RNA, 17 nt, Bordetella pertussis
cgagcaggcgcaggccg

SEQ ID NO: 2419547 - RNA, 12 nt, Bordetella pertussis
cgagcaggcgcg

SEQ ID NO: 2419548 - RNA, 14 nt, Bordetella pertussis
cgagcaggcgcgcg

SEQ ID NO: 2419549 - RNA, 15 nt, Bordetella pertussis
cgagcaggcgcgcgg

SEQ ID NO: 2419550 - RNA, 23 nt, Bordetella pertussis
cgagcagggcaucaccaucgaug

SEQ ID NO: 2419551 - RNA, 23 nt, Bordetella pertussis
cgagcagggggucgaucauggcc

SEQ ID NO: 2419552 - RNA, 20 nt, Bordetella pertussis
cgagcaguacacgcgcaaca

SEQ ID NO: 2419553 - RNA, 15 nt, Bordetella pertussis
cgagcaucauggcgc

SEQ ID NO: 2419554 - RNA, 18 nt, Bordetella pertussis
cgagcaucauggcgcgcg

SEQ ID NO: 2419555 - RNA, 16 nt, Bordetella pertussis
cgagcaucccggcgcu

SEQ ID NO: 2419556 - RNA, 23 nt, Bordetella pertussis
cgagcaucccggcgcucagcgcg

SEQ ID NO: 2419557 - RNA, 20 nt, Bordetella pertussis
cgagcaucuggcgcauggcc

SEQ ID NO: 2419558 - RNA, 23 nt, Bordetella pertussis
cgagcaugagugauuguccugca

SEQ ID NO: 2419559 - RNA, 14 nt, Bordetella pertussis
cgagcaugcgcagc

SEQ ID NO: 2419560 - RNA, 15 nt, Bordetella pertussis
cgagcaugcgcagcg

SEQ ID NO: 2419561 - RNA, 14 nt, Bordetella pertussis
cgagcaugcgggcc

SEQ ID NO: 2419562 - RNA, 15 nt, Bordetella pertussis
cgagcaugcgggcca

SEQ ID NO: 2419563 - RNA, 18 nt, Bordetella pertussis
cgagcaugcgggccaugu

SEQ ID NO: 2419564 - RNA, 18 nt, Bordetella pertussis
cgagcauggcaucgguca

SEQ ID NO: 2419565 - RNA, 21 nt, Bordetella pertussis
cgagcauggcgguggccagcg

SEQ ID NO: 2419566 - RNA, 17 nt, Bordetella pertussis
cgagcauugccgcggca

SEQ ID NO: 2419567 - RNA, 23 nt, Bordetella pertussis
cgagccaauaacagaggaacgcc

SEQ ID NO: 2419568 - RNA, 13 nt, Bordetella pertussis
cgagcccagguug

SEQ ID NO: 2419569 - RNA, 24 nt, Bordetella pertussis
cgagcccaucaggugggccgagcc

SEQ ID NO: 2419570 - RNA, 18 nt, Bordetella pertussis
cgagcccgacgcgaggca

SEQ ID NO: 2419571 - RNA, 17 nt, Bordetella pertussis
cgagcccgccaucgcca

SEQ ID NO: 2419572 - RNA, 20 nt, Bordetella pertussis
cgagcccgccaucgccagga

SEQ ID NO: 2419573 - RNA, 20 nt, Bordetella pertussis
cgagcccgcgucagacgcgc

SEQ ID NO: 2419574 - RNA, 21 nt, Bordetella pertussis
cgagcccgcgucagacgcgcu

SEQ ID NO: 2419575 - RNA, 19 nt, Bordetella pertussis
cgagcccgcgucggcgcgg

SEQ ID NO: 2419576 - RNA, 17 nt, Bordetella pertussis
cgagcccggcaccaugc

SEQ ID NO: 2419577 - RNA, 16 nt, Bordetella pertussis
cgagcccuggcuuggc

SEQ ID NO: 2419578 - RNA, 18 nt, Bordetella pertussis
cgagcccuggcuuggccg

SEQ ID NO: 2419579 - RNA, 20 nt, Bordetella pertussis
cgagccgaaguacacggcca

SEQ ID NO: 2419580 - RNA, 22 nt, Bordetella pertussis
cgagccgaaguacacggccagc

SEQ ID NO: 2419581 - RNA, 23 nt, Bordetella pertussis
cgagccgaaguacacggccagca

SEQ ID NO: 2419582 - RNA, 13 nt, Bordetella pertussis
cgagccgacgcuc

SEQ ID NO: 2419583 - RNA, 17 nt, Bordetella pertussis
cgagccgcagaacagca

SEQ ID NO: 2419584 - RNA, 14 nt, Bordetella pertussis
cgagcucaccgacu

SEQ ID NO: 2419585 - RNA, 18 nt, Bordetella pertussis
cgagcuccucgagcgugg

SEQ ID NO: 2419586 - RNA, 17 nt, Bordetella pertussis
cgagcucgauggcuucg

SEQ ID NO: 2419587 - RNA, 15 nt, Bordetella pertussis
cgagcucggcauggc

SEQ ID NO: 2419588 - RNA, 15 nt, Bordetella pertussis
cgagcugagcaccag

SEQ ID NO: 2419589 - RNA, 19 nt, Bordetella pertussis
cgagcugagcaccagcagc

SEQ ID NO: 2419590 - RNA, 20 nt, Bordetella pertussis
cgagcugagcaccagcagcc

SEQ ID NO: 2419591 - RNA, 23 nt, Bordetella pertussis
cgagcugagcaccagcagcccca

SEQ ID NO: 2419592 - RNA, 15 nt, Bordetella pertussis
cgagcugcagcccgg

SEQ ID NO: 2419593 - RNA, 16 nt, Bordetella pertussis
cgagcugcagcccggc

SEQ ID NO: 2419594 - RNA, 14 nt, Bordetella pertussis
cgagcugcgcggcu

SEQ ID NO: 2419595 - RNA, 13 nt, Bordetella pertussis
cgagcugcgcugc

SEQ ID NO: 2419596 - RNA, 21 nt, Bordetella pertussis
cgagcugcucgagcaugcggg

SEQ ID NO: 2419597 - RNA, 15 nt, Bordetella pertussis
cgagcuggcccacgc

SEQ ID NO: 2419598 - RNA, 18 nt, Bordetella pertussis
cgagcuggcccacgccca

SEQ ID NO: 2419599 - RNA, 13 nt, Bordetella pertussis
cgagcuggccggc

SEQ ID NO: 2419600 - RNA, 14 nt, Bordetella pertussis
cgagcuggccggcg

SEQ ID NO: 2419601 - RNA, 16 nt, Bordetella pertussis
cgagcuggccggcgac

SEQ ID NO: 2419602 - RNA, 23 nt, Bordetella pertussis
cgagcugguagacaugcucgaug

SEQ ID NO: 2419603 - RNA, 17 nt, Bordetella pertussis
cgagcuggugauggugu

SEQ ID NO: 2419604 - RNA, 20 nt, Bordetella pertussis
cgaggaaagcggccuguucg

SEQ ID NO: 2419605 - RNA, 14 nt, Bordetella pertussis
cgaggaaccagccg

SEQ ID NO: 2419606 - RNA, 15 nt, Bordetella pertussis
cgaggaaccagccgu

SEQ ID NO: 2419607 - RNA, 15 nt, Bordetella pertussis
cgaggaaggcccgcg

SEQ ID NO: 2419608 - RNA, 16 nt, Bordetella pertussis
cgaggaaggcccgcgu

SEQ ID NO: 2419609 - RNA, 21 nt, Bordetella pertussis
cgaggacaggccagugccugg

SEQ ID NO: 2419610 - RNA, 16 nt, Bordetella pertussis
cgaggacaggggccuc

SEQ ID NO: 2419611 - RNA, 17 nt, Bordetella pertussis
cgaggacaggggccuca

SEQ ID NO: 2419612 - RNA, 22 nt, Bordetella pertussis
cgaggacaggggccucaugacg

SEQ ID NO: 2419613 - RNA, 15 nt, Bordetella pertussis
cgaggaccugaccgu

SEQ ID NO: 2419614 - RNA, 18 nt, Bordetella pertussis
cgaggaccugaccgugca

SEQ ID NO: 2419615 - RNA, 19 nt, Bordetella pertussis
cgaggaccuguggcgcacc

SEQ ID NO: 2419616 - RNA, 14 nt, Bordetella pertussis
cgaggacgaccaac

SEQ ID NO: 2419617 - RNA, 14 nt, Bordetella pertussis
cgaggacgaccuug

SEQ ID NO: 2419618 - RNA, 18 nt, Bordetella pertussis
cgaggacgaccuugcugg

SEQ ID NO: 2419619 - RNA, 21 nt, Bordetella pertussis
cgaggacgaccuugcuggacc

SEQ ID NO: 2419620 - RNA, 13 nt, Bordetella pertussis
cgaggagccggcg

SEQ ID NO: 2419621 - RNA, 15 nt, Bordetella pertussis
cgaggagccggcggg

SEQ ID NO: 2419622 - RNA, 20 nt, Bordetella pertussis
cgaggagccggcgggcggcu

SEQ ID NO: 2419623 - RNA, 23 nt, Bordetella pertussis
cgaggagccggcgggcggcugcc

SEQ ID NO: 2419624 - RNA, 20 nt, Bordetella pertussis
cgaggagcugcugugcgccg

SEQ ID NO: 2419625 - RNA, 21 nt, Bordetella pertussis
cgaggagcugcugugcgccgg

SEQ ID NO: 2419626 - RNA, 15 nt, Bordetella pertussis
cgaggaggugcgccg

SEQ ID NO: 2419627 - RNA, 16 nt, Bordetella pertussis
cgaggaggugcgccgc

SEQ ID NO: 2419628 - RNA, 17 nt, Bordetella pertussis
cgaggaggugcgccgcu

SEQ ID NO: 2419629 - RNA, 21 nt, Bordetella pertussis
cgaggcaaucagccccaggcg

SEQ ID NO: 2419630 - RNA, 22 nt, Bordetella pertussis
cgaggcaaucagccccaggcgc

SEQ ID NO: 2419631 - RNA, 22 nt, Bordetella pertussis
cgaggcagaaguggucgcgcag

SEQ ID NO: 2419632 - RNA, 20 nt, Bordetella pertussis
cgaggcauacaggcuguggc

SEQ ID NO: 2419633 - RNA, 13 nt, Bordetella pertussis
cgaggccaccuug

SEQ ID NO: 2419634 - RNA, 23 nt, Bordetella pertussis
cgaggccacggcaaugucgcagg

SEQ ID NO: 2419635 - RNA, 19 nt, Bordetella pertussis
cgaggccagcgugcccagc

SEQ ID NO: 2419636 - RNA, 15 nt, Bordetella pertussis
cgaggccaggcugac

SEQ ID NO: 2419637 - RNA, 17 nt, Bordetella pertussis
cgaggccaggcugacca

SEQ ID NO: 2419638 - RNA, 20 nt, Bordetella pertussis
cgaggccaggcugaccagcg

SEQ ID NO: 2419639 - RNA, 23 nt, Bordetella pertussis
cgaggccagguugggugcgccgc

SEQ ID NO: 2419640 - RNA, 19 nt, Bordetella pertussis
cgaggccgaguagcggcgc

SEQ ID NO: 2419641 - RNA, 20 nt, Bordetella pertussis
cgaggccgaguagcggcgca

SEQ ID NO: 2419642 - RNA, 21 nt, Bordetella pertussis
cgaggccgaguagcggcgcaa

SEQ ID NO: 2419643 - RNA, 19 nt, Bordetella pertussis
cgaggccgcccgccccggc

SEQ ID NO: 2419644 - RNA, 20 nt, Bordetella pertussis
cgaggccgcccgccccggcg

SEQ ID NO: 2419645 - RNA, 22 nt, Bordetella pertussis
cgaggccgcccgccccggcgca

SEQ ID NO: 2419646 - RNA, 16 nt, Bordetella pertussis
cgaggccggcgucugg

SEQ ID NO: 2419647 - RNA, 15 nt, Bordetella pertussis
cgaggccucgugcug

SEQ ID NO: 2419648 - RNA, 16 nt, Bordetella pertussis
cgaggccuugcucgcc

SEQ ID NO: 2419649 - RNA, 22 nt, Bordetella pertussis
cgaggccuugcucgcccauggc

SEQ ID NO: 2419650 - RNA, 14 nt, Bordetella pertussis
cgaggcgaacaggc

SEQ ID NO: 2419651 - RNA, 15 nt, Bordetella pertussis
cgaggcgaacaggca

SEQ ID NO: 2419652 - RNA, 20 nt, Bordetella pertussis
cgaggcgaacaggcacagga

SEQ ID NO: 2419653 - RNA, 20 nt, Bordetella pertussis
cgaggcgaacauggccgaga

SEQ ID NO: 2419654 - RNA, 17 nt, Bordetella pertussis
cgaggcgaugccccggu

SEQ ID NO: 2419655 - RNA, 16 nt, Bordetella pertussis
cgaggcgauggucggc

SEQ ID NO: 2419656 - RNA, 15 nt, Bordetella pertussis
cgaggcgcagcgcag

SEQ ID NO: 2419657 - RNA, 14 nt, Bordetella pertussis
cgaggcgcaggccg

SEQ ID NO: 2419658 - RNA, 18 nt, Bordetella pertussis
cgaggcgcaggccgacgc

SEQ ID NO: 2419659 - RNA, 13 nt, Bordetella pertussis
cgaggcgccgccg

SEQ ID NO: 2419660 - RNA, 15 nt, Bordetella pertussis
cgaggcgcgcagcac

SEQ ID NO: 2419661 - RNA, 17 nt, Bordetella pertussis
cgaggcgcgcagcacgc

SEQ ID NO: 2419662 - RNA, 19 nt, Bordetella pertussis
cgaggcgcgcagcacgccg

SEQ ID NO: 2419663 - RNA, 20 nt, Bordetella pertussis
cgaggcgcgcagcacgccga

SEQ ID NO: 2419664 - RNA, 16 nt, Bordetella pertussis
cgaggcgcuggccggc

SEQ ID NO: 2419665 - RNA, 13 nt, Bordetella pertussis
cgaggcggcaagc

SEQ ID NO: 2419666 - RNA, 17 nt, Bordetella pertussis
cgaggcggcaagcggcg

SEQ ID NO: 2419667 - RNA, 19 nt, Bordetella pertussis
cgaggcggcaagcggcgug

SEQ ID NO: 2419668 - RNA, 14 nt, Bordetella pertussis
cgaggcgggcagca

SEQ ID NO: 2419669 - RNA, 13 nt, Bordetella pertussis
cgaggcggggcug

SEQ ID NO: 2419670 - RNA, 16 nt, Bordetella pertussis
cgaggcggggcuggcg

SEQ ID NO: 2419671 - RNA, 20 nt, Bordetella pertussis
cgaggcggggcuggcgcggc

SEQ ID NO: 2419672 - RNA, 21 nt, Bordetella pertussis
cgaggcggggcuggcgcggcu

SEQ ID NO: 2419673 - RNA, 22 nt, Bordetella pertussis
cgaggcggggcuggcgcggcug

SEQ ID NO: 2419674 - RNA, 20 nt, Bordetella pertussis
cgaggcggugggcagggcgg

SEQ ID NO: 2419675 - RNA, 14 nt, Bordetella pertussis
cgaggcugcgcgcg

SEQ ID NO: 2419676 - RNA, 16 nt, Bordetella pertussis
cgaggcugcgcgcgcc

SEQ ID NO: 2419677 - RNA, 19 nt, Bordetella pertussis
cgaggcugcgcgcgccagc

SEQ ID NO: 2419678 - RNA, 20 nt, Bordetella pertussis
cgaggcugcgcgcgccagcg

SEQ ID NO: 2419679 - RNA, 13 nt, Bordetella pertussis
cgaggcuggcgcc

SEQ ID NO: 2419680 - RNA, 22 nt, Bordetella pertussis
cgaggcuuuuuuucgccgggcg

SEQ ID NO: 2419681 - RNA, 15 nt, Bordetella pertussis
cgagggcaucagcgc

SEQ ID NO: 2419682 - RNA, 16 nt, Bordetella pertussis
cgagggcaucagcgcg

SEQ ID NO: 2419683 - RNA, 18 nt, Bordetella pertussis
cgagggcaucagcgcgaa

SEQ ID NO: 2419684 - RNA, 13 nt, Bordetella pertussis
cgagggccgcgcg

SEQ ID NO: 2419685 - RNA, 14 nt, Bordetella pertussis
cgagggccgcggcg

SEQ ID NO: 2419686 - RNA, 21 nt, Bordetella pertussis
cgagggccggaacagcgucca

SEQ ID NO: 2419687 - RNA, 12 nt, Bordetella pertussis
cgagggccggcg

SEQ ID NO: 2419688 - RNA, 15 nt, Bordetella pertussis
cgagggccggcgcca

SEQ ID NO: 2419689 - RNA, 16 nt, Bordetella pertussis
cgagggcgcggcgccg

SEQ ID NO: 2419690 - RNA, 17 nt, Bordetella pertussis
cgagggcgcggcgccgc

SEQ ID NO: 2419691 - RNA, 18 nt, Bordetella pertussis
cgagggcgcguccaagca

SEQ ID NO: 2419692 - RNA, 19 nt, Bordetella pertussis
cgagggcgcgucgaccuug

SEQ ID NO: 2419693 - RNA, 21 nt, Bordetella pertussis
cgagggcgucaucggcgcgca

SEQ ID NO: 2419694 - RNA, 24 nt, Bordetella pertussis
cgagggcgucaucggcgcgcagca

SEQ ID NO: 2419695 - RNA, 15 nt, Bordetella pertussis
cgagggcucgaccgc

SEQ ID NO: 2419696 - RNA, 19 nt, Bordetella pertussis
cgagggcucgaccgccgcc

SEQ ID NO: 2419697 - RNA, 14 nt, Bordetella pertussis
cgaucagccggcca

SEQ ID NO: 2419698 - RNA, 16 nt, Bordetella pertussis
cgaucagccggccaug

SEQ ID NO: 2419699 - RNA, 20 nt, Bordetella pertussis
cgaucagcgaaugcgacagc

SEQ ID NO: 2419700 - RNA, 21 nt, Bordetella pertussis
cgaucagcgaaugcgacagcg

SEQ ID NO: 2419701 - RNA, 22 nt, Bordetella pertussis
cgaucagcgacagcagggucgg

SEQ ID NO: 2419702 - RNA, 14 nt, Bordetella pertussis
cgaucagcgcccag

SEQ ID NO: 2419703 - RNA, 16 nt, Bordetella pertussis
cgaucagcgcccaggu

SEQ ID NO: 2419704 - RNA, 13 nt, Bordetella pertussis
cgaucagcgcgcc

SEQ ID NO: 2419705 - RNA, 17 nt, Bordetella pertussis
cgaucagcgcggccgcu

SEQ ID NO: 2419706 - RNA, 21 nt, Bordetella pertussis
cgaucagcggauugaccagcg

SEQ ID NO: 2419707 - RNA, 18 nt, Bordetella pertussis
cgaucagcgggcuggcca

SEQ ID NO: 2419708 - RNA, 21 nt, Bordetella pertussis
cgaucagcugcggccccggca

SEQ ID NO: 2419709 - RNA, 15 nt, Bordetella pertussis
cgaucaggcccagca

SEQ ID NO: 2419710 - RNA, 18 nt, Bordetella pertussis
cgaucaggcccuggggcc

SEQ ID NO: 2419711 - RNA, 13 nt, Bordetella pertussis
cgaucaggccgcc

SEQ ID NO: 2419712 - RNA, 17 nt, Bordetella pertussis
cgaucaggcgcuccaug

SEQ ID NO: 2419713 - RNA, 21 nt, Bordetella pertussis
cgaucaggcgcuccauggcgc

SEQ ID NO: 2419714 - RNA, 12 nt, Bordetella pertussis
cgaucaggcggc

SEQ ID NO: 2419715 - RNA, 18 nt, Bordetella pertussis
cgaucaggcggcgcggcg

SEQ ID NO: 2419716 - RNA, 19 nt, Bordetella pertussis
cgaucaguaucucggcgcc

SEQ ID NO: 2419717 - RNA, 15 nt, Bordetella pertussis
cgaucaucaggauga

SEQ ID NO: 2419718 - RNA, 15 nt, Bordetella pertussis
cgaucaucaggucca

SEQ ID NO: 2419719 - RNA, 18 nt, Bordetella pertussis
cgaucaucagguccacuu

SEQ ID NO: 2419720 - RNA, 14 nt, Bordetella pertussis
cgaucauccaggcc

SEQ ID NO: 2419721 - RNA, 24 nt, Bordetella pertussis
cgaucauccaggccgugagcgccg

SEQ ID NO: 2419722 - RNA, 23 nt, Bordetella pertussis
cgaucaugaugcgcugggccagg

SEQ ID NO: 2419723 - RNA, 14 nt, Bordetella pertussis
cgaucaugcgcugc

SEQ ID NO: 2419724 - RNA, 20 nt, Bordetella pertussis
cgaucaugcgcugcgagccg

SEQ ID NO: 2419725 - RNA, 16 nt, Bordetella pertussis
cgaucauggccagccg

SEQ ID NO: 2419726 - RNA, 13 nt, Bordetella pertussis
cgaucauggcgcc

SEQ ID NO: 2419727 - RNA, 14 nt, Bordetella pertussis
cgaucauggcgccg

SEQ ID NO: 2419728 - RNA, 23 nt, Bordetella pertussis
cgauccacggccggcgcacgccg

SEQ ID NO: 2419729 - RNA, 18 nt, Bordetella pertussis
cgauccacucggccagcg

SEQ ID NO: 2419730 - RNA, 12 nt, Bordetella pertussis
cgauccagcagc

SEQ ID NO: 2419731 - RNA, 18 nt, Bordetella pertussis
cgauccagcagcguggcc

SEQ ID NO: 2419732 - RNA, 19 nt, Bordetella pertussis
cgauccagcagcguggcca

SEQ ID NO: 2419733 - RNA, 15 nt, Bordetella pertussis
cgauccagcccaccg

SEQ ID NO: 2419734 - RNA, 15 nt, Bordetella pertussis
cgauccagcgccugg

SEQ ID NO: 2419735 - RNA, 16 nt, Bordetella pertussis
cgauccaggccaccgc

SEQ ID NO: 2419736 - RNA, 16 nt, Bordetella pertussis
cgauccagggccgcag

SEQ ID NO: 2419737 - RNA, 16 nt, Bordetella pertussis
cgauccagggccgcca

SEQ ID NO: 2419738 - RNA, 17 nt, Bordetella pertussis
cgauccagggccgccag

SEQ ID NO: 2419739 - RNA, 22 nt, Bordetella pertussis
cgauccagggccgccagcaccu

SEQ ID NO: 2419740 - RNA, 14 nt, Bordetella pertussis
cgauccccugcccg

SEQ ID NO: 2419741 - RNA, 15 nt, Bordetella pertussis
cgauccccugcccgc

SEQ ID NO: 2419742 - RNA, 22 nt, Bordetella pertussis
cgaucccgacgauccgcgggua

SEQ ID NO: 2419743 - RNA, 14 nt, Bordetella pertussis
cgaucccggccacg

SEQ ID NO: 2419744 - RNA, 22 nt, Bordetella pertussis
cgaucccgucauggcggcaggc

SEQ ID NO: 2419745 - RNA, 17 nt, Bordetella pertussis
cgaucccuugugcgcgc

SEQ ID NO: 2419746 - RNA, 17 nt, Bordetella pertussis
cgauccgaugaugccca

SEQ ID NO: 2419747 - RNA, 18 nt, Bordetella pertussis
cgauccgaugaugcccag

SEQ ID NO: 2419748 - RNA, 19 nt, Bordetella pertussis
cgauccgaugaugcccagg

SEQ ID NO: 2419749 - RNA, 18 nt, Bordetella pertussis
cgauccgaugcccgguuc

SEQ ID NO: 2419750 - RNA, 15 nt, Bordetella pertussis
cgauccgccgcggcc

SEQ ID NO: 2419751 - RNA, 16 nt, Bordetella pertussis
cgauccgccgcggcca

SEQ ID NO: 2419752 - RNA, 16 nt, Bordetella pertussis
cgauccgcgggcgggc

SEQ ID NO: 2419753 - RNA, 17 nt, Bordetella pertussis
cgauccgcgggcgggcc

SEQ ID NO: 2419754 - RNA, 22 nt, Bordetella pertussis
cgauccgcggguauucgaaggc

SEQ ID NO: 2419755 - RNA, 12 nt, Bordetella pertussis
cgauccggcagc

SEQ ID NO: 2419756 - RNA, 14 nt, Bordetella pertussis
cgauccggcgaccg

SEQ ID NO: 2419757 - RNA, 19 nt, Bordetella pertussis
cgauccggcgaccgacggc

SEQ ID NO: 2419758 - RNA, 13 nt, Bordetella pertussis
cgauccggcgcag

SEQ ID NO: 2419759 - RNA, 12 nt, Bordetella pertussis
cgauccggugau

SEQ ID NO: 2419760 - RNA, 16 nt, Bordetella pertussis
cgauccgguugacgau

SEQ ID NO: 2419761 - RNA, 16 nt, Bordetella pertussis
cgaucgaacgcggcca

SEQ ID NO: 2419762 - RNA, 20 nt, Bordetella pertussis
cgaucgaauggucggccucg

SEQ ID NO: 2419763 - RNA, 23 nt, Bordetella pertussis
cgaucgagaaguuggcgggcgcu

SEQ ID NO: 2419764 - RNA, 13 nt, Bordetella pertussis
cgaucgagcaggc

SEQ ID NO: 2419765 - RNA, 16 nt, Bordetella pertussis
cgaucgagcaggccgc

SEQ ID NO: 2419766 - RNA, 17 nt, Bordetella pertussis
cgaucgagcaggccgcc

SEQ ID NO: 2419767 - RNA, 19 nt, Bordetella pertussis
cgaucgcaucgcggcagcc

SEQ ID NO: 2419768 - RNA, 14 nt, Bordetella pertussis
cgaucgccagcagg

SEQ ID NO: 2419769 - RNA, 15 nt, Bordetella pertussis
cgaucgccagcaggc

SEQ ID NO: 2419770 - RNA, 16 nt, Bordetella pertussis
cgaucgccaggucggc

SEQ ID NO: 2419771 - RNA, 12 nt, Bordetella pertussis
cgaucgccgaca

SEQ ID NO: 2419772 - RNA, 16 nt, Bordetella pertussis
cgaucgccgcaugggc

SEQ ID NO: 2419773 - RNA, 14 nt, Bordetella pertussis
cgaucgccuggggc

SEQ ID NO: 2419774 - RNA, 19 nt, Bordetella pertussis
cgaucgccuggggcgggcg

SEQ ID NO: 2419775 - RNA, 22 nt, Bordetella pertussis
cgaucgccuguaucugcgccgu

SEQ ID NO: 2419776 - RNA, 16 nt, Bordetella pertussis
cgaucgcgccggccug

SEQ ID NO: 2419777 - RNA, 17 nt, Bordetella pertussis
cgaucgcgccggccugg

SEQ ID NO: 2419778 - RNA, 19 nt, Bordetella pertussis
cgaucgcgccggccugggc

SEQ ID NO: 2419779 - RNA, 12 nt, Bordetella pertussis
cgaucgcgccgu

SEQ ID NO: 2419780 - RNA, 19 nt, Bordetella pertussis
cgaucggagaaaucgccgc

SEQ ID NO: 2419781 - RNA, 21 nt, Bordetella pertussis
cgaucggagaaaucgccgccg

SEQ ID NO: 2419782 - RNA, 23 nt, Bordetella pertussis
cgaucggcccgggcguggcgucg

SEQ ID NO: 2419783 - RNA, 14 nt, Bordetella pertussis
cgaucggccggccg

SEQ ID NO: 2419784 - RNA, 14 nt, Bordetella pertussis
cgaucggcgccgcg

SEQ ID NO: 2419785 - RNA, 21 nt, Bordetella pertussis
cgaucggcgccgcgcgcggcc

SEQ ID NO: 2419786 - RNA, 17 nt, Bordetella pertussis
cgaucggcgccuggccg

SEQ ID NO: 2419787 - RNA, 23 nt, Bordetella pertussis
cgaucggcgccuggccgcccagc

SEQ ID NO: 2419788 - RNA, 13 nt, Bordetella pertussis
cgaucggcgcgcc

SEQ ID NO: 2419789 - RNA, 18 nt, Bordetella pertussis
cgaucggcgcgcccgcca

SEQ ID NO: 2419790 - RNA, 21 nt, Bordetella pertussis
cgaucggcgcgcccgccacgu

SEQ ID NO: 2419791 - RNA, 21 nt, Bordetella pertussis
cgaucggcuugccgcgcggcg

SEQ ID NO: 2419792 - RNA, 15 nt, Bordetella pertussis
cgaucgggagccucu

SEQ ID NO: 2419793 - RNA, 18 nt, Bordetella pertussis
cgaucgggagccucugga

SEQ ID NO: 2419794 - RNA, 13 nt, Bordetella pertussis
cgaucgucagcag

SEQ ID NO: 2419795 - RNA, 14 nt, Bordetella pertussis
cgaucgucagcagc

SEQ ID NO: 2419796 - RNA, 13 nt, Bordetella pertussis
cgaucgucgaccg

SEQ ID NO: 2419797 - RNA, 18 nt, Bordetella pertussis
cgaucgucuugaccagca

SEQ ID NO: 2419798 - RNA, 23 nt, Bordetella pertussis
cgaucgugcacgcccgcggcgcc

SEQ ID NO: 2419799 - RNA, 21 nt, Bordetella pertussis
cgaucuacgacgccuggaccg

SEQ ID NO: 2419800 - RNA, 17 nt, Bordetella pertussis
cgaucucagccaucauc

SEQ ID NO: 2419801 - RNA, 20 nt, Bordetella pertussis
cgaucucagccaucaucauc

SEQ ID NO: 2419802 - RNA, 18 nt, Bordetella pertussis
cgaucuccgggagccugu

SEQ ID NO: 2419803 - RNA, 22 nt, Bordetella pertussis
cgaucucgcgcgcgcgguccau

SEQ ID NO: 2419804 - RNA, 23 nt, Bordetella pertussis
cgaucucgcggcugguggugccg

SEQ ID NO: 2419805 - RNA, 14 nt, Bordetella pertussis
cgaucucggccucg

SEQ ID NO: 2419806 - RNA, 15 nt, Bordetella pertussis
cgaucucggccucgg

SEQ ID NO: 2419807 - RNA, 14 nt, Bordetella pertussis
cgaucucgggcagg

SEQ ID NO: 2419808 - RNA, 12 nt, Bordetella pertussis
cgaucucgucga

SEQ ID NO: 2419809 - RNA, 21 nt, Bordetella pertussis
cgaucucgucgaccgccucga

SEQ ID NO: 2419810 - RNA, 14 nt, Bordetella pertussis
cgaugccgccaugc

SEQ ID NO: 2419811 - RNA, 17 nt, Bordetella pertussis
cgaugccgccaugcgcc

SEQ ID NO: 2419812 - RNA, 23 nt, Bordetella pertussis
cgaugccgccaugcgccagcagg

SEQ ID NO: 2419813 - RNA, 15 nt, Bordetella pertussis
cgaugccgccgccga

SEQ ID NO: 2419814 - RNA, 14 nt, Bordetella pertussis
cgaugccgcgcacc

SEQ ID NO: 2419815 - RNA, 15 nt, Bordetella pertussis
cgaugccgcgcaccu

SEQ ID NO: 2419816 - RNA, 15 nt, Bordetella pertussis
cgaugccggccagca

SEQ ID NO: 2419817 - RNA, 17 nt, Bordetella pertussis
cgaugccggccagcagc

SEQ ID NO: 2419818 - RNA, 18 nt, Bordetella pertussis
cgaugccggcggccugca

SEQ ID NO: 2419819 - RNA, 14 nt, Bordetella pertussis
cgaugccgucgccg

SEQ ID NO: 2419820 - RNA, 16 nt, Bordetella pertussis
cgaugcgaucgucgcu

SEQ ID NO: 2419821 - RNA, 14 nt, Bordetella pertussis
cgaugcgcaccaug

SEQ ID NO: 2419822 - RNA, 15 nt, Bordetella pertussis
cgaugcgcacgccca

SEQ ID NO: 2419823 - RNA, 17 nt, Bordetella pertussis
cgaugcgcacgcccaga

SEQ ID NO: 2419824 - RNA, 14 nt, Bordetella pertussis
cgaugcgcaggcug

SEQ ID NO: 2419825 - RNA, 23 nt, Bordetella pertussis
cgaugcgccaggccucggucgcc

SEQ ID NO: 2419826 - RNA, 15 nt, Bordetella pertussis
cgaugcgccaggcgc

SEQ ID NO: 2419827 - RNA, 16 nt, Bordetella pertussis
cgaugcgccaggcgcu

SEQ ID NO: 2419828 - RNA, 21 nt, Bordetella pertussis
cgaugcgccaguccagcgcgc

SEQ ID NO: 2419829 - RNA, 23 nt, Bordetella pertussis
cgaugcgccaguccagcgcgccg

SEQ ID NO: 2419830 - RNA, 17 nt, Bordetella pertussis
cgaugcgccgcaccagc

SEQ ID NO: 2419831 - RNA, 18 nt, Bordetella pertussis
cgaugcgccgcaccagcg

SEQ ID NO: 2419832 - RNA, 18 nt, Bordetella pertussis
cgaugcgccggccuggcg

SEQ ID NO: 2419833 - RNA, 17 nt, Bordetella pertussis
cgaugcgcgaagcgccc

SEQ ID NO: 2419834 - RNA, 20 nt, Bordetella pertussis
cgaugcgcgaagcgcccugg

SEQ ID NO: 2419835 - RNA, 13 nt, Bordetella pertussis
cgaugcgcgcgcg

SEQ ID NO: 2419836 - RNA, 18 nt, Bordetella pertussis
cgaugcgcgcgcgggcca

SEQ ID NO: 2419837 - RNA, 23 nt, Bordetella pertussis
cgaugcgcgcgcgggccagcaga

SEQ ID NO: 2419838 - RNA, 17 nt, Bordetella pertussis
cgaugcgcgcgugcagc

SEQ ID NO: 2419839 - RNA, 18 nt, Bordetella pertussis
cgaugcgcggcccggccg

SEQ ID NO: 2419840 - RNA, 22 nt, Bordetella pertussis
cgaugcgcugcuggaggccggc

SEQ ID NO: 2419841 - RNA, 18 nt, Bordetella pertussis
cgaugcgcuugccgaccu

SEQ ID NO: 2419842 - RNA, 17 nt, Bordetella pertussis
cgaugcggcgcaugcug

SEQ ID NO: 2419843 - RNA, 14 nt, Bordetella pertussis
cgaugcgggcaucg

SEQ ID NO: 2419844 - RNA, 14 nt, Bordetella pertussis
cgaugcgggccacg

SEQ ID NO: 2419845 - RNA, 17 nt, Bordetella pertussis
cgaugcgggccacgccg

SEQ ID NO: 2419846 - RNA, 18 nt, Bordetella pertussis
cgaugcgggccacgccgg

SEQ ID NO: 2419847 - RNA, 19 nt, Bordetella pertussis
cgaugcgggccacgccggc

SEQ ID NO: 2419848 - RNA, 16 nt, Bordetella pertussis
cgaugcgggccuggau

SEQ ID NO: 2419849 - RNA, 13 nt, Bordetella pertussis
cgaugcgggcggc

SEQ ID NO: 2419850 - RNA, 18 nt, Bordetella pertussis
cgaugcgguaggcccagc

SEQ ID NO: 2419851 - RNA, 19 nt, Bordetella pertussis
cgaugcgguaggcccagca

SEQ ID NO: 2419852 - RNA, 17 nt, Bordetella pertussis
cgaugcggucggccgcg

SEQ ID NO: 2419853 - RNA, 18 nt, Bordetella pertussis
cgaugcggucggccgcgc

SEQ ID NO: 2419854 - RNA, 22 nt, Bordetella pertussis
cgaugcggugggucucggcguc

SEQ ID NO: 2419855 - RNA, 20 nt, Bordetella pertussis
cgaugcgguuguugccgcgu

SEQ ID NO: 2419856 - RNA, 21 nt, Bordetella pertussis
cgaugcgucaggggcaugccg

SEQ ID NO: 2419857 - RNA, 16 nt, Bordetella pertussis
cgaugcguccgccgug

SEQ ID NO: 2419858 - RNA, 20 nt, Bordetella pertussis
cgaugcguccgccgugcagg

SEQ ID NO: 2419859 - RNA, 18 nt, Bordetella pertussis
cgaugcguucgcccgugc

SEQ ID NO: 2419860 - RNA, 18 nt, Bordetella pertussis
cgaugcucgccggcgccg

SEQ ID NO: 2419861 - RNA, 15 nt, Bordetella pertussis
cgaugcugaccaccg

SEQ ID NO: 2419862 - RNA, 16 nt, Bordetella pertussis
cgaugcugaccaccgg

SEQ ID NO: 2419863 - RNA, 17 nt, Bordetella pertussis
cgaugcugaccaccggg

SEQ ID NO: 2419864 - RNA, 14 nt, Bordetella pertussis
cgaugcugcagggc

SEQ ID NO: 2419865 - RNA, 15 nt, Bordetella pertussis
cgaugcuggcgcgga

SEQ ID NO: 2419866 - RNA, 22 nt, Bordetella pertussis
cgaugcuggcgcggaccugcuc

SEQ ID NO: 2419867 - RNA, 17 nt, Bordetella pertussis
cgaugcuggcggcaucg

SEQ ID NO: 2419868 - RNA, 17 nt, Bordetella pertussis
cgaugcuuagcgcagca

SEQ ID NO: 2419869 - RNA, 20 nt, Bordetella pertussis
cgauggaacucguuggccag

SEQ ID NO: 2419870 - RNA, 22 nt, Bordetella pertussis
cgauggaacucguuggccagcg

SEQ ID NO: 2419871 - RNA, 23 nt, Bordetella pertussis
cgauggacucauaggcaucgacc

SEQ ID NO: 2419872 - RNA, 15 nt, Bordetella pertussis
cgauggcacggcacg

SEQ ID NO: 2419873 - RNA, 16 nt, Bordetella pertussis
cgauggcaucgccccg

SEQ ID NO: 2419874 - RNA, 19 nt, Bordetella pertussis
cgauggcaucgggcagggc

SEQ ID NO: 2419875 - RNA, 20 nt, Bordetella pertussis
cgauggcauggggcaggcgc

SEQ ID NO: 2419876 - RNA, 23 nt, Bordetella pertussis
cgauggcauggggcaggcgcagc

SEQ ID NO: 2419877 - RNA, 17 nt, Bordetella pertussis
cgauggccacgcgcugu

SEQ ID NO: 2419878 - RNA, 13 nt, Bordetella pertussis
cgauggccaggug

SEQ ID NO: 2419879 - RNA, 14 nt, Bordetella pertussis
cgauggcccgcagg

SEQ ID NO: 2419880 - RNA, 17 nt, Bordetella pertussis
cgauggcccgcaggugg

SEQ ID NO: 2419881 - RNA, 18 nt, Bordetella pertussis
cgauggcccgcagguggg

SEQ ID NO: 2419882 - RNA, 12 nt, Bordetella pertussis
cgauggcccggu

SEQ ID NO: 2419883 - RNA, 19 nt, Bordetella pertussis
cgauggcccgguaggccac

SEQ ID NO: 2419884 - RNA, 12 nt, Bordetella pertussis
cgauggccgcca

SEQ ID NO: 2419885 - RNA, 15 nt, Bordetella pertussis
cgauggccgccagcg

SEQ ID NO: 2419886 - RNA, 15 nt, Bordetella pertussis
cgauggccgcgccca

SEQ ID NO: 2419887 - RNA, 19 nt, Bordetella pertussis
cgauggccgggagcggcca

SEQ ID NO: 2419888 - RNA, 20 nt, Bordetella pertussis
cgauggccgggagcggccag

SEQ ID NO: 2419889 - RNA, 21 nt, Bordetella pertussis
cgauggccgggagcggccagc

SEQ ID NO: 2419890 - RNA, 22 nt, Bordetella pertussis
cgauggccggggcgucgucgcg

SEQ ID NO: 2419891 - RNA, 17 nt, Bordetella pertussis
cgauggccucggcaugg

SEQ ID NO: 2419892 - RNA, 18 nt, Bordetella pertussis
cgauggccucggcauggc

SEQ ID NO: 2419893 - RNA, 19 nt, Bordetella pertussis
cgauggccucggcauggcg

SEQ ID NO: 2419894 - RNA, 17 nt, Bordetella pertussis
cgauggcgauguaggcc

SEQ ID NO: 2419895 - RNA, 20 nt, Bordetella pertussis
cgauggcgauguaggccagg

SEQ ID NO: 2419896 - RNA, 19 nt, Bordetella pertussis
cgauggcgcaauaggccgc

SEQ ID NO: 2419897 - RNA, 20 nt, Bordetella pertussis
cgauggcgcaauaggccgcg

SEQ ID NO: 2419898 - RNA, 16 nt, Bordetella pertussis
cgauggcgcaggcgcg

SEQ ID NO: 2419899 - RNA, 20 nt, Bordetella pertussis
cgauggcgccaccuucgccg

SEQ ID NO: 2419900 - RNA, 14 nt, Bordetella pertussis
cgauggcgcccacg

SEQ ID NO: 2419901 - RNA, 13 nt, Bordetella pertussis
cgauggcgccggc

SEQ ID NO: 2419902 - RNA, 18 nt, Bordetella pertussis
cgauggcgccggccagcg

SEQ ID NO: 2419903 - RNA, 12 nt, Bordetella pertussis
cgauggcgcgcg

SEQ ID NO: 2419904 - RNA, 14 nt, Bordetella pertussis
cgauggcgcgcgcc

SEQ ID NO: 2419905 - RNA, 15 nt, Bordetella pertussis
cgauggcgcgcgcca

SEQ ID NO: 2419906 - RNA, 15 nt, Bordetella pertussis
cgauggcgcgcggcu

SEQ ID NO: 2419907 - RNA, 13 nt, Bordetella pertussis
cgauggcgcggcc

SEQ ID NO: 2419908 - RNA, 22 nt, Bordetella pertussis
cgauggcgcggccggaggccgc

SEQ ID NO: 2419909 - RNA, 24 nt, Bordetella pertussis
cgauggcgcggccggaggccgccc

SEQ ID NO: 2419910 - RNA, 16 nt, Bordetella pertussis
cgauggcgcgucgccg

SEQ ID NO: 2419911 - RNA, 22 nt, Bordetella pertussis
cgauggcgcgucgccgcgccgu

SEQ ID NO: 2419912 - RNA, 12 nt, Bordetella pertussis
cgauggcggcca

SEQ ID NO: 2419913 - RNA, 20 nt, Bordetella pertussis
cgauggcggccagggcaagc

SEQ ID NO: 2419914 - RNA, 13 nt, Bordetella pertussis
cgauggcggcgcu

SEQ ID NO: 2419915 - RNA, 13 nt, Bordetella pertussis
cgauggcggcggc

SEQ ID NO: 2419916 - RNA, 19 nt, Bordetella pertussis
cgauggcgggguuggccgc

SEQ ID NO: 2419917 - RNA, 23 nt, Bordetella pertussis
cgauggcgggguuggccgccagg

SEQ ID NO: 2419918 - RNA, 22 nt, Bordetella pertussis
cgauggcgguggugggcagaac

SEQ ID NO: 2419919 - RNA, 15 nt, Bordetella pertussis
cgauggcguacagca

SEQ ID NO: 2419920 - RNA, 18 nt, Bordetella pertussis
cgauggcguacagcaggg

SEQ ID NO: 2419921 - RNA, 14 nt, Bordetella pertussis
cgauggcguccagc

SEQ ID NO: 2419922 - RNA, 17 nt, Bordetella pertussis
cgauggcguccagcagc

SEQ ID NO: 2419923 - RNA, 18 nt, Bordetella pertussis
cgcaaccggucggccggc

SEQ ID NO: 2419924 - RNA, 21 nt, Bordetella pertussis
cgcaaccggucggccggcagc

SEQ ID NO: 2419925 - RNA, 22 nt, Bordetella pertussis
cgcaaccggucggccggcagcg

SEQ ID NO: 2419926 - RNA, 15 nt, Bordetella pertussis
cgcaaccgucgaccg

SEQ ID NO: 2419927 - RNA, 22 nt, Bordetella pertussis
cgcaacgcaggcgccgccccgu

SEQ ID NO: 2419928 - RNA, 14 nt, Bordetella pertussis
cgcaacgcaugcgc

SEQ ID NO: 2419929 - RNA, 17 nt, Bordetella pertussis
cgcaacgcaugcgcgau

SEQ ID NO: 2419930 - RNA, 12 nt, Bordetella pertussis
cgcaacgccagc

SEQ ID NO: 2419931 - RNA, 13 nt, Bordetella pertussis
cgcaacgccagca

SEQ ID NO: 2419932 - RNA, 15 nt, Bordetella pertussis
cgcaacgccgccacc

SEQ ID NO: 2419933 - RNA, 16 nt, Bordetella pertussis
cgcaacgccgccacca

SEQ ID NO: 2419934 - RNA, 13 nt, Bordetella pertussis
cgcaacgccgccg

SEQ ID NO: 2419935 - RNA, 22 nt, Bordetella pertussis
cgcaacgccgccggcagggcca

SEQ ID NO: 2419936 - RNA, 15 nt, Bordetella pertussis
cgcaacgccgggccg

SEQ ID NO: 2419937 - RNA, 17 nt, Bordetella pertussis
cgcaacgccgggccgcg

SEQ ID NO: 2419938 - RNA, 13 nt, Bordetella pertussis
cgcaacgcgcgcg

SEQ ID NO: 2419939 - RNA, 19 nt, Bordetella pertussis
cgcaacgcgcgcgcgcaca

SEQ ID NO: 2419940 - RNA, 13 nt, Bordetella pertussis
cgcaacuccagca

SEQ ID NO: 2419941 - RNA, 16 nt, Bordetella pertussis
cgcaacucggccaccu

SEQ ID NO: 2419942 - RNA, 15 nt, Bordetella pertussis
cgcaagacgcggcag

SEQ ID NO: 2419943 - RNA, 18 nt, Bordetella pertussis
cgcaagacgcggcagggc

SEQ ID NO: 2419944 - RNA, 21 nt, Bordetella pertussis
cgcaagagcgugugucccggc

SEQ ID NO: 2419945 - RNA, 19 nt, Bordetella pertussis
cgcaagauuucauggcguc

SEQ ID NO: 2419946 - RNA, 15 nt, Bordetella pertussis
cgcaagcaagcccca

SEQ ID NO: 2419947 - RNA, 21 nt, Bordetella pertussis
cgcaagcaagccccaggcagg

SEQ ID NO: 2419948 - RNA, 18 nt, Bordetella pertussis
cgcaagcaccgccugcug

SEQ ID NO: 2419949 - RNA, 15 nt, Bordetella pertussis
cgcaagcaggucacg

SEQ ID NO: 2419950 - RNA, 18 nt, Bordetella pertussis
cgcaagcauuugcgcgac

SEQ ID NO: 2419951 - RNA, 20 nt, Bordetella pertussis
cgcaagcauuugcgcgacgg

SEQ ID NO: 2419952 - RNA, 16 nt, Bordetella pertussis
cgcaagcccaggcggc

SEQ ID NO: 2419953 - RNA, 21 nt, Bordetella pertussis
cgcaagcccaggcggcccagc

SEQ ID NO: 2419954 - RNA, 14 nt, Bordetella pertussis
cgcaagccgcccgc

SEQ ID NO: 2419955 - RNA, 22 nt, Bordetella pertussis
cgcaagccgcccgcggcggccc

SEQ ID NO: 2419956 - RNA, 13 nt, Bordetella pertussis
cgcaagccgcugg

SEQ ID NO: 2419957 - RNA, 14 nt, Bordetella pertussis
cgcaagccgcugga

SEQ ID NO: 2419958 - RNA, 13 nt, Bordetella pertussis
cgcaagcgcgccg

SEQ ID NO: 2419959 - RNA, 15 nt, Bordetella pertussis
cgcaagcgcgccgac

SEQ ID NO: 2419960 - RNA, 19 nt, Bordetella pertussis
cgcaagcggccaugcgccg

SEQ ID NO: 2419961 - RNA, 15 nt, Bordetella pertussis
cgcaagcggccccag

SEQ ID NO: 2419962 - RNA, 15 nt, Bordetella pertussis
cgcaagcuggccgau

SEQ ID NO: 2419963 - RNA, 13 nt, Bordetella pertussis
cgcaagcuggcgg

SEQ ID NO: 2419964 - RNA, 21 nt, Bordetella pertussis
cgcaagcuggcggcgcgcggc

SEQ ID NO: 2419965 - RNA, 17 nt, Bordetella pertussis
cgcaaggaaguggccga

SEQ ID NO: 2419966 - RNA, 18 nt, Bordetella pertussis
cgcaaggcaugcgccagc

SEQ ID NO: 2419967 - RNA, 18 nt, Bordetella pertussis
cgcaaggccgacuggaug

SEQ ID NO: 2419968 - RNA, 19 nt, Bordetella pertussis
cgcaaggccgacuggauga

SEQ ID NO: 2419969 - RNA, 20 nt, Bordetella pertussis
cgcaaggccugcucgggcgc

SEQ ID NO: 2419970 - RNA, 21 nt, Bordetella pertussis
cgcaaggccugcucgggcgcc

SEQ ID NO: 2419971 - RNA, 13 nt, Bordetella pertussis
cgcaaggcggccc

SEQ ID NO: 2419972 - RNA, 21 nt, Bordetella pertussis
cgcaaggcggcccggccgccg

SEQ ID NO: 2419973 - RNA, 18 nt, Bordetella pertussis
cgcaaggcgggcuggucg

SEQ ID NO: 2419974 - RNA, 22 nt, Bordetella pertussis
cgcaaggcgucgggcacguccg

SEQ ID NO: 2419975 - RNA, 22 nt, Bordetella pertussis
cgcaagggccccccggcgcggc

SEQ ID NO: 2419976 - RNA, 23 nt, Bordetella pertussis
cgcaagggccccccggcgcggcc

SEQ ID NO: 2419977 - RNA, 15 nt, Bordetella pertussis
cgcaaggggccggcg

SEQ ID NO: 2419978 - RNA, 16 nt, Bordetella pertussis
cgcaaggggccggcgc

SEQ ID NO: 2419979 - RNA, 16 nt, Bordetella pertussis
cgcaagggggacuggc

SEQ ID NO: 2419980 - RNA, 21 nt, Bordetella pertussis
cgcaagggggacuggcaccgg

SEQ ID NO: 2419981 - RNA, 19 nt, Bordetella pertussis
cgcaaggguuguggccgug

SEQ ID NO: 2419982 - RNA, 16 nt, Bordetella pertussis
cgcaagugcuggcccg

SEQ ID NO: 2419983 - RNA, 17 nt, Bordetella pertussis
cgcaagugcuggcccgc

SEQ ID NO: 2419984 - RNA, 21 nt, Bordetella pertussis
cgcaagugcuggcccgccagc

SEQ ID NO: 2419985 - RNA, 18 nt, Bordetella pertussis
cgcaaguguggcgcaccg

SEQ ID NO: 2419986 - RNA, 20 nt, Bordetella pertussis
cgcaaguguggcgcaccgcg

SEQ ID NO: 2419987 - RNA, 18 nt, Bordetella pertussis
cgcaaguucaucaucgcc

SEQ ID NO: 2419988 - RNA, 20 nt, Bordetella pertussis
cgcaauaccuucagcccggc

SEQ ID NO: 2419989 - RNA, 15 nt, Bordetella pertussis
cgcaauacgccgccg

SEQ ID NO: 2419990 - RNA, 19 nt, Bordetella pertussis
cgcaauagcucgcauccau

SEQ ID NO: 2419991 - RNA, 14 nt, Bordetella pertussis
cgcaauaggccgcg

SEQ ID NO: 2419992 - RNA, 16 nt, Bordetella pertussis
cgcaauaggccgcgau

SEQ ID NO: 2419993 - RNA, 14 nt, Bordetella pertussis
cgcaaugcgcggcg

SEQ ID NO: 2419994 - RNA, 19 nt, Bordetella pertussis
cgcaauggacacagcggcg

SEQ ID NO: 2419995 - RNA, 23 nt, Bordetella pertussis
cgcacaaagcggguugcggcagc

SEQ ID NO: 2419996 - RNA, 19 nt, Bordetella pertussis
cgcacaaccugguacggca

SEQ ID NO: 2419997 - RNA, 16 nt, Bordetella pertussis
cgcacaagggccccgc

SEQ ID NO: 2419998 - RNA, 20 nt, Bordetella pertussis
cgcacaagggccccgcgagg

SEQ ID NO: 2419999 - RNA, 17 nt, Bordetella pertussis
cgcacacaccgcgucau

SEQ ID NO: 2420000 - RNA, 22 nt, Bordetella pertussis
cgcacacgcgcugggcguggcg

SEQ ID NO: 2420001 - RNA, 23 nt, Bordetella pertussis
cgcacacgcgcugggcguggcgc

SEQ ID NO: 2420002 - RNA, 16 nt, Bordetella pertussis
cgcacacuggccagca

SEQ ID NO: 2420003 - RNA, 20 nt, Bordetella pertussis
cgcacacuggccagcaagcg

SEQ ID NO: 2420004 - RNA, 22 nt, Bordetella pertussis
cgcacacuggccagcaagcgcu

SEQ ID NO: 2420005 - RNA, 14 nt, Bordetella pertussis
cgcacagcauggcc

SEQ ID NO: 2420006 - RNA, 22 nt, Bordetella pertussis
cgcacagcccgaucgacggccg

SEQ ID NO: 2420007 - RNA, 20 nt, Bordetella pertussis
cgcacagccggggcgagcgc

SEQ ID NO: 2420008 - RNA, 14 nt, Bordetella pertussis
cgcacagcgcggcg

SEQ ID NO: 2420009 - RNA, 20 nt, Bordetella pertussis
cgcacagcgcggcgaugccc

SEQ ID NO: 2420010 - RNA, 12 nt, Bordetella pertussis
cgcacagcucgu

SEQ ID NO: 2420011 - RNA, 20 nt, Bordetella pertussis
cgcacaggcgcucgcccucg

SEQ ID NO: 2420012 - RNA, 22 nt, Bordetella pertussis
cgcacaggcgcucgcccucgcg

SEQ ID NO: 2420013 - RNA, 20 nt, Bordetella pertussis
cgcacaggcggcgccggcac

SEQ ID NO: 2420014 - RNA, 22 nt, Bordetella pertussis
cgcacagggcgucgcgaugcgc

SEQ ID NO: 2420015 - RNA, 23 nt, Bordetella pertussis
cgcacagggcgucgcgaugcgcc

SEQ ID NO: 2420016 - RNA, 19 nt, Bordetella pertussis
cgcacaguucgugcaccag

SEQ ID NO: 2420017 - RNA, 21 nt, Bordetella pertussis
cgcacaguucgugcaccagcc

SEQ ID NO: 2420018 - RNA, 15 nt, Bordetella pertussis
cgcacauacaaggcg

SEQ ID NO: 2420019 - RNA, 20 nt, Bordetella pertussis
cgcacauacaaggcgcggca

SEQ ID NO: 2420020 - RNA, 20 nt, Bordetella pertussis
cgcacaucaggucgaccugc

SEQ ID NO: 2420021 - RNA, 23 nt, Bordetella pertussis
cgcacaucaggucgaccugcuug

SEQ ID NO: 2420022 - RNA, 14 nt, Bordetella pertussis
cgcacaugaugccc

SEQ ID NO: 2420023 - RNA, 16 nt, Bordetella pertussis
cgcacaugaugcccag

SEQ ID NO: 2420024 - RNA, 20 nt, Bordetella pertussis
cgcacaugaugcccagcgcc

SEQ ID NO: 2420025 - RNA, 21 nt, Bordetella pertussis
cgcacaugaugcccagcgcca

SEQ ID NO: 2420026 - RNA, 13 nt, Bordetella pertussis
cgcaccaccagca

SEQ ID NO: 2420027 - RNA, 14 nt, Bordetella pertussis
cgcaccaccgccga

SEQ ID NO: 2420028 - RNA, 16 nt, Bordetella pertussis
cgcaccaccuggcuga

SEQ ID NO: 2420029 - RNA, 14 nt, Bordetella pertussis
cgcaccagcccgcc

SEQ ID NO: 2420030 - RNA, 17 nt, Bordetella pertussis
cgcaccagcccgcccgc

SEQ ID NO: 2420031 - RNA, 23 nt, Bordetella pertussis
cgcaccagcccgcccgcgcccag

SEQ ID NO: 2420032 - RNA, 20 nt, Bordetella pertussis
cgcaccagcgaguuguccug

SEQ ID NO: 2420033 - RNA, 19 nt, Bordetella pertussis
cgcaccagcgccgacggca

SEQ ID NO: 2420034 - RNA, 12 nt, Bordetella pertussis
cgcaccagcgcg

SEQ ID NO: 2420035 - RNA, 16 nt, Bordetella pertussis
cgcacgccggccugcg

SEQ ID NO: 2420036 - RNA, 14 nt, Bordetella pertussis
cgcacgccgggcgc

SEQ ID NO: 2420037 - RNA, 15 nt, Bordetella pertussis
cgcacgccgggcgcg

SEQ ID NO: 2420038 - RNA, 16 nt, Bordetella pertussis
cgcacgccgggcgcgg

SEQ ID NO: 2420039 - RNA, 18 nt, Bordetella pertussis
cgcacgccgggcgcggcc

SEQ ID NO: 2420040 - RNA, 16 nt, Bordetella pertussis
cgcacgcgcagcacgc

SEQ ID NO: 2420041 - RNA, 13 nt, Bordetella pertussis
cgcacgcgcggca

SEQ ID NO: 2420042 - RNA, 14 nt, Bordetella pertussis
cgcacgcgcggcag

SEQ ID NO: 2420043 - RNA, 21 nt, Bordetella pertussis
cgcacgcggccgcgggccgcu

SEQ ID NO: 2420044 - RNA, 18 nt, Bordetella pertussis
cgcacgcucuacacggcc

SEQ ID NO: 2420045 - RNA, 19 nt, Bordetella pertussis
cgcacgcucuacacggccg

SEQ ID NO: 2420046 - RNA, 19 nt, Bordetella pertussis
cgcacgcucugcaccuugg

SEQ ID NO: 2420047 - RNA, 13 nt, Bordetella pertussis
cgcacgcuggcau

SEQ ID NO: 2420048 - RNA, 15 nt, Bordetella pertussis
cgcacgcuggcgccc

SEQ ID NO: 2420049 - RNA, 17 nt, Bordetella pertussis
cgcacgcuggcgcccgc

SEQ ID NO: 2420050 - RNA, 23 nt, Bordetella pertussis
cgcacgcugggcuacgacccgcu

SEQ ID NO: 2420051 - RNA, 14 nt, Bordetella pertussis
cgcacggacagccc

SEQ ID NO: 2420052 - RNA, 13 nt, Bordetella pertussis
cgcacggccagca

SEQ ID NO: 2420053 - RNA, 22 nt, Bordetella pertussis
cgcacggccgucaacagcaugg

SEQ ID NO: 2420054 - RNA, 13 nt, Bordetella pertussis
cgcacggcgcccu

SEQ ID NO: 2420055 - RNA, 15 nt, Bordetella pertussis
cgcacggcgcccugc

SEQ ID NO: 2420056 - RNA, 21 nt, Bordetella pertussis
cgcacggcggcgaucacgccg

SEQ ID NO: 2420057 - RNA, 18 nt, Bordetella pertussis
cgcacgggccgacggccu

SEQ ID NO: 2420058 - RNA, 17 nt, Bordetella pertussis
cgcacgggcgaggcggg

SEQ ID NO: 2420059 - RNA, 16 nt, Bordetella pertussis
cgcacggggacuggca

SEQ ID NO: 2420060 - RNA, 22 nt, Bordetella pertussis
cgcacggggacuggcaccggcc

SEQ ID NO: 2420061 - RNA, 23 nt, Bordetella pertussis
cgcacggggacuggcaccggccg

SEQ ID NO: 2420062 - RNA, 19 nt, Bordetella pertussis
cgcacggggacuggcacgc

SEQ ID NO: 2420063 - RNA, 22 nt, Bordetella pertussis
cgcacggggacuggcacgcgcu

SEQ ID NO: 2420064 - RNA, 14 nt, Bordetella pertussis
cgcacgguccaggc

SEQ ID NO: 2420065 - RNA, 15 nt, Bordetella pertussis
cgcacgguccaggcg

SEQ ID NO: 2420066 - RNA, 16 nt, Bordetella pertussis
cgcacgguccaggcgg

SEQ ID NO: 2420067 - RNA, 18 nt, Bordetella pertussis
cgcacgguccaggcggcc

SEQ ID NO: 2420068 - RNA, 19 nt, Bordetella pertussis
cgcacgguccaggcggccg

SEQ ID NO: 2420069 - RNA, 21 nt, Bordetella pertussis
cgcacgguccaggcggccgcg

SEQ ID NO: 2420070 - RNA, 18 nt, Bordetella pertussis
cgcacggucgaagaucuu

SEQ ID NO: 2420071 - RNA, 16 nt, Bordetella pertussis
cgcacggugcgcacga

SEQ ID NO: 2420072 - RNA, 15 nt, Bordetella pertussis
cgcacgguggcgccg

SEQ ID NO: 2420073 - RNA, 16 nt, Bordetella pertussis
cgcacgguggcgccgu

SEQ ID NO: 2420074 - RNA, 19 nt, Bordetella pertussis
cgcacgguggcgccgucgc

SEQ ID NO: 2420075 - RNA, 16 nt, Bordetella pertussis
cgcacguccagagucu

SEQ ID NO: 2420076 - RNA, 20 nt, Bordetella pertussis
cgcacgugacgccggcgaau

SEQ ID NO: 2420077 - RNA, 19 nt, Bordetella pertussis
cgcacguggaccagggacg

SEQ ID NO: 2420078 - RNA, 23 nt, Bordetella pertussis
cgcacucgaccgccgggacaggc

SEQ ID NO: 2420079 - RNA, 20 nt, Bordetella pertussis
cgcacugagaaaggccgcca

SEQ ID NO: 2420080 - RNA, 16 nt, Bordetella pertussis
cgcacugauagaccga

SEQ ID NO: 2420081 - RNA, 16 nt, Bordetella pertussis
cgcacugaucgccgcc

SEQ ID NO: 2420082 - RNA, 18 nt, Bordetella pertussis
cgcacugggugacgcugg

SEQ ID NO: 2420083 - RNA, 21 nt, Bordetella pertussis
cgcacugggugacgcuggagc

SEQ ID NO: 2420084 - RNA, 17 nt, Bordetella pertussis
cgcacuggguggccagc

SEQ ID NO: 2420085 - RNA, 20 nt, Bordetella pertussis
cgcacuggguggccagcgcc

SEQ ID NO: 2420086 - RNA, 24 nt, Bordetella pertussis
cgcacuggguggccagcgccgcca

SEQ ID NO: 2420087 - RNA, 14 nt, Bordetella pertussis
cgcacuggguuuuu

SEQ ID NO: 2420088 - RNA, 18 nt, Bordetella pertussis
cgcacuucgggccacccg

SEQ ID NO: 2420089 - RNA, 16 nt, Bordetella pertussis
cgcagaaaccgccaca

SEQ ID NO: 2420090 - RNA, 23 nt, Bordetella pertussis
cgcagaaaccgccacagcgccgc

SEQ ID NO: 2420091 - RNA, 21 nt, Bordetella pertussis
cgcagaaauggaugcgcgccc

SEQ ID NO: 2420092 - RNA, 14 nt, Bordetella pertussis
cgcagaacagcagc

SEQ ID NO: 2420093 - RNA, 15 nt, Bordetella pertussis
cgcagaacagcagcg

SEQ ID NO: 2420094 - RNA, 16 nt, Bordetella pertussis
cgcagaacagcagcgu

SEQ ID NO: 2420095 - RNA, 18 nt, Bordetella pertussis
cgcagaagcagccgcgcg

SEQ ID NO: 2420096 - RNA, 21 nt, Bordetella pertussis
cgcagaagcagccgcgcggcc

SEQ ID NO: 2420097 - RNA, 17 nt, Bordetella pertussis
cgcagaaggcgaacugg

SEQ ID NO: 2420098 - RNA, 16 nt, Bordetella pertussis
cgcagacgacgcagcg

SEQ ID NO: 2420099 - RNA, 22 nt, Bordetella pertussis
cgcagacgacgcagcgugcgac

SEQ ID NO: 2420100 - RNA, 17 nt, Bordetella pertussis
cgcagacgaugaagacg

SEQ ID NO: 2420101 - RNA, 23 nt, Bordetella pertussis
cgcagacgaugaagacgauggug

SEQ ID NO: 2420102 - RNA, 20 nt, Bordetella pertussis
cgcagacgcgcucaggcggu

SEQ ID NO: 2420103 - RNA, 17 nt, Bordetella pertussis
cgcagacggucgacacc

SEQ ID NO: 2420104 - RNA, 22 nt, Bordetella pertussis
cgcagagggagcgacacccgcg

SEQ ID NO: 2420105 - RNA, 14 nt, Bordetella pertussis
cgcagaucccaggc

SEQ ID NO: 2420106 - RNA, 16 nt, Bordetella pertussis
cgcagauccucgaaca

SEQ ID NO: 2420107 - RNA, 15 nt, Bordetella pertussis
cgcagauggccagca

SEQ ID NO: 2420108 - RNA, 16 nt, Bordetella pertussis
cgcagauggccagcag

SEQ ID NO: 2420109 - RNA, 17 nt, Bordetella pertussis
cgcagauggccagcagc

SEQ ID NO: 2420110 - RNA, 21 nt, Bordetella pertussis
cgcagauggcggcgaugccgc

SEQ ID NO: 2420111 - RNA, 19 nt, Bordetella pertussis
cgcagauggcguaggcggc

SEQ ID NO: 2420112 - RNA, 17 nt, Bordetella pertussis
cgcagauuuccagcgcg

SEQ ID NO: 2420113 - RNA, 20 nt, Bordetella pertussis
cgcagauuuccagcgcgucc

SEQ ID NO: 2420114 - RNA, 17 nt, Bordetella pertussis
cgcagcaacccgcccgg

SEQ ID NO: 2420115 - RNA, 18 nt, Bordetella pertussis
cgcagcaacccgcccggg

SEQ ID NO: 2420116 - RNA, 13 nt, Bordetella pertussis
cgcagcaacggug

SEQ ID NO: 2420117 - RNA, 20 nt, Bordetella pertussis
cgcagcaacggugagccggc

SEQ ID NO: 2420118 - RNA, 21 nt, Bordetella pertussis
cgcagcaacggugagccggcc

SEQ ID NO: 2420119 - RNA, 14 nt, Bordetella pertussis
cgcagcaaggcgcg

SEQ ID NO: 2420120 - RNA, 16 nt, Bordetella pertussis
cgcagcaaggcgcgcc

SEQ ID NO: 2420121 - RNA, 20 nt, Bordetella pertussis
cgcagcaagucagcccgcgu

SEQ ID NO: 2420122 - RNA, 21 nt, Bordetella pertussis
cgcagcaagucagcccgcguc

SEQ ID NO: 2420123 - RNA, 23 nt, Bordetella pertussis
cgcagcaauucaagccgcaccau

SEQ ID NO: 2420124 - RNA, 20 nt, Bordetella pertussis
cgcagcaauugccccagcac

SEQ ID NO: 2420125 - RNA, 21 nt, Bordetella pertussis
cgcagcaauugccccagcacg

SEQ ID NO: 2420126 - RNA, 16 nt, Bordetella pertussis
cgcagcaccagcaugu

SEQ ID NO: 2420127 - RNA, 18 nt, Bordetella pertussis
cgcagcaccgccagcgcg

SEQ ID NO: 2420128 - RNA, 13 nt, Bordetella pertussis
cgcagcaccgcgc

SEQ ID NO: 2420129 - RNA, 21 nt, Bordetella pertussis
cgcagcaccgcgcgcacgacc

SEQ ID NO: 2420130 - RNA, 16 nt, Bordetella pertussis
cgcagcaccggcguga

SEQ ID NO: 2420131 - RNA, 21 nt, Bordetella pertussis
cgcagcaccggcgugagcgcc

SEQ ID NO: 2420132 - RNA, 13 nt, Bordetella pertussis
cgcagcaccucgg

SEQ ID NO: 2420133 - RNA, 14 nt, Bordetella pertussis
cgcagcaccucggc

SEQ ID NO: 2420134 - RNA, 22 nt, Bordetella pertussis
cgcagcaccucggggcgcggcc

SEQ ID NO: 2420135 - RNA, 23 nt, Bordetella pertussis
cgcagcaccucggggcgcggccg

SEQ ID NO: 2420136 - RNA, 19 nt, Bordetella pertussis
cgcagcaccuugaccuggu

SEQ ID NO: 2420137 - RNA, 18 nt, Bordetella pertussis
cgcagcacgauggggcca

SEQ ID NO: 2420138 - RNA, 13 nt, Bordetella pertussis
cgcagcacgccca

SEQ ID NO: 2420139 - RNA, 15 nt, Bordetella pertussis
cgcagcacgcccaga

SEQ ID NO: 2420140 - RNA, 20 nt, Bordetella pertussis
cgcagcacgcccagauggcc

SEQ ID NO: 2420141 - RNA, 15 nt, Bordetella pertussis
cgcagcacgccgcgc

SEQ ID NO: 2420142 - RNA, 19 nt, Bordetella pertussis
cgcagcacgccgcgccagg

SEQ ID NO: 2420143 - RNA, 21 nt, Bordetella pertussis
cgcagcacgccgcgccaggca

SEQ ID NO: 2420144 - RNA, 13 nt, Bordetella pertussis
cgcagcacgcugc

SEQ ID NO: 2420145 - RNA, 19 nt, Bordetella pertussis
cgcagcacgcugcgcggcg

SEQ ID NO: 2420146 - RNA, 20 nt, Bordetella pertussis
cgcagcacgcugcgcggcgg

SEQ ID NO: 2420147 - RNA, 15 nt, Bordetella pertussis
cgcagcgggcccguc

SEQ ID NO: 2420148 - RNA, 21 nt, Bordetella pertussis
cgcagcgggcccgucgcgcca

SEQ ID NO: 2420149 - RNA, 19 nt, Bordetella pertussis
cgcagcggggacaggcgcc

SEQ ID NO: 2420150 - RNA, 23 nt, Bordetella pertussis
cgcagcggggacaggcgcccgug

SEQ ID NO: 2420151 - RNA, 17 nt, Bordetella pertussis
cgcagcgggugaucacg

SEQ ID NO: 2420152 - RNA, 22 nt, Bordetella pertussis
cgcagcgucgcggcgucgaccg

SEQ ID NO: 2420153 - RNA, 19 nt, Bordetella pertussis
cgcagcgucugcgcaucga

SEQ ID NO: 2420154 - RNA, 15 nt, Bordetella pertussis
cgcagcgugaccgac

SEQ ID NO: 2420155 - RNA, 18 nt, Bordetella pertussis
cgcagcgugcggaccagc

SEQ ID NO: 2420156 - RNA, 17 nt, Bordetella pertussis
cgcagcguggcggcgac

SEQ ID NO: 2420157 - RNA, 21 nt, Bordetella pertussis
cgcagcguuacgcgaccagcu

SEQ ID NO: 2420158 - RNA, 21 nt, Bordetella pertussis
cgcagcucccccacgccgccg

SEQ ID NO: 2420159 - RNA, 20 nt, Bordetella pertussis
cgcagcuccgggucgagcgc

SEQ ID NO: 2420160 - RNA, 22 nt, Bordetella pertussis
cgcagcuccguauccuggucga

SEQ ID NO: 2420161 - RNA, 19 nt, Bordetella pertussis
cgcagcucgaccgucagca

SEQ ID NO: 2420162 - RNA, 15 nt, Bordetella pertussis
cgcagcucguggcgc

SEQ ID NO: 2420163 - RNA, 17 nt, Bordetella pertussis
cgcagcucguggcgcgc

SEQ ID NO: 2420164 - RNA, 18 nt, Bordetella pertussis
cgcagcucguggcgcgcc

SEQ ID NO: 2420165 - RNA, 22 nt, Bordetella pertussis
cgcagcucguggcgcgccucca

SEQ ID NO: 2420166 - RNA, 19 nt, Bordetella pertussis
cgcagcugccugagcaccg

SEQ ID NO: 2420167 - RNA, 22 nt, Bordetella pertussis
cgcagcugccugagcaccgccg

SEQ ID NO: 2420168 - RNA, 23 nt, Bordetella pertussis
cgcagcugccugagcaccgccgc

SEQ ID NO: 2420169 - RNA, 21 nt, Bordetella pertussis
cgcagcuggacuauggccugg

SEQ ID NO: 2420170 - RNA, 13 nt, Bordetella pertussis
cgcagcuugcccg

SEQ ID NO: 2420171 - RNA, 14 nt, Bordetella pertussis
cgcagcuugcccgc

SEQ ID NO: 2420172 - RNA, 16 nt, Bordetella pertussis
cgcagcuugcccgcgc

SEQ ID NO: 2420173 - RNA, 19 nt, Bordetella pertussis
cgcagcuugcccgcgcgca

SEQ ID NO: 2420174 - RNA, 22 nt, Bordetella pertussis
cgcagcuugcccgcgcgcacgu

SEQ ID NO: 2420175 - RNA, 20 nt, Bordetella pertussis
cgcaggaauccuggugccag

SEQ ID NO: 2420176 - RNA, 21 nt, Bordetella pertussis
cgcaggaauuccucgcggcug

SEQ ID NO: 2420177 - RNA, 19 nt, Bordetella pertussis
cgcaggacaaggcgcgcgc

SEQ ID NO: 2420178 - RNA, 15 nt, Bordetella pertussis
cgcaggacggcgccg

SEQ ID NO: 2420179 - RNA, 14 nt, Bordetella pertussis
cgcaggagcaugcc

SEQ ID NO: 2420180 - RNA, 12 nt, Bordetella pertussis
cgcaggagucgc

SEQ ID NO: 2420181 - RNA, 22 nt, Bordetella pertussis
cgcaggagucgcuccccgugcg

SEQ ID NO: 2420182 - RNA, 13 nt, Bordetella pertussis
cgcaggagucgga

SEQ ID NO: 2420183 - RNA, 19 nt, Bordetella pertussis
cgcaggauaccggagcggc

SEQ ID NO: 2420184 - RNA, 16 nt, Bordetella pertussis
cgcaggaugacguggc

SEQ ID NO: 2420185 - RNA, 18 nt, Bordetella pertussis
cgcaggaugcgcuggccg

SEQ ID NO: 2420186 - RNA, 22 nt, Bordetella pertussis
cgcaggaugcgcuggccggccg

SEQ ID NO: 2420187 - RNA, 22 nt, Bordetella pertussis
cgcaggauuuccucgccguagg

SEQ ID NO: 2420188 - RNA, 17 nt, Bordetella pertussis
cgcaggcaaagccugac

SEQ ID NO: 2420189 - RNA, 18 nt, Bordetella pertussis
cgcaggcaaagccugacg

SEQ ID NO: 2420190 - RNA, 19 nt, Bordetella pertussis
cgcaggcaagcugcuggcg

SEQ ID NO: 2420191 - RNA, 22 nt, Bordetella pertussis
cgcaggcaagcugcuggcgcgc

SEQ ID NO: 2420192 - RNA, 20 nt, Bordetella pertussis
cgcaggcauucgugaugccc

SEQ ID NO: 2420193 - RNA, 16 nt, Bordetella pertussis
cgcaggccagcccgcg

SEQ ID NO: 2420194 - RNA, 22 nt, Bordetella pertussis
cgcaggccagcccgcgcgcguu

SEQ ID NO: 2420195 - RNA, 12 nt, Bordetella pertussis
cgcaggccagcg

SEQ ID NO: 2420196 - RNA, 13 nt, Bordetella pertussis
cgcaggccagcgc

SEQ ID NO: 2420197 - RNA, 14 nt, Bordetella pertussis
cgcaggcccacaau

SEQ ID NO: 2420198 - RNA, 13 nt, Bordetella pertussis
cgcaggcccagcc

SEQ ID NO: 2420199 - RNA, 15 nt, Bordetella pertussis
cgcaggcccagccag

SEQ ID NO: 2420200 - RNA, 16 nt, Bordetella pertussis
cgcaggcccaugacga

SEQ ID NO: 2420201 - RNA, 21 nt, Bordetella pertussis
cgcaggcccaugacgaccuug

SEQ ID NO: 2420202 - RNA, 16 nt, Bordetella pertussis
cgcaggcccgacagga

SEQ ID NO: 2420203 - RNA, 16 nt, Bordetella pertussis
cgcaggccgccacuug

SEQ ID NO: 2420204 - RNA, 13 nt, Bordetella pertussis
cgcaggccgcggc

SEQ ID NO: 2420205 - RNA, 15 nt, Bordetella pertussis
cgcaggccgcggcca

SEQ ID NO: 2420206 - RNA, 18 nt, Bordetella pertussis
cgcaggccgcggccaggc

SEQ ID NO: 2420207 - RNA, 16 nt, Bordetella pertussis
cgcaggccggcggcca

SEQ ID NO: 2420208 - RNA, 18 nt, Bordetella pertussis
cgcaggccggcggccagc

SEQ ID NO: 2420209 - RNA, 19 nt, Bordetella pertussis
cgcaggccguuggccgcgc

SEQ ID NO: 2420210 - RNA, 15 nt, Bordetella pertussis
cgcaggccugcugca

SEQ ID NO: 2420211 - RNA, 18 nt, Bordetella pertussis
cgcaggcgauuccggggu

SEQ ID NO: 2420212 - RNA, 15 nt, Bordetella pertussis
cgcaggcgccgcacc

SEQ ID NO: 2420213 - RNA, 16 nt, Bordetella pertussis
cgcaggcgccgcaccc

SEQ ID NO: 2420214 - RNA, 16 nt, Bordetella pertussis
cgcaggcgccgccccg

SEQ ID NO: 2420215 - RNA, 13 nt, Bordetella pertussis
cgcaggcgcgcca

SEQ ID NO: 2420216 - RNA, 15 nt, Bordetella pertussis
cgcaggcgcgcgccu

SEQ ID NO: 2420217 - RNA, 20 nt, Bordetella pertussis
cgcaggcgcguggccacggc

SEQ ID NO: 2420218 - RNA, 15 nt, Bordetella pertussis
cgcaggcgcugcagc

SEQ ID NO: 2420219 - RNA, 14 nt, Bordetella pertussis
cgcaggcggcggcc

SEQ ID NO: 2420220 - RNA, 21 nt, Bordetella pertussis
cgcaggcggcggccuccagca

SEQ ID NO: 2420221 - RNA, 22 nt, Bordetella pertussis
cgcaggcggcggccuccagcag

SEQ ID NO: 2420222 - RNA, 23 nt, Bordetella pertussis
cgcaggcggcggccuccagcagg

SEQ ID NO: 2420223 - RNA, 23 nt, Bordetella pertussis
cgcaggcgggcgccgcgcccggc

SEQ ID NO: 2420224 - RNA, 12 nt, Bordetella pertussis
cgcaggcgugcg

SEQ ID NO: 2420225 - RNA, 17 nt, Bordetella pertussis
cgcaggcgugcgcgggc

SEQ ID NO: 2420226 - RNA, 20 nt, Bordetella pertussis
cgcaggcgugcgcgggcgcc

SEQ ID NO: 2420227 - RNA, 20 nt, Bordetella pertussis
cgcaggcguucgcaccaguc

SEQ ID NO: 2420228 - RNA, 17 nt, Bordetella pertussis
cgcaggcugucgaugcg

SEQ ID NO: 2420229 - RNA, 21 nt, Bordetella pertussis
cgcagggacaggcaccccggc

SEQ ID NO: 2420230 - RNA, 15 nt, Bordetella pertussis
cgcagggacaggcuc

SEQ ID NO: 2420231 - RNA, 17 nt, Bordetella pertussis
cgcagggcauacaugag

SEQ ID NO: 2420232 - RNA, 18 nt, Bordetella pertussis
cgcagggcccgcaucggc

SEQ ID NO: 2420233 - RNA, 17 nt, Bordetella pertussis
cgcagggcgaacguggc

SEQ ID NO: 2420234 - RNA, 22 nt, Bordetella pertussis
cgcagggcgaacguggccugcu

SEQ ID NO: 2420235 - RNA, 21 nt, Bordetella pertussis
cgcagggcgcaacgccggccg

SEQ ID NO: 2420236 - RNA, 13 nt, Bordetella pertussis
cgcagggcggccg

SEQ ID NO: 2420237 - RNA, 14 nt, Bordetella pertussis
cgcagggcggccgg

SEQ ID NO: 2420238 - RNA, 16 nt, Bordetella pertussis
cgcagggcggccggca

SEQ ID NO: 2420239 - RNA, 19 nt, Bordetella pertussis
cgcagggcggccucgacgg

SEQ ID NO: 2420240 - RNA, 22 nt, Bordetella pertussis
cgcagggcggccucgacggccg

SEQ ID NO: 2420241 - RNA, 15 nt, Bordetella pertussis
cgcagggcgggcggu

SEQ ID NO: 2420242 - RNA, 19 nt, Bordetella pertussis
cgcaggggauugccgcgcg

SEQ ID NO: 2420243 - RNA, 24 nt, Bordetella pertussis
cgcaggguggcaucguggaagauc

SEQ ID NO: 2420244 - RNA, 16 nt, Bordetella pertussis
cgcagguagucgguca

SEQ ID NO: 2420245 - RNA, 18 nt, Bordetella pertussis
cgcagguauuccgccguc

SEQ ID NO: 2420246 - RNA, 17 nt, Bordetella pertussis
cgcagguccaggccugg

SEQ ID NO: 2420247 - RNA, 15 nt, Bordetella pertussis
cgcaggucggccagg

SEQ ID NO: 2420248 - RNA, 16 nt, Bordetella pertussis
cgcaggucggccagga

SEQ ID NO: 2420249 - RNA, 13 nt, Bordetella pertussis
cgcaggucggcga

SEQ ID NO: 2420250 - RNA, 18 nt, Bordetella pertussis
cgcaggucggcgaugcgc

SEQ ID NO: 2420251 - RNA, 19 nt, Bordetella pertussis
cgcaggugccuguccccac

SEQ ID NO: 2420252 - RNA, 22 nt, Bordetella pertussis
cgcagguggggcagcaggccgg

SEQ ID NO: 2420253 - RNA, 17 nt, Bordetella pertussis
cgcaggugugccagccg

SEQ ID NO: 2420254 - RNA, 17 nt, Bordetella pertussis
cgcaguacccggugcag

SEQ ID NO: 2420255 - RNA, 19 nt, Bordetella pertussis
cgcaguacccggugcagcg

SEQ ID NO: 2420256 - RNA, 16 nt, Bordetella pertussis
cgcaguagcguugcag

SEQ ID NO: 2420257 - RNA, 21 nt, Bordetella pertussis
cgcaguagcguugcaguucgg

SEQ ID NO: 2420258 - RNA, 15 nt, Bordetella pertussis
cgcaguaucccggcc

SEQ ID NO: 2420259 - RNA, 17 nt, Bordetella pertussis
cgcauggcuggucccug

SEQ ID NO: 2420260 - RNA, 20 nt, Bordetella pertussis
cgcaugggaaauccgccggg

SEQ ID NO: 2420261 - RNA, 13 nt, Bordetella pertussis
cgcaugggccagg

SEQ ID NO: 2420262 - RNA, 17 nt, Bordetella pertussis
cgcaugggcgcaggccg

SEQ ID NO: 2420263 - RNA, 18 nt, Bordetella pertussis
cgcaugggcgcaggccgc

SEQ ID NO: 2420264 - RNA, 15 nt, Bordetella pertussis
cgcaugggcgcgccc

SEQ ID NO: 2420265 - RNA, 19 nt, Bordetella pertussis
cgcaugggcgcgcccggcg

SEQ ID NO: 2420266 - RNA, 19 nt, Bordetella pertussis
cgcauggggacuggcgccu

SEQ ID NO: 2420267 - RNA, 22 nt, Bordetella pertussis
cgcauggggacuggcgccugca

SEQ ID NO: 2420268 - RNA, 23 nt, Bordetella pertussis
cgcauggggacuggcgccugcaa

SEQ ID NO: 2420269 - RNA, 13 nt, Bordetella pertussis
cgcauggucgcga

SEQ ID NO: 2420270 - RNA, 15 nt, Bordetella pertussis
cgcaugguggcgcag

SEQ ID NO: 2420271 - RNA, 20 nt, Bordetella pertussis
cgcauguagucgucgcuggc

SEQ ID NO: 2420272 - RNA, 14 nt, Bordetella pertussis
cgcaugucagcgcc

SEQ ID NO: 2420273 - RNA, 14 nt, Bordetella pertussis
cgcaugucccagcg

SEQ ID NO: 2420274 - RNA, 15 nt, Bordetella pertussis
cgcaugucccgcaug

SEQ ID NO: 2420275 - RNA, 16 nt, Bordetella pertussis
cgcaugucgaagcagg

SEQ ID NO: 2420276 - RNA, 20 nt, Bordetella pertussis
cgcaugucgaagcaggcggu

SEQ ID NO: 2420277 - RNA, 22 nt, Bordetella pertussis
cgcauuaucgcuaggaucgcga

SEQ ID NO: 2420278 - RNA, 13 nt, Bordetella pertussis
cgcauucgcgccu

SEQ ID NO: 2420279 - RNA, 15 nt, Bordetella pertussis
cgcauucgcgccuga

SEQ ID NO: 2420280 - RNA, 17 nt, Bordetella pertussis
cgcauucgucgcugccg

SEQ ID NO: 2420281 - RNA, 13 nt, Bordetella pertussis
cgcauugccgccg

SEQ ID NO: 2420282 - RNA, 19 nt, Bordetella pertussis
cgcauugccgccgcccugc

SEQ ID NO: 2420283 - RNA, 19 nt, Bordetella pertussis
cgcauugccgucggccgcg

SEQ ID NO: 2420284 - RNA, 19 nt, Bordetella pertussis
cgcauugcgguccaggaag

SEQ ID NO: 2420285 - RNA, 18 nt, Bordetella pertussis
cgcauuggcccugcuggg

SEQ ID NO: 2420286 - RNA, 16 nt, Bordetella pertussis
cgcauuggccgccgcc

SEQ ID NO: 2420287 - RNA, 18 nt, Bordetella pertussis
cgcauuggugagcacgcg

SEQ ID NO: 2420288 - RNA, 15 nt, Bordetella pertussis
cgcauuucgaccugc

SEQ ID NO: 2420289 - RNA, 15 nt, Bordetella pertussis
cgcauuucucggccu

SEQ ID NO: 2420290 - RNA, 21 nt, Bordetella pertussis
cgcauuucucggccugggcgc

SEQ ID NO: 2420291 - RNA, 18 nt, Bordetella pertussis
cgccaaaaggcagcaggc

SEQ ID NO: 2420292 - RNA, 20 nt, Bordetella pertussis
cgccaaagcgcagcgugacc

SEQ ID NO: 2420293 - RNA, 22 nt, Bordetella pertussis
cgccaacgcacaagggccccgc

SEQ ID NO: 2420294 - RNA, 18 nt, Bordetella pertussis
cgccaacggugccagucc

SEQ ID NO: 2420295 - RNA, 15 nt, Bordetella pertussis
cgccaacgucggcag

SEQ ID NO: 2420296 - RNA, 20 nt, Bordetella pertussis
cgccaacgucggcagccaga

SEQ ID NO: 2420297 - RNA, 18 nt, Bordetella pertussis
cgccaagaccgcggccgc

SEQ ID NO: 2420298 - RNA, 19 nt, Bordetella pertussis
cgccaagaccgcggccgcg

SEQ ID NO: 2420299 - RNA, 21 nt, Bordetella pertussis
cgccaagaccgcggccgcgcu

SEQ ID NO: 2420300 - RNA, 15 nt, Bordetella pertussis
cgccaagcggcaggc

SEQ ID NO: 2420301 - RNA, 16 nt, Bordetella pertussis
cgccaagcggcaggcg

SEQ ID NO: 2420302 - RNA, 18 nt, Bordetella pertussis
cgccaagcggcaggcggc

SEQ ID NO: 2420303 - RNA, 13 nt, Bordetella pertussis
cgccaagcugcug

SEQ ID NO: 2420304 - RNA, 17 nt, Bordetella pertussis
cgccaagcugcuggccg

SEQ ID NO: 2420305 - RNA, 19 nt, Bordetella pertussis
cgccaagcugcuggccggc

SEQ ID NO: 2420306 - RNA, 20 nt, Bordetella pertussis
cgccaagcugcuggccggcc

SEQ ID NO: 2420307 - RNA, 15 nt, Bordetella pertussis
cgccaagggcgcgcc

SEQ ID NO: 2420308 - RNA, 16 nt, Bordetella pertussis
cgccaagggcgcgcca

SEQ ID NO: 2420309 - RNA, 16 nt, Bordetella pertussis
cgccaaucugccgcug

SEQ ID NO: 2420310 - RNA, 19 nt, Bordetella pertussis
cgccaaucugccgcugacc

SEQ ID NO: 2420311 - RNA, 21 nt, Bordetella pertussis
cgccaaucugccgcugaccgg

SEQ ID NO: 2420312 - RNA, 22 nt, Bordetella pertussis
cgccaaucugccgcugaccggc

SEQ ID NO: 2420313 - RNA, 18 nt, Bordetella pertussis
cgccaauugcuugccugu

SEQ ID NO: 2420314 - RNA, 23 nt, Bordetella pertussis
cgccaauugcuugccugucccca

SEQ ID NO: 2420315 - RNA, 18 nt, Bordetella pertussis
cgccacaccgcugcggga

SEQ ID NO: 2420316 - RNA, 15 nt, Bordetella pertussis
cgccacacgggcgcc

SEQ ID NO: 2420317 - RNA, 17 nt, Bordetella pertussis
cgccacacgggcgccug

SEQ ID NO: 2420318 - RNA, 18 nt, Bordetella pertussis
cgccacacgggcgccugc

SEQ ID NO: 2420319 - RNA, 19 nt, Bordetella pertussis
cgccacagauuggccacca

SEQ ID NO: 2420320 - RNA, 22 nt, Bordetella pertussis
cgccacagauuggccaccaggg

SEQ ID NO: 2420321 - RNA, 18 nt, Bordetella pertussis
cgccacagcgccaucgcg

SEQ ID NO: 2420322 - RNA, 20 nt, Bordetella pertussis
cgccacagcgccaucgcgcg

SEQ ID NO: 2420323 - RNA, 13 nt, Bordetella pertussis
cgccacagcgccg

SEQ ID NO: 2420324 - RNA, 17 nt, Bordetella pertussis
cgccacagcgccgcggc

SEQ ID NO: 2420325 - RNA, 21 nt, Bordetella pertussis
cgccacaggcugacgcccggc

SEQ ID NO: 2420326 - RNA, 15 nt, Bordetella pertussis
cgccacagggccuga

SEQ ID NO: 2420327 - RNA, 17 nt, Bordetella pertussis
cgccacaggugcgcggc

SEQ ID NO: 2420328 - RNA, 19 nt, Bordetella pertussis
cgccacaggugcgcggcgc

SEQ ID NO: 2420329 - RNA, 15 nt, Bordetella pertussis
cgccaccacgcgcac

SEQ ID NO: 2420330 - RNA, 17 nt, Bordetella pertussis
cgccaccacgcgcacca

SEQ ID NO: 2420331 - RNA, 16 nt, Bordetella pertussis
cgccaccagaucgaua

SEQ ID NO: 2420332 - RNA, 19 nt, Bordetella pertussis
cgccaccagcagcgccagg

SEQ ID NO: 2420333 - RNA, 12 nt, Bordetella pertussis
cgccaccagcgc

SEQ ID NO: 2420334 - RNA, 13 nt, Bordetella pertussis
cgccaccagcgcg

SEQ ID NO: 2420335 - RNA, 13 nt, Bordetella pertussis
cgccaccagcggc

SEQ ID NO: 2420336 - RNA, 15 nt, Bordetella pertussis
cgccaccagcggcgu

SEQ ID NO: 2420337 - RNA, 23 nt, Bordetella pertussis
cgccaccagcggcguggcggcca

SEQ ID NO: 2420338 - RNA, 17 nt, Bordetella pertussis
cgccaccagcgucagca

SEQ ID NO: 2420339 - RNA, 13 nt, Bordetella pertussis
cgccaccagcuug

SEQ ID NO: 2420340 - RNA, 18 nt, Bordetella pertussis
cgccaccagcuugcgcgc

SEQ ID NO: 2420341 - RNA, 20 nt, Bordetella pertussis
cgccaccagcuugcgcgccg

SEQ ID NO: 2420342 - RNA, 21 nt, Bordetella pertussis
cgccaccagcuugcgcgccgc

SEQ ID NO: 2420343 - RNA, 19 nt, Bordetella pertussis
cgccaccaggaacgccagc

SEQ ID NO: 2420344 - RNA, 13 nt, Bordetella pertussis
cgccaccaggccg

SEQ ID NO: 2420345 - RNA, 14 nt, Bordetella pertussis
cgccaccaggccga

SEQ ID NO: 2420346 - RNA, 18 nt, Bordetella pertussis
cgccaccaggccgauggc

SEQ ID NO: 2420347 - RNA, 21 nt, Bordetella pertussis
cgccaccagggcgcccgccga

SEQ ID NO: 2420348 - RNA, 13 nt, Bordetella pertussis
cgccaccagugcg

SEQ ID NO: 2420349 - RNA, 16 nt, Bordetella pertussis
cgccaccagugcgccg

SEQ ID NO: 2420350 - RNA, 18 nt, Bordetella pertussis
cgccaccagugcgccggc

SEQ ID NO: 2420351 - RNA, 20 nt, Bordetella pertussis
cgccaccagugcgccggcgg

SEQ ID NO: 2420352 - RNA, 21 nt, Bordetella pertussis
cgccaccagugcgccggcggc

SEQ ID NO: 2420353 - RNA, 22 nt, Bordetella pertussis
cgccaccagugcgccggcggcg

SEQ ID NO: 2420354 - RNA, 16 nt, Bordetella pertussis
cgccaccaugccuugc

SEQ ID NO: 2420355 - RNA, 23 nt, Bordetella pertussis
cgccaccaugccuugcgcgacag

SEQ ID NO: 2420356 - RNA, 24 nt, Bordetella pertussis
cgccaccaugccuugcgcgacagc

SEQ ID NO: 2420357 - RNA, 14 nt, Bordetella pertussis
cgccacccaggcgg

SEQ ID NO: 2420358 - RNA, 17 nt, Bordetella pertussis
cgccaccccgccgcuga

SEQ ID NO: 2420359 - RNA, 18 nt, Bordetella pertussis
cgccaccccgccgcugaa

SEQ ID NO: 2420360 - RNA, 16 nt, Bordetella pertussis
cgccacccguaccgcc

SEQ ID NO: 2420361 - RNA, 16 nt, Bordetella pertussis
cgccacccuggcacgc

SEQ ID NO: 2420362 - RNA, 20 nt, Bordetella pertussis
cgccacccuggcacgcugga

SEQ ID NO: 2420363 - RNA, 21 nt, Bordetella pertussis
cgccaccgcauggggcgaggu

SEQ ID NO: 2420364 - RNA, 13 nt, Bordetella pertussis
cgccaccgccaga

SEQ ID NO: 2420365 - RNA, 14 nt, Bordetella pertussis
cgccaccgcccaga

SEQ ID NO: 2420366 - RNA, 17 nt, Bordetella pertussis
cgccaccgcgccgccca

SEQ ID NO: 2420367 - RNA, 20 nt, Bordetella pertussis
cgccaccggucgccguccag

SEQ ID NO: 2420368 - RNA, 18 nt, Bordetella pertussis
cgccaccgugauggcgcg

SEQ ID NO: 2420369 - RNA, 19 nt, Bordetella pertussis
cgccaccgugauggcgcgg

SEQ ID NO: 2420370 - RNA, 16 nt, Bordetella pertussis
cgccaccguggccacg

SEQ ID NO: 2420371 - RNA, 13 nt, Bordetella pertussis
cgccaccguggcg

SEQ ID NO: 2420372 - RNA, 17 nt, Bordetella pertussis
cgccagccagcgcaugc

SEQ ID NO: 2420373 - RNA, 18 nt, Bordetella pertussis
cgccagccagcgcaugcc

SEQ ID NO: 2420374 - RNA, 17 nt, Bordetella pertussis
cgccagcccgacggcca

SEQ ID NO: 2420375 - RNA, 18 nt, Bordetella pertussis
cgccagcccgacggccag

SEQ ID NO: 2420376 - RNA, 19 nt, Bordetella pertussis
cgccagcccgacggccagc

SEQ ID NO: 2420377 - RNA, 15 nt, Bordetella pertussis
cgccagcccgcccgc

SEQ ID NO: 2420378 - RNA, 13 nt, Bordetella pertussis
cgccagcccgccg

SEQ ID NO: 2420379 - RNA, 14 nt, Bordetella pertussis
cgccagcccgccgc

SEQ ID NO: 2420380 - RNA, 16 nt, Bordetella pertussis
cgccagcccgcugccg

SEQ ID NO: 2420381 - RNA, 20 nt, Bordetella pertussis
cgccagccgcgccugcagca

SEQ ID NO: 2420382 - RNA, 22 nt, Bordetella pertussis
cgccagccgcgccugcagcagc

SEQ ID NO: 2420383 - RNA, 23 nt, Bordetella pertussis
cgccagccgcgccugcagcagcg

SEQ ID NO: 2420384 - RNA, 13 nt, Bordetella pertussis
cgccagccgcgcg

SEQ ID NO: 2420385 - RNA, 17 nt, Bordetella pertussis
cgccagccgcgcgaccu

SEQ ID NO: 2420386 - RNA, 19 nt, Bordetella pertussis
cgccagccgcgcgaccuug

SEQ ID NO: 2420387 - RNA, 14 nt, Bordetella pertussis
cgccagccgcucca

SEQ ID NO: 2420388 - RNA, 17 nt, Bordetella pertussis
cgccagccgcuccagga

SEQ ID NO: 2420389 - RNA, 13 nt, Bordetella pertussis
cgccagccgcugc

SEQ ID NO: 2420390 - RNA, 17 nt, Bordetella pertussis
cgccagccgcugcagcg

SEQ ID NO: 2420391 - RNA, 16 nt, Bordetella pertussis
cgccagccgcuggcgc

SEQ ID NO: 2420392 - RNA, 18 nt, Bordetella pertussis
cgccagccgcuggcgcgc

SEQ ID NO: 2420393 - RNA, 16 nt, Bordetella pertussis
cgccagccgcuugccc

SEQ ID NO: 2420394 - RNA, 19 nt, Bordetella pertussis
cgccagccgcuugcccguc

SEQ ID NO: 2420395 - RNA, 12 nt, Bordetella pertussis
cgccagccggcc

SEQ ID NO: 2420396 - RNA, 17 nt, Bordetella pertussis
cgccagccggcccagca

SEQ ID NO: 2420397 - RNA, 22 nt, Bordetella pertussis
cgccagccggcccagcacgccg

SEQ ID NO: 2420398 - RNA, 15 nt, Bordetella pertussis
cgccagccguugcgc

SEQ ID NO: 2420399 - RNA, 22 nt, Bordetella pertussis
cgccagccguugcgccagcggc

SEQ ID NO: 2420400 - RNA, 12 nt, Bordetella pertussis
cgccagcgacga

SEQ ID NO: 2420401 - RNA, 13 nt, Bordetella pertussis
cgccagcgccagc

SEQ ID NO: 2420402 - RNA, 12 nt, Bordetella pertussis
cgccagcgccau

SEQ ID NO: 2420403 - RNA, 13 nt, Bordetella pertussis
cgccagcgccgcg

SEQ ID NO: 2420404 - RNA, 22 nt, Bordetella pertussis
cgccagcgccgcgcgcgugccg

SEQ ID NO: 2420405 - RNA, 14 nt, Bordetella pertussis
cgccagcgccgcgu

SEQ ID NO: 2420406 - RNA, 15 nt, Bordetella pertussis
cgccagcgccggcgc

SEQ ID NO: 2420407 - RNA, 16 nt, Bordetella pertussis
cgccagcgccggcgcg

SEQ ID NO: 2420408 - RNA, 20 nt, Bordetella pertussis
cgccagcgccggcgcgucca

SEQ ID NO: 2420409 - RNA, 15 nt, Bordetella pertussis
cgccagcgccuccau

SEQ ID NO: 2420410 - RNA, 13 nt, Bordetella pertussis
cgccagcgccucg

SEQ ID NO: 2420411 - RNA, 14 nt, Bordetella pertussis
cgccagcgccucgc

SEQ ID NO: 2420412 - RNA, 13 nt, Bordetella pertussis
cgccagcgccugg

SEQ ID NO: 2420413 - RNA, 15 nt, Bordetella pertussis
cgccagcgccuggac

SEQ ID NO: 2420414 - RNA, 18 nt, Bordetella pertussis
cgccagcgccuggaccug

SEQ ID NO: 2420415 - RNA, 20 nt, Bordetella pertussis
cgccagcgccuggaccugga

SEQ ID NO: 2420416 - RNA, 17 nt, Bordetella pertussis
cgccagcgccuggguca

SEQ ID NO: 2420417 - RNA, 21 nt, Bordetella pertussis
cgccagcgcgaaaacccgcgg

SEQ ID NO: 2420418 - RNA, 22 nt, Bordetella pertussis
cgccagcgcgaaaacccgcggc

SEQ ID NO: 2420419 - RNA, 13 nt, Bordetella pertussis
cgccagcgcgccg

SEQ ID NO: 2420420 - RNA, 19 nt, Bordetella pertussis
cgccagcgcgccgcccacc

SEQ ID NO: 2420421 - RNA, 21 nt, Bordetella pertussis
cgccagcgcgccgcccaccac

SEQ ID NO: 2420422 - RNA, 22 nt, Bordetella pertussis
cgccagcgcgcgauagauggcc

SEQ ID NO: 2420423 - RNA, 21 nt, Bordetella pertussis
cgccagcgcgcgcgaggcggc

SEQ ID NO: 2420424 - RNA, 16 nt, Bordetella pertussis
cgccagcgcggccagc

SEQ ID NO: 2420425 - RNA, 17 nt, Bordetella pertussis
cgccagcgcggccagcg

SEQ ID NO: 2420426 - RNA, 20 nt, Bordetella pertussis
cgccagcgcggcgggccggu

SEQ ID NO: 2420427 - RNA, 13 nt, Bordetella pertussis
cgccagcgcggcu

SEQ ID NO: 2420428 - RNA, 15 nt, Bordetella pertussis
cgccagcgcggcuug

SEQ ID NO: 2420429 - RNA, 13 nt, Bordetella pertussis
cgccagcgcgucg

SEQ ID NO: 2420430 - RNA, 15 nt, Bordetella pertussis
cgccagcgcgucgcg

SEQ ID NO: 2420431 - RNA, 22 nt, Bordetella pertussis
cgccagcgcuguccaggccggg

SEQ ID NO: 2420432 - RNA, 20 nt, Bordetella pertussis
cgccagcgcuucgggcagcu

SEQ ID NO: 2420433 - RNA, 24 nt, Bordetella pertussis
cgccagcggauggugcucggcgau

SEQ ID NO: 2420434 - RNA, 14 nt, Bordetella pertussis
cgccagcggcagcg

SEQ ID NO: 2420435 - RNA, 12 nt, Bordetella pertussis
cgccagcggccg

SEQ ID NO: 2420436 - RNA, 14 nt, Bordetella pertussis
cgccagcggccguc

SEQ ID NO: 2420437 - RNA, 15 nt, Bordetella pertussis
cgccagcggccgucg

SEQ ID NO: 2420438 - RNA, 18 nt, Bordetella pertussis
cgccagcggccgucgccu

SEQ ID NO: 2420439 - RNA, 19 nt, Bordetella pertussis
cgccagcggccgucgccuu

SEQ ID NO: 2420440 - RNA, 19 nt, Bordetella pertussis
cgccagcggcgacugcccc

SEQ ID NO: 2420441 - RNA, 22 nt, Bordetella pertussis
cgccagcggcgacugccccagc

SEQ ID NO: 2420442 - RNA, 23 nt, Bordetella pertussis
cgccagcggcugcuugagcagcc

SEQ ID NO: 2420443 - RNA, 13 nt, Bordetella pertussis
cgccagcggcugg

SEQ ID NO: 2420444 - RNA, 13 nt, Bordetella pertussis
cgccagcgggagc

SEQ ID NO: 2420445 - RNA, 18 nt, Bordetella pertussis
cgccagcgggagccuguc

SEQ ID NO: 2420446 - RNA, 23 nt, Bordetella pertussis
cgccagcguaucgccgccgccgg

SEQ ID NO: 2420447 - RNA, 14 nt, Bordetella pertussis
cgccagcguggccg

SEQ ID NO: 2420448 - RNA, 17 nt, Bordetella pertussis
cgccagcguggccgagg

SEQ ID NO: 2420449 - RNA, 18 nt, Bordetella pertussis
cgccagcguggccgaggu

SEQ ID NO: 2420450 - RNA, 20 nt, Bordetella pertussis
cgccagcguggccgaggugc

SEQ ID NO: 2420451 - RNA, 18 nt, Bordetella pertussis
cgccagcguucggccacc

SEQ ID NO: 2420452 - RNA, 17 nt, Bordetella pertussis
cgccagcuccagccgca

SEQ ID NO: 2420453 - RNA, 19 nt, Bordetella pertussis
cgccagcuccagccgcagg

SEQ ID NO: 2420454 - RNA, 17 nt, Bordetella pertussis
cgccagcucgcgcagca

SEQ ID NO: 2420455 - RNA, 18 nt, Bordetella pertussis
cgccagcucgcgcagcag

SEQ ID NO: 2420456 - RNA, 11 nt, Bordetella pertussis
cgccagcucgg

SEQ ID NO: 2420457 - RNA, 14 nt, Bordetella pertussis
cgccagcucggcca

SEQ ID NO: 2420458 - RNA, 15 nt, Bordetella pertussis
cgccagcucggccaa

SEQ ID NO: 2420459 - RNA, 16 nt, Bordetella pertussis
cgccagcucggccaag

SEQ ID NO: 2420460 - RNA, 18 nt, Bordetella pertussis
cgccagcucggccaaggc

SEQ ID NO: 2420461 - RNA, 19 nt, Bordetella pertussis
cgccagcucggccaaggca

SEQ ID NO: 2420462 - RNA, 14 nt, Bordetella pertussis
cgccagcucggccu

SEQ ID NO: 2420463 - RNA, 20 nt, Bordetella pertussis
cgccagcucggccugcggcu

SEQ ID NO: 2420464 - RNA, 17 nt, Bordetella pertussis
cgccagcucuucgagcg

SEQ ID NO: 2420465 - RNA, 19 nt, Bordetella pertussis
cgccagcucuucgagcgcg

SEQ ID NO: 2420466 - RNA, 21 nt, Bordetella pertussis
cgccagcucuucgagcgcggc

SEQ ID NO: 2420467 - RNA, 22 nt, Bordetella pertussis
cgccagcucuucgagcgcggcg

SEQ ID NO: 2420468 - RNA, 12 nt, Bordetella pertussis
cgccagcugacc

SEQ ID NO: 2420469 - RNA, 20 nt, Bordetella pertussis
cgccagcugaccucgcccag

SEQ ID NO: 2420470 - RNA, 14 nt, Bordetella pertussis
cgccagcugcgcag

SEQ ID NO: 2420471 - RNA, 18 nt, Bordetella pertussis
cgccagcugcgcagcgac

SEQ ID NO: 2420472 - RNA, 17 nt, Bordetella pertussis
cgccagcuggaccgccu

SEQ ID NO: 2420473 - RNA, 21 nt, Bordetella pertussis
cgccagcuggaccgccuggcc

SEQ ID NO: 2420474 - RNA, 14 nt, Bordetella pertussis
cgccagcugggcga

SEQ ID NO: 2420475 - RNA, 15 nt, Bordetella pertussis
cgccagcuugcgcgc

SEQ ID NO: 2420476 - RNA, 19 nt, Bordetella pertussis
cgccagcuugcgcgccuug

SEQ ID NO: 2420477 - RNA, 16 nt, Bordetella pertussis
cgccaggaacagcgcc

SEQ ID NO: 2420478 - RNA, 22 nt, Bordetella pertussis
cgccaggaacagcgccggcagc

SEQ ID NO: 2420479 - RNA, 20 nt, Bordetella pertussis
cgccaggaagaucggcccgg

SEQ ID NO: 2420480 - RNA, 21 nt, Bordetella pertussis
cgccaggaagaucggcccggc

SEQ ID NO: 2420481 - RNA, 18 nt, Bordetella pertussis
cgccaggaagccgugcgc

SEQ ID NO: 2420482 - RNA, 20 nt, Bordetella pertussis
cgccaggaagcgcgccgcgc

SEQ ID NO: 2420483 - RNA, 18 nt, Bordetella pertussis
cgccaggaagcgggccug

SEQ ID NO: 2420484 - RNA, 21 nt, Bordetella pertussis
cgccaggacgggaaagcggcg

SEQ ID NO: 2420485 - RNA, 17 nt, Bordetella pertussis
cgccaugaucgccggca

SEQ ID NO: 2420486 - RNA, 18 nt, Bordetella pertussis
cgccaugaucgccggcaa

SEQ ID NO: 2420487 - RNA, 18 nt, Bordetella pertussis
cgccaugaugucgcgcgc

SEQ ID NO: 2420488 - RNA, 20 nt, Bordetella pertussis
cgccaugaugucgcgcgccu

SEQ ID NO: 2420489 - RNA, 20 nt, Bordetella pertussis
cgccaugcaacacgaccagc

SEQ ID NO: 2420490 - RNA, 22 nt, Bordetella pertussis
cgccaugcaacacgaccagcag

SEQ ID NO: 2420491 - RNA, 23 nt, Bordetella pertussis
cgccaugcaacacgaccagcagg

SEQ ID NO: 2420492 - RNA, 13 nt, Bordetella pertussis
cgccaugcagcug

SEQ ID NO: 2420493 - RNA, 14 nt, Bordetella pertussis
cgccaugccgcgcc

SEQ ID NO: 2420494 - RNA, 17 nt, Bordetella pertussis
cgccaugccgcgcccgc

SEQ ID NO: 2420495 - RNA, 14 nt, Bordetella pertussis
cgccaugccggccc

SEQ ID NO: 2420496 - RNA, 17 nt, Bordetella pertussis
cgccaugccggccccgu

SEQ ID NO: 2420497 - RNA, 12 nt, Bordetella pertussis
cgccaugccggg

SEQ ID NO: 2420498 - RNA, 20 nt, Bordetella pertussis
cgccaugcgacagcccggga

SEQ ID NO: 2420499 - RNA, 20 nt, Bordetella pertussis
cgccaugcgauacagcuugg

SEQ ID NO: 2420500 - RNA, 19 nt, Bordetella pertussis
cgccaugcgaugcugcagg

SEQ ID NO: 2420501 - RNA, 21 nt, Bordetella pertussis
cgccaugcgaugcugcagggc

SEQ ID NO: 2420502 - RNA, 22 nt, Bordetella pertussis
cgccaugcgaugcugcagggcc

SEQ ID NO: 2420503 - RNA, 19 nt, Bordetella pertussis
cgccaugcgcaccaccgcc

SEQ ID NO: 2420504 - RNA, 12 nt, Bordetella pertussis
cgccaugcgcag

SEQ ID NO: 2420505 - RNA, 18 nt, Bordetella pertussis
cgccaugcgcauggccag

SEQ ID NO: 2420506 - RNA, 19 nt, Bordetella pertussis
cgccaugcgcauggccagc

SEQ ID NO: 2420507 - RNA, 20 nt, Bordetella pertussis
cgccaugcgcauggccagcg

SEQ ID NO: 2420508 - RNA, 14 nt, Bordetella pertussis
cgccaugcgccagc

SEQ ID NO: 2420509 - RNA, 15 nt, Bordetella pertussis
cgccaugcgccagca

SEQ ID NO: 2420510 - RNA, 15 nt, Bordetella pertussis
cgccaugcgcccggc

SEQ ID NO: 2420511 - RNA, 17 nt, Bordetella pertussis
cgccaugcgcccggcca

SEQ ID NO: 2420512 - RNA, 21 nt, Bordetella pertussis
cgccaugcgcccggccaccgc

SEQ ID NO: 2420513 - RNA, 14 nt, Bordetella pertussis
cgccaugcggcugg

SEQ ID NO: 2420514 - RNA, 17 nt, Bordetella pertussis
cgccaugcggcuggccg

SEQ ID NO: 2420515 - RNA, 18 nt, Bordetella pertussis
cgccaugcggcuggccga

SEQ ID NO: 2420516 - RNA, 23 nt, Bordetella pertussis
cgccaugcucgcgcacagcgcgc

SEQ ID NO: 2420517 - RNA, 14 nt, Bordetella pertussis
cgccaugcuggccg

SEQ ID NO: 2420518 - RNA, 17 nt, Bordetella pertussis
cgccaugcuggccgccg

SEQ ID NO: 2420519 - RNA, 21 nt, Bordetella pertussis
cgccaugcuggccgccgcgcu

SEQ ID NO: 2420520 - RNA, 13 nt, Bordetella pertussis
cgccauggacgcc

SEQ ID NO: 2420521 - RNA, 17 nt, Bordetella pertussis
cgccauggacgccgaac

SEQ ID NO: 2420522 - RNA, 18 nt, Bordetella pertussis
cgccauggaggcgcagcg

SEQ ID NO: 2420523 - RNA, 21 nt, Bordetella pertussis
cgccauggaggcgcagcgcgg

SEQ ID NO: 2420524 - RNA, 22 nt, Bordetella pertussis
cgccauggaggcgcagcgcggc

SEQ ID NO: 2420525 - RNA, 14 nt, Bordetella pertussis
cgccauggccacga

SEQ ID NO: 2420526 - RNA, 14 nt, Bordetella pertussis
cgccauggccggcc

SEQ ID NO: 2420527 - RNA, 12 nt, Bordetella pertussis
cgccauggcgcg

SEQ ID NO: 2420528 - RNA, 16 nt, Bordetella pertussis
cgccauggcgcgcaga

SEQ ID NO: 2420529 - RNA, 16 nt, Bordetella pertussis
cgccauggcgcuggca

SEQ ID NO: 2420530 - RNA, 14 nt, Bordetella pertussis
cgccauggcggccg

SEQ ID NO: 2420531 - RNA, 15 nt, Bordetella pertussis
cgccauggcggccgc

SEQ ID NO: 2420532 - RNA, 22 nt, Bordetella pertussis
cgccauggcggccgccgccagc

SEQ ID NO: 2420533 - RNA, 13 nt, Bordetella pertussis
cgccauggcggcg

SEQ ID NO: 2420534 - RNA, 16 nt, Bordetella pertussis
cgccauggcggcggcc

SEQ ID NO: 2420535 - RNA, 17 nt, Bordetella pertussis
cgccauggucucgucca

SEQ ID NO: 2420536 - RNA, 23 nt, Bordetella pertussis
cgccauggugaacggccccgcca

SEQ ID NO: 2420537 - RNA, 13 nt, Bordetella pertussis
cgccauggugccg

SEQ ID NO: 2420538 - RNA, 19 nt, Bordetella pertussis
cgccauggugccgcgcagg

SEQ ID NO: 2420539 - RNA, 21 nt, Bordetella pertussis
cgccauguauaacguggcgcg

SEQ ID NO: 2420540 - RNA, 23 nt, Bordetella pertussis
cgccauguauaacguggcgcgca

SEQ ID NO: 2420541 - RNA, 21 nt, Bordetella pertussis
cgccaugucgacgaucucgcg

SEQ ID NO: 2420542 - RNA, 19 nt, Bordetella pertussis
cgccaugugcgccgcgccg

SEQ ID NO: 2420543 - RNA, 23 nt, Bordetella pertussis
cgccaugugcgccgcgccguaca

SEQ ID NO: 2420544 - RNA, 22 nt, Bordetella pertussis
cgccaugugcguugccagccca

SEQ ID NO: 2420545 - RNA, 15 nt, Bordetella pertussis
cgccauguggcgacg

SEQ ID NO: 2420546 - RNA, 18 nt, Bordetella pertussis
cgccauucauccagcgcg

SEQ ID NO: 2420547 - RNA, 19 nt, Bordetella pertussis
cgccauucauccagcgcgc

SEQ ID NO: 2420548 - RNA, 20 nt, Bordetella pertussis
cgccauucauccagcgcgcg

SEQ ID NO: 2420549 - RNA, 23 nt, Bordetella pertussis
cgccauugccacggcgggccggc

SEQ ID NO: 2420550 - RNA, 12 nt, Bordetella pertussis
cgccauugcggg

SEQ ID NO: 2420551 - RNA, 23 nt, Bordetella pertussis
cgccauugcggggauguuccggc

SEQ ID NO: 2420552 - RNA, 13 nt, Bordetella pertussis
cgcccaacccggc

SEQ ID NO: 2420553 - RNA, 15 nt, Bordetella pertussis
cgcccaacccggcga

SEQ ID NO: 2420554 - RNA, 22 nt, Bordetella pertussis
cgcccaagucgaguucggcgcg

SEQ ID NO: 2420555 - RNA, 21 nt, Bordetella pertussis
cgcccaauccgaucagcacga

SEQ ID NO: 2420556 - RNA, 17 nt, Bordetella pertussis
cgcccaaucgggcagca

SEQ ID NO: 2420557 - RNA, 21 nt, Bordetella pertussis
cgcccaaucgggcagcacgcg

SEQ ID NO: 2420558 - RNA, 22 nt, Bordetella pertussis
cgcccaaucgggcagcacgcgc

SEQ ID NO: 2420559 - RNA, 21 nt, Bordetella pertussis
cgcccacaggaacaggccggc

SEQ ID NO: 2420560 - RNA, 22 nt, Bordetella pertussis
cgcccacaggaacaggccggcc

SEQ ID NO: 2420561 - RNA, 17 nt, Bordetella pertussis
cgcccacauagaccggc

SEQ ID NO: 2420562 - RNA, 21 nt, Bordetella pertussis
cgcccacauagaccggcugca

SEQ ID NO: 2420563 - RNA, 16 nt, Bordetella pertussis
cgcccacauagcggcc

SEQ ID NO: 2420564 - RNA, 17 nt, Bordetella pertussis
cgcccacauagcggccg

SEQ ID NO: 2420565 - RNA, 19 nt, Bordetella pertussis
cgcccacauagcggccggc

SEQ ID NO: 2420566 - RNA, 21 nt, Bordetella pertussis
cgcccacauagcggccggcgc

SEQ ID NO: 2420567 - RNA, 22 nt, Bordetella pertussis
cgcccacauagcggccggcgcg

SEQ ID NO: 2420568 - RNA, 13 nt, Bordetella pertussis
cgcccaccaccag

SEQ ID NO: 2420569 - RNA, 21 nt, Bordetella pertussis
cgcccaccaccagcgcggcca

SEQ ID NO: 2420570 - RNA, 21 nt, Bordetella pertussis
cgcccaccaccagcggcgugc

SEQ ID NO: 2420571 - RNA, 15 nt, Bordetella pertussis
cgcccaccacgccgc

SEQ ID NO: 2420572 - RNA, 17 nt, Bordetella pertussis
cgcccaccacgccgccc

SEQ ID NO: 2420573 - RNA, 20 nt, Bordetella pertussis
cgcccaccacgccgcccagc

SEQ ID NO: 2420574 - RNA, 13 nt, Bordetella pertussis
cgcccaccagggu

SEQ ID NO: 2420575 - RNA, 18 nt, Bordetella pertussis
cgcccaccagggugccgc

SEQ ID NO: 2420576 - RNA, 19 nt, Bordetella pertussis
cgcccaccagggugccgcc

SEQ ID NO: 2420577 - RNA, 20 nt, Bordetella pertussis
cgcccaccaugagcacgccc

SEQ ID NO: 2420578 - RNA, 22 nt, Bordetella pertussis
cgcccaccaugagcacgcccca

SEQ ID NO: 2420579 - RNA, 16 nt, Bordetella pertussis
cgcccaccgagacgcu

SEQ ID NO: 2420580 - RNA, 17 nt, Bordetella pertussis
cgcccaccgugaccagc

SEQ ID NO: 2420581 - RNA, 13 nt, Bordetella pertussis
cgcccacgcacau

SEQ ID NO: 2420582 - RNA, 22 nt, Bordetella pertussis
cgcccacgcacaugaugcccag

SEQ ID NO: 2420583 - RNA, 23 nt, Bordetella pertussis
cgcccacgccgaauacgcucagg

SEQ ID NO: 2420584 - RNA, 15 nt, Bordetella pertussis
cgcccacgccgccug

SEQ ID NO: 2420585 - RNA, 20 nt, Bordetella pertussis
cgcccacgccgccuggcccg

SEQ ID NO: 2420586 - RNA, 13 nt, Bordetella pertussis
cgcccacgccgcu

SEQ ID NO: 2420587 - RNA, 15 nt, Bordetella pertussis
cgcccacgcgccgcc

SEQ ID NO: 2420588 - RNA, 18 nt, Bordetella pertussis
cgcccacgcgccgccagg

SEQ ID NO: 2420589 - RNA, 14 nt, Bordetella pertussis
cgcccacgcggcgc

SEQ ID NO: 2420590 - RNA, 15 nt, Bordetella pertussis
cgcccacgcggcgcu

SEQ ID NO: 2420591 - RNA, 18 nt, Bordetella pertussis
cgcccacgcggcgcugcu

SEQ ID NO: 2420592 - RNA, 14 nt, Bordetella pertussis
cgcccacggccgca

SEQ ID NO: 2420593 - RNA, 18 nt, Bordetella pertussis
cgcccacggccgcaugcg

SEQ ID NO: 2420594 - RNA, 19 nt, Bordetella pertussis
cgcccacggccuguccggc

SEQ ID NO: 2420595 - RNA, 17 nt, Bordetella pertussis
cgcccacgggcgccugg

SEQ ID NO: 2420596 - RNA, 17 nt, Bordetella pertussis
cgcccacugccaggcga

SEQ ID NO: 2420597 - RNA, 19 nt, Bordetella pertussis
cgcccaugcgcuggcgcaa

SEQ ID NO: 2420598 - RNA, 23 nt, Bordetella pertussis
cgcccaugcugaauugcgggccg

SEQ ID NO: 2420599 - RNA, 23 nt, Bordetella pertussis
cgcccaugggaaucugcuugccg

SEQ ID NO: 2420600 - RNA, 14 nt, Bordetella pertussis
cgcccauggucagg

SEQ ID NO: 2420601 - RNA, 22 nt, Bordetella pertussis
cgcccauguagaacgccagggu

SEQ ID NO: 2420602 - RNA, 20 nt, Bordetella pertussis
cgcccauuccgagcgggccc

SEQ ID NO: 2420603 - RNA, 14 nt, Bordetella pertussis
cgcccauugcggcg

SEQ ID NO: 2420604 - RNA, 15 nt, Bordetella pertussis
cgcccauugcggcgg

SEQ ID NO: 2420605 - RNA, 21 nt, Bordetella pertussis
cgcccauuuccgcuucggaca

SEQ ID NO: 2420606 - RNA, 15 nt, Bordetella pertussis
cgccccaacgcggcc

SEQ ID NO: 2420607 - RNA, 18 nt, Bordetella pertussis
cgccccaacgcggccagc

SEQ ID NO: 2420608 - RNA, 19 nt, Bordetella pertussis
cgccccaacgcggccagcg

SEQ ID NO: 2420609 - RNA, 20 nt, Bordetella pertussis
cgccccaacggccuucggcg

SEQ ID NO: 2420610 - RNA, 23 nt, Bordetella pertussis
cgccccacgagaagccgaugucg

SEQ ID NO: 2420611 - RNA, 16 nt, Bordetella pertussis
cgccccaggcguacga

SEQ ID NO: 2420612 - RNA, 21 nt, Bordetella pertussis
cgccccaggcgucggcggccc

SEQ ID NO: 2420613 - RNA, 22 nt, Bordetella pertussis
cgccccaguugcgcguccaggc

SEQ ID NO: 2420614 - RNA, 18 nt, Bordetella pertussis
cgccccaucaccauggcc

SEQ ID NO: 2420615 - RNA, 19 nt, Bordetella pertussis
cgccccauccacggcgcca

SEQ ID NO: 2420616 - RNA, 20 nt, Bordetella pertussis
cgccccauccacggcgccau

SEQ ID NO: 2420617 - RNA, 18 nt, Bordetella pertussis
cgccccauugggacgcca

SEQ ID NO: 2420618 - RNA, 15 nt, Bordetella pertussis
cgcccccacgccgcu

SEQ ID NO: 2420619 - RNA, 16 nt, Bordetella pertussis
cgcccccacgccgcug

SEQ ID NO: 2420620 - RNA, 12 nt, Bordetella pertussis
cgcccccagcac

SEQ ID NO: 2420621 - RNA, 23 nt, Bordetella pertussis
cgcccccagcacgguugccacgg

SEQ ID NO: 2420622 - RNA, 22 nt, Bordetella pertussis
cgcccccagcagcgaggacacg

SEQ ID NO: 2420623 - RNA, 14 nt, Bordetella pertussis
cgcccccagcgccg

SEQ ID NO: 2420624 - RNA, 13 nt, Bordetella pertussis
cgccccccgaggc

SEQ ID NO: 2420625 - RNA, 21 nt, Bordetella pertussis
cgcccccgaaggccgcgccua

SEQ ID NO: 2420626 - RNA, 14 nt, Bordetella pertussis
cgcccccgacgcca

SEQ ID NO: 2420627 - RNA, 20 nt, Bordetella pertussis
cgcccccgauccccugcccg

SEQ ID NO: 2420628 - RNA, 21 nt, Bordetella pertussis
cgcccccgauccccugcccgc

SEQ ID NO: 2420629 - RNA, 12 nt, Bordetella pertussis
cgcccccgccgc

SEQ ID NO: 2420630 - RNA, 21 nt, Bordetella pertussis
cgcccccgccgcacgggcgcc

SEQ ID NO: 2420631 - RNA, 14 nt, Bordetella pertussis
cgcccccgcggcgc

SEQ ID NO: 2420632 - RNA, 16 nt, Bordetella pertussis
cgcccccgcggcgccc

SEQ ID NO: 2420633 - RNA, 18 nt, Bordetella pertussis
cgcccccgcggcgccccg

SEQ ID NO: 2420634 - RNA, 22 nt, Bordetella pertussis
cgccccgacccuguacaagcgc

SEQ ID NO: 2420635 - RNA, 14 nt, Bordetella pertussis
cgccccgacgcgcu

SEQ ID NO: 2420636 - RNA, 23 nt, Bordetella pertussis
cgccccgaucagcaagggcccca

SEQ ID NO: 2420637 - RNA, 17 nt, Bordetella pertussis
cgccccgaucggcgccg

SEQ ID NO: 2420638 - RNA, 21 nt, Bordetella pertussis
cgccccgaucggcgccgcgcg

SEQ ID NO: 2420639 - RNA, 16 nt, Bordetella pertussis
cgccccgcacgaucag

SEQ ID NO: 2420640 - RNA, 18 nt, Bordetella pertussis
cgccccgcacgaucagca

SEQ ID NO: 2420641 - RNA, 15 nt, Bordetella pertussis
cgccccgcaguuuga

SEQ ID NO: 2420642 - RNA, 12 nt, Bordetella pertussis
cgccccggccga

SEQ ID NO: 2420643 - RNA, 15 nt, Bordetella pertussis
cgccccggcgcgcag

SEQ ID NO: 2420644 - RNA, 14 nt, Bordetella pertussis
cgccccggcgcggc

SEQ ID NO: 2420645 - RNA, 16 nt, Bordetella pertussis
cgccccggcgcggcgc

SEQ ID NO: 2420646 - RNA, 19 nt, Bordetella pertussis
cgccccggcgcggcgcgcg

SEQ ID NO: 2420647 - RNA, 14 nt, Bordetella pertussis
cgccccgucaucgg

SEQ ID NO: 2420648 - RNA, 23 nt, Bordetella pertussis
cgccccgucaucgggugcggcgc

SEQ ID NO: 2420649 - RNA, 22 nt, Bordetella pertussis
cgccccgucggccgucugggcg

SEQ ID NO: 2420650 - RNA, 21 nt, Bordetella pertussis
cgccccgugccauggaccggc

SEQ ID NO: 2420651 - RNA, 11 nt, Bordetella pertussis
cgccccuagcg

SEQ ID NO: 2420652 - RNA, 16 nt, Bordetella pertussis
cgccccuagcgccgcg

SEQ ID NO: 2420653 - RNA, 19 nt, Bordetella pertussis
cgccccuagcgccgcgcca

SEQ ID NO: 2420654 - RNA, 20 nt, Bordetella pertussis
cgccccuagcgccgcgccag

SEQ ID NO: 2420655 - RNA, 21 nt, Bordetella pertussis
cgccccuagcgccgcgccagg

SEQ ID NO: 2420656 - RNA, 22 nt, Bordetella pertussis
cgccccuucagcuuccagguac

SEQ ID NO: 2420657 - RNA, 18 nt, Bordetella pertussis
cgccccuuccacccgcau

SEQ ID NO: 2420658 - RNA, 19 nt, Bordetella pertussis
cgccccuugcggggcgcgu

SEQ ID NO: 2420659 - RNA, 17 nt, Bordetella pertussis
cgcccgaaagguccugg

SEQ ID NO: 2420660 - RNA, 18 nt, Bordetella pertussis
cgcccgacagcacgcccg

SEQ ID NO: 2420661 - RNA, 21 nt, Bordetella pertussis
cgcccgacagcacgcccgcca

SEQ ID NO: 2420662 - RNA, 14 nt, Bordetella pertussis
cgcccgaccugcug

SEQ ID NO: 2420663 - RNA, 16 nt, Bordetella pertussis
cgcccgaccugcuggc

SEQ ID NO: 2420664 - RNA, 19 nt, Bordetella pertussis
cgcccgaccugcuggcgcg

SEQ ID NO: 2420665 - RNA, 19 nt, Bordetella pertussis
cgcccgacgaggagccggc

SEQ ID NO: 2420666 - RNA, 22 nt, Bordetella pertussis
cgcccgacgaggagccggcggg

SEQ ID NO: 2420667 - RNA, 15 nt, Bordetella pertussis
cgcccgacggcgcgc

SEQ ID NO: 2420668 - RNA, 17 nt, Bordetella pertussis
cgcccgacggcgcgccc

SEQ ID NO: 2420669 - RNA, 17 nt, Bordetella pertussis
cgcccgacgguaucuca

SEQ ID NO: 2420670 - RNA, 23 nt, Bordetella pertussis
cgcccgacgguaucucagcgcgc

SEQ ID NO: 2420671 - RNA, 15 nt, Bordetella pertussis
cgcccgagagcugcg

SEQ ID NO: 2420672 - RNA, 23 nt, Bordetella pertussis
cgcccgagagcugcgucuugagc

SEQ ID NO: 2420673 - RNA, 15 nt, Bordetella pertussis
cgcccgagauggcgc

SEQ ID NO: 2420674 - RNA, 15 nt, Bordetella pertussis
cgcccgagcgccaca

SEQ ID NO: 2420675 - RNA, 17 nt, Bordetella pertussis
cgcccgagcuggccggc

SEQ ID NO: 2420676 - RNA, 19 nt, Bordetella pertussis
cgcccgagcuggccggcga

SEQ ID NO: 2420677 - RNA, 14 nt, Bordetella pertussis
cgcccgaggcgcgc

SEQ ID NO: 2420678 - RNA, 15 nt, Bordetella pertussis
cgcccgaucggccgg

SEQ ID NO: 2420679 - RNA, 18 nt, Bordetella pertussis
cgcccgaucggccggccg

SEQ ID NO: 2420680 - RNA, 19 nt, Bordetella pertussis
cgcccgaucggccggccgg

SEQ ID NO: 2420681 - RNA, 17 nt, Bordetella pertussis
cgcccgaugccuuggug

SEQ ID NO: 2420682 - RNA, 20 nt, Bordetella pertussis
cgcccgaugcucgccggcgc

SEQ ID NO: 2420683 - RNA, 22 nt, Bordetella pertussis
cgcccgaugcucgccggcgccg

SEQ ID NO: 2420684 - RNA, 21 nt, Bordetella pertussis
cgcccgcaacgggccggccgc

SEQ ID NO: 2420685 - RNA, 22 nt, Bordetella pertussis
cgcccgcaacgggccggccgcc

SEQ ID NO: 2420686 - RNA, 21 nt, Bordetella pertussis
cgcccgcacgaagcggcaucg

SEQ ID NO: 2420687 - RNA, 13 nt, Bordetella pertussis
cgcccgcacgaug

SEQ ID NO: 2420688 - RNA, 18 nt, Bordetella pertussis
cgcccgcaggcggcggcc

SEQ ID NO: 2420689 - RNA, 22 nt, Bordetella pertussis
cgcccgcaggcggcggccucca

SEQ ID NO: 2420690 - RNA, 13 nt, Bordetella pertussis
cgcccgcaucggc

SEQ ID NO: 2420691 - RNA, 22 nt, Bordetella pertussis
cgcccgcauggaccgccgccgu

SEQ ID NO: 2420692 - RNA, 21 nt, Bordetella pertussis
cgcccgcaugucccagcgcuc

SEQ ID NO: 2420693 - RNA, 22 nt, Bordetella pertussis
cgcccgcaugucccagcgcucg

SEQ ID NO: 2420694 - RNA, 12 nt, Bordetella pertussis
cgcccgccacca

SEQ ID NO: 2420695 - RNA, 17 nt, Bordetella pertussis
cgcccgccaccaggaac

SEQ ID NO: 2420696 - RNA, 19 nt, Bordetella pertussis
cgcccgccaccaggaacgc

SEQ ID NO: 2420697 - RNA, 21 nt, Bordetella pertussis
cgcccgccagcagcucggcga

SEQ ID NO: 2420698 - RNA, 23 nt, Bordetella pertussis
cgcccgccagcagcucggcgacc

SEQ ID NO: 2420699 - RNA, 12 nt, Bordetella pertussis
cgcccgccaggc

SEQ ID NO: 2420700 - RNA, 13 nt, Bordetella pertussis
cgcccgccaggcc

SEQ ID NO: 2420701 - RNA, 18 nt, Bordetella pertussis
cgcccgccaggccaggua

SEQ ID NO: 2420702 - RNA, 14 nt, Bordetella pertussis
cgcccgcccccuug

SEQ ID NO: 2420703 - RNA, 13 nt, Bordetella pertussis
cgcccgccccgca

SEQ ID NO: 2420704 - RNA, 13 nt, Bordetella pertussis
cgcccgccccggc

SEQ ID NO: 2420705 - RNA, 15 nt, Bordetella pertussis
cgcccgccccggcgc

SEQ ID NO: 2420706 - RNA, 16 nt, Bordetella pertussis
cgcccgccccggcgca

SEQ ID NO: 2420707 - RNA, 11 nt, Bordetella pertussis
cgcccgcccgc

SEQ ID NO: 2420708 - RNA, 13 nt, Bordetella pertussis
cgcccgcccgcug

SEQ ID NO: 2420709 - RNA, 15 nt, Bordetella pertussis
cgcccucgcgccacc

SEQ ID NO: 2420710 - RNA, 16 nt, Bordetella pertussis
cgcccucgcgccacca

SEQ ID NO: 2420711 - RNA, 20 nt, Bordetella pertussis
cgcccucguugacgccgacg

SEQ ID NO: 2420712 - RNA, 14 nt, Bordetella pertussis
cgcccucuucggcg

SEQ ID NO: 2420713 - RNA, 17 nt, Bordetella pertussis
cgcccucuuucgccgcg

SEQ ID NO: 2420714 - RNA, 18 nt, Bordetella pertussis
cgcccucuuucgccgcgc

SEQ ID NO: 2420715 - RNA, 20 nt, Bordetella pertussis
cgcccugaacuauggcgcgc

SEQ ID NO: 2420716 - RNA, 22 nt, Bordetella pertussis
cgcccugaacuauggcgcgcgc

SEQ ID NO: 2420717 - RNA, 13 nt, Bordetella pertussis
cgcccugacgacc

SEQ ID NO: 2420718 - RNA, 15 nt, Bordetella pertussis
cgcccugacgaccaa

SEQ ID NO: 2420719 - RNA, 17 nt, Bordetella pertussis
cgcccugacgccugcgc

SEQ ID NO: 2420720 - RNA, 19 nt, Bordetella pertussis
cgcccugacgccugcgccg

SEQ ID NO: 2420721 - RNA, 20 nt, Bordetella pertussis
cgcccugacgccugcgccgg

SEQ ID NO: 2420722 - RNA, 19 nt, Bordetella pertussis
cgcccugcaccgucacgcg

SEQ ID NO: 2420723 - RNA, 13 nt, Bordetella pertussis
cgcccugcacgcg

SEQ ID NO: 2420724 - RNA, 16 nt, Bordetella pertussis
cgcccugcacgcgcgc

SEQ ID NO: 2420725 - RNA, 17 nt, Bordetella pertussis
cgcccugcacgcgcgcg

SEQ ID NO: 2420726 - RNA, 12 nt, Bordetella pertussis
cgcccugcaggg

SEQ ID NO: 2420727 - RNA, 14 nt, Bordetella pertussis
cgcccugcagggca

SEQ ID NO: 2420728 - RNA, 21 nt, Bordetella pertussis
cgcccugccaauagcgguggc

SEQ ID NO: 2420729 - RNA, 13 nt, Bordetella pertussis
cgcccugcccggc

SEQ ID NO: 2420730 - RNA, 16 nt, Bordetella pertussis
cgcccugcccggcgag

SEQ ID NO: 2420731 - RNA, 22 nt, Bordetella pertussis
cgcccugccgccaagggcgcgc

SEQ ID NO: 2420732 - RNA, 22 nt, Bordetella pertussis
cgcccugcgaacccgccgcgau

SEQ ID NO: 2420733 - RNA, 22 nt, Bordetella pertussis
cgcccugcgcguacguggcgcg

SEQ ID NO: 2420734 - RNA, 23 nt, Bordetella pertussis
cgcccugcgcguacguggcgcgg

SEQ ID NO: 2420735 - RNA, 17 nt, Bordetella pertussis
cgcccugcucgaucugg

SEQ ID NO: 2420736 - RNA, 14 nt, Bordetella pertussis
cgcccugcucgcgc

SEQ ID NO: 2420737 - RNA, 15 nt, Bordetella pertussis
cgcccugcucgcgca

SEQ ID NO: 2420738 - RNA, 17 nt, Bordetella pertussis
cgcccugcucgcgcagc

SEQ ID NO: 2420739 - RNA, 13 nt, Bordetella pertussis
cgcccugcugccc

SEQ ID NO: 2420740 - RNA, 16 nt, Bordetella pertussis
cgcccugcugcccgcc

SEQ ID NO: 2420741 - RNA, 14 nt, Bordetella pertussis
cgcccugcuggcgc

SEQ ID NO: 2420742 - RNA, 15 nt, Bordetella pertussis
cgcccugcuggcgca

SEQ ID NO: 2420743 - RNA, 15 nt, Bordetella pertussis
cgcccuggaucaggg

SEQ ID NO: 2420744 - RNA, 19 nt, Bordetella pertussis
cgcccuggauggcggccgc

SEQ ID NO: 2420745 - RNA, 21 nt, Bordetella pertussis
cgcccuggauggcggccgcca

SEQ ID NO: 2420746 - RNA, 23 nt, Bordetella pertussis
cgcccuggauggcggccgccagc

SEQ ID NO: 2420747 - RNA, 18 nt, Bordetella pertussis
cgcccuggcagcuggcgc

SEQ ID NO: 2420748 - RNA, 20 nt, Bordetella pertussis
cgcccuggcagcuggcgcgg

SEQ ID NO: 2420749 - RNA, 15 nt, Bordetella pertussis
cgcccuggccgcgcc

SEQ ID NO: 2420750 - RNA, 16 nt, Bordetella pertussis
cgcccuggccgcgccg

SEQ ID NO: 2420751 - RNA, 20 nt, Bordetella pertussis
cgcccuggccguacauggcc

SEQ ID NO: 2420752 - RNA, 19 nt, Bordetella pertussis
cgcccuggccuucgaccug

SEQ ID NO: 2420753 - RNA, 23 nt, Bordetella pertussis
cgcccuggccuucgaccugcccg

SEQ ID NO: 2420754 - RNA, 12 nt, Bordetella pertussis
cgcccuggcgca

SEQ ID NO: 2420755 - RNA, 13 nt, Bordetella pertussis
cgcccuggcgcag

SEQ ID NO: 2420756 - RNA, 16 nt, Bordetella pertussis
cgcccuggcgcaggcc

SEQ ID NO: 2420757 - RNA, 19 nt, Bordetella pertussis
cgcccuggcgcaggccggc

SEQ ID NO: 2420758 - RNA, 23 nt, Bordetella pertussis
cgcccuggcgcaggccggcggcc

SEQ ID NO: 2420759 - RNA, 17 nt, Bordetella pertussis
cgcccuggcgcagggca

SEQ ID NO: 2420760 - RNA, 18 nt, Bordetella pertussis
cgcccuggcgccgcggcc

SEQ ID NO: 2420761 - RNA, 19 nt, Bordetella pertussis
cgcccuggcgccgcggccg

SEQ ID NO: 2420762 - RNA, 20 nt, Bordetella pertussis
cgcccuggcgccgcggccgg

SEQ ID NO: 2420763 - RNA, 15 nt, Bordetella pertussis
cgcccuggcgcgagg

SEQ ID NO: 2420764 - RNA, 19 nt, Bordetella pertussis
cgcccuggcgcgaggcggc

SEQ ID NO: 2420765 - RNA, 23 nt, Bordetella pertussis
cgcccuggcgcgaggcggcgacg

SEQ ID NO: 2420766 - RNA, 16 nt, Bordetella pertussis
cgcccuggcguggcgc

SEQ ID NO: 2420767 - RNA, 20 nt, Bordetella pertussis
cgcccuggcguggcgcgcgc

SEQ ID NO: 2420768 - RNA, 22 nt, Bordetella pertussis
cgcccuggcguggcgcgcgccg

SEQ ID NO: 2420769 - RNA, 12 nt, Bordetella pertussis
cgcccugggcag

SEQ ID NO: 2420770 - RNA, 14 nt, Bordetella pertussis
cgcccugggcagca

SEQ ID NO: 2420771 - RNA, 22 nt, Bordetella pertussis
cgcccuggucaucgccaugcug

SEQ ID NO: 2420772 - RNA, 15 nt, Bordetella pertussis
cgcccuucagguagc

SEQ ID NO: 2420773 - RNA, 18 nt, Bordetella pertussis
cgcccuugagcacggcgc

SEQ ID NO: 2420774 - RNA, 21 nt, Bordetella pertussis
cgcccuugagcacggcgcggc

SEQ ID NO: 2420775 - RNA, 14 nt, Bordetella pertussis
cgcccuugaugccg

SEQ ID NO: 2420776 - RNA, 16 nt, Bordetella pertussis
cgcccuugaugccguc

SEQ ID NO: 2420777 - RNA, 18 nt, Bordetella pertussis
cgcccuugaugccgucgg

SEQ ID NO: 2420778 - RNA, 17 nt, Bordetella pertussis
cgcccuugauggccucg

SEQ ID NO: 2420779 - RNA, 20 nt, Bordetella pertussis
cgcccuugauggccucggcg

SEQ ID NO: 2420780 - RNA, 22 nt, Bordetella pertussis
cgcccuugauggccucggcggc

SEQ ID NO: 2420781 - RNA, 20 nt, Bordetella pertussis
cgcccuugccagggccuggc

SEQ ID NO: 2420782 - RNA, 23 nt, Bordetella pertussis
cgcccuugccguuguccgccugc

SEQ ID NO: 2420783 - RNA, 17 nt, Bordetella pertussis
cgcccuugcgccaguug

SEQ ID NO: 2420784 - RNA, 13 nt, Bordetella pertussis
cgcccuugcggcg

SEQ ID NO: 2420785 - RNA, 15 nt, Bordetella pertussis
cgcccuugcggcgag

SEQ ID NO: 2420786 - RNA, 21 nt, Bordetella pertussis
cgcccuugggcaucaggggcu

SEQ ID NO: 2420787 - RNA, 18 nt, Bordetella pertussis
cgcccuugggcucgucga

SEQ ID NO: 2420788 - RNA, 19 nt, Bordetella pertussis
cgcccuugggcucgucgac

SEQ ID NO: 2420789 - RNA, 24 nt, Bordetella pertussis
cgcccuugggcucgucgacgcggc

SEQ ID NO: 2420790 - RNA, 18 nt, Bordetella pertussis
cgcccuuugcauugcggc

SEQ ID NO: 2420791 - RNA, 13 nt, Bordetella pertussis
cgccgaacaccag

SEQ ID NO: 2420792 - RNA, 22 nt, Bordetella pertussis
cgccgaacaggguauugacccc

SEQ ID NO: 2420793 - RNA, 14 nt, Bordetella pertussis
cgccgaaccagcgc

SEQ ID NO: 2420794 - RNA, 19 nt, Bordetella pertussis
cgccgaacgacuuggcgca

SEQ ID NO: 2420795 - RNA, 18 nt, Bordetella pertussis
cgccgaacgcgcagcgaa

SEQ ID NO: 2420796 - RNA, 15 nt, Bordetella pertussis
cgccgaacggggccg

SEQ ID NO: 2420797 - RNA, 18 nt, Bordetella pertussis
cgccgaacggggccgccu

SEQ ID NO: 2420798 - RNA, 14 nt, Bordetella pertussis
cgccgaacugccgg

SEQ ID NO: 2420799 - RNA, 15 nt, Bordetella pertussis
cgccgaacugccggc

SEQ ID NO: 2420800 - RNA, 17 nt, Bordetella pertussis
cgccgaacugccggcgc

SEQ ID NO: 2420801 - RNA, 18 nt, Bordetella pertussis
cgccgaacugccggcgcg

SEQ ID NO: 2420802 - RNA, 15 nt, Bordetella pertussis
cgccgaagcaaugca

SEQ ID NO: 2420803 - RNA, 19 nt, Bordetella pertussis
cgccgaagcaaugcagcgc

SEQ ID NO: 2420804 - RNA, 21 nt, Bordetella pertussis
cgccgaagcaaugcagcgcga

SEQ ID NO: 2420805 - RNA, 18 nt, Bordetella pertussis
cgccgaagccgccgccgu

SEQ ID NO: 2420806 - RNA, 19 nt, Bordetella pertussis
cgccgaagcgcaggccuuc

SEQ ID NO: 2420807 - RNA, 13 nt, Bordetella pertussis
cgccgaaggcggc

SEQ ID NO: 2420808 - RNA, 17 nt, Bordetella pertussis
cgccgaaggcggcgccg

SEQ ID NO: 2420809 - RNA, 19 nt, Bordetella pertussis
cgccgaaggcggcgccggu

SEQ ID NO: 2420810 - RNA, 22 nt, Bordetella pertussis
cgccgaaggcggcgccggugac

SEQ ID NO: 2420811 - RNA, 19 nt, Bordetella pertussis
cgccgaaggcgugcugaac

SEQ ID NO: 2420812 - RNA, 16 nt, Bordetella pertussis
cgccgaagucggcgcg

SEQ ID NO: 2420813 - RNA, 17 nt, Bordetella pertussis
cgccgaaguugcggccg

SEQ ID NO: 2420814 - RNA, 18 nt, Bordetella pertussis
cgccgaaguugcggccgu

SEQ ID NO: 2420815 - RNA, 20 nt, Bordetella pertussis
cgccgaaguugcggccgugc

SEQ ID NO: 2420816 - RNA, 17 nt, Bordetella pertussis
cgccgaauugcuggagc

SEQ ID NO: 2420817 - RNA, 19 nt, Bordetella pertussis
cgccgaauugcuggagcgc

SEQ ID NO: 2420818 - RNA, 15 nt, Bordetella pertussis
cgccgacaacggcgu

SEQ ID NO: 2420819 - RNA, 20 nt, Bordetella pertussis
cgccgacaacggcgugcugc

SEQ ID NO: 2420820 - RNA, 17 nt, Bordetella pertussis
cgccgacaggaaggcga

SEQ ID NO: 2420821 - RNA, 21 nt, Bordetella pertussis
cgccgaccaccugcaccgccg

SEQ ID NO: 2420822 - RNA, 20 nt, Bordetella pertussis
accuuccugcuggaccugcu

SEQ ID NO: 2420823 - RNA, 20 nt, Bordetella pertussis
accuucucgaugcgcgccac

SEQ ID NO: 2420824 - RNA, 22 nt, Bordetella pertussis
accuucugcaaggccugcugca

SEQ ID NO: 2420825 - RNA, 14 nt, Bordetella pertussis
accuucugccgcca

SEQ ID NO: 2420826 - RNA, 17 nt, Bordetella pertussis
accuucuuccaggcgcc

SEQ ID NO: 2420827 - RNA, 17 nt, Bordetella pertussis
accuugacgcgcaggcc

SEQ ID NO: 2420828 - RNA, 23 nt, Bordetella pertussis
accuugacgcgcaggccauugcu

SEQ ID NO: 2420829 - RNA, 15 nt, Bordetella pertussis
accuugcccacgcca

SEQ ID NO: 2420830 - RNA, 15 nt, Bordetella pertussis
accuugcccagcagc

SEQ ID NO: 2420831 - RNA, 20 nt, Bordetella pertussis
accuugcccgucagcggcgc

SEQ ID NO: 2420832 - RNA, 22 nt, Bordetella pertussis
accuugcccgucagcggcgcgc

SEQ ID NO: 2420833 - RNA, 18 nt, Bordetella pertussis
accuugcgaggcccggcc

SEQ ID NO: 2420834 - RNA, 14 nt, Bordetella pertussis
accuugcgcgcgaa

SEQ ID NO: 2420835 - RNA, 14 nt, Bordetella pertussis
accuugcggccgcg

SEQ ID NO: 2420836 - RNA, 16 nt, Bordetella pertussis
accuugcggccgcgca

SEQ ID NO: 2420837 - RNA, 18 nt, Bordetella pertussis
accuugcuggaccgcgcc

SEQ ID NO: 2420838 - RNA, 22 nt, Bordetella pertussis
accuuggcccggcgggaacagg

SEQ ID NO: 2420839 - RNA, 22 nt, Bordetella pertussis
accuuggcggccgacagcuugc

SEQ ID NO: 2420840 - RNA, 12 nt, Bordetella pertussis
accuuggcggcu

SEQ ID NO: 2420841 - RNA, 19 nt, Bordetella pertussis
accuuggcggcuggcgcgg

SEQ ID NO: 2420842 - RNA, 17 nt, Bordetella pertussis
accuuguuggcgccggc

SEQ ID NO: 2420843 - RNA, 18 nt, Bordetella pertussis
accuuuccgaucagcugc

SEQ ID NO: 2420844 - RNA, 19 nt, Bordetella pertussis
accuuuccgaucagcugcg

SEQ ID NO: 2420845 - RNA, 23 nt, Bordetella pertussis
accuuuccgaucagcugcggccc

SEQ ID NO: 2420846 - RNA, 15 nt, Bordetella pertussis
accuuucugcugcuc

SEQ ID NO: 2420847 - RNA, 18 nt, Bordetella pertussis
acgaaaaccaggcugccc

SEQ ID NO: 2420848 - RNA, 14 nt, Bordetella pertussis
acgaaaccaggccg

SEQ ID NO: 2420849 - RNA, 23 nt, Bordetella pertussis
acgaaagcggcaaagccgcugcg

SEQ ID NO: 2420850 - RNA, 19 nt, Bordetella pertussis
acgaaauagccgaccaccc

SEQ ID NO: 2420851 - RNA, 13 nt, Bordetella pertussis
acgaacaacacga

SEQ ID NO: 2420852 - RNA, 14 nt, Bordetella pertussis
acgaacagcgccag

SEQ ID NO: 2420853 - RNA, 15 nt, Bordetella pertussis
acgaacagcgccagg

SEQ ID NO: 2420854 - RNA, 15 nt, Bordetella pertussis
acgaacaggccgccg

SEQ ID NO: 2420855 - RNA, 22 nt, Bordetella pertussis
acgaagaacaccaucaaggcca

SEQ ID NO: 2420856 - RNA, 13 nt, Bordetella pertussis
acgaagaacugcu

SEQ ID NO: 2420857 - RNA, 11 nt, Bordetella pertussis
acgaagcaggu

SEQ ID NO: 2420858 - RNA, 23 nt, Bordetella pertussis
acgaagcaggugaugcgcgcggc

SEQ ID NO: 2420859 - RNA, 14 nt, Bordetella pertussis
acgaagccgaugcg

SEQ ID NO: 2420860 - RNA, 19 nt, Bordetella pertussis
acgaagccgaugcgccgcg

SEQ ID NO: 2420861 - RNA, 22 nt, Bordetella pertussis
acgaagcgcagcaccgcgcgca

SEQ ID NO: 2420862 - RNA, 18 nt, Bordetella pertussis
acgaaggcauccaggucu

SEQ ID NO: 2420863 - RNA, 17 nt, Bordetella pertussis
acgaagggauagcgccg

SEQ ID NO: 2420864 - RNA, 14 nt, Bordetella pertussis
acgaagggcagcag

SEQ ID NO: 2420865 - RNA, 17 nt, Bordetella pertussis
acgaagggcagcagcag

SEQ ID NO: 2420866 - RNA, 17 nt, Bordetella pertussis
acgaauccccgcucagg

SEQ ID NO: 2420867 - RNA, 17 nt, Bordetella pertussis
acgaauuccucgccgcc

SEQ ID NO: 2420868 - RNA, 21 nt, Bordetella pertussis
cgccgacuucagacagacgcu

SEQ ID NO: 2420869 - RNA, 16 nt, Bordetella pertussis
cgccgagaaauccagc

SEQ ID NO: 2420870 - RNA, 20 nt, Bordetella pertussis
cgccgagaaauccagcgcgc

SEQ ID NO: 2420871 - RNA, 23 nt, Bordetella pertussis
cgccgagaaauccagcgcgccca

SEQ ID NO: 2420872 - RNA, 14 nt, Bordetella pertussis
cgccgagauggacg

SEQ ID NO: 2420873 - RNA, 21 nt, Bordetella pertussis
cgccgagcagggggucgauca

SEQ ID NO: 2420874 - RNA, 13 nt, Bordetella pertussis
cgccgagccgcug

SEQ ID NO: 2420875 - RNA, 11 nt, Bordetella pertussis
cgccgagcggc

SEQ ID NO: 2420876 - RNA, 19 nt, Bordetella pertussis
cgccgagcggcaucugcag

SEQ ID NO: 2420877 - RNA, 20 nt, Bordetella pertussis
cgccgagcggggccgcgccg

SEQ ID NO: 2420878 - RNA, 22 nt, Bordetella pertussis
cgccgagcggggccgcgccggc

SEQ ID NO: 2420879 - RNA, 21 nt, Bordetella pertussis
cgccgaggaucuggccggcgc

SEQ ID NO: 2420880 - RNA, 22 nt, Bordetella pertussis
cgccgaggaucuggccggcgcu

SEQ ID NO: 2420881 - RNA, 16 nt, Bordetella pertussis
cgccgaggccugcugu

SEQ ID NO: 2420882 - RNA, 18 nt, Bordetella pertussis
cgccgaggcgggcagcau

SEQ ID NO: 2420883 - RNA, 15 nt, Bordetella pertussis
cgccgaggcggucga

SEQ ID NO: 2420884 - RNA, 15 nt, Bordetella pertussis
cgccgagggccgcgc

SEQ ID NO: 2420885 - RNA, 18 nt, Bordetella pertussis
cgccgagggccgcgcgau

SEQ ID NO: 2420886 - RNA, 16 nt, Bordetella pertussis
cgccgaggugaucugg

SEQ ID NO: 2420887 - RNA, 14 nt, Bordetella pertussis
cgccgagucggcga

SEQ ID NO: 2420888 - RNA, 21 nt, Bordetella pertussis
cgccgagucggcgauggcgcg

SEQ ID NO: 2420889 - RNA, 21 nt, Bordetella pertussis
cgccgaguuuccgcacccggu

SEQ ID NO: 2420890 - RNA, 15 nt, Bordetella pertussis
cgccgauaccacgcg

SEQ ID NO: 2420891 - RNA, 16 nt, Bordetella pertussis
cgccgauaccacgcgc

SEQ ID NO: 2420892 - RNA, 22 nt, Bordetella pertussis
cgccgauaccacgcgcggcggc

SEQ ID NO: 2420893 - RNA, 22 nt, Bordetella pertussis
cgccgaucaccacgggcacgau

SEQ ID NO: 2420894 - RNA, 17 nt, Bordetella pertussis
cgccgaucagcaggucg

SEQ ID NO: 2420895 - RNA, 22 nt, Bordetella pertussis
cgccgaucagcaggucggcgcg

SEQ ID NO: 2420896 - RNA, 20 nt, Bordetella pertussis
cgccgauccacucggccagc

SEQ ID NO: 2420897 - RNA, 21 nt, Bordetella pertussis
cgccgauccacucggccagcg

SEQ ID NO: 2420898 - RNA, 22 nt, Bordetella pertussis
cgccgauccacucggccagcgc

SEQ ID NO: 2420899 - RNA, 19 nt, Bordetella pertussis
cgccgauccagcccaccgc

SEQ ID NO: 2420900 - RNA, 23 nt, Bordetella pertussis
cgccgauccagcccaccgcgaac

SEQ ID NO: 2420901 - RNA, 19 nt, Bordetella pertussis
cgccgauccagggccgcag

SEQ ID NO: 2420902 - RNA, 21 nt, Bordetella pertussis
cgccgauccagggccgcagca

SEQ ID NO: 2420903 - RNA, 14 nt, Bordetella pertussis
cgccgauccggcgc

SEQ ID NO: 2420904 - RNA, 21 nt, Bordetella pertussis
cgccgaucgagcaggccgccg

SEQ ID NO: 2420905 - RNA, 22 nt, Bordetella pertussis
cgccgaucgagcaggccgccgg

SEQ ID NO: 2420906 - RNA, 17 nt, Bordetella pertussis
cgccgaucgcgcacagc

SEQ ID NO: 2420907 - RNA, 20 nt, Bordetella pertussis
cgccgaucgcgcacagcaug

SEQ ID NO: 2420908 - RNA, 23 nt, Bordetella pertussis
cgccgaucgcgcacagcauggcc

SEQ ID NO: 2420909 - RNA, 13 nt, Bordetella pertussis
cgccgaucgcggc

SEQ ID NO: 2420910 - RNA, 17 nt, Bordetella pertussis
cgccgaucgcggcucca

SEQ ID NO: 2420911 - RNA, 16 nt, Bordetella pertussis
cgccgaucggcaaagc

SEQ ID NO: 2420912 - RNA, 21 nt, Bordetella pertussis
cgccgaucggcuugccgcgcg

SEQ ID NO: 2420913 - RNA, 15 nt, Bordetella pertussis
cgccgaucugcuucc

SEQ ID NO: 2420914 - RNA, 19 nt, Bordetella pertussis
cgccgaugaccagcagcgc

SEQ ID NO: 2420915 - RNA, 20 nt, Bordetella pertussis
cgccgaugaccagcagcgcc

SEQ ID NO: 2420916 - RNA, 14 nt, Bordetella pertussis
cgccgaugaccagg

SEQ ID NO: 2420917 - RNA, 15 nt, Bordetella pertussis
cgccgaugaccaggg

SEQ ID NO: 2420918 - RNA, 19 nt, Bordetella pertussis
cgccgaugaccagggcgcc

SEQ ID NO: 2420919 - RNA, 20 nt, Bordetella pertussis
cgccgaugaccagggcgccg

SEQ ID NO: 2420920 - RNA, 15 nt, Bordetella pertussis
cgccgaugcacaggu

SEQ ID NO: 2420921 - RNA, 14 nt, Bordetella pertussis
cgccgaugccgcca

SEQ ID NO: 2420922 - RNA, 17 nt, Bordetella pertussis
cgccgaugccgccauca

SEQ ID NO: 2420923 - RNA, 18 nt, Bordetella pertussis
cgccgaugcgcucggucc

SEQ ID NO: 2420924 - RNA, 12 nt, Bordetella pertussis
cgccgauggcgc

SEQ ID NO: 2420925 - RNA, 14 nt, Bordetella pertussis
cgccgauggcgcca

SEQ ID NO: 2420926 - RNA, 14 nt, Bordetella pertussis
cgccgauggcgccg

SEQ ID NO: 2420927 - RNA, 15 nt, Bordetella pertussis
cgccgauggcgccgc

SEQ ID NO: 2420928 - RNA, 16 nt, Bordetella pertussis
cgccgauggcgccgcu

SEQ ID NO: 2420929 - RNA, 18 nt, Bordetella pertussis
cgccgauggcgccgcugu

SEQ ID NO: 2420930 - RNA, 13 nt, Bordetella pertussis
cgccgauggcgcg

SEQ ID NO: 2420931 - RNA, 17 nt, Bordetella pertussis
cgccgauggcgcgcggc

SEQ ID NO: 2420932 - RNA, 17 nt, Bordetella pertussis
cgccgauggcgcggccg

SEQ ID NO: 2420933 - RNA, 19 nt, Bordetella pertussis
cgccgauggcgcggccgcc

SEQ ID NO: 2420934 - RNA, 20 nt, Bordetella pertussis
cgccgcccuugcgccaguug

SEQ ID NO: 2420935 - RNA, 12 nt, Bordetella pertussis
cgccgccgaacg

SEQ ID NO: 2420936 - RNA, 11 nt, Bordetella pertussis
cgccgccgaag

SEQ ID NO: 2420937 - RNA, 18 nt, Bordetella pertussis
cgccgccgaagccgccgc

SEQ ID NO: 2420938 - RNA, 24 nt, Bordetella pertussis
cgccgccgaagccgccgccgucaa

SEQ ID NO: 2420939 - RNA, 14 nt, Bordetella pertussis
cgccgccgacggca

SEQ ID NO: 2420940 - RNA, 23 nt, Bordetella pertussis
cgccgccgacggcauggcggcca

SEQ ID NO: 2420941 - RNA, 14 nt, Bordetella pertussis
cgccgccgauggcg

SEQ ID NO: 2420942 - RNA, 16 nt, Bordetella pertussis
cgccgccgauggcgcg

SEQ ID NO: 2420943 - RNA, 17 nt, Bordetella pertussis
cgccgccgauggcgcgc

SEQ ID NO: 2420944 - RNA, 21 nt, Bordetella pertussis
cgccgccgauggcgcgcggcu

SEQ ID NO: 2420945 - RNA, 19 nt, Bordetella pertussis
cgccgccgcagccgccagc

SEQ ID NO: 2420946 - RNA, 14 nt, Bordetella pertussis
cgccgccgccaugg

SEQ ID NO: 2420947 - RNA, 13 nt, Bordetella pertussis
cgccgccgcccac

SEQ ID NO: 2420948 - RNA, 13 nt, Bordetella pertussis
cgccgccgcccgc

SEQ ID NO: 2420949 - RNA, 15 nt, Bordetella pertussis
cgccgccgcccgccc

SEQ ID NO: 2420950 - RNA, 16 nt, Bordetella pertussis
cgccgccgcccgcccg

SEQ ID NO: 2420951 - RNA, 14 nt, Bordetella pertussis
cgccgccgcccggc

SEQ ID NO: 2420952 - RNA, 15 nt, Bordetella pertussis
cgccgccgcccggca

SEQ ID NO: 2420953 - RNA, 12 nt, Bordetella pertussis
cgccgccgccgg

SEQ ID NO: 2420954 - RNA, 13 nt, Bordetella pertussis
cgccgccgccggg

SEQ ID NO: 2420955 - RNA, 12 nt, Bordetella pertussis
cgccgccgcgca

SEQ ID NO: 2420956 - RNA, 15 nt, Bordetella pertussis
cgccgccgcgcacca

SEQ ID NO: 2420957 - RNA, 16 nt, Bordetella pertussis
cgccgccgcgcaccac

SEQ ID NO: 2420958 - RNA, 14 nt, Bordetella pertussis
cgccgccgcgcccu

SEQ ID NO: 2420959 - RNA, 14 nt, Bordetella pertussis
cgccgccgcgccga

SEQ ID NO: 2420960 - RNA, 14 nt, Bordetella pertussis
cgccgccgcgccgc

SEQ ID NO: 2420961 - RNA, 15 nt, Bordetella pertussis
cgccgccgcgccgcu

SEQ ID NO: 2420962 - RNA, 23 nt, Bordetella pertussis
cgccgccgcgccgcuggcgucca

SEQ ID NO: 2420963 - RNA, 14 nt, Bordetella pertussis
cgccgccgcgcgcg

SEQ ID NO: 2420964 - RNA, 15 nt, Bordetella pertussis
cgccgccgcgcgcug

SEQ ID NO: 2420965 - RNA, 16 nt, Bordetella pertussis
cgccgccgcgcgcugg

SEQ ID NO: 2420966 - RNA, 14 nt, Bordetella pertussis
cgccgccgcgcucg

SEQ ID NO: 2420967 - RNA, 14 nt, Bordetella pertussis
cgccgccgcgcugu

SEQ ID NO: 2420968 - RNA, 21 nt, Bordetella pertussis
cgccgccgcgcugugcgacga

SEQ ID NO: 2420969 - RNA, 15 nt, Bordetella pertussis
cgccgccgcggccug

SEQ ID NO: 2420970 - RNA, 16 nt, Bordetella pertussis
cgccgccgcggccugg

SEQ ID NO: 2420971 - RNA, 17 nt, Bordetella pertussis
cgccgccgcggccuggc

SEQ ID NO: 2420972 - RNA, 22 nt, Bordetella pertussis
cgccgccgcguggcggcgcagc

SEQ ID NO: 2420973 - RNA, 13 nt, Bordetella pertussis
cgccgccggcaag

SEQ ID NO: 2420974 - RNA, 15 nt, Bordetella pertussis
cgccgccggcaaucg

SEQ ID NO: 2420975 - RNA, 12 nt, Bordetella pertussis
cgccgccggcac

SEQ ID NO: 2420976 - RNA, 13 nt, Bordetella pertussis
cgccgccggcagg

SEQ ID NO: 2420977 - RNA, 17 nt, Bordetella pertussis
cgccgccggcagggcca

SEQ ID NO: 2420978 - RNA, 20 nt, Bordetella pertussis
cgccgccggcagggccagcg

SEQ ID NO: 2420979 - RNA, 21 nt, Bordetella pertussis
cgccgccggcagggccagcgc

SEQ ID NO: 2420980 - RNA, 22 nt, Bordetella pertussis
cgccgccggcagggccagcgcc

SEQ ID NO: 2420981 - RNA, 12 nt, Bordetella pertussis
cgccgccggcca

SEQ ID NO: 2420982 - RNA, 14 nt, Bordetella pertussis
cgccgccggccagc

SEQ ID NO: 2420983 - RNA, 15 nt, Bordetella pertussis
cgccgccggccauca

SEQ ID NO: 2420984 - RNA, 12 nt, Bordetella pertussis
cgccgccggccc

SEQ ID NO: 2420985 - RNA, 13 nt, Bordetella pertussis
cgccgccggccca

SEQ ID NO: 2420986 - RNA, 14 nt, Bordetella pertussis
cgccgccggcccag

SEQ ID NO: 2420987 - RNA, 15 nt, Bordetella pertussis
cgccgccggcccagg

SEQ ID NO: 2420988 - RNA, 17 nt, Bordetella pertussis
cgccgccggcccgccac

SEQ ID NO: 2420989 - RNA, 14 nt, Bordetella pertussis
cgccgccggcccgg

SEQ ID NO: 2420990 - RNA, 14 nt, Bordetella pertussis
cgccgccggccugc

SEQ ID NO: 2420991 - RNA, 15 nt, Bordetella pertussis
cgccgccggccugcu

SEQ ID NO: 2420992 - RNA, 16 nt, Bordetella pertussis
cgccgccggccugcug

SEQ ID NO: 2420993 - RNA, 14 nt, Bordetella pertussis
cgccgccggcgaca

SEQ ID NO: 2420994 - RNA, 14 nt, Bordetella pertussis
cgccgccggcgcgg

SEQ ID NO: 2420995 - RNA, 13 nt, Bordetella pertussis
cgccgccggcgga

SEQ ID NO: 2420996 - RNA, 16 nt, Bordetella pertussis
cgccgccggcggccug

SEQ ID NO: 2420997 - RNA, 19 nt, Bordetella pertussis
cgccgccggcgucgcucag

SEQ ID NO: 2420998 - RNA, 13 nt, Bordetella pertussis
cgccgccgggccu

SEQ ID NO: 2420999 - RNA, 16 nt, Bordetella pertussis
cgccgccgggccugcc

SEQ ID NO: 2421000 - RNA, 12 nt, Bordetella pertussis
cgccgccgggcg

SEQ ID NO: 2421001 - RNA, 18 nt, Bordetella pertussis
cgccgccgggcgcgcgcc

SEQ ID NO: 2421002 - RNA, 19 nt, Bordetella pertussis
cgccgccgggcgcgcgccg

SEQ ID NO: 2421003 - RNA, 19 nt, Bordetella pertussis
cgccgccggucaccgccgc

SEQ ID NO: 2421004 - RNA, 17 nt, Bordetella pertussis
cgccgccggugcaccag

SEQ ID NO: 2421005 - RNA, 21 nt, Bordetella pertussis
cgccgccggugcaccaggcca

SEQ ID NO: 2421006 - RNA, 18 nt, Bordetella pertussis
cgccgccguagccgcugc

SEQ ID NO: 2421007 - RNA, 22 nt, Bordetella pertussis
cgccgccguagccgcugcgcgc

SEQ ID NO: 2421008 - RNA, 23 nt, Bordetella pertussis
cgccgccguaggacagccccagc

SEQ ID NO: 2421009 - RNA, 14 nt, Bordetella pertussis
cgccgccgucaacg

SEQ ID NO: 2421010 - RNA, 20 nt, Bordetella pertussis
cgccgccgucaacgcccagg

SEQ ID NO: 2421011 - RNA, 17 nt, Bordetella pertussis
cgccgccgugacgcuga

SEQ ID NO: 2421012 - RNA, 20 nt, Bordetella pertussis
cgccgccgugacgcugaugg

SEQ ID NO: 2421013 - RNA, 14 nt, Bordetella pertussis
cgccgccgugcgcg

SEQ ID NO: 2421014 - RNA, 23 nt, Bordetella pertussis
cgccgccgugcgcgggcgcggca

SEQ ID NO: 2421015 - RNA, 18 nt, Bordetella pertussis
cgccgccuaccagguggg

SEQ ID NO: 2421016 - RNA, 18 nt, Bordetella pertussis
cgccgccucagcccgcgu

SEQ ID NO: 2421017 - RNA, 14 nt, Bordetella pertussis
cgccgccucaggcc

SEQ ID NO: 2421018 - RNA, 17 nt, Bordetella pertussis
cgccgccucaggccggc

SEQ ID NO: 2421019 - RNA, 19 nt, Bordetella pertussis
cgccgccucaggccggcgc

SEQ ID NO: 2421020 - RNA, 23 nt, Bordetella pertussis
cgccgccucaggccggcgccugg

SEQ ID NO: 2421021 - RNA, 18 nt, Bordetella pertussis
cgccgccucgaccggcga

SEQ ID NO: 2421022 - RNA, 21 nt, Bordetella pertussis
cgccgccucgauugaccagca

SEQ ID NO: 2421023 - RNA, 22 nt, Bordetella pertussis
cgccgccucgauugaccagcac

SEQ ID NO: 2421024 - RNA, 16 nt, Bordetella pertussis
cgccgccucgcgcucc

SEQ ID NO: 2421025 - RNA, 18 nt, Bordetella pertussis
cgccgccucgcgcuccag

SEQ ID NO: 2421026 - RNA, 20 nt, Bordetella pertussis
cgccgccucgggcacggcca

SEQ ID NO: 2421027 - RNA, 22 nt, Bordetella pertussis
cgccgccucgggcacggccagc

SEQ ID NO: 2421028 - RNA, 23 nt, Bordetella pertussis
cgccgccugcgcaauucuuccuc

SEQ ID NO: 2421029 - RNA, 13 nt, Bordetella pertussis
cgccgccugcgcg

SEQ ID NO: 2421030 - RNA, 12 nt, Bordetella pertussis
cgccgccugcgg

SEQ ID NO: 2421031 - RNA, 18 nt, Bordetella pertussis
cgccgccugcggcgcggc

SEQ ID NO: 2421032 - RNA, 20 nt, Bordetella pertussis
cgccgccugcggcgcggccg

SEQ ID NO: 2421033 - RNA, 13 nt, Bordetella pertussis
cgccgccuggccc

SEQ ID NO: 2421034 - RNA, 14 nt, Bordetella pertussis
cgccgccuggccca

SEQ ID NO: 2421035 - RNA, 16 nt, Bordetella pertussis
cgccgccuggcccaca

SEQ ID NO: 2421036 - RNA, 15 nt, Bordetella pertussis
cgccgccuggcccga

SEQ ID NO: 2421037 - RNA, 18 nt, Bordetella pertussis
cgccgccuucaccggccc

SEQ ID NO: 2421038 - RNA, 17 nt, Bordetella pertussis
cgccgccuuggacgcgc

SEQ ID NO: 2421039 - RNA, 16 nt, Bordetella pertussis
cgccgcgaacuggcgg

SEQ ID NO: 2421040 - RNA, 19 nt, Bordetella pertussis
cgccgcgacaaauagccga

SEQ ID NO: 2421041 - RNA, 23 nt, Bordetella pertussis
cgccgcgacaaauagccgaccgc

SEQ ID NO: 2421042 - RNA, 19 nt, Bordetella pertussis
cgccgcgacacaaggcggc

SEQ ID NO: 2421043 - RNA, 14 nt, Bordetella pertussis
cgccgcgaccacca

SEQ ID NO: 2421044 - RNA, 16 nt, Bordetella pertussis
cgccgcgaccaccagc

SEQ ID NO: 2421045 - RNA, 16 nt, Bordetella pertussis
cgccgcgaccgggccg

SEQ ID NO: 2421046 - RNA, 15 nt, Bordetella pertussis
cgccgcgacgcucga

SEQ ID NO: 2421047 - RNA, 14 nt, Bordetella pertussis
cgccgcgaucagcg

SEQ ID NO: 2421048 - RNA, 22 nt, Bordetella pertussis
cgccgcgucaacuacacggugg

SEQ ID NO: 2421049 - RNA, 17 nt, Bordetella pertussis
cgccgcguccgcccgcu

SEQ ID NO: 2421050 - RNA, 18 nt, Bordetella pertussis
cgccgcguccgcccgcuc

SEQ ID NO: 2421051 - RNA, 23 nt, Bordetella pertussis
cgccgcguccgcccgcuccacca

SEQ ID NO: 2421052 - RNA, 13 nt, Bordetella pertussis
cgccgcguccggc

SEQ ID NO: 2421053 - RNA, 15 nt, Bordetella pertussis
cgccgcguccggcgc

SEQ ID NO: 2421054 - RNA, 16 nt, Bordetella pertussis
cgccgcguccggcgcc

SEQ ID NO: 2421055 - RNA, 20 nt, Bordetella pertussis
cgccgcguccggcgcccgcc

SEQ ID NO: 2421056 - RNA, 18 nt, Bordetella pertussis
cgccgcguccucggccug

SEQ ID NO: 2421057 - RNA, 19 nt, Bordetella pertussis
cgccgcguccucggccugg

SEQ ID NO: 2421058 - RNA, 22 nt, Bordetella pertussis
cgccgcguccucggccuggccc

SEQ ID NO: 2421059 - RNA, 18 nt, Bordetella pertussis
cgccgcgucgagcgcgac

SEQ ID NO: 2421060 - RNA, 23 nt, Bordetella pertussis
cgccgcgucgagcgcgacgcgcu

SEQ ID NO: 2421061 - RNA, 18 nt, Bordetella pertussis
cgccgcgucgcuggccgg

SEQ ID NO: 2421062 - RNA, 23 nt, Bordetella pertussis
cgccgcgucgcuggccggacgca

SEQ ID NO: 2421063 - RNA, 16 nt, Bordetella pertussis
cgccgcgucggcgccg

SEQ ID NO: 2421064 - RNA, 17 nt, Bordetella pertussis
cgccgcgucggcgccga

SEQ ID NO: 2421065 - RNA, 21 nt, Bordetella pertussis
cgccgcgucggcgccgaucag

SEQ ID NO: 2421066 - RNA, 18 nt, Bordetella pertussis
cgccgcgucgguggccag

SEQ ID NO: 2421067 - RNA, 20 nt, Bordetella pertussis
cgccgcgucgguggccagcc

SEQ ID NO: 2421068 - RNA, 17 nt, Bordetella pertussis
cgccgcguggcggcgca

SEQ ID NO: 2421069 - RNA, 20 nt, Bordetella pertussis
cgccgcguggcggcgcagcg

SEQ ID NO: 2421070 - RNA, 16 nt, Bordetella pertussis
cgccgcgugguggcgc

SEQ ID NO: 2421071 - RNA, 22 nt, Bordetella pertussis
cgccgcguucacgccggcgcgc

SEQ ID NO: 2421072 - RNA, 16 nt, Bordetella pertussis
cgccgcguugcagcca

SEQ ID NO: 2421073 - RNA, 19 nt, Bordetella pertussis
cgccgcguugcagccacag

SEQ ID NO: 2421074 - RNA, 21 nt, Bordetella pertussis
cgccgcguugcagccacaggc

SEQ ID NO: 2421075 - RNA, 14 nt, Bordetella pertussis
cgccgcuacgcggc

SEQ ID NO: 2421076 - RNA, 15 nt, Bordetella pertussis
cgccgcucagcgcgg

SEQ ID NO: 2421077 - RNA, 16 nt, Bordetella pertussis
cgccgcucagcgcggc

SEQ ID NO: 2421078 - RNA, 21 nt, Bordetella pertussis
cgccgcucagcgcggcgcggc

SEQ ID NO: 2421079 - RNA, 14 nt, Bordetella pertussis
cgccgcuccggcau

SEQ ID NO: 2421080 - RNA, 21 nt, Bordetella pertussis
cgccgcucgacgucgcccugg

SEQ ID NO: 2421081 - RNA, 14 nt, Bordetella pertussis
cgccgcucgucccc

SEQ ID NO: 2421082 - RNA, 16 nt, Bordetella pertussis
cgccgcugauggcggu

SEQ ID NO: 2421083 - RNA, 14 nt, Bordetella pertussis
cgccgcugcagcgc

SEQ ID NO: 2421084 - RNA, 16 nt, Bordetella pertussis
cgccgcugccggccga

SEQ ID NO: 2421085 - RNA, 21 nt, Bordetella pertussis
cgccgcugccggccgaccggc

SEQ ID NO: 2421086 - RNA, 22 nt, Bordetella pertussis
cgccgcugcgaaaaagcccgcg

SEQ ID NO: 2421087 - RNA, 16 nt, Bordetella pertussis
cgccgcugcgcagcag

SEQ ID NO: 2421088 - RNA, 17 nt, Bordetella pertussis
cgccgcugcgcagcagc

SEQ ID NO: 2421089 - RNA, 19 nt, Bordetella pertussis
cgccgcugcgcuugaccgc

SEQ ID NO: 2421090 - RNA, 14 nt, Bordetella pertussis
cgccgcuggccacg

SEQ ID NO: 2421091 - RNA, 15 nt, Bordetella pertussis
cgccgcuggccacgu

SEQ ID NO: 2421092 - RNA, 17 nt, Bordetella pertussis
cgccgcuggccagccgc

SEQ ID NO: 2421093 - RNA, 17 nt, Bordetella pertussis
cgccgcuggcggccgcg

SEQ ID NO: 2421094 - RNA, 22 nt, Bordetella pertussis
cgccgcuggcggccgcgggcgu

SEQ ID NO: 2421095 - RNA, 13 nt, Bordetella pertussis
cgccgcuggcguc

SEQ ID NO: 2421096 - RNA, 16 nt, Bordetella pertussis
cgccgcuggcguccag

SEQ ID NO: 2421097 - RNA, 18 nt, Bordetella pertussis
cgccgcuggcguccaggu

SEQ ID NO: 2421098 - RNA, 18 nt, Bordetella pertussis
cgccgcuggcgucgcgcu

SEQ ID NO: 2421099 - RNA, 12 nt, Bordetella pertussis
cgccgcugucga

SEQ ID NO: 2421100 - RNA, 21 nt, Bordetella pertussis
cgccgcugucggucagcacuu

SEQ ID NO: 2421101 - RNA, 21 nt, Bordetella pertussis
cgccgcuguggacgccgccgg

SEQ ID NO: 2421102 - RNA, 22 nt, Bordetella pertussis
cgccgcuguggacgccgccggc

SEQ ID NO: 2421103 - RNA, 18 nt, Bordetella pertussis
cgccgcuguugcccacca

SEQ ID NO: 2421104 - RNA, 19 nt, Bordetella pertussis
cgccgcuguugcccaccag

SEQ ID NO: 2421105 - RNA, 17 nt, Bordetella pertussis
cgccgcuuccaccgucu

SEQ ID NO: 2421106 - RNA, 15 nt, Bordetella pertussis
cgccgcuuccggcau

SEQ ID NO: 2421107 - RNA, 21 nt, Bordetella pertussis
cgccgcuuccggcaugaccgc

SEQ ID NO: 2421108 - RNA, 15 nt, Bordetella pertussis
cgccgcuuccggccg

SEQ ID NO: 2421109 - RNA, 16 nt, Bordetella pertussis
cgccgcuuccggccgg

SEQ ID NO: 2421110 - RNA, 21 nt, Bordetella pertussis
cgccgcuugcguucaugccgg

SEQ ID NO: 2421111 - RNA, 17 nt, Bordetella pertussis
cgccgcuuucgaccuug

SEQ ID NO: 2421112 - RNA, 23 nt, Bordetella pertussis
cgccgcuuucgaccuugcugacg

SEQ ID NO: 2421113 - RNA, 15 nt, Bordetella pertussis
cgccgcuuucucccg

SEQ ID NO: 2421114 - RNA, 20 nt, Bordetella pertussis
cgccgcuuucucccgccgcu

SEQ ID NO: 2421115 - RNA, 21 nt, Bordetella pertussis
cgccgcuuucucccgccgcuu

SEQ ID NO: 2421116 - RNA, 21 nt, Bordetella pertussis
cgccggaaagcuguccacgcc

SEQ ID NO: 2421117 - RNA, 22 nt, Bordetella pertussis
cgccggaaagcuguccacgccg

SEQ ID NO: 2421118 - RNA, 17 nt, Bordetella pertussis
cgccggacagcugcggg

SEQ ID NO: 2421119 - RNA, 14 nt, Bordetella pertussis
cgccggacaucagc

SEQ ID NO: 2421120 - RNA, 13 nt, Bordetella pertussis
cgccggacggcgc

SEQ ID NO: 2421121 - RNA, 19 nt, Bordetella pertussis
cgccggacguagucgcacg

SEQ ID NO: 2421122 - RNA, 23 nt, Bordetella pertussis
cgccggacguagucgcacgcggc

SEQ ID NO: 2421123 - RNA, 13 nt, Bordetella pertussis
cgccggacugggc

SEQ ID NO: 2421124 - RNA, 19 nt, Bordetella pertussis
cgccggacugggcgucgcu

SEQ ID NO: 2421125 - RNA, 19 nt, Bordetella pertussis
cgccggacuugaaucccga

SEQ ID NO: 2421126 - RNA, 13 nt, Bordetella pertussis
cgccggaggcgcg

SEQ ID NO: 2421127 - RNA, 16 nt, Bordetella pertussis
cgccggaggcgcgcag

SEQ ID NO: 2421128 - RNA, 18 nt, Bordetella pertussis
cgccggaggcgcgcagcu

SEQ ID NO: 2421129 - RNA, 16 nt, Bordetella pertussis
cgccggaucggccggc

SEQ ID NO: 2421130 - RNA, 16 nt, Bordetella pertussis
cgccggaugcgcgugg

SEQ ID NO: 2421131 - RNA, 20 nt, Bordetella pertussis
cgccggaugcgcguggcgcg

SEQ ID NO: 2421132 - RNA, 13 nt, Bordetella pertussis
cgccggauugacg

SEQ ID NO: 2421133 - RNA, 18 nt, Bordetella pertussis
cgccggauugacguccau

SEQ ID NO: 2421134 - RNA, 16 nt, Bordetella pertussis
cgccggcaaacccggc

SEQ ID NO: 2421135 - RNA, 20 nt, Bordetella pertussis
cgccggcaagggucccagcu

SEQ ID NO: 2421136 - RNA, 22 nt, Bordetella pertussis
cgccggcaaucgaaaagcccgc

SEQ ID NO: 2421137 - RNA, 18 nt, Bordetella pertussis
cgccggcaccagcgccac

SEQ ID NO: 2421138 - RNA, 13 nt, Bordetella pertussis
cgccggcacccgg

SEQ ID NO: 2421139 - RNA, 17 nt, Bordetella pertussis
cgccggcacccggcuca

SEQ ID NO: 2421140 - RNA, 13 nt, Bordetella pertussis
cgccggcacgcug

SEQ ID NO: 2421141 - RNA, 23 nt, Bordetella pertussis
cgccggcagccccagcgcccagg

SEQ ID NO: 2421142 - RNA, 16 nt, Bordetella pertussis
cgccggcaggcgcgcc

SEQ ID NO: 2421143 - RNA, 20 nt, Bordetella pertussis
cgccggcaggcgcgccagcc

SEQ ID NO: 2421144 - RNA, 12 nt, Bordetella pertussis
cgccggcagggc

SEQ ID NO: 2421145 - RNA, 17 nt, Bordetella pertussis
cgccggcagggccagcg

SEQ ID NO: 2421146 - RNA, 20 nt, Bordetella pertussis
cgccggcagggccagcgcca

SEQ ID NO: 2421147 - RNA, 13 nt, Bordetella pertussis
cgccggcagggcg

SEQ ID NO: 2421148 - RNA, 15 nt, Bordetella pertussis
cgccggcagggcggc

SEQ ID NO: 2421149 - RNA, 18 nt, Bordetella pertussis
cgccggcagggcggccag

SEQ ID NO: 2421150 - RNA, 16 nt, Bordetella pertussis
cgccggcaucggcggc

SEQ ID NO: 2421151 - RNA, 21 nt, Bordetella pertussis
cgccggcaugaagcgcagcag

SEQ ID NO: 2421152 - RNA, 15 nt, Bordetella pertussis
cgccggcauggucga

SEQ ID NO: 2421153 - RNA, 18 nt, Bordetella pertussis
cgccggcauggucgauga

SEQ ID NO: 2421154 - RNA, 17 nt, Bordetella pertussis
cgccggcauguugccgc

SEQ ID NO: 2421155 - RNA, 19 nt, Bordetella pertussis
cgccggcauguugccgcug

SEQ ID NO: 2421156 - RNA, 11 nt, Bordetella pertussis
cgccggccacc

SEQ ID NO: 2421157 - RNA, 12 nt, Bordetella pertussis
cgccggccacca

SEQ ID NO: 2421158 - RNA, 13 nt, Bordetella pertussis
cgccggccaccgc

SEQ ID NO: 2421159 - RNA, 14 nt, Bordetella pertussis
cgccggccaccgcc

SEQ ID NO: 2421160 - RNA, 12 nt, Bordetella pertussis
cgccggccacga

SEQ ID NO: 2421161 - RNA, 14 nt, Bordetella pertussis
cgccggcggccugg

SEQ ID NO: 2421162 - RNA, 16 nt, Bordetella pertussis
cgccggcggccuggac

SEQ ID NO: 2421163 - RNA, 17 nt, Bordetella pertussis
cgccggcggccuggacc

SEQ ID NO: 2421164 - RNA, 21 nt, Bordetella pertussis
cgccggcggcgaugcgggcca

SEQ ID NO: 2421165 - RNA, 13 nt, Bordetella pertussis
cgccggcggcgca

SEQ ID NO: 2421166 - RNA, 16 nt, Bordetella pertussis
cgccggcggcgcacca

SEQ ID NO: 2421167 - RNA, 16 nt, Bordetella pertussis
cgccggcggcgccggc

SEQ ID NO: 2421168 - RNA, 18 nt, Bordetella pertussis
cgccggcggcgccggccu

SEQ ID NO: 2421169 - RNA, 16 nt, Bordetella pertussis
cgccggcggcgcuggc

SEQ ID NO: 2421170 - RNA, 18 nt, Bordetella pertussis
cgccggcggcgcuggcga

SEQ ID NO: 2421171 - RNA, 20 nt, Bordetella pertussis
cgccggcggcggucagcgaa

SEQ ID NO: 2421172 - RNA, 14 nt, Bordetella pertussis
cgccggcggcgucg

SEQ ID NO: 2421173 - RNA, 23 nt, Bordetella pertussis
cgccggcggcgucggcgcccggc

SEQ ID NO: 2421174 - RNA, 14 nt, Bordetella pertussis
cgccggcggcgugc

SEQ ID NO: 2421175 - RNA, 16 nt, Bordetella pertussis
cgccggcggcgugccc

SEQ ID NO: 2421176 - RNA, 23 nt, Bordetella pertussis
cgccggcggcgugcccugcggcg

SEQ ID NO: 2421177 - RNA, 15 nt, Bordetella pertussis
cgccggcggcgugcg

SEQ ID NO: 2421178 - RNA, 17 nt, Bordetella pertussis
cgccggcggcguggccg

SEQ ID NO: 2421179 - RNA, 19 nt, Bordetella pertussis
cgccggcgggcaacuucac

SEQ ID NO: 2421180 - RNA, 17 nt, Bordetella pertussis
cgccggcgggcaggcgg

SEQ ID NO: 2421181 - RNA, 21 nt, Bordetella pertussis
cgccggcgggcaggcgggcca

SEQ ID NO: 2421182 - RNA, 14 nt, Bordetella pertussis
cgccggcgggcgcu

SEQ ID NO: 2421183 - RNA, 17 nt, Bordetella pertussis
cgccggcgggcgcugcc

SEQ ID NO: 2421184 - RNA, 15 nt, Bordetella pertussis
cgccggcgguaagcg

SEQ ID NO: 2421185 - RNA, 22 nt, Bordetella pertussis
cgccggcgguaagcguccgcgc

SEQ ID NO: 2421186 - RNA, 15 nt, Bordetella pertussis
cgccggcggucacgc

SEQ ID NO: 2421187 - RNA, 17 nt, Bordetella pertussis
cgccggcggucacgccg

SEQ ID NO: 2421188 - RNA, 23 nt, Bordetella pertussis
cgccggcguagucguugccggcc

SEQ ID NO: 2421189 - RNA, 15 nt, Bordetella pertussis
cgccggcgucacgcg

SEQ ID NO: 2421190 - RNA, 19 nt, Bordetella pertussis
cgccggcgucacgcggccg

SEQ ID NO: 2421191 - RNA, 13 nt, Bordetella pertussis
cgccggcgugccc

SEQ ID NO: 2421192 - RNA, 17 nt, Bordetella pertussis
cgccggcuaccgcgcca

SEQ ID NO: 2421193 - RNA, 17 nt, Bordetella pertussis
cgccggcucagcccccc

SEQ ID NO: 2421194 - RNA, 15 nt, Bordetella pertussis
cgccggcucaggcca

SEQ ID NO: 2421195 - RNA, 17 nt, Bordetella pertussis
cgccggcucaggccagc

SEQ ID NO: 2421196 - RNA, 19 nt, Bordetella pertussis
cgccggcucaggccagcga

SEQ ID NO: 2421197 - RNA, 20 nt, Bordetella pertussis
cgccggcucaggccagcgac

SEQ ID NO: 2421198 - RNA, 21 nt, Bordetella pertussis
cgccggcucaggccagcgacc

SEQ ID NO: 2421199 - RNA, 15 nt, Bordetella pertussis
cgccggcucccgcgc

SEQ ID NO: 2421200 - RNA, 16 nt, Bordetella pertussis
cgccggcucccgcgcu

SEQ ID NO: 2421201 - RNA, 17 nt, Bordetella pertussis
cgccggcucccgcgcug

SEQ ID NO: 2421202 - RNA, 20 nt, Bordetella pertussis
cgccggcucccgcgcugccg

SEQ ID NO: 2421203 - RNA, 21 nt, Bordetella pertussis
cgccggcucccgcgcugccgc

SEQ ID NO: 2421204 - RNA, 21 nt, Bordetella pertussis
cgccggcuccgauagcggcgc

SEQ ID NO: 2421205 - RNA, 24 nt, Bordetella pertussis
cgccggcuccgauagcggcgccgc

SEQ ID NO: 2421206 - RNA, 20 nt, Bordetella pertussis
cgccggcucgaacaggcugg

SEQ ID NO: 2421207 - RNA, 16 nt, Bordetella pertussis
cgccggcucguacggc

SEQ ID NO: 2421208 - RNA, 20 nt, Bordetella pertussis
cgccggcugaauuggcgccc

SEQ ID NO: 2421209 - RNA, 15 nt, Bordetella pertussis
cgccggcuggcaugc

SEQ ID NO: 2421210 - RNA, 15 nt, Bordetella pertussis
cgccggcuuccagca

SEQ ID NO: 2421211 - RNA, 17 nt, Bordetella pertussis
cgccggcuuccagcagc

SEQ ID NO: 2421212 - RNA, 20 nt, Bordetella pertussis
cgccggcuucgucauggucg

SEQ ID NO: 2421213 - RNA, 13 nt, Bordetella pertussis
cgccggcuugcgc

SEQ ID NO: 2421214 - RNA, 14 nt, Bordetella pertussis
cgccggcuugcgcc

SEQ ID NO: 2421215 - RNA, 17 nt, Bordetella pertussis
cgccggcuugcgccagc

SEQ ID NO: 2421216 - RNA, 19 nt, Bordetella pertussis
cgccggcuugcgccagcca

SEQ ID NO: 2421217 - RNA, 20 nt, Bordetella pertussis
cgccggcuugcgccagccac

SEQ ID NO: 2421218 - RNA, 18 nt, Bordetella pertussis
cgccggcuuucagcgccg

SEQ ID NO: 2421219 - RNA, 19 nt, Bordetella pertussis
cgccggcuuucagcgccga

SEQ ID NO: 2421220 - RNA, 21 nt, Bordetella pertussis
cgccggcuuucagcgccgagc

SEQ ID NO: 2421221 - RNA, 13 nt, Bordetella pertussis
cgccgggacaggc

SEQ ID NO: 2421222 - RNA, 15 nt, Bordetella pertussis
cgccgggacaggcac

SEQ ID NO: 2421223 - RNA, 12 nt, Bordetella pertussis
cgccgggacgga

SEQ ID NO: 2421224 - RNA, 14 nt, Bordetella pertussis
cgccgggcagcccg

SEQ ID NO: 2421225 - RNA, 15 nt, Bordetella pertussis
cgccgggcagcccgc

SEQ ID NO: 2421226 - RNA, 16 nt, Bordetella pertussis
cgccgggcagcccgcg

SEQ ID NO: 2421227 - RNA, 23 nt, Bordetella pertussis
cgccgggcagcgggccgcagcau

SEQ ID NO: 2421228 - RNA, 18 nt, Bordetella pertussis
cgccgggcaugcaccagg

SEQ ID NO: 2421229 - RNA, 20 nt, Bordetella pertussis
cgccgggcauugccggagca

SEQ ID NO: 2421230 - RNA, 24 nt, Bordetella pertussis
cgccgggccagaccuggugaucgc

SEQ ID NO: 2421231 - RNA, 17 nt, Bordetella pertussis
cgccgggcccggccacg

SEQ ID NO: 2421232 - RNA, 21 nt, Bordetella pertussis
cgccgggcccggccacggccg

SEQ ID NO: 2421233 - RNA, 14 nt, Bordetella pertussis
cgccgggccgcgac

SEQ ID NO: 2421234 - RNA, 17 nt, Bordetella pertussis
cgccgggccgcgcccac

SEQ ID NO: 2421235 - RNA, 15 nt, Bordetella pertussis
cgccgggccgcgccg

SEQ ID NO: 2421236 - RNA, 16 nt, Bordetella pertussis
cgccgggccgcgccgc

SEQ ID NO: 2421237 - RNA, 17 nt, Bordetella pertussis
cgccgggccggcgggca

SEQ ID NO: 2421238 - RNA, 17 nt, Bordetella pertussis
cgccgggccgucgugcg

SEQ ID NO: 2421239 - RNA, 21 nt, Bordetella pertussis
cgccgggcgaaccgguggcca

SEQ ID NO: 2421240 - RNA, 14 nt, Bordetella pertussis
cgccgggcgacggc

SEQ ID NO: 2421241 - RNA, 14 nt, Bordetella pertussis
cgccgggcgcgccg

SEQ ID NO: 2421242 - RNA, 15 nt, Bordetella pertussis
cgccgggcgcgccgg

SEQ ID NO: 2421243 - RNA, 18 nt, Bordetella pertussis
cgccgggcgcgccggcgg

SEQ ID NO: 2421244 - RNA, 13 nt, Bordetella pertussis
cgccgggcgcgcg

SEQ ID NO: 2421245 - RNA, 16 nt, Bordetella pertussis
cgccgggcgcgcgccg

SEQ ID NO: 2421246 - RNA, 17 nt, Bordetella pertussis
cgccgggcgcgcgccgg

SEQ ID NO: 2421247 - RNA, 22 nt, Bordetella pertussis
cgccgggcgcgcgccggcggcc

SEQ ID NO: 2421248 - RNA, 12 nt, Bordetella pertussis
cgccgggcgcgg

SEQ ID NO: 2421249 - RNA, 15 nt, Bordetella pertussis
cgccgggcgcggcca

SEQ ID NO: 2421250 - RNA, 17 nt, Bordetella pertussis
cgccgggcgcggccagg

SEQ ID NO: 2421251 - RNA, 20 nt, Bordetella pertussis
cgccgggcgcggccaggcgc

SEQ ID NO: 2421252 - RNA, 22 nt, Bordetella pertussis
cgccgggcgcggcccggcgucg

SEQ ID NO: 2421253 - RNA, 15 nt, Bordetella pertussis
cgccgggcgcggccg

SEQ ID NO: 2421254 - RNA, 19 nt, Bordetella pertussis
cgccgggcgcggccgccgc

SEQ ID NO: 2421255 - RNA, 17 nt, Bordetella pertussis
cgccgggcggaucgccg

SEQ ID NO: 2421256 - RNA, 16 nt, Bordetella pertussis
cgccgggcggcgccgu

SEQ ID NO: 2421257 - RNA, 15 nt, Bordetella pertussis
cgccgggcggcgcgg

SEQ ID NO: 2421258 - RNA, 18 nt, Bordetella pertussis
cgccgggcggcgcgggcg

SEQ ID NO: 2421259 - RNA, 20 nt, Bordetella pertussis
cgccgggcggcgcgggcggc

SEQ ID NO: 2421260 - RNA, 18 nt, Bordetella pertussis
cgccgggcgggucggcga

SEQ ID NO: 2421261 - RNA, 21 nt, Bordetella pertussis
cgccgggcuccucgcccgacc

SEQ ID NO: 2421262 - RNA, 20 nt, Bordetella pertussis
cgccgggcuggauccggcgc

SEQ ID NO: 2421263 - RNA, 16 nt, Bordetella pertussis
cgccgggcuguccgcc

SEQ ID NO: 2421264 - RNA, 17 nt, Bordetella pertussis
cgccgggcuguccgcca

SEQ ID NO: 2421265 - RNA, 19 nt, Bordetella pertussis
cgccgggcuguccgccacc

SEQ ID NO: 2421266 - RNA, 22 nt, Bordetella pertussis
cgccggggaggccucgacgcug

SEQ ID NO: 2421267 - RNA, 17 nt, Bordetella pertussis
cgccggggcgccggugu

SEQ ID NO: 2421268 - RNA, 15 nt, Bordetella pertussis
cgccggggcggcgca

SEQ ID NO: 2421269 - RNA, 17 nt, Bordetella pertussis
cgccggggcggcgcagc

SEQ ID NO: 2421270 - RNA, 19 nt, Bordetella pertussis
cgccggggcggcgcagcau

SEQ ID NO: 2421271 - RNA, 21 nt, Bordetella pertussis
cgccggggcggcggcgcccgc

SEQ ID NO: 2421272 - RNA, 22 nt, Bordetella pertussis
cgccggggcggcggcgcccgca

SEQ ID NO: 2421273 - RNA, 14 nt, Bordetella pertussis
cgccggggcggcuc

SEQ ID NO: 2421274 - RNA, 17 nt, Bordetella pertussis
cgccgucgcccuggcgg

SEQ ID NO: 2421275 - RNA, 18 nt, Bordetella pertussis
cgccgucgcccuggcggc

SEQ ID NO: 2421276 - RNA, 14 nt, Bordetella pertussis
cgccgucgcgcugu

SEQ ID NO: 2421277 - RNA, 19 nt, Bordetella pertussis
cgccgucgcgcuguuccag

SEQ ID NO: 2421278 - RNA, 20 nt, Bordetella pertussis
cgccgucgcggaccuccugg

SEQ ID NO: 2421279 - RNA, 15 nt, Bordetella pertussis
cgccgucgcuggggc

SEQ ID NO: 2421280 - RNA, 16 nt, Bordetella pertussis
cgccgucgcuggggcg

SEQ ID NO: 2421281 - RNA, 13 nt, Bordetella pertussis
cgccgucgggggc

SEQ ID NO: 2421282 - RNA, 14 nt, Bordetella pertussis
cgccgucggggugg

SEQ ID NO: 2421283 - RNA, 16 nt, Bordetella pertussis
cgccgucguugacggg

SEQ ID NO: 2421284 - RNA, 18 nt, Bordetella pertussis
cgccgucguugacgggga

SEQ ID NO: 2421285 - RNA, 14 nt, Bordetella pertussis
cgccgucugcgccg

SEQ ID NO: 2421286 - RNA, 15 nt, Bordetella pertussis
cgccgucugcgccgc

SEQ ID NO: 2421287 - RNA, 22 nt, Bordetella pertussis
cgccgucugcgccgccgcgugg

SEQ ID NO: 2421288 - RNA, 18 nt, Bordetella pertussis
cgccgucugugcgccccg

SEQ ID NO: 2421289 - RNA, 19 nt, Bordetella pertussis
cgccgucugugcgccccgc

SEQ ID NO: 2421290 - RNA, 23 nt, Bordetella pertussis
cgccgucugugcgccccgcuggc

SEQ ID NO: 2421291 - RNA, 16 nt, Bordetella pertussis
cgccgucuucgguggc

SEQ ID NO: 2421292 - RNA, 19 nt, Bordetella pertussis
cgccgugaaugcgccuggc

SEQ ID NO: 2421293 - RNA, 18 nt, Bordetella pertussis
cgccgugacgcugauggc

SEQ ID NO: 2421294 - RNA, 23 nt, Bordetella pertussis
cgccgugacuucggccgccagcc

SEQ ID NO: 2421295 - RNA, 24 nt, Bordetella pertussis
cgccgugacuucggccgccagccg

SEQ ID NO: 2421296 - RNA, 16 nt, Bordetella pertussis
cgccgugaugccgccc

SEQ ID NO: 2421297 - RNA, 17 nt, Bordetella pertussis
cgccgugaugccgcccg

SEQ ID NO: 2421298 - RNA, 19 nt, Bordetella pertussis
cgccgugaugccgcccgca

SEQ ID NO: 2421299 - RNA, 23 nt, Bordetella pertussis
cgccgugaugccgcccgcaugca

SEQ ID NO: 2421300 - RNA, 15 nt, Bordetella pertussis
cgccgugcagacggc

SEQ ID NO: 2421301 - RNA, 17 nt, Bordetella pertussis
cgccgugcagacggcgg

SEQ ID NO: 2421302 - RNA, 18 nt, Bordetella pertussis
cgccgugcagacggcggc

SEQ ID NO: 2421303 - RNA, 21 nt, Bordetella pertussis
cgccgugcagacggcggcugg

SEQ ID NO: 2421304 - RNA, 14 nt, Bordetella pertussis
cgccgugcagggcc

SEQ ID NO: 2421305 - RNA, 15 nt, Bordetella pertussis
cgccgugcagggcca

SEQ ID NO: 2421306 - RNA, 17 nt, Bordetella pertussis
cgccgugcagggccagg

SEQ ID NO: 2421307 - RNA, 14 nt, Bordetella pertussis
cgccgugcccggcg

SEQ ID NO: 2421308 - RNA, 17 nt, Bordetella pertussis
cgccgugcccggcgggc

SEQ ID NO: 2421309 - RNA, 19 nt, Bordetella pertussis
cgccgugcccggcgggccg

SEQ ID NO: 2421310 - RNA, 15 nt, Bordetella pertussis
cgccgugccgggccu

SEQ ID NO: 2421311 - RNA, 17 nt, Bordetella pertussis
cgccgugcgagcacggc

SEQ ID NO: 2421312 - RNA, 21 nt, Bordetella pertussis
cgccgugcgagcacggcgugg

SEQ ID NO: 2421313 - RNA, 14 nt, Bordetella pertussis
cgccgugcgcgggc

SEQ ID NO: 2421314 - RNA, 22 nt, Bordetella pertussis
cgccgugcgcgggcgcggcagg

SEQ ID NO: 2421315 - RNA, 23 nt, Bordetella pertussis
cgccgugcgcgggcgcggcaggc

SEQ ID NO: 2421316 - RNA, 13 nt, Bordetella pertussis
cgccgugcugauc

SEQ ID NO: 2421317 - RNA, 21 nt, Bordetella pertussis
cgccgugcuggaggugccguc

SEQ ID NO: 2421318 - RNA, 14 nt, Bordetella pertussis
cgccgugcugggcg

SEQ ID NO: 2421319 - RNA, 16 nt, Bordetella pertussis
cgccgugcugggcggc

SEQ ID NO: 2421320 - RNA, 20 nt, Bordetella pertussis
cgccgugcugggcggccagg

SEQ ID NO: 2421321 - RNA, 13 nt, Bordetella pertussis
cgccgugcuguac

SEQ ID NO: 2421322 - RNA, 20 nt, Bordetella pertussis
cgccguggccaagggcgccg

SEQ ID NO: 2421323 - RNA, 21 nt, Bordetella pertussis
cgccguggccaagggcgccgc

SEQ ID NO: 2421324 - RNA, 14 nt, Bordetella pertussis
cgccguggccggca

SEQ ID NO: 2421325 - RNA, 14 nt, Bordetella pertussis
cgccguggugcuga

SEQ ID NO: 2421326 - RNA, 20 nt, Bordetella pertussis
cgccguggugcugaccggcu

SEQ ID NO: 2421327 - RNA, 21 nt, Bordetella pertussis
cgccguggugcugaccggcuu

SEQ ID NO: 2421328 - RNA, 17 nt, Bordetella pertussis
cgccguguaggcggucu

SEQ ID NO: 2421329 - RNA, 16 nt, Bordetella pertussis
cgccguguuguccugg

SEQ ID NO: 2421330 - RNA, 17 nt, Bordetella pertussis
cgccguguuguccugga

SEQ ID NO: 2421331 - RNA, 19 nt, Bordetella pertussis
cgccguucagggacgggcc

SEQ ID NO: 2421332 - RNA, 23 nt, Bordetella pertussis
cgccguucagggacgggccagcc

SEQ ID NO: 2421333 - RNA, 19 nt, Bordetella pertussis
cgccguuccugcagcgugc

SEQ ID NO: 2421334 - RNA, 14 nt, Bordetella pertussis
cgccguucgucgcg

SEQ ID NO: 2421335 - RNA, 16 nt, Bordetella pertussis
cgccguucgucgcgca

SEQ ID NO: 2421336 - RNA, 20 nt, Bordetella pertussis
cgccguucgucgcgcagcag

SEQ ID NO: 2421337 - RNA, 18 nt, Bordetella pertussis
cgccguucuggcugcgcg

SEQ ID NO: 2421338 - RNA, 14 nt, Bordetella pertussis
cgccguugcggccc

SEQ ID NO: 2421339 - RNA, 15 nt, Bordetella pertussis
cgccguugcggcccg

SEQ ID NO: 2421340 - RNA, 20 nt, Bordetella pertussis
cgccguugcggcccgccgac

SEQ ID NO: 2421341 - RNA, 23 nt, Bordetella pertussis
cgccguugcggcccgccgacugg

SEQ ID NO: 2421342 - RNA, 21 nt, Bordetella pertussis
cgccguugcgggcugcgcggg

SEQ ID NO: 2421343 - RNA, 16 nt, Bordetella pertussis
cgccguugcucgcgcg

SEQ ID NO: 2421344 - RNA, 18 nt, Bordetella pertussis
cgccguugcucgcgcgca

SEQ ID NO: 2421345 - RNA, 19 nt, Bordetella pertussis
cgccguugucgacgaucag

SEQ ID NO: 2421346 - RNA, 16 nt, Bordetella pertussis
cgccguuuucagcgca

SEQ ID NO: 2421347 - RNA, 21 nt, Bordetella pertussis
cgccguuuucagcgcaggcug

SEQ ID NO: 2421348 - RNA, 24 nt, Bordetella pertussis
cgccguuuuuuucguugcauugca

SEQ ID NO: 2421349 - RNA, 14 nt, Bordetella pertussis
cgccuacacggugg

SEQ ID NO: 2421350 - RNA, 16 nt, Bordetella pertussis
cgccuacacgguggcg

SEQ ID NO: 2421351 - RNA, 18 nt, Bordetella pertussis
cgccuacacgguggcggu

SEQ ID NO: 2421352 - RNA, 19 nt, Bordetella pertussis
cgccuacagcagcggcucg

SEQ ID NO: 2421353 - RNA, 17 nt, Bordetella pertussis
cgccuaccaggugggcg

SEQ ID NO: 2421354 - RNA, 22 nt, Bordetella pertussis
cgccuaccaggugggcgcgcuc

SEQ ID NO: 2421355 - RNA, 15 nt, Bordetella pertussis
cgccuaccggcgccg

SEQ ID NO: 2421356 - RNA, 14 nt, Bordetella pertussis
cgccuacuggcgcg

SEQ ID NO: 2421357 - RNA, 16 nt, Bordetella pertussis
cgccuauguaggcgcc

SEQ ID NO: 2421358 - RNA, 17 nt, Bordetella pertussis
cgccuauguaggcgccg

SEQ ID NO: 2421359 - RNA, 19 nt, Bordetella pertussis
cgccuauguaggcgccgcg

SEQ ID NO: 2421360 - RNA, 23 nt, Bordetella pertussis
cgccuauguaggcgccgcgcccg

SEQ ID NO: 2421361 - RNA, 21 nt, Bordetella pertussis
cgccuauugcgacgccgccga

SEQ ID NO: 2421362 - RNA, 22 nt, Bordetella pertussis
cgccuauuuccagggcgucgcg

SEQ ID NO: 2421363 - RNA, 15 nt, Bordetella pertussis
cgccucaccgcgccg

SEQ ID NO: 2421364 - RNA, 18 nt, Bordetella pertussis
cgccucaccgcgccgggc

SEQ ID NO: 2421365 - RNA, 19 nt, Bordetella pertussis
cgccucagcguuuccaggg

SEQ ID NO: 2421366 - RNA, 19 nt, Bordetella pertussis
cgccucaggccggcgccug

SEQ ID NO: 2421367 - RNA, 14 nt, Bordetella pertussis
cgccuccagcgcgg

SEQ ID NO: 2421368 - RNA, 22 nt, Bordetella pertussis
cgccuccaggaugagcgccugc

SEQ ID NO: 2421369 - RNA, 12 nt, Bordetella pertussis
cgccuccaggcg

SEQ ID NO: 2421370 - RNA, 21 nt, Bordetella pertussis
cgccuccaucagcagcaccuu

SEQ ID NO: 2421371 - RNA, 22 nt, Bordetella pertussis
cgccucccauugcgcggccagg

SEQ ID NO: 2421372 - RNA, 17 nt, Bordetella pertussis
cgccuccccaggccagc

SEQ ID NO: 2421373 - RNA, 20 nt, Bordetella pertussis
cgccucgaacguccgcccca

SEQ ID NO: 2421374 - RNA, 18 nt, Bordetella pertussis
cgccucgaagaccucggc

SEQ ID NO: 2421375 - RNA, 21 nt, Bordetella pertussis
cgccucgaagaccucggcgcu

SEQ ID NO: 2421376 - RNA, 23 nt, Bordetella pertussis
cgccucgaagaccucggcgcuca

SEQ ID NO: 2421377 - RNA, 14 nt, Bordetella pertussis
cgccucgaccggcg

SEQ ID NO: 2421378 - RNA, 16 nt, Bordetella pertussis
cgccucgaccggcgaa

SEQ ID NO: 2421379 - RNA, 21 nt, Bordetella pertussis
cgccucgacgaugcccugcgc

SEQ ID NO: 2421380 - RNA, 14 nt, Bordetella pertussis
cgccucgacgcccg

SEQ ID NO: 2421381 - RNA, 17 nt, Bordetella pertussis
cgccucgacgcccgggc

SEQ ID NO: 2421382 - RNA, 20 nt, Bordetella pertussis
cgccucgacgcccgggcggc

SEQ ID NO: 2421383 - RNA, 20 nt, Bordetella pertussis
cgccucgaguuugcggucca

SEQ ID NO: 2421384 - RNA, 15 nt, Bordetella pertussis
cgccucgaucgccag

SEQ ID NO: 2421385 - RNA, 16 nt, Bordetella pertussis
cgccucgaucgccagg

SEQ ID NO: 2421386 - RNA, 14 nt, Bordetella pertussis
cgccugcguggcgg

SEQ ID NO: 2421387 - RNA, 21 nt, Bordetella pertussis
cgccugcguggcgggccgcgc

SEQ ID NO: 2421388 - RNA, 20 nt, Bordetella pertussis
cgccugcguugcgaucagcg

SEQ ID NO: 2421389 - RNA, 16 nt, Bordetella pertussis
cgccugcucacgcccc

SEQ ID NO: 2421390 - RNA, 17 nt, Bordetella pertussis
cgccugcucacgccccg

SEQ ID NO: 2421391 - RNA, 19 nt, Bordetella pertussis
cgccugcucguacagcggc

SEQ ID NO: 2421392 - RNA, 11 nt, Bordetella pertussis
cgccugcugcg

SEQ ID NO: 2421393 - RNA, 14 nt, Bordetella pertussis
cgccugcugcgccg

SEQ ID NO: 2421394 - RNA, 19 nt, Bordetella pertussis
cgccugcugcgccgucugu

SEQ ID NO: 2421395 - RNA, 22 nt, Bordetella pertussis
cgccugcugcgccgucugugcg

SEQ ID NO: 2421396 - RNA, 16 nt, Bordetella pertussis
cgccugcugcgccugg

SEQ ID NO: 2421397 - RNA, 20 nt, Bordetella pertussis
cgccugcugcgccuggccgc

SEQ ID NO: 2421398 - RNA, 14 nt, Bordetella pertussis
cgccugcugggccg

SEQ ID NO: 2421399 - RNA, 19 nt, Bordetella pertussis
cgccugcugggccgcgcuc

SEQ ID NO: 2421400 - RNA, 20 nt, Bordetella pertussis
cgccugcugggccgcgcucg

SEQ ID NO: 2421401 - RNA, 16 nt, Bordetella pertussis
cgccugcuggucggcg

SEQ ID NO: 2421402 - RNA, 14 nt, Bordetella pertussis
cgccuggaccggcu

SEQ ID NO: 2421403 - RNA, 13 nt, Bordetella pertussis
cgccuggaccugg

SEQ ID NO: 2421404 - RNA, 14 nt, Bordetella pertussis
cgccuggcacgacg

SEQ ID NO: 2421405 - RNA, 21 nt, Bordetella pertussis
cgccuggccagauagcccagg

SEQ ID NO: 2421406 - RNA, 13 nt, Bordetella pertussis
cgccuggcccaug

SEQ ID NO: 2421407 - RNA, 17 nt, Bordetella pertussis
cgccuggcccgaacggc

SEQ ID NO: 2421408 - RNA, 19 nt, Bordetella pertussis
cgccuggcccgaacggccc

SEQ ID NO: 2421409 - RNA, 15 nt, Bordetella pertussis
cgccuggccgagcgc

SEQ ID NO: 2421410 - RNA, 14 nt, Bordetella pertussis
cgccuggccgccca

SEQ ID NO: 2421411 - RNA, 16 nt, Bordetella pertussis
cgccuggccgcccagc

SEQ ID NO: 2421412 - RNA, 17 nt, Bordetella pertussis
cgccuggccgcccagcg

SEQ ID NO: 2421413 - RNA, 22 nt, Bordetella pertussis
cgccuggccgcccagcgccugc

SEQ ID NO: 2421414 - RNA, 13 nt, Bordetella pertussis
cgccuggccgcgc

SEQ ID NO: 2421415 - RNA, 15 nt, Bordetella pertussis
cgccuggccgcgcug

SEQ ID NO: 2421416 - RNA, 15 nt, Bordetella pertussis
cgccuggccggcuug

SEQ ID NO: 2421417 - RNA, 22 nt, Bordetella pertussis
cgccuggccuucgcugcccugg

SEQ ID NO: 2421418 - RNA, 22 nt, Bordetella pertussis
cgccuggcgcaugacggcgucg

SEQ ID NO: 2421419 - RNA, 17 nt, Bordetella pertussis
cgccuggcgccgcgccc

SEQ ID NO: 2421420 - RNA, 18 nt, Bordetella pertussis
cgccuggcgccgcgcccg

SEQ ID NO: 2421421 - RNA, 15 nt, Bordetella pertussis
cgccuggcgcgccca

SEQ ID NO: 2421422 - RNA, 16 nt, Bordetella pertussis
cgccuggcgcgcccac

SEQ ID NO: 2421423 - RNA, 13 nt, Bordetella pertussis
cgccuggcgcggc

SEQ ID NO: 2421424 - RNA, 19 nt, Bordetella pertussis
cgccuggcgcggccccaug

SEQ ID NO: 2421425 - RNA, 14 nt, Bordetella pertussis
cgccuggcgcggcg

SEQ ID NO: 2421426 - RNA, 15 nt, Bordetella pertussis
cgccuggcgcggcgc

SEQ ID NO: 2421427 - RNA, 16 nt, Bordetella pertussis
cgccuggcgcggcgcc

SEQ ID NO: 2421428 - RNA, 14 nt, Bordetella pertussis
cgccuggcgggccu

SEQ ID NO: 2421429 - RNA, 16 nt, Bordetella pertussis
cgccuggcgggccugg

SEQ ID NO: 2421430 - RNA, 19 nt, Bordetella pertussis
cgccuggcgggccugggcg

SEQ ID NO: 2421431 - RNA, 20 nt, Bordetella pertussis
cgccuggcgggccugggcgu

SEQ ID NO: 2421432 - RNA, 23 nt, Bordetella pertussis
cgccuggcguucaaucgcgcuuc

SEQ ID NO: 2421433 - RNA, 18 nt, Bordetella pertussis
cgccuggcuuacaggccc

SEQ ID NO: 2421434 - RNA, 22 nt, Bordetella pertussis
cgccuggcuucccgguccaggc

SEQ ID NO: 2421435 - RNA, 23 nt, Bordetella pertussis
cgccuggcuucccgguccaggcc

SEQ ID NO: 2421436 - RNA, 18 nt, Bordetella pertussis
cgccuggcuuucgccgcg

SEQ ID NO: 2421437 - RNA, 20 nt, Bordetella pertussis
cgccuggcuuucgccgcggg

SEQ ID NO: 2421438 - RNA, 13 nt, Bordetella pertussis
cgccugggccuuc

SEQ ID NO: 2421439 - RNA, 15 nt, Bordetella pertussis
cgccugggccuucuu

SEQ ID NO: 2421440 - RNA, 14 nt, Bordetella pertussis
cgccugggcgcgga

SEQ ID NO: 2421441 - RNA, 12 nt, Bordetella pertussis
cgccugggcggc

SEQ ID NO: 2421442 - RNA, 14 nt, Bordetella pertussis
cgccugggcggcca

SEQ ID NO: 2421443 - RNA, 15 nt, Bordetella pertussis
cgccugggcggccac

SEQ ID NO: 2421444 - RNA, 17 nt, Bordetella pertussis
cgccugggcggccacgu

SEQ ID NO: 2421445 - RNA, 14 nt, Bordetella pertussis
cgccugggcggcgc

SEQ ID NO: 2421446 - RNA, 15 nt, Bordetella pertussis
cgccugggcggcgca

SEQ ID NO: 2421447 - RNA, 14 nt, Bordetella pertussis
cgccuggggcgggc

SEQ ID NO: 2421448 - RNA, 16 nt, Bordetella pertussis
cgccuggggcgggcgc

SEQ ID NO: 2421449 - RNA, 14 nt, Bordetella pertussis
cgccuggggcgugc

SEQ ID NO: 2421450 - RNA, 17 nt, Bordetella pertussis
cgccugggggcuggagg

SEQ ID NO: 2421451 - RNA, 18 nt, Bordetella pertussis
cgccugggggcuggaggc

SEQ ID NO: 2421452 - RNA, 18 nt, Bordetella pertussis
cgccugggucaggucggc

SEQ ID NO: 2421453 - RNA, 20 nt, Bordetella pertussis
cgccugguaguaaucgcgcg

SEQ ID NO: 2421454 - RNA, 23 nt, Bordetella pertussis
cgccugguaguaaucgcgcgcca

SEQ ID NO: 2421455 - RNA, 14 nt, Bordetella pertussis
cgccuggucgacgc

SEQ ID NO: 2421456 - RNA, 16 nt, Bordetella pertussis
cgccuggucgacgccg

SEQ ID NO: 2421457 - RNA, 19 nt, Bordetella pertussis
cgccuggucgacgccggcg

SEQ ID NO: 2421458 - RNA, 17 nt, Bordetella pertussis
cgccuggucgcgcgccu

SEQ ID NO: 2421459 - RNA, 17 nt, Bordetella pertussis
cgccuguaucagcgccu

SEQ ID NO: 2421460 - RNA, 14 nt, Bordetella pertussis
cgccugucccaggc

SEQ ID NO: 2421461 - RNA, 17 nt, Bordetella pertussis
cgccuguccccgcugcg

SEQ ID NO: 2421462 - RNA, 20 nt, Bordetella pertussis
cgccuguccccgcugcggca

SEQ ID NO: 2421463 - RNA, 23 nt, Bordetella pertussis
cgccuguccccgcugcggcaagg

SEQ ID NO: 2421464 - RNA, 19 nt, Bordetella pertussis
cgccugucccgcugggggc

SEQ ID NO: 2421465 - RNA, 15 nt, Bordetella pertussis
cgccugugccagcug

SEQ ID NO: 2421466 - RNA, 17 nt, Bordetella pertussis
cgccugugccagcuggc

SEQ ID NO: 2421467 - RNA, 13 nt, Bordetella pertussis
cgccuuacgcggc

SEQ ID NO: 2421468 - RNA, 19 nt, Bordetella pertussis
cgccuuacuucuugcgcau

SEQ ID NO: 2421469 - RNA, 23 nt, Bordetella pertussis
cgccuuacuucuugcgcaucggc

SEQ ID NO: 2421470 - RNA, 17 nt, Bordetella pertussis
cgccuucaccggcccca

SEQ ID NO: 2421471 - RNA, 19 nt, Bordetella pertussis
cgccuucagcgggccggca

SEQ ID NO: 2421472 - RNA, 22 nt, Bordetella pertussis
cgccuucagcgggccggcacca

SEQ ID NO: 2421473 - RNA, 14 nt, Bordetella pertussis
cgccuucaucgucg

SEQ ID NO: 2421474 - RNA, 14 nt, Bordetella pertussis
cgccuucccaggcg

SEQ ID NO: 2421475 - RNA, 15 nt, Bordetella pertussis
cgccuuccggcagcg

SEQ ID NO: 2421476 - RNA, 18 nt, Bordetella pertussis
cgccuuccggcagcggcc

SEQ ID NO: 2421477 - RNA, 20 nt, Bordetella pertussis
cgccuuccggcagcggccag

SEQ ID NO: 2421478 - RNA, 22 nt, Bordetella pertussis
cgccuuccggcagcggccagcg

SEQ ID NO: 2421479 - RNA, 17 nt, Bordetella pertussis
cgccuuccggccccaug

SEQ ID NO: 2421480 - RNA, 22 nt, Bordetella pertussis
cgccuucgagcaccaugccggg

SEQ ID NO: 2421481 - RNA, 16 nt, Bordetella pertussis
cgccuucgagcugcac

SEQ ID NO: 2421482 - RNA, 17 nt, Bordetella pertussis
cgccuucgaggccggcg

SEQ ID NO: 2421483 - RNA, 19 nt, Bordetella pertussis
cgccuucgaggccggcguc

SEQ ID NO: 2421484 - RNA, 23 nt, Bordetella pertussis
cgccuucgaucuucucgccgcgc

SEQ ID NO: 2421485 - RNA, 14 nt, Bordetella pertussis
cgccuucgccgugg

SEQ ID NO: 2421486 - RNA, 14 nt, Bordetella pertussis
cgccuucgcugacg

SEQ ID NO: 2421487 - RNA, 20 nt, Bordetella pertussis
cgccuucggcaggcgccggc

SEQ ID NO: 2421488 - RNA, 13 nt, Bordetella pertussis
cgccuucggcgac

SEQ ID NO: 2421489 - RNA, 20 nt, Bordetella pertussis
cgccuucggcgcgcacgcuc

SEQ ID NO: 2421490 - RNA, 14 nt, Bordetella pertussis
cgccuucggcgcgg

SEQ ID NO: 2421491 - RNA, 17 nt, Bordetella pertussis
cgccuucggcgcggcgg

SEQ ID NO: 2421492 - RNA, 13 nt, Bordetella pertussis
cgccuucggcggc

SEQ ID NO: 2421493 - RNA, 16 nt, Bordetella pertussis
cgccuucggcggcggg

SEQ ID NO: 2421494 - RNA, 18 nt, Bordetella pertussis
cgccuucggcggcgggcu

SEQ ID NO: 2421495 - RNA, 23 nt, Bordetella pertussis
cgccuucgucgaggucagcggcu

SEQ ID NO: 2421496 - RNA, 18 nt, Bordetella pertussis
cgccuucgucgcgcaccc

SEQ ID NO: 2421497 - RNA, 16 nt, Bordetella pertussis
cgccuucuacccgcuc

SEQ ID NO: 2421498 - RNA, 16 nt, Bordetella pertussis
cgccuucuuucgcgag

SEQ ID NO: 2421499 - RNA, 20 nt, Bordetella pertussis
acgacguuguucaggaaggc

SEQ ID NO: 2421500 - RNA, 21 nt, Bordetella pertussis
acgacucgucgaccaccagca

SEQ ID NO: 2421501 - RNA, 17 nt, Bordetella pertussis
acgagaaugcgccgucc

SEQ ID NO: 2421502 - RNA, 18 nt, Bordetella pertussis
acgagaaugcgccguccg

SEQ ID NO: 2421503 - RNA, 13 nt, Bordetella pertussis
acgagacaggcgc

SEQ ID NO: 2421504 - RNA, 17 nt, Bordetella pertussis
acgagacaggcgcgcca

SEQ ID NO: 2421505 - RNA, 14 nt, Bordetella pertussis
acgagaucgccugg

SEQ ID NO: 2421506 - RNA, 14 nt, Bordetella pertussis
acgagaugccgaug

SEQ ID NO: 2421507 - RNA, 19 nt, Bordetella pertussis
acgagaugccgaugauggc

SEQ ID NO: 2421508 - RNA, 15 nt, Bordetella pertussis
acgagcgcaccaugg

SEQ ID NO: 2421509 - RNA, 16 nt, Bordetella pertussis
acgagcgcaccauggc

SEQ ID NO: 2421510 - RNA, 22 nt, Bordetella pertussis
acgagcgcagcaagcugcugcu

SEQ ID NO: 2421511 - RNA, 22 nt, Bordetella pertussis
acgagcggcggcuucgcgcagc

SEQ ID NO: 2421512 - RNA, 22 nt, Bordetella pertussis
acgagcgggugaugcugcagcg

SEQ ID NO: 2421513 - RNA, 14 nt, Bordetella pertussis
acgagcugcagccc

SEQ ID NO: 2421514 - RNA, 16 nt, Bordetella pertussis
acgagcugcagcccgg

SEQ ID NO: 2421515 - RNA, 15 nt, Bordetella pertussis
acgaggcgcggucgu

SEQ ID NO: 2421516 - RNA, 12 nt, Bordetella pertussis
acgagggccgcg

SEQ ID NO: 2421517 - RNA, 13 nt, Bordetella pertussis
acgagggccggcg

SEQ ID NO: 2421518 - RNA, 17 nt, Bordetella pertussis
acgagggccggcgccag

SEQ ID NO: 2421519 - RNA, 12 nt, Bordetella pertussis
acgagggcgcca

SEQ ID NO: 2421520 - RNA, 13 nt, Bordetella pertussis
acgagggcgccau

SEQ ID NO: 2421521 - RNA, 19 nt, Bordetella pertussis
acgaggucuugccgaucgg

SEQ ID NO: 2421522 - RNA, 14 nt, Bordetella pertussis
acgagugcaggccc

SEQ ID NO: 2421523 - RNA, 15 nt, Bordetella pertussis
acgauauccaggcgc

SEQ ID NO: 2421524 - RNA, 16 nt, Bordetella pertussis
acgauauccaggcgcg

SEQ ID NO: 2421525 - RNA, 19 nt, Bordetella pertussis
acgauauuggcgucggccg

SEQ ID NO: 2421526 - RNA, 14 nt, Bordetella pertussis
acgaucaccacgcc

SEQ ID NO: 2421527 - RNA, 13 nt, Bordetella pertussis
acgaucaccgccg

SEQ ID NO: 2421528 - RNA, 14 nt, Bordetella pertussis
acgaucaccgccgc

SEQ ID NO: 2421529 - RNA, 22 nt, Bordetella pertussis
acgaucaggcccuggggccgcg

SEQ ID NO: 2421530 - RNA, 13 nt, Bordetella pertussis
acgaucaggcggc

SEQ ID NO: 2421531 - RNA, 19 nt, Bordetella pertussis
acgauccacggccggcgca

SEQ ID NO: 2421532 - RNA, 18 nt, Bordetella pertussis
acgaucccgucauggcgg

SEQ ID NO: 2421533 - RNA, 13 nt, Bordetella pertussis
acgaucgcggcgc

SEQ ID NO: 2421534 - RNA, 12 nt, Bordetella pertussis
acgaucggcgcc

SEQ ID NO: 2421535 - RNA, 20 nt, Bordetella pertussis
acgaucgucagcagcacgcc

SEQ ID NO: 2421536 - RNA, 14 nt, Bordetella pertussis
acgaucuaggccgu

SEQ ID NO: 2421537 - RNA, 16 nt, Bordetella pertussis
acgaucucggcguuga

SEQ ID NO: 2421538 - RNA, 21 nt, Bordetella pertussis
acgaucuggcgcgcgaccagg

SEQ ID NO: 2421539 - RNA, 21 nt, Bordetella pertussis
acgaucuucuggacuugcggc

SEQ ID NO: 2421540 - RNA, 18 nt, Bordetella pertussis
acgaugaagaugccgaac

SEQ ID NO: 2421541 - RNA, 19 nt, Bordetella pertussis
acgaugcccagggccgcgc

SEQ ID NO: 2421542 - RNA, 21 nt, Bordetella pertussis
acgaugcccaggucguugcgc

SEQ ID NO: 2421543 - RNA, 17 nt, Bordetella pertussis
acgaugcccugcgccag

SEQ ID NO: 2421544 - RNA, 18 nt, Bordetella pertussis
acgaugccgcccacgcca

SEQ ID NO: 2421545 - RNA, 14 nt, Bordetella pertussis
acgaugccgccgcc

SEQ ID NO: 2421546 - RNA, 15 nt, Bordetella pertussis
acgaugccgccgccg

SEQ ID NO: 2421547 - RNA, 24 nt, Bordetella pertussis
acgaugccggucuccagcgcgucg

SEQ ID NO: 2421548 - RNA, 17 nt, Bordetella pertussis
acgaugccgucgccgcc

SEQ ID NO: 2421549 - RNA, 18 nt, Bordetella pertussis
acgaugcgcgaagcgccc

SEQ ID NO: 2421550 - RNA, 19 nt, Bordetella pertussis
acgaugcgcgaagcgcccu

SEQ ID NO: 2421551 - RNA, 14 nt, Bordetella pertussis
acgaugcgggcauc

SEQ ID NO: 2421552 - RNA, 22 nt, Bordetella pertussis
acgaugcgggcaucgcccugcu

SEQ ID NO: 2421553 - RNA, 17 nt, Bordetella pertussis
acgauggaaaugccguc

SEQ ID NO: 2421554 - RNA, 20 nt, Bordetella pertussis
acgauggccgaaugcccgcc

SEQ ID NO: 2421555 - RNA, 17 nt, Bordetella pertussis
acgauggcgccggcuuc

SEQ ID NO: 2421556 - RNA, 12 nt, Bordetella pertussis
acgauggcgcgc

SEQ ID NO: 2421557 - RNA, 12 nt, Bordetella pertussis
acgauggggcca

SEQ ID NO: 2421558 - RNA, 16 nt, Bordetella pertussis
acgauggggccauggc

SEQ ID NO: 2421559 - RNA, 12 nt, Bordetella pertussis
acgauggggccg

SEQ ID NO: 2421560 - RNA, 20 nt, Bordetella pertussis
acgauggggccgucgccgau

SEQ ID NO: 2421561 - RNA, 16 nt, Bordetella pertussis
acgauggugccggccg

SEQ ID NO: 2421562 - RNA, 19 nt, Bordetella pertussis
acgauguagaucuggcgcg

SEQ ID NO: 2421563 - RNA, 20 nt, Bordetella pertussis
acgaugucgccgccgcgcac

SEQ ID NO: 2421564 - RNA, 21 nt, Bordetella pertussis
acgaugucgccgccgcgcacc

SEQ ID NO: 2421565 - RNA, 13 nt, Bordetella pertussis
acgaugucggcgc

SEQ ID NO: 2421566 - RNA, 15 nt, Bordetella pertussis
acgaugucggcgcaa

SEQ ID NO: 2421567 - RNA, 22 nt, Bordetella pertussis
acgaugucguacacaugcuugc

SEQ ID NO: 2421568 - RNA, 21 nt, Bordetella pertussis
acgaugucguccagcuccagg

SEQ ID NO: 2421569 - RNA, 18 nt, Bordetella pertussis
acgauguugccgccggcc

SEQ ID NO: 2421570 - RNA, 19 nt, Bordetella pertussis
acgauguugcgcaggcugu

SEQ ID NO: 2421571 - RNA, 20 nt, Bordetella pertussis
cgcgacaggcggugcgcgcg

SEQ ID NO: 2421572 - RNA, 21 nt, Bordetella pertussis
cgcgacaggcggugcgcgcgg

SEQ ID NO: 2421573 - RNA, 17 nt, Bordetella pertussis
cgcgacaguucgccccc

SEQ ID NO: 2421574 - RNA, 14 nt, Bordetella pertussis
cgcgaccaccagca

SEQ ID NO: 2421575 - RNA, 16 nt, Bordetella pertussis
cgcgaccaccagcacc

SEQ ID NO: 2421576 - RNA, 15 nt, Bordetella pertussis
cgcgaccaccgugau

SEQ ID NO: 2421577 - RNA, 14 nt, Bordetella pertussis
cgcgaccacggucu

SEQ ID NO: 2421578 - RNA, 16 nt, Bordetella pertussis
cgcgaccacggucugg

SEQ ID NO: 2421579 - RNA, 19 nt, Bordetella pertussis
cgcgaccacggucuggcgc

SEQ ID NO: 2421580 - RNA, 21 nt, Bordetella pertussis
cgcgaccacggucuggcgcga

SEQ ID NO: 2421581 - RNA, 14 nt, Bordetella pertussis
cgcgaccaggcugg

SEQ ID NO: 2421582 - RNA, 22 nt, Bordetella pertussis
cgcgacccagaacccggccggc

SEQ ID NO: 2421583 - RNA, 23 nt, Bordetella pertussis
cgcgacccauaguugcaugaugu

SEQ ID NO: 2421584 - RNA, 17 nt, Bordetella pertussis
cgcgacccgauagccgc

SEQ ID NO: 2421585 - RNA, 23 nt, Bordetella pertussis
cgcgacccgauagccgcgcgccu

SEQ ID NO: 2421586 - RNA, 12 nt, Bordetella pertussis
cgcgaccgccgc

SEQ ID NO: 2421587 - RNA, 19 nt, Bordetella pertussis
cgcgaccgccgcgggauuc

SEQ ID NO: 2421588 - RNA, 15 nt, Bordetella pertussis
cgcgaccgccuccag

SEQ ID NO: 2421589 - RNA, 23 nt, Bordetella pertussis
cgcgaccgccuccagcgcggcgg

SEQ ID NO: 2421590 - RNA, 16 nt, Bordetella pertussis
cgcgaccgcgcggcgc

SEQ ID NO: 2421591 - RNA, 17 nt, Bordetella pertussis
cgcgaccgcgcggcgcu

SEQ ID NO: 2421592 - RNA, 20 nt, Bordetella pertussis
cgcgaccgcgcggcgcugca

SEQ ID NO: 2421593 - RNA, 23 nt, Bordetella pertussis
cgcgaccggcgcgaacaccggca

SEQ ID NO: 2421594 - RNA, 12 nt, Bordetella pertussis
cgcgaccgggcc

SEQ ID NO: 2421595 - RNA, 14 nt, Bordetella pertussis
cgcgaccgggccga

SEQ ID NO: 2421596 - RNA, 17 nt, Bordetella pertussis
cgcgaccuccaguaucg

SEQ ID NO: 2421597 - RNA, 13 nt, Bordetella pertussis
cgcgaccuccggc

SEQ ID NO: 2421598 - RNA, 15 nt, Bordetella pertussis
cgcgaccuccggcaa

SEQ ID NO: 2421599 - RNA, 20 nt, Bordetella pertussis
cgcgaccuccggcaacagca

SEQ ID NO: 2421600 - RNA, 15 nt, Bordetella pertussis
cgcgaccucggcggc

SEQ ID NO: 2421601 - RNA, 22 nt, Bordetella pertussis
cgcgaccugcgggcgcagcgcc

SEQ ID NO: 2421602 - RNA, 23 nt, Bordetella pertussis
cgcgaccugcgggcgcagcgccg

SEQ ID NO: 2421603 - RNA, 18 nt, Bordetella pertussis
cgcgacgccagcgcgcca

SEQ ID NO: 2421604 - RNA, 16 nt, Bordetella pertussis
cgcgacgccugcgcca

SEQ ID NO: 2421605 - RNA, 18 nt, Bordetella pertussis
cgcgacgcgacgcgggcg

SEQ ID NO: 2421606 - RNA, 15 nt, Bordetella pertussis
cgcgacgcgggcggc

SEQ ID NO: 2421607 - RNA, 17 nt, Bordetella pertussis
cgcgacgcgggcggccg

SEQ ID NO: 2421608 - RNA, 21 nt, Bordetella pertussis
cgcgacgcgggcggccgacgg

SEQ ID NO: 2421609 - RNA, 23 nt, Bordetella pertussis
cgcgacgcuguuggucaggucga

SEQ ID NO: 2421610 - RNA, 13 nt, Bordetella pertussis
cgcgacggcgccg

SEQ ID NO: 2421611 - RNA, 13 nt, Bordetella pertussis
cgcgacggcggcc

SEQ ID NO: 2421612 - RNA, 15 nt, Bordetella pertussis
cgcgcaacucggcca

SEQ ID NO: 2421613 - RNA, 18 nt, Bordetella pertussis
cgcgcaacucggccaccu

SEQ ID NO: 2421614 - RNA, 12 nt, Bordetella pertussis
cgcgcaagccgc

SEQ ID NO: 2421615 - RNA, 17 nt, Bordetella pertussis
cgcgcaagccgccgccc

SEQ ID NO: 2421616 - RNA, 13 nt, Bordetella pertussis
cgcgcaaggcggc

SEQ ID NO: 2421617 - RNA, 16 nt, Bordetella pertussis
cgcgcaaggcggcccg

SEQ ID NO: 2421618 - RNA, 12 nt, Bordetella pertussis
cgcgcaagggcc

SEQ ID NO: 2421619 - RNA, 15 nt, Bordetella pertussis
cgcgcaagggccagu

SEQ ID NO: 2421620 - RNA, 14 nt, Bordetella pertussis
cgcgcaagguggcg

SEQ ID NO: 2421621 - RNA, 17 nt, Bordetella pertussis
cgcgcaauacgccgccg

SEQ ID NO: 2421622 - RNA, 15 nt, Bordetella pertussis
cgcgcaaugcgcggc

SEQ ID NO: 2421623 - RNA, 17 nt, Bordetella pertussis
cgcgcaaugcgcggcgc

SEQ ID NO: 2421624 - RNA, 14 nt, Bordetella pertussis
cgcgcaauugcuuc

SEQ ID NO: 2421625 - RNA, 18 nt, Bordetella pertussis
cgcgcacaaacgcacgau

SEQ ID NO: 2421626 - RNA, 14 nt, Bordetella pertussis
cgcgcacaagcgcg

SEQ ID NO: 2421627 - RNA, 15 nt, Bordetella pertussis
cgcgcacacuggcca

SEQ ID NO: 2421628 - RNA, 20 nt, Bordetella pertussis
cgcgcacacuggccagcaag

SEQ ID NO: 2421629 - RNA, 22 nt, Bordetella pertussis
cgcgcacagcauggccaccagg

SEQ ID NO: 2421630 - RNA, 22 nt, Bordetella pertussis
cgcgcacagcccgaucgacggc

SEQ ID NO: 2421631 - RNA, 15 nt, Bordetella pertussis
cgcgcacagcgcggc

SEQ ID NO: 2421632 - RNA, 21 nt, Bordetella pertussis
cgcgcacagcgcggcgaugcc

SEQ ID NO: 2421633 - RNA, 22 nt, Bordetella pertussis
cgcgcacagcgcggcgaugccc

SEQ ID NO: 2421634 - RNA, 14 nt, Bordetella pertussis
cgcgcacaggcgcu

SEQ ID NO: 2421635 - RNA, 18 nt, Bordetella pertussis
cgcgcacauccagccgau

SEQ ID NO: 2421636 - RNA, 23 nt, Bordetella pertussis
cgcgcacauuggaguaguggccc

SEQ ID NO: 2421637 - RNA, 13 nt, Bordetella pertussis
cgcgcaccaccug

SEQ ID NO: 2421638 - RNA, 18 nt, Bordetella pertussis
cgcgcaccaccuggcuga

SEQ ID NO: 2421639 - RNA, 14 nt, Bordetella pertussis
cgcgcaccagcccg

SEQ ID NO: 2421640 - RNA, 12 nt, Bordetella pertussis
cgcgcaccagcg

SEQ ID NO: 2421641 - RNA, 13 nt, Bordetella pertussis
cgcgcaccagcgg

SEQ ID NO: 2421642 - RNA, 14 nt, Bordetella pertussis
cgcgcaccagcuug

SEQ ID NO: 2421643 - RNA, 12 nt, Bordetella pertussis
cgcgcaccaggc

SEQ ID NO: 2421644 - RNA, 15 nt, Bordetella pertussis
cgcgcaccaggcgcg

SEQ ID NO: 2421645 - RNA, 16 nt, Bordetella pertussis
cgcgcaccaggcgcgg

SEQ ID NO: 2421646 - RNA, 23 nt, Bordetella pertussis
cgcgcaccaggucgcggugcgcc

SEQ ID NO: 2421647 - RNA, 17 nt, Bordetella pertussis
cgcgcaccaucgccgag

SEQ ID NO: 2421648 - RNA, 19 nt, Bordetella pertussis
cgcgcaccauucucgcccu

SEQ ID NO: 2421649 - RNA, 12 nt, Bordetella pertussis
cgcgcacccgca

SEQ ID NO: 2421650 - RNA, 13 nt, Bordetella pertussis
cgcgcacccgcag

SEQ ID NO: 2421651 - RNA, 16 nt, Bordetella pertussis
cgcgcaccgacaccaa

SEQ ID NO: 2421652 - RNA, 16 nt, Bordetella pertussis
cgcgcaccgccugcug

SEQ ID NO: 2421653 - RNA, 22 nt, Bordetella pertussis
cgcgcaccugggaggggccggc

SEQ ID NO: 2421654 - RNA, 16 nt, Bordetella pertussis
cgcgcaccugggcguc

SEQ ID NO: 2421655 - RNA, 21 nt, Bordetella pertussis
cgcgcaccugggcgucgaucu

SEQ ID NO: 2421656 - RNA, 21 nt, Bordetella pertussis
cgcgcacgaagccgaugcgcc

SEQ ID NO: 2421657 - RNA, 22 nt, Bordetella pertussis
cgcgcacgaagccgaugcgccg

SEQ ID NO: 2421658 - RNA, 17 nt, Bordetella pertussis
cgcgcacgaccaccagc

SEQ ID NO: 2421659 - RNA, 18 nt, Bordetella pertussis
cgcgcacgaccaccagcg

SEQ ID NO: 2421660 - RNA, 15 nt, Bordetella pertussis
cgcgcacgacgucgc

SEQ ID NO: 2421661 - RNA, 19 nt, Bordetella pertussis
cgcgcacgacgucgcgcgg

SEQ ID NO: 2421662 - RNA, 13 nt, Bordetella pertussis
cgcgcacgcccgc

SEQ ID NO: 2421663 - RNA, 15 nt, Bordetella pertussis
cgcgcacgcccgcga

SEQ ID NO: 2421664 - RNA, 21 nt, Bordetella pertussis
cgcgcacgcgcucgggcagcu

SEQ ID NO: 2421665 - RNA, 15 nt, Bordetella pertussis
cgcgcacgcgcuugc

SEQ ID NO: 2421666 - RNA, 13 nt, Bordetella pertussis
cgcgcacgcuggg

SEQ ID NO: 2421667 - RNA, 14 nt, Bordetella pertussis
cgcgcacggccagc

SEQ ID NO: 2421668 - RNA, 14 nt, Bordetella pertussis
cgcgcacgggcgcc

SEQ ID NO: 2421669 - RNA, 19 nt, Bordetella pertussis
cgcgcacggugcgcacgau

SEQ ID NO: 2421670 - RNA, 15 nt, Bordetella pertussis
cgcgcacguggacca

SEQ ID NO: 2421671 - RNA, 21 nt, Bordetella pertussis
cgcgcacguggaccagggacg

SEQ ID NO: 2421672 - RNA, 21 nt, Bordetella pertussis
cgcgcagacgcgcucaggcgg

SEQ ID NO: 2421673 - RNA, 16 nt, Bordetella pertussis
cgcgcagacgggcccg

SEQ ID NO: 2421674 - RNA, 21 nt, Bordetella pertussis
cgcgcagaucccaggcgcuca

SEQ ID NO: 2421675 - RNA, 12 nt, Bordetella pertussis
cgcgcagcaacc

SEQ ID NO: 2421676 - RNA, 16 nt, Bordetella pertussis
cgcgcagcaacccgcc

SEQ ID NO: 2421677 - RNA, 18 nt, Bordetella pertussis
cgcgcagcaacccgcccg

SEQ ID NO: 2421678 - RNA, 19 nt, Bordetella pertussis
cgcgcagcaagucagcccg

SEQ ID NO: 2421679 - RNA, 20 nt, Bordetella pertussis
cgcgcagcaagucagcccgc

SEQ ID NO: 2421680 - RNA, 14 nt, Bordetella pertussis
cgcgcagcaccgcc

SEQ ID NO: 2421681 - RNA, 15 nt, Bordetella pertussis
cgcgcagcaccgcca

SEQ ID NO: 2421682 - RNA, 14 nt, Bordetella pertussis
cgcgcagcaccggc

SEQ ID NO: 2421683 - RNA, 16 nt, Bordetella pertussis
cgcgcagcaccggcgu

SEQ ID NO: 2421684 - RNA, 18 nt, Bordetella pertussis
cgcgcagcaccucggggc

SEQ ID NO: 2421685 - RNA, 13 nt, Bordetella pertussis
cgcgcagcacgau

SEQ ID NO: 2421686 - RNA, 22 nt, Bordetella pertussis
cgcgcagcacgauggggccaug

SEQ ID NO: 2421687 - RNA, 14 nt, Bordetella pertussis
cgcgcagcacgccc

SEQ ID NO: 2421688 - RNA, 15 nt, Bordetella pertussis
cgcgcagcacgcccg

SEQ ID NO: 2421689 - RNA, 16 nt, Bordetella pertussis
cgcgcagcacgcccgc

SEQ ID NO: 2421690 - RNA, 23 nt, Bordetella pertussis
cgcgcagcacgcugcgcggcggc

SEQ ID NO: 2421691 - RNA, 22 nt, Bordetella pertussis
cgcgcagcagacgcuucaggcc

SEQ ID NO: 2421692 - RNA, 13 nt, Bordetella pertussis
cgcgcagcagcgc

SEQ ID NO: 2421693 - RNA, 12 nt, Bordetella pertussis
cgcgcagcagcu

SEQ ID NO: 2421694 - RNA, 20 nt, Bordetella pertussis
cgcgcagcagcuugccgacc

SEQ ID NO: 2421695 - RNA, 14 nt, Bordetella pertussis
cgcgcagcaggccc

SEQ ID NO: 2421696 - RNA, 15 nt, Bordetella pertussis
cgcgcagcaggccgc

SEQ ID NO: 2421697 - RNA, 17 nt, Bordetella pertussis
cgcgcagcaggccgcgc

SEQ ID NO: 2421698 - RNA, 19 nt, Bordetella pertussis
cgcgcagcaggccgcgcgu

SEQ ID NO: 2421699 - RNA, 13 nt, Bordetella pertussis
cgcgcagcagggu

SEQ ID NO: 2421700 - RNA, 20 nt, Bordetella pertussis
cgcgcagcaggguggccacg

SEQ ID NO: 2421701 - RNA, 16 nt, Bordetella pertussis
cgcgcagccacagcgc

SEQ ID NO: 2421702 - RNA, 17 nt, Bordetella pertussis
cgcgcagccacagcgcg

SEQ ID NO: 2421703 - RNA, 21 nt, Bordetella pertussis
cgcgcagccacagcgcguggc

SEQ ID NO: 2421704 - RNA, 12 nt, Bordetella pertussis
cgcgcagccagg

SEQ ID NO: 2421705 - RNA, 14 nt, Bordetella pertussis
cgcgcagccaggua

SEQ ID NO: 2421706 - RNA, 15 nt, Bordetella pertussis
cgcgcagcccggcgu

SEQ ID NO: 2421707 - RNA, 16 nt, Bordetella pertussis
cgcgcagcccggcgug

SEQ ID NO: 2421708 - RNA, 22 nt, Bordetella pertussis
cgcgcagcccggcgugcccagg

SEQ ID NO: 2421709 - RNA, 18 nt, Bordetella pertussis
cgcgcagccgacaggcgc

SEQ ID NO: 2421710 - RNA, 13 nt, Bordetella pertussis
cgcgcagccgcgc

SEQ ID NO: 2421711 - RNA, 14 nt, Bordetella pertussis
cgcgcagccgcgcc

SEQ ID NO: 2421712 - RNA, 15 nt, Bordetella pertussis
cgcgcagcgaacggc

SEQ ID NO: 2421713 - RNA, 14 nt, Bordetella pertussis
cgcgcagcgaggcc

SEQ ID NO: 2421714 - RNA, 12 nt, Bordetella pertussis
cgcgcagcgccg

SEQ ID NO: 2421715 - RNA, 14 nt, Bordetella pertussis
cgcgcagcgccgcc

SEQ ID NO: 2421716 - RNA, 17 nt, Bordetella pertussis
cgcgcagcgccgccacc

SEQ ID NO: 2421717 - RNA, 15 nt, Bordetella pertussis
cgcgcagcgccuggc

SEQ ID NO: 2421718 - RNA, 15 nt, Bordetella pertussis
cgcgcagcgcgaccg

SEQ ID NO: 2421719 - RNA, 15 nt, Bordetella pertussis
cgcgcagcggcaggc

SEQ ID NO: 2421720 - RNA, 22 nt, Bordetella pertussis
cgcgcagcggcaggcccugccg

SEQ ID NO: 2421721 - RNA, 13 nt, Bordetella pertussis
cgcgcagcggcgc

SEQ ID NO: 2421722 - RNA, 16 nt, Bordetella pertussis
cgcgcagcggcgcgcg

SEQ ID NO: 2421723 - RNA, 19 nt, Bordetella pertussis
cgcgcagcgucucgcccac

SEQ ID NO: 2421724 - RNA, 13 nt, Bordetella pertussis
cgcgcagcgucug

SEQ ID NO: 2421725 - RNA, 22 nt, Bordetella pertussis
cgcgcagcgugcggaccagcgg

SEQ ID NO: 2421726 - RNA, 17 nt, Bordetella pertussis
acgcaggcccagccagc

SEQ ID NO: 2421727 - RNA, 22 nt, Bordetella pertussis
acgcaggcccagccagcccugg

SEQ ID NO: 2421728 - RNA, 13 nt, Bordetella pertussis
acgcaggcgggcg

SEQ ID NO: 2421729 - RNA, 15 nt, Bordetella pertussis
acgcaggcgggcgcc

SEQ ID NO: 2421730 - RNA, 19 nt, Bordetella pertussis
acgcaggcgggcgccgcgc

SEQ ID NO: 2421731 - RNA, 18 nt, Bordetella pertussis
acgcauauccaggcggcg

SEQ ID NO: 2421732 - RNA, 20 nt, Bordetella pertussis
acgcauauccaggcggcgcu

SEQ ID NO: 2421733 - RNA, 13 nt, Bordetella pertussis
acgcaucggcgcc

SEQ ID NO: 2421734 - RNA, 14 nt, Bordetella pertussis
acgcaugcgugcgc

SEQ ID NO: 2421735 - RNA, 16 nt, Bordetella pertussis
acgcaugcgugcgcau

SEQ ID NO: 2421736 - RNA, 15 nt, Bordetella pertussis
acgccaagaccgcgg

SEQ ID NO: 2421737 - RNA, 16 nt, Bordetella pertussis
acgccaagcugcuggc

SEQ ID NO: 2421738 - RNA, 17 nt, Bordetella pertussis
acgccaagcugcuggcc

SEQ ID NO: 2421739 - RNA, 13 nt, Bordetella pertussis
acgccaaggagac

SEQ ID NO: 2421740 - RNA, 16 nt, Bordetella pertussis
acgccacaaagccucc

SEQ ID NO: 2421741 - RNA, 15 nt, Bordetella pertussis
acgccaccaggccga

SEQ ID NO: 2421742 - RNA, 17 nt, Bordetella pertussis
acgccaccagugcgccg

SEQ ID NO: 2421743 - RNA, 19 nt, Bordetella pertussis
acgccaccagugcgccggc

SEQ ID NO: 2421744 - RNA, 15 nt, Bordetella pertussis
acgccacgcccaucu

SEQ ID NO: 2421745 - RNA, 13 nt, Bordetella pertussis
acgccacgcgcgg

SEQ ID NO: 2421746 - RNA, 20 nt, Bordetella pertussis
acgccacuggccuugugcgc

SEQ ID NO: 2421747 - RNA, 16 nt, Bordetella pertussis
acgccacuugcaggcc

SEQ ID NO: 2421748 - RNA, 17 nt, Bordetella pertussis
acgccacuugcaggccg

SEQ ID NO: 2421749 - RNA, 18 nt, Bordetella pertussis
acgccacuugcaggccgc

SEQ ID NO: 2421750 - RNA, 22 nt, Bordetella pertussis
acgccagcaggcgaaacgccag

SEQ ID NO: 2421751 - RNA, 14 nt, Bordetella pertussis
acgccagcccgccg

SEQ ID NO: 2421752 - RNA, 18 nt, Bordetella pertussis
acgccagcccgccggcgc

SEQ ID NO: 2421753 - RNA, 21 nt, Bordetella pertussis
acgccaucgacgcuugccggc

SEQ ID NO: 2421754 - RNA, 15 nt, Bordetella pertussis
acgccaucucgcgcg

SEQ ID NO: 2421755 - RNA, 16 nt, Bordetella pertussis
acgccaucuugcaggc

SEQ ID NO: 2421756 - RNA, 16 nt, Bordetella pertussis
acgccauggacgccga

SEQ ID NO: 2421757 - RNA, 13 nt, Bordetella pertussis
acgccauggcggc

SEQ ID NO: 2421758 - RNA, 19 nt, Bordetella pertussis
acgccauggcggcggccac

SEQ ID NO: 2421759 - RNA, 13 nt, Bordetella pertussis
acgcccacgcgcc

SEQ ID NO: 2421760 - RNA, 16 nt, Bordetella pertussis
acgcccacgcgccgcc

SEQ ID NO: 2421761 - RNA, 18 nt, Bordetella pertussis
acgcccacgcgccgccag

SEQ ID NO: 2421762 - RNA, 19 nt, Bordetella pertussis
acgcccagcccugcccgca

SEQ ID NO: 2421763 - RNA, 15 nt, Bordetella pertussis
acgcccagccgcagc

SEQ ID NO: 2421764 - RNA, 15 nt, Bordetella pertussis
acgcccagccugccg

SEQ ID NO: 2421765 - RNA, 15 nt, Bordetella pertussis
acgcccagcgccggc

SEQ ID NO: 2421766 - RNA, 23 nt, Bordetella pertussis
acgcccagcugggccacagggcg

SEQ ID NO: 2421767 - RNA, 12 nt, Bordetella pertussis
acgcccaggccc

SEQ ID NO: 2421768 - RNA, 20 nt, Bordetella pertussis
acgcccaggcccaccgcauc

SEQ ID NO: 2421769 - RNA, 16 nt, Bordetella pertussis
acgcccaggccguggc

SEQ ID NO: 2421770 - RNA, 20 nt, Bordetella pertussis
acgcccaggccguggcgcac

SEQ ID NO: 2421771 - RNA, 22 nt, Bordetella pertussis
acgcccagguugcggccgccac

SEQ ID NO: 2421772 - RNA, 21 nt, Bordetella pertussis
acgcccaguauggugaccggc

SEQ ID NO: 2421773 - RNA, 22 nt, Bordetella pertussis
acgcccaguauggugaccggcg

SEQ ID NO: 2421774 - RNA, 15 nt, Bordetella pertussis
acgcccaucugccag

SEQ ID NO: 2421775 - RNA, 19 nt, Bordetella pertussis
acgcccaugcgaucggccu

SEQ ID NO: 2421776 - RNA, 22 nt, Bordetella pertussis
acgcccauggucaggacgacga

SEQ ID NO: 2421777 - RNA, 20 nt, Bordetella pertussis
acgccccggccgaucgcgcc

SEQ ID NO: 2421778 - RNA, 23 nt, Bordetella pertussis
acgcccgagauggcgcaggcgcg

SEQ ID NO: 2421779 - RNA, 14 nt, Bordetella pertussis
acgcccgccagcag

SEQ ID NO: 2421780 - RNA, 17 nt, Bordetella pertussis
acgcccgcccgcugacc

SEQ ID NO: 2421781 - RNA, 11 nt, Bordetella pertussis
acgcccgccuu

SEQ ID NO: 2421782 - RNA, 17 nt, Bordetella pertussis
acgcccgcgacgcuggc

SEQ ID NO: 2421783 - RNA, 13 nt, Bordetella pertussis
acgcccgcgcgcg

SEQ ID NO: 2421784 - RNA, 15 nt, Bordetella pertussis
acgcccgcggcgccc

SEQ ID NO: 2421785 - RNA, 16 nt, Bordetella pertussis
acgcccgcggcgccca

SEQ ID NO: 2421786 - RNA, 20 nt, Bordetella pertussis
acgcccgcggcgcccagcug

SEQ ID NO: 2421787 - RNA, 22 nt, Bordetella pertussis
acgcccggcccaggccgggcgu

SEQ ID NO: 2421788 - RNA, 14 nt, Bordetella pertussis
acgcccggcgcggu

SEQ ID NO: 2421789 - RNA, 16 nt, Bordetella pertussis
acgcccggugccugcc

SEQ ID NO: 2421790 - RNA, 16 nt, Bordetella pertussis
acgcccgucucgcgcg

SEQ ID NO: 2421791 - RNA, 20 nt, Bordetella pertussis
acgcccugaacuauggcgcg

SEQ ID NO: 2421792 - RNA, 15 nt, Bordetella pertussis
acgcccuggcagcug

SEQ ID NO: 2421793 - RNA, 16 nt, Bordetella pertussis
acgcccuggcagcugg

SEQ ID NO: 2421794 - RNA, 17 nt, Bordetella pertussis
acgcccuggcagcuggc

SEQ ID NO: 2421795 - RNA, 20 nt, Bordetella pertussis
acgcccuggcagcuggcgcg

SEQ ID NO: 2421796 - RNA, 12 nt, Bordetella pertussis
acgcccuggccg

SEQ ID NO: 2421797 - RNA, 18 nt, Bordetella pertussis
acgcccuggcgcaggccg

SEQ ID NO: 2421798 - RNA, 20 nt, Bordetella pertussis
acgcccuggcgcaggccggc

SEQ ID NO: 2421799 - RNA, 15 nt, Bordetella pertussis
acgcccuggcggucu

SEQ ID NO: 2421800 - RNA, 19 nt, Bordetella pertussis
acgcccuggcuggcggccc

SEQ ID NO: 2421801 - RNA, 16 nt, Bordetella pertussis
acgccgaacacaucga

SEQ ID NO: 2421802 - RNA, 23 nt, Bordetella pertussis
acgccgaacacaucgagggcguc

SEQ ID NO: 2421803 - RNA, 19 nt, Bordetella pertussis
acgccgaaggucuuggcgu

SEQ ID NO: 2421804 - RNA, 21 nt, Bordetella pertussis
acgccgaaggucuuggcgugc

SEQ ID NO: 2421805 - RNA, 20 nt, Bordetella pertussis
acgccgaauugcuggagcgc

SEQ ID NO: 2421806 - RNA, 20 nt, Bordetella pertussis
cgcgccagcgccggcgcguc

SEQ ID NO: 2421807 - RNA, 14 nt, Bordetella pertussis
cgcgccagcgccuc

SEQ ID NO: 2421808 - RNA, 15 nt, Bordetella pertussis
cgcgccagcgccugg

SEQ ID NO: 2421809 - RNA, 12 nt, Bordetella pertussis
cgcgccagcgcg

SEQ ID NO: 2421810 - RNA, 14 nt, Bordetella pertussis
cgcgccagcgcgcg

SEQ ID NO: 2421811 - RNA, 14 nt, Bordetella pertussis
cgcgccagcgcggc

SEQ ID NO: 2421812 - RNA, 15 nt, Bordetella pertussis
cgcgccagcgcggcc

SEQ ID NO: 2421813 - RNA, 18 nt, Bordetella pertussis
cgcgccagcgcggccagc

SEQ ID NO: 2421814 - RNA, 19 nt, Bordetella pertussis
cgcgccagcgcggccagcg

SEQ ID NO: 2421815 - RNA, 19 nt, Bordetella pertussis
cgcgccagcgcggcgggcc

SEQ ID NO: 2421816 - RNA, 14 nt, Bordetella pertussis
cgcgccagcggccg

SEQ ID NO: 2421817 - RNA, 14 nt, Bordetella pertussis
cgcgccagcggcug

SEQ ID NO: 2421818 - RNA, 19 nt, Bordetella pertussis
cgcgccagcggcugcuuga

SEQ ID NO: 2421819 - RNA, 11 nt, Bordetella pertussis
cgcgccagcuc

SEQ ID NO: 2421820 - RNA, 12 nt, Bordetella pertussis
cgcgccagcucg

SEQ ID NO: 2421821 - RNA, 13 nt, Bordetella pertussis
cgcgccagcucgc

SEQ ID NO: 2421822 - RNA, 18 nt, Bordetella pertussis
cgcgccagcucgcgcagc

SEQ ID NO: 2421823 - RNA, 19 nt, Bordetella pertussis
cgcgccagcucgcgcagca

SEQ ID NO: 2421824 - RNA, 12 nt, Bordetella pertussis
cgcgccagcuga

SEQ ID NO: 2421825 - RNA, 20 nt, Bordetella pertussis
cgcgccagcugaccucgccc

SEQ ID NO: 2421826 - RNA, 19 nt, Bordetella pertussis
cgcgccaggaagcgcgccg

SEQ ID NO: 2421827 - RNA, 17 nt, Bordetella pertussis
cgcgccaggauggccac

SEQ ID NO: 2421828 - RNA, 21 nt, Bordetella pertussis
cgcgccaggauggccacgacc

SEQ ID NO: 2421829 - RNA, 22 nt, Bordetella pertussis
cgcgccaggauggccacgacca

SEQ ID NO: 2421830 - RNA, 16 nt, Bordetella pertussis
cgcgccaggcccaggg

SEQ ID NO: 2421831 - RNA, 20 nt, Bordetella pertussis
cgcgccaggccccgccgggc

SEQ ID NO: 2421832 - RNA, 17 nt, Bordetella pertussis
cgcgccaggccggcggc

SEQ ID NO: 2421833 - RNA, 13 nt, Bordetella pertussis
cgcgccaggcgca

SEQ ID NO: 2421834 - RNA, 15 nt, Bordetella pertussis
cgcgccaggcgcaug

SEQ ID NO: 2421835 - RNA, 17 nt, Bordetella pertussis
cgcgccaggcgccgggc

SEQ ID NO: 2421836 - RNA, 21 nt, Bordetella pertussis
cgcgccaggcgccgggccgcu

SEQ ID NO: 2421837 - RNA, 14 nt, Bordetella pertussis
cgcgccaggcgcgc

SEQ ID NO: 2421838 - RNA, 17 nt, Bordetella pertussis
cgcgccaggcgcgcauc

SEQ ID NO: 2421839 - RNA, 13 nt, Bordetella pertussis
cgcgccaggcgcu

SEQ ID NO: 2421840 - RNA, 16 nt, Bordetella pertussis
cgcgccgaacaccagc

SEQ ID NO: 2421841 - RNA, 23 nt, Bordetella pertussis
cgcgccgaacgacuuggcgcaaa

SEQ ID NO: 2421842 - RNA, 16 nt, Bordetella pertussis
cgcgccgaacgcgcag

SEQ ID NO: 2421843 - RNA, 17 nt, Bordetella pertussis
cgcgccgaacgcgcagc

SEQ ID NO: 2421844 - RNA, 17 nt, Bordetella pertussis
cgcgccgaagcgcaggc

SEQ ID NO: 2421845 - RNA, 22 nt, Bordetella pertussis
cgcgccgaagcgcaggccuucg

SEQ ID NO: 2421846 - RNA, 16 nt, Bordetella pertussis
cgcgccgaccaccugc

SEQ ID NO: 2421847 - RNA, 17 nt, Bordetella pertussis
cgcgccgaccacgcugg

SEQ ID NO: 2421848 - RNA, 20 nt, Bordetella pertussis
cgcgccgaccacgcugggcc

SEQ ID NO: 2421849 - RNA, 13 nt, Bordetella pertussis
cgcgccgaccagg

SEQ ID NO: 2421850 - RNA, 15 nt, Bordetella pertussis
cgcgccgaccggccc

SEQ ID NO: 2421851 - RNA, 13 nt, Bordetella pertussis
cgcgccgacgacc

SEQ ID NO: 2421852 - RNA, 20 nt, Bordetella pertussis
cgcgccgacgaccgaaccga

SEQ ID NO: 2421853 - RNA, 23 nt, Bordetella pertussis
cgcgccgacggcggcgcggcgcc

SEQ ID NO: 2421854 - RNA, 15 nt, Bordetella pertussis
cgcgccgagcggggc

SEQ ID NO: 2421855 - RNA, 16 nt, Bordetella pertussis
cgcgccgagcggggcc

SEQ ID NO: 2421856 - RNA, 21 nt, Bordetella pertussis
cgcgccgagcggggccgcgcc

SEQ ID NO: 2421857 - RNA, 21 nt, Bordetella pertussis
cgcgccgaggaucuggccggc

SEQ ID NO: 2421858 - RNA, 23 nt, Bordetella pertussis
cgcgccgaggaucuggccggcgc

SEQ ID NO: 2421859 - RNA, 22 nt, Bordetella pertussis
cgcgccgaggugaucuggucca

SEQ ID NO: 2421860 - RNA, 16 nt, Bordetella pertussis
cgcgccgaguuuccgc

SEQ ID NO: 2421861 - RNA, 19 nt, Bordetella pertussis
cgcgccgaguuuccgcacc

SEQ ID NO: 2421862 - RNA, 21 nt, Bordetella pertussis
cgcgccgaguuuccgcacccg

SEQ ID NO: 2421863 - RNA, 22 nt, Bordetella pertussis
cgcgccgaguuuccgcacccgg

SEQ ID NO: 2421864 - RNA, 20 nt, Bordetella pertussis
cgcgccgaucaccacgggca

SEQ ID NO: 2421865 - RNA, 21 nt, Bordetella pertussis
cgcgccgaucaccacgggcac

SEQ ID NO: 2421866 - RNA, 22 nt, Bordetella pertussis
cgcgccgaucaccacgggcacg

SEQ ID NO: 2421867 - RNA, 14 nt, Bordetella pertussis
cgcgccgaugcgcc

SEQ ID NO: 2421868 - RNA, 16 nt, Bordetella pertussis
cgcgccgaugcgccag

SEQ ID NO: 2421869 - RNA, 18 nt, Bordetella pertussis
cgcgccgaugcgccaggc

SEQ ID NO: 2421870 - RNA, 21 nt, Bordetella pertussis
cgcgccgcaauagaucaucca

SEQ ID NO: 2421871 - RNA, 23 nt, Bordetella pertussis
cgcgccgcaauagaucauccagg

SEQ ID NO: 2421872 - RNA, 17 nt, Bordetella pertussis
cgcgccgcagcguggcg

SEQ ID NO: 2421873 - RNA, 12 nt, Bordetella pertussis
cgcgccgcaggc

SEQ ID NO: 2421874 - RNA, 13 nt, Bordetella pertussis
cgcgccgccagcg

SEQ ID NO: 2421875 - RNA, 22 nt, Bordetella pertussis
cgcgccgccagcgcgcgcgagg

SEQ ID NO: 2421876 - RNA, 13 nt, Bordetella pertussis
cgcgccgccaggc

SEQ ID NO: 2421877 - RNA, 15 nt, Bordetella pertussis
cgcgccgccaggcgc

SEQ ID NO: 2421878 - RNA, 16 nt, Bordetella pertussis
cgcgccgccaggcgcg

SEQ ID NO: 2421879 - RNA, 17 nt, Bordetella pertussis
cgcgccgccaggcgcga

SEQ ID NO: 2421880 - RNA, 14 nt, Bordetella pertussis
cgcgccgcccccgc

SEQ ID NO: 2421881 - RNA, 15 nt, Bordetella pertussis
cgcgccgcccccgcc

SEQ ID NO: 2421882 - RNA, 19 nt, Bordetella pertussis
cgcgccgcccccgcccagc

SEQ ID NO: 2421883 - RNA, 14 nt, Bordetella pertussis
cgcgccgcccgcgg

SEQ ID NO: 2421884 - RNA, 22 nt, Bordetella pertussis
cgcgccgcccgcggccagccac

SEQ ID NO: 2421885 - RNA, 13 nt, Bordetella pertussis
cgcgccgcccggg

SEQ ID NO: 2421886 - RNA, 13 nt, Bordetella pertussis
cgcgccgccgaug

SEQ ID NO: 2421887 - RNA, 20 nt, Bordetella pertussis
cgcgccgccgccggcccgcc

SEQ ID NO: 2421888 - RNA, 14 nt, Bordetella pertussis
cgcgccgccgccug

SEQ ID NO: 2421889 - RNA, 16 nt, Bordetella pertussis
cgcgccgccgccuggc

SEQ ID NO: 2421890 - RNA, 13 nt, Bordetella pertussis
cgcgccgccgcgc

SEQ ID NO: 2421891 - RNA, 14 nt, Bordetella pertussis
cgcgccgccgcgcc

SEQ ID NO: 2421892 - RNA, 14 nt, Bordetella pertussis
cgcgccgccgcgcu

SEQ ID NO: 2421893 - RNA, 13 nt, Bordetella pertussis
cgcgccgccggcc

SEQ ID NO: 2421894 - RNA, 19 nt, Bordetella pertussis
cgcgccgccggccagccug

SEQ ID NO: 2421895 - RNA, 17 nt, Bordetella pertussis
cgcgccgccggcgucgc

SEQ ID NO: 2421896 - RNA, 20 nt, Bordetella pertussis
cgcgccgccgggccugcccg

SEQ ID NO: 2421897 - RNA, 22 nt, Bordetella pertussis
cgcgccgccguaggacagcccc

SEQ ID NO: 2421898 - RNA, 23 nt, Bordetella pertussis
cgcgccgccguaggacagcccca

SEQ ID NO: 2421899 - RNA, 23 nt, Bordetella pertussis
cgcgccgccucgauugaccagca

SEQ ID NO: 2421900 - RNA, 13 nt, Bordetella pertussis
cgcgccgccuggc

SEQ ID NO: 2421901 - RNA, 15 nt, Bordetella pertussis
cgcgccgccuggccc

SEQ ID NO: 2421902 - RNA, 14 nt, Bordetella pertussis
cgcgccgcgaaacg

SEQ ID NO: 2421903 - RNA, 14 nt, Bordetella pertussis
cgcgccgcgacgcu

SEQ ID NO: 2421904 - RNA, 18 nt, Bordetella pertussis
cgcgccgcgacgcucgag

SEQ ID NO: 2421905 - RNA, 13 nt, Bordetella pertussis
cgcgccgcgaugg

SEQ ID NO: 2421906 - RNA, 22 nt, Bordetella pertussis
cgcgccgcgauggcgccggcca

SEQ ID NO: 2421907 - RNA, 12 nt, Bordetella pertussis
cgcgccgcgccg

SEQ ID NO: 2421908 - RNA, 16 nt, Bordetella pertussis
cgcgccgcgccgcccc

SEQ ID NO: 2421909 - RNA, 16 nt, Bordetella pertussis
cgcgccgcgccgguca

SEQ ID NO: 2421910 - RNA, 13 nt, Bordetella pertussis
cgcgccgcgccuu

SEQ ID NO: 2421911 - RNA, 13 nt, Bordetella pertussis
cgcgccgcgcgca

SEQ ID NO: 2421912 - RNA, 16 nt, Bordetella pertussis
cgcgccgcgcgcacgg

SEQ ID NO: 2421913 - RNA, 13 nt, Bordetella pertussis
cgcgccgcgcgcg

SEQ ID NO: 2421914 - RNA, 14 nt, Bordetella pertussis
cgcgccgcgcgcgg

SEQ ID NO: 2421915 - RNA, 18 nt, Bordetella pertussis
cgcgccgcgcgcggcggc

SEQ ID NO: 2421916 - RNA, 13 nt, Bordetella pertussis
cgcgccgcgcugc

SEQ ID NO: 2421917 - RNA, 20 nt, Bordetella pertussis
cgcgccgcggcaagccgcgg

SEQ ID NO: 2421918 - RNA, 13 nt, Bordetella pertussis
cgcgccgcggcac

SEQ ID NO: 2421919 - RNA, 14 nt, Bordetella pertussis
cgcgccgcggcacg

SEQ ID NO: 2421920 - RNA, 13 nt, Bordetella pertussis
cgcgccgcgucgg

SEQ ID NO: 2421921 - RNA, 22 nt, Bordetella pertussis
cgcgccgcguugcagccacagg

SEQ ID NO: 2421922 - RNA, 18 nt, Bordetella pertussis
cgcgccgcuacagcguca

SEQ ID NO: 2421923 - RNA, 16 nt, Bordetella pertussis
cgcgccgcuggcggcc

SEQ ID NO: 2421924 - RNA, 19 nt, Bordetella pertussis
cgcgccgcuggcguccagg

SEQ ID NO: 2421925 - RNA, 13 nt, Bordetella pertussis
cgcgccgcuguac

SEQ ID NO: 2421926 - RNA, 20 nt, Bordetella pertussis
cgcgccgcuguugcccacca

SEQ ID NO: 2421927 - RNA, 17 nt, Bordetella pertussis
cgcgccggaucgcacac

SEQ ID NO: 2421928 - RNA, 19 nt, Bordetella pertussis
cgcgccggaugcgcguggc

SEQ ID NO: 2421929 - RNA, 12 nt, Bordetella pertussis
cgcgccggcagg

SEQ ID NO: 2421930 - RNA, 17 nt, Bordetella pertussis
cgcgccggcagggcggc

SEQ ID NO: 2421931 - RNA, 18 nt, Bordetella pertussis
cgcgccggcagggcggcc

SEQ ID NO: 2421932 - RNA, 19 nt, Bordetella pertussis
cgcgccggcagggcggcca

SEQ ID NO: 2421933 - RNA, 13 nt, Bordetella pertussis
cgcgccggcaucg

SEQ ID NO: 2421934 - RNA, 14 nt, Bordetella pertussis
cgcgccggccagcg

SEQ ID NO: 2421935 - RNA, 17 nt, Bordetella pertussis
cgcgccggccagcggca

SEQ ID NO: 2421936 - RNA, 14 nt, Bordetella pertussis
cgcgccggccaggg

SEQ ID NO: 2421937 - RNA, 21 nt, Bordetella pertussis
cgcgccggccagggccaccac

SEQ ID NO: 2421938 - RNA, 13 nt, Bordetella pertussis
cgcgccggcccaa

SEQ ID NO: 2421939 - RNA, 15 nt, Bordetella pertussis
cgcgccggcccaagg

SEQ ID NO: 2421940 - RNA, 16 nt, Bordetella pertussis
cgcgccggcccaaggc

SEQ ID NO: 2421941 - RNA, 18 nt, Bordetella pertussis
cgcgccggcccaaggccc

SEQ ID NO: 2421942 - RNA, 14 nt, Bordetella pertussis
cgcgccggcccagg

SEQ ID NO: 2421943 - RNA, 16 nt, Bordetella pertussis
cgcgccggccgacggc

SEQ ID NO: 2421944 - RNA, 17 nt, Bordetella pertussis
cgcgccggccgccagca

SEQ ID NO: 2421945 - RNA, 20 nt, Bordetella pertussis
cgcgccggccgcggggcugg

SEQ ID NO: 2421946 - RNA, 13 nt, Bordetella pertussis
cgcgccggccggu

SEQ ID NO: 2421947 - RNA, 11 nt, Bordetella pertussis
cgcgccggccu

SEQ ID NO: 2421948 - RNA, 13 nt, Bordetella pertussis
cgcgccggccugc

SEQ ID NO: 2421949 - RNA, 18 nt, Bordetella pertussis
cgcgccggccugggcggc

SEQ ID NO: 2421950 - RNA, 13 nt, Bordetella pertussis
cgcgccggcgccg

SEQ ID NO: 2421951 - RNA, 15 nt, Bordetella pertussis
cgcgccggcgccggc

SEQ ID NO: 2421952 - RNA, 20 nt, Bordetella pertussis
cgcgccggcgccggcgcgcc

SEQ ID NO: 2421953 - RNA, 13 nt, Bordetella pertussis
cgcgccggcgcgc

SEQ ID NO: 2421954 - RNA, 20 nt, Bordetella pertussis
cgcgcgagaccagcggaucg

SEQ ID NO: 2421955 - RNA, 12 nt, Bordetella pertussis
cgcgcgagcagu

SEQ ID NO: 2421956 - RNA, 13 nt, Bordetella pertussis
cgcgcgagcaguc

SEQ ID NO: 2421957 - RNA, 24 nt, Bordetella pertussis
cgcgcgagcagucgaccacgcguc

SEQ ID NO: 2421958 - RNA, 22 nt, Bordetella pertussis
cgcgcgagcggcggccgcgucc

SEQ ID NO: 2421959 - RNA, 14 nt, Bordetella pertussis
cgcgcgagcggcgu

SEQ ID NO: 2421960 - RNA, 14 nt, Bordetella pertussis
cgcgcgagcugcgc

SEQ ID NO: 2421961 - RNA, 18 nt, Bordetella pertussis
cgcgcgagcugcgcggcu

SEQ ID NO: 2421962 - RNA, 13 nt, Bordetella pertussis
cgcgcgaggcggc

SEQ ID NO: 2421963 - RNA, 16 nt, Bordetella pertussis
cgcgcgaggcggcggc

SEQ ID NO: 2421964 - RNA, 20 nt, Bordetella pertussis
cgcgcgauagauggccaggu

SEQ ID NO: 2421965 - RNA, 14 nt, Bordetella pertussis
cgcgcgauccgcgc

SEQ ID NO: 2421966 - RNA, 15 nt, Bordetella pertussis
cgcgcgauccgcgcc

SEQ ID NO: 2421967 - RNA, 16 nt, Bordetella pertussis
cgcgcgaucgccagca

SEQ ID NO: 2421968 - RNA, 22 nt, Bordetella pertussis
cgcgcgaucgccagcaggcgcu

SEQ ID NO: 2421969 - RNA, 14 nt, Bordetella pertussis
cgcgcgaucgccgc

SEQ ID NO: 2421970 - RNA, 15 nt, Bordetella pertussis
cgcgcgaucucgggc

SEQ ID NO: 2421971 - RNA, 14 nt, Bordetella pertussis
cgcgcgaugcgcag

SEQ ID NO: 2421972 - RNA, 17 nt, Bordetella pertussis
cgcgcgaugcgcaggcu

SEQ ID NO: 2421973 - RNA, 15 nt, Bordetella pertussis
cgcgcgaugcgcggc

SEQ ID NO: 2421974 - RNA, 22 nt, Bordetella pertussis
cgcgcgaugcgcggcccggccg

SEQ ID NO: 2421975 - RNA, 17 nt, Bordetella pertussis
cgcgcgauguucaggcc

SEQ ID NO: 2421976 - RNA, 19 nt, Bordetella pertussis
cgcgcgauguucaggccgg

SEQ ID NO: 2421977 - RNA, 14 nt, Bordetella pertussis
cgcgcgcaccggcu

SEQ ID NO: 2421978 - RNA, 14 nt, Bordetella pertussis
cgcgcgcacgacca

SEQ ID NO: 2421979 - RNA, 20 nt, Bordetella pertussis
cgcgcgcacgaccaccagcg

SEQ ID NO: 2421980 - RNA, 21 nt, Bordetella pertussis
cgcgcgcacgaccaccagcgc

SEQ ID NO: 2421981 - RNA, 22 nt, Bordetella pertussis
cgcgcgcacgaccaccagcgca

SEQ ID NO: 2421982 - RNA, 12 nt, Bordetella pertussis
cgcgcgcacgcg

SEQ ID NO: 2421983 - RNA, 13 nt, Bordetella pertussis
cgcgcgcacgcgc

SEQ ID NO: 2421984 - RNA, 14 nt, Bordetella pertussis
cgcgcgcacgcugg

SEQ ID NO: 2421985 - RNA, 13 nt, Bordetella pertussis
cgcgcgcacggcg

SEQ ID NO: 2421986 - RNA, 16 nt, Bordetella pertussis
cgcgcgcacggcgccc

SEQ ID NO: 2421987 - RNA, 20 nt, Bordetella pertussis
cgcgcgcagacgcgcucagg

SEQ ID NO: 2421988 - RNA, 14 nt, Bordetella pertussis
cgcgcgcaggcgcu

SEQ ID NO: 2421989 - RNA, 14 nt, Bordetella pertussis
cgcgcgcagggcga

SEQ ID NO: 2421990 - RNA, 13 nt, Bordetella pertussis
cgcgcgcaucacg

SEQ ID NO: 2421991 - RNA, 16 nt, Bordetella pertussis
cgcgcgcaucggccgg

SEQ ID NO: 2421992 - RNA, 16 nt, Bordetella pertussis
cgcgcgcaucgggauc

SEQ ID NO: 2421993 - RNA, 18 nt, Bordetella pertussis
cgcgcgcaugcgccuuac

SEQ ID NO: 2421994 - RNA, 12 nt, Bordetella pertussis
cgcgcgccacca

SEQ ID NO: 2421995 - RNA, 12 nt, Bordetella pertussis
cgcgcgccaccg

SEQ ID NO: 2421996 - RNA, 13 nt, Bordetella pertussis
cgcgcgccaccgc

SEQ ID NO: 2421997 - RNA, 11 nt, Bordetella pertussis
cgcgcgccagc

SEQ ID NO: 2421998 - RNA, 14 nt, Bordetella pertussis
cgcgcgccagcgcg

SEQ ID NO: 2421999 - RNA, 16 nt, Bordetella pertussis
cgcgcgccagcgcggc

SEQ ID NO: 2422000 - RNA, 14 nt, Bordetella pertussis
cgcgcgccagcggc

SEQ ID NO: 2422001 - RNA, 18 nt, Bordetella pertussis
cgcgcgccagcggcugcu

SEQ ID NO: 2422002 - RNA, 13 nt, Bordetella pertussis
cgcgcgccagcug

SEQ ID NO: 2422003 - RNA, 19 nt, Bordetella pertussis
cgcgcgccagggcgccgcg

SEQ ID NO: 2422004 - RNA, 14 nt, Bordetella pertussis
cgcgcgccaggugc

SEQ ID NO: 2422005 - RNA, 22 nt, Bordetella pertussis
cgcgcgccaguugcgcaccgcu

SEQ ID NO: 2422006 - RNA, 18 nt, Bordetella pertussis
cgcgcgccauccggcgca

SEQ ID NO: 2422007 - RNA, 17 nt, Bordetella pertussis
cgcgcgcccaccgagac

SEQ ID NO: 2422008 - RNA, 12 nt, Bordetella pertussis
cgcgcgcccagg

SEQ ID NO: 2422009 - RNA, 16 nt, Bordetella pertussis
cgcgcgcccaggccag

SEQ ID NO: 2422010 - RNA, 14 nt, Bordetella pertussis
cgcgcgcccccagc

SEQ ID NO: 2422011 - RNA, 15 nt, Bordetella pertussis
cgcgcgcccccagcg

SEQ ID NO: 2422012 - RNA, 21 nt, Bordetella pertussis
cgcgcgcccccagcgccguca

SEQ ID NO: 2422013 - RNA, 12 nt, Bordetella pertussis
cgcgcgccccgc

SEQ ID NO: 2422014 - RNA, 22 nt, Bordetella pertussis
cgcgcgccccgcuucgggccgg

SEQ ID NO: 2422015 - RNA, 14 nt, Bordetella pertussis
cgcgcgccgaugcg

SEQ ID NO: 2422016 - RNA, 13 nt, Bordetella pertussis
cgcgcgccgcacg

SEQ ID NO: 2422017 - RNA, 13 nt, Bordetella pertussis
cgcgcgccgcauc

SEQ ID NO: 2422018 - RNA, 14 nt, Bordetella pertussis
cgcgcgccgcauca

SEQ ID NO: 2422019 - RNA, 12 nt, Bordetella pertussis
cgcgcgccgccg

SEQ ID NO: 2422020 - RNA, 19 nt, Bordetella pertussis
cgcgcgccgccucagcccg

SEQ ID NO: 2422021 - RNA, 20 nt, Bordetella pertussis
cgcgcgccgccucagcccgc

SEQ ID NO: 2422022 - RNA, 13 nt, Bordetella pertussis
cgcgcgccgcgcc

SEQ ID NO: 2422023 - RNA, 22 nt, Bordetella pertussis
cgcgcgccgcgccggggcggcu

SEQ ID NO: 2422024 - RNA, 14 nt, Bordetella pertussis
cgcgcgccggcauc

SEQ ID NO: 2422025 - RNA, 13 nt, Bordetella pertussis
cgcgcgccggcca

SEQ ID NO: 2422026 - RNA, 15 nt, Bordetella pertussis
cgcgcgccggccagc

SEQ ID NO: 2422027 - RNA, 13 nt, Bordetella pertussis
cgcgcgccggccg

SEQ ID NO: 2422028 - RNA, 14 nt, Bordetella pertussis
cgcgcgccggcgcc

SEQ ID NO: 2422029 - RNA, 15 nt, Bordetella pertussis
cgcgcgccggcgccg

SEQ ID NO: 2422030 - RNA, 14 nt, Bordetella pertussis
cgcgcgccggcggc

SEQ ID NO: 2422031 - RNA, 21 nt, Bordetella pertussis
cgcgcgccggcucgaacaggc

SEQ ID NO: 2422032 - RNA, 16 nt, Bordetella pertussis
cgcgcgccugcagcag

SEQ ID NO: 2422033 - RNA, 14 nt, Bordetella pertussis
cgcgcgccugcaug

SEQ ID NO: 2422034 - RNA, 16 nt, Bordetella pertussis
cgcgcgccugcaugcc

SEQ ID NO: 2422035 - RNA, 13 nt, Bordetella pertussis
cgcgcgccugcgc

SEQ ID NO: 2422036 - RNA, 14 nt, Bordetella pertussis
cgcgcgccugcucg

SEQ ID NO: 2422037 - RNA, 20 nt, Bordetella pertussis
cgcgcgcgacgacagcggcg

SEQ ID NO: 2422038 - RNA, 15 nt, Bordetella pertussis
cgcgcgcgaggcggc

SEQ ID NO: 2422039 - RNA, 13 nt, Bordetella pertussis
cgcgcgcgcacag

SEQ ID NO: 2422040 - RNA, 14 nt, Bordetella pertussis
cgcgcgcgcacagg

SEQ ID NO: 2422041 - RNA, 11 nt, Bordetella pertussis
cgcgcgcgccc

SEQ ID NO: 2422042 - RNA, 14 nt, Bordetella pertussis
cgcgcgcgcccugc

SEQ ID NO: 2422043 - RNA, 12 nt, Bordetella pertussis
cgcgcgcgccgc

SEQ ID NO: 2422044 - RNA, 13 nt, Bordetella pertussis
cgcgcgcgccgca

SEQ ID NO: 2422045 - RNA, 13 nt, Bordetella pertussis
cgcgcgcgccgcc

SEQ ID NO: 2422046 - RNA, 14 nt, Bordetella pertussis
cgcgcgcgccggca

SEQ ID NO: 2422047 - RNA, 15 nt, Bordetella pertussis
cgcgcgcgccggcau

SEQ ID NO: 2422048 - RNA, 15 nt, Bordetella pertussis
cgcgcgcgccugccc

SEQ ID NO: 2422049 - RNA, 16 nt, Bordetella pertussis
cgcgcgcgcgcacagg

SEQ ID NO: 2422050 - RNA, 13 nt, Bordetella pertussis
cgcgcgcgcgccg

SEQ ID NO: 2422051 - RNA, 14 nt, Bordetella pertussis
cgcgcgcgcgccgc

SEQ ID NO: 2422052 - RNA, 15 nt, Bordetella pertussis
cgcgcgcgcgccgca

SEQ ID NO: 2422053 - RNA, 14 nt, Bordetella pertussis
cgcgcgcgcguagc

SEQ ID NO: 2422054 - RNA, 17 nt, Bordetella pertussis
cgcgcgcggacugccag

SEQ ID NO: 2422055 - RNA, 13 nt, Bordetella pertussis
cgcgcgcggaucg

SEQ ID NO: 2422056 - RNA, 14 nt, Bordetella pertussis
cgcgcgcggaucga

SEQ ID NO: 2422057 - RNA, 17 nt, Bordetella pertussis
cgcgcgcggaucgacgc

SEQ ID NO: 2422058 - RNA, 20 nt, Bordetella pertussis
cgcgcgcggccggcgcgccg

SEQ ID NO: 2422059 - RNA, 11 nt, Bordetella pertussis
cgcgcgcggcg

SEQ ID NO: 2422060 - RNA, 15 nt, Bordetella pertussis
cgcgcgcggcgccgc

SEQ ID NO: 2422061 - RNA, 14 nt, Bordetella pertussis
cgcgcgcggcgccu

SEQ ID NO: 2422062 - RNA, 15 nt, Bordetella pertussis
cgcgcgcggcgccug

SEQ ID NO: 2422063 - RNA, 14 nt, Bordetella pertussis
cgcgcgcggcggcc

SEQ ID NO: 2422064 - RNA, 15 nt, Bordetella pertussis
cgcgcgcgggcgccc

SEQ ID NO: 2422065 - RNA, 13 nt, Bordetella pertussis
cgcgcgcgggcgu

SEQ ID NO: 2422066 - RNA, 21 nt, Bordetella pertussis
cgcgcgcggugucgccgccgc

SEQ ID NO: 2422067 - RNA, 21 nt, Bordetella pertussis
cgcgcgcgguugagcgccagg

SEQ ID NO: 2422068 - RNA, 21 nt, Bordetella pertussis
cgcgcgcguauggcggcgccg

SEQ ID NO: 2422069 - RNA, 21 nt, Bordetella pertussis
cgcgcgcgucgccgcuggcca

SEQ ID NO: 2422070 - RNA, 11 nt, Bordetella pertussis
cgcgcuccggc

SEQ ID NO: 2422071 - RNA, 16 nt, Bordetella pertussis
cgcgcuccggcugcgc

SEQ ID NO: 2422072 - RNA, 20 nt, Bordetella pertussis
cgcgcucgaacaucgcgaag

SEQ ID NO: 2422073 - RNA, 21 nt, Bordetella pertussis
cgcgcucgaacaucgcgaagg

SEQ ID NO: 2422074 - RNA, 23 nt, Bordetella pertussis
cgcgcucgaauggcugcgcgccg

SEQ ID NO: 2422075 - RNA, 13 nt, Bordetella pertussis
cgcgcucgagcau

SEQ ID NO: 2422076 - RNA, 21 nt, Bordetella pertussis
cgcgcucgagcaucuggcgca

SEQ ID NO: 2422077 - RNA, 23 nt, Bordetella pertussis
cgcgcucgagcaucuggcgcaug

SEQ ID NO: 2422078 - RNA, 18 nt, Bordetella pertussis
cgcgcucgagcgcggcgc

SEQ ID NO: 2422079 - RNA, 14 nt, Bordetella pertussis
cgcgcucgcccagc

SEQ ID NO: 2422080 - RNA, 15 nt, Bordetella pertussis
cgcgcucgcccagcc

SEQ ID NO: 2422081 - RNA, 13 nt, Bordetella pertussis
cgcgcucgcccgg

SEQ ID NO: 2422082 - RNA, 14 nt, Bordetella pertussis
cgcgcucgcccggc

SEQ ID NO: 2422083 - RNA, 13 nt, Bordetella pertussis
cgcgcucgcgcca

SEQ ID NO: 2422084 - RNA, 14 nt, Bordetella pertussis
cgcgcucgcgccag

SEQ ID NO: 2422085 - RNA, 16 nt, Bordetella pertussis
cgcgcucgcgccaggc

SEQ ID NO: 2422086 - RNA, 13 nt, Bordetella pertussis
cgcgcucgcgcgc

SEQ ID NO: 2422087 - RNA, 14 nt, Bordetella pertussis
cgcgcucgcgcgcg

SEQ ID NO: 2422088 - RNA, 14 nt, Bordetella pertussis
cgcgcucgcgcucg

SEQ ID NO: 2422089 - RNA, 18 nt, Bordetella pertussis
cgcgcucgcgcucggcca

SEQ ID NO: 2422090 - RNA, 16 nt, Bordetella pertussis
cgcgcucgcugccggc

SEQ ID NO: 2422091 - RNA, 18 nt, Bordetella pertussis
cgcgcucgcugccggcgu

SEQ ID NO: 2422092 - RNA, 18 nt, Bordetella pertussis
cgcgcucggacgccgcgc

SEQ ID NO: 2422093 - RNA, 20 nt, Bordetella pertussis
cgcgcucggacgccgcgcgg

SEQ ID NO: 2422094 - RNA, 18 nt, Bordetella pertussis
cgcgcucggagggcucca

SEQ ID NO: 2422095 - RNA, 12 nt, Bordetella pertussis
cgcgcucggcca

SEQ ID NO: 2422096 - RNA, 20 nt, Bordetella pertussis
cgcgcucggccagcgcgcgg

SEQ ID NO: 2422097 - RNA, 21 nt, Bordetella pertussis
cgcgcucggccagcgcgcggc

SEQ ID NO: 2422098 - RNA, 22 nt, Bordetella pertussis
cgcgcucggccagcgcgcggcc

SEQ ID NO: 2422099 - RNA, 23 nt, Bordetella pertussis
cgcgcucggccagcgcgcggccg

SEQ ID NO: 2422100 - RNA, 14 nt, Bordetella pertussis
cgcgcucggcgccg

SEQ ID NO: 2422101 - RNA, 13 nt, Bordetella pertussis
cgcgcucggcgcu

SEQ ID NO: 2422102 - RNA, 15 nt, Bordetella pertussis
cgcgcucggcgcugc

SEQ ID NO: 2422103 - RNA, 16 nt, Bordetella pertussis
cgcgcucggcgcugcc

SEQ ID NO: 2422104 - RNA, 17 nt, Bordetella pertussis
cgcgcucgggcagcucg

SEQ ID NO: 2422105 - RNA, 14 nt, Bordetella pertussis
cgcgcugacagcgc

SEQ ID NO: 2422106 - RNA, 16 nt, Bordetella pertussis
cgcgcugauccuggcu

SEQ ID NO: 2422107 - RNA, 16 nt, Bordetella pertussis
cgcgcugaugcgcggc

SEQ ID NO: 2422108 - RNA, 12 nt, Bordetella pertussis
cgcgcugauucg

SEQ ID NO: 2422109 - RNA, 14 nt, Bordetella pertussis
cgcgcugcacggcc

SEQ ID NO: 2422110 - RNA, 12 nt, Bordetella pertussis
cgcgcugcagca

SEQ ID NO: 2422111 - RNA, 15 nt, Bordetella pertussis
cgcgcugcagcagca

SEQ ID NO: 2422112 - RNA, 17 nt, Bordetella pertussis
cgcgcugcccaccgccg

SEQ ID NO: 2422113 - RNA, 14 nt, Bordetella pertussis
cgcgcugcccagcc

SEQ ID NO: 2422114 - RNA, 16 nt, Bordetella pertussis
cgcgcugcccagccac

SEQ ID NO: 2422115 - RNA, 14 nt, Bordetella pertussis
cgcgcugccgcugc

SEQ ID NO: 2422116 - RNA, 21 nt, Bordetella pertussis
cgcgcugccggaaacccgggc

SEQ ID NO: 2422117 - RNA, 23 nt, Bordetella pertussis
cgcgcugccugaaaccgcaggca

SEQ ID NO: 2422118 - RNA, 14 nt, Bordetella pertussis
cgcgcugcgacagc

SEQ ID NO: 2422119 - RNA, 16 nt, Bordetella pertussis
cgcgcugcgacagcag

SEQ ID NO: 2422120 - RNA, 18 nt, Bordetella pertussis
cgcgcugcgacagcagca

SEQ ID NO: 2422121 - RNA, 13 nt, Bordetella pertussis
cgcgcugcgcccg

SEQ ID NO: 2422122 - RNA, 12 nt, Bordetella pertussis
cgcgcugcgcgc

SEQ ID NO: 2422123 - RNA, 13 nt, Bordetella pertussis
cgcgcugcgcgcc

SEQ ID NO: 2422124 - RNA, 17 nt, Bordetella pertussis
cgcgcugcggucagcug

SEQ ID NO: 2422125 - RNA, 18 nt, Bordetella pertussis
cgcgcugcugcaggccgg

SEQ ID NO: 2422126 - RNA, 20 nt, Bordetella pertussis
cgcgcugcugcaggccggcg

SEQ ID NO: 2422127 - RNA, 14 nt, Bordetella pertussis
cgcgcugcugccgu

SEQ ID NO: 2422128 - RNA, 20 nt, Bordetella pertussis
cgcgcugcugccgucggcgu

SEQ ID NO: 2422129 - RNA, 12 nt, Bordetella pertussis
cgcgcuggaaga

SEQ ID NO: 2422130 - RNA, 15 nt, Bordetella pertussis
cgcgcuggcgcagca

SEQ ID NO: 2422131 - RNA, 16 nt, Bordetella pertussis
cgcgcuggcgcagcag

SEQ ID NO: 2422132 - RNA, 16 nt, Bordetella pertussis
cgcgcuggcgcccggc

SEQ ID NO: 2422133 - RNA, 17 nt, Bordetella pertussis
cgcgcuggcgcccggcc

SEQ ID NO: 2422134 - RNA, 12 nt, Bordetella pertussis
cgcgcuggcgcg

SEQ ID NO: 2422135 - RNA, 13 nt, Bordetella pertussis
cgcgcuggcgcga

SEQ ID NO: 2422136 - RNA, 19 nt, Bordetella pertussis
cgcgcuggcgcgcgacggc

SEQ ID NO: 2422137 - RNA, 23 nt, Bordetella pertussis
cgcgcuggcgcucgggcgcggca

SEQ ID NO: 2422138 - RNA, 22 nt, Bordetella pertussis
cgcgcuggcgcuggccgcccgc

SEQ ID NO: 2422139 - RNA, 15 nt, Bordetella pertussis
cgcgcuggcggcgca

SEQ ID NO: 2422140 - RNA, 18 nt, Bordetella pertussis
cgcgcuggcggcgcaggc

SEQ ID NO: 2422141 - RNA, 21 nt, Bordetella pertussis
cgcgcuggcggcgcaggccgc

SEQ ID NO: 2422142 - RNA, 11 nt, Bordetella pertussis
cgcgcuggcug

SEQ ID NO: 2422143 - RNA, 19 nt, Bordetella pertussis
cgcgcuggcugugcccgcc

SEQ ID NO: 2422144 - RNA, 20 nt, Bordetella pertussis
cgcgcuggcugugcccgccc

SEQ ID NO: 2422145 - RNA, 22 nt, Bordetella pertussis
cgcgcuggcugugcccgcccca

SEQ ID NO: 2422146 - RNA, 23 nt, Bordetella pertussis
cgcgcugggaaacagcgaaagca

SEQ ID NO: 2422147 - RNA, 12 nt, Bordetella pertussis
cgcgcugggcgc

SEQ ID NO: 2422148 - RNA, 20 nt, Bordetella pertussis
cgcgcugggcgcugcugcug

SEQ ID NO: 2422149 - RNA, 15 nt, Bordetella pertussis
cgcgcuggggcagca

SEQ ID NO: 2422150 - RNA, 17 nt, Bordetella pertussis
cgcgcugggucaggucg

SEQ ID NO: 2422151 - RNA, 14 nt, Bordetella pertussis
cgcgcuggugcugg

SEQ ID NO: 2422152 - RNA, 17 nt, Bordetella pertussis
cgcgcuggugcuggccg

SEQ ID NO: 2422153 - RNA, 18 nt, Bordetella pertussis
cgcgcuguaggcgccggc

SEQ ID NO: 2422154 - RNA, 20 nt, Bordetella pertussis
cgcgcuguaggcgccggcgc

SEQ ID NO: 2422155 - RNA, 21 nt, Bordetella pertussis
cgcgcuguaggcgccggcgcc

SEQ ID NO: 2422156 - RNA, 21 nt, Bordetella pertussis
cgcgcuguucgggcgcggugc

SEQ ID NO: 2422157 - RNA, 19 nt, Bordetella pertussis
cgcgcuguugcuccaggcc

SEQ ID NO: 2422158 - RNA, 16 nt, Bordetella pertussis
cgcgcuucacccugga

SEQ ID NO: 2422159 - RNA, 22 nt, Bordetella pertussis
cgcgcuucacccuggaugccau

SEQ ID NO: 2422160 - RNA, 18 nt, Bordetella pertussis
cgcgcuucaggcgccgca

SEQ ID NO: 2422161 - RNA, 19 nt, Bordetella pertussis
cgcgcuucaggcgccgcag

SEQ ID NO: 2422162 - RNA, 21 nt, Bordetella pertussis
acgccgaauugcuggagcgcc

SEQ ID NO: 2422163 - RNA, 16 nt, Bordetella pertussis
acgccgaccucggcac

SEQ ID NO: 2422164 - RNA, 22 nt, Bordetella pertussis
acgccgaccucuucguugucgc

SEQ ID NO: 2422165 - RNA, 18 nt, Bordetella pertussis
acgccgaccuggcgcccg

SEQ ID NO: 2422166 - RNA, 21 nt, Bordetella pertussis
acgccgacugggugcgccuga

SEQ ID NO: 2422167 - RNA, 21 nt, Bordetella pertussis
acgccgagaagauuucccaga

SEQ ID NO: 2422168 - RNA, 15 nt, Bordetella pertussis
acgccgaucgcgcac

SEQ ID NO: 2422169 - RNA, 16 nt, Bordetella pertussis
acgccgaucgcgcaca

SEQ ID NO: 2422170 - RNA, 20 nt, Bordetella pertussis
acgccgaucgcgcacagcau

SEQ ID NO: 2422171 - RNA, 19 nt, Bordetella pertussis
acgccgaugaccagggcgc

SEQ ID NO: 2422172 - RNA, 20 nt, Bordetella pertussis
acgccgaugaccagggcgcc

SEQ ID NO: 2422173 - RNA, 13 nt, Bordetella pertussis
acgccgauggcgc

SEQ ID NO: 2422174 - RNA, 14 nt, Bordetella pertussis
acgccgauggcgcg

SEQ ID NO: 2422175 - RNA, 15 nt, Bordetella pertussis
acgccgauggcgcgg

SEQ ID NO: 2422176 - RNA, 23 nt, Bordetella pertussis
acgccgauguccacgaaggcgcc

SEQ ID NO: 2422177 - RNA, 17 nt, Bordetella pertussis
acgccgauugaggccag

SEQ ID NO: 2422178 - RNA, 20 nt, Bordetella pertussis
acgccgauugaggccagcac

SEQ ID NO: 2422179 - RNA, 21 nt, Bordetella pertussis
acgccgauugaggccagcacg

SEQ ID NO: 2422180 - RNA, 23 nt, Bordetella pertussis
acgccgauugaggccagcacgcc

SEQ ID NO: 2422181 - RNA, 18 nt, Bordetella pertussis
acgccgccaccagggcgc

SEQ ID NO: 2422182 - RNA, 14 nt, Bordetella pertussis
acgccgccacgcug

SEQ ID NO: 2422183 - RNA, 18 nt, Bordetella pertussis
cgcgcuuucaggugggcg

SEQ ID NO: 2422184 - RNA, 19 nt, Bordetella pertussis
cgcgcuuuuccccgcccag

SEQ ID NO: 2422185 - RNA, 20 nt, Bordetella pertussis
cgcgcuuuuccccgcccagc

SEQ ID NO: 2422186 - RNA, 22 nt, Bordetella pertussis
cgcgcuuuuccccgcccagcga

SEQ ID NO: 2422187 - RNA, 22 nt, Bordetella pertussis
cgcggaaauccguaguccagca

SEQ ID NO: 2422188 - RNA, 20 nt, Bordetella pertussis
cgcggaagcugacgaaacgc

SEQ ID NO: 2422189 - RNA, 20 nt, Bordetella pertussis
cgcggaagucgggcaccagc

SEQ ID NO: 2422190 - RNA, 21 nt, Bordetella pertussis
cgcggacagaugccguccugg

SEQ ID NO: 2422191 - RNA, 13 nt, Bordetella pertussis
cgcggaccuccug

SEQ ID NO: 2422192 - RNA, 17 nt, Bordetella pertussis
cgcggaccugcucgagc

SEQ ID NO: 2422193 - RNA, 22 nt, Bordetella pertussis
cgcggacgaagccuaggcugca

SEQ ID NO: 2422194 - RNA, 13 nt, Bordetella pertussis
cgcggacgccaug

SEQ ID NO: 2422195 - RNA, 16 nt, Bordetella pertussis
cgcggacgccauggcg

SEQ ID NO: 2422196 - RNA, 19 nt, Bordetella pertussis
cgcggacgccauggcggcg

SEQ ID NO: 2422197 - RNA, 21 nt, Bordetella pertussis
cgcggacgccauggcggcggc

SEQ ID NO: 2422198 - RNA, 15 nt, Bordetella pertussis
cgcggacuucgcccg

SEQ ID NO: 2422199 - RNA, 17 nt, Bordetella pertussis
cgcggacuucgcccggg

SEQ ID NO: 2422200 - RNA, 23 nt, Bordetella pertussis
cgcggacuucgcuuucgguggcg

SEQ ID NO: 2422201 - RNA, 22 nt, Bordetella pertussis
cgcggaggugucgccgcccaug

SEQ ID NO: 2422202 - RNA, 20 nt, Bordetella pertussis
cgcggauauucgucggccgc

SEQ ID NO: 2422203 - RNA, 21 nt, Bordetella pertussis
cgcggaucaugggcucgcgcg

SEQ ID NO: 2422204 - RNA, 12 nt, Bordetella pertussis
cgcggauccagc

SEQ ID NO: 2422205 - RNA, 14 nt, Bordetella pertussis
cgcggauccagcca

SEQ ID NO: 2422206 - RNA, 20 nt, Bordetella pertussis
cgcggaucgaaaccggcgcg

SEQ ID NO: 2422207 - RNA, 12 nt, Bordetella pertussis
cgcggaucgacg

SEQ ID NO: 2422208 - RNA, 13 nt, Bordetella pertussis
cgcggaucggcca

SEQ ID NO: 2422209 - RNA, 16 nt, Bordetella pertussis
cgcggaucgugcgcca

SEQ ID NO: 2422210 - RNA, 20 nt, Bordetella pertussis
cgcggaucgugucgaacgga

SEQ ID NO: 2422211 - RNA, 19 nt, Bordetella pertussis
cgcggaugaccugcgccag

SEQ ID NO: 2422212 - RNA, 23 nt, Bordetella pertussis
cgcggaugaucgcgcagcaccgc

SEQ ID NO: 2422213 - RNA, 17 nt, Bordetella pertussis
cgcggaugccguccacg

SEQ ID NO: 2422214 - RNA, 21 nt, Bordetella pertussis
cgcggaugccguccacgccgc

SEQ ID NO: 2422215 - RNA, 15 nt, Bordetella pertussis
cgcggaugcgcgccu

SEQ ID NO: 2422216 - RNA, 16 nt, Bordetella pertussis
cgcggaugcgcgccuu

SEQ ID NO: 2422217 - RNA, 24 nt, Bordetella pertussis
cgcggauugccguccuggcgaccg

SEQ ID NO: 2422218 - RNA, 21 nt, Bordetella pertussis
cgcggauuugcuucaggucgc

SEQ ID NO: 2422219 - RNA, 19 nt, Bordetella pertussis
cgcggcacgaaaagccgcg

SEQ ID NO: 2422220 - RNA, 13 nt, Bordetella pertussis
cgcggcagcccgg

SEQ ID NO: 2422221 - RNA, 15 nt, Bordetella pertussis
cgcggcagcccggca

SEQ ID NO: 2422222 - RNA, 13 nt, Bordetella pertussis
cgcggcagcgccg

SEQ ID NO: 2422223 - RNA, 15 nt, Bordetella pertussis
cgcggcagcgccggg

SEQ ID NO: 2422224 - RNA, 21 nt, Bordetella pertussis
cgcggcaggccccggcccggc

SEQ ID NO: 2422225 - RNA, 16 nt, Bordetella pertussis
cgcggcagggcgucgg

SEQ ID NO: 2422226 - RNA, 19 nt, Bordetella pertussis
cgcggcagggcgucggccg

SEQ ID NO: 2422227 - RNA, 22 nt, Bordetella pertussis
cgcggcagguucugcgcguccu

SEQ ID NO: 2422228 - RNA, 22 nt, Bordetella pertussis
cgcggcauacgccgauggcgcg

SEQ ID NO: 2422229 - RNA, 16 nt, Bordetella pertussis
cgcggcauagcccagg

SEQ ID NO: 2422230 - RNA, 17 nt, Bordetella pertussis
cgcggcauagcccaggc

SEQ ID NO: 2422231 - RNA, 19 nt, Bordetella pertussis
cgcggcauagcccaggccg

SEQ ID NO: 2422232 - RNA, 20 nt, Bordetella pertussis
cgcggcauagcccaggccgc

SEQ ID NO: 2422233 - RNA, 22 nt, Bordetella pertussis
cgcggcauagcccaggccgccg

SEQ ID NO: 2422234 - RNA, 23 nt, Bordetella pertussis
cgcggcauagcccaggccgccgg

SEQ ID NO: 2422235 - RNA, 15 nt, Bordetella pertussis
cgcggcaucggccau

SEQ ID NO: 2422236 - RNA, 15 nt, Bordetella pertussis
cgcggcaugccgcug

SEQ ID NO: 2422237 - RNA, 16 nt, Bordetella pertussis
cgcggcaugccgcugc

SEQ ID NO: 2422238 - RNA, 14 nt, Bordetella pertussis
cgcggcauggcgcc

SEQ ID NO: 2422239 - RNA, 15 nt, Bordetella pertussis
cgcggcauggcgccg

SEQ ID NO: 2422240 - RNA, 16 nt, Bordetella pertussis
cgcggcauggcgccgc

SEQ ID NO: 2422241 - RNA, 18 nt, Bordetella pertussis
cgcggcauggcgccgcgc

SEQ ID NO: 2422242 - RNA, 19 nt, Bordetella pertussis
cgcggcauggcgccgcgcc

SEQ ID NO: 2422243 - RNA, 23 nt, Bordetella pertussis
cgcggcauggcgccgcgccgccg

SEQ ID NO: 2422244 - RNA, 17 nt, Bordetella pertussis
cgcggccaaccccgagg

SEQ ID NO: 2422245 - RNA, 14 nt, Bordetella pertussis
cgcggccaauggcc

SEQ ID NO: 2422246 - RNA, 15 nt, Bordetella pertussis
cgcggccaccaggcu

SEQ ID NO: 2422247 - RNA, 16 nt, Bordetella pertussis
cgcggccacccugccg

SEQ ID NO: 2422248 - RNA, 14 nt, Bordetella pertussis
cgcggccacgccca

SEQ ID NO: 2422249 - RNA, 17 nt, Bordetella pertussis
cgcggccacgcccaagu

SEQ ID NO: 2422250 - RNA, 18 nt, Bordetella pertussis
cgcggccacggccugccc

SEQ ID NO: 2422251 - RNA, 18 nt, Bordetella pertussis
cgcggccagaccuugcgc

SEQ ID NO: 2422252 - RNA, 10 nt, Bordetella pertussis
cgcggccagc

SEQ ID NO: 2422253 - RNA, 11 nt, Bordetella pertussis
cgcggccagca

SEQ ID NO: 2422254 - RNA, 12 nt, Bordetella pertussis
cgcggccagcac

SEQ ID NO: 2422255 - RNA, 13 nt, Bordetella pertussis
cgcggccagcacc

SEQ ID NO: 2422256 - RNA, 14 nt, Bordetella pertussis
cgcggccagcaccg

SEQ ID NO: 2422257 - RNA, 17 nt, Bordetella pertussis
cgcggccagcaccggcc

SEQ ID NO: 2422258 - RNA, 22 nt, Bordetella pertussis
cgcggccagcaccggcccgaag

SEQ ID NO: 2422259 - RNA, 19 nt, Bordetella pertussis
cgcggccagcaccggccgc

SEQ ID NO: 2422260 - RNA, 21 nt, Bordetella pertussis
cgcggccagcaccggccgccg

SEQ ID NO: 2422261 - RNA, 22 nt, Bordetella pertussis
cgcggccagcaccggccgccgc

SEQ ID NO: 2422262 - RNA, 14 nt, Bordetella pertussis
cgcggccagcacga

SEQ ID NO: 2422263 - RNA, 13 nt, Bordetella pertussis
cgcggccagccac

SEQ ID NO: 2422264 - RNA, 17 nt, Bordetella pertussis
cgcggccagccacgccg

SEQ ID NO: 2422265 - RNA, 18 nt, Bordetella pertussis
cgcggccagccacgccgg

SEQ ID NO: 2422266 - RNA, 21 nt, Bordetella pertussis
cgcggccagccacgccggcgc

SEQ ID NO: 2422267 - RNA, 13 nt, Bordetella pertussis
cgcggccagccgg

SEQ ID NO: 2422268 - RNA, 14 nt, Bordetella pertussis
cgcggccagccggg

SEQ ID NO: 2422269 - RNA, 17 nt, Bordetella pertussis
cgcggccagcgccgcgc

SEQ ID NO: 2422270 - RNA, 15 nt, Bordetella pertussis
cgcggccagcgccgg

SEQ ID NO: 2422271 - RNA, 20 nt, Bordetella pertussis
cgcggccagcgcgucgagca

SEQ ID NO: 2422272 - RNA, 21 nt, Bordetella pertussis
cgcggccagcgcgucgagcag

SEQ ID NO: 2422273 - RNA, 23 nt, Bordetella pertussis
cgcggccagcggaugaugcggcg

SEQ ID NO: 2422274 - RNA, 13 nt, Bordetella pertussis
cgcggccagcggc

SEQ ID NO: 2422275 - RNA, 14 nt, Bordetella pertussis
cgcggccagcggca

SEQ ID NO: 2422276 - RNA, 14 nt, Bordetella pertussis
cgcggccagcggcg

SEQ ID NO: 2422277 - RNA, 13 nt, Bordetella pertussis
cgcggccaggccc

SEQ ID NO: 2422278 - RNA, 21 nt, Bordetella pertussis
cgcggccaggcccaugccgcc

SEQ ID NO: 2422279 - RNA, 12 nt, Bordetella pertussis
cgcggccaggcg

SEQ ID NO: 2422280 - RNA, 14 nt, Bordetella pertussis
cgcggccaggcgcu

SEQ ID NO: 2422281 - RNA, 16 nt, Bordetella pertussis
cgcggccagggcugcg

SEQ ID NO: 2422282 - RNA, 19 nt, Bordetella pertussis
cgcggccagggcugcggcg

SEQ ID NO: 2422283 - RNA, 22 nt, Bordetella pertussis
cgcggccagggcugcggcggga

SEQ ID NO: 2422284 - RNA, 22 nt, Bordetella pertussis
cgcggccagggugccccgccgg

SEQ ID NO: 2422285 - RNA, 21 nt, Bordetella pertussis
cgcggccaguucgacgcccau

SEQ ID NO: 2422286 - RNA, 22 nt, Bordetella pertussis
cgcggccaguucgacgcccaug

SEQ ID NO: 2422287 - RNA, 24 nt, Bordetella pertussis
cgcggccaugccggguugcaggau

SEQ ID NO: 2422288 - RNA, 20 nt, Bordetella pertussis
cgcggccaugcggugcgccg

SEQ ID NO: 2422289 - RNA, 17 nt, Bordetella pertussis
cgcggccauguccagca

SEQ ID NO: 2422290 - RNA, 22 nt, Bordetella pertussis
cgcggccauguccagcagcuug

SEQ ID NO: 2422291 - RNA, 16 nt, Bordetella pertussis
cgcggcccagcgcggc

SEQ ID NO: 2422292 - RNA, 17 nt, Bordetella pertussis
cgcggcccagcgcggcg

SEQ ID NO: 2422293 - RNA, 21 nt, Bordetella pertussis
cgcggcccagcgcggcggcca

SEQ ID NO: 2422294 - RNA, 16 nt, Bordetella pertussis
cgcggcccgccacgca

SEQ ID NO: 2422295 - RNA, 17 nt, Bordetella pertussis
cgcggcccgccacgcag

SEQ ID NO: 2422296 - RNA, 21 nt, Bordetella pertussis
cgcggcgccgcauuuccucga

SEQ ID NO: 2422297 - RNA, 23 nt, Bordetella pertussis
cgcggcgccgcauuuccucgacc

SEQ ID NO: 2422298 - RNA, 15 nt, Bordetella pertussis
cgcggcgccgccggc

SEQ ID NO: 2422299 - RNA, 17 nt, Bordetella pertussis
cgcggcgccgccggcgg

SEQ ID NO: 2422300 - RNA, 12 nt, Bordetella pertussis
cgcggcgccgcu

SEQ ID NO: 2422301 - RNA, 18 nt, Bordetella pertussis
cgcggcgccgcuggccac

SEQ ID NO: 2422302 - RNA, 20 nt, Bordetella pertussis
cgcggcgccgcuggccacgu

SEQ ID NO: 2422303 - RNA, 14 nt, Bordetella pertussis
cgcggcgccggccg

SEQ ID NO: 2422304 - RNA, 19 nt, Bordetella pertussis
cgcggcgccggccgucauc

SEQ ID NO: 2422305 - RNA, 19 nt, Bordetella pertussis
cgcggcgccggccuccagc

SEQ ID NO: 2422306 - RNA, 22 nt, Bordetella pertussis
cgcggcgccguccagcgcggca

SEQ ID NO: 2422307 - RNA, 21 nt, Bordetella pertussis
cgcggcgccugcgcgcgcugg

SEQ ID NO: 2422308 - RNA, 21 nt, Bordetella pertussis
cgcggcgccuggggcgugccc

SEQ ID NO: 2422309 - RNA, 15 nt, Bordetella pertussis
cgcggcgcgccagcg

SEQ ID NO: 2422310 - RNA, 12 nt, Bordetella pertussis
cgcggcgcgccg

SEQ ID NO: 2422311 - RNA, 22 nt, Bordetella pertussis
cgcggcgcgccguccgggccgg

SEQ ID NO: 2422312 - RNA, 21 nt, Bordetella pertussis
cgcggcgcgcgauacgucgaa

SEQ ID NO: 2422313 - RNA, 13 nt, Bordetella pertussis
cgcggcgcgcgcc

SEQ ID NO: 2422314 - RNA, 16 nt, Bordetella pertussis
cgcggcgcgcgccagg

SEQ ID NO: 2422315 - RNA, 14 nt, Bordetella pertussis
cgcggcgcgcgccg

SEQ ID NO: 2422316 - RNA, 15 nt, Bordetella pertussis
cgcggcgcgcgccga

SEQ ID NO: 2422317 - RNA, 17 nt, Bordetella pertussis
cgcggcgcgcgccgagg

SEQ ID NO: 2422318 - RNA, 14 nt, Bordetella pertussis
cgcggcgcgcgccu

SEQ ID NO: 2422319 - RNA, 15 nt, Bordetella pertussis
cgcggcgcgcgccug

SEQ ID NO: 2422320 - RNA, 17 nt, Bordetella pertussis
cgcggcgcgcgccugca

SEQ ID NO: 2422321 - RNA, 14 nt, Bordetella pertussis
cgcggcgcgcgcgc

SEQ ID NO: 2422322 - RNA, 17 nt, Bordetella pertussis
cgcggcgcgcgcgcgca

SEQ ID NO: 2422323 - RNA, 16 nt, Bordetella pertussis
cgcggcgcgcgcggcg

SEQ ID NO: 2422324 - RNA, 21 nt, Bordetella pertussis
cgcggcgcgcgcggcgccugg

SEQ ID NO: 2422325 - RNA, 13 nt, Bordetella pertussis
cgcggcgcggcag

SEQ ID NO: 2422326 - RNA, 14 nt, Bordetella pertussis
cgcggcgcggcagg

SEQ ID NO: 2422327 - RNA, 15 nt, Bordetella pertussis
cgcggcgcggcaggu

SEQ ID NO: 2422328 - RNA, 13 nt, Bordetella pertussis
cgcggcgcggcca

SEQ ID NO: 2422329 - RNA, 17 nt, Bordetella pertussis
cgcggcgcggccagcag

SEQ ID NO: 2422330 - RNA, 18 nt, Bordetella pertussis
cgcggcgcggccagcagc

SEQ ID NO: 2422331 - RNA, 13 nt, Bordetella pertussis
cgcggcgcggccc

SEQ ID NO: 2422332 - RNA, 13 nt, Bordetella pertussis
cgcggcgcggccu

SEQ ID NO: 2422333 - RNA, 16 nt, Bordetella pertussis
cgcggcgcggcgcagg

SEQ ID NO: 2422334 - RNA, 17 nt, Bordetella pertussis
cgcggcgcggcgcaggc

SEQ ID NO: 2422335 - RNA, 13 nt, Bordetella pertussis
cgcggcgcgucgc

SEQ ID NO: 2422336 - RNA, 16 nt, Bordetella pertussis
cgcggcgcgucgcgcg

SEQ ID NO: 2422337 - RNA, 18 nt, Bordetella pertussis
cgcggcgcgucgcgcgcc

SEQ ID NO: 2422338 - RNA, 22 nt, Bordetella pertussis
cgcggcgcguucagcagcaggc

SEQ ID NO: 2422339 - RNA, 21 nt, Bordetella pertussis
cgcggcgcguucucagccgcc

SEQ ID NO: 2422340 - RNA, 14 nt, Bordetella pertussis
cgcggcgcuacgcc

SEQ ID NO: 2422341 - RNA, 20 nt, Bordetella pertussis
cgcggcgcugcacgcggccg

SEQ ID NO: 2422342 - RNA, 12 nt, Bordetella pertussis
cgcggcgcugcu

SEQ ID NO: 2422343 - RNA, 20 nt, Bordetella pertussis
cgcggcgcugcuggccggcc

SEQ ID NO: 2422344 - RNA, 17 nt, Bordetella pertussis
cgcggcgcuggcgccgc

SEQ ID NO: 2422345 - RNA, 23 nt, Bordetella pertussis
cgcggcgcuggcgccgcgcgcca

SEQ ID NO: 2422346 - RNA, 14 nt, Bordetella pertussis
cgcggcgcuggcgu

SEQ ID NO: 2422347 - RNA, 19 nt, Bordetella pertussis
cgcggcggacugcgccgca

SEQ ID NO: 2422348 - RNA, 15 nt, Bordetella pertussis
cgcggcggaucggcg

SEQ ID NO: 2422349 - RNA, 19 nt, Bordetella pertussis
cgcggcggcaccagcaggc

SEQ ID NO: 2422350 - RNA, 13 nt, Bordetella pertussis
cgcggcggcagcg

SEQ ID NO: 2422351 - RNA, 13 nt, Bordetella pertussis
cgcggcggccagg

SEQ ID NO: 2422352 - RNA, 16 nt, Bordetella pertussis
cgcggcggccaggcgu

SEQ ID NO: 2422353 - RNA, 20 nt, Bordetella pertussis
cgcggcggccaugcccaggc

SEQ ID NO: 2422354 - RNA, 13 nt, Bordetella pertussis
cgcggcggcccgg

SEQ ID NO: 2422355 - RNA, 13 nt, Bordetella pertussis
cgcggcggccugg

SEQ ID NO: 2422356 - RNA, 21 nt, Bordetella pertussis
cgcggcggccuugugcgccag

SEQ ID NO: 2422357 - RNA, 23 nt, Bordetella pertussis
cgcggcggccuugugcgccagcg

SEQ ID NO: 2422358 - RNA, 13 nt, Bordetella pertussis
cgcggcggcgacc

SEQ ID NO: 2422359 - RNA, 16 nt, Bordetella pertussis
cgcggcggcgaccggc

SEQ ID NO: 2422360 - RNA, 14 nt, Bordetella pertussis
cgcggcggcggcca

SEQ ID NO: 2422361 - RNA, 22 nt, Bordetella pertussis
cgcggcggcggccaugacggcc

SEQ ID NO: 2422362 - RNA, 20 nt, Bordetella pertussis
cgcggcggcgucaaugccag

SEQ ID NO: 2422363 - RNA, 22 nt, Bordetella pertussis
cgcggcggcuugccgucgaccg

SEQ ID NO: 2422364 - RNA, 19 nt, Bordetella pertussis
cgcggcgggaccgugccgc

SEQ ID NO: 2422365 - RNA, 20 nt, Bordetella pertussis
cgcggcgggaccgugccgcc

SEQ ID NO: 2422366 - RNA, 21 nt, Bordetella pertussis
cgcggcgggaccgugccgccg

SEQ ID NO: 2422367 - RNA, 13 nt, Bordetella pertussis
cgcggcgggcgcu

SEQ ID NO: 2422368 - RNA, 15 nt, Bordetella pertussis
cgcggcgggcgcugg

SEQ ID NO: 2422369 - RNA, 16 nt, Bordetella pertussis
cgcggcgggcgcuggc

SEQ ID NO: 2422370 - RNA, 21 nt, Bordetella pertussis
cgcggcgggcgcuggcgcgcg

SEQ ID NO: 2422371 - RNA, 20 nt, Bordetella pertussis
cgcggcgggcggcgcggcca

SEQ ID NO: 2422372 - RNA, 14 nt, Bordetella pertussis
cgcggcgggcucga

SEQ ID NO: 2422373 - RNA, 19 nt, Bordetella pertussis
cgcggcgggcucgagcugg

SEQ ID NO: 2422374 - RNA, 20 nt, Bordetella pertussis
cgcggcgggcucgagcuggc

SEQ ID NO: 2422375 - RNA, 14 nt, Bordetella pertussis
cgcggcgggcuugg

SEQ ID NO: 2422376 - RNA, 17 nt, Bordetella pertussis
cgcggcgggugccgcga

SEQ ID NO: 2422377 - RNA, 19 nt, Bordetella pertussis
cgcggcgggugccgcgaga

SEQ ID NO: 2422378 - RNA, 19 nt, Bordetella pertussis
cgcggcggguggccucgcc

SEQ ID NO: 2422379 - RNA, 19 nt, Bordetella pertussis
cgcggcggguucgcagggc

SEQ ID NO: 2422380 - RNA, 18 nt, Bordetella pertussis
cgcggcgguccucgccgg

SEQ ID NO: 2422381 - RNA, 21 nt, Bordetella pertussis
cgcggcgguccucgccgguca

SEQ ID NO: 2422382 - RNA, 16 nt, Bordetella pertussis
cgcggcgguccugcug

SEQ ID NO: 2422383 - RNA, 14 nt, Bordetella pertussis
cgcggcggugccgc

SEQ ID NO: 2422384 - RNA, 15 nt, Bordetella pertussis
cgcggcggugccgcc

SEQ ID NO: 2422385 - RNA, 14 nt, Bordetella pertussis
cgcggcggugccug

SEQ ID NO: 2422386 - RNA, 13 nt, Bordetella pertussis
cgcggcgguggcg

SEQ ID NO: 2422387 - RNA, 17 nt, Bordetella pertussis
cgcggcgguuucggccg

SEQ ID NO: 2422388 - RNA, 18 nt, Bordetella pertussis
cgcggcgguuucggccgg

SEQ ID NO: 2422389 - RNA, 18 nt, Bordetella pertussis
cgcggcguaccgguccag

SEQ ID NO: 2422390 - RNA, 16 nt, Bordetella pertussis
cgcggcguacuggcgc

SEQ ID NO: 2422391 - RNA, 16 nt, Bordetella pertussis
cgcggcguauggcgcg

SEQ ID NO: 2422392 - RNA, 20 nt, Bordetella pertussis
cgcggcguccgaauacgcca

SEQ ID NO: 2422393 - RNA, 15 nt, Bordetella pertussis
cgcggcguccgcgcc

SEQ ID NO: 2422394 - RNA, 18 nt, Bordetella pertussis
cgcggcguccgcgccgaa

SEQ ID NO: 2422395 - RNA, 13 nt, Bordetella pertussis
acgcgccgcccgg

SEQ ID NO: 2422396 - RNA, 13 nt, Bordetella pertussis
acgcgccgccugg

SEQ ID NO: 2422397 - RNA, 14 nt, Bordetella pertussis
acgcgccgccuggc

SEQ ID NO: 2422398 - RNA, 20 nt, Bordetella pertussis
acgcgccgcuguaccguucg

SEQ ID NO: 2422399 - RNA, 17 nt, Bordetella pertussis
acgcgccggcccaggcg

SEQ ID NO: 2422400 - RNA, 19 nt, Bordetella pertussis
acgcgccgggcgaaccggu

SEQ ID NO: 2422401 - RNA, 13 nt, Bordetella pertussis
acgcgccugcgcg

SEQ ID NO: 2422402 - RNA, 18 nt, Bordetella pertussis
acgcgcgacgccguggug

SEQ ID NO: 2422403 - RNA, 19 nt, Bordetella pertussis
acgcgcgauccgcgccagg

SEQ ID NO: 2422404 - RNA, 21 nt, Bordetella pertussis
acgcgcgauccgcgccaggcg

SEQ ID NO: 2422405 - RNA, 15 nt, Bordetella pertussis
acgcgcgcaaugcgc

SEQ ID NO: 2422406 - RNA, 17 nt, Bordetella pertussis
acgcgcgcaaugcgcgg

SEQ ID NO: 2422407 - RNA, 21 nt, Bordetella pertussis
acgcgcgcaaugcgcggcgcu

SEQ ID NO: 2422408 - RNA, 11 nt, Bordetella pertussis
acgcgcgccac

SEQ ID NO: 2422409 - RNA, 21 nt, Bordetella pertussis
acgcgcgccacuauguggcgu

SEQ ID NO: 2422410 - RNA, 19 nt, Bordetella pertussis
cgcggcugcgaaaggccga

SEQ ID NO: 2422411 - RNA, 15 nt, Bordetella pertussis
cgcggcugcgggccg

SEQ ID NO: 2422412 - RNA, 22 nt, Bordetella pertussis
cgcggcugcgggccggcgccgg

SEQ ID NO: 2422413 - RNA, 14 nt, Bordetella pertussis
cgcggcugcugggc

SEQ ID NO: 2422414 - RNA, 18 nt, Bordetella pertussis
cgcggcugcugggcaugg

SEQ ID NO: 2422415 - RNA, 22 nt, Bordetella pertussis
cgcggcuggggcugcugggccg

SEQ ID NO: 2422416 - RNA, 21 nt, Bordetella pertussis
cgcggcugggucggcgugacg

SEQ ID NO: 2422417 - RNA, 17 nt, Bordetella pertussis
cgcggcugguggugccg

SEQ ID NO: 2422418 - RNA, 20 nt, Bordetella pertussis
cgcggcugguggugccgcgc

SEQ ID NO: 2422419 - RNA, 15 nt, Bordetella pertussis
cgcggcuguccuggc

SEQ ID NO: 2422420 - RNA, 21 nt, Bordetella pertussis
cgcggcuguccuggcguggcc

SEQ ID NO: 2422421 - RNA, 19 nt, Bordetella pertussis
cgcggcuugcagcggacgg

SEQ ID NO: 2422422 - RNA, 21 nt, Bordetella pertussis
cgcggcuugguugucgcgcac

SEQ ID NO: 2422423 - RNA, 16 nt, Bordetella pertussis
cgcggcuuuuucucgg

SEQ ID NO: 2422424 - RNA, 23 nt, Bordetella pertussis
cgcggcuuuuucucggccucgcg

SEQ ID NO: 2422425 - RNA, 21 nt, Bordetella pertussis
cgcgggaagcgcucgcgcagg

SEQ ID NO: 2422426 - RNA, 22 nt, Bordetella pertussis
cgcgggagaucuguaccgccgg

SEQ ID NO: 2422427 - RNA, 18 nt, Bordetella pertussis
cgcgggcaaagcccagca

SEQ ID NO: 2422428 - RNA, 20 nt, Bordetella pertussis
cgcgggcaaagcccagcaag

SEQ ID NO: 2422429 - RNA, 16 nt, Bordetella pertussis
cgcgggcacucggcca

SEQ ID NO: 2422430 - RNA, 12 nt, Bordetella pertussis
cgcgggcagcaa

SEQ ID NO: 2422431 - RNA, 22 nt, Bordetella pertussis
cgcgggcagggcgggggacgcc

SEQ ID NO: 2422432 - RNA, 16 nt, Bordetella pertussis
cgcgggcagugcgccg

SEQ ID NO: 2422433 - RNA, 16 nt, Bordetella pertussis
cgcgggccacgcgccg

SEQ ID NO: 2422434 - RNA, 18 nt, Bordetella pertussis
cgcgggccacugcgccug

SEQ ID NO: 2422435 - RNA, 22 nt, Bordetella pertussis
cgcgggccacugcgccugggcg

SEQ ID NO: 2422436 - RNA, 12 nt, Bordetella pertussis
cgcgggccaggc

SEQ ID NO: 2422437 - RNA, 19 nt, Bordetella pertussis
cgcgggccaggccggccca

SEQ ID NO: 2422438 - RNA, 13 nt, Bordetella pertussis
cgcgggccaguug

SEQ ID NO: 2422439 - RNA, 18 nt, Bordetella pertussis
cgcgggcccgcucggcca

SEQ ID NO: 2422440 - RNA, 22 nt, Bordetella pertussis
cgcgggcccuggcguucgcgcg

SEQ ID NO: 2422441 - RNA, 18 nt, Bordetella pertussis
cgcgggccuacuugccgg

SEQ ID NO: 2422442 - RNA, 21 nt, Bordetella pertussis
cgcgggccuacuugccggcgc

SEQ ID NO: 2422443 - RNA, 22 nt, Bordetella pertussis
cgcgggccuacuugccggcgcu

SEQ ID NO: 2422444 - RNA, 19 nt, Bordetella pertussis
cgcgggccuuggccagcag

SEQ ID NO: 2422445 - RNA, 20 nt, Bordetella pertussis
cgcgggccuuggccagcagc

SEQ ID NO: 2422446 - RNA, 22 nt, Bordetella pertussis
cgcgggccuuggccagcagcgc

SEQ ID NO: 2422447 - RNA, 23 nt, Bordetella pertussis
cgcgggcgauuugccgcagcccg

SEQ ID NO: 2422448 - RNA, 19 nt, Bordetella pertussis
cgcgggcgcccgcgcgcga

SEQ ID NO: 2422449 - RNA, 13 nt, Bordetella pertussis
cgcgggcgcccgg

SEQ ID NO: 2422450 - RNA, 17 nt, Bordetella pertussis
cgcgggcgcccggccgg

SEQ ID NO: 2422451 - RNA, 13 nt, Bordetella pertussis
cgcgggcgccgcg

SEQ ID NO: 2422452 - RNA, 15 nt, Bordetella pertussis
cgcgggcgccgcgca

SEQ ID NO: 2422453 - RNA, 12 nt, Bordetella pertussis
cgcgggcgcgca

SEQ ID NO: 2422454 - RNA, 20 nt, Bordetella pertussis
cgcgggcgcgcagcgcgacc

SEQ ID NO: 2422455 - RNA, 13 nt, Bordetella pertussis
cgcgggcgcgcgc

SEQ ID NO: 2422456 - RNA, 15 nt, Bordetella pertussis
cgcgggcgcgcgccc

SEQ ID NO: 2422457 - RNA, 13 nt, Bordetella pertussis
cgcgggcgcggca

SEQ ID NO: 2422458 - RNA, 15 nt, Bordetella pertussis
cgcgggcgcggcagg

SEQ ID NO: 2422459 - RNA, 14 nt, Bordetella pertussis
cgcgggcggccacg

SEQ ID NO: 2422460 - RNA, 19 nt, Bordetella pertussis
cgcgggcggccacgcgccg

SEQ ID NO: 2422461 - RNA, 20 nt, Bordetella pertussis
cgcgggcggccacgcgccgc

SEQ ID NO: 2422462 - RNA, 12 nt, Bordetella pertussis
cgcgggcggccc

SEQ ID NO: 2422463 - RNA, 16 nt, Bordetella pertussis
cgcgggcggccgacgg

SEQ ID NO: 2422464 - RNA, 22 nt, Bordetella pertussis
cgcgggcggccuaucaccuggg

SEQ ID NO: 2422465 - RNA, 15 nt, Bordetella pertussis
cgcgggcggcgccgg

SEQ ID NO: 2422466 - RNA, 18 nt, Bordetella pertussis
cgcgggcggcgccggccg

SEQ ID NO: 2422467 - RNA, 19 nt, Bordetella pertussis
cgcgggcggcgccggccgc

SEQ ID NO: 2422468 - RNA, 17 nt, Bordetella pertussis
cgcgggcggcgcgccca

SEQ ID NO: 2422469 - RNA, 23 nt, Bordetella pertussis
cgcgggcggcgcgcccagcggca

SEQ ID NO: 2422470 - RNA, 20 nt, Bordetella pertussis
cgcgggcggucggcgcggcg

SEQ ID NO: 2422471 - RNA, 17 nt, Bordetella pertussis
cgcgggcuugcugcccc

SEQ ID NO: 2422472 - RNA, 19 nt, Bordetella pertussis
cgcgggcuugcugcccccc

SEQ ID NO: 2422473 - RNA, 20 nt, Bordetella pertussis
cgcgggcuugcugccccccg

SEQ ID NO: 2422474 - RNA, 15 nt, Bordetella pertussis
cgcggggacaggcac

SEQ ID NO: 2422475 - RNA, 19 nt, Bordetella pertussis
cgcggggacaggcacccau

SEQ ID NO: 2422476 - RNA, 17 nt, Bordetella pertussis
cgcggggacaggcaccg

SEQ ID NO: 2422477 - RNA, 21 nt, Bordetella pertussis
cgcggggacaggcaccgccgc

SEQ ID NO: 2422478 - RNA, 17 nt, Bordetella pertussis
cgcggggacaggcaccu

SEQ ID NO: 2422479 - RNA, 22 nt, Bordetella pertussis
cgcggggacuggcucccaccgg

SEQ ID NO: 2422480 - RNA, 13 nt, Bordetella pertussis
cgcggggccaggc

SEQ ID NO: 2422481 - RNA, 14 nt, Bordetella pertussis
cgcggggccaggcg

SEQ ID NO: 2422482 - RNA, 15 nt, Bordetella pertussis
cgcggggccaggcgc

SEQ ID NO: 2422483 - RNA, 12 nt, Bordetella pertussis
cgcggggccggu

SEQ ID NO: 2422484 - RNA, 16 nt, Bordetella pertussis
cgcggggccgguccgc

SEQ ID NO: 2422485 - RNA, 18 nt, Bordetella pertussis
cgcggggcuggccagcug

SEQ ID NO: 2422486 - RNA, 24 nt, Bordetella pertussis
cgcgggggauagacccuccucgcu

SEQ ID NO: 2422487 - RNA, 20 nt, Bordetella pertussis
cgcgggggugcgcgacagcu

SEQ ID NO: 2422488 - RNA, 22 nt, Bordetella pertussis
cgcggguaggcaaagcgcagca

SEQ ID NO: 2422489 - RNA, 15 nt, Bordetella pertussis
cgcggguccaggccc

SEQ ID NO: 2422490 - RNA, 14 nt, Bordetella pertussis
cgcggguccuugcc

SEQ ID NO: 2422491 - RNA, 13 nt, Bordetella pertussis
cgcgggugcgcag

SEQ ID NO: 2422492 - RNA, 15 nt, Bordetella pertussis
cgcgggugcgcagca

SEQ ID NO: 2422493 - RNA, 13 nt, Bordetella pertussis
cgcgggugcgggc

SEQ ID NO: 2422494 - RNA, 20 nt, Bordetella pertussis
cgcggguggccgcuccagag

SEQ ID NO: 2422495 - RNA, 16 nt, Bordetella pertussis
cgcggguggugcugcu

SEQ ID NO: 2422496 - RNA, 18 nt, Bordetella pertussis
cgcgggugucgcuccccc

SEQ ID NO: 2422497 - RNA, 13 nt, Bordetella pertussis
cgcggguucgacg

SEQ ID NO: 2422498 - RNA, 17 nt, Bordetella pertussis
cgcggguucgacgccgg

SEQ ID NO: 2422499 - RNA, 19 nt, Bordetella pertussis
cgcggguucgacgccggca

SEQ ID NO: 2422500 - RNA, 20 nt, Bordetella pertussis
cgcggguuggucgucagcgc

SEQ ID NO: 2422501 - RNA, 23 nt, Bordetella pertussis
cgcggguuggucgucagcgccgc

SEQ ID NO: 2422502 - RNA, 24 nt, Bordetella pertussis
cgcggguuggucgucagcgccgcg

SEQ ID NO: 2422503 - RNA, 19 nt, Bordetella pertussis
cgcgguaaugacgcagccg

SEQ ID NO: 2422504 - RNA, 21 nt, Bordetella pertussis
cgcgguaaugacgcagccgcc

SEQ ID NO: 2422505 - RNA, 23 nt, Bordetella pertussis
cgcgguaaugacgcagccgcccg

SEQ ID NO: 2422506 - RNA, 16 nt, Bordetella pertussis
cgcgguacgcaccgcc

SEQ ID NO: 2422507 - RNA, 18 nt, Bordetella pertussis
cgcgguacgcaccgccgc

SEQ ID NO: 2422508 - RNA, 22 nt, Bordetella pertussis
cgcgguacgcaccgccgccggc

SEQ ID NO: 2422509 - RNA, 16 nt, Bordetella pertussis
cgcgguacgcccagcu

SEQ ID NO: 2422510 - RNA, 13 nt, Bordetella pertussis
cgcgguagcgccc

SEQ ID NO: 2422511 - RNA, 14 nt, Bordetella pertussis
cgcgguagcgcccc

SEQ ID NO: 2422512 - RNA, 17 nt, Bordetella pertussis
cgcgguaggacggcagc

SEQ ID NO: 2422513 - RNA, 18 nt, Bordetella pertussis
cgcgguaggacggcagca

SEQ ID NO: 2422514 - RNA, 18 nt, Bordetella pertussis
cgcgguagguagcgcgca

SEQ ID NO: 2422515 - RNA, 19 nt, Bordetella pertussis
cgcgguagguagcgcgcag

SEQ ID NO: 2422516 - RNA, 22 nt, Bordetella pertussis
cgcgguagguaugguuggccac

SEQ ID NO: 2422517 - RNA, 14 nt, Bordetella pertussis
cgcgguauggccgc

SEQ ID NO: 2422518 - RNA, 15 nt, Bordetella pertussis
cgcgguauggccgcc

SEQ ID NO: 2422519 - RNA, 16 nt, Bordetella pertussis
cgcgguauggccgccc

SEQ ID NO: 2422520 - RNA, 20 nt, Bordetella pertussis
cgcgguauggccgcccagca

SEQ ID NO: 2422521 - RNA, 22 nt, Bordetella pertussis
cgcgguauucgcgcuggcgcga

SEQ ID NO: 2422522 - RNA, 23 nt, Bordetella pertussis
cgcguccaggcccuggcggcgca

SEQ ID NO: 2422523 - RNA, 20 nt, Bordetella pertussis
cgcguccaucuggaccgcgc

SEQ ID NO: 2422524 - RNA, 22 nt, Bordetella pertussis
cgcguccaucuggaccgcgcgc

SEQ ID NO: 2422525 - RNA, 19 nt, Bordetella pertussis
cgcgucccgugccggccgg

SEQ ID NO: 2422526 - RNA, 22 nt, Bordetella pertussis
cgcgucccgugccggccggacc

SEQ ID NO: 2422527 - RNA, 12 nt, Bordetella pertussis
cgcguccgcgac

SEQ ID NO: 2422528 - RNA, 16 nt, Bordetella pertussis
cgcguccgcgacgcug

SEQ ID NO: 2422529 - RNA, 24 nt, Bordetella pertussis
cgcguccgcucaugccggcaagca

SEQ ID NO: 2422530 - RNA, 14 nt, Bordetella pertussis
cgcguccggcgccc

SEQ ID NO: 2422531 - RNA, 16 nt, Bordetella pertussis
cgcguccggcgcccgc

SEQ ID NO: 2422532 - RNA, 21 nt, Bordetella pertussis
cgcguccggcgcccgccgccg

SEQ ID NO: 2422533 - RNA, 23 nt, Bordetella pertussis
cgcguccggugcgauagcgccgc

SEQ ID NO: 2422534 - RNA, 24 nt, Bordetella pertussis
cgcguccggugcgauagcgccgcg

SEQ ID NO: 2422535 - RNA, 14 nt, Bordetella pertussis
cgcguccucggcca

SEQ ID NO: 2422536 - RNA, 15 nt, Bordetella pertussis
cgcguccucggccag

SEQ ID NO: 2422537 - RNA, 18 nt, Bordetella pertussis
cgcguccucggccagccg

SEQ ID NO: 2422538 - RNA, 14 nt, Bordetella pertussis
cgcguccucggccu

SEQ ID NO: 2422539 - RNA, 13 nt, Bordetella pertussis
cgcguccugccag

SEQ ID NO: 2422540 - RNA, 13 nt, Bordetella pertussis
cgcguccugcgcc

SEQ ID NO: 2422541 - RNA, 14 nt, Bordetella pertussis
cgcguccugcgcca

SEQ ID NO: 2422542 - RNA, 18 nt, Bordetella pertussis
cgcguccugcgccaguug

SEQ ID NO: 2422543 - RNA, 20 nt, Bordetella pertussis
cgcguccugcgccaguugcg

SEQ ID NO: 2422544 - RNA, 14 nt, Bordetella pertussis
cgcguccuggcgcg

SEQ ID NO: 2422545 - RNA, 14 nt, Bordetella pertussis
cgcguccugggccg

SEQ ID NO: 2422546 - RNA, 23 nt, Bordetella pertussis
cgcguccugggccgagcgcgcca

SEQ ID NO: 2422547 - RNA, 15 nt, Bordetella pertussis
cgcguccuuggcggc

SEQ ID NO: 2422548 - RNA, 13 nt, Bordetella pertussis
cgcgucgacagca

SEQ ID NO: 2422549 - RNA, 18 nt, Bordetella pertussis
cgcgucgacagcaugaac

SEQ ID NO: 2422550 - RNA, 15 nt, Bordetella pertussis
cgcgucgagcagcgc

SEQ ID NO: 2422551 - RNA, 16 nt, Bordetella pertussis
cgcgucgagcagcgca

SEQ ID NO: 2422552 - RNA, 15 nt, Bordetella pertussis
cgcgucgagcaggcc

SEQ ID NO: 2422553 - RNA, 17 nt, Bordetella pertussis
cgcgucgagcaggccgg

SEQ ID NO: 2422554 - RNA, 20 nt, Bordetella pertussis
cgcgucgagcaggccggcgu

SEQ ID NO: 2422555 - RNA, 14 nt, Bordetella pertussis
cgcgucgagcgcga

SEQ ID NO: 2422556 - RNA, 23 nt, Bordetella pertussis
cgcgucgagcgcgacgcgcucgu

SEQ ID NO: 2422557 - RNA, 20 nt, Bordetella pertussis
cgcgucgaucagcgcgggcc

SEQ ID NO: 2422558 - RNA, 21 nt, Bordetella pertussis
cgcgucgauccggcagcagca

SEQ ID NO: 2422559 - RNA, 16 nt, Bordetella pertussis
cgcgucgauggagucg

SEQ ID NO: 2422560 - RNA, 20 nt, Bordetella pertussis
cgcgucgccgccguuuucgc

SEQ ID NO: 2422561 - RNA, 13 nt, Bordetella pertussis
cgcgucgccgcgc

SEQ ID NO: 2422562 - RNA, 14 nt, Bordetella pertussis
cgcgucgccgcgcc

SEQ ID NO: 2422563 - RNA, 15 nt, Bordetella pertussis
cgcgucgccgcgccg

SEQ ID NO: 2422564 - RNA, 22 nt, Bordetella pertussis
cgcgucgccgcuggccagccgc

SEQ ID NO: 2422565 - RNA, 15 nt, Bordetella pertussis
cgcgucgccggcgau

SEQ ID NO: 2422566 - RNA, 16 nt, Bordetella pertussis
cgcgucgcgcgccagg

SEQ ID NO: 2422567 - RNA, 17 nt, Bordetella pertussis
cgcgucgcgcgccaggc

SEQ ID NO: 2422568 - RNA, 18 nt, Bordetella pertussis
cgcgucgcgcgccaggcg

SEQ ID NO: 2422569 - RNA, 14 nt, Bordetella pertussis
cgcgucgcgcggcg

SEQ ID NO: 2422570 - RNA, 17 nt, Bordetella pertussis
cgcgucgcgcggcggca

SEQ ID NO: 2422571 - RNA, 19 nt, Bordetella pertussis
cgcgucgcgguacaggcug

SEQ ID NO: 2422572 - RNA, 19 nt, Bordetella pertussis
cgcgucgcguagcgcggcc

SEQ ID NO: 2422573 - RNA, 22 nt, Bordetella pertussis
cgcgucgcucauggaggggcgc

SEQ ID NO: 2422574 - RNA, 14 nt, Bordetella pertussis
cgcgucgcuggccg

SEQ ID NO: 2422575 - RNA, 15 nt, Bordetella pertussis
cgcgucgcuggccgg

SEQ ID NO: 2422576 - RNA, 16 nt, Bordetella pertussis
cgcgucgcugucggcg

SEQ ID NO: 2422577 - RNA, 16 nt, Bordetella pertussis
cgcgucggacgcgcgc

SEQ ID NO: 2422578 - RNA, 17 nt, Bordetella pertussis
cgcgucggacgcgcgcc

SEQ ID NO: 2422579 - RNA, 18 nt, Bordetella pertussis
cgcgucggacgcgcgccg

SEQ ID NO: 2422580 - RNA, 20 nt, Bordetella pertussis
cgcgucggccaaggccggcg

SEQ ID NO: 2422581 - RNA, 14 nt, Bordetella pertussis
cgcgucggccagcg

SEQ ID NO: 2422582 - RNA, 16 nt, Bordetella pertussis
cgcgucggccagcgcc

SEQ ID NO: 2422583 - RNA, 17 nt, Bordetella pertussis
cgcgucggccagcgccg

SEQ ID NO: 2422584 - RNA, 13 nt, Bordetella pertussis
cgcgucggccgcg

SEQ ID NO: 2422585 - RNA, 16 nt, Bordetella pertussis
cgcgucggccugccag

SEQ ID NO: 2422586 - RNA, 13 nt, Bordetella pertussis
cgcgucggcgccg

SEQ ID NO: 2422587 - RNA, 16 nt, Bordetella pertussis
cgcgucggcgccgaug

SEQ ID NO: 2422588 - RNA, 13 nt, Bordetella pertussis
cgcgucggcgcgc

SEQ ID NO: 2422589 - RNA, 14 nt, Bordetella pertussis
cgcgucgugcccgc

SEQ ID NO: 2422590 - RNA, 15 nt, Bordetella pertussis
cgcgucgugcccgcc

SEQ ID NO: 2422591 - RNA, 18 nt, Bordetella pertussis
cgcgucgugcccgccacc

SEQ ID NO: 2422592 - RNA, 23 nt, Bordetella pertussis
cgcgucgugcccgccacccaggg

SEQ ID NO: 2422593 - RNA, 21 nt, Bordetella pertussis
cgcgucguugcgccgaucgcg

SEQ ID NO: 2422594 - RNA, 16 nt, Bordetella pertussis
cgcgucuccagcgccg

SEQ ID NO: 2422595 - RNA, 17 nt, Bordetella pertussis
cgcgucuccagcgccgg

SEQ ID NO: 2422596 - RNA, 21 nt, Bordetella pertussis
cgcgucuccagcgccggcagc

SEQ ID NO: 2422597 - RNA, 19 nt, Bordetella pertussis
cgcgucuggaggacgagcg

SEQ ID NO: 2422598 - RNA, 15 nt, Bordetella pertussis
cgcgucugggccgag

SEQ ID NO: 2422599 - RNA, 18 nt, Bordetella pertussis
cgcgucuucggcgcggcg

SEQ ID NO: 2422600 - RNA, 19 nt, Bordetella pertussis
cgcgucuuggcgggcacca

SEQ ID NO: 2422601 - RNA, 16 nt, Bordetella pertussis
cgcgugaacggcucga

SEQ ID NO: 2422602 - RNA, 23 nt, Bordetella pertussis
cgcgugagaaaagugaucaccgc

SEQ ID NO: 2422603 - RNA, 13 nt, Bordetella pertussis
cgcgugauggaga

SEQ ID NO: 2422604 - RNA, 20 nt, Bordetella pertussis
cgcgugcagaucugcacgcu

SEQ ID NO: 2422605 - RNA, 23 nt, Bordetella pertussis
cgcgugcagaucugcacgcugua

SEQ ID NO: 2422606 - RNA, 14 nt, Bordetella pertussis
cgcgugcagccagc

SEQ ID NO: 2422607 - RNA, 21 nt, Bordetella pertussis
cgcgugcagccagcggccgau

SEQ ID NO: 2422608 - RNA, 15 nt, Bordetella pertussis
cgcgugcagcgccgc

SEQ ID NO: 2422609 - RNA, 16 nt, Bordetella pertussis
cgcgugcagcgccgcg

SEQ ID NO: 2422610 - RNA, 18 nt, Bordetella pertussis
cgcgugcagcgccgcgcg

SEQ ID NO: 2422611 - RNA, 14 nt, Bordetella pertussis
cgcgugcaggccgc

SEQ ID NO: 2422612 - RNA, 13 nt, Bordetella pertussis
cgcgugcagguag

SEQ ID NO: 2422613 - RNA, 13 nt, Bordetella pertussis
cgcgugccagcag

SEQ ID NO: 2422614 - RNA, 15 nt, Bordetella pertussis
cgcgugcccgcgucc

SEQ ID NO: 2422615 - RNA, 13 nt, Bordetella pertussis
cgcgugccgcgca

SEQ ID NO: 2422616 - RNA, 15 nt, Bordetella pertussis
cgcgugcgcgcgcca

SEQ ID NO: 2422617 - RNA, 13 nt, Bordetella pertussis
cgcgugcgcggcc

SEQ ID NO: 2422618 - RNA, 14 nt, Bordetella pertussis
cgcgugcgcggccg

SEQ ID NO: 2422619 - RNA, 17 nt, Bordetella pertussis
cgcgugcgcggccgcgc

SEQ ID NO: 2422620 - RNA, 13 nt, Bordetella pertussis
cgcgugcggaugc

SEQ ID NO: 2422621 - RNA, 15 nt, Bordetella pertussis
cgcgugcggggcggc

SEQ ID NO: 2422622 - RNA, 15 nt, Bordetella pertussis
cgcgugcgugccgac

SEQ ID NO: 2422623 - RNA, 15 nt, Bordetella pertussis
cgcgugcguuucgga

SEQ ID NO: 2422624 - RNA, 21 nt, Bordetella pertussis
cgcgugcucaucggcaggccg

SEQ ID NO: 2422625 - RNA, 17 nt, Bordetella pertussis
cgcgugcuggcgcagca

SEQ ID NO: 2422626 - RNA, 13 nt, Bordetella pertussis
cgcguggccagca

SEQ ID NO: 2422627 - RNA, 16 nt, Bordetella pertussis
cgcguggccagcacgg

SEQ ID NO: 2422628 - RNA, 16 nt, Bordetella pertussis
cgcguggccaucaacg

SEQ ID NO: 2422629 - RNA, 18 nt, Bordetella pertussis
acgcugaagcgccgccac

SEQ ID NO: 2422630 - RNA, 12 nt, Bordetella pertussis
acgcugacccug

SEQ ID NO: 2422631 - RNA, 14 nt, Bordetella pertussis
acgcugaucgccgg

SEQ ID NO: 2422632 - RNA, 15 nt, Bordetella pertussis
acgcugaucgccggc

SEQ ID NO: 2422633 - RNA, 16 nt, Bordetella pertussis
acgcugaucgccggcg

SEQ ID NO: 2422634 - RNA, 18 nt, Bordetella pertussis
acgcugaucggccgacug

SEQ ID NO: 2422635 - RNA, 16 nt, Bordetella pertussis
acgcugaucucggccu

SEQ ID NO: 2422636 - RNA, 15 nt, Bordetella pertussis
cgcguggcgcccagc

SEQ ID NO: 2422637 - RNA, 14 nt, Bordetella pertussis
cgcguggcgcgcca

SEQ ID NO: 2422638 - RNA, 18 nt, Bordetella pertussis
cgcguggcgcgccagcgc

SEQ ID NO: 2422639 - RNA, 14 nt, Bordetella pertussis
cgcguggcggcgca

SEQ ID NO: 2422640 - RNA, 19 nt, Bordetella pertussis
cgcguggcggcgcagcgcc

SEQ ID NO: 2422641 - RNA, 18 nt, Bordetella pertussis
cgcgugggcacccggccg

SEQ ID NO: 2422642 - RNA, 20 nt, Bordetella pertussis
cgcgugggcacccggccgcu

SEQ ID NO: 2422643 - RNA, 21 nt, Bordetella pertussis
cgcgugggcacccggccgcug

SEQ ID NO: 2422644 - RNA, 15 nt, Bordetella pertussis
cgcgugggccagcaa

SEQ ID NO: 2422645 - RNA, 16 nt, Bordetella pertussis
cgcgugggcggcggca

SEQ ID NO: 2422646 - RNA, 22 nt, Bordetella pertussis
cgcgugggcggcggcaugcugg

SEQ ID NO: 2422647 - RNA, 15 nt, Bordetella pertussis
cgcgugguggcgcag

SEQ ID NO: 2422648 - RNA, 19 nt, Bordetella pertussis
cgcgugguggcgcagaugg

SEQ ID NO: 2422649 - RNA, 19 nt, Bordetella pertussis
cgcgugucccagccggcgg

SEQ ID NO: 2422650 - RNA, 22 nt, Bordetella pertussis
cgcgugugguuggcgcugcugc

SEQ ID NO: 2422651 - RNA, 18 nt, Bordetella pertussis
cgcguucaagucgcccug

SEQ ID NO: 2422652 - RNA, 21 nt, Bordetella pertussis
cgcguucacgccggcgcgccg

SEQ ID NO: 2422653 - RNA, 20 nt, Bordetella pertussis
cgcguucagcagcaggcccu

SEQ ID NO: 2422654 - RNA, 19 nt, Bordetella pertussis
cgcguucagcauuucgcaa

SEQ ID NO: 2422655 - RNA, 16 nt, Bordetella pertussis
cgcguucagggcgccg

SEQ ID NO: 2422656 - RNA, 14 nt, Bordetella pertussis
cgcguuccggccgc

SEQ ID NO: 2422657 - RNA, 15 nt, Bordetella pertussis
cgcguucgccgcagc

SEQ ID NO: 2422658 - RNA, 17 nt, Bordetella pertussis
cgcguucgccgcagccg

SEQ ID NO: 2422659 - RNA, 15 nt, Bordetella pertussis
cgcguucgccgucgu

SEQ ID NO: 2422660 - RNA, 14 nt, Bordetella pertussis
cgcguucgggcggc

SEQ ID NO: 2422661 - RNA, 15 nt, Bordetella pertussis
cgcguucgggcggca

SEQ ID NO: 2422662 - RNA, 17 nt, Bordetella pertussis
cgcguucgggcggcagg

SEQ ID NO: 2422663 - RNA, 19 nt, Bordetella pertussis
cgcguucucagccgcccgc

SEQ ID NO: 2422664 - RNA, 14 nt, Bordetella pertussis
cgcguugagcgccg

SEQ ID NO: 2422665 - RNA, 22 nt, Bordetella pertussis
cgcguugagcgccgacgggccg

SEQ ID NO: 2422666 - RNA, 20 nt, Bordetella pertussis
cgcguugcaccgcgucggcc

SEQ ID NO: 2422667 - RNA, 21 nt, Bordetella pertussis
cgcguugcaccgcgucggccu

SEQ ID NO: 2422668 - RNA, 15 nt, Bordetella pertussis
cgcguugcgcugccc

SEQ ID NO: 2422669 - RNA, 17 nt, Bordetella pertussis
cgcguuguucgggccgg

SEQ ID NO: 2422670 - RNA, 20 nt, Bordetella pertussis
cgcguuguucgggccggcug

SEQ ID NO: 2422671 - RNA, 23 nt, Bordetella pertussis
cgcguuguucgggccggcugccg

SEQ ID NO: 2422672 - RNA, 21 nt, Bordetella pertussis
cgcguuucccucggugcugcu

SEQ ID NO: 2422673 - RNA, 14 nt, Bordetella pertussis
cgcguuucggucag

SEQ ID NO: 2422674 - RNA, 17 nt, Bordetella pertussis
cgcuaaccgcucgucau

SEQ ID NO: 2422675 - RNA, 22 nt, Bordetella pertussis
cgcuaaggagaauccgcaggcg

SEQ ID NO: 2422676 - RNA, 18 nt, Bordetella pertussis
cgcuacagcgucacggca

SEQ ID NO: 2422677 - RNA, 19 nt, Bordetella pertussis
cgcuacagggugccgcgcc

SEQ ID NO: 2422678 - RNA, 20 nt, Bordetella pertussis
cgcuacagggugccgcgccg

SEQ ID NO: 2422679 - RNA, 13 nt, Bordetella pertussis
cgcuaccaggcgc

SEQ ID NO: 2422680 - RNA, 15 nt, Bordetella pertussis
cgcuaccaggcgcgc

SEQ ID NO: 2422681 - RNA, 12 nt, Bordetella pertussis
cgcuaccccggc

SEQ ID NO: 2422682 - RNA, 16 nt, Bordetella pertussis
cgcuaccccggcagcg

SEQ ID NO: 2422683 - RNA, 23 nt, Bordetella pertussis
cgcuacccugcccauucccgccc

SEQ ID NO: 2422684 - RNA, 18 nt, Bordetella pertussis
cgcuaccgcuucccuggc

SEQ ID NO: 2422685 - RNA, 20 nt, Bordetella pertussis
cgcuacgacgagaucgcgcc

SEQ ID NO: 2422686 - RNA, 18 nt, Bordetella pertussis
cgcuacgcggcgucagga

SEQ ID NO: 2422687 - RNA, 13 nt, Bordetella pertussis
cgcuaggaucgcg

SEQ ID NO: 2422688 - RNA, 18 nt, Bordetella pertussis
cgcuaggccuugccgccg

SEQ ID NO: 2422689 - RNA, 15 nt, Bordetella pertussis
cgcuaucauccgcgc

SEQ ID NO: 2422690 - RNA, 17 nt, Bordetella pertussis
cgcuaucauccgcgcau

SEQ ID NO: 2422691 - RNA, 21 nt, Bordetella pertussis
cgcuaugggggcgagcgggcc

SEQ ID NO: 2422692 - RNA, 22 nt, Bordetella pertussis
cgcuaugggggcgagcgggccg

SEQ ID NO: 2422693 - RNA, 15 nt, Bordetella pertussis
cgcucaagggccugu

SEQ ID NO: 2422694 - RNA, 23 nt, Bordetella pertussis
cgcucaauucggccugacgggcc

SEQ ID NO: 2422695 - RNA, 23 nt, Bordetella pertussis
cgcucacagggucaaggcgcggc

SEQ ID NO: 2422696 - RNA, 14 nt, Bordetella pertussis
cgcucaccgagggc

SEQ ID NO: 2422697 - RNA, 15 nt, Bordetella pertussis
cgcucaccgagggcc

SEQ ID NO: 2422698 - RNA, 20 nt, Bordetella pertussis
cgcucacgcccgugucgccg

SEQ ID NO: 2422699 - RNA, 15 nt, Bordetella pertussis
cgcucagcaccaggc

SEQ ID NO: 2422700 - RNA, 16 nt, Bordetella pertussis
cgcucagcaccaggcc

SEQ ID NO: 2422701 - RNA, 20 nt, Bordetella pertussis
cgcucagcaccaggccgccg

SEQ ID NO: 2422702 - RNA, 21 nt, Bordetella pertussis
cgcucagcaugcgcugggcgg

SEQ ID NO: 2422703 - RNA, 23 nt, Bordetella pertussis
cgcucagccuugucgcgggcagu

SEQ ID NO: 2422704 - RNA, 19 nt, Bordetella pertussis
cgcucagcgacgcgcgccg

SEQ ID NO: 2422705 - RNA, 22 nt, Bordetella pertussis
cgcucagcgacgcgcgccggcg

SEQ ID NO: 2422706 - RNA, 15 nt, Bordetella pertussis
cgcucagcgccauca

SEQ ID NO: 2422707 - RNA, 19 nt, Bordetella pertussis
cgcucagcgccaucaucgc

SEQ ID NO: 2422708 - RNA, 13 nt, Bordetella pertussis
cgcucagcgcgcc

SEQ ID NO: 2422709 - RNA, 15 nt, Bordetella pertussis
cgcucagcgcgccga

SEQ ID NO: 2422710 - RNA, 22 nt, Bordetella pertussis
cgcucagcgcggcgcggccagc

SEQ ID NO: 2422711 - RNA, 17 nt, Bordetella pertussis
cgcucaggaaccagcgg

SEQ ID NO: 2422712 - RNA, 22 nt, Bordetella pertussis
cgcucaggaaccagcggcuggc

SEQ ID NO: 2422713 - RNA, 13 nt, Bordetella pertussis
cgcucaggccgcc

SEQ ID NO: 2422714 - RNA, 14 nt, Bordetella pertussis
cgcucaggccgccg

SEQ ID NO: 2422715 - RNA, 18 nt, Bordetella pertussis
cgcucaggccgccggcgc

SEQ ID NO: 2422716 - RNA, 18 nt, Bordetella pertussis
cgcucaggccgcugggca

SEQ ID NO: 2422717 - RNA, 21 nt, Bordetella pertussis
cgcucaggccgcugggcacau

SEQ ID NO: 2422718 - RNA, 22 nt, Bordetella pertussis
cgcucaggccgcugggcacauc

SEQ ID NO: 2422719 - RNA, 18 nt, Bordetella pertussis
cgcucagggggcgcccca

SEQ ID NO: 2422720 - RNA, 20 nt, Bordetella pertussis
cgcucagggggcgccccaac

SEQ ID NO: 2422721 - RNA, 15 nt, Bordetella pertussis
cgcucaggguacggc

SEQ ID NO: 2422722 - RNA, 21 nt, Bordetella pertussis
cgcucaggguacggcgaugcc

SEQ ID NO: 2422723 - RNA, 23 nt, Bordetella pertussis
cgcucagguagaccacgcgcugc

SEQ ID NO: 2422724 - RNA, 13 nt, Bordetella pertussis
cgcucaucaucgc

SEQ ID NO: 2422725 - RNA, 17 nt, Bordetella pertussis
cgcucaucaucgcgcug

SEQ ID NO: 2422726 - RNA, 18 nt, Bordetella pertussis
cgcucaucaucgcgcugg

SEQ ID NO: 2422727 - RNA, 22 nt, Bordetella pertussis
cgcucaucaucgcgcuggcgcg

SEQ ID NO: 2422728 - RNA, 13 nt, Bordetella pertussis
cgcucauccaggc

SEQ ID NO: 2422729 - RNA, 16 nt, Bordetella pertussis
cgcucauccaggcgcg

SEQ ID NO: 2422730 - RNA, 19 nt, Bordetella pertussis
cgcucaugaaacgaucggc

SEQ ID NO: 2422731 - RNA, 21 nt, Bordetella pertussis
cgcucaugaaacgaucggcga

SEQ ID NO: 2422732 - RNA, 16 nt, Bordetella pertussis
cgcucaugaccagcgg

SEQ ID NO: 2422733 - RNA, 17 nt, Bordetella pertussis
cgcucaugaccagcggc

SEQ ID NO: 2422734 - RNA, 18 nt, Bordetella pertussis
cgcucaugaccagcggcg

SEQ ID NO: 2422735 - RNA, 19 nt, Bordetella pertussis
cgcucaugaccagcggcgu

SEQ ID NO: 2422736 - RNA, 22 nt, Bordetella pertussis
cgcucauggaggggcgcaggca

SEQ ID NO: 2422737 - RNA, 21 nt, Bordetella pertussis
cgcuccaccagcaccggcagc

SEQ ID NO: 2422738 - RNA, 22 nt, Bordetella pertussis
cgcuccaccagcaccggcagcg

SEQ ID NO: 2422739 - RNA, 15 nt, Bordetella pertussis
cgcuccagagcgcgc

SEQ ID NO: 2422740 - RNA, 17 nt, Bordetella pertussis
cgcuccagagcgcgcac

SEQ ID NO: 2422741 - RNA, 19 nt, Bordetella pertussis
cgcuccagauaugccccuc

SEQ ID NO: 2422742 - RNA, 22 nt, Bordetella pertussis
cgcuccagcgucauggccuggc

SEQ ID NO: 2422743 - RNA, 12 nt, Bordetella pertussis
cgcuccagggcg

SEQ ID NO: 2422744 - RNA, 19 nt, Bordetella pertussis
cgcuccagggcgucggcga

SEQ ID NO: 2422745 - RNA, 16 nt, Bordetella pertussis
cgcuccaugcggcggc

SEQ ID NO: 2422746 - RNA, 15 nt, Bordetella pertussis
cgcuccauggcgccg

SEQ ID NO: 2422747 - RNA, 19 nt, Bordetella pertussis
cgcuccgccauggaggcgc

SEQ ID NO: 2422748 - RNA, 19 nt, Bordetella pertussis
cgcugauggccgccagcgg

SEQ ID NO: 2422749 - RNA, 16 nt, Bordetella pertussis
cgcugauucgcgucgu

SEQ ID NO: 2422750 - RNA, 23 nt, Bordetella pertussis
cgcugcacggccuugucgcgccc

SEQ ID NO: 2422751 - RNA, 23 nt, Bordetella pertussis
cgcugcagaucaucgagcaccgc

SEQ ID NO: 2422752 - RNA, 18 nt, Bordetella pertussis
cgcugcagcacgcaccag

SEQ ID NO: 2422753 - RNA, 21 nt, Bordetella pertussis
cgcugcagcacgcaccaggcg

SEQ ID NO: 2422754 - RNA, 13 nt, Bordetella pertussis
cgcugcagcauga

SEQ ID NO: 2422755 - RNA, 21 nt, Bordetella pertussis
cgcugcagccauucggccacu

SEQ ID NO: 2422756 - RNA, 15 nt, Bordetella pertussis
cgcugcagcgcagga

SEQ ID NO: 2422757 - RNA, 12 nt, Bordetella pertussis
cgcugcagcgcu

SEQ ID NO: 2422758 - RNA, 14 nt, Bordetella pertussis
cgcugcagcgcugg

SEQ ID NO: 2422759 - RNA, 19 nt, Bordetella pertussis
cgcugcagcgucugcuggu

SEQ ID NO: 2422760 - RNA, 21 nt, Bordetella pertussis
cgcugcaggaucgcggccagc

SEQ ID NO: 2422761 - RNA, 12 nt, Bordetella pertussis
cgcugcaggccc

SEQ ID NO: 2422762 - RNA, 17 nt, Bordetella pertussis
cgcugcauacgccgcug

SEQ ID NO: 2422763 - RNA, 18 nt, Bordetella pertussis
cgcugcauacgccgcuga

SEQ ID NO: 2422764 - RNA, 16 nt, Bordetella pertussis
cgcugcaugggcggcc

SEQ ID NO: 2422765 - RNA, 17 nt, Bordetella pertussis
cgcugcaugggcggccc

SEQ ID NO: 2422766 - RNA, 19 nt, Bordetella pertussis
cgcugcaugggcggcccgc

SEQ ID NO: 2422767 - RNA, 20 nt, Bordetella pertussis
cgcugcaugggcggcccgcu

SEQ ID NO: 2422768 - RNA, 21 nt, Bordetella pertussis
cgcugcaugggcggcccgcuc

SEQ ID NO: 2422769 - RNA, 12 nt, Bordetella pertussis
cgcugccagcca

SEQ ID NO: 2422770 - RNA, 19 nt, Bordetella pertussis
cgcugccagggugcaccag

SEQ ID NO: 2422771 - RNA, 20 nt, Bordetella pertussis
cgcugcccaccuuccugcug

SEQ ID NO: 2422772 - RNA, 13 nt, Bordetella pertussis
cgcugcccagcau

SEQ ID NO: 2422773 - RNA, 14 nt, Bordetella pertussis
cgcugcccagcaug

SEQ ID NO: 2422774 - RNA, 17 nt, Bordetella pertussis
cgcugcccagcaugggg

SEQ ID NO: 2422775 - RNA, 19 nt, Bordetella pertussis
cgcugcccagccacaccag

SEQ ID NO: 2422776 - RNA, 22 nt, Bordetella pertussis
cgcugcccagcgucagcugggc

SEQ ID NO: 2422777 - RNA, 15 nt, Bordetella pertussis
cgcugcccgacgacg

SEQ ID NO: 2422778 - RNA, 17 nt, Bordetella pertussis
cgcugcccgucgcuggc

SEQ ID NO: 2422779 - RNA, 19 nt, Bordetella pertussis
cgcugcccguuggcgucga

SEQ ID NO: 2422780 - RNA, 15 nt, Bordetella pertussis
cgcugcccugcugcu

SEQ ID NO: 2422781 - RNA, 23 nt, Bordetella pertussis
cgcugcccuggaucaggaugggc

SEQ ID NO: 2422782 - RNA, 15 nt, Bordetella pertussis
cgcugccgaccagca

SEQ ID NO: 2422783 - RNA, 22 nt, Bordetella pertussis
cgcugccgaccagcacgggaug

SEQ ID NO: 2422784 - RNA, 13 nt, Bordetella pertussis
cgcugccgcgcga

SEQ ID NO: 2422785 - RNA, 14 nt, Bordetella pertussis
cgcugccgcgcgau

SEQ ID NO: 2422786 - RNA, 14 nt, Bordetella pertussis
cgcugccgcgcgcc

SEQ ID NO: 2422787 - RNA, 16 nt, Bordetella pertussis
cgcugccgcgcgccgg

SEQ ID NO: 2422788 - RNA, 16 nt, Bordetella pertussis
cgcugccgcugcaggc

SEQ ID NO: 2422789 - RNA, 21 nt, Bordetella pertussis
cgcugccggaaacccgggcuu

SEQ ID NO: 2422790 - RNA, 22 nt, Bordetella pertussis
cgcugccggccgaccggcgcgc

SEQ ID NO: 2422791 - RNA, 11 nt, Bordetella pertussis
cgcugccggcg

SEQ ID NO: 2422792 - RNA, 13 nt, Bordetella pertussis
cgcugccggcgcc

SEQ ID NO: 2422793 - RNA, 14 nt, Bordetella pertussis
cgcugccggcgccc

SEQ ID NO: 2422794 - RNA, 20 nt, Bordetella pertussis
cgcugccgggcucggccacc

SEQ ID NO: 2422795 - RNA, 21 nt, Bordetella pertussis
cgcugccgggcucggccacca

SEQ ID NO: 2422796 - RNA, 23 nt, Bordetella pertussis
cgcugccgggcucggccaccaug

SEQ ID NO: 2422797 - RNA, 14 nt, Bordetella pertussis
cgcugccugccggc

SEQ ID NO: 2422798 - RNA, 15 nt, Bordetella pertussis
cgcugccugccggcc

SEQ ID NO: 2422799 - RNA, 18 nt, Bordetella pertussis
cgcugccugccggccggc

SEQ ID NO: 2422800 - RNA, 20 nt, Bordetella pertussis
cgcugccugccggccggcca

SEQ ID NO: 2422801 - RNA, 22 nt, Bordetella pertussis
cgcugccugccggccggccagu

SEQ ID NO: 2422802 - RNA, 20 nt, Bordetella pertussis
cgcugcgaaaaagcccgcgc

SEQ ID NO: 2422803 - RNA, 14 nt, Bordetella pertussis
cgcugcgaaacagc

SEQ ID NO: 2422804 - RNA, 17 nt, Bordetella pertussis
cgcugcgaaacagcagc

SEQ ID NO: 2422805 - RNA, 18 nt, Bordetella pertussis
cgcugcgaaacagcagcg

SEQ ID NO: 2422806 - RNA, 19 nt, Bordetella pertussis
cgcugcgaaacagcagcgg

SEQ ID NO: 2422807 - RNA, 16 nt, Bordetella pertussis
cgcugcgacagcagca

SEQ ID NO: 2422808 - RNA, 16 nt, Bordetella pertussis
cgcugcgagccgccgc

SEQ ID NO: 2422809 - RNA, 14 nt, Bordetella pertussis
cgcugcgcagcagg

SEQ ID NO: 2422810 - RNA, 16 nt, Bordetella pertussis
cgcugcgcagcagggc

SEQ ID NO: 2422811 - RNA, 12 nt, Bordetella pertussis
cgcugcgcaggc

SEQ ID NO: 2422812 - RNA, 16 nt, Bordetella pertussis
cgcugcgcaggcgcgc

SEQ ID NO: 2422813 - RNA, 13 nt, Bordetella pertussis
cgcugcgcauggc

SEQ ID NO: 2422814 - RNA, 14 nt, Bordetella pertussis
cgcugcgcccgcua

SEQ ID NO: 2422815 - RNA, 20 nt, Bordetella pertussis
cgcugcgccgaggccugcug

SEQ ID NO: 2422816 - RNA, 12 nt, Bordetella pertussis
cgcugcgccgcg

SEQ ID NO: 2422817 - RNA, 15 nt, Bordetella pertussis
cgcugcgccggcggc

SEQ ID NO: 2422818 - RNA, 19 nt, Bordetella pertussis
cgcugcgccuuggcgcgca

SEQ ID NO: 2422819 - RNA, 21 nt, Bordetella pertussis
cgcugcgccuuggcgcgcaga

SEQ ID NO: 2422820 - RNA, 13 nt, Bordetella pertussis
cgcugcgcgaacg

SEQ ID NO: 2422821 - RNA, 12 nt, Bordetella pertussis
cgcugcgcgccg

SEQ ID NO: 2422822 - RNA, 15 nt, Bordetella pertussis
cgcugcgcgccgccg

SEQ ID NO: 2422823 - RNA, 13 nt, Bordetella pertussis
cgcugcgcgcggc

SEQ ID NO: 2422824 - RNA, 15 nt, Bordetella pertussis
cgcugcgcgcggccu

SEQ ID NO: 2422825 - RNA, 19 nt, Bordetella pertussis
cgcugcgcgcggccuggcg

SEQ ID NO: 2422826 - RNA, 20 nt, Bordetella pertussis
cgcugcgcgcggccuggcgg

SEQ ID NO: 2422827 - RNA, 15 nt, Bordetella pertussis
cgcugcgcggcggcu

SEQ ID NO: 2422828 - RNA, 15 nt, Bordetella pertussis
cgcugcgcuggccgc

SEQ ID NO: 2422829 - RNA, 17 nt, Bordetella pertussis
cgcugcgcuggccgcga

SEQ ID NO: 2422830 - RNA, 17 nt, Bordetella pertussis
cgcugcgcuugaccgcc

SEQ ID NO: 2422831 - RNA, 22 nt, Bordetella pertussis
cgcugcggcaagggugccuguc

SEQ ID NO: 2422832 - RNA, 13 nt, Bordetella pertussis
cgcugcggccggu

SEQ ID NO: 2422833 - RNA, 20 nt, Bordetella pertussis
cgcugcgggaggugccgcag

SEQ ID NO: 2422834 - RNA, 21 nt, Bordetella pertussis
cgcugcggucgcgaucgucga

SEQ ID NO: 2422835 - RNA, 15 nt, Bordetella pertussis
cgcugcguccaccac

SEQ ID NO: 2422836 - RNA, 16 nt, Bordetella pertussis
cgcugcguccaccacc

SEQ ID NO: 2422837 - RNA, 22 nt, Bordetella pertussis
cgcugcguccaccaccaggccg

SEQ ID NO: 2422838 - RNA, 23 nt, Bordetella pertussis
cgcugcguccaccaccaggccgg

SEQ ID NO: 2422839 - RNA, 18 nt, Bordetella pertussis
cgcugcucgaaacgcugg

SEQ ID NO: 2422840 - RNA, 21 nt, Bordetella pertussis
cgcugcucgacagcagcccgc

SEQ ID NO: 2422841 - RNA, 17 nt, Bordetella pertussis
cgcugcucuccaugcug

SEQ ID NO: 2422842 - RNA, 14 nt, Bordetella pertussis
cgcugcucuuggcg

SEQ ID NO: 2422843 - RNA, 17 nt, Bordetella pertussis
cgcugcucuuggcgccg

SEQ ID NO: 2422844 - RNA, 15 nt, Bordetella pertussis
cgcugcugaccgacg

SEQ ID NO: 2422845 - RNA, 19 nt, Bordetella pertussis
cgcugcugauccucgccag

SEQ ID NO: 2422846 - RNA, 20 nt, Bordetella pertussis
cgcugcugauccucgccagc

SEQ ID NO: 2422847 - RNA, 13 nt, Bordetella pertussis
cgcugcugcaggc

SEQ ID NO: 2422848 - RNA, 16 nt, Bordetella pertussis
cgcugcugcaggccgg

SEQ ID NO: 2422849 - RNA, 23 nt, Bordetella pertussis
cgcugcugcaggccggcgcgcau

SEQ ID NO: 2422850 - RNA, 11 nt, Bordetella pertussis
cgcugcugcug

SEQ ID NO: 2422851 - RNA, 18 nt, Bordetella pertussis
cgcugcugcuggcugccc

SEQ ID NO: 2422852 - RNA, 19 nt, Bordetella pertussis
cgcugcuggaggccggcgu

SEQ ID NO: 2422853 - RNA, 20 nt, Bordetella pertussis
cgcugcuggccaagcgcgcc

SEQ ID NO: 2422854 - RNA, 21 nt, Bordetella pertussis
cgcugcuggccaagcgcgccg

SEQ ID NO: 2422855 - RNA, 13 nt, Bordetella pertussis
cgcugcuggccgc

SEQ ID NO: 2422856 - RNA, 15 nt, Bordetella pertussis
cgcugcuggccgcgg

SEQ ID NO: 2422857 - RNA, 15 nt, Bordetella pertussis
cgcugcuggccggcc

SEQ ID NO: 2422858 - RNA, 16 nt, Bordetella pertussis
cgcugcuggccggcca

SEQ ID NO: 2422859 - RNA, 17 nt, Bordetella pertussis
cgcugcuggccggccag

SEQ ID NO: 2422860 - RNA, 14 nt, Bordetella pertussis
cgcugcuggcggcg

SEQ ID NO: 2422861 - RNA, 15 nt, Bordetella pertussis
cgcuggggcagcagg

SEQ ID NO: 2422862 - RNA, 22 nt, Bordetella pertussis
cgcuggggcaggacgccggcgc

SEQ ID NO: 2422863 - RNA, 23 nt, Bordetella pertussis
cgcuggggcaggacgccggcgcc

SEQ ID NO: 2422864 - RNA, 14 nt, Bordetella pertussis
cgcuggggcugccg

SEQ ID NO: 2422865 - RNA, 19 nt, Bordetella pertussis
cgcuggucaccgccccgac

SEQ ID NO: 2422866 - RNA, 16 nt, Bordetella pertussis
cgcugguccgccgccg

SEQ ID NO: 2422867 - RNA, 18 nt, Bordetella pertussis
cgcuggucgagagccugg

SEQ ID NO: 2422868 - RNA, 16 nt, Bordetella pertussis
cgcuggucgcgcagca

SEQ ID NO: 2422869 - RNA, 18 nt, Bordetella pertussis
cgcuggucguaucgccgc

SEQ ID NO: 2422870 - RNA, 14 nt, Bordetella pertussis
cgcuggucgucgcg

SEQ ID NO: 2422871 - RNA, 18 nt, Bordetella pertussis
cgcuggugaagucggccc

SEQ ID NO: 2422872 - RNA, 18 nt, Bordetella pertussis
cgcuggugaucugcugcg

SEQ ID NO: 2422873 - RNA, 12 nt, Bordetella pertussis
cgcuggugcuga

SEQ ID NO: 2422874 - RNA, 13 nt, Bordetella pertussis
cgcuggugcugag

SEQ ID NO: 2422875 - RNA, 13 nt, Bordetella pertussis
cgcuggugcuggc

SEQ ID NO: 2422876 - RNA, 15 nt, Bordetella pertussis
cgcuggugcuggccg

SEQ ID NO: 2422877 - RNA, 15 nt, Bordetella pertussis
cgcugguggccacca

SEQ ID NO: 2422878 - RNA, 20 nt, Bordetella pertussis
cgcugguggccaccagcccc

SEQ ID NO: 2422879 - RNA, 23 nt, Bordetella pertussis
cgcuguagaggcgcggcucgccg

SEQ ID NO: 2422880 - RNA, 14 nt, Bordetella pertussis
cgcuguagcgcagc

SEQ ID NO: 2422881 - RNA, 15 nt, Bordetella pertussis
cgcuguagcgcagcc

SEQ ID NO: 2422882 - RNA, 17 nt, Bordetella pertussis
cgcuguauauauagggg

SEQ ID NO: 2422883 - RNA, 14 nt, Bordetella pertussis
cgcuguccgaugcg

SEQ ID NO: 2422884 - RNA, 15 nt, Bordetella pertussis
cgcuguccggcgcuc

SEQ ID NO: 2422885 - RNA, 18 nt, Bordetella pertussis
cgcuguccggcgcucgcc

SEQ ID NO: 2422886 - RNA, 21 nt, Bordetella pertussis
cgcuguccggcgcucgccccg

SEQ ID NO: 2422887 - RNA, 23 nt, Bordetella pertussis
cgcuguccggcgcucgccccggc

SEQ ID NO: 2422888 - RNA, 13 nt, Bordetella pertussis
cgcugucgaccuc

SEQ ID NO: 2422889 - RNA, 18 nt, Bordetella pertussis
cgcugucgaccucgucga

SEQ ID NO: 2422890 - RNA, 16 nt, Bordetella pertussis
cgcugucggucagcac

SEQ ID NO: 2422891 - RNA, 17 nt, Bordetella pertussis
cgcugucgugccgcacg

SEQ ID NO: 2422892 - RNA, 14 nt, Bordetella pertussis
cgcugugcgcggcg

SEQ ID NO: 2422893 - RNA, 15 nt, Bordetella pertussis
cgcugugcgcggcga

SEQ ID NO: 2422894 - RNA, 22 nt, Bordetella pertussis
cgcugugcgcguuccggccgcg

SEQ ID NO: 2422895 - RNA, 22 nt, Bordetella pertussis
cgcuguggacgccgccggccca

SEQ ID NO: 2422896 - RNA, 15 nt, Bordetella pertussis
cgcuguggcgcgcca

SEQ ID NO: 2422897 - RNA, 17 nt, Bordetella pertussis
cgcuguuccagccagua

SEQ ID NO: 2422898 - RNA, 13 nt, Bordetella pertussis
cgcuguucggcga

SEQ ID NO: 2422899 - RNA, 14 nt, Bordetella pertussis
cgcuguucgggcgc

SEQ ID NO: 2422900 - RNA, 16 nt, Bordetella pertussis
cgcuguucgggcgcgg

SEQ ID NO: 2422901 - RNA, 20 nt, Bordetella pertussis
cgcuguucgggcgcggugcg

SEQ ID NO: 2422902 - RNA, 20 nt, Bordetella pertussis
cgcuguucggggcagggcgc

SEQ ID NO: 2422903 - RNA, 23 nt, Bordetella pertussis
cgcuguucuucggcaaccgcgcc

SEQ ID NO: 2422904 - RNA, 20 nt, Bordetella pertussis
cgcuguugcuccaggccggc

SEQ ID NO: 2422905 - RNA, 13 nt, Bordetella pertussis
cgcuguugcuggc

SEQ ID NO: 2422906 - RNA, 17 nt, Bordetella pertussis
cgcuguugcuggccacc

SEQ ID NO: 2422907 - RNA, 14 nt, Bordetella pertussis
cgcuguuggccggc

SEQ ID NO: 2422908 - RNA, 19 nt, Bordetella pertussis
cgcuguuggccggcgcgcc

SEQ ID NO: 2422909 - RNA, 20 nt, Bordetella pertussis
cgcuguuggccggcgcgccc

SEQ ID NO: 2422910 - RNA, 16 nt, Bordetella pertussis
cgcuguuggccgucgc

SEQ ID NO: 2422911 - RNA, 18 nt, Bordetella pertussis
cgcuguuuccgggccugg

SEQ ID NO: 2422912 - RNA, 22 nt, Bordetella pertussis
cgcuguuuccgggccuggccug

SEQ ID NO: 2422913 - RNA, 19 nt, Bordetella pertussis
cgcuguuuucggccgacuc

SEQ ID NO: 2422914 - RNA, 19 nt, Bordetella pertussis
cgcuuacaucaaggccgau

SEQ ID NO: 2422915 - RNA, 15 nt, Bordetella pertussis
cgcuuaccgcgccgg

SEQ ID NO: 2422916 - RNA, 19 nt, Bordetella pertussis
cgcuuacuggaucuuggcc

SEQ ID NO: 2422917 - RNA, 23 nt, Bordetella pertussis
cgcuuaucgcggcgcggcgcagg

SEQ ID NO: 2422918 - RNA, 14 nt, Bordetella pertussis
cgcuucaggcgccg

SEQ ID NO: 2422919 - RNA, 16 nt, Bordetella pertussis
cgcuucagugcucggg

SEQ ID NO: 2422920 - RNA, 23 nt, Bordetella pertussis
cgcuuccaggaguucccagcgcg

SEQ ID NO: 2422921 - RNA, 15 nt, Bordetella pertussis
cgcuucccgcacggg

SEQ ID NO: 2422922 - RNA, 19 nt, Bordetella pertussis
cgcuuccgccaccgcgccg

SEQ ID NO: 2422923 - RNA, 13 nt, Bordetella pertussis
cgcuuccggcaug

SEQ ID NO: 2422924 - RNA, 19 nt, Bordetella pertussis
cgcuuccggcaugaccgcg

SEQ ID NO: 2422925 - RNA, 13 nt, Bordetella pertussis
cgcuuccggccgg

SEQ ID NO: 2422926 - RNA, 15 nt, Bordetella pertussis
cgcuuccucgaccag

SEQ ID NO: 2422927 - RNA, 20 nt, Bordetella pertussis
cgcuuccucgaccaggucca

SEQ ID NO: 2422928 - RNA, 13 nt, Bordetella pertussis
cgcuuccugcugc

SEQ ID NO: 2422929 - RNA, 15 nt, Bordetella pertussis
cgcuuccugcugcgc

SEQ ID NO: 2422930 - RNA, 19 nt, Bordetella pertussis
cgcuuccugcugcgccugg

SEQ ID NO: 2422931 - RNA, 20 nt, Bordetella pertussis
cgcuuccugcugcgccuggc

SEQ ID NO: 2422932 - RNA, 23 nt, Bordetella pertussis
cgcuucgagccgguacagccagg

SEQ ID NO: 2422933 - RNA, 15 nt, Bordetella pertussis
cgcuucgaugcuggc

SEQ ID NO: 2422934 - RNA, 12 nt, Bordetella pertussis
cgcuucggccug

SEQ ID NO: 2422935 - RNA, 15 nt, Bordetella pertussis
cgcuucggccugcgc

SEQ ID NO: 2422936 - RNA, 14 nt, Bordetella pertussis
cgcuucggcggccg

SEQ ID NO: 2422937 - RNA, 16 nt, Bordetella pertussis
cgcuucggcggccgcg

SEQ ID NO: 2422938 - RNA, 23 nt, Bordetella pertussis
cgcuucggucagcugcuguuggc

SEQ ID NO: 2422939 - RNA, 14 nt, Bordetella pertussis
cgcuucgucggccg

SEQ ID NO: 2422940 - RNA, 16 nt, Bordetella pertussis
cgcuucgucggccgcc

SEQ ID NO: 2422941 - RNA, 19 nt, Bordetella pertussis
cgcuucgucggccgccagc

SEQ ID NO: 2422942 - RNA, 17 nt, Bordetella pertussis
cgcuucgucgggcagcg

SEQ ID NO: 2422943 - RNA, 22 nt, Bordetella pertussis
cgcuucgucgggcagcgcggcg

SEQ ID NO: 2422944 - RNA, 14 nt, Bordetella pertussis
cgcuucgugcagcg

SEQ ID NO: 2422945 - RNA, 16 nt, Bordetella pertussis
cgcuucgugcagcgcg

SEQ ID NO: 2422946 - RNA, 17 nt, Bordetella pertussis
cgcuucgugcggccgca

SEQ ID NO: 2422947 - RNA, 19 nt, Bordetella pertussis
cgcuucgugcggccgcagc

SEQ ID NO: 2422948 - RNA, 23 nt, Bordetella pertussis
cgcuucguucagcuucuggauca

SEQ ID NO: 2422949 - RNA, 18 nt, Bordetella pertussis
cgcuucucacugcccgcg

SEQ ID NO: 2422950 - RNA, 20 nt, Bordetella pertussis
cgcuucugccagacggccag

SEQ ID NO: 2422951 - RNA, 23 nt, Bordetella pertussis
cgcuucugccagacggccagcgc

SEQ ID NO: 2422952 - RNA, 23 nt, Bordetella pertussis
cgcuucuuccuugcgaugccagu

SEQ ID NO: 2422953 - RNA, 23 nt, Bordetella pertussis
cgcuugaaaugcguggcgugccg

SEQ ID NO: 2422954 - RNA, 19 nt, Bordetella pertussis
cgcuugaaguaaucgcccg

SEQ ID NO: 2422955 - RNA, 21 nt, Bordetella pertussis
cgcuugaaguaaucgcccggc

SEQ ID NO: 2422956 - RNA, 22 nt, Bordetella pertussis
cgcuugacccguuugcgcagcu

SEQ ID NO: 2422957 - RNA, 20 nt, Bordetella pertussis
cgcuugacggccaagacgcg

SEQ ID NO: 2422958 - RNA, 15 nt, Bordetella pertussis
cgcuugacguccagc

SEQ ID NO: 2422959 - RNA, 20 nt, Bordetella pertussis
cgcuugcccgucaugcgccg

SEQ ID NO: 2422960 - RNA, 21 nt, Bordetella pertussis
cgcuugcccgucaugcgccgc

SEQ ID NO: 2422961 - RNA, 15 nt, Bordetella pertussis
cgcuugccgaccucc

SEQ ID NO: 2422962 - RNA, 22 nt, Bordetella pertussis
cgcuugccgaccuccaggccca

SEQ ID NO: 2422963 - RNA, 19 nt, Bordetella pertussis
cgcuugccgcaaccgucga

SEQ ID NO: 2422964 - RNA, 23 nt, Bordetella pertussis
cgcuugccgcccacugccaggcg

SEQ ID NO: 2422965 - RNA, 18 nt, Bordetella pertussis
cgcuugcgcucggugugg

SEQ ID NO: 2422966 - RNA, 18 nt, Bordetella pertussis
cgcuugcgcuuggcaggc

SEQ ID NO: 2422967 - RNA, 22 nt, Bordetella pertussis
cgcuugcgcuuggcaggcgucu

SEQ ID NO: 2422968 - RNA, 18 nt, Bordetella pertussis
cgcuugcucggugcgggc

SEQ ID NO: 2422969 - RNA, 22 nt, Bordetella pertussis
cgcuuggaccccguggucgcca

SEQ ID NO: 2422970 - RNA, 14 nt, Bordetella pertussis
cgcuuggccagcug

SEQ ID NO: 2422971 - RNA, 15 nt, Bordetella pertussis
cgcuuggccagcugg

SEQ ID NO: 2422972 - RNA, 18 nt, Bordetella pertussis
cgcuuggccagcuggcgc

SEQ ID NO: 2422973 - RNA, 21 nt, Bordetella pertussis
cggagaaaucgccgccggcgg

SEQ ID NO: 2422974 - RNA, 13 nt, Bordetella pertussis
cggagcagcagcg

SEQ ID NO: 2422975 - RNA, 15 nt, Bordetella pertussis
cggagcagcagcggg

SEQ ID NO: 2422976 - RNA, 18 nt, Bordetella pertussis
cggagcagucgcgcagcc

SEQ ID NO: 2422977 - RNA, 16 nt, Bordetella pertussis
cggagccaguccccgc

SEQ ID NO: 2422978 - RNA, 23 nt, Bordetella pertussis
cggagccaguccccgcagggaca

SEQ ID NO: 2422979 - RNA, 24 nt, Bordetella pertussis
cggagccaguccccgcagggacag

SEQ ID NO: 2422980 - RNA, 18 nt, Bordetella pertussis
cggagcccgucaggcgga

SEQ ID NO: 2422981 - RNA, 12 nt, Bordetella pertussis
cggagccgcgca

SEQ ID NO: 2422982 - RNA, 14 nt, Bordetella pertussis
cggagccgcgcaca

SEQ ID NO: 2422983 - RNA, 14 nt, Bordetella pertussis
cggagcgacggcag

SEQ ID NO: 2422984 - RNA, 20 nt, Bordetella pertussis
cggaggauacggccagcgcc

SEQ ID NO: 2422985 - RNA, 14 nt, Bordetella pertussis
cggaggcgcgcagc

SEQ ID NO: 2422986 - RNA, 18 nt, Bordetella pertussis
cggaggcgcgcagcuccg

SEQ ID NO: 2422987 - RNA, 20 nt, Bordetella pertussis
cggaggcggccgcgggcggc

SEQ ID NO: 2422988 - RNA, 21 nt, Bordetella pertussis
cggaggcggccgcgggcggcg

SEQ ID NO: 2422989 - RNA, 14 nt, Bordetella pertussis
cggagggcuccagg

SEQ ID NO: 2422990 - RNA, 16 nt, Bordetella pertussis
cggagguaugcacgac

SEQ ID NO: 2422991 - RNA, 17 nt, Bordetella pertussis
cggagguaugcacgacc

SEQ ID NO: 2422992 - RNA, 21 nt, Bordetella pertussis
cggagguaugcacgaccaggc

SEQ ID NO: 2422993 - RNA, 19 nt, Bordetella pertussis
cggaguaguugucgucgcg

SEQ ID NO: 2422994 - RNA, 22 nt, Bordetella pertussis
cggagucgccccgacgcgcuuc

SEQ ID NO: 2422995 - RNA, 16 nt, Bordetella pertussis
cggagucggcgccgcg

SEQ ID NO: 2422996 - RNA, 17 nt, Bordetella pertussis
cggauaacaucaugggc

SEQ ID NO: 2422997 - RNA, 17 nt, Bordetella pertussis
cggauaauugggcggca

SEQ ID NO: 2422998 - RNA, 20 nt, Bordetella pertussis
cggauaauugggcggcaucu

SEQ ID NO: 2422999 - RNA, 17 nt, Bordetella pertussis
cggauaccgccgccgcu

SEQ ID NO: 2423000 - RNA, 19 nt, Bordetella pertussis
cggauacgaaaccaggccg

SEQ ID NO: 2423001 - RNA, 20 nt, Bordetella pertussis
cggauacgaaaccaggccgg

SEQ ID NO: 2423002 - RNA, 15 nt, Bordetella pertussis
cggauagcggugcag

SEQ ID NO: 2423003 - RNA, 19 nt, Bordetella pertussis
cggauagcggugcaggggc

SEQ ID NO: 2423004 - RNA, 15 nt, Bordetella pertussis
cggauauggccggcg

SEQ ID NO: 2423005 - RNA, 20 nt, Bordetella pertussis
cggauauggccggcgcgcuc

SEQ ID NO: 2423006 - RNA, 24 nt, Bordetella pertussis
cggauauucgucggccgccgccgu

SEQ ID NO: 2423007 - RNA, 16 nt, Bordetella pertussis
cggaucacccagcggc

SEQ ID NO: 2423008 - RNA, 20 nt, Bordetella pertussis
cggaucacccagcggcuggc

SEQ ID NO: 2423009 - RNA, 21 nt, Bordetella pertussis
cggaucacccagcggcuggcc

SEQ ID NO: 2423010 - RNA, 22 nt, Bordetella pertussis
cggaucacccagcggcuggcca

SEQ ID NO: 2423011 - RNA, 12 nt, Bordetella pertussis
cggaucacgcua

SEQ ID NO: 2423012 - RNA, 13 nt, Bordetella pertussis
cggaucagcgccu

SEQ ID NO: 2423013 - RNA, 21 nt, Bordetella pertussis
cggaucagcgccucaucguuc

SEQ ID NO: 2423014 - RNA, 15 nt, Bordetella pertussis
cggaucauccgggcc

SEQ ID NO: 2423015 - RNA, 20 nt, Bordetella pertussis
cggaucauccgggcccgguu

SEQ ID NO: 2423016 - RNA, 22 nt, Bordetella pertussis
cggaucaugggcucgcgcgagc

SEQ ID NO: 2423017 - RNA, 18 nt, Bordetella pertussis
cggaucauugggucugcg

SEQ ID NO: 2423018 - RNA, 15 nt, Bordetella pertussis
cggauccagccaugg

SEQ ID NO: 2423019 - RNA, 22 nt, Bordetella pertussis
cggauccagccauggaagcggc

SEQ ID NO: 2423020 - RNA, 16 nt, Bordetella pertussis
cggauccagcgaggca

SEQ ID NO: 2423021 - RNA, 19 nt, Bordetella pertussis
cggauccagcgaggcaucg

SEQ ID NO: 2423022 - RNA, 13 nt, Bordetella pertussis
cggaucccaggcc

SEQ ID NO: 2423023 - RNA, 15 nt, Bordetella pertussis
cggaucccaggccgg

SEQ ID NO: 2423024 - RNA, 19 nt, Bordetella pertussis
cggaucccaggccggcucg

SEQ ID NO: 2423025 - RNA, 22 nt, Bordetella pertussis
cggaucgaaaccggcgcgcgcg

SEQ ID NO: 2423026 - RNA, 16 nt, Bordetella pertussis
cggaucgaacgccucg

SEQ ID NO: 2423027 - RNA, 17 nt, Bordetella pertussis
cggaucgaacgccucgg

SEQ ID NO: 2423028 - RNA, 14 nt, Bordetella pertussis
cggaucgagcgcgg

SEQ ID NO: 2423029 - RNA, 14 nt, Bordetella pertussis
cggaucgccgggca

SEQ ID NO: 2423030 - RNA, 16 nt, Bordetella pertussis
cggaucgccgggcagg

SEQ ID NO: 2423031 - RNA, 20 nt, Bordetella pertussis
cggaucgccgguagcgcugg

SEQ ID NO: 2423032 - RNA, 17 nt, Bordetella pertussis
cggaucgcggcgcggcu

SEQ ID NO: 2423033 - RNA, 14 nt, Bordetella pertussis
cggaucggccacga

SEQ ID NO: 2423034 - RNA, 12 nt, Bordetella pertussis
cggaucggccgg

SEQ ID NO: 2423035 - RNA, 14 nt, Bordetella pertussis
cggaucggccggca

SEQ ID NO: 2423036 - RNA, 16 nt, Bordetella pertussis
cggaucggggcaacga

SEQ ID NO: 2423037 - RNA, 23 nt, Bordetella pertussis
cggaucgucuuuuuacaggcagc

SEQ ID NO: 2423038 - RNA, 13 nt, Bordetella pertussis
cggaucgugcgcc

SEQ ID NO: 2423039 - RNA, 16 nt, Bordetella pertussis
cggaucgugcgccacu

SEQ ID NO: 2423040 - RNA, 14 nt, Bordetella pertussis
cggaucucggccag

SEQ ID NO: 2423041 - RNA, 21 nt, Bordetella pertussis
cggaucucggccagcagcgcc

SEQ ID NO: 2423042 - RNA, 17 nt, Bordetella pertussis
cggaucuuccuugaagc

SEQ ID NO: 2423043 - RNA, 16 nt, Bordetella pertussis
cggaugaacgaccagc

SEQ ID NO: 2423044 - RNA, 15 nt, Bordetella pertussis
cggaugaagggcugg

SEQ ID NO: 2423045 - RNA, 17 nt, Bordetella pertussis
cggaugaagggcuggcc

SEQ ID NO: 2423046 - RNA, 22 nt, Bordetella pertussis
cggaugaagggcuggccggcca

SEQ ID NO: 2423047 - RNA, 16 nt, Bordetella pertussis
cggaugaccugcgcca

SEQ ID NO: 2423048 - RNA, 23 nt, Bordetella pertussis
cggaugaccuggugcaccacgcg

SEQ ID NO: 2423049 - RNA, 15 nt, Bordetella pertussis
cggaugagcaggccg

SEQ ID NO: 2423050 - RNA, 16 nt, Bordetella pertussis
cggaugagcaggccgg

SEQ ID NO: 2423051 - RNA, 17 nt, Bordetella pertussis
cggaugagcaggccggg

SEQ ID NO: 2423052 - RNA, 17 nt, Bordetella pertussis
cggaugaugcggcgcca

SEQ ID NO: 2423053 - RNA, 19 nt, Bordetella pertussis
cggaugaugcggcgccacg

SEQ ID NO: 2423054 - RNA, 21 nt, Bordetella pertussis
cggaugaugcggcgccacgca

SEQ ID NO: 2423055 - RNA, 20 nt, Bordetella pertussis
cggaugcacguagcgcagca

SEQ ID NO: 2423056 - RNA, 14 nt, Bordetella pertussis
cggaugcagcagcg

SEQ ID NO: 2423057 - RNA, 16 nt, Bordetella pertussis
cggaugccgcccgugc

SEQ ID NO: 2423058 - RNA, 17 nt, Bordetella pertussis
cggaugccguccacgcc

SEQ ID NO: 2423059 - RNA, 21 nt, Bordetella pertussis
cggaugccguccacgccgcgc

SEQ ID NO: 2423060 - RNA, 16 nt, Bordetella pertussis
cggaugccgucuuggc

SEQ ID NO: 2423061 - RNA, 16 nt, Bordetella pertussis
cggaugcgcaggacgg

SEQ ID NO: 2423062 - RNA, 21 nt, Bordetella pertussis
cggaugcgcaggacggcgccg

SEQ ID NO: 2423063 - RNA, 22 nt, Bordetella pertussis
cggaugcgcaggacggcgccgu

SEQ ID NO: 2423064 - RNA, 14 nt, Bordetella pertussis
cggaugcgccgccc

SEQ ID NO: 2423065 - RNA, 16 nt, Bordetella pertussis
cggaugcgccgcccca

SEQ ID NO: 2423066 - RNA, 13 nt, Bordetella pertussis
cggaugcgcgccu

SEQ ID NO: 2423067 - RNA, 17 nt, Bordetella pertussis
cggaugcgcguggcgcg

SEQ ID NO: 2423068 - RNA, 23 nt, Bordetella pertussis
cggaugcgcguugccggugcgcg

SEQ ID NO: 2423069 - RNA, 21 nt, Bordetella pertussis
cggaugcgguacugcggcgcc

SEQ ID NO: 2423070 - RNA, 17 nt, Bordetella pertussis
cggauggcauaguccuc

SEQ ID NO: 2423071 - RNA, 13 nt, Bordetella pertussis
cggauggcgcgga

SEQ ID NO: 2423072 - RNA, 19 nt, Bordetella pertussis
cggauggcuuccugcaccu

SEQ ID NO: 2423073 - RNA, 13 nt, Bordetella pertussis
cggaugggcgccg

SEQ ID NO: 2423074 - RNA, 14 nt, Bordetella pertussis
cggaugggcgccgu

SEQ ID NO: 2423075 - RNA, 22 nt, Bordetella pertussis
cggaugguagaugcgcgcgacc

SEQ ID NO: 2423076 - RNA, 15 nt, Bordetella pertussis
cggaugucaguuucc

SEQ ID NO: 2423077 - RNA, 21 nt, Bordetella pertussis
cggauguggggguuguggcgg

SEQ ID NO: 2423078 - RNA, 14 nt, Bordetella pertussis
cggauucaggcgau

SEQ ID NO: 2423079 - RNA, 15 nt, Bordetella pertussis
cggauugaccagcgc

SEQ ID NO: 2423080 - RNA, 16 nt, Bordetella pertussis
cggauugaccagcgcg

SEQ ID NO: 2423081 - RNA, 18 nt, Bordetella pertussis
cggauugaccagcgcggc

SEQ ID NO: 2423082 - RNA, 23 nt, Bordetella pertussis
cggauugaccagcgcggccguca

SEQ ID NO: 2423083 - RNA, 14 nt, Bordetella pertussis
cggauugccgccgc

SEQ ID NO: 2423084 - RNA, 19 nt, Bordetella pertussis
cggauugccguccuggcga

SEQ ID NO: 2423085 - RNA, 16 nt, Bordetella pertussis
cggauuggacagcagu

SEQ ID NO: 2423086 - RNA, 23 nt, Bordetella pertussis
cggcacgacggccuccgcgccga

SEQ ID NO: 2423087 - RNA, 14 nt, Bordetella pertussis
cggcacgacgucgu

SEQ ID NO: 2423088 - RNA, 19 nt, Bordetella pertussis
cggcacgaucggcgccugg

SEQ ID NO: 2423089 - RNA, 22 nt, Bordetella pertussis
cggcacgaucggcgccuggccg

SEQ ID NO: 2423090 - RNA, 20 nt, Bordetella pertussis
cggcacgauuuccgcuacca

SEQ ID NO: 2423091 - RNA, 21 nt, Bordetella pertussis
cggcacgauuuccgcuaccag

SEQ ID NO: 2423092 - RNA, 24 nt, Bordetella pertussis
cggcacgcacagcaugcgcugguc

SEQ ID NO: 2423093 - RNA, 22 nt, Bordetella pertussis
cggcacgccgaugaacgacagg

SEQ ID NO: 2423094 - RNA, 15 nt, Bordetella pertussis
cggcacgccggcggc

SEQ ID NO: 2423095 - RNA, 16 nt, Bordetella pertussis
cggcacgccggcggcc

SEQ ID NO: 2423096 - RNA, 18 nt, Bordetella pertussis
cggcacgccggcggcgcu

SEQ ID NO: 2423097 - RNA, 17 nt, Bordetella pertussis
cggcacgccucgccggc

SEQ ID NO: 2423098 - RNA, 13 nt, Bordetella pertussis
cggcacgccugcc

SEQ ID NO: 2423099 - RNA, 19 nt, Bordetella pertussis
cggcacgccugccgcgccc

SEQ ID NO: 2423100 - RNA, 22 nt, Bordetella pertussis
cggcacgccugccgcgcccggc

SEQ ID NO: 2423101 - RNA, 13 nt, Bordetella pertussis
cggcacgcgccag

SEQ ID NO: 2423102 - RNA, 12 nt, Bordetella pertussis
cggcacgcgcgc

SEQ ID NO: 2423103 - RNA, 16 nt, Bordetella pertussis
cggcacgcgcgccggc

SEQ ID NO: 2423104 - RNA, 18 nt, Bordetella pertussis
cggcacgcgcgccggcag

SEQ ID NO: 2423105 - RNA, 17 nt, Bordetella pertussis
cggcacgcugaucgccg

SEQ ID NO: 2423106 - RNA, 13 nt, Bordetella pertussis
cggcacggccagc

SEQ ID NO: 2423107 - RNA, 14 nt, Bordetella pertussis
cggcacggccggcc

SEQ ID NO: 2423108 - RNA, 17 nt, Bordetella pertussis
cggcacggccggccagg

SEQ ID NO: 2423109 - RNA, 20 nt, Bordetella pertussis
cggcacggccggccaggcgc

SEQ ID NO: 2423110 - RNA, 22 nt, Bordetella pertussis
cggcacggccggccaggcgccg

SEQ ID NO: 2423111 - RNA, 18 nt, Bordetella pertussis
cggcacggccggccugca

SEQ ID NO: 2423112 - RNA, 17 nt, Bordetella pertussis
cggcacgggucaggcug

SEQ ID NO: 2423113 - RNA, 19 nt, Bordetella pertussis
cggcacgggucaggcugcg

SEQ ID NO: 2423114 - RNA, 20 nt, Bordetella pertussis
cggcacgggucaggcugcgg

SEQ ID NO: 2423115 - RNA, 22 nt, Bordetella pertussis
cggcacgggucaggcugcggcg

SEQ ID NO: 2423116 - RNA, 13 nt, Bordetella pertussis
cggcacgguggcg

SEQ ID NO: 2423117 - RNA, 23 nt, Bordetella pertussis
cggcacgguggcgaaggccgccg

SEQ ID NO: 2423118 - RNA, 15 nt, Bordetella pertussis
cggcacguaccaggc

SEQ ID NO: 2423119 - RNA, 17 nt, Bordetella pertussis
cggcacguaccaggcgc

SEQ ID NO: 2423120 - RNA, 21 nt, Bordetella pertussis
cggcacguaccaggcgcugac

SEQ ID NO: 2423121 - RNA, 13 nt, Bordetella pertussis
cggcacgucauug

SEQ ID NO: 2423122 - RNA, 13 nt, Bordetella pertussis
cggcacguccgag

SEQ ID NO: 2423123 - RNA, 17 nt, Bordetella pertussis
cggcacguccggcacgg

SEQ ID NO: 2423124 - RNA, 18 nt, Bordetella pertussis
cggcacguccggcacggc

SEQ ID NO: 2423125 - RNA, 21 nt, Bordetella pertussis
cggcacguccggcacggcggc

SEQ ID NO: 2423126 - RNA, 13 nt, Bordetella pertussis
cggcacgucgcgc

SEQ ID NO: 2423127 - RNA, 15 nt, Bordetella pertussis
cggcacgucgggcag

SEQ ID NO: 2423128 - RNA, 16 nt, Bordetella pertussis
cggcacgucgggcagg

SEQ ID NO: 2423129 - RNA, 20 nt, Bordetella pertussis
cggcacgucgggcaggaugg

SEQ ID NO: 2423130 - RNA, 18 nt, Bordetella pertussis
cggcacgugauaguccac

SEQ ID NO: 2423131 - RNA, 14 nt, Bordetella pertussis
cggcacgugccgga

SEQ ID NO: 2423132 - RNA, 17 nt, Bordetella pertussis
cggcacguugucgagca

SEQ ID NO: 2423133 - RNA, 19 nt, Bordetella pertussis
cggcacguugucgagcagg

SEQ ID NO: 2423134 - RNA, 20 nt, Bordetella pertussis
cggcacguugucgagcaggc

SEQ ID NO: 2423135 - RNA, 15 nt, Bordetella pertussis
cggcacugaugcugg

SEQ ID NO: 2423136 - RNA, 18 nt, Bordetella pertussis
cggcacugaugcugguca

SEQ ID NO: 2423137 - RNA, 22 nt, Bordetella pertussis
cggcacugaugcuggucagccu

SEQ ID NO: 2423138 - RNA, 18 nt, Bordetella pertussis
cggcagaacagcggaucg

SEQ ID NO: 2423139 - RNA, 15 nt, Bordetella pertussis
cggcagaaggcgaca

SEQ ID NO: 2423140 - RNA, 18 nt, Bordetella pertussis
cggcagaaggcgacaucg

SEQ ID NO: 2423141 - RNA, 18 nt, Bordetella pertussis
cggcagacgaucauccag

SEQ ID NO: 2423142 - RNA, 22 nt, Bordetella pertussis
cggcagacgaucauccaggccg

SEQ ID NO: 2423143 - RNA, 17 nt, Bordetella pertussis
cggcagaucggcgcugg

SEQ ID NO: 2423144 - RNA, 18 nt, Bordetella pertussis
cggcagaucggcgcuggc

SEQ ID NO: 2423145 - RNA, 23 nt, Bordetella pertussis
cggcagaucggcgcuggccuggc

SEQ ID NO: 2423146 - RNA, 15 nt, Bordetella pertussis
cggcagaucuccgga

SEQ ID NO: 2423147 - RNA, 21 nt, Bordetella pertussis
cggcagaugaucuacgcgcgc

SEQ ID NO: 2423148 - RNA, 22 nt, Bordetella pertussis
cggcagauggugcuccgacggc

SEQ ID NO: 2423149 - RNA, 15 nt, Bordetella pertussis
cggcagcacgauggc

SEQ ID NO: 2423150 - RNA, 19 nt, Bordetella pertussis
cggcagcacgauggcgccc

SEQ ID NO: 2423151 - RNA, 20 nt, Bordetella pertussis
cggcagcacgauggcgccca

SEQ ID NO: 2423152 - RNA, 22 nt, Bordetella pertussis
cggcagcacgauggcgcccacg

SEQ ID NO: 2423153 - RNA, 24 nt, Bordetella pertussis
cggcagcacgauggcgcccacggc

SEQ ID NO: 2423154 - RNA, 15 nt, Bordetella pertussis
cggcagcagcagcgc

SEQ ID NO: 2423155 - RNA, 16 nt, Bordetella pertussis
cggcagcagcagcgcg

SEQ ID NO: 2423156 - RNA, 16 nt, Bordetella pertussis
cggcagcagcagcgug

SEQ ID NO: 2423157 - RNA, 20 nt, Bordetella pertussis
cggcagcagcagcgugcggu

SEQ ID NO: 2423158 - RNA, 17 nt, Bordetella pertussis
cggcagcagcgagaaca

SEQ ID NO: 2423159 - RNA, 15 nt, Bordetella pertussis
cggcagcagcgcgcc

SEQ ID NO: 2423160 - RNA, 16 nt, Bordetella pertussis
cggcagcagcgcgccg

SEQ ID NO: 2423161 - RNA, 17 nt, Bordetella pertussis
cggcagcagcgcgccgg

SEQ ID NO: 2423162 - RNA, 23 nt, Bordetella pertussis
cggcagcagggauucggcgaacg

SEQ ID NO: 2423163 - RNA, 18 nt, Bordetella pertussis
cggcagcauggcgcgcgg

SEQ ID NO: 2423164 - RNA, 11 nt, Bordetella pertussis
cggcagcccca

SEQ ID NO: 2423165 - RNA, 20 nt, Bordetella pertussis
cggcagccccagcgcccagg

SEQ ID NO: 2423166 - RNA, 18 nt, Bordetella pertussis
cggcagccccgggugcag

SEQ ID NO: 2423167 - RNA, 12 nt, Bordetella pertussis
cggcagccgaaa

SEQ ID NO: 2423168 - RNA, 13 nt, Bordetella pertussis
cggcagccggcca

SEQ ID NO: 2423169 - RNA, 18 nt, Bordetella pertussis
cggcagccggccauggcc

SEQ ID NO: 2423170 - RNA, 13 nt, Bordetella pertussis
cggcagccugggg

SEQ ID NO: 2423171 - RNA, 14 nt, Bordetella pertussis
cggcagcgacucgc

SEQ ID NO: 2423172 - RNA, 20 nt, Bordetella pertussis
cggcagcgacucgccgugcu

SEQ ID NO: 2423173 - RNA, 20 nt, Bordetella pertussis
cggcagcgcaccgucgccag

SEQ ID NO: 2423174 - RNA, 13 nt, Bordetella pertussis
cggcagcgccgca

SEQ ID NO: 2423175 - RNA, 13 nt, Bordetella pertussis
cggcagcgccggg

SEQ ID NO: 2423176 - RNA, 13 nt, Bordetella pertussis
cggcagcgccuug

SEQ ID NO: 2423177 - RNA, 19 nt, Bordetella pertussis
cggcagcgccuugccuucc

SEQ ID NO: 2423178 - RNA, 16 nt, Bordetella pertussis
cggcagcgcgaacggc

SEQ ID NO: 2423179 - RNA, 15 nt, Bordetella pertussis
cggcagcgcgaccgg

SEQ ID NO: 2423180 - RNA, 17 nt, Bordetella pertussis
cggcagcgcgaccggcg

SEQ ID NO: 2423181 - RNA, 19 nt, Bordetella pertussis
cggcagcgcgaccggcgcg

SEQ ID NO: 2423182 - RNA, 12 nt, Bordetella pertussis
cggcagcgcgca

SEQ ID NO: 2423183 - RNA, 15 nt, Bordetella pertussis
cggcagcgcgcagga

SEQ ID NO: 2423184 - RNA, 17 nt, Bordetella pertussis
cggcagcgcgcaggaca

SEQ ID NO: 2423185 - RNA, 22 nt, Bordetella pertussis
cggcagcgcgcaggacaaggcg

SEQ ID NO: 2423186 - RNA, 14 nt, Bordetella pertussis
cggcagcgcgcgcg

SEQ ID NO: 2423187 - RNA, 13 nt, Bordetella pertussis
cggcagcgcguau

SEQ ID NO: 2423188 - RNA, 12 nt, Bordetella pertussis
cggcagcggcca

SEQ ID NO: 2423189 - RNA, 14 nt, Bordetella pertussis
cggcagcggccagc

SEQ ID NO: 2423190 - RNA, 15 nt, Bordetella pertussis
cggcagcggccagcg

SEQ ID NO: 2423191 - RNA, 16 nt, Bordetella pertussis
cggcagcggccagcgc

SEQ ID NO: 2423192 - RNA, 13 nt, Bordetella pertussis
cggcagcggcgcc

SEQ ID NO: 2423193 - RNA, 23 nt, Bordetella pertussis
cggcagcggcgccaugcgcacca

SEQ ID NO: 2423194 - RNA, 14 nt, Bordetella pertussis
cggcagcgggucga

SEQ ID NO: 2423195 - RNA, 19 nt, Bordetella pertussis
cggcagcguaucgcccgcg

SEQ ID NO: 2423196 - RNA, 21 nt, Bordetella pertussis
cggcagcguaucgcccgcgcg

SEQ ID NO: 2423197 - RNA, 23 nt, Bordetella pertussis
cggcagcguaucgcccgcgcggu

SEQ ID NO: 2423198 - RNA, 22 nt, Bordetella pertussis
cggcagcgucaauccgccgcca

SEQ ID NO: 2423199 - RNA, 16 nt, Bordetella pertussis
cggcauggcgccgcgc

SEQ ID NO: 2423200 - RNA, 17 nt, Bordetella pertussis
cggcauggcgccgcgcc

SEQ ID NO: 2423201 - RNA, 13 nt, Bordetella pertussis
cggcauggcgcgc

SEQ ID NO: 2423202 - RNA, 16 nt, Bordetella pertussis
cggcauggcgcgcgcg

SEQ ID NO: 2423203 - RNA, 17 nt, Bordetella pertussis
cggcauggcgcgcgcgg

SEQ ID NO: 2423204 - RNA, 17 nt, Bordetella pertussis
cggcauggcggccagcu

SEQ ID NO: 2423205 - RNA, 22 nt, Bordetella pertussis
cggcauggcggccagcuugacc

SEQ ID NO: 2423206 - RNA, 15 nt, Bordetella pertussis
cggcaugggcgugcc

SEQ ID NO: 2423207 - RNA, 16 nt, Bordetella pertussis
cggcaugggcgugccg

SEQ ID NO: 2423208 - RNA, 18 nt, Bordetella pertussis
cggcaugggcgugccgcg

SEQ ID NO: 2423209 - RNA, 21 nt, Bordetella pertussis
cggcaugggcgugccgcgcug

SEQ ID NO: 2423210 - RNA, 20 nt, Bordetella pertussis
cggcauggguaaagcgccgg

SEQ ID NO: 2423211 - RNA, 23 nt, Bordetella pertussis
cggcauggguaaagcgccggccc

SEQ ID NO: 2423212 - RNA, 19 nt, Bordetella pertussis
cggcaugguagcgguccag

SEQ ID NO: 2423213 - RNA, 23 nt, Bordetella pertussis
cggcaugguagcgguccagcugc

SEQ ID NO: 2423214 - RNA, 19 nt, Bordetella pertussis
cggcauggucggcauggcc

SEQ ID NO: 2423215 - RNA, 18 nt, Bordetella pertussis
cggcaugguguaccgggc

SEQ ID NO: 2423216 - RNA, 20 nt, Bordetella pertussis
cggcauggugugccuguccc

SEQ ID NO: 2423217 - RNA, 21 nt, Bordetella pertussis
cggcauggugugccugucccc

SEQ ID NO: 2423218 - RNA, 17 nt, Bordetella pertussis
cggcauguaggccucgg

SEQ ID NO: 2423219 - RNA, 20 nt, Bordetella pertussis
cggcauguaggccucgggcc

SEQ ID NO: 2423220 - RNA, 18 nt, Bordetella pertussis
cggcaugucccgaggcgc

SEQ ID NO: 2423221 - RNA, 20 nt, Bordetella pertussis
cggcaugucccgaggcgccc

SEQ ID NO: 2423222 - RNA, 13 nt, Bordetella pertussis
cggcaugucgaug

SEQ ID NO: 2423223 - RNA, 17 nt, Bordetella pertussis
cggcauguugccgcugg

SEQ ID NO: 2423224 - RNA, 22 nt, Bordetella pertussis
cggcauugccgccacgggcccg

SEQ ID NO: 2423225 - RNA, 21 nt, Bordetella pertussis
cggcauuucgcauaccggccg

SEQ ID NO: 2423226 - RNA, 18 nt, Bordetella pertussis
cggcauuucgcugggcgc

SEQ ID NO: 2423227 - RNA, 19 nt, Bordetella pertussis
cggccaacagcucgcgcca

SEQ ID NO: 2423228 - RNA, 23 nt, Bordetella pertussis
cggccaaccccgagggcgcggcg

SEQ ID NO: 2423229 - RNA, 19 nt, Bordetella pertussis
cggccaacccucgcacggc

SEQ ID NO: 2423230 - RNA, 14 nt, Bordetella pertussis
cggccaacggcugg

SEQ ID NO: 2423231 - RNA, 17 nt, Bordetella pertussis
cggccaacggcuggcug

SEQ ID NO: 2423232 - RNA, 21 nt, Bordetella pertussis
cggccaacggcuggcugggcg

SEQ ID NO: 2423233 - RNA, 14 nt, Bordetella pertussis
cggccaagcagcgc

SEQ ID NO: 2423234 - RNA, 15 nt, Bordetella pertussis
cggccaagcagcgcc

SEQ ID NO: 2423235 - RNA, 18 nt, Bordetella pertussis
cggccaagcagcgccugc

SEQ ID NO: 2423236 - RNA, 21 nt, Bordetella pertussis
cggccaagcuggagaagcgcc

SEQ ID NO: 2423237 - RNA, 15 nt, Bordetella pertussis
cggccaaggcaagca

SEQ ID NO: 2423238 - RNA, 19 nt, Bordetella pertussis
cggccaaggcaagcagcga

SEQ ID NO: 2423239 - RNA, 23 nt, Bordetella pertussis
cggccaaggcauuggcgccgcgc

SEQ ID NO: 2423240 - RNA, 14 nt, Bordetella pertussis
cggccaaggccggc

SEQ ID NO: 2423241 - RNA, 16 nt, Bordetella pertussis
cggccaaggccggcgc

SEQ ID NO: 2423242 - RNA, 20 nt, Bordetella pertussis
cggccaaggccggcgcgucg

SEQ ID NO: 2423243 - RNA, 15 nt, Bordetella pertussis
cggccaaucggccug

SEQ ID NO: 2423244 - RNA, 18 nt, Bordetella pertussis
cggccaaucggccugcug

SEQ ID NO: 2423245 - RNA, 22 nt, Bordetella pertussis
cggccaauggccggugagaucc

SEQ ID NO: 2423246 - RNA, 12 nt, Bordetella pertussis
cggccaccacca

SEQ ID NO: 2423247 - RNA, 14 nt, Bordetella pertussis
cggccaccaccagg

SEQ ID NO: 2423248 - RNA, 19 nt, Bordetella pertussis
cggccaccaccaggcccag

SEQ ID NO: 2423249 - RNA, 16 nt, Bordetella pertussis
cggccaccacgauggc

SEQ ID NO: 2423250 - RNA, 20 nt, Bordetella pertussis
cggccaccacgauggcgcaa

SEQ ID NO: 2423251 - RNA, 12 nt, Bordetella pertussis
cggccaccagcg

SEQ ID NO: 2423252 - RNA, 15 nt, Bordetella pertussis
cggccaccagcggcg

SEQ ID NO: 2423253 - RNA, 16 nt, Bordetella pertussis
cggccaccagcggcgc

SEQ ID NO: 2423254 - RNA, 17 nt, Bordetella pertussis
cggccaccagcggcgcc

SEQ ID NO: 2423255 - RNA, 12 nt, Bordetella pertussis
cggccaccaggc

SEQ ID NO: 2423256 - RNA, 16 nt, Bordetella pertussis
cggccaccaggccguc

SEQ ID NO: 2423257 - RNA, 15 nt, Bordetella pertussis
cggccaccagggccc

SEQ ID NO: 2423258 - RNA, 18 nt, Bordetella pertussis
cggccaccaugcggucga

SEQ ID NO: 2423259 - RNA, 23 nt, Bordetella pertussis
cggccaccaugcggucgaugacc

SEQ ID NO: 2423260 - RNA, 15 nt, Bordetella pertussis
cggccaccgccgugu

SEQ ID NO: 2423261 - RNA, 13 nt, Bordetella pertussis
cggccaccgccug

SEQ ID NO: 2423262 - RNA, 16 nt, Bordetella pertussis
cggccaccgccugugc

SEQ ID NO: 2423263 - RNA, 15 nt, Bordetella pertussis
cggccaccgcguuga

SEQ ID NO: 2423264 - RNA, 19 nt, Bordetella pertussis
cggccaccgcguugagcgc

SEQ ID NO: 2423265 - RNA, 21 nt, Bordetella pertussis
cggccaccgcguugagcgccg

SEQ ID NO: 2423266 - RNA, 19 nt, Bordetella pertussis
cggccaccucuucagcccg

SEQ ID NO: 2423267 - RNA, 21 nt, Bordetella pertussis
cggccaccucuucagcccggc

SEQ ID NO: 2423268 - RNA, 14 nt, Bordetella pertussis
cggccaccuggcgc

SEQ ID NO: 2423269 - RNA, 15 nt, Bordetella pertussis
cggccaccuggcgca

SEQ ID NO: 2423270 - RNA, 18 nt, Bordetella pertussis
cggccaccuggucgucgg

SEQ ID NO: 2423271 - RNA, 16 nt, Bordetella pertussis
cggccacgaccggcuc

SEQ ID NO: 2423272 - RNA, 17 nt, Bordetella pertussis
cggccacgaccggcucg

SEQ ID NO: 2423273 - RNA, 22 nt, Bordetella pertussis
cggccacgauguugcgcaggcu

SEQ ID NO: 2423274 - RNA, 15 nt, Bordetella pertussis
cggccacgcagcgcg

SEQ ID NO: 2423275 - RNA, 18 nt, Bordetella pertussis
cggccacgcgcaacgccg

SEQ ID NO: 2423276 - RNA, 21 nt, Bordetella pertussis
cggccacgcgcaacgccgcca

SEQ ID NO: 2423277 - RNA, 14 nt, Bordetella pertussis
cggccacgcgccgc

SEQ ID NO: 2423278 - RNA, 16 nt, Bordetella pertussis
cggccacgcgccgccc

SEQ ID NO: 2423279 - RNA, 14 nt, Bordetella pertussis
cggccacgcgcugc

SEQ ID NO: 2423280 - RNA, 15 nt, Bordetella pertussis
cggccacgcgcugca

SEQ ID NO: 2423281 - RNA, 20 nt, Bordetella pertussis
cggccacgcgcugcagcagc

SEQ ID NO: 2423282 - RNA, 13 nt, Bordetella pertussis
cggccacgcugcc

SEQ ID NO: 2423283 - RNA, 17 nt, Bordetella pertussis
cggccacgcugcccugc

SEQ ID NO: 2423284 - RNA, 15 nt, Bordetella pertussis
cggccacggccggca

SEQ ID NO: 2423285 - RNA, 17 nt, Bordetella pertussis
cggccacggccggcagc

SEQ ID NO: 2423286 - RNA, 18 nt, Bordetella pertussis
cggccacggccggcagcg

SEQ ID NO: 2423287 - RNA, 14 nt, Bordetella pertussis
cggccacggccggg

SEQ ID NO: 2423288 - RNA, 17 nt, Bordetella pertussis
cggccacggccgggccu

SEQ ID NO: 2423289 - RNA, 14 nt, Bordetella pertussis
cggccacggccugc

SEQ ID NO: 2423290 - RNA, 15 nt, Bordetella pertussis
cggccacggccugcc

SEQ ID NO: 2423291 - RNA, 18 nt, Bordetella pertussis
cggccacggccugcccgg

SEQ ID NO: 2423292 - RNA, 20 nt, Bordetella pertussis
cggccacggccugcccgggc

SEQ ID NO: 2423293 - RNA, 17 nt, Bordetella pertussis
cggccacggcggugacc

SEQ ID NO: 2423294 - RNA, 22 nt, Bordetella pertussis
cggccacggcggugaccaccag

SEQ ID NO: 2423295 - RNA, 23 nt, Bordetella pertussis
cggccacggcggugaccaccagg

SEQ ID NO: 2423296 - RNA, 14 nt, Bordetella pertussis
cggccacggcugga

SEQ ID NO: 2423297 - RNA, 16 nt, Bordetella pertussis
cggccacgggaccgcu

SEQ ID NO: 2423298 - RNA, 19 nt, Bordetella pertussis
cggccacgggaccgcucag

SEQ ID NO: 2423299 - RNA, 14 nt, Bordetella pertussis
cggccacgucgccc

SEQ ID NO: 2423300 - RNA, 12 nt, Bordetella pertussis
cggccacgucgg

SEQ ID NO: 2423301 - RNA, 16 nt, Bordetella pertussis
cggccacgucggcggc

SEQ ID NO: 2423302 - RNA, 20 nt, Bordetella pertussis
cggccacgucggcggccgcc

SEQ ID NO: 2423303 - RNA, 21 nt, Bordetella pertussis
cggccacgucggcggccgccu

SEQ ID NO: 2423304 - RNA, 20 nt, Bordetella pertussis
cggccacguguggcaggcca

SEQ ID NO: 2423305 - RNA, 24 nt, Bordetella pertussis
cggccacguguggcaggccagcgc

SEQ ID NO: 2423306 - RNA, 20 nt, Bordetella pertussis
cggccacuuccuggugggcg

SEQ ID NO: 2423307 - RNA, 18 nt, Bordetella pertussis
cggccacuucgcggccga

SEQ ID NO: 2423308 - RNA, 17 nt, Bordetella pertussis
cggccacuuucgcgcgc

SEQ ID NO: 2423309 - RNA, 20 nt, Bordetella pertussis
cggccacuuucgcgcgcgcc

SEQ ID NO: 2423310 - RNA, 21 nt, Bordetella pertussis
cggccacuuucgcgcgcgccu

SEQ ID NO: 2423311 - RNA, 23 nt, Bordetella pertussis
cggccacuuucgcgcgcgccugc

SEQ ID NO: 2423312 - RNA, 18 nt, Bordetella pertussis
cggccagcuugaccgcca

SEQ ID NO: 2423313 - RNA, 15 nt, Bordetella pertussis
cggccagcuugagca

SEQ ID NO: 2423314 - RNA, 22 nt, Bordetella pertussis
cggccagcuugagcaggcgcga

SEQ ID NO: 2423315 - RNA, 17 nt, Bordetella pertussis
cggccagcuugccgcuc

SEQ ID NO: 2423316 - RNA, 20 nt, Bordetella pertussis
cggccagcuuguagcggcca

SEQ ID NO: 2423317 - RNA, 17 nt, Bordetella pertussis
cggccaggaaagccggc

SEQ ID NO: 2423318 - RNA, 17 nt, Bordetella pertussis
cggccaggacgaucccg

SEQ ID NO: 2423319 - RNA, 18 nt, Bordetella pertussis
cggccaggacgaucccgg

SEQ ID NO: 2423320 - RNA, 18 nt, Bordetella pertussis
cggccaggacggugucgc

SEQ ID NO: 2423321 - RNA, 18 nt, Bordetella pertussis
cggccaggaucgcggcca

SEQ ID NO: 2423322 - RNA, 20 nt, Bordetella pertussis
cggccaggauggcguugccg

SEQ ID NO: 2423323 - RNA, 22 nt, Bordetella pertussis
cggccaggauggcguugccggc

SEQ ID NO: 2423324 - RNA, 11 nt, Bordetella pertussis
cggccaggcca

SEQ ID NO: 2423325 - RNA, 17 nt, Bordetella pertussis
cggccaggcccugcgcg

SEQ ID NO: 2423326 - RNA, 15 nt, Bordetella pertussis
cggccaggccgauga

SEQ ID NO: 2423327 - RNA, 12 nt, Bordetella pertussis
cggccaggccgg

SEQ ID NO: 2423328 - RNA, 13 nt, Bordetella pertussis
cggccaggccggc

SEQ ID NO: 2423329 - RNA, 14 nt, Bordetella pertussis
cggccaggccggcc

SEQ ID NO: 2423330 - RNA, 16 nt, Bordetella pertussis
cggccaggccggccug

SEQ ID NO: 2423331 - RNA, 17 nt, Bordetella pertussis
cggccaggccggccugc

SEQ ID NO: 2423332 - RNA, 15 nt, Bordetella pertussis
cggccaggccggcgc

SEQ ID NO: 2423333 - RNA, 16 nt, Bordetella pertussis
cggccaggccggcgcg

SEQ ID NO: 2423334 - RNA, 18 nt, Bordetella pertussis
cggccaggccggcgcgcc

SEQ ID NO: 2423335 - RNA, 22 nt, Bordetella pertussis
cggccaggccggcgcgccggcc

SEQ ID NO: 2423336 - RNA, 23 nt, Bordetella pertussis
cggccaggccggcgcgccggccc

SEQ ID NO: 2423337 - RNA, 12 nt, Bordetella pertussis
cggccaggcgcc

SEQ ID NO: 2423338 - RNA, 16 nt, Bordetella pertussis
cggccaggcgccgcuc

SEQ ID NO: 2423339 - RNA, 23 nt, Bordetella pertussis
cggccaggcgccgcucagcgcgg

SEQ ID NO: 2423340 - RNA, 15 nt, Bordetella pertussis
cggccaggcgccggc

SEQ ID NO: 2423341 - RNA, 17 nt, Bordetella pertussis
cggccaggcgccggcgg

SEQ ID NO: 2423342 - RNA, 14 nt, Bordetella pertussis
cggccaggcgccug

SEQ ID NO: 2423343 - RNA, 15 nt, Bordetella pertussis
cggccaggcgccuga

SEQ ID NO: 2423344 - RNA, 18 nt, Bordetella pertussis
cggccaggcgccugagcc

SEQ ID NO: 2423345 - RNA, 14 nt, Bordetella pertussis
cggccaggcgcgcc

SEQ ID NO: 2423346 - RNA, 15 nt, Bordetella pertussis
cggccaggcgcgccg

SEQ ID NO: 2423347 - RNA, 22 nt, Bordetella pertussis
cggccaggcgcgugcgcaggcg

SEQ ID NO: 2423348 - RNA, 23 nt, Bordetella pertussis
cggccaggcguacgcuuaucgcg

SEQ ID NO: 2423349 - RNA, 23 nt, Bordetella pertussis
cggccagggcaagcgcgucgaug

SEQ ID NO: 2423350 - RNA, 13 nt, Bordetella pertussis
cggccagggccac

SEQ ID NO: 2423351 - RNA, 18 nt, Bordetella pertussis
cggccagggccacgccgg

SEQ ID NO: 2423352 - RNA, 19 nt, Bordetella pertussis
cggccagggccacgccggc

SEQ ID NO: 2423353 - RNA, 16 nt, Bordetella pertussis
cggccagggccugcgg

SEQ ID NO: 2423354 - RNA, 18 nt, Bordetella pertussis
cggccagggccugcgggc

SEQ ID NO: 2423355 - RNA, 23 nt, Bordetella pertussis
cggccagggccugcgggccgggc

SEQ ID NO: 2423356 - RNA, 16 nt, Bordetella pertussis
cggccagggcugcggc

SEQ ID NO: 2423357 - RNA, 17 nt, Bordetella pertussis
cggccagggcugcggcg

SEQ ID NO: 2423358 - RNA, 19 nt, Bordetella pertussis
cggccagggcugcggcggg

SEQ ID NO: 2423359 - RNA, 14 nt, Bordetella pertussis
cggccaggggcagc

SEQ ID NO: 2423360 - RNA, 18 nt, Bordetella pertussis
cggccaggggcagcucgg

SEQ ID NO: 2423361 - RNA, 17 nt, Bordetella pertussis
cggccaggggcgcuggu

SEQ ID NO: 2423362 - RNA, 17 nt, Bordetella pertussis
cggccagggucaggggc

SEQ ID NO: 2423363 - RNA, 21 nt, Bordetella pertussis
cggccagggucaggggcaggu

SEQ ID NO: 2423364 - RNA, 17 nt, Bordetella pertussis
cggccagggugccccgc

SEQ ID NO: 2423365 - RNA, 20 nt, Bordetella pertussis
cggccagggugccccgccgg

SEQ ID NO: 2423366 - RNA, 14 nt, Bordetella pertussis
cggccaggucgcgc

SEQ ID NO: 2423367 - RNA, 15 nt, Bordetella pertussis
cggccaggucgcgca

SEQ ID NO: 2423368 - RNA, 13 nt, Bordetella pertussis
cggccaggucggc

SEQ ID NO: 2423369 - RNA, 21 nt, Bordetella pertussis
cggccaggucggcggccagcg

SEQ ID NO: 2423370 - RNA, 23 nt, Bordetella pertussis
cggccaggucggcggccagcgcg

SEQ ID NO: 2423371 - RNA, 17 nt, Bordetella pertussis
cggccaggucggcgucg

SEQ ID NO: 2423372 - RNA, 15 nt, Bordetella pertussis
cggccaggugcgcca

SEQ ID NO: 2423373 - RNA, 18 nt, Bordetella pertussis
cggccaggugcgccaugc

SEQ ID NO: 2423374 - RNA, 14 nt, Bordetella pertussis
cggccagucgcggu

SEQ ID NO: 2423375 - RNA, 16 nt, Bordetella pertussis
cggccagucgcggugc

SEQ ID NO: 2423376 - RNA, 17 nt, Bordetella pertussis
cggccaguggcgcggcg

SEQ ID NO: 2423377 - RNA, 17 nt, Bordetella pertussis
cggccaguucgacgccc

SEQ ID NO: 2423378 - RNA, 21 nt, Bordetella pertussis
cggccaguucgacgcccaugc

SEQ ID NO: 2423379 - RNA, 15 nt, Bordetella pertussis
cggccaguucguccg

SEQ ID NO: 2423380 - RNA, 17 nt, Bordetella pertussis
cggccaguucguccgcu

SEQ ID NO: 2423381 - RNA, 17 nt, Bordetella pertussis
cggccauccggccacgc

SEQ ID NO: 2423382 - RNA, 18 nt, Bordetella pertussis
cggccauccggccacgca

SEQ ID NO: 2423383 - RNA, 24 nt, Bordetella pertussis
cggccaucgaagccagauaaaggc

SEQ ID NO: 2423384 - RNA, 20 nt, Bordetella pertussis
cggccaucgccauggccacg

SEQ ID NO: 2423385 - RNA, 15 nt, Bordetella pertussis
cggccaucgccgcca

SEQ ID NO: 2423386 - RNA, 17 nt, Bordetella pertussis
cggccaucgccgccacg

SEQ ID NO: 2423387 - RNA, 19 nt, Bordetella pertussis
cggccaucuuggugcgcgc

SEQ ID NO: 2423388 - RNA, 20 nt, Bordetella pertussis
cggccaucuuggugcgcgcc

SEQ ID NO: 2423389 - RNA, 22 nt, Bordetella pertussis
cggccaugacgggaauccgcug

SEQ ID NO: 2423390 - RNA, 20 nt, Bordetella pertussis
cggccaugauacccauggcc

SEQ ID NO: 2423391 - RNA, 13 nt, Bordetella pertussis
cggccaugcccag

SEQ ID NO: 2423392 - RNA, 18 nt, Bordetella pertussis
cggccaugcccaggccca

SEQ ID NO: 2423393 - RNA, 19 nt, Bordetella pertussis
cggccaugcccaggcccag

SEQ ID NO: 2423394 - RNA, 13 nt, Bordetella pertussis
cggccaugccgac

SEQ ID NO: 2423395 - RNA, 16 nt, Bordetella pertussis
cggccaugccggguug

SEQ ID NO: 2423396 - RNA, 19 nt, Bordetella pertussis
cggccaugccgucaccggc

SEQ ID NO: 2423397 - RNA, 20 nt, Bordetella pertussis
cggccaugccgucaccggcu

SEQ ID NO: 2423398 - RNA, 15 nt, Bordetella pertussis
cggccaugcgccgcu

SEQ ID NO: 2423399 - RNA, 16 nt, Bordetella pertussis
cggccaugcgcgccag

SEQ ID NO: 2423400 - RNA, 20 nt, Bordetella pertussis
cggccaugcgcgccagcaug

SEQ ID NO: 2423401 - RNA, 17 nt, Bordetella pertussis
cggccaugcggugcgcc

SEQ ID NO: 2423402 - RNA, 21 nt, Bordetella pertussis
cggccaugcucagcagcaccg

SEQ ID NO: 2423403 - RNA, 15 nt, Bordetella pertussis
cggccauggccgcca

SEQ ID NO: 2423404 - RNA, 23 nt, Bordetella pertussis
cggccauggcgcuguuggccggc

SEQ ID NO: 2423405 - RNA, 15 nt, Bordetella pertussis
cggccauggcggccg

SEQ ID NO: 2423406 - RNA, 16 nt, Bordetella pertussis
cggccauggcggccgg

SEQ ID NO: 2423407 - RNA, 18 nt, Bordetella pertussis
cggccauggcggccggcg

SEQ ID NO: 2423408 - RNA, 21 nt, Bordetella pertussis
cggccauggcggccggcguug

SEQ ID NO: 2423409 - RNA, 19 nt, Bordetella pertussis
cggccauggugccccaugc

SEQ ID NO: 2423410 - RNA, 20 nt, Bordetella pertussis
cggccauguagauggccgcc

SEQ ID NO: 2423411 - RNA, 21 nt, Bordetella pertussis
cggccauguagauggccgccu

SEQ ID NO: 2423412 - RNA, 15 nt, Bordetella pertussis
cggccaugugcgcca

SEQ ID NO: 2423413 - RNA, 20 nt, Bordetella pertussis
cggccauguucuucaggcuc

SEQ ID NO: 2423414 - RNA, 15 nt, Bordetella pertussis
cggcccaaggccccg

SEQ ID NO: 2423415 - RNA, 16 nt, Bordetella pertussis
cggcccaaggccccgc

SEQ ID NO: 2423416 - RNA, 18 nt, Bordetella pertussis
cggcccaaggccccgcga

SEQ ID NO: 2423417 - RNA, 19 nt, Bordetella pertussis
cggcccaaggccccgcgac

SEQ ID NO: 2423418 - RNA, 14 nt, Bordetella pertussis
cggcccacagcgcc

SEQ ID NO: 2423419 - RNA, 15 nt, Bordetella pertussis
cggcccacagcgccc

SEQ ID NO: 2423420 - RNA, 12 nt, Bordetella pertussis
cggcccacccgg

SEQ ID NO: 2423421 - RNA, 19 nt, Bordetella pertussis
cggcccacccggcacgcgc

SEQ ID NO: 2423422 - RNA, 20 nt, Bordetella pertussis
cggcccacccggcacgcgcc

SEQ ID NO: 2423423 - RNA, 21 nt, Bordetella pertussis
cggcccacccggcacgcgccg

SEQ ID NO: 2423424 - RNA, 13 nt, Bordetella pertussis
cggcccacggcca

SEQ ID NO: 2423425 - RNA, 22 nt, Bordetella pertussis
cggcccugggcgcggcgguggc

SEQ ID NO: 2423426 - RNA, 17 nt, Bordetella pertussis
cggcccuggucgucgcg

SEQ ID NO: 2423427 - RNA, 19 nt, Bordetella pertussis
cggcccuggucgucgcggc

SEQ ID NO: 2423428 - RNA, 13 nt, Bordetella pertussis
cggcccuggucua

SEQ ID NO: 2423429 - RNA, 16 nt, Bordetella pertussis
cggcccugucggccga

SEQ ID NO: 2423430 - RNA, 16 nt, Bordetella pertussis
cggcccuguucgcgcg

SEQ ID NO: 2423431 - RNA, 24 nt, Bordetella pertussis
cggcccuugcgcgaacggcaggug

SEQ ID NO: 2423432 - RNA, 19 nt, Bordetella pertussis
cggccgaaaccgccgcggc

SEQ ID NO: 2423433 - RNA, 17 nt, Bordetella pertussis
cggccgaaccgcgcagc

SEQ ID NO: 2423434 - RNA, 21 nt, Bordetella pertussis
cggccgaaccgcgcagccgcu

SEQ ID NO: 2423435 - RNA, 18 nt, Bordetella pertussis
cggccgaagcgcaagccc

SEQ ID NO: 2423436 - RNA, 20 nt, Bordetella pertussis
cggccgaagcgcaagcccag

SEQ ID NO: 2423437 - RNA, 22 nt, Bordetella pertussis
cggccgaagcgcaagcccaggc

SEQ ID NO: 2423438 - RNA, 15 nt, Bordetella pertussis
cggccgacagcuugc

SEQ ID NO: 2423439 - RNA, 20 nt, Bordetella pertussis
cggccgacagcuugcgcugg

SEQ ID NO: 2423440 - RNA, 18 nt, Bordetella pertussis
cggccgaccacuggaagc

SEQ ID NO: 2423441 - RNA, 17 nt, Bordetella pertussis
cggccgacccgcggccc

SEQ ID NO: 2423442 - RNA, 22 nt, Bordetella pertussis
cggccgacccgcggcccuugcg

SEQ ID NO: 2423443 - RNA, 11 nt, Bordetella pertussis
cggccgaccgg

SEQ ID NO: 2423444 - RNA, 15 nt, Bordetella pertussis
cggccgaccggcgcg

SEQ ID NO: 2423445 - RNA, 18 nt, Bordetella pertussis
cggccgaccggcgcgcgc

SEQ ID NO: 2423446 - RNA, 13 nt, Bordetella pertussis
acggccgggcgcc

SEQ ID NO: 2423447 - RNA, 23 nt, Bordetella pertussis
acggccggggcccgcgggcgccc

SEQ ID NO: 2423448 - RNA, 22 nt, Bordetella pertussis
acggccgggucccuggcccugg

SEQ ID NO: 2423449 - RNA, 15 nt, Bordetella pertussis
acggccggucagccc

SEQ ID NO: 2423450 - RNA, 18 nt, Bordetella pertussis
acggccggucagcccagg

SEQ ID NO: 2423451 - RNA, 19 nt, Bordetella pertussis
acggccggucagcccaggc

SEQ ID NO: 2423452 - RNA, 23 nt, Bordetella pertussis
acggccggucagcccaggcgggc

SEQ ID NO: 2423453 - RNA, 18 nt, Bordetella pertussis
acggccucccgccgcccg

SEQ ID NO: 2423454 - RNA, 18 nt, Bordetella pertussis
acggccuccgcgccgacc

SEQ ID NO: 2423455 - RNA, 16 nt, Bordetella pertussis
acggccucggccagga

SEQ ID NO: 2423456 - RNA, 13 nt, Bordetella pertussis
acggccugcccgg

SEQ ID NO: 2423457 - RNA, 14 nt, Bordetella pertussis
acggccugcgcgcc

SEQ ID NO: 2423458 - RNA, 23 nt, Bordetella pertussis
acggccuggaggccgagcgcgag

SEQ ID NO: 2423459 - RNA, 13 nt, Bordetella pertussis
acggccuguccgg

SEQ ID NO: 2423460 - RNA, 15 nt, Bordetella pertussis
acggccuucggcggc

SEQ ID NO: 2423461 - RNA, 20 nt, Bordetella pertussis
acggccuucggcggcgcgcu

SEQ ID NO: 2423462 - RNA, 18 nt, Bordetella pertussis
acggccuugucgcgcccg

SEQ ID NO: 2423463 - RNA, 17 nt, Bordetella pertussis
acggcgacuuccagcag

SEQ ID NO: 2423464 - RNA, 18 nt, Bordetella pertussis
acggcgacuuccagcaga

SEQ ID NO: 2423465 - RNA, 19 nt, Bordetella pertussis
acggcgacuuccagcagau

SEQ ID NO: 2423466 - RNA, 20 nt, Bordetella pertussis
acggcgacuuccagcagauu

SEQ ID NO: 2423467 - RNA, 17 nt, Bordetella pertussis
acggcgaggaggugcgc

SEQ ID NO: 2423468 - RNA, 21 nt, Bordetella pertussis
acggcgaggaggugcgccgcu

SEQ ID NO: 2423469 - RNA, 22 nt, Bordetella pertussis
acggcgaggaggugcgccgcuc

SEQ ID NO: 2423470 - RNA, 18 nt, Bordetella pertussis
acggcgagucugaaaggg

SEQ ID NO: 2423471 - RNA, 16 nt, Bordetella pertussis
acggcgaucauggcgu

SEQ ID NO: 2423472 - RNA, 19 nt, Bordetella pertussis
acggcgaugaacagcggca

SEQ ID NO: 2423473 - RNA, 17 nt, Bordetella pertussis
acggcgaugcugccguc

SEQ ID NO: 2423474 - RNA, 15 nt, Bordetella pertussis
acggcgauggccgac

SEQ ID NO: 2423475 - RNA, 12 nt, Bordetella pertussis
acggcgccaugc

SEQ ID NO: 2423476 - RNA, 17 nt, Bordetella pertussis
acggcgccgauccggcg

SEQ ID NO: 2423477 - RNA, 19 nt, Bordetella pertussis
acggcgccgauccggcgca

SEQ ID NO: 2423478 - RNA, 12 nt, Bordetella pertussis
acggcgccgucc

SEQ ID NO: 2423479 - RNA, 22 nt, Bordetella pertussis
acggcgccguccgcaucgcgca

SEQ ID NO: 2423480 - RNA, 18 nt, Bordetella pertussis
acggcgccuggcgcauga

SEQ ID NO: 2423481 - RNA, 18 nt, Bordetella pertussis
acggcgcgcccgcaggcg

SEQ ID NO: 2423482 - RNA, 20 nt, Bordetella pertussis
acggcgcgcccgcaggcggc

SEQ ID NO: 2423483 - RNA, 14 nt, Bordetella pertussis
acggcgcgcccgcc

SEQ ID NO: 2423484 - RNA, 15 nt, Bordetella pertussis
acggcgcgcgccugc

SEQ ID NO: 2423485 - RNA, 13 nt, Bordetella pertussis
acggcgcggaucg

SEQ ID NO: 2423486 - RNA, 20 nt, Bordetella pertussis
acggcgcggaugccguccac

SEQ ID NO: 2423487 - RNA, 23 nt, Bordetella pertussis
acggcgcggaugccguccacgcc

SEQ ID NO: 2423488 - RNA, 15 nt, Bordetella pertussis
acggcgcggccugcu

SEQ ID NO: 2423489 - RNA, 24 nt, Bordetella pertussis
acggcgcgggcacucggccauggu

SEQ ID NO: 2423490 - RNA, 13 nt, Bordetella pertussis
acggcgcggugcc

SEQ ID NO: 2423491 - RNA, 15 nt, Bordetella pertussis
acggcgcggugccug

SEQ ID NO: 2423492 - RNA, 19 nt, Bordetella pertussis
acggcgcggugccugugcc

SEQ ID NO: 2423493 - RNA, 14 nt, Bordetella pertussis
acggcgcucggccu

SEQ ID NO: 2423494 - RNA, 15 nt, Bordetella pertussis
acggcgcucggccuc

SEQ ID NO: 2423495 - RNA, 17 nt, Bordetella pertussis
acggcgcucuugguggu

SEQ ID NO: 2423496 - RNA, 23 nt, Bordetella pertussis
acggcgcucuugguggugccugc

SEQ ID NO: 2423497 - RNA, 16 nt, Bordetella pertussis
acggcgcuggcgagca

SEQ ID NO: 2423498 - RNA, 12 nt, Bordetella pertussis
acggcggaaauu

SEQ ID NO: 2423499 - RNA, 16 nt, Bordetella pertussis
acggcggacuggccgc

SEQ ID NO: 2423500 - RNA, 22 nt, Bordetella pertussis
acggcggacuggccgcgccgcu

SEQ ID NO: 2423501 - RNA, 14 nt, Bordetella pertussis
acggcggcaggccg

SEQ ID NO: 2423502 - RNA, 15 nt, Bordetella pertussis
acggcggcaggccgc

SEQ ID NO: 2423503 - RNA, 18 nt, Bordetella pertussis
acggcggcaggccgcgcc

SEQ ID NO: 2423504 - RNA, 15 nt, Bordetella pertussis
acggcggcgcgcgga

SEQ ID NO: 2423505 - RNA, 17 nt, Bordetella pertussis
acggcggcgcggcgcca

SEQ ID NO: 2423506 - RNA, 13 nt, Bordetella pertussis
acggcggcggcca

SEQ ID NO: 2423507 - RNA, 20 nt, Bordetella pertussis
acggcggcggccaucgccau

SEQ ID NO: 2423508 - RNA, 18 nt, Bordetella pertussis
acggcggcuucggccguc

SEQ ID NO: 2423509 - RNA, 13 nt, Bordetella pertussis
acggcgggccggc

SEQ ID NO: 2423510 - RNA, 16 nt, Bordetella pertussis
acggcgggccggcucg

SEQ ID NO: 2423511 - RNA, 22 nt, Bordetella pertussis
acggcgggccggcucggcggca

SEQ ID NO: 2423512 - RNA, 14 nt, Bordetella pertussis
acggcgggcgcccc

SEQ ID NO: 2423513 - RNA, 14 nt, Bordetella pertussis
acggcgggcgcgca

SEQ ID NO: 2423514 - RNA, 20 nt, Bordetella pertussis
acggcgggcgcgcaggccuc

SEQ ID NO: 2423515 - RNA, 16 nt, Bordetella pertussis
acggcggugccgcgca

SEQ ID NO: 2423516 - RNA, 14 nt, Bordetella pertussis
acggcgucgagcac

SEQ ID NO: 2423517 - RNA, 15 nt, Bordetella pertussis
acggcgucgaugcgc

SEQ ID NO: 2423518 - RNA, 16 nt, Bordetella pertussis
acggcgucgccggcca

SEQ ID NO: 2423519 - RNA, 19 nt, Bordetella pertussis
acggcgucgccggccaggc

SEQ ID NO: 2423520 - RNA, 23 nt, Bordetella pertussis
acggcgucgggcagcaggcgcau

SEQ ID NO: 2423521 - RNA, 22 nt, Bordetella pertussis
acggcucgagcuccugcucgau

SEQ ID NO: 2423522 - RNA, 15 nt, Bordetella pertussis
acggcuggccgucga

SEQ ID NO: 2423523 - RNA, 21 nt, Bordetella pertussis
acggcuggcugggcgcgccgc

SEQ ID NO: 2423524 - RNA, 15 nt, Bordetella pertussis
acggcuucgcccagc

SEQ ID NO: 2423525 - RNA, 18 nt, Bordetella pertussis
acggcuucgcccagcgcu

SEQ ID NO: 2423526 - RNA, 13 nt, Bordetella pertussis
acggcuugaccac

SEQ ID NO: 2423527 - RNA, 20 nt, Bordetella pertussis
acggcuugaccacggccagc

SEQ ID NO: 2423528 - RNA, 22 nt, Bordetella pertussis
acggcuugaccacggccagcag

SEQ ID NO: 2423529 - RNA, 17 nt, Bordetella pertussis
acggcuugcgcgccugc

SEQ ID NO: 2423530 - RNA, 18 nt, Bordetella pertussis
acggcuugcgcgccugcu

SEQ ID NO: 2423531 - RNA, 21 nt, Bordetella pertussis
acggcuugcgcguaggcgcgc

SEQ ID NO: 2423532 - RNA, 21 nt, Bordetella pertussis
acggcuugcuucaggcuggcc

SEQ ID NO: 2423533 - RNA, 16 nt, Bordetella pertussis
acggcuuggcgugcgc

SEQ ID NO: 2423534 - RNA, 22 nt, Bordetella pertussis
acggcuuggcgugcgcgagcug

SEQ ID NO: 2423535 - RNA, 17 nt, Bordetella pertussis
acgggaauccgcugcgc

SEQ ID NO: 2423536 - RNA, 15 nt, Bordetella pertussis
acgggaaugaagcgc

SEQ ID NO: 2423537 - RNA, 18 nt, Bordetella pertussis
acgggaugcuccagcuug

SEQ ID NO: 2423538 - RNA, 14 nt, Bordetella pertussis
cggccgccggcggc

SEQ ID NO: 2423539 - RNA, 17 nt, Bordetella pertussis
cggccgccggcggcgcc

SEQ ID NO: 2423540 - RNA, 18 nt, Bordetella pertussis
cggccgccggcggcgccg

SEQ ID NO: 2423541 - RNA, 18 nt, Bordetella pertussis
cggccgccgggccgcgac

SEQ ID NO: 2423542 - RNA, 21 nt, Bordetella pertussis
cggccgccguaaucggcgucg

SEQ ID NO: 2423543 - RNA, 15 nt, Bordetella pertussis
cggccgccuccaggc

SEQ ID NO: 2423544 - RNA, 19 nt, Bordetella pertussis
cggccgccuccaggcggcg

SEQ ID NO: 2423545 - RNA, 20 nt, Bordetella pertussis
cggccgccuccaggcggcgg

SEQ ID NO: 2423546 - RNA, 21 nt, Bordetella pertussis
cggccgccuccaggcggcggu

SEQ ID NO: 2423547 - RNA, 14 nt, Bordetella pertussis
cggccgccugcgcc

SEQ ID NO: 2423548 - RNA, 23 nt, Bordetella pertussis
cggccgccugcgccgaggcgggc

SEQ ID NO: 2423549 - RNA, 14 nt, Bordetella pertussis
cggccgccuggccc

SEQ ID NO: 2423550 - RNA, 22 nt, Bordetella pertussis
cggccgcgacgcuacagcguca

SEQ ID NO: 2423551 - RNA, 23 nt, Bordetella pertussis
cggccgcgaucgaguggugcgcg

SEQ ID NO: 2423552 - RNA, 17 nt, Bordetella pertussis
cggccgcgcaaggcggc

SEQ ID NO: 2423553 - RNA, 22 nt, Bordetella pertussis
cggccgcgcaaggcggcccggc

SEQ ID NO: 2423554 - RNA, 13 nt, Bordetella pertussis
cggccgcgcaccu

SEQ ID NO: 2423555 - RNA, 13 nt, Bordetella pertussis
cggccgcgcagga

SEQ ID NO: 2423556 - RNA, 15 nt, Bordetella pertussis
cggccgcgccagccc

SEQ ID NO: 2423557 - RNA, 15 nt, Bordetella pertussis
cggccgcgcccaugc

SEQ ID NO: 2423558 - RNA, 12 nt, Bordetella pertussis
cggccgcgcccg

SEQ ID NO: 2423559 - RNA, 13 nt, Bordetella pertussis
cggccgcgcccga

SEQ ID NO: 2423560 - RNA, 14 nt, Bordetella pertussis
cggccgcgcccgag

SEQ ID NO: 2423561 - RNA, 15 nt, Bordetella pertussis
cggccgcgccgccgc

SEQ ID NO: 2423562 - RNA, 23 nt, Bordetella pertussis
cggccgcgccgccgcccuggccg

SEQ ID NO: 2423563 - RNA, 18 nt, Bordetella pertussis
cggccgcgccgcgccggu

SEQ ID NO: 2423564 - RNA, 14 nt, Bordetella pertussis
cggccgcgcgcauc

SEQ ID NO: 2423565 - RNA, 20 nt, Bordetella pertussis
cggccgcgcgcaucacgcug

SEQ ID NO: 2423566 - RNA, 22 nt, Bordetella pertussis
cggccgcgcgcgccaugucgac

SEQ ID NO: 2423567 - RNA, 20 nt, Bordetella pertussis
cggccgcgcgcuucaggcgc

SEQ ID NO: 2423568 - RNA, 21 nt, Bordetella pertussis
cggccgcgcgcuucaggcgcc

SEQ ID NO: 2423569 - RNA, 14 nt, Bordetella pertussis
cggccgcgcggccg

SEQ ID NO: 2423570 - RNA, 15 nt, Bordetella pertussis
cggccgcgcggccgu

SEQ ID NO: 2423571 - RNA, 17 nt, Bordetella pertussis
cggccgcgcggccguca

SEQ ID NO: 2423572 - RNA, 15 nt, Bordetella pertussis
cggccgcgcuggcgc

SEQ ID NO: 2423573 - RNA, 22 nt, Bordetella pertussis
cggccgcggaagucgggcacca

SEQ ID NO: 2423574 - RNA, 24 nt, Bordetella pertussis
cggccgcggaagucgggcaccagc

SEQ ID NO: 2423575 - RNA, 13 nt, Bordetella pertussis
cggccgcggccgg

SEQ ID NO: 2423576 - RNA, 15 nt, Bordetella pertussis
cggccgcggccggca

SEQ ID NO: 2423577 - RNA, 14 nt, Bordetella pertussis
cggccgcggcguug

SEQ ID NO: 2423578 - RNA, 14 nt, Bordetella pertussis
cggccgcgggccgc

SEQ ID NO: 2423579 - RNA, 15 nt, Bordetella pertussis
cggccgcgggccgcu

SEQ ID NO: 2423580 - RNA, 19 nt, Bordetella pertussis
cggccgcgggcggcgcgcc

SEQ ID NO: 2423581 - RNA, 20 nt, Bordetella pertussis
cggccgcgggcggcgcgccc

SEQ ID NO: 2423582 - RNA, 14 nt, Bordetella pertussis
cggccgcgggcgug

SEQ ID NO: 2423583 - RNA, 18 nt, Bordetella pertussis
cggccgcgggcgugcugg

SEQ ID NO: 2423584 - RNA, 23 nt, Bordetella pertussis
cggccgcgggcgugcuggcacug

SEQ ID NO: 2423585 - RNA, 21 nt, Bordetella pertussis
cggccgcggggcuggccagcu

SEQ ID NO: 2423586 - RNA, 22 nt, Bordetella pertussis
cggccgcggggcuggccagcug

SEQ ID NO: 2423587 - RNA, 23 nt, Bordetella pertussis
cggccgcggggcuggccagcugg

SEQ ID NO: 2423588 - RNA, 18 nt, Bordetella pertussis
cggccgcggguggccgcu

SEQ ID NO: 2423589 - RNA, 19 nt, Bordetella pertussis
cggccgcggguggccgcuc

SEQ ID NO: 2423590 - RNA, 18 nt, Bordetella pertussis
cggccgcggucagccaga

SEQ ID NO: 2423591 - RNA, 19 nt, Bordetella pertussis
cggccgcguccagcgcgcg

SEQ ID NO: 2423592 - RNA, 19 nt, Bordetella pertussis
cggccgcgucgaucagcgc

SEQ ID NO: 2423593 - RNA, 20 nt, Bordetella pertussis
cggccgcgucgaucagcgcg

SEQ ID NO: 2423594 - RNA, 21 nt, Bordetella pertussis
cggccgcgucgaucagcgcgg

SEQ ID NO: 2423595 - RNA, 14 nt, Bordetella pertussis
cggccgcgucggcc

SEQ ID NO: 2423596 - RNA, 17 nt, Bordetella pertussis
cggccgcgucggccuca

SEQ ID NO: 2423597 - RNA, 20 nt, Bordetella pertussis
cggccgcguggccgcgcugc

SEQ ID NO: 2423598 - RNA, 21 nt, Bordetella pertussis
cggccgcguggccgcgcugcu

SEQ ID NO: 2423599 - RNA, 15 nt, Bordetella pertussis
cggccgcguucagca

SEQ ID NO: 2423600 - RNA, 15 nt, Bordetella pertussis
cggccgcugccgcgc

SEQ ID NO: 2423601 - RNA, 19 nt, Bordetella pertussis
cggccgcugccgcgcgccg

SEQ ID NO: 2423602 - RNA, 21 nt, Bordetella pertussis
cggccgcugccgcgcgccggc

SEQ ID NO: 2423603 - RNA, 17 nt, Bordetella pertussis
cggccggacagggccgc

SEQ ID NO: 2423604 - RNA, 19 nt, Bordetella pertussis
cggccggacagggccgcga

SEQ ID NO: 2423605 - RNA, 22 nt, Bordetella pertussis
cggccggacagggccgcgagca

SEQ ID NO: 2423606 - RNA, 13 nt, Bordetella pertussis
cggccggaccgcu

SEQ ID NO: 2423607 - RNA, 16 nt, Bordetella pertussis
cggccggaccgcugug

SEQ ID NO: 2423608 - RNA, 20 nt, Bordetella pertussis
cggccggaccgcugugcgcg

SEQ ID NO: 2423609 - RNA, 16 nt, Bordetella pertussis
cggccggaggccgccc

SEQ ID NO: 2423610 - RNA, 21 nt, Bordetella pertussis
cggccggaugcgcaggacggc

SEQ ID NO: 2423611 - RNA, 17 nt, Bordetella pertussis
cggccggcaaggggcca

SEQ ID NO: 2423612 - RNA, 22 nt, Bordetella pertussis
cggccggcaaggggccagccug

SEQ ID NO: 2423613 - RNA, 23 nt, Bordetella pertussis
cggccggcaaggugaucgaggcg

SEQ ID NO: 2423614 - RNA, 14 nt, Bordetella pertussis
cggccggcaccagg

SEQ ID NO: 2423615 - RNA, 15 nt, Bordetella pertussis
cggccggcaccagga

SEQ ID NO: 2423616 - RNA, 14 nt, Bordetella pertussis
cggccggcacgccc

SEQ ID NO: 2423617 - RNA, 17 nt, Bordetella pertussis
cggccggcacgcccagc

SEQ ID NO: 2423618 - RNA, 18 nt, Bordetella pertussis
cggccggcacgcccagcc

SEQ ID NO: 2423619 - RNA, 20 nt, Bordetella pertussis
cggccggcacgcccagccgc

SEQ ID NO: 2423620 - RNA, 13 nt, Bordetella pertussis
cggccggcacggc

SEQ ID NO: 2423621 - RNA, 15 nt, Bordetella pertussis
cggccggcacggccg

SEQ ID NO: 2423622 - RNA, 16 nt, Bordetella pertussis
cggccggcacggccgg

SEQ ID NO: 2423623 - RNA, 17 nt, Bordetella pertussis
cggccggcacggccggc

SEQ ID NO: 2423624 - RNA, 19 nt, Bordetella pertussis
cggccggcacggccggcca

SEQ ID NO: 2423625 - RNA, 21 nt, Bordetella pertussis
cggccggcacggccggccagg

SEQ ID NO: 2423626 - RNA, 14 nt, Bordetella pertussis
cggccggcagcgcg

SEQ ID NO: 2423627 - RNA, 23 nt, Bordetella pertussis
cggccggcagcgcgaccggcgcg

SEQ ID NO: 2423628 - RNA, 18 nt, Bordetella pertussis
cggccggcagcggcgcca

SEQ ID NO: 2423629 - RNA, 15 nt, Bordetella pertussis
cggccggcaggccgg

SEQ ID NO: 2423630 - RNA, 18 nt, Bordetella pertussis
cggccggcaggccggcca

SEQ ID NO: 2423631 - RNA, 15 nt, Bordetella pertussis
cggccggcaggucga

SEQ ID NO: 2423632 - RNA, 13 nt, Bordetella pertussis
cggccggccagcc

SEQ ID NO: 2423633 - RNA, 14 nt, Bordetella pertussis
cggccggccagcca

SEQ ID NO: 2423634 - RNA, 16 nt, Bordetella pertussis
cggccggccaggcgcc

SEQ ID NO: 2423635 - RNA, 19 nt, Bordetella pertussis
cggccggccaggcgccgcu

SEQ ID NO: 2423636 - RNA, 16 nt, Bordetella pertussis
cggccggccaguacgu

SEQ ID NO: 2423637 - RNA, 22 nt, Bordetella pertussis
cggccggccaguacgucggaca

SEQ ID NO: 2423638 - RNA, 15 nt, Bordetella pertussis
cggccggcccgugcg

SEQ ID NO: 2423639 - RNA, 13 nt, Bordetella pertussis
cggccggccgggc

SEQ ID NO: 2423640 - RNA, 14 nt, Bordetella pertussis
cggccggccgggca

SEQ ID NO: 2423641 - RNA, 14 nt, Bordetella pertussis
cggccggccgggcc

SEQ ID NO: 2423642 - RNA, 16 nt, Bordetella pertussis
cggccggccgggccgc

SEQ ID NO: 2423643 - RNA, 15 nt, Bordetella pertussis
cggccggccugcggg

SEQ ID NO: 2423644 - RNA, 16 nt, Bordetella pertussis
cggccggccugcgggc

SEQ ID NO: 2423645 - RNA, 22 nt, Bordetella pertussis
cggccggccugcuuggccgcgu

SEQ ID NO: 2423646 - RNA, 21 nt, Bordetella pertussis
cggccggcgcaguuccggcgg

SEQ ID NO: 2423647 - RNA, 22 nt, Bordetella pertussis
cggccggcgcaguuccggcggg

SEQ ID NO: 2423648 - RNA, 14 nt, Bordetella pertussis
cggccggcgccggc

SEQ ID NO: 2423649 - RNA, 15 nt, Bordetella pertussis
cggccggcgccggca

SEQ ID NO: 2423650 - RNA, 14 nt, Bordetella pertussis
cggccggcgcgccg

SEQ ID NO: 2423651 - RNA, 22 nt, Bordetella pertussis
cggccuaucaccugggcaaccg

SEQ ID NO: 2423652 - RNA, 20 nt, Bordetella pertussis
cggccuaugugcaggccacc

SEQ ID NO: 2423653 - RNA, 20 nt, Bordetella pertussis
cggccuauuuggcggccugg

SEQ ID NO: 2423654 - RNA, 22 nt, Bordetella pertussis
cggccuauuuggcggccuggcc

SEQ ID NO: 2423655 - RNA, 15 nt, Bordetella pertussis
cggccucaaccgcgc

SEQ ID NO: 2423656 - RNA, 15 nt, Bordetella pertussis
cggccucagcggccg

SEQ ID NO: 2423657 - RNA, 18 nt, Bordetella pertussis
cggccucagcggccgcug

SEQ ID NO: 2423658 - RNA, 21 nt, Bordetella pertussis
cggccucagcggccgcugccg

SEQ ID NO: 2423659 - RNA, 16 nt, Bordetella pertussis
cggccucaucgagcgc

SEQ ID NO: 2423660 - RNA, 17 nt, Bordetella pertussis
cggccucaucgagcgcc

SEQ ID NO: 2423661 - RNA, 23 nt, Bordetella pertussis
cggccuccagcaucgccgccagc

SEQ ID NO: 2423662 - RNA, 13 nt, Bordetella pertussis
cggccucccgccg

SEQ ID NO: 2423663 - RNA, 19 nt, Bordetella pertussis
cggccucccgccgcccggc

SEQ ID NO: 2423664 - RNA, 18 nt, Bordetella pertussis
cggccucccggaccagca

SEQ ID NO: 2423665 - RNA, 15 nt, Bordetella pertussis
cggccuccgcgcaca

SEQ ID NO: 2423666 - RNA, 18 nt, Bordetella pertussis
cggccuccgcgcacagcg

SEQ ID NO: 2423667 - RNA, 17 nt, Bordetella pertussis
cggccuccgcgccgacc

SEQ ID NO: 2423668 - RNA, 14 nt, Bordetella pertussis
cggccuccggcagg

SEQ ID NO: 2423669 - RNA, 19 nt, Bordetella pertussis
cggccucgacgauggccgg

SEQ ID NO: 2423670 - RNA, 22 nt, Bordetella pertussis
cggccucgacgauggccggggc

SEQ ID NO: 2423671 - RNA, 15 nt, Bordetella pertussis
cggccucgacggccg

SEQ ID NO: 2423672 - RNA, 17 nt, Bordetella pertussis
cggccucgacggccgcc

SEQ ID NO: 2423673 - RNA, 19 nt, Bordetella pertussis
cggccucgacggccgccgg

SEQ ID NO: 2423674 - RNA, 22 nt, Bordetella pertussis
cggccucgagguauucgcgcga

SEQ ID NO: 2423675 - RNA, 19 nt, Bordetella pertussis
cggccucgcccaugcgggc

SEQ ID NO: 2423676 - RNA, 15 nt, Bordetella pertussis
cggccucgccggccu

SEQ ID NO: 2423677 - RNA, 17 nt, Bordetella pertussis
cggccucgccggccugg

SEQ ID NO: 2423678 - RNA, 22 nt, Bordetella pertussis
cggccucgcgcagggcggccuc

SEQ ID NO: 2423679 - RNA, 14 nt, Bordetella pertussis
cggccucgcggcgc

SEQ ID NO: 2423680 - RNA, 15 nt, Bordetella pertussis
cggccucgcggcgca

SEQ ID NO: 2423681 - RNA, 17 nt, Bordetella pertussis
cggccucgcggcgcagc

SEQ ID NO: 2423682 - RNA, 19 nt, Bordetella pertussis
cggccucgcugcgggcggc

SEQ ID NO: 2423683 - RNA, 22 nt, Bordetella pertussis
cggccucgcugcgggcggccug

SEQ ID NO: 2423684 - RNA, 23 nt, Bordetella pertussis
cggccucgcugcgggcggccugg

SEQ ID NO: 2423685 - RNA, 15 nt, Bordetella pertussis
cggccucggccagcu

SEQ ID NO: 2423686 - RNA, 14 nt, Bordetella pertussis
cggccucggccagg

SEQ ID NO: 2423687 - RNA, 20 nt, Bordetella pertussis
cggccucggccauguagaug

SEQ ID NO: 2423688 - RNA, 23 nt, Bordetella pertussis
cggccucggcgaagugcccgcug

SEQ ID NO: 2423689 - RNA, 21 nt, Bordetella pertussis
cggccucggcgggcggcgcca

SEQ ID NO: 2423690 - RNA, 17 nt, Bordetella pertussis
cggccucgguggucagg

SEQ ID NO: 2423691 - RNA, 21 nt, Bordetella pertussis
cggccucgguggucagguagc

SEQ ID NO: 2423692 - RNA, 22 nt, Bordetella pertussis
cggccucguaguguucgauggc

SEQ ID NO: 2423693 - RNA, 19 nt, Bordetella pertussis
cggccucguccucgucggc

SEQ ID NO: 2423694 - RNA, 14 nt, Bordetella pertussis
cggccucuucgucg

SEQ ID NO: 2423695 - RNA, 19 nt, Bordetella pertussis
cggccucuucgucgccggc

SEQ ID NO: 2423696 - RNA, 22 nt, Bordetella pertussis
cggccucuucgucgccggcgcu

SEQ ID NO: 2423697 - RNA, 19 nt, Bordetella pertussis
cggccugaaccaggccgcc

SEQ ID NO: 2423698 - RNA, 23 nt, Bordetella pertussis
cggccugaaccaggccgccaggg

SEQ ID NO: 2423699 - RNA, 17 nt, Bordetella pertussis
cggccugacgcgcaagc

SEQ ID NO: 2423700 - RNA, 20 nt, Bordetella pertussis
cggccugacgcgcaagcggc

SEQ ID NO: 2423701 - RNA, 23 nt, Bordetella pertussis
cggccugacgcgcaagcggcccc

SEQ ID NO: 2423702 - RNA, 14 nt, Bordetella pertussis
cggccugcaaugcg

SEQ ID NO: 2423703 - RNA, 16 nt, Bordetella pertussis
cggccugcaaugcggc

SEQ ID NO: 2423704 - RNA, 17 nt, Bordetella pertussis
cggccugcaaugcggcc

SEQ ID NO: 2423705 - RNA, 18 nt, Bordetella pertussis
cggccugcaaugcggcca

SEQ ID NO: 2423706 - RNA, 19 nt, Bordetella pertussis
cggccugcaaugcggccag

SEQ ID NO: 2423707 - RNA, 21 nt, Bordetella pertussis
cggccugcaaugcggccaggc

SEQ ID NO: 2423708 - RNA, 14 nt, Bordetella pertussis
cggccugcaccggc

SEQ ID NO: 2423709 - RNA, 15 nt, Bordetella pertussis
cggccugcaccggcg

SEQ ID NO: 2423710 - RNA, 17 nt, Bordetella pertussis
cggccugcaccggcgcg

SEQ ID NO: 2423711 - RNA, 20 nt, Bordetella pertussis
cggccugcacggugggcagc

SEQ ID NO: 2423712 - RNA, 22 nt, Bordetella pertussis
cggccugcacggugggcagcag

SEQ ID NO: 2423713 - RNA, 22 nt, Bordetella pertussis
cggccugcagaccagcaccggc

SEQ ID NO: 2423714 - RNA, 12 nt, Bordetella pertussis
cggccugcaggc

SEQ ID NO: 2423715 - RNA, 15 nt, Bordetella pertussis
cggccugcaggccca

SEQ ID NO: 2423716 - RNA, 20 nt, Bordetella pertussis
cggccugcaggccguuccag

SEQ ID NO: 2423717 - RNA, 13 nt, Bordetella pertussis
cggccugcaggcu

SEQ ID NO: 2423718 - RNA, 16 nt, Bordetella pertussis
cggccugcaggugccg

SEQ ID NO: 2423719 - RNA, 19 nt, Bordetella pertussis
cggccugcaggugccgccg

SEQ ID NO: 2423720 - RNA, 12 nt, Bordetella pertussis
cggccugcaugu

SEQ ID NO: 2423721 - RNA, 20 nt, Bordetella pertussis
cggccugcaugucguacagg

SEQ ID NO: 2423722 - RNA, 16 nt, Bordetella pertussis
cggccugccaccagcg

SEQ ID NO: 2423723 - RNA, 21 nt, Bordetella pertussis
cggccugccaccagcgcgcca

SEQ ID NO: 2423724 - RNA, 13 nt, Bordetella pertussis
cggccugccagcc

SEQ ID NO: 2423725 - RNA, 16 nt, Bordetella pertussis
cggccugccagccugc

SEQ ID NO: 2423726 - RNA, 13 nt, Bordetella pertussis
cggccugcccggg

SEQ ID NO: 2423727 - RNA, 18 nt, Bordetella pertussis
cggccugcccgggcggga

SEQ ID NO: 2423728 - RNA, 21 nt, Bordetella pertussis
cggccugcccguucacgcgca

SEQ ID NO: 2423729 - RNA, 12 nt, Bordetella pertussis
cggccugccggc

SEQ ID NO: 2423730 - RNA, 13 nt, Bordetella pertussis
cggccugccggcg

SEQ ID NO: 2423731 - RNA, 15 nt, Bordetella pertussis
cggccugccggcgca

SEQ ID NO: 2423732 - RNA, 17 nt, Bordetella pertussis
cggccugccggcgcaca

SEQ ID NO: 2423733 - RNA, 15 nt, Bordetella pertussis
cggccugccggcgcg

SEQ ID NO: 2423734 - RNA, 17 nt, Bordetella pertussis
cggccugccggcgcgcc

SEQ ID NO: 2423735 - RNA, 19 nt, Bordetella pertussis
cggccugccggcgcgccuc

SEQ ID NO: 2423736 - RNA, 18 nt, Bordetella pertussis
cggccugcgccaccagcu

SEQ ID NO: 2423737 - RNA, 19 nt, Bordetella pertussis
cggccugcgccaccagcuu

SEQ ID NO: 2423738 - RNA, 14 nt, Bordetella pertussis
cggccugcgccagc

SEQ ID NO: 2423739 - RNA, 16 nt, Bordetella pertussis
cggccugcgccagcuc

SEQ ID NO: 2423740 - RNA, 14 nt, Bordetella pertussis
cggccugcgccggc

SEQ ID NO: 2423741 - RNA, 18 nt, Bordetella pertussis
cggccugcgccggcaugg

SEQ ID NO: 2423742 - RNA, 12 nt, Bordetella pertussis
cggccugcgcgc

SEQ ID NO: 2423743 - RNA, 14 nt, Bordetella pertussis
cggccugcgcgccg

SEQ ID NO: 2423744 - RNA, 15 nt, Bordetella pertussis
cggccugcgcgccga

SEQ ID NO: 2423745 - RNA, 15 nt, Bordetella pertussis
cggccugcgcgccgg

SEQ ID NO: 2423746 - RNA, 16 nt, Bordetella pertussis
cggccugcgcgucccg

SEQ ID NO: 2423747 - RNA, 13 nt, Bordetella pertussis
cggccugcgggcg

SEQ ID NO: 2423748 - RNA, 16 nt, Bordetella pertussis
cggccugcgggcgccg

SEQ ID NO: 2423749 - RNA, 22 nt, Bordetella pertussis
cggccugcgggcgccgcggggc

SEQ ID NO: 2423750 - RNA, 23 nt, Bordetella pertussis
cggccugcgggcgccgcggggcg

SEQ ID NO: 2423751 - RNA, 19 nt, Bordetella pertussis
cggccugcgucgccaccuc

SEQ ID NO: 2423752 - RNA, 20 nt, Bordetella pertussis
cggccugcgugucaggcgga

SEQ ID NO: 2423753 - RNA, 16 nt, Bordetella pertussis
cggccugcuccggcgu

SEQ ID NO: 2423754 - RNA, 20 nt, Bordetella pertussis
cggccugcucgcaggccugc

SEQ ID NO: 2423755 - RNA, 18 nt, Bordetella pertussis
cggccugcucgccggcca

SEQ ID NO: 2423756 - RNA, 23 nt, Bordetella pertussis
cggccugcucgccggccagcgcg

SEQ ID NO: 2423757 - RNA, 18 nt, Bordetella pertussis
cggccugcucgugcauca

SEQ ID NO: 2423758 - RNA, 21 nt, Bordetella pertussis
cggccugcuuggcagccuugg

SEQ ID NO: 2423759 - RNA, 17 nt, Bordetella pertussis
cggccuggaacauggcc

SEQ ID NO: 2423760 - RNA, 13 nt, Bordetella pertussis
cggccuggaccug

SEQ ID NO: 2423761 - RNA, 18 nt, Bordetella pertussis
cggccuggaccugagcca

SEQ ID NO: 2423762 - RNA, 20 nt, Bordetella pertussis
cggccuggaccugagccagg

SEQ ID NO: 2423763 - RNA, 15 nt, Bordetella pertussis
cggccuggaggccga

SEQ ID NO: 2423764 - RNA, 19 nt, Bordetella pertussis
cggccuggaggccgagcgc

SEQ ID NO: 2423765 - RNA, 21 nt, Bordetella pertussis
cggccuggaggccgagcgcga

SEQ ID NO: 2423766 - RNA, 12 nt, Bordetella pertussis
cggccuggcccc

SEQ ID NO: 2423767 - RNA, 16 nt, Bordetella pertussis
cggccuggccccaggc

SEQ ID NO: 2423768 - RNA, 19 nt, Bordetella pertussis
cggccuggccccaggcgcc

SEQ ID NO: 2423769 - RNA, 20 nt, Bordetella pertussis
cggccuggccccaggcgccc

SEQ ID NO: 2423770 - RNA, 17 nt, Bordetella pertussis
cggccuggccgcgcgcc

SEQ ID NO: 2423771 - RNA, 22 nt, Bordetella pertussis
cggccuggccgcgcgccugcuc

SEQ ID NO: 2423772 - RNA, 12 nt, Bordetella pertussis
cggccuggccgg

SEQ ID NO: 2423773 - RNA, 11 nt, Bordetella pertussis
cggccuggcgc

SEQ ID NO: 2423774 - RNA, 14 nt, Bordetella pertussis
cggccuggcgcgac

SEQ ID NO: 2423775 - RNA, 13 nt, Bordetella pertussis
cggccuggcgcgc

SEQ ID NO: 2423776 - RNA, 14 nt, Bordetella pertussis
cggccuggcgcgca

SEQ ID NO: 2423777 - RNA, 17 nt, Bordetella pertussis
cggccuggcgcgcaucg

SEQ ID NO: 2423778 - RNA, 14 nt, Bordetella pertussis
cggccuggcgcgcg

SEQ ID NO: 2423779 - RNA, 15 nt, Bordetella pertussis
cggccuggcgcgcgg

SEQ ID NO: 2423780 - RNA, 19 nt, Bordetella pertussis
cggccuggcgcgcggccug

SEQ ID NO: 2423781 - RNA, 20 nt, Bordetella pertussis
cggccuggcgcgcggccugg

SEQ ID NO: 2423782 - RNA, 21 nt, Bordetella pertussis
cggccuggcgcuccucgcgcg

SEQ ID NO: 2423783 - RNA, 14 nt, Bordetella pertussis
cggccuggcgggcc

SEQ ID NO: 2423784 - RNA, 15 nt, Bordetella pertussis
cggccuggcgggccg

SEQ ID NO: 2423785 - RNA, 19 nt, Bordetella pertussis
cggccuggcgggccgaggc

SEQ ID NO: 2423786 - RNA, 17 nt, Bordetella pertussis
cggccuggcgguaugcg

SEQ ID NO: 2423787 - RNA, 21 nt, Bordetella pertussis
cggccuggcgguaugcggcgc

SEQ ID NO: 2423788 - RNA, 15 nt, Bordetella pertussis
cggccugggaggcgc

SEQ ID NO: 2423789 - RNA, 17 nt, Bordetella pertussis
cggccugggaggcgcug

SEQ ID NO: 2423790 - RNA, 20 nt, Bordetella pertussis
cggccugggcgcgaugggcc

SEQ ID NO: 2423791 - RNA, 22 nt, Bordetella pertussis
cggccugggcgcgaugggccug

SEQ ID NO: 2423792 - RNA, 15 nt, Bordetella pertussis
cggccugggcggcgc

SEQ ID NO: 2423793 - RNA, 15 nt, Bordetella pertussis
cggccugggcgggcc

SEQ ID NO: 2423794 - RNA, 21 nt, Bordetella pertussis
cggccuggggacgggcgcaca

SEQ ID NO: 2423795 - RNA, 22 nt, Bordetella pertussis
cggccuggggacgggcgcacag

SEQ ID NO: 2423796 - RNA, 22 nt, Bordetella pertussis
cggccuggucaugacgggcggc

SEQ ID NO: 2423797 - RNA, 19 nt, Bordetella pertussis
cggccugguccgccgcgac

SEQ ID NO: 2423798 - RNA, 19 nt, Bordetella pertussis
cggccuguucgcggugucg

SEQ ID NO: 2423799 - RNA, 19 nt, Bordetella pertussis
cggccuucaccccgccacc

SEQ ID NO: 2423800 - RNA, 24 nt, Bordetella pertussis
cggccuucaugaucuggccgacca

SEQ ID NO: 2423801 - RNA, 21 nt, Bordetella pertussis
cggccuucauuuccugguuca

SEQ ID NO: 2423802 - RNA, 16 nt, Bordetella pertussis
cggccuuccggcauca

SEQ ID NO: 2423803 - RNA, 13 nt, Bordetella pertussis
cggccuucgccgg

SEQ ID NO: 2423804 - RNA, 20 nt, Bordetella pertussis
cggccuucggcggcgcgcug

SEQ ID NO: 2423805 - RNA, 21 nt, Bordetella pertussis
cggccuucggcggcgcgcugg

SEQ ID NO: 2423806 - RNA, 15 nt, Bordetella pertussis
cggccuucugcgcca

SEQ ID NO: 2423807 - RNA, 18 nt, Bordetella pertussis
cggccuucugcgccagcg

SEQ ID NO: 2423808 - RNA, 22 nt, Bordetella pertussis
cggccuugagcaucugcggcac

SEQ ID NO: 2423809 - RNA, 24 nt, Bordetella pertussis
cggccuugagcaucugcggcacga

SEQ ID NO: 2423810 - RNA, 14 nt, Bordetella pertussis
cggccuugccggcc

SEQ ID NO: 2423811 - RNA, 15 nt, Bordetella pertussis
cggccuugccggcca

SEQ ID NO: 2423812 - RNA, 15 nt, Bordetella pertussis
cggccuugccggugg

SEQ ID NO: 2423813 - RNA, 22 nt, Bordetella pertussis
cggccuugccgguggacggcca

SEQ ID NO: 2423814 - RNA, 21 nt, Bordetella pertussis
cggccuuggccauguccuggc

SEQ ID NO: 2423815 - RNA, 21 nt, Bordetella pertussis
cggccuuggccgcagccggcu

SEQ ID NO: 2423816 - RNA, 22 nt, Bordetella pertussis
cggccuuggccgcagccggcug

SEQ ID NO: 2423817 - RNA, 13 nt, Bordetella pertussis
cggccuugggcgc

SEQ ID NO: 2423818 - RNA, 17 nt, Bordetella pertussis
cggccuugggcgcggcg

SEQ ID NO: 2423819 - RNA, 18 nt, Bordetella pertussis
cggccuugggcgcggcgg

SEQ ID NO: 2423820 - RNA, 19 nt, Bordetella pertussis
cggccuugggcgcggcggc

SEQ ID NO: 2423821 - RNA, 23 nt, Bordetella pertussis
cggccuugggcgcggcggccugg

SEQ ID NO: 2423822 - RNA, 14 nt, Bordetella pertussis
cggccuugucgcgc

SEQ ID NO: 2423823 - RNA, 15 nt, Bordetella pertussis
cggccuugucgcgcc

SEQ ID NO: 2423824 - RNA, 17 nt, Bordetella pertussis
cggccuugucgcgcccg

SEQ ID NO: 2423825 - RNA, 18 nt, Bordetella pertussis
cggccuugucgcgcccga

SEQ ID NO: 2423826 - RNA, 14 nt, Bordetella pertussis
cggccuuugcgcgc

SEQ ID NO: 2423827 - RNA, 22 nt, Bordetella pertussis
cggccuuuuuuugcggcacggc

SEQ ID NO: 2423828 - RNA, 15 nt, Bordetella pertussis
cggcgaaagcgucgg

SEQ ID NO: 2423829 - RNA, 19 nt, Bordetella pertussis
cggcgaacacgucgcgggc

SEQ ID NO: 2423830 - RNA, 14 nt, Bordetella pertussis
cggcgaacagcgcg

SEQ ID NO: 2423831 - RNA, 14 nt, Bordetella pertussis
cggcgaagccgcag

SEQ ID NO: 2423832 - RNA, 15 nt, Bordetella pertussis
cggcgaagccgcagc

SEQ ID NO: 2423833 - RNA, 18 nt, Bordetella pertussis
cggcgaagccgcagcggc

SEQ ID NO: 2423834 - RNA, 22 nt, Bordetella pertussis
cggcgaagccgcagcggcagcg

SEQ ID NO: 2423835 - RNA, 24 nt, Bordetella pertussis
cggcgaagccuugcgcggccagca

SEQ ID NO: 2423836 - RNA, 16 nt, Bordetella pertussis
cggcgaaggcgcggcu

SEQ ID NO: 2423837 - RNA, 18 nt, Bordetella pertussis
cggcgaaggucuggucgc

SEQ ID NO: 2423838 - RNA, 19 nt, Bordetella pertussis
cggcgaaguccugcaugcc

SEQ ID NO: 2423839 - RNA, 15 nt, Bordetella pertussis
cggcgaagugcccgc

SEQ ID NO: 2423840 - RNA, 23 nt, Bordetella pertussis
cggcgaagugcccgcuggccaug

SEQ ID NO: 2423841 - RNA, 13 nt, Bordetella pertussis
cggcgaaugccgg

SEQ ID NO: 2423842 - RNA, 14 nt, Bordetella pertussis
cggcgaaugccggc

SEQ ID NO: 2423843 - RNA, 22 nt, Bordetella pertussis
cggcgacacccccagggcgcgc

SEQ ID NO: 2423844 - RNA, 16 nt, Bordetella pertussis
cggcgacaccgcggcc

SEQ ID NO: 2423845 - RNA, 13 nt, Bordetella pertussis
cggcgacagcgau

SEQ ID NO: 2423846 - RNA, 16 nt, Bordetella pertussis
cggcgacagggcgucg

SEQ ID NO: 2423847 - RNA, 23 nt, Bordetella pertussis
cggcgacauagaucuccggcgcc

SEQ ID NO: 2423848 - RNA, 13 nt, Bordetella pertussis
cggcgaccaggcc

SEQ ID NO: 2423849 - RNA, 15 nt, Bordetella pertussis
cggcgaccaggccca

SEQ ID NO: 2423850 - RNA, 17 nt, Bordetella pertussis
cggcgaccaggcccaug

SEQ ID NO: 2423851 - RNA, 19 nt, Bordetella pertussis
cggcgaccaggcccauggc

SEQ ID NO: 2423852 - RNA, 18 nt, Bordetella pertussis
cggcgaccaggugcgggc

SEQ ID NO: 2423853 - RNA, 16 nt, Bordetella pertussis
cggcgaccgacggcau

SEQ ID NO: 2423854 - RNA, 13 nt, Bordetella pertussis
cggcgaccgccgg

SEQ ID NO: 2423855 - RNA, 14 nt, Bordetella pertussis
cggcgaccggcgcc

SEQ ID NO: 2423856 - RNA, 15 nt, Bordetella pertussis
cggcgaccggcgccg

SEQ ID NO: 2423857 - RNA, 17 nt, Bordetella pertussis
cggcgaccggcgccggc

SEQ ID NO: 2423858 - RNA, 19 nt, Bordetella pertussis
cggcgaccggcgccggcuc

SEQ ID NO: 2423859 - RNA, 20 nt, Bordetella pertussis
cggcgaccggcgccggcucc

SEQ ID NO: 2423860 - RNA, 18 nt, Bordetella pertussis
cggcgacgaacccgggcg

SEQ ID NO: 2423861 - RNA, 19 nt, Bordetella pertussis
cggcgacgaacccgggcgu

SEQ ID NO: 2423862 - RNA, 20 nt, Bordetella pertussis
cggcgacgacuacgcgcugg

SEQ ID NO: 2423863 - RNA, 18 nt, Bordetella pertussis
cggcgacgaucccgacga

SEQ ID NO: 2423864 - RNA, 18 nt, Bordetella pertussis
cggcgacgaugccgcaga

SEQ ID NO: 2423865 - RNA, 16 nt, Bordetella pertussis
cggcgacgcagcacgg

SEQ ID NO: 2423866 - RNA, 17 nt, Bordetella pertussis
cggcgacgcagcacggc

SEQ ID NO: 2423867 - RNA, 18 nt, Bordetella pertussis
cggcgacgccgcggugcu

SEQ ID NO: 2423868 - RNA, 12 nt, Bordetella pertussis
cggcgacggcau

SEQ ID NO: 2423869 - RNA, 14 nt, Bordetella pertussis
cggcgacggcgccu

SEQ ID NO: 2423870 - RNA, 16 nt, Bordetella pertussis
cggcgacggcgccugg

SEQ ID NO: 2423871 - RNA, 14 nt, Bordetella pertussis
cggcgacggcgucg

SEQ ID NO: 2423872 - RNA, 15 nt, Bordetella pertussis
cggcgacggcgucgg

SEQ ID NO: 2423873 - RNA, 15 nt, Bordetella pertussis
cggcgacguggcgcu

SEQ ID NO: 2423874 - RNA, 17 nt, Bordetella pertussis
cggcgacguuggcgaau

SEQ ID NO: 2423875 - RNA, 15 nt, Bordetella pertussis
cggcgacucggcauc

SEQ ID NO: 2423876 - RNA, 15 nt, Bordetella pertussis
cggcgcagcgcacga

SEQ ID NO: 2423877 - RNA, 16 nt, Bordetella pertussis
cggcgcagcgcacgau

SEQ ID NO: 2423878 - RNA, 18 nt, Bordetella pertussis
cggcgcaggaugcgcugg

SEQ ID NO: 2423879 - RNA, 20 nt, Bordetella pertussis
cggcgcaggaugcgcuggcc

SEQ ID NO: 2423880 - RNA, 13 nt, Bordetella pertussis
cggcgcaggccag

SEQ ID NO: 2423881 - RNA, 14 nt, Bordetella pertussis
cggcgcaggccagc

SEQ ID NO: 2423882 - RNA, 15 nt, Bordetella pertussis
cggcgcaggccagcg

SEQ ID NO: 2423883 - RNA, 16 nt, Bordetella pertussis
cggcgcaggccagcgc

SEQ ID NO: 2423884 - RNA, 18 nt, Bordetella pertussis
cggcgcaggccagcgccg

SEQ ID NO: 2423885 - RNA, 19 nt, Bordetella pertussis
cggcgcaggccagcgccgc

SEQ ID NO: 2423886 - RNA, 15 nt, Bordetella pertussis
cggcgcaggccgcgc

SEQ ID NO: 2423887 - RNA, 18 nt, Bordetella pertussis
cggcgcaggccgcgccgg

SEQ ID NO: 2423888 - RNA, 19 nt, Bordetella pertussis
cggcgcaggccgcgccggc

SEQ ID NO: 2423889 - RNA, 14 nt, Bordetella pertussis
cggcgcaggccugc

SEQ ID NO: 2423890 - RNA, 17 nt, Bordetella pertussis
cggcgcaggccugcggc

SEQ ID NO: 2423891 - RNA, 17 nt, Bordetella pertussis
cggcgcaggcgggcgau

SEQ ID NO: 2423892 - RNA, 19 nt, Bordetella pertussis
cggcgcagguccaccgcca

SEQ ID NO: 2423893 - RNA, 16 nt, Bordetella pertussis
cggcgcagucgcgcac

SEQ ID NO: 2423894 - RNA, 15 nt, Bordetella pertussis
cggcgcaguuccggc

SEQ ID NO: 2423895 - RNA, 20 nt, Bordetella pertussis
cggcgcaguuccggcgggcc

SEQ ID NO: 2423896 - RNA, 15 nt, Bordetella pertussis
cggcgcaucagcgcg

SEQ ID NO: 2423897 - RNA, 18 nt, Bordetella pertussis
cggcgcaucagcgcgccc

SEQ ID NO: 2423898 - RNA, 19 nt, Bordetella pertussis
cggcgcaucagcgcgcccg

SEQ ID NO: 2423899 - RNA, 21 nt, Bordetella pertussis
cggcgcaucagcgcgcccgcu

SEQ ID NO: 2423900 - RNA, 22 nt, Bordetella pertussis
cggcgcaucccagacagccacg

SEQ ID NO: 2423901 - RNA, 14 nt, Bordetella pertussis
cggcgcaucggcgc

SEQ ID NO: 2423902 - RNA, 16 nt, Bordetella pertussis
cggcgcaucggcgcca

SEQ ID NO: 2423903 - RNA, 17 nt, Bordetella pertussis
cggcgcaucggcgccag

SEQ ID NO: 2423904 - RNA, 18 nt, Bordetella pertussis
cggcgcaucggcgccagu

SEQ ID NO: 2423905 - RNA, 24 nt, Bordetella pertussis
cggcgcaugagccggcagaucggc

SEQ ID NO: 2423906 - RNA, 15 nt, Bordetella pertussis
cggcgcaugauggcc

SEQ ID NO: 2423907 - RNA, 17 nt, Bordetella pertussis
cggcgcaugauggccgg

SEQ ID NO: 2423908 - RNA, 20 nt, Bordetella pertussis
cggcgcaugauggccggccu

SEQ ID NO: 2423909 - RNA, 17 nt, Bordetella pertussis
cggcgcaugcagccgca

SEQ ID NO: 2423910 - RNA, 13 nt, Bordetella pertussis
cggcgcaugcugc

SEQ ID NO: 2423911 - RNA, 15 nt, Bordetella pertussis
cggcgcaugcugcgc

SEQ ID NO: 2423912 - RNA, 23 nt, Bordetella pertussis
cggcgcauugccgucggccgcgc

SEQ ID NO: 2423913 - RNA, 23 nt, Bordetella pertussis
cggcgccaaagcacaggauggcg

SEQ ID NO: 2423914 - RNA, 17 nt, Bordetella pertussis
cggcgccaagcggcagg

SEQ ID NO: 2423915 - RNA, 20 nt, Bordetella pertussis
cggcgccaagcggcaggcgg

SEQ ID NO: 2423916 - RNA, 22 nt, Bordetella pertussis
cggcgccaagcggcaggcggca

SEQ ID NO: 2423917 - RNA, 12 nt, Bordetella pertussis
cggcgccacccc

SEQ ID NO: 2423918 - RNA, 22 nt, Bordetella pertussis
cggcgccacgcagaaggcgaac

SEQ ID NO: 2423919 - RNA, 17 nt, Bordetella pertussis
cggcgccacugccaggc

SEQ ID NO: 2423920 - RNA, 18 nt, Bordetella pertussis
cggcgccacugccaggcg

SEQ ID NO: 2423921 - RNA, 19 nt, Bordetella pertussis
cggcgccacugccaggcgc

SEQ ID NO: 2423922 - RNA, 20 nt, Bordetella pertussis
cggcgccacugccaggcgcc

SEQ ID NO: 2423923 - RNA, 21 nt, Bordetella pertussis
cggcgccacugccaggcgccc

SEQ ID NO: 2423924 - RNA, 14 nt, Bordetella pertussis
cggcgccagcaugc

SEQ ID NO: 2423925 - RNA, 17 nt, Bordetella pertussis
cggcgccagcaugcgcg

SEQ ID NO: 2423926 - RNA, 12 nt, Bordetella pertussis
cggcgccagcca

SEQ ID NO: 2423927 - RNA, 14 nt, Bordetella pertussis
cggcgccagccaga

SEQ ID NO: 2423928 - RNA, 15 nt, Bordetella pertussis
cggcgccagccagau

SEQ ID NO: 2423929 - RNA, 13 nt, Bordetella pertussis
cggcgccagccgc

SEQ ID NO: 2423930 - RNA, 14 nt, Bordetella pertussis
cggcgccagccgcu

SEQ ID NO: 2423931 - RNA, 15 nt, Bordetella pertussis
cggcgccagccgcuc

SEQ ID NO: 2423932 - RNA, 18 nt, Bordetella pertussis
cggcgccagccgcuccag

SEQ ID NO: 2423933 - RNA, 14 nt, Bordetella pertussis
cggcgccagcgccc

SEQ ID NO: 2423934 - RNA, 16 nt, Bordetella pertussis
cggcgccagcgccccg

SEQ ID NO: 2423935 - RNA, 18 nt, Bordetella pertussis
cggcgccagcgccccggc

SEQ ID NO: 2423936 - RNA, 15 nt, Bordetella pertussis
cggcgccagcgccgc

SEQ ID NO: 2423937 - RNA, 18 nt, Bordetella pertussis
cggcgccagcgccgcguc

SEQ ID NO: 2423938 - RNA, 13 nt, Bordetella pertussis
cggcgccagcgcu

SEQ ID NO: 2423939 - RNA, 14 nt, Bordetella pertussis
cggcgccagcgcuu

SEQ ID NO: 2423940 - RNA, 13 nt, Bordetella pertussis
cggcgccagcugg

SEQ ID NO: 2423941 - RNA, 14 nt, Bordetella pertussis
cggcgccagcuggg

SEQ ID NO: 2423942 - RNA, 15 nt, Bordetella pertussis
cggcgccaguagcgc

SEQ ID NO: 2423943 - RNA, 20 nt, Bordetella pertussis
cggcgccaguagcgccggcu

SEQ ID NO: 2423944 - RNA, 16 nt, Bordetella pertussis
cggcgccagucgcgca

SEQ ID NO: 2423945 - RNA, 17 nt, Bordetella pertussis
cggcgccagucgcgcag

SEQ ID NO: 2423946 - RNA, 18 nt, Bordetella pertussis
cggcgccaugaucgccgg

SEQ ID NO: 2423947 - RNA, 20 nt, Bordetella pertussis
cggcgccaugaucgccggca

SEQ ID NO: 2423948 - RNA, 22 nt, Bordetella pertussis
cggcgccaugaucgccggcaac

SEQ ID NO: 2423949 - RNA, 14 nt, Bordetella pertussis
cggcgccaugccgc

SEQ ID NO: 2423950 - RNA, 16 nt, Bordetella pertussis
cggcgccaugccgcgc

SEQ ID NO: 2423951 - RNA, 19 nt, Bordetella pertussis
cggcgccaugccgcgcccg

SEQ ID NO: 2423952 - RNA, 14 nt, Bordetella pertussis
cggcgccaugcgca

SEQ ID NO: 2423953 - RNA, 15 nt, Bordetella pertussis
cggcgccaugcgcac

SEQ ID NO: 2423954 - RNA, 23 nt, Bordetella pertussis
cggcgccaugcgcaccaccgccg

SEQ ID NO: 2423955 - RNA, 19 nt, Bordetella pertussis
cggcgccaugcuggccgcc

SEQ ID NO: 2423956 - RNA, 23 nt, Bordetella pertussis
cggcgccaugcuggccgccgcgc

SEQ ID NO: 2423957 - RNA, 15 nt, Bordetella pertussis
cggcgcccacgccga

SEQ ID NO: 2423958 - RNA, 12 nt, Bordetella pertussis
cggcgcccagcu

SEQ ID NO: 2423959 - RNA, 18 nt, Bordetella pertussis
cggcgcccagcuggcgcc

SEQ ID NO: 2423960 - RNA, 11 nt, Bordetella pertussis
cggcgcccagg

SEQ ID NO: 2423961 - RNA, 12 nt, Bordetella pertussis
cggcgcccaggc

SEQ ID NO: 2423962 - RNA, 15 nt, Bordetella pertussis
cggcgcccaggccca

SEQ ID NO: 2423963 - RNA, 17 nt, Bordetella pertussis
cggcgcccaggcccagc

SEQ ID NO: 2423964 - RNA, 20 nt, Bordetella pertussis
cggcgcccaggcccagcgcg

SEQ ID NO: 2423965 - RNA, 23 nt, Bordetella pertussis
cggcgcccauuccgagcgggccc

SEQ ID NO: 2423966 - RNA, 16 nt, Bordetella pertussis
cggcgcccccagcagc

SEQ ID NO: 2423967 - RNA, 17 nt, Bordetella pertussis
cggcgcccccagcagcg

SEQ ID NO: 2423968 - RNA, 18 nt, Bordetella pertussis
cggcgcccccagcagcga

SEQ ID NO: 2423969 - RNA, 17 nt, Bordetella pertussis
cggcgcccccgcggcgc

SEQ ID NO: 2423970 - RNA, 19 nt, Bordetella pertussis
cggcgcccccgcggcgccc

SEQ ID NO: 2423971 - RNA, 14 nt, Bordetella pertussis
cggcgcccgaggcc

SEQ ID NO: 2423972 - RNA, 10 nt, Bordetella pertussis
cggcgcccgc

SEQ ID NO: 2423973 - RNA, 21 nt, Bordetella pertussis
cggcgcccgcauggaccgccg

SEQ ID NO: 2423974 - RNA, 12 nt, Bordetella pertussis
cggcgcccgccg

SEQ ID NO: 2423975 - RNA, 16 nt, Bordetella pertussis
cggcgcccgccgccgg

SEQ ID NO: 2423976 - RNA, 17 nt, Bordetella pertussis
cggcgcccgccgccggg

SEQ ID NO: 2423977 - RNA, 18 nt, Bordetella pertussis
cggcgcccgccgccgggc

SEQ ID NO: 2423978 - RNA, 21 nt, Bordetella pertussis
cggcgcccgccgccgggcgcg

SEQ ID NO: 2423979 - RNA, 14 nt, Bordetella pertussis
cggcgcccgccugc

SEQ ID NO: 2423980 - RNA, 16 nt, Bordetella pertussis
cggcgcccgccugcgu

SEQ ID NO: 2423981 - RNA, 13 nt, Bordetella pertussis
cggcgcccgcgca

SEQ ID NO: 2423982 - RNA, 17 nt, Bordetella pertussis
cggcgcccgcgcaugca

SEQ ID NO: 2423983 - RNA, 14 nt, Bordetella pertussis
cggcgcccgcggcc

SEQ ID NO: 2423984 - RNA, 14 nt, Bordetella pertussis
cggcgcccgcugcg

SEQ ID NO: 2423985 - RNA, 14 nt, Bordetella pertussis
cggcgcccggcagc

SEQ ID NO: 2423986 - RNA, 15 nt, Bordetella pertussis
cggcgcccggcagcc

SEQ ID NO: 2423987 - RNA, 14 nt, Bordetella pertussis
cggcgcccggcgcc

SEQ ID NO: 2423988 - RNA, 18 nt, Bordetella pertussis
cggcgcccggcgccgcgc

SEQ ID NO: 2423989 - RNA, 20 nt, Bordetella pertussis
cggcgcccggcgccgcgcgc

SEQ ID NO: 2423990 - RNA, 13 nt, Bordetella pertussis
cggcgcgacgcgc

SEQ ID NO: 2423991 - RNA, 14 nt, Bordetella pertussis
cggcgcgacgcgcu

SEQ ID NO: 2423992 - RNA, 15 nt, Bordetella pertussis
cggcgcgacgcgcuu

SEQ ID NO: 2423993 - RNA, 23 nt, Bordetella pertussis
cggcgcgagcgcacaggcggcgc

SEQ ID NO: 2423994 - RNA, 19 nt, Bordetella pertussis
cggcgcgauggucaccacc

SEQ ID NO: 2423995 - RNA, 14 nt, Bordetella pertussis
cggcgcgcacgcuc

SEQ ID NO: 2423996 - RNA, 18 nt, Bordetella pertussis
cggcgcgcacgggcgagg

SEQ ID NO: 2423997 - RNA, 18 nt, Bordetella pertussis
cggcgcgcagcagacgcu

SEQ ID NO: 2423998 - RNA, 14 nt, Bordetella pertussis
cggcgcgcagcgcc

SEQ ID NO: 2423999 - RNA, 17 nt, Bordetella pertussis
cggcgcgcagcgccugc

SEQ ID NO: 2424000 - RNA, 14 nt, Bordetella pertussis
cggcgcgcaggcag

SEQ ID NO: 2424001 - RNA, 21 nt, Bordetella pertussis
cggcgcgcaucgucaggcagg

SEQ ID NO: 2424002 - RNA, 14 nt, Bordetella pertussis
cggcgcgccacccu

SEQ ID NO: 2424003 - RNA, 17 nt, Bordetella pertussis
cggcgcgccagcgcggc

SEQ ID NO: 2424004 - RNA, 18 nt, Bordetella pertussis
cggcgcgccagcgcggcc

SEQ ID NO: 2424005 - RNA, 19 nt, Bordetella pertussis
cggcgcgccagcgcggcca

SEQ ID NO: 2424006 - RNA, 21 nt, Bordetella pertussis
cggcgcgccagcgcggccagc

SEQ ID NO: 2424007 - RNA, 23 nt, Bordetella pertussis
cggcgcgccauggucucccccuc

SEQ ID NO: 2424008 - RNA, 17 nt, Bordetella pertussis
cggcgcgcccaccaggg

SEQ ID NO: 2424009 - RNA, 13 nt, Bordetella pertussis
cggcgcgcccagg

SEQ ID NO: 2424010 - RNA, 14 nt, Bordetella pertussis
cggcgcgcccaggg

SEQ ID NO: 2424011 - RNA, 22 nt, Bordetella pertussis
cggcgcgcccgcaggcggcggc

SEQ ID NO: 2424012 - RNA, 16 nt, Bordetella pertussis
cggcgcgcccgccacg

SEQ ID NO: 2424013 - RNA, 14 nt, Bordetella pertussis
cggcgcgcccgccg

SEQ ID NO: 2424014 - RNA, 21 nt, Bordetella pertussis
cggcgcgcccgccgcgucggc

SEQ ID NO: 2424015 - RNA, 20 nt, Bordetella pertussis
cggcgcgcccgccuucggcg

SEQ ID NO: 2424016 - RNA, 21 nt, Bordetella pertussis
cggcgcgcccgccuucggcgg

SEQ ID NO: 2424017 - RNA, 23 nt, Bordetella pertussis
cggcgcgcccgccuucggcggcg

SEQ ID NO: 2424018 - RNA, 11 nt, Bordetella pertussis
cggcgcgccgc

SEQ ID NO: 2424019 - RNA, 13 nt, Bordetella pertussis
cggcgcgccgccc

SEQ ID NO: 2424020 - RNA, 15 nt, Bordetella pertussis
cggcgcgccgcccgc

SEQ ID NO: 2424021 - RNA, 16 nt, Bordetella pertussis
cggcgcgccgcgccgc

SEQ ID NO: 2424022 - RNA, 15 nt, Bordetella pertussis
cggcgcgccggccca

SEQ ID NO: 2424023 - RNA, 20 nt, Bordetella pertussis
cggcgcgccggcccaaggcc

SEQ ID NO: 2424024 - RNA, 14 nt, Bordetella pertussis
cggcgcgccggccg

SEQ ID NO: 2424025 - RNA, 15 nt, Bordetella pertussis
cggcgcgccggccgc

SEQ ID NO: 2424026 - RNA, 21 nt, Bordetella pertussis
cggcgcgccggccgcggggcu

SEQ ID NO: 2424027 - RNA, 18 nt, Bordetella pertussis
cggcgcgccggccugcgc

SEQ ID NO: 2424028 - RNA, 12 nt, Bordetella pertussis
cggcgcgccggg

SEQ ID NO: 2424029 - RNA, 19 nt, Bordetella pertussis
cggcgcgccgggccagacc

SEQ ID NO: 2424030 - RNA, 17 nt, Bordetella pertussis
cggcgcgccguccgggc

SEQ ID NO: 2424031 - RNA, 20 nt, Bordetella pertussis
cggcgcgccguccgggccgg

SEQ ID NO: 2424032 - RNA, 23 nt, Bordetella pertussis
cggcgcgccucggcgcgcgcggc

SEQ ID NO: 2424033 - RNA, 13 nt, Bordetella pertussis
cggcgcgccuuac

SEQ ID NO: 2424034 - RNA, 19 nt, Bordetella pertussis
cggcgcgccuuacgcggcg

SEQ ID NO: 2424035 - RNA, 19 nt, Bordetella pertussis
cggcgcgccuucggcaggc

SEQ ID NO: 2424036 - RNA, 21 nt, Bordetella pertussis
cggcgcgccuucggcaggcgc

SEQ ID NO: 2424037 - RNA, 22 nt, Bordetella pertussis
cggcgcgccuucggcaggcgcc

SEQ ID NO: 2424038 - RNA, 23 nt, Bordetella pertussis
cggcgcgccuucggcaggcgccg

SEQ ID NO: 2424039 - RNA, 14 nt, Bordetella pertussis
cggcgcgcgaucuc

SEQ ID NO: 2424040 - RNA, 19 nt, Bordetella pertussis
cggcgcgcgaucucgggca

SEQ ID NO: 2424041 - RNA, 11 nt, Bordetella pertussis
cggcgcgcgca

SEQ ID NO: 2424042 - RNA, 12 nt, Bordetella pertussis
cggcgcgcgcag

SEQ ID NO: 2424043 - RNA, 11 nt, Bordetella pertussis
cggcgcgcgcc

SEQ ID NO: 2424044 - RNA, 19 nt, Bordetella pertussis
cggcgcgcgccaggcccag

SEQ ID NO: 2424045 - RNA, 22 nt, Bordetella pertussis
cggcgcgcgccgcgccggggcg

SEQ ID NO: 2424046 - RNA, 14 nt, Bordetella pertussis
cggcgcgcgccggc

SEQ ID NO: 2424047 - RNA, 15 nt, Bordetella pertussis
cggcgcgcgccggcu

SEQ ID NO: 2424048 - RNA, 16 nt, Bordetella pertussis
cggcgcgcgccggcuc

SEQ ID NO: 2424049 - RNA, 17 nt, Bordetella pertussis
cggcgcgcgccggcucg

SEQ ID NO: 2424050 - RNA, 13 nt, Bordetella pertussis
cggcgcgcgccgu

SEQ ID NO: 2424051 - RNA, 12 nt, Bordetella pertussis
cggcgcgcgccu

SEQ ID NO: 2424052 - RNA, 15 nt, Bordetella pertussis
cggcgcgcgccugcu

SEQ ID NO: 2424053 - RNA, 15 nt, Bordetella pertussis
cggcgcgcgcgacca

SEQ ID NO: 2424054 - RNA, 15 nt, Bordetella pertussis
cggcgcgcgcgccgc

SEQ ID NO: 2424055 - RNA, 13 nt, Bordetella pertussis
cggcgcgcgcgcg

SEQ ID NO: 2424056 - RNA, 14 nt, Bordetella pertussis
cggcgcgcgcgcgc

SEQ ID NO: 2424057 - RNA, 21 nt, Bordetella pertussis
cggcgcgcgcggccaguucga

SEQ ID NO: 2424058 - RNA, 15 nt, Bordetella pertussis
cggcgcgcgcggcgc

SEQ ID NO: 2424059 - RNA, 17 nt, Bordetella pertussis
cggcgcgcgcggcgccg

SEQ ID NO: 2424060 - RNA, 19 nt, Bordetella pertussis
cggcgcgcgcggucggugc

SEQ ID NO: 2424061 - RNA, 20 nt, Bordetella pertussis
cggcgcgcgcguacagccgg

SEQ ID NO: 2424062 - RNA, 15 nt, Bordetella pertussis
cggcgcgcgcguucg

SEQ ID NO: 2424063 - RNA, 11 nt, Bordetella pertussis
cggcgcgcgcu

SEQ ID NO: 2424064 - RNA, 17 nt, Bordetella pertussis
cggcgcgcgcugauucg

SEQ ID NO: 2424065 - RNA, 14 nt, Bordetella pertussis
cggcgcgcggaucg

SEQ ID NO: 2424066 - RNA, 16 nt, Bordetella pertussis
cggcgcgcggccgugu

SEQ ID NO: 2424067 - RNA, 23 nt, Bordetella pertussis
cggcgcgcggccguguucgagca

SEQ ID NO: 2424068 - RNA, 14 nt, Bordetella pertussis
cggcgcgcgguggc

SEQ ID NO: 2424069 - RNA, 17 nt, Bordetella pertussis
cggcgcgcgugccgcgc

SEQ ID NO: 2424070 - RNA, 20 nt, Bordetella pertussis
cggcgcgcgugccgcgcagu

SEQ ID NO: 2424071 - RNA, 16 nt, Bordetella pertussis
cggcgcgcucggcgcc

SEQ ID NO: 2424072 - RNA, 17 nt, Bordetella pertussis
cggcgcgcucggcgccg

SEQ ID NO: 2424073 - RNA, 16 nt, Bordetella pertussis
cggcgcgcucuccgaa

SEQ ID NO: 2424074 - RNA, 15 nt, Bordetella pertussis
cggcgcgcuggacgu

SEQ ID NO: 2424075 - RNA, 12 nt, Bordetella pertussis
cggcgcggaucg

SEQ ID NO: 2424076 - RNA, 13 nt, Bordetella pertussis
cggcgcggaucga

SEQ ID NO: 2424077 - RNA, 21 nt, Bordetella pertussis
cggcgcggaucgugcgccacu

SEQ ID NO: 2424078 - RNA, 19 nt, Bordetella pertussis
cggcgcggaugccguccac

SEQ ID NO: 2424079 - RNA, 23 nt, Bordetella pertussis
cggcgcggccagcagcgcgugca

SEQ ID NO: 2424080 - RNA, 13 nt, Bordetella pertussis
cggcgcggcccgc

SEQ ID NO: 2424081 - RNA, 14 nt, Bordetella pertussis
cggcgcggcccgcc

SEQ ID NO: 2424082 - RNA, 15 nt, Bordetella pertussis
cggcgcggcccgcca

SEQ ID NO: 2424083 - RNA, 17 nt, Bordetella pertussis
cggcgcggcccgccacg

SEQ ID NO: 2424084 - RNA, 21 nt, Bordetella pertussis
cggcgcggcccgccacgcagg

SEQ ID NO: 2424085 - RNA, 13 nt, Bordetella pertussis
cggcgcggccggg

SEQ ID NO: 2424086 - RNA, 11 nt, Bordetella pertussis
cggcgcggccu

SEQ ID NO: 2424087 - RNA, 14 nt, Bordetella pertussis
cggcgcggccuucc

SEQ ID NO: 2424088 - RNA, 23 nt, Bordetella pertussis
cggcgcggcgagcacggccugcu

SEQ ID NO: 2424089 - RNA, 17 nt, Bordetella pertussis
cggcgcggcgaucggcc

SEQ ID NO: 2424090 - RNA, 23 nt, Bordetella pertussis
cggcgcggcgaucggcccgggcg

SEQ ID NO: 2424091 - RNA, 22 nt, Bordetella pertussis
cggcgcggcgauugcggcccgc

SEQ ID NO: 2424092 - RNA, 18 nt, Bordetella pertussis
cggcgcggcgcaggccug

SEQ ID NO: 2424093 - RNA, 12 nt, Bordetella pertussis
cggcgcggcgcc

SEQ ID NO: 2424094 - RNA, 13 nt, Bordetella pertussis
cggcgcggcgcca

SEQ ID NO: 2424095 - RNA, 15 nt, Bordetella pertussis
cggcgcggcgccagc

SEQ ID NO: 2424096 - RNA, 20 nt, Bordetella pertussis
cggcgcggcgccagcgcccc

SEQ ID NO: 2424097 - RNA, 15 nt, Bordetella pertussis
cggcgcggcgcgcgc

SEQ ID NO: 2424098 - RNA, 14 nt, Bordetella pertussis
cggcgcggcgcgcu

SEQ ID NO: 2424099 - RNA, 14 nt, Bordetella pertussis
cggcgcggcgcugg

SEQ ID NO: 2424100 - RNA, 18 nt, Bordetella pertussis
cggcgcggcgggcgcugg

SEQ ID NO: 2424101 - RNA, 14 nt, Bordetella pertussis
cggcgcggcgggcu

SEQ ID NO: 2424102 - RNA, 14 nt, Bordetella pertussis
cggcgcggcugccc

SEQ ID NO: 2424103 - RNA, 21 nt, Bordetella pertussis
cggcgcggcugcugggcaugg

SEQ ID NO: 2424104 - RNA, 22 nt, Bordetella pertussis
cggcggacuggccgcgccgcug

SEQ ID NO: 2424105 - RNA, 15 nt, Bordetella pertussis
cggcggaucacccag

SEQ ID NO: 2424106 - RNA, 20 nt, Bordetella pertussis
cggcggaucacccagcggcu

SEQ ID NO: 2424107 - RNA, 22 nt, Bordetella pertussis
cggcggaucacccagcggcugg

SEQ ID NO: 2424108 - RNA, 14 nt, Bordetella pertussis
cggcggaucgaacg

SEQ ID NO: 2424109 - RNA, 16 nt, Bordetella pertussis
cggcggaucggcgugg

SEQ ID NO: 2424110 - RNA, 17 nt, Bordetella pertussis
cggcggaucggcguggu

SEQ ID NO: 2424111 - RNA, 13 nt, Bordetella pertussis
cggcggaugcgaa

SEQ ID NO: 2424112 - RNA, 14 nt, Bordetella pertussis
cggcggcaagcagc

SEQ ID NO: 2424113 - RNA, 18 nt, Bordetella pertussis
cggcggcaagcagccgga

SEQ ID NO: 2424114 - RNA, 21 nt, Bordetella pertussis
cggcggcaauaucggcacccg

SEQ ID NO: 2424115 - RNA, 15 nt, Bordetella pertussis
cggcggcaccagcag

SEQ ID NO: 2424116 - RNA, 17 nt, Bordetella pertussis
cggcggcaccagcaggc

SEQ ID NO: 2424117 - RNA, 19 nt, Bordetella pertussis
cggcggcaccagcaggccg

SEQ ID NO: 2424118 - RNA, 21 nt, Bordetella pertussis
cggcggcaccagcaggccggu

SEQ ID NO: 2424119 - RNA, 19 nt, Bordetella pertussis
cggcggcaccauugccggc

SEQ ID NO: 2424120 - RNA, 21 nt, Bordetella pertussis
cggcggcaccauugccggcgc

SEQ ID NO: 2424121 - RNA, 22 nt, Bordetella pertussis
cggcggcaccauugccggcgcg

SEQ ID NO: 2424122 - RNA, 19 nt, Bordetella pertussis
cggcggcaccgcgcagccc

SEQ ID NO: 2424123 - RNA, 22 nt, Bordetella pertussis
cggcggcaccgcgcagcccggc

SEQ ID NO: 2424124 - RNA, 15 nt, Bordetella pertussis
cggcggcacgcgcgc

SEQ ID NO: 2424125 - RNA, 17 nt, Bordetella pertussis
cggcggcacgcgcgccg

SEQ ID NO: 2424126 - RNA, 18 nt, Bordetella pertussis
cggcggcacgcgcgccgg

SEQ ID NO: 2424127 - RNA, 19 nt, Bordetella pertussis
cggcggcacgcugcgcagg

SEQ ID NO: 2424128 - RNA, 14 nt, Bordetella pertussis
cggcggcacggccg

SEQ ID NO: 2424129 - RNA, 13 nt, Bordetella pertussis
cggcggcagccgg

SEQ ID NO: 2424130 - RNA, 14 nt, Bordetella pertussis
cggcggcagccggc

SEQ ID NO: 2424131 - RNA, 16 nt, Bordetella pertussis
cggcggcagccggcca

SEQ ID NO: 2424132 - RNA, 13 nt, Bordetella pertussis
cggcggcaggccg

SEQ ID NO: 2424133 - RNA, 14 nt, Bordetella pertussis
cggcggcaggccgc

SEQ ID NO: 2424134 - RNA, 16 nt, Bordetella pertussis
cggcggcaggccgcgc

SEQ ID NO: 2424135 - RNA, 18 nt, Bordetella pertussis
cggcggcaggccgcgcca

SEQ ID NO: 2424136 - RNA, 20 nt, Bordetella pertussis
cggcggcaggccgcgccaca

SEQ ID NO: 2424137 - RNA, 14 nt, Bordetella pertussis
cggcggcaggucgg

SEQ ID NO: 2424138 - RNA, 21 nt, Bordetella pertussis
cggcggcaucguucaggcgca

SEQ ID NO: 2424139 - RNA, 16 nt, Bordetella pertussis
cggcggcaugcgccag

SEQ ID NO: 2424140 - RNA, 17 nt, Bordetella pertussis
cggcggcaugcgccagc

SEQ ID NO: 2424141 - RNA, 19 nt, Bordetella pertussis
cggcggcaugcgccagcca

SEQ ID NO: 2424142 - RNA, 22 nt, Bordetella pertussis
cggcggcaugcgccagccagcg

SEQ ID NO: 2424143 - RNA, 23 nt, Bordetella pertussis
cggcggcaugcgccagccagcgc

SEQ ID NO: 2424144 - RNA, 14 nt, Bordetella pertussis
cggcggcaugcugg

SEQ ID NO: 2424145 - RNA, 14 nt, Bordetella pertussis
cggcggccacgacc

SEQ ID NO: 2424146 - RNA, 16 nt, Bordetella pertussis
cggcggccacgaccgg

SEQ ID NO: 2424147 - RNA, 18 nt, Bordetella pertussis
cggcggccacgaccggcu

SEQ ID NO: 2424148 - RNA, 20 nt, Bordetella pertussis
cggcggccacgaccggcucg

SEQ ID NO: 2424149 - RNA, 21 nt, Bordetella pertussis
cggcggccacgaccggcucga

SEQ ID NO: 2424150 - RNA, 13 nt, Bordetella pertussis
cggcggccagcag

SEQ ID NO: 2424151 - RNA, 16 nt, Bordetella pertussis
cggcggccagcagcgg

SEQ ID NO: 2424152 - RNA, 20 nt, Bordetella pertussis
cggcggccagcagcggcagg

SEQ ID NO: 2424153 - RNA, 22 nt, Bordetella pertussis
cggcggccagcagcggcagguc

SEQ ID NO: 2424154 - RNA, 15 nt, Bordetella pertussis
cggcggccagccggc

SEQ ID NO: 2424155 - RNA, 19 nt, Bordetella pertussis
cggcggccagccggcgcgc

SEQ ID NO: 2424156 - RNA, 21 nt, Bordetella pertussis
cggcggccagccggcgcgcca

SEQ ID NO: 2424157 - RNA, 15 nt, Bordetella pertussis
cggcggccagcgcgc

SEQ ID NO: 2424158 - RNA, 18 nt, Bordetella pertussis
cggcggccagcgcgcaac

SEQ ID NO: 2424159 - RNA, 16 nt, Bordetella pertussis
cggcggccagcgcgcc

SEQ ID NO: 2424160 - RNA, 17 nt, Bordetella pertussis
cggcggccagcgcgccc

SEQ ID NO: 2424161 - RNA, 18 nt, Bordetella pertussis
cggcggccagcgcgcccu

SEQ ID NO: 2424162 - RNA, 11 nt, Bordetella pertussis
cggcggccagg

SEQ ID NO: 2424163 - RNA, 12 nt, Bordetella pertussis
cggcggccaggc

SEQ ID NO: 2424164 - RNA, 14 nt, Bordetella pertussis
cggcggccaggccc

SEQ ID NO: 2424165 - RNA, 15 nt, Bordetella pertussis
cggcggccaggcccu

SEQ ID NO: 2424166 - RNA, 19 nt, Bordetella pertussis
cggcggccaggcccugcgc

SEQ ID NO: 2424167 - RNA, 20 nt, Bordetella pertussis
cggcggccaggcccugcgcg

SEQ ID NO: 2424168 - RNA, 15 nt, Bordetella pertussis
cggcggccaggccgg

SEQ ID NO: 2424169 - RNA, 18 nt, Bordetella pertussis
cggcggccaggccggcga

SEQ ID NO: 2424170 - RNA, 20 nt, Bordetella pertussis
cggcggccaggccggcgcgc

SEQ ID NO: 2424171 - RNA, 15 nt, Bordetella pertussis
cggcggccaggcgua

SEQ ID NO: 2424172 - RNA, 15 nt, Bordetella pertussis
cggcggccaucgcca

SEQ ID NO: 2424173 - RNA, 22 nt, Bordetella pertussis
cggcggccaucgccauggccac

SEQ ID NO: 2424174 - RNA, 21 nt, Bordetella pertussis
cggcggccaucuuggugcgcg

SEQ ID NO: 2424175 - RNA, 24 nt, Bordetella pertussis
cggcggccaucuuggugcgcgcca

SEQ ID NO: 2424176 - RNA, 20 nt, Bordetella pertussis
cggcggccaugacggccauc

SEQ ID NO: 2424177 - RNA, 16 nt, Bordetella pertussis
cggcggccaugcccag

SEQ ID NO: 2424178 - RNA, 18 nt, Bordetella pertussis
cggcggccaugcccaggc

SEQ ID NO: 2424179 - RNA, 20 nt, Bordetella pertussis
cggcggccaugcccaggccc

SEQ ID NO: 2424180 - RNA, 16 nt, Bordetella pertussis
cggcggccaugccgac

SEQ ID NO: 2424181 - RNA, 17 nt, Bordetella pertussis
cggcggcccacagcgcc

SEQ ID NO: 2424182 - RNA, 19 nt, Bordetella pertussis
cggcggcccacagcgcccc

SEQ ID NO: 2424183 - RNA, 18 nt, Bordetella pertussis
cggcggcccaucgugcgc

SEQ ID NO: 2424184 - RNA, 22 nt, Bordetella pertussis
cggcggccgaagcgcaagccca

SEQ ID NO: 2424185 - RNA, 16 nt, Bordetella pertussis
cggcggccgccugcgc

SEQ ID NO: 2424186 - RNA, 21 nt, Bordetella pertussis
cggcggccgccugcgccgagg

SEQ ID NO: 2424187 - RNA, 13 nt, Bordetella pertussis
cggcggccgccuu

SEQ ID NO: 2424188 - RNA, 21 nt, Bordetella pertussis
cggcggccgcguccagcgcgc

SEQ ID NO: 2424189 - RNA, 12 nt, Bordetella pertussis
cggcggccggcu

SEQ ID NO: 2424190 - RNA, 16 nt, Bordetella pertussis
cggcggccggggccgc

SEQ ID NO: 2424191 - RNA, 18 nt, Bordetella pertussis
cggcggccggggccgccc

SEQ ID NO: 2424192 - RNA, 15 nt, Bordetella pertussis
cggcggccgguaucg

SEQ ID NO: 2424193 - RNA, 15 nt, Bordetella pertussis
cggcggccuccagca

SEQ ID NO: 2424194 - RNA, 14 nt, Bordetella pertussis
cggcggccuccgcg

SEQ ID NO: 2424195 - RNA, 17 nt, Bordetella pertussis
cggcggccuccgcgcac

SEQ ID NO: 2424196 - RNA, 15 nt, Bordetella pertussis
cggcggccuccggca

SEQ ID NO: 2424197 - RNA, 21 nt, Bordetella pertussis
cggcggccuccggcaggaucu

SEQ ID NO: 2424198 - RNA, 13 nt, Bordetella pertussis
cggcggccugcuu

SEQ ID NO: 2424199 - RNA, 21 nt, Bordetella pertussis
cggcggccuggaccugagcca

SEQ ID NO: 2424200 - RNA, 23 nt, Bordetella pertussis
cggcggccuggaccugagccagg

SEQ ID NO: 2424201 - RNA, 14 nt, Bordetella pertussis
cggcggccugggcc

SEQ ID NO: 2424202 - RNA, 18 nt, Bordetella pertussis
cggcggccugggccaugg

SEQ ID NO: 2424203 - RNA, 20 nt, Bordetella pertussis
cggcggccuugugcgccagc

SEQ ID NO: 2424204 - RNA, 18 nt, Bordetella pertussis
cggcggccuuugcgcgcu

SEQ ID NO: 2424205 - RNA, 19 nt, Bordetella pertussis
cggcggcgacucggcaucg

SEQ ID NO: 2424206 - RNA, 16 nt, Bordetella pertussis
cggcggcgagcgcggc

SEQ ID NO: 2424207 - RNA, 23 nt, Bordetella pertussis
cggcggcgagcgcggcgcgcgcc

SEQ ID NO: 2424208 - RNA, 15 nt, Bordetella pertussis
cggcggcgagggcgu

SEQ ID NO: 2424209 - RNA, 16 nt, Bordetella pertussis
cggcggcgaucacgcc

SEQ ID NO: 2424210 - RNA, 18 nt, Bordetella pertussis
cggcggcgaugccgcugg

SEQ ID NO: 2424211 - RNA, 14 nt, Bordetella pertussis
cggcggcgaugguc

SEQ ID NO: 2424212 - RNA, 15 nt, Bordetella pertussis
cggcggcgcaccaau

SEQ ID NO: 2424213 - RNA, 13 nt, Bordetella pertussis
cggcggcgcauug

SEQ ID NO: 2424214 - RNA, 23 nt, Bordetella pertussis
cggcggcgcauugccgucggccg

SEQ ID NO: 2424215 - RNA, 17 nt, Bordetella pertussis
cggcggcgcccgcaugg

SEQ ID NO: 2424216 - RNA, 21 nt, Bordetella pertussis
cggcggcgcccgcauggaccg

SEQ ID NO: 2424217 - RNA, 15 nt, Bordetella pertussis
cggcguacugcugca

SEQ ID NO: 2424218 - RNA, 14 nt, Bordetella pertussis
cggcguacuggcgc

SEQ ID NO: 2424219 - RNA, 16 nt, Bordetella pertussis
cggcguacuggcgcgg

SEQ ID NO: 2424220 - RNA, 20 nt, Bordetella pertussis
cggcguacuggcgcggcggc

SEQ ID NO: 2424221 - RNA, 15 nt, Bordetella pertussis
cggcguagagcgccg

SEQ ID NO: 2424222 - RNA, 16 nt, Bordetella pertussis
cggcguagagcgccgc

SEQ ID NO: 2424223 - RNA, 17 nt, Bordetella pertussis
cggcguagagcgccgcg

SEQ ID NO: 2424224 - RNA, 17 nt, Bordetella pertussis
cggcguagccgaucugg

SEQ ID NO: 2424225 - RNA, 16 nt, Bordetella pertussis
cggcguagcugcgccg

SEQ ID NO: 2424226 - RNA, 17 nt, Bordetella pertussis
cggcguagcugcgccgc

SEQ ID NO: 2424227 - RNA, 21 nt, Bordetella pertussis
cggcguagucguugccggcca

SEQ ID NO: 2424228 - RNA, 22 nt, Bordetella pertussis
cggcguagucguugccggccag

SEQ ID NO: 2424229 - RNA, 18 nt, Bordetella pertussis
cggcguaguucagccaca

SEQ ID NO: 2424230 - RNA, 22 nt, Bordetella pertussis
cggcguaguucagccacacgau

SEQ ID NO: 2424231 - RNA, 16 nt, Bordetella pertussis
cggcguauaggccacc

SEQ ID NO: 2424232 - RNA, 18 nt, Bordetella pertussis
cggcguauaggccacccc

SEQ ID NO: 2424233 - RNA, 19 nt, Bordetella pertussis
cggcguauaggccaccccg

SEQ ID NO: 2424234 - RNA, 14 nt, Bordetella pertussis
cggcguauggcccg

SEQ ID NO: 2424235 - RNA, 19 nt, Bordetella pertussis
cggcguauggcccgccacc

SEQ ID NO: 2424236 - RNA, 20 nt, Bordetella pertussis
cggcguauggcccgccacca

SEQ ID NO: 2424237 - RNA, 23 nt, Bordetella pertussis
cggcguauggcccgccaccacgg

SEQ ID NO: 2424238 - RNA, 15 nt, Bordetella pertussis
cggcguauggcgcgg

SEQ ID NO: 2424239 - RNA, 21 nt, Bordetella pertussis
cggcguauugcuccacaggcc

SEQ ID NO: 2424240 - RNA, 24 nt, Bordetella pertussis
cggcgucaaaccaagcagggacag

SEQ ID NO: 2424241 - RNA, 15 nt, Bordetella pertussis
cggcgucaaugccag

SEQ ID NO: 2424242 - RNA, 21 nt, Bordetella pertussis
cggcgucaccuugggaucguc

SEQ ID NO: 2424243 - RNA, 14 nt, Bordetella pertussis
cggcgucacgcggc

SEQ ID NO: 2424244 - RNA, 18 nt, Bordetella pertussis
cggcgucacgcggccggg

SEQ ID NO: 2424245 - RNA, 14 nt, Bordetella pertussis
cggcgucagcgccc

SEQ ID NO: 2424246 - RNA, 13 nt, Bordetella pertussis
cggcgucaggccg

SEQ ID NO: 2424247 - RNA, 15 nt, Bordetella pertussis
cggcgucaggccguc

SEQ ID NO: 2424248 - RNA, 17 nt, Bordetella pertussis
cggcgucaggccgucga

SEQ ID NO: 2424249 - RNA, 22 nt, Bordetella pertussis
cggcgucaggccgucgagccgg

SEQ ID NO: 2424250 - RNA, 23 nt, Bordetella pertussis
cggcgucaggccgucgagccggg

SEQ ID NO: 2424251 - RNA, 21 nt, Bordetella pertussis
cggcguccauuagggcccagc

SEQ ID NO: 2424252 - RNA, 23 nt, Bordetella pertussis
cggcguccauuagggcccagcug

SEQ ID NO: 2424253 - RNA, 21 nt, Bordetella pertussis
cggcguccgaauacgccacgu

SEQ ID NO: 2424254 - RNA, 14 nt, Bordetella pertussis
cggcguccgcgccg

SEQ ID NO: 2424255 - RNA, 15 nt, Bordetella pertussis
cggcguccgcgccga

SEQ ID NO: 2424256 - RNA, 18 nt, Bordetella pertussis
cggcguccucgcgguccu

SEQ ID NO: 2424257 - RNA, 13 nt, Bordetella pertussis
cggcguccugccg

SEQ ID NO: 2424258 - RNA, 16 nt, Bordetella pertussis
cggcguccugccgcga

SEQ ID NO: 2424259 - RNA, 17 nt, Bordetella pertussis
cggcguccugccgcgac

SEQ ID NO: 2424260 - RNA, 17 nt, Bordetella pertussis
cggcguccugcggcggc

SEQ ID NO: 2424261 - RNA, 13 nt, Bordetella pertussis
cggcgucgaacag

SEQ ID NO: 2424262 - RNA, 12 nt, Bordetella pertussis
cggcgucgaccg

SEQ ID NO: 2424263 - RNA, 16 nt, Bordetella pertussis
cggcgucgacgcccgc

SEQ ID NO: 2424264 - RNA, 18 nt, Bordetella pertussis
cggcgucgacgcccgcgc

SEQ ID NO: 2424265 - RNA, 14 nt, Bordetella pertussis
cggcgucgagcacg

SEQ ID NO: 2424266 - RNA, 19 nt, Bordetella pertussis
cggcgucgagcacgcggcg

SEQ ID NO: 2424267 - RNA, 20 nt, Bordetella pertussis
cggcgucgagcacgcggcgc

SEQ ID NO: 2424268 - RNA, 16 nt, Bordetella pertussis
cggcgucgaucggcgc

SEQ ID NO: 2424269 - RNA, 19 nt, Bordetella pertussis
cggcgucgaucggcgcgcc

SEQ ID NO: 2424270 - RNA, 21 nt, Bordetella pertussis
cggcgucgaucggcgcgcccg

SEQ ID NO: 2424271 - RNA, 22 nt, Bordetella pertussis
cggcgucgaucggcgcgcccgc

SEQ ID NO: 2424272 - RNA, 16 nt, Bordetella pertussis
cggcgucgaugcgcgc

SEQ ID NO: 2424273 - RNA, 19 nt, Bordetella pertussis
cggcgucgccgcgcacgau

SEQ ID NO: 2424274 - RNA, 17 nt, Bordetella pertussis
cggcgucgccggccagg

SEQ ID NO: 2424275 - RNA, 17 nt, Bordetella pertussis
cggcgucgcuggcagcc

SEQ ID NO: 2424276 - RNA, 13 nt, Bordetella pertussis
cggcgucggcgcc

SEQ ID NO: 2424277 - RNA, 14 nt, Bordetella pertussis
cggcgucggcgccc

SEQ ID NO: 2424278 - RNA, 16 nt, Bordetella pertussis
cggcgucggcgcccgg

SEQ ID NO: 2424279 - RNA, 21 nt, Bordetella pertussis
cggcgucggcgcccggcgccg

SEQ ID NO: 2424280 - RNA, 21 nt, Bordetella pertussis
cggcgucgggucagccuugcu

SEQ ID NO: 2424281 - RNA, 13 nt, Bordetella pertussis
cggcgucggugcc

SEQ ID NO: 2424282 - RNA, 21 nt, Bordetella pertussis
cggcgucguccaucgacgcgg

SEQ ID NO: 2424283 - RNA, 18 nt, Bordetella pertussis
cggcgucuggagcggccu

SEQ ID NO: 2424284 - RNA, 20 nt, Bordetella pertussis
cggcgucuggagcggccugg

SEQ ID NO: 2424285 - RNA, 23 nt, Bordetella pertussis
cggcgucuggagcggccuggccc

SEQ ID NO: 2424286 - RNA, 18 nt, Bordetella pertussis
cggcgugaccgcgacgcg

SEQ ID NO: 2424287 - RNA, 20 nt, Bordetella pertussis
cggcgugaccgcgacgcgcc

SEQ ID NO: 2424288 - RNA, 23 nt, Bordetella pertussis
cggcgugacgcugacccuggccg

SEQ ID NO: 2424289 - RNA, 18 nt, Bordetella pertussis
cggcgugacguugccgcg

SEQ ID NO: 2424290 - RNA, 19 nt, Bordetella pertussis
cggcgugacguugccgcgc

SEQ ID NO: 2424291 - RNA, 20 nt, Bordetella pertussis
cggcgugacguugccgcgcg

SEQ ID NO: 2424292 - RNA, 22 nt, Bordetella pertussis
cggcgugacguugccgcgcgcg

SEQ ID NO: 2424293 - RNA, 15 nt, Bordetella pertussis
cggcgugagcacgac

SEQ ID NO: 2424294 - RNA, 14 nt, Bordetella pertussis
cggcgugagcgcca

SEQ ID NO: 2424295 - RNA, 19 nt, Bordetella pertussis
cggcgugaugcccaggccc

SEQ ID NO: 2424296 - RNA, 22 nt, Bordetella pertussis
cggcgugaugcccaggcccugg

SEQ ID NO: 2424297 - RNA, 18 nt, Bordetella pertussis
cggcgugcagcaagccca

SEQ ID NO: 2424298 - RNA, 21 nt, Bordetella pertussis
cggcgugcagcaagcccaccg

SEQ ID NO: 2424299 - RNA, 12 nt, Bordetella pertussis
cggcgugccaug

SEQ ID NO: 2424300 - RNA, 12 nt, Bordetella pertussis
cggcgugcccaa

SEQ ID NO: 2424301 - RNA, 14 nt, Bordetella pertussis
cggcgugcccaaug

SEQ ID NO: 2424302 - RNA, 14 nt, Bordetella pertussis
cggcgugcccaggg

SEQ ID NO: 2424303 - RNA, 16 nt, Bordetella pertussis
cggcgugcccagggcc

SEQ ID NO: 2424304 - RNA, 21 nt, Bordetella pertussis
cggcgugcccagggccacgaa

SEQ ID NO: 2424305 - RNA, 23 nt, Bordetella pertussis
cggcgugcccugcggcgcggcca

SEQ ID NO: 2424306 - RNA, 19 nt, Bordetella pertussis
cggcgugcgcgugcaugug

SEQ ID NO: 2424307 - RNA, 13 nt, Bordetella pertussis
cggcgugcgcugg

SEQ ID NO: 2424308 - RNA, 17 nt, Bordetella pertussis
cggcgugcgcuggcugg

SEQ ID NO: 2424309 - RNA, 18 nt, Bordetella pertussis
cggcgugcgcuggcuggg

SEQ ID NO: 2424310 - RNA, 16 nt, Bordetella pertussis
cggcgugcggcccagc

SEQ ID NO: 2424311 - RNA, 18 nt, Bordetella pertussis
cggcgugcggcccagccg

SEQ ID NO: 2424312 - RNA, 23 nt, Bordetella pertussis
cggcgugcggcccagccgcucgg

SEQ ID NO: 2424313 - RNA, 13 nt, Bordetella pertussis
cggcgugcugagg

SEQ ID NO: 2424314 - RNA, 13 nt, Bordetella pertussis
cggcgugcugccc

SEQ ID NO: 2424315 - RNA, 15 nt, Bordetella pertussis
cggcgugcugcccgc

SEQ ID NO: 2424316 - RNA, 16 nt, Bordetella pertussis
cggcgugcugcccgcg

SEQ ID NO: 2424317 - RNA, 18 nt, Bordetella pertussis
cggcgugcugcccgcgug

SEQ ID NO: 2424318 - RNA, 12 nt, Bordetella pertussis
cggcguggccug

SEQ ID NO: 2424319 - RNA, 15 nt, Bordetella pertussis
cggcguggccugccc

SEQ ID NO: 2424320 - RNA, 22 nt, Bordetella pertussis
cggcguggccugcccgucgggc

SEQ ID NO: 2424321 - RNA, 13 nt, Bordetella pertussis
cggcguggcgccg

SEQ ID NO: 2424322 - RNA, 14 nt, Bordetella pertussis
cggcguggcgcgca

SEQ ID NO: 2424323 - RNA, 16 nt, Bordetella pertussis
cggcguggcgcgcaac

SEQ ID NO: 2424324 - RNA, 22 nt, Bordetella pertussis
cggcguggcgcgcacacuggcc

SEQ ID NO: 2424325 - RNA, 15 nt, Bordetella pertussis
cggcguggcgcgccc

SEQ ID NO: 2424326 - RNA, 14 nt, Bordetella pertussis
cggcguggcggcca

SEQ ID NO: 2424327 - RNA, 14 nt, Bordetella pertussis
cggcguggcggggc

SEQ ID NO: 2424328 - RNA, 17 nt, Bordetella pertussis
cggcguggggccggccg

SEQ ID NO: 2424329 - RNA, 19 nt, Bordetella pertussis
cggcguggggccggccgcg

SEQ ID NO: 2424330 - RNA, 23 nt, Bordetella pertussis
cggcugcaagacgcccaggccca

SEQ ID NO: 2424331 - RNA, 17 nt, Bordetella pertussis
cggcugcaccagcgcgc

SEQ ID NO: 2424332 - RNA, 18 nt, Bordetella pertussis
cggcugcaccagcgcgcc

SEQ ID NO: 2424333 - RNA, 15 nt, Bordetella pertussis
cggcugccagggccg

SEQ ID NO: 2424334 - RNA, 16 nt, Bordetella pertussis
cggcugcccaccuugc

SEQ ID NO: 2424335 - RNA, 16 nt, Bordetella pertussis
cggcugcccgggcugc

SEQ ID NO: 2424336 - RNA, 13 nt, Bordetella pertussis
cggcugcccucgg

SEQ ID NO: 2424337 - RNA, 17 nt, Bordetella pertussis
cggcugcccucggucag

SEQ ID NO: 2424338 - RNA, 22 nt, Bordetella pertussis
cggcugcccucggucagcgcca

SEQ ID NO: 2424339 - RNA, 19 nt, Bordetella pertussis
cggcugccgauacgggcgc

SEQ ID NO: 2424340 - RNA, 23 nt, Bordetella pertussis
cggcugccgcggauugccguccu

SEQ ID NO: 2424341 - RNA, 13 nt, Bordetella pertussis
cggcugcgcgccg

SEQ ID NO: 2424342 - RNA, 14 nt, Bordetella pertussis
cggcugcgcgccga

SEQ ID NO: 2424343 - RNA, 14 nt, Bordetella pertussis
cggcugcgcgcgca

SEQ ID NO: 2424344 - RNA, 13 nt, Bordetella pertussis
cggcugcgcggcc

SEQ ID NO: 2424345 - RNA, 14 nt, Bordetella pertussis
cggcugcgcggccg

SEQ ID NO: 2424346 - RNA, 18 nt, Bordetella pertussis
cggcugcgcggccgagcg

SEQ ID NO: 2424347 - RNA, 12 nt, Bordetella pertussis
cggcugcgggcc

SEQ ID NO: 2424348 - RNA, 15 nt, Bordetella pertussis
cggcugcgggccggc

SEQ ID NO: 2424349 - RNA, 16 nt, Bordetella pertussis
cggcugcgggccggcg

SEQ ID NO: 2424350 - RNA, 15 nt, Bordetella pertussis
cggcugcgggcgcaa

SEQ ID NO: 2424351 - RNA, 22 nt, Bordetella pertussis
cggcugcgggcgcaagccagca

SEQ ID NO: 2424352 - RNA, 17 nt, Bordetella pertussis
cggcugcuugagcagcc

SEQ ID NO: 2424353 - RNA, 20 nt, Bordetella pertussis
cggcugcuugagcagccacu

SEQ ID NO: 2424354 - RNA, 22 nt, Bordetella pertussis
cggcuggacgcuuucggggcgc

SEQ ID NO: 2424355 - RNA, 18 nt, Bordetella pertussis
cggcuggagauacuggcc

SEQ ID NO: 2424356 - RNA, 21 nt, Bordetella pertussis
cggcuggaugaaaucgaggaa

SEQ ID NO: 2424357 - RNA, 17 nt, Bordetella pertussis
cggcuggauggugccgc

SEQ ID NO: 2424358 - RNA, 22 nt, Bordetella pertussis
cggcuggauggugccgccgccc

SEQ ID NO: 2424359 - RNA, 18 nt, Bordetella pertussis
cggcuggccacuggccgc

SEQ ID NO: 2424360 - RNA, 21 nt, Bordetella pertussis
cggcuggccacuggccgcgcu

SEQ ID NO: 2424361 - RNA, 15 nt, Bordetella pertussis
cggcuggccgaucac

SEQ ID NO: 2424362 - RNA, 13 nt, Bordetella pertussis
cggcuggccgucg

SEQ ID NO: 2424363 - RNA, 23 nt, Bordetella pertussis
cggcuggccgucgaacuccucga

SEQ ID NO: 2424364 - RNA, 18 nt, Bordetella pertussis
cggcuggcgaucaccgac

SEQ ID NO: 2424365 - RNA, 14 nt, Bordetella pertussis
cggcuggcgcacgu

SEQ ID NO: 2424366 - RNA, 19 nt, Bordetella pertussis
cggcuggcgcacguccaga

SEQ ID NO: 2424367 - RNA, 14 nt, Bordetella pertussis
cggcuggcgcggcc

SEQ ID NO: 2424368 - RNA, 15 nt, Bordetella pertussis
cggcuggcgcggccg

SEQ ID NO: 2424369 - RNA, 17 nt, Bordetella pertussis
cggcuggcugggcgcgc

SEQ ID NO: 2424370 - RNA, 20 nt, Bordetella pertussis
cggcuggcugggcgcgccgc

SEQ ID NO: 2424371 - RNA, 21 nt, Bordetella pertussis
cggcuggcugggcgcgccgcu

SEQ ID NO: 2424372 - RNA, 23 nt, Bordetella pertussis
cggcuggcugggcgcgccgcugc

SEQ ID NO: 2424373 - RNA, 14 nt, Bordetella pertussis
cggcugggcggccu

SEQ ID NO: 2424374 - RNA, 20 nt, Bordetella pertussis
cggcugggcggccuuggccg

SEQ ID NO: 2424375 - RNA, 21 nt, Bordetella pertussis
cggcugggugcggucagucgg

SEQ ID NO: 2424376 - RNA, 23 nt, Bordetella pertussis
cggcuggucgccgucaggaucag

SEQ ID NO: 2424377 - RNA, 17 nt, Bordetella pertussis
cggcuggugccgacggc

SEQ ID NO: 2424378 - RNA, 20 nt, Bordetella pertussis
cggcuggugccgacggcgcg

SEQ ID NO: 2424379 - RNA, 22 nt, Bordetella pertussis
cggcuggugccgacggcgcggg

SEQ ID NO: 2424380 - RNA, 16 nt, Bordetella pertussis
cggcuguagucgccgc

SEQ ID NO: 2424381 - RNA, 17 nt, Bordetella pertussis
cggcuguagucgccgcu

SEQ ID NO: 2424382 - RNA, 21 nt, Bordetella pertussis
cggcuguagucgccgcugccg

SEQ ID NO: 2424383 - RNA, 13 nt, Bordetella pertussis
cggcuguccaccu

SEQ ID NO: 2424384 - RNA, 19 nt, Bordetella pertussis
cggcuguccaccugcaccg

SEQ ID NO: 2424385 - RNA, 22 nt, Bordetella pertussis
cggcuguccaccugcaccguca

SEQ ID NO: 2424386 - RNA, 18 nt, Bordetella pertussis
cggcuguccuggcguggc

SEQ ID NO: 2424387 - RNA, 21 nt, Bordetella pertussis
cggcugucgggcggcgccugg

SEQ ID NO: 2424388 - RNA, 19 nt, Bordetella pertussis
cggcugugggccucgcugg

SEQ ID NO: 2424389 - RNA, 18 nt, Bordetella pertussis
cggcuucagccgcaagcu

SEQ ID NO: 2424390 - RNA, 19 nt, Bordetella pertussis
cggcuucagccgcaagcug

SEQ ID NO: 2424391 - RNA, 13 nt, Bordetella pertussis
cggcuucaggcgc

SEQ ID NO: 2424392 - RNA, 14 nt, Bordetella pertussis
cggcuuccagcagc

SEQ ID NO: 2424393 - RNA, 15 nt, Bordetella pertussis
cggcuuccagcagca

SEQ ID NO: 2424394 - RNA, 19 nt, Bordetella pertussis
cggcuuccagcagcaugcc

SEQ ID NO: 2424395 - RNA, 22 nt, Bordetella pertussis
cggcuuccagcagcaugccgcg

SEQ ID NO: 2424396 - RNA, 19 nt, Bordetella pertussis
cggcuucgaccacgcggcg

SEQ ID NO: 2424397 - RNA, 20 nt, Bordetella pertussis
cggcuucgaccacgcggcgg

SEQ ID NO: 2424398 - RNA, 17 nt, Bordetella pertussis
cggcuucgagcgcgacg

SEQ ID NO: 2424399 - RNA, 15 nt, Bordetella pertussis
cggcuucgcccagcg

SEQ ID NO: 2424400 - RNA, 20 nt, Bordetella pertussis
cggcuucgcccagcgcuugc

SEQ ID NO: 2424401 - RNA, 15 nt, Bordetella pertussis
cggcuucgcccggau

SEQ ID NO: 2424402 - RNA, 15 nt, Bordetella pertussis
cggcuucgcgcagca

SEQ ID NO: 2424403 - RNA, 18 nt, Bordetella pertussis
cggcuucgcgcagcaagu

SEQ ID NO: 2424404 - RNA, 21 nt, Bordetella pertussis
cggcuucgcgcagcaagucag

SEQ ID NO: 2424405 - RNA, 16 nt, Bordetella pertussis
cggcuucggccgucag

SEQ ID NO: 2424406 - RNA, 20 nt, Bordetella pertussis
cggcuucggccgucagcagc

SEQ ID NO: 2424407 - RNA, 15 nt, Bordetella pertussis
cggcuucguucaagc

SEQ ID NO: 2424408 - RNA, 16 nt, Bordetella pertussis
cggcuucguucaagcg

SEQ ID NO: 2424409 - RNA, 21 nt, Bordetella pertussis
cggcuucuccucuuuccccuc

SEQ ID NO: 2424410 - RNA, 17 nt, Bordetella pertussis
cggcuugaccacggcca

SEQ ID NO: 2424411 - RNA, 20 nt, Bordetella pertussis
cggcuugaccacggccagca

SEQ ID NO: 2424412 - RNA, 22 nt, Bordetella pertussis
cggcuugaccacggccagcagc

SEQ ID NO: 2424413 - RNA, 23 nt, Bordetella pertussis
cggcuugaccacggccagcagca

SEQ ID NO: 2424414 - RNA, 16 nt, Bordetella pertussis
cggcuugauggcgaug

SEQ ID NO: 2424415 - RNA, 23 nt, Bordetella pertussis
cggcuugauggcgauguccagcg

SEQ ID NO: 2424416 - RNA, 19 nt, Bordetella pertussis
cggcuugcacgccggccac

SEQ ID NO: 2424417 - RNA, 20 nt, Bordetella pertussis
cggcuugcagcggacggcgc

SEQ ID NO: 2424418 - RNA, 23 nt, Bordetella pertussis
cggcuugccgaaggugccugucc

SEQ ID NO: 2424419 - RNA, 13 nt, Bordetella pertussis
cggcuugccgcgc

SEQ ID NO: 2424420 - RNA, 18 nt, Bordetella pertussis
cggcuugccgcgcggcgu

SEQ ID NO: 2424421 - RNA, 16 nt, Bordetella pertussis
cggcuugccgcggcgc

SEQ ID NO: 2424422 - RNA, 21 nt, Bordetella pertussis
cggcuugccgcggcgcggccu

SEQ ID NO: 2424423 - RNA, 14 nt, Bordetella pertussis
cggcuugccgucga

SEQ ID NO: 2424424 - RNA, 21 nt, Bordetella pertussis
cggcuugcgcaagccggccgc

SEQ ID NO: 2424425 - RNA, 13 nt, Bordetella pertussis
cggcuugcgcgcc

SEQ ID NO: 2424426 - RNA, 14 nt, Bordetella pertussis
cggcuugcgcgccu

SEQ ID NO: 2424427 - RNA, 15 nt, Bordetella pertussis
cggcuugcgcgccug

SEQ ID NO: 2424428 - RNA, 13 nt, Bordetella pertussis
cggcuugcgcggc

SEQ ID NO: 2424429 - RNA, 15 nt, Bordetella pertussis
cggcuugcgcggcgc

SEQ ID NO: 2424430 - RNA, 19 nt, Bordetella pertussis
cggcuugcgcggcgcgucg

SEQ ID NO: 2424431 - RNA, 23 nt, Bordetella pertussis
cggcuugcgcguaggcgcgcgca

SEQ ID NO: 2424432 - RNA, 18 nt, Bordetella pertussis
cggcuuggccucggccgg

SEQ ID NO: 2424433 - RNA, 19 nt, Bordetella pertussis
cggcuuggccucggccggc

SEQ ID NO: 2424434 - RNA, 22 nt, Bordetella pertussis
cggcuuggccucggccggcagg

SEQ ID NO: 2424435 - RNA, 14 nt, Bordetella pertussis
cggcuuggcgugcg

SEQ ID NO: 2424436 - RNA, 17 nt, Bordetella pertussis
cggcuugggcacacacc

SEQ ID NO: 2424437 - RNA, 16 nt, Bordetella pertussis
cggcuugggcccggcg

SEQ ID NO: 2424438 - RNA, 14 nt, Bordetella pertussis
cggcuugggcgugc

SEQ ID NO: 2424439 - RNA, 16 nt, Bordetella pertussis
cggcuugggcgugccc

SEQ ID NO: 2424440 - RNA, 17 nt, Bordetella pertussis
cggcuuggggcgcgccg

SEQ ID NO: 2424441 - RNA, 21 nt, Bordetella pertussis
cggcuugguugucgcgcaccg

SEQ ID NO: 2424442 - RNA, 22 nt, Bordetella pertussis
cgggcagcggcgacggcgccug

SEQ ID NO: 2424443 - RNA, 19 nt, Bordetella pertussis
cgggcagcgggccgcagca

SEQ ID NO: 2424444 - RNA, 15 nt, Bordetella pertussis
cgggcagcucgcgcg

SEQ ID NO: 2424445 - RNA, 15 nt, Bordetella pertussis
cgggcagcuuggcgc

SEQ ID NO: 2424446 - RNA, 20 nt, Bordetella pertussis
cgggcagcuuggcgcgccgg

SEQ ID NO: 2424447 - RNA, 21 nt, Bordetella pertussis
cgggcagcuuggcgcgccgga

SEQ ID NO: 2424448 - RNA, 12 nt, Bordetella pertussis
cgggcaggagcg

SEQ ID NO: 2424449 - RNA, 15 nt, Bordetella pertussis
cgggcaggauggcca

SEQ ID NO: 2424450 - RNA, 17 nt, Bordetella pertussis
cgggcaggauggccaug

SEQ ID NO: 2424451 - RNA, 12 nt, Bordetella pertussis
cgggcaggccgc

SEQ ID NO: 2424452 - RNA, 18 nt, Bordetella pertussis
cgggcaggcgggccaggc

SEQ ID NO: 2424453 - RNA, 14 nt, Bordetella pertussis
cgggcaggcucagc

SEQ ID NO: 2424454 - RNA, 16 nt, Bordetella pertussis
cgggcaggcucagccc

SEQ ID NO: 2424455 - RNA, 15 nt, Bordetella pertussis
cgggcaggcuccaca

SEQ ID NO: 2424456 - RNA, 17 nt, Bordetella pertussis
cgggcaggcuccacagc

SEQ ID NO: 2424457 - RNA, 21 nt, Bordetella pertussis
cgggcaggcuccacagccacu

SEQ ID NO: 2424458 - RNA, 14 nt, Bordetella pertussis
cgggcagggugggc

SEQ ID NO: 2424459 - RNA, 20 nt, Bordetella pertussis
cgggcagggugggcacgcgc

SEQ ID NO: 2424460 - RNA, 12 nt, Bordetella pertussis
cgggcaggucgg

SEQ ID NO: 2424461 - RNA, 13 nt, Bordetella pertussis
cgggcaggucggc

SEQ ID NO: 2424462 - RNA, 17 nt, Bordetella pertussis
cgggcagugcgccggac

SEQ ID NO: 2424463 - RNA, 22 nt, Bordetella pertussis
cgggcaguucgggcacgccguu

SEQ ID NO: 2424464 - RNA, 18 nt, Bordetella pertussis
cgggcaguugcuggcggc

SEQ ID NO: 2424465 - RNA, 20 nt, Bordetella pertussis
cgggcaucgggguuccacag

SEQ ID NO: 2424466 - RNA, 22 nt, Bordetella pertussis
cgggcaucgggguuccacagcg

SEQ ID NO: 2424467 - RNA, 14 nt, Bordetella pertussis
cgggcaugacgacc

SEQ ID NO: 2424468 - RNA, 16 nt, Bordetella pertussis
cgggcaugcaccaggc

SEQ ID NO: 2424469 - RNA, 22 nt, Bordetella pertussis
cgggcaugcgaaagccggccuc

SEQ ID NO: 2424470 - RNA, 21 nt, Bordetella pertussis
cgggcauggcccggcucgccg

SEQ ID NO: 2424471 - RNA, 22 nt, Bordetella pertussis
cgggcaugggccccaagagggc

SEQ ID NO: 2424472 - RNA, 22 nt, Bordetella pertussis
cgggcaugucgcggcccacggc

SEQ ID NO: 2424473 - RNA, 17 nt, Bordetella pertussis
cgggcauugccggagca

SEQ ID NO: 2424474 - RNA, 21 nt, Bordetella pertussis
cgggcauugccggagcagcag

SEQ ID NO: 2424475 - RNA, 22 nt, Bordetella pertussis
cgggcauugccggagcagcagc

SEQ ID NO: 2424476 - RNA, 21 nt, Bordetella pertussis
cgggcauugggcagcggacgg

SEQ ID NO: 2424477 - RNA, 18 nt, Bordetella pertussis
cgggccacccgccgccgg

SEQ ID NO: 2424478 - RNA, 20 nt, Bordetella pertussis
cgggccacccgccgccggcg

SEQ ID NO: 2424479 - RNA, 13 nt, Bordetella pertussis
cgggccacgccgg

SEQ ID NO: 2424480 - RNA, 16 nt, Bordetella pertussis
cgggccacgccggccg

SEQ ID NO: 2424481 - RNA, 20 nt, Bordetella pertussis
cgggccacgccggccggggu

SEQ ID NO: 2424482 - RNA, 14 nt, Bordetella pertussis
cgggccacgcgccg

SEQ ID NO: 2424483 - RNA, 15 nt, Bordetella pertussis
cgggccacgcgccgu

SEQ ID NO: 2424484 - RNA, 14 nt, Bordetella pertussis
cgggccacugcgcc

SEQ ID NO: 2424485 - RNA, 19 nt, Bordetella pertussis
cgggccacugcgccugggc

SEQ ID NO: 2424486 - RNA, 16 nt, Bordetella pertussis
cgggccagaccuggug

SEQ ID NO: 2424487 - RNA, 22 nt, Bordetella pertussis
cgggccagccccggcgcgccgg

SEQ ID NO: 2424488 - RNA, 19 nt, Bordetella pertussis
cgggccagcuccccgggcg

SEQ ID NO: 2424489 - RNA, 13 nt, Bordetella pertussis
cgggccagcucuu

SEQ ID NO: 2424490 - RNA, 14 nt, Bordetella pertussis
cgggccaggccgau

SEQ ID NO: 2424491 - RNA, 13 nt, Bordetella pertussis
cgggccaggccgg

SEQ ID NO: 2424492 - RNA, 15 nt, Bordetella pertussis
cgggccaggccggcc

SEQ ID NO: 2424493 - RNA, 14 nt, Bordetella pertussis
cgggccaggccggu

SEQ ID NO: 2424494 - RNA, 19 nt, Bordetella pertussis
cgggccagguauucggcgg

SEQ ID NO: 2424495 - RNA, 21 nt, Bordetella pertussis
cgggccagguauucggcggug

SEQ ID NO: 2424496 - RNA, 19 nt, Bordetella pertussis
cgggccauccguccgccag

SEQ ID NO: 2424497 - RNA, 20 nt, Bordetella pertussis
cgggccccgcagggcccgca

SEQ ID NO: 2424498 - RNA, 23 nt, Bordetella pertussis
cgggccccgcagggcccgcaucg

SEQ ID NO: 2424499 - RNA, 14 nt, Bordetella pertussis
cgggcccgacagcg

SEQ ID NO: 2424500 - RNA, 13 nt, Bordetella pertussis
cgggcccgcaucg

SEQ ID NO: 2424501 - RNA, 12 nt, Bordetella pertussis
cgggcccgcgca

SEQ ID NO: 2424502 - RNA, 14 nt, Bordetella pertussis
cgggcccgcgcaga

SEQ ID NO: 2424503 - RNA, 15 nt, Bordetella pertussis
cgggcccgcgcagac

SEQ ID NO: 2424504 - RNA, 12 nt, Bordetella pertussis
cgggcccgcgcc

SEQ ID NO: 2424505 - RNA, 13 nt, Bordetella pertussis
cgggcccgcgccg

SEQ ID NO: 2424506 - RNA, 14 nt, Bordetella pertussis
cgggcccgcucggc

SEQ ID NO: 2424507 - RNA, 19 nt, Bordetella pertussis
cgggcccgcucggccagca

SEQ ID NO: 2424508 - RNA, 19 nt, Bordetella pertussis
cgggcccggaucauccggg

SEQ ID NO: 2424509 - RNA, 22 nt, Bordetella pertussis
cgggcccggaucauccgggccc

SEQ ID NO: 2424510 - RNA, 17 nt, Bordetella pertussis
cgggcccggccacggcc

SEQ ID NO: 2424511 - RNA, 16 nt, Bordetella pertussis
cgggcccgucgcgcca

SEQ ID NO: 2424512 - RNA, 17 nt, Bordetella pertussis
cgggcccgucgcgccag

SEQ ID NO: 2424513 - RNA, 18 nt, Bordetella pertussis
cgggcccgucgcgccagg

SEQ ID NO: 2424514 - RNA, 19 nt, Bordetella pertussis
cgggcccgucgcgccaggc

SEQ ID NO: 2424515 - RNA, 21 nt, Bordetella pertussis
cgggcccgucgcgccaggccg

SEQ ID NO: 2424516 - RNA, 21 nt, Bordetella pertussis
cgggcccuggcguucgcgcgc

SEQ ID NO: 2424517 - RNA, 14 nt, Bordetella pertussis
cgggccgaccaggc

SEQ ID NO: 2424518 - RNA, 19 nt, Bordetella pertussis
cgggccgaccaggccggcg

SEQ ID NO: 2424519 - RNA, 13 nt, Bordetella pertussis
cgggccgacgcgc

SEQ ID NO: 2424520 - RNA, 16 nt, Bordetella pertussis
cgggccgacggccucg

SEQ ID NO: 2424521 - RNA, 23 nt, Bordetella pertussis
cgggccgacggccucggccagga

SEQ ID NO: 2424522 - RNA, 22 nt, Bordetella pertussis
cgggccgaguggaugcgcuugc

SEQ ID NO: 2424523 - RNA, 14 nt, Bordetella pertussis
cgggccgcagcaug

SEQ ID NO: 2424524 - RNA, 16 nt, Bordetella pertussis
cgggccgcagcauggc

SEQ ID NO: 2424525 - RNA, 20 nt, Bordetella pertussis
cgggccgcagcauggcgcca

SEQ ID NO: 2424526 - RNA, 17 nt, Bordetella pertussis
cgggccgccgcacagcg

SEQ ID NO: 2424527 - RNA, 16 nt, Bordetella pertussis
cgggccgcgaccacgg

SEQ ID NO: 2424528 - RNA, 13 nt, Bordetella pertussis
cgggccgcgccca

SEQ ID NO: 2424529 - RNA, 14 nt, Bordetella pertussis
cgggccgcgcccac

SEQ ID NO: 2424530 - RNA, 16 nt, Bordetella pertussis
cgggccgcgcccacag

SEQ ID NO: 2424531 - RNA, 21 nt, Bordetella pertussis
cgggccgcgccccuagcgccg

SEQ ID NO: 2424532 - RNA, 22 nt, Bordetella pertussis
cgggccgcgccccuagcgccgc

SEQ ID NO: 2424533 - RNA, 16 nt, Bordetella pertussis
cgggccgcgcgcgggc

SEQ ID NO: 2424534 - RNA, 22 nt, Bordetella pertussis
cgggccgcgcgcgggcgcccgc

SEQ ID NO: 2424535 - RNA, 13 nt, Bordetella pertussis
cgggccgcgcugg

SEQ ID NO: 2424536 - RNA, 21 nt, Bordetella pertussis
cgggccgcggacgaagccuag

SEQ ID NO: 2424537 - RNA, 23 nt, Bordetella pertussis
cgggccgcggacgaagccuaggc

SEQ ID NO: 2424538 - RNA, 17 nt, Bordetella pertussis
cgggccgcuggcccggg

SEQ ID NO: 2424539 - RNA, 21 nt, Bordetella pertussis
cgggccgcuggucaccgcccc

SEQ ID NO: 2424540 - RNA, 15 nt, Bordetella pertussis
cgggccgcugguggc

SEQ ID NO: 2424541 - RNA, 14 nt, Bordetella pertussis
cgggccggcaccac

SEQ ID NO: 2424542 - RNA, 18 nt, Bordetella pertussis
cgggccggcaccacgacc

SEQ ID NO: 2424543 - RNA, 13 nt, Bordetella pertussis
cgggccggccgcc

SEQ ID NO: 2424544 - RNA, 15 nt, Bordetella pertussis
cgggccggccgccgg

SEQ ID NO: 2424545 - RNA, 15 nt, Bordetella pertussis
cgggccggcgccggu

SEQ ID NO: 2424546 - RNA, 16 nt, Bordetella pertussis
cgggccggcgcgccug

SEQ ID NO: 2424547 - RNA, 15 nt, Bordetella pertussis
cgggccggcggcagc

SEQ ID NO: 2424548 - RNA, 16 nt, Bordetella pertussis
cgggccggcgggcaug

SEQ ID NO: 2424549 - RNA, 15 nt, Bordetella pertussis
cgggccggcgggcgu

SEQ ID NO: 2424550 - RNA, 14 nt, Bordetella pertussis
cgggccggcucggc

SEQ ID NO: 2424551 - RNA, 22 nt, Bordetella pertussis
cgggccggcucggcggcaucgu

SEQ ID NO: 2424552 - RNA, 14 nt, Bordetella pertussis
cgggccggcugggc

SEQ ID NO: 2424553 - RNA, 21 nt, Bordetella pertussis
cgggccggcugggcggccuug

SEQ ID NO: 2424554 - RNA, 17 nt, Bordetella pertussis
cgggccgggcaggccgc

SEQ ID NO: 2424555 - RNA, 21 nt, Bordetella pertussis
cgggcgcggugcgcaccaggc

SEQ ID NO: 2424556 - RNA, 23 nt, Bordetella pertussis
cgggcgcggugcgcaccaggccc

SEQ ID NO: 2424557 - RNA, 14 nt, Bordetella pertussis
cgggcgcguggccc

SEQ ID NO: 2424558 - RNA, 16 nt, Bordetella pertussis
cgggcgcguggcccgc

SEQ ID NO: 2424559 - RNA, 19 nt, Bordetella pertussis
cgggcgcguggcccgcgcc

SEQ ID NO: 2424560 - RNA, 20 nt, Bordetella pertussis
cgggcgcguggcccgcgccg

SEQ ID NO: 2424561 - RNA, 16 nt, Bordetella pertussis
cgggcgcugcacgcag

SEQ ID NO: 2424562 - RNA, 20 nt, Bordetella pertussis
cgggcgcugcacgcagcgca

SEQ ID NO: 2424563 - RNA, 21 nt, Bordetella pertussis
cgggcgcugcacgcagcgcag

SEQ ID NO: 2424564 - RNA, 13 nt, Bordetella pertussis
cgggcgcugccca

SEQ ID NO: 2424565 - RNA, 16 nt, Bordetella pertussis
cgggcgcugcccagga

SEQ ID NO: 2424566 - RNA, 18 nt, Bordetella pertussis
cgggcgcugccugccggc

SEQ ID NO: 2424567 - RNA, 14 nt, Bordetella pertussis
cgggcgcugcgccg

SEQ ID NO: 2424568 - RNA, 23 nt, Bordetella pertussis
cgggcgcugcgccggcggcaccg

SEQ ID NO: 2424569 - RNA, 14 nt, Bordetella pertussis
cgggcgcuggcgcg

SEQ ID NO: 2424570 - RNA, 14 nt, Bordetella pertussis
cgggcgcuucgucg

SEQ ID NO: 2424571 - RNA, 17 nt, Bordetella pertussis
cgggcggccacgcgccg

SEQ ID NO: 2424572 - RNA, 13 nt, Bordetella pertussis
cgggcggcccgca

SEQ ID NO: 2424573 - RNA, 14 nt, Bordetella pertussis
cgggcggcccggcg

SEQ ID NO: 2424574 - RNA, 14 nt, Bordetella pertussis
cgggcggccgacgg

SEQ ID NO: 2424575 - RNA, 12 nt, Bordetella pertussis
cgggcggccggc

SEQ ID NO: 2424576 - RNA, 15 nt, Bordetella pertussis
cgggcggccggcgcg

SEQ ID NO: 2424577 - RNA, 12 nt, Bordetella pertussis
cgggcggccugg

SEQ ID NO: 2424578 - RNA, 14 nt, Bordetella pertussis
cgggcggcgccagc

SEQ ID NO: 2424579 - RNA, 22 nt, Bordetella pertussis
cgggcggcgccgucgaucccau

SEQ ID NO: 2424580 - RNA, 14 nt, Bordetella pertussis
cgggcggcgcgccc

SEQ ID NO: 2424581 - RNA, 17 nt, Bordetella pertussis
cgggcggcgcgcccagc

SEQ ID NO: 2424582 - RNA, 22 nt, Bordetella pertussis
cgggcggcgcgcccagcggcag

SEQ ID NO: 2424583 - RNA, 15 nt, Bordetella pertussis
cgggcggcgcggcca

SEQ ID NO: 2424584 - RNA, 19 nt, Bordetella pertussis
cgggcggcgcggccaaccc

SEQ ID NO: 2424585 - RNA, 13 nt, Bordetella pertussis
cgggcggcggcgc

SEQ ID NO: 2424586 - RNA, 22 nt, Bordetella pertussis
cgggcggcgguuucuuccagca

SEQ ID NO: 2424587 - RNA, 12 nt, Bordetella pertussis
cgggcggcgucg

SEQ ID NO: 2424588 - RNA, 15 nt, Bordetella pertussis
cgggcggcgucgccg

SEQ ID NO: 2424589 - RNA, 17 nt, Bordetella pertussis
cgggcggcuaggcgcag

SEQ ID NO: 2424590 - RNA, 15 nt, Bordetella pertussis
cgggcggcugccagu

SEQ ID NO: 2424591 - RNA, 13 nt, Bordetella pertussis
cgggcggcugccc

SEQ ID NO: 2424592 - RNA, 16 nt, Bordetella pertussis
cgggcggcugcccggg

SEQ ID NO: 2424593 - RNA, 14 nt, Bordetella pertussis
cgggcggcugcugg

SEQ ID NO: 2424594 - RNA, 20 nt, Bordetella pertussis
cgggcgggaaguggaaccgc

SEQ ID NO: 2424595 - RNA, 13 nt, Bordetella pertussis
cgggcgggccgcg

SEQ ID NO: 2424596 - RNA, 14 nt, Bordetella pertussis
cgggcgggccgcgg

SEQ ID NO: 2424597 - RNA, 20 nt, Bordetella pertussis
cgggcggggugaucugcgcc

SEQ ID NO: 2424598 - RNA, 21 nt, Bordetella pertussis
cgggcggggugaucugcgcca

SEQ ID NO: 2424599 - RNA, 13 nt, Bordetella pertussis
cgggcgggucggc

SEQ ID NO: 2424600 - RNA, 15 nt, Bordetella pertussis
cgggcgggucggcga

SEQ ID NO: 2424601 - RNA, 22 nt, Bordetella pertussis
cgggcgggucggcgaacagcgc

SEQ ID NO: 2424602 - RNA, 16 nt, Bordetella pertussis
cgggcggguucguggc

SEQ ID NO: 2424603 - RNA, 21 nt, Bordetella pertussis
cgggcggucggcgcggcgccg

SEQ ID NO: 2424604 - RNA, 17 nt, Bordetella pertussis
cgggcggugcggccucg

SEQ ID NO: 2424605 - RNA, 21 nt, Bordetella pertussis
cgggcguacguacugccaugg

SEQ ID NO: 2424606 - RNA, 13 nt, Bordetella pertussis
cgggcgucaccgg

SEQ ID NO: 2424607 - RNA, 15 nt, Bordetella pertussis
cgggcgucaccggcg

SEQ ID NO: 2424608 - RNA, 13 nt, Bordetella pertussis
cgggcgucaugcg

SEQ ID NO: 2424609 - RNA, 14 nt, Bordetella pertussis
cgggcgucaugcgc

SEQ ID NO: 2424610 - RNA, 16 nt, Bordetella pertussis
cgggcgugaccagcug

SEQ ID NO: 2424611 - RNA, 19 nt, Bordetella pertussis
cgggcgugaccagcugcac

SEQ ID NO: 2424612 - RNA, 16 nt, Bordetella pertussis
cgggcgugaugccgac

SEQ ID NO: 2424613 - RNA, 21 nt, Bordetella pertussis
cgggcgugaugccgaccaggc

SEQ ID NO: 2424614 - RNA, 11 nt, Bordetella pertussis
cgggcgugcgg

SEQ ID NO: 2424615 - RNA, 19 nt, Bordetella pertussis
cgggcgugcuggcacuguc

SEQ ID NO: 2424616 - RNA, 15 nt, Bordetella pertussis
cgggcguggcgcagg

SEQ ID NO: 2424617 - RNA, 19 nt, Bordetella pertussis
cgggcguuugcccuucgcg

SEQ ID NO: 2424618 - RNA, 15 nt, Bordetella pertussis
cgggcuccucgcccg

SEQ ID NO: 2424619 - RNA, 17 nt, Bordetella pertussis
cgggcuccucgcccgac

SEQ ID NO: 2424620 - RNA, 19 nt, Bordetella pertussis
cgggcuccucgcccgaccu

SEQ ID NO: 2424621 - RNA, 21 nt, Bordetella pertussis
cgggcucgaaguacagcuuga

SEQ ID NO: 2424622 - RNA, 23 nt, Bordetella pertussis
cgggcucgacuucggccgacaug

SEQ ID NO: 2424623 - RNA, 18 nt, Bordetella pertussis
cgggcucgagccucacuc

SEQ ID NO: 2424624 - RNA, 13 nt, Bordetella pertussis
cgggcucgagcug

SEQ ID NO: 2424625 - RNA, 20 nt, Bordetella pertussis
cgggcucgagcuggcuggcc

SEQ ID NO: 2424626 - RNA, 14 nt, Bordetella pertussis
cgggcucgcgcgcg

SEQ ID NO: 2424627 - RNA, 15 nt, Bordetella pertussis
cgggcucggccacca

SEQ ID NO: 2424628 - RNA, 17 nt, Bordetella pertussis
cgggcucggccaccaug

SEQ ID NO: 2424629 - RNA, 12 nt, Bordetella pertussis
cgggcucggcgc

SEQ ID NO: 2424630 - RNA, 22 nt, Bordetella pertussis
cgggcucguauugugcaugcgc

SEQ ID NO: 2424631 - RNA, 16 nt, Bordetella pertussis
cgggcugaacauccug

SEQ ID NO: 2424632 - RNA, 23 nt, Bordetella pertussis
cgggcugaacauccugaccggcu

SEQ ID NO: 2424633 - RNA, 14 nt, Bordetella pertussis
cgggcugauccgca

SEQ ID NO: 2424634 - RNA, 16 nt, Bordetella pertussis
cgggcugaugcaggcc

SEQ ID NO: 2424635 - RNA, 18 nt, Bordetella pertussis
cgggcugaugcaggccug

SEQ ID NO: 2424636 - RNA, 19 nt, Bordetella pertussis
cgggcugaugcaggccugc

SEQ ID NO: 2424637 - RNA, 20 nt, Bordetella pertussis
cgggcugaugcaggccugca

SEQ ID NO: 2424638 - RNA, 15 nt, Bordetella pertussis
cgggcugccggcagc

SEQ ID NO: 2424639 - RNA, 20 nt, Bordetella pertussis
cgggcugccguagcccaggu

SEQ ID NO: 2424640 - RNA, 21 nt, Bordetella pertussis
cgggcugcgacaggcgcagcu

SEQ ID NO: 2424641 - RNA, 15 nt, Bordetella pertussis
cgggcugcgcggguc

SEQ ID NO: 2424642 - RNA, 12 nt, Bordetella pertussis
cgggcugcugca

SEQ ID NO: 2424643 - RNA, 18 nt, Bordetella pertussis
cgggcugcugcacgcgcg

SEQ ID NO: 2424644 - RNA, 19 nt, Bordetella pertussis
cgggcugcugcacgcgcgc

SEQ ID NO: 2424645 - RNA, 20 nt, Bordetella pertussis
cgggcugcugcacgcgcgcg

SEQ ID NO: 2424646 - RNA, 22 nt, Bordetella pertussis
cgggcugcugcccgaagcgcag

SEQ ID NO: 2424647 - RNA, 17 nt, Bordetella pertussis
cgggcuggauccggcgc

SEQ ID NO: 2424648 - RNA, 18 nt, Bordetella pertussis
cgggcuggauccggcgcu

SEQ ID NO: 2424649 - RNA, 23 nt, Bordetella pertussis
cgggcuggauccggcgcuggcgc

SEQ ID NO: 2424650 - RNA, 14 nt, Bordetella pertussis
cgggcuggccagcg

SEQ ID NO: 2424651 - RNA, 14 nt, Bordetella pertussis
cgggcuggccgccu

SEQ ID NO: 2424652 - RNA, 14 nt, Bordetella pertussis
cgggcuggucgcgc

SEQ ID NO: 2424653 - RNA, 15 nt, Bordetella pertussis
cgggcuggucgcgcc

SEQ ID NO: 2424654 - RNA, 18 nt, Bordetella pertussis
cgggcuggucgcgccggu

SEQ ID NO: 2424655 - RNA, 20 nt, Bordetella pertussis
cgggcuggugcgccgugccc

SEQ ID NO: 2424656 - RNA, 21 nt, Bordetella pertussis
cgggcuggugcgccgugcccg

SEQ ID NO: 2424657 - RNA, 14 nt, Bordetella pertussis
cgggcuguccgcca

SEQ ID NO: 2424658 - RNA, 18 nt, Bordetella pertussis
cgggcuguccgccaccag

SEQ ID NO: 2424659 - RNA, 16 nt, Bordetella pertussis
cgggcuguucgcgcag

SEQ ID NO: 2424660 - RNA, 17 nt, Bordetella pertussis
cgggcuguucgcgcagc

SEQ ID NO: 2424661 - RNA, 21 nt, Bordetella pertussis
cgggcuguucgcgcagcaggc

SEQ ID NO: 2424662 - RNA, 13 nt, Bordetella pertussis
cgggcuugcugcc

SEQ ID NO: 2424663 - RNA, 19 nt, Bordetella pertussis
cgggcuugcugccccccga

SEQ ID NO: 2424664 - RNA, 23 nt, Bordetella pertussis
cgggcuugucgcugcgcauggcg

SEQ ID NO: 2424665 - RNA, 20 nt, Bordetella pertussis
cgggcuuucggucucgcgcg

SEQ ID NO: 2424666 - RNA, 22 nt, Bordetella pertussis
cgggcuuucggucucgcgcggc

SEQ ID NO: 2424667 - RNA, 18 nt, Bordetella pertussis
cggggaaauugacggcgc

SEQ ID NO: 2424668 - RNA, 21 nt, Bordetella pertussis
cgggguucuguccggcgcugg

SEQ ID NO: 2424669 - RNA, 23 nt, Bordetella pertussis
cgggguugccaagauggcccagg

SEQ ID NO: 2424670 - RNA, 15 nt, Bordetella pertussis
cgggguuggccgcca

SEQ ID NO: 2424671 - RNA, 22 nt, Bordetella pertussis
cgggguuuugcuuugcgggcgc

SEQ ID NO: 2424672 - RNA, 15 nt, Bordetella pertussis
cggguaccaggcucc

SEQ ID NO: 2424673 - RNA, 13 nt, Bordetella pertussis
cggguacggcaga

SEQ ID NO: 2424674 - RNA, 14 nt, Bordetella pertussis
cggguacguggccc

SEQ ID NO: 2424675 - RNA, 18 nt, Bordetella pertussis
cggguaucgucgaccugg

SEQ ID NO: 2424676 - RNA, 19 nt, Bordetella pertussis
cggguaucgucgaccugga

SEQ ID NO: 2424677 - RNA, 19 nt, Bordetella pertussis
cggguauucgaaggcagca

SEQ ID NO: 2424678 - RNA, 14 nt, Bordetella pertussis
cgggucaaggcggg

SEQ ID NO: 2424679 - RNA, 16 nt, Bordetella pertussis
cgggucaaggcggggc

SEQ ID NO: 2424680 - RNA, 18 nt, Bordetella pertussis
cgggucaaguccggcgcc

SEQ ID NO: 2424681 - RNA, 19 nt, Bordetella pertussis
cgggucaaguccggcgccg

SEQ ID NO: 2424682 - RNA, 17 nt, Bordetella pertussis
cgggucacccgccgcac

SEQ ID NO: 2424683 - RNA, 18 nt, Bordetella pertussis
cgggucacccgccgcacc

SEQ ID NO: 2424684 - RNA, 17 nt, Bordetella pertussis
cgggucaggcugcggcg

SEQ ID NO: 2424685 - RNA, 19 nt, Bordetella pertussis
cggguccagccccacgccg

SEQ ID NO: 2424686 - RNA, 24 nt, Bordetella pertussis
cggguccagccccacgccgaccuc

SEQ ID NO: 2424687 - RNA, 19 nt, Bordetella pertussis
cgggucccaaccagggccg

SEQ ID NO: 2424688 - RNA, 18 nt, Bordetella pertussis
cgggucccuggcccuggc

SEQ ID NO: 2424689 - RNA, 19 nt, Bordetella pertussis
cggguccggcgugccaugg

SEQ ID NO: 2424690 - RNA, 17 nt, Bordetella pertussis
cggguccuugccgggcu

SEQ ID NO: 2424691 - RNA, 15 nt, Bordetella pertussis
cgggucgagcgccga

SEQ ID NO: 2424692 - RNA, 14 nt, Bordetella pertussis
cgggucgaggucga

SEQ ID NO: 2424693 - RNA, 23 nt, Bordetella pertussis
cgggucgaucgucuugaccagca

SEQ ID NO: 2424694 - RNA, 19 nt, Bordetella pertussis
cgggucgccgguggugucg

SEQ ID NO: 2424695 - RNA, 15 nt, Bordetella pertussis
cgggucgcgcagcau

SEQ ID NO: 2424696 - RNA, 14 nt, Bordetella pertussis
cgggucggccugcc

SEQ ID NO: 2424697 - RNA, 21 nt, Bordetella pertussis
cgggucggccugccaccagcg

SEQ ID NO: 2424698 - RNA, 17 nt, Bordetella pertussis
cgggucggcgaacagcg

SEQ ID NO: 2424699 - RNA, 23 nt, Bordetella pertussis
cgggucggcgaacagcgcguucg

SEQ ID NO: 2424700 - RNA, 15 nt, Bordetella pertussis
cgggucgggcgucug

SEQ ID NO: 2424701 - RNA, 17 nt, Bordetella pertussis
cgggucgucccagcgca

SEQ ID NO: 2424702 - RNA, 19 nt, Bordetella pertussis
cgggucgucccagcgcacg

SEQ ID NO: 2424703 - RNA, 22 nt, Bordetella pertussis
cgggucgucccagcgcacgcag

SEQ ID NO: 2424704 - RNA, 17 nt, Bordetella pertussis
cgggucgucgggcggcg

SEQ ID NO: 2424705 - RNA, 21 nt, Bordetella pertussis
cgggucguucgaacugguaca

SEQ ID NO: 2424706 - RNA, 19 nt, Bordetella pertussis
cgggucuccacgaagucga

SEQ ID NO: 2424707 - RNA, 22 nt, Bordetella pertussis
cgggugaccuuggucgggucca

SEQ ID NO: 2424708 - RNA, 17 nt, Bordetella pertussis
cgggugaggggccagcc

SEQ ID NO: 2424709 - RNA, 19 nt, Bordetella pertussis
cgggugaggggccagccug

SEQ ID NO: 2424710 - RNA, 19 nt, Bordetella pertussis
cgggugaucacggccguca

SEQ ID NO: 2424711 - RNA, 20 nt, Bordetella pertussis
cgggugauggauuucgaccg

SEQ ID NO: 2424712 - RNA, 17 nt, Bordetella pertussis
cgggugccuguccccac

SEQ ID NO: 2424713 - RNA, 22 nt, Bordetella pertussis
cgggugccuguccccacagggg

SEQ ID NO: 2424714 - RNA, 18 nt, Bordetella pertussis
cgggugccuguccccgcc

SEQ ID NO: 2424715 - RNA, 17 nt, Bordetella pertussis
cgggugcgccugcagcg

SEQ ID NO: 2424716 - RNA, 22 nt, Bordetella pertussis
cgggugcgccugcagcgccgcc

SEQ ID NO: 2424717 - RNA, 23 nt, Bordetella pertussis
cgggugcgccugcagcgccgccu

SEQ ID NO: 2424718 - RNA, 19 nt, Bordetella pertussis
cgggugcugcagcgcacca

SEQ ID NO: 2424719 - RNA, 22 nt, Bordetella pertussis
cgggugcugcagcgcaccacca

SEQ ID NO: 2424720 - RNA, 22 nt, Bordetella pertussis
cggguggauggucuugccgaug

SEQ ID NO: 2424721 - RNA, 23 nt, Bordetella pertussis
cggguggccgauuccagcgccgc

SEQ ID NO: 2424722 - RNA, 12 nt, Bordetella pertussis
cggguggccgcu

SEQ ID NO: 2424723 - RNA, 15 nt, Bordetella pertussis
cggguggccggaucg

SEQ ID NO: 2424724 - RNA, 12 nt, Bordetella pertussis
cggguggccucg

SEQ ID NO: 2424725 - RNA, 19 nt, Bordetella pertussis
cggguggccucgcccuggc

SEQ ID NO: 2424726 - RNA, 14 nt, Bordetella pertussis
cggguggcggcggg

SEQ ID NO: 2424727 - RNA, 14 nt, Bordetella pertussis
cgggugggccggcu

SEQ ID NO: 2424728 - RNA, 19 nt, Bordetella pertussis
cgggugggcgcgccgcgac

SEQ ID NO: 2424729 - RNA, 12 nt, Bordetella pertussis
cggguggguucg

SEQ ID NO: 2424730 - RNA, 22 nt, Bordetella pertussis
cggguggucgcgcccgccgugg

SEQ ID NO: 2424731 - RNA, 14 nt, Bordetella pertussis
cggguggugcugcu

SEQ ID NO: 2424732 - RNA, 15 nt, Bordetella pertussis
cggguggugcugcuc

SEQ ID NO: 2424733 - RNA, 21 nt, Bordetella pertussis
cggguggugcugcucaacggc

SEQ ID NO: 2424734 - RNA, 18 nt, Bordetella pertussis
cggguguagaagaacagc

SEQ ID NO: 2424735 - RNA, 20 nt, Bordetella pertussis
cggguucgacgccggcagcg

SEQ ID NO: 2424736 - RNA, 19 nt, Bordetella pertussis
cggguugcaggaugcgcgg

SEQ ID NO: 2424737 - RNA, 20 nt, Bordetella pertussis
cggguugcaggaugcgcggc

SEQ ID NO: 2424738 - RNA, 13 nt, Bordetella pertussis
cggguugcccggc

SEQ ID NO: 2424739 - RNA, 16 nt, Bordetella pertussis
cggguugccgcugcau

SEQ ID NO: 2424740 - RNA, 23 nt, Bordetella pertussis
cggguugccgggauccacgccgc

SEQ ID NO: 2424741 - RNA, 15 nt, Bordetella pertussis
cggguugcgcgccag

SEQ ID NO: 2424742 - RNA, 17 nt, Bordetella pertussis
cggguugcgcgccagcu

SEQ ID NO: 2424743 - RNA, 15 nt, Bordetella pertussis
cggguugcggcagcg

SEQ ID NO: 2424744 - RNA, 17 nt, Bordetella pertussis
cggguugcggcagcgcc

SEQ ID NO: 2424745 - RNA, 13 nt, Bordetella pertussis
cggguuggcgucc

SEQ ID NO: 2424746 - RNA, 19 nt, Bordetella pertussis
cggguugugcccgcccggg

SEQ ID NO: 2424747 - RNA, 22 nt, Bordetella pertussis
cggguuuccagcccguggacga

SEQ ID NO: 2424748 - RNA, 15 nt, Bordetella pertussis
cggguuucggcaucu

SEQ ID NO: 2424749 - RNA, 21 nt, Bordetella pertussis
cggguuugcccaguacgaugc

SEQ ID NO: 2424750 - RNA, 22 nt, Bordetella pertussis
cggguuuuccuuuugcgcggcc

SEQ ID NO: 2424751 - RNA, 20 nt, Bordetella pertussis
cggguuuuuuuuggcguacg

SEQ ID NO: 2424752 - RNA, 17 nt, Bordetella pertussis
cgguaaccgacgcagcg

SEQ ID NO: 2424753 - RNA, 12 nt, Bordetella pertussis
cgguaaccggcg

SEQ ID NO: 2424754 - RNA, 18 nt, Bordetella pertussis
cgguaaccggcgauaacu

SEQ ID NO: 2424755 - RNA, 17 nt, Bordetella pertussis
cgguaaggcgcuugcgc

SEQ ID NO: 2424756 - RNA, 20 nt, Bordetella pertussis
cgguaaggcgcuugcgcagg

SEQ ID NO: 2424757 - RNA, 22 nt, Bordetella pertussis
cgguaaugacgcagccgcccgg

SEQ ID NO: 2424758 - RNA, 16 nt, Bordetella pertussis
cgguacaccugacgcg

SEQ ID NO: 2424759 - RNA, 16 nt, Bordetella pertussis
cgguacagccaggcca

SEQ ID NO: 2424760 - RNA, 15 nt, Bordetella pertussis
cgguacaggccggcg

SEQ ID NO: 2424761 - RNA, 17 nt, Bordetella pertussis
cgguacaggccggcggc

SEQ ID NO: 2424762 - RNA, 18 nt, Bordetella pertussis
cgguacaggucguagacc

SEQ ID NO: 2424763 - RNA, 22 nt, Bordetella pertussis
cgguaccaggccgagaugugcg

SEQ ID NO: 2424764 - RNA, 17 nt, Bordetella pertussis
cgguacgcaccgccgcc

SEQ ID NO: 2424765 - RNA, 13 nt, Bordetella pertussis
cgguacgcccagc

SEQ ID NO: 2424766 - RNA, 15 nt, Bordetella pertussis
cgguacgcgcagucc

SEQ ID NO: 2424767 - RNA, 20 nt, Bordetella pertussis
cgguacuccuugacgcgcgc

SEQ ID NO: 2424768 - RNA, 16 nt, Bordetella pertussis
cgguacugcggcgccu

SEQ ID NO: 2424769 - RNA, 18 nt, Bordetella pertussis
cgguacugcggcgccugg

SEQ ID NO: 2424770 - RNA, 15 nt, Bordetella pertussis
cgguagccggcgugg

SEQ ID NO: 2424771 - RNA, 20 nt, Bordetella pertussis
cgguagccgggucuggccgg

SEQ ID NO: 2424772 - RNA, 23 nt, Bordetella pertussis
cgguagccgggucuggccggccg

SEQ ID NO: 2424773 - RNA, 15 nt, Bordetella pertussis
cgguagcgcaagcag

SEQ ID NO: 2424774 - RNA, 23 nt, Bordetella pertussis
cgguagcgcucguccaugccggc

SEQ ID NO: 2424775 - RNA, 12 nt, Bordetella pertussis
cgguagcgcugg

SEQ ID NO: 2424776 - RNA, 21 nt, Bordetella pertussis
cgguagcgcugggcgccagca

SEQ ID NO: 2424777 - RNA, 19 nt, Bordetella pertussis
cgguaggacggcagcaccg

SEQ ID NO: 2424778 - RNA, 14 nt, Bordetella pertussis
cgguaggcccagca

SEQ ID NO: 2424779 - RNA, 20 nt, Bordetella pertussis
cgguaggccuggucgggguc

SEQ ID NO: 2424780 - RNA, 21 nt, Bordetella pertussis
cggucgccuguaucagcgccu

SEQ ID NO: 2424781 - RNA, 22 nt, Bordetella pertussis
cggucgccuguaucagcgccug

SEQ ID NO: 2424782 - RNA, 13 nt, Bordetella pertussis
cggucgcgcuggc

SEQ ID NO: 2424783 - RNA, 17 nt, Bordetella pertussis
cggucgcuuccagcgca

SEQ ID NO: 2424784 - RNA, 20 nt, Bordetella pertussis
cggucggaaacacguccagc

SEQ ID NO: 2424785 - RNA, 23 nt, Bordetella pertussis
cggucggaaacacguccagcgcc

SEQ ID NO: 2424786 - RNA, 12 nt, Bordetella pertussis
cggucggccgcu

SEQ ID NO: 2424787 - RNA, 21 nt, Bordetella pertussis
cggucggccgcuccgccaugg

SEQ ID NO: 2424788 - RNA, 13 nt, Bordetella pertussis
cggucggccggca

SEQ ID NO: 2424789 - RNA, 15 nt, Bordetella pertussis
cggucggccggcagc

SEQ ID NO: 2424790 - RNA, 18 nt, Bordetella pertussis
cggucggccggcagcggc

SEQ ID NO: 2424791 - RNA, 15 nt, Bordetella pertussis
cggucggcgcggcgc

SEQ ID NO: 2424792 - RNA, 15 nt, Bordetella pertussis
cggucgggaucaucc

SEQ ID NO: 2424793 - RNA, 19 nt, Bordetella pertussis
cggucggugcaaugcccag

SEQ ID NO: 2424794 - RNA, 21 nt, Bordetella pertussis
cggucggugcaaugcccaguu

SEQ ID NO: 2424795 - RNA, 18 nt, Bordetella pertussis
cggucgucagcacgcccu

SEQ ID NO: 2424796 - RNA, 21 nt, Bordetella pertussis
cggucgucagcacgcccuggc

SEQ ID NO: 2424797 - RNA, 21 nt, Bordetella pertussis
cggucguccccaauacccgcc

SEQ ID NO: 2424798 - RNA, 22 nt, Bordetella pertussis
cggucguccucgaugacgacga

SEQ ID NO: 2424799 - RNA, 15 nt, Bordetella pertussis
cggucguggcugacc

SEQ ID NO: 2424800 - RNA, 13 nt, Bordetella pertussis
cggucguggucga

SEQ ID NO: 2424801 - RNA, 19 nt, Bordetella pertussis
cggucguuccagaacggcg

SEQ ID NO: 2424802 - RNA, 21 nt, Bordetella pertussis
cggucguuccagaacggcgcg

SEQ ID NO: 2424803 - RNA, 22 nt, Bordetella pertussis
cggucuccgguucggcgcggcg

SEQ ID NO: 2424804 - RNA, 23 nt, Bordetella pertussis
cggucuccgguucggcgcggcgc

SEQ ID NO: 2424805 - RNA, 15 nt, Bordetella pertussis
cggucucgcgcggcc

SEQ ID NO: 2424806 - RNA, 14 nt, Bordetella pertussis
cggucucgugcgug

SEQ ID NO: 2424807 - RNA, 17 nt, Bordetella pertussis
cggucucgugcgugcgg

SEQ ID NO: 2424808 - RNA, 12 nt, Bordetella pertussis
cggucugcaccu

SEQ ID NO: 2424809 - RNA, 20 nt, Bordetella pertussis
cggucugcaccugcguggcc

SEQ ID NO: 2424810 - RNA, 14 nt, Bordetella pertussis
cggucugcacgccg

SEQ ID NO: 2424811 - RNA, 15 nt, Bordetella pertussis
cggucugcacgccgg

SEQ ID NO: 2424812 - RNA, 17 nt, Bordetella pertussis
cggucugcgguccgaug

SEQ ID NO: 2424813 - RNA, 18 nt, Bordetella pertussis
cggucugcgugcgcggcg

SEQ ID NO: 2424814 - RNA, 21 nt, Bordetella pertussis
cggucugcuucauccaggcgc

SEQ ID NO: 2424815 - RNA, 22 nt, Bordetella pertussis
cggucugcuucauccaggcgcu

SEQ ID NO: 2424816 - RNA, 15 nt, Bordetella pertussis
cggucuggcccacgc

SEQ ID NO: 2424817 - RNA, 16 nt, Bordetella pertussis
cggucuggcccacgcg

SEQ ID NO: 2424818 - RNA, 15 nt, Bordetella pertussis
cggucuggcgcgaca

SEQ ID NO: 2424819 - RNA, 15 nt, Bordetella pertussis
cggucugggcgcgga

SEQ ID NO: 2424820 - RNA, 23 nt, Bordetella pertussis
cggucugggcgucccaggccacg

SEQ ID NO: 2424821 - RNA, 17 nt, Bordetella pertussis
cggucuggucggcgaug

SEQ ID NO: 2424822 - RNA, 21 nt, Bordetella pertussis
cggucuguuuuuuugggggcc

SEQ ID NO: 2424823 - RNA, 16 nt, Bordetella pertussis
cggugaaaucgacgug

SEQ ID NO: 2424824 - RNA, 13 nt, Bordetella pertussis
cggugaaggccac

SEQ ID NO: 2424825 - RNA, 14 nt, Bordetella pertussis
cggugaaggcgccc

SEQ ID NO: 2424826 - RNA, 20 nt, Bordetella pertussis
cggugaaggcgcccgggcug

SEQ ID NO: 2424827 - RNA, 18 nt, Bordetella pertussis
cggugacaugcguggccg

SEQ ID NO: 2424828 - RNA, 20 nt, Bordetella pertussis
cggugacaugcguggccgcg

SEQ ID NO: 2424829 - RNA, 13 nt, Bordetella pertussis
cggugaccaccag

SEQ ID NO: 2424830 - RNA, 17 nt, Bordetella pertussis
cggugaccaccaggccg

SEQ ID NO: 2424831 - RNA, 15 nt, Bordetella pertussis
cggugaccaugcgca

SEQ ID NO: 2424832 - RNA, 14 nt, Bordetella pertussis
cggugaccgccagc

SEQ ID NO: 2424833 - RNA, 18 nt, Bordetella pertussis
cggugaccgccagcaggc

SEQ ID NO: 2424834 - RNA, 19 nt, Bordetella pertussis
cggugaccggguggcugcg

SEQ ID NO: 2424835 - RNA, 16 nt, Bordetella pertussis
cggugacgcccugcca

SEQ ID NO: 2424836 - RNA, 20 nt, Bordetella pertussis
cggugacgcccugccauucg

SEQ ID NO: 2424837 - RNA, 15 nt, Bordetella pertussis
cggugagauccagcg

SEQ ID NO: 2424838 - RNA, 17 nt, Bordetella pertussis
cggugagcaagcgcugg

SEQ ID NO: 2424839 - RNA, 19 nt, Bordetella pertussis
cggugaggcggccgggcgu

SEQ ID NO: 2424840 - RNA, 13 nt, Bordetella pertussis
cggugaucagcag

SEQ ID NO: 2424841 - RNA, 14 nt, Bordetella pertussis
cggugaucaucgug

SEQ ID NO: 2424842 - RNA, 21 nt, Bordetella pertussis
cggugaucaucgugccgggga

SEQ ID NO: 2424843 - RNA, 17 nt, Bordetella pertussis
cggugauccacugcagc

SEQ ID NO: 2424844 - RNA, 20 nt, Bordetella pertussis
cggugauccacugcagcagu

SEQ ID NO: 2424845 - RNA, 21 nt, Bordetella pertussis
cggugaucgaguaggccggca

SEQ ID NO: 2424846 - RNA, 21 nt, Bordetella pertussis
cggugaucuugccgaugcggc

SEQ ID NO: 2424847 - RNA, 22 nt, Bordetella pertussis
cggugaucuugccgaugcggcg

SEQ ID NO: 2424848 - RNA, 19 nt, Bordetella pertussis
cggugaugauccugcuggu

SEQ ID NO: 2424849 - RNA, 22 nt, Bordetella pertussis
cggugaugauccugcugguggc

SEQ ID NO: 2424850 - RNA, 18 nt, Bordetella pertussis
cggugaugauggccaggu

SEQ ID NO: 2424851 - RNA, 21 nt, Bordetella pertussis
cggugaugauggccaggucca

SEQ ID NO: 2424852 - RNA, 19 nt, Bordetella pertussis
cggugaugcccgaggcggc

SEQ ID NO: 2424853 - RNA, 20 nt, Bordetella pertussis
cggugaugcggcgcgccgcg

SEQ ID NO: 2424854 - RNA, 18 nt, Bordetella pertussis
cggugauguacgcaucgg

SEQ ID NO: 2424855 - RNA, 20 nt, Bordetella pertussis
cggugauguacgcaucggcg

SEQ ID NO: 2424856 - RNA, 23 nt, Bordetella pertussis
cggugauguacgcaucggcgccg

SEQ ID NO: 2424857 - RNA, 14 nt, Bordetella pertussis
cggugaugucgccg

SEQ ID NO: 2424858 - RNA, 22 nt, Bordetella pertussis
cggugauuucggcgcaucggcg

SEQ ID NO: 2424859 - RNA, 17 nt, Bordetella pertussis
cggugcacacgccuucg

SEQ ID NO: 2424860 - RNA, 16 nt, Bordetella pertussis
cggugcaccaggccac

SEQ ID NO: 2424861 - RNA, 12 nt, Bordetella pertussis
cggugcagccca

SEQ ID NO: 2424862 - RNA, 14 nt, Bordetella pertussis
cggugcagcccagc

SEQ ID NO: 2424863 - RNA, 16 nt, Bordetella pertussis
cggugcagcguggcgc

SEQ ID NO: 2424864 - RNA, 21 nt, Bordetella pertussis
cggugcaggggccgcacgcgc

SEQ ID NO: 2424865 - RNA, 20 nt, Bordetella pertussis
cggugcaggucaucgcgcug

SEQ ID NO: 2424866 - RNA, 14 nt, Bordetella pertussis
cggugcaucggccg

SEQ ID NO: 2424867 - RNA, 15 nt, Bordetella pertussis
cggugcaucggccgg

SEQ ID NO: 2424868 - RNA, 18 nt, Bordetella pertussis
cggugcaucggccggcgg

SEQ ID NO: 2424869 - RNA, 18 nt, Bordetella pertussis
cggugcaucucggcaucg

SEQ ID NO: 2424870 - RNA, 14 nt, Bordetella pertussis
cggugccagucccc

SEQ ID NO: 2424871 - RNA, 18 nt, Bordetella pertussis
cggugccaguccccaugc

SEQ ID NO: 2424872 - RNA, 23 nt, Bordetella pertussis
cggugccaguccccaugcggccc

SEQ ID NO: 2424873 - RNA, 17 nt, Bordetella pertussis
cggugccagucccccug

SEQ ID NO: 2424874 - RNA, 13 nt, Bordetella pertussis
cggugccgcccac

SEQ ID NO: 2424875 - RNA, 14 nt, Bordetella pertussis
cggugccgcccacc

SEQ ID NO: 2424876 - RNA, 17 nt, Bordetella pertussis
cggugccgcccaccgug

SEQ ID NO: 2424877 - RNA, 11 nt, Bordetella pertussis
cggugccgcgc

SEQ ID NO: 2424878 - RNA, 13 nt, Bordetella pertussis
cggugccgcgcac

SEQ ID NO: 2424879 - RNA, 15 nt, Bordetella pertussis
cggugccgcgcaccc

SEQ ID NO: 2424880 - RNA, 17 nt, Bordetella pertussis
cggugccgcgcacccag

SEQ ID NO: 2424881 - RNA, 19 nt, Bordetella pertussis
cggugccgcgcacccaggc

SEQ ID NO: 2424882 - RNA, 13 nt, Bordetella pertussis
cggugccgcgcgc

SEQ ID NO: 2424883 - RNA, 14 nt, Bordetella pertussis
cggugccgcgcgcg

SEQ ID NO: 2424884 - RNA, 17 nt, Bordetella pertussis
cggugccgcgcgcggcc

SEQ ID NO: 2424885 - RNA, 15 nt, Bordetella pertussis
cggugccgcgcgcuu

SEQ ID NO: 2424886 - RNA, 22 nt, Bordetella pertussis
cggugccggccagccugcccgu

SEQ ID NO: 2424887 - RNA, 15 nt, Bordetella pertussis
cggugccguccagcg

SEQ ID NO: 2424888 - RNA, 17 nt, Bordetella pertussis
cggugccguccagcgcg

SEQ ID NO: 2424889 - RNA, 21 nt, Bordetella pertussis
cggugccguccagcgcggcgc

SEQ ID NO: 2424890 - RNA, 13 nt, Bordetella pertussis
cggugccgugggc

SEQ ID NO: 2424891 - RNA, 16 nt, Bordetella pertussis
cggugccugccccugc

SEQ ID NO: 2424892 - RNA, 16 nt, Bordetella pertussis
cggugccuguccccac

SEQ ID NO: 2424893 - RNA, 14 nt, Bordetella pertussis
cgguguucgcgucg

SEQ ID NO: 2424894 - RNA, 18 nt, Bordetella pertussis
cgguguucgcgucgucgu

SEQ ID NO: 2424895 - RNA, 11 nt, Bordetella pertussis
cgguguucucg

SEQ ID NO: 2424896 - RNA, 14 nt, Bordetella pertussis
cgguucaaccggcg

SEQ ID NO: 2424897 - RNA, 21 nt, Bordetella pertussis
cgguucagcgcgccagcgcgc

SEQ ID NO: 2424898 - RNA, 16 nt, Bordetella pertussis
cgguucaggccccggc

SEQ ID NO: 2424899 - RNA, 20 nt, Bordetella pertussis
cgguucaggccccggccggu

SEQ ID NO: 2424900 - RNA, 14 nt, Bordetella pertussis
cgguuccagccugg

SEQ ID NO: 2424901 - RNA, 21 nt, Bordetella pertussis
cgguucgauguaguagccgcc

SEQ ID NO: 2424902 - RNA, 17 nt, Bordetella pertussis
cgguucgcauagcgccg

SEQ ID NO: 2424903 - RNA, 20 nt, Bordetella pertussis
cgguucgcccaccaccagcg

SEQ ID NO: 2424904 - RNA, 23 nt, Bordetella pertussis
cgguucgcccaccaccagcggcg

SEQ ID NO: 2424905 - RNA, 15 nt, Bordetella pertussis
cgguucggcgcggcg

SEQ ID NO: 2424906 - RNA, 17 nt, Bordetella pertussis
cgguucgggcggguucg

SEQ ID NO: 2424907 - RNA, 16 nt, Bordetella pertussis
cgguucgucagggccg

SEQ ID NO: 2424908 - RNA, 21 nt, Bordetella pertussis
cgguucguccucgucggccau

SEQ ID NO: 2424909 - RNA, 23 nt, Bordetella pertussis
cgguucguccucgucggccaugc

SEQ ID NO: 2424910 - RNA, 13 nt, Bordetella pertussis
cgguucugcggcg

SEQ ID NO: 2424911 - RNA, 18 nt, Bordetella pertussis
cgguucuggaucgcgccc

SEQ ID NO: 2424912 - RNA, 14 nt, Bordetella pertussis
cgguugagcgccag

SEQ ID NO: 2424913 - RNA, 16 nt, Bordetella pertussis
cgguugagcgccaggg

SEQ ID NO: 2424914 - RNA, 19 nt, Bordetella pertussis
cgguugcagcgcgccaggc

SEQ ID NO: 2424915 - RNA, 21 nt, Bordetella pertussis
cgguugcagcgcgccaggcgc

SEQ ID NO: 2424916 - RNA, 14 nt, Bordetella pertussis
cgguugcgaggcgg

SEQ ID NO: 2424917 - RNA, 15 nt, Bordetella pertussis
cgguugcgaggcggc

SEQ ID NO: 2424918 - RNA, 18 nt, Bordetella pertussis
cgguugcgguucugggcc

SEQ ID NO: 2424919 - RNA, 19 nt, Bordetella pertussis
cgguugcgucucggccugu

SEQ ID NO: 2424920 - RNA, 21 nt, Bordetella pertussis
cgguuggcgccuuccggcagc

SEQ ID NO: 2424921 - RNA, 19 nt, Bordetella pertussis
cgguuggugucgcgcagcg

SEQ ID NO: 2424922 - RNA, 20 nt, Bordetella pertussis
cgguugguuugcggcgcgac

SEQ ID NO: 2424923 - RNA, 22 nt, Bordetella pertussis
cgguuguugcccaccgccagga

SEQ ID NO: 2424924 - RNA, 19 nt, Bordetella pertussis
cgguuucggccugcaggcc

SEQ ID NO: 2424925 - RNA, 23 nt, Bordetella pertussis
cgguuucggccugcaggcccagc

SEQ ID NO: 2424926 - RNA, 23 nt, Bordetella pertussis
cgguuuuucuuuggccgcgcgcc

SEQ ID NO: 2424927 - RNA, 17 nt, Bordetella pertussis
cgguuuuugaggacccc

SEQ ID NO: 2424928 - RNA, 19 nt, Bordetella pertussis
cgguuuuuucuugccggcc

SEQ ID NO: 2424929 - RNA, 20 nt, Bordetella pertussis
cgguuuuuucuugccggccc

SEQ ID NO: 2424930 - RNA, 18 nt, Bordetella pertussis
cguaacaggacagccgcu

SEQ ID NO: 2424931 - RNA, 16 nt, Bordetella pertussis
cguaagcaggucugca

SEQ ID NO: 2424932 - RNA, 16 nt, Bordetella pertussis
cguaagcgcuggacgc

SEQ ID NO: 2424933 - RNA, 19 nt, Bordetella pertussis
cguaagcgcuggacgcccu

SEQ ID NO: 2424934 - RNA, 13 nt, Bordetella pertussis
cguaaggccgccg

SEQ ID NO: 2424935 - RNA, 17 nt, Bordetella pertussis
cguaaggccgccggcca

SEQ ID NO: 2424936 - RNA, 13 nt, Bordetella pertussis
cguaagugcccag

SEQ ID NO: 2424937 - RNA, 14 nt, Bordetella pertussis
cguaagugcccagg

SEQ ID NO: 2424938 - RNA, 15 nt, Bordetella pertussis
cguaagugcccaggc

SEQ ID NO: 2424939 - RNA, 18 nt, Bordetella pertussis
cguaagugcccaggcccg

SEQ ID NO: 2424940 - RNA, 17 nt, Bordetella pertussis
cguaauagcuggcggcg

SEQ ID NO: 2424941 - RNA, 21 nt, Bordetella pertussis
cguaauagcuggcggcgcgcu

SEQ ID NO: 2424942 - RNA, 15 nt, Bordetella pertussis
cguaaucgagcuggc

SEQ ID NO: 2424943 - RNA, 17 nt, Bordetella pertussis
cguaaucggcgucggca

SEQ ID NO: 2424944 - RNA, 15 nt, Bordetella pertussis
cguacagccgcggca

SEQ ID NO: 2424945 - RNA, 16 nt, Bordetella pertussis
cguacagccgcggcag

SEQ ID NO: 2424946 - RNA, 17 nt, Bordetella pertussis
cguacagcgaaggggcg

SEQ ID NO: 2424947 - RNA, 12 nt, Bordetella pertussis
cguacaggccgu

SEQ ID NO: 2424948 - RNA, 15 nt, Bordetella pertussis
cguacagggccgcga

SEQ ID NO: 2424949 - RNA, 15 nt, Bordetella pertussis
cguacauggccaggu

SEQ ID NO: 2424950 - RNA, 18 nt, Bordetella pertussis
cguaccaggcagccggcc

SEQ ID NO: 2424951 - RNA, 21 nt, Bordetella pertussis
cguaccaggcagccggccccg

SEQ ID NO: 2424952 - RNA, 19 nt, Bordetella pertussis
cguaccaggcgcugaccug

SEQ ID NO: 2424953 - RNA, 13 nt, Bordetella pertussis
cguaccaggugcg

SEQ ID NO: 2424954 - RNA, 20 nt, Bordetella pertussis
cguaccaguacaccggcgug

SEQ ID NO: 2424955 - RNA, 21 nt, Bordetella pertussis
cguaccccagcaugugcgcgg

SEQ ID NO: 2424956 - RNA, 18 nt, Bordetella pertussis
cguaccgccacaccgcug

SEQ ID NO: 2424957 - RNA, 14 nt, Bordetella pertussis
cguaccgguccaga

SEQ ID NO: 2424958 - RNA, 15 nt, Bordetella pertussis
cguaccugcagcagg

SEQ ID NO: 2424959 - RNA, 19 nt, Bordetella pertussis
cguaccugcagcaggcgca

SEQ ID NO: 2424960 - RNA, 21 nt, Bordetella pertussis
cguacgaagcaaacaggcugc

SEQ ID NO: 2424961 - RNA, 21 nt, Bordetella pertussis
cguacgaggcauacaggcugu

SEQ ID NO: 2424962 - RNA, 15 nt, Bordetella pertussis
cguacgauagcggau

SEQ ID NO: 2424963 - RNA, 16 nt, Bordetella pertussis
cguacgcccggccgcc

SEQ ID NO: 2424964 - RNA, 20 nt, Bordetella pertussis
cguacgcggcgcccgcgcau

SEQ ID NO: 2424965 - RNA, 21 nt, Bordetella pertussis
cguacgcggcgcggucggcgg

SEQ ID NO: 2424966 - RNA, 19 nt, Bordetella pertussis
cguacgcuuaucgcggcgc

SEQ ID NO: 2424967 - RNA, 12 nt, Bordetella pertussis
cguacggcgucg

SEQ ID NO: 2424968 - RNA, 17 nt, Bordetella pertussis
cguacggcgucgggcag

SEQ ID NO: 2424969 - RNA, 19 nt, Bordetella pertussis
cguacguaccaggccgucg

SEQ ID NO: 2424970 - RNA, 19 nt, Bordetella pertussis
cguacgucaaggccugccc

SEQ ID NO: 2424971 - RNA, 12 nt, Bordetella pertussis
cguacguggcgc

SEQ ID NO: 2424972 - RNA, 16 nt, Bordetella pertussis
cguacguggcgcggcu

SEQ ID NO: 2424973 - RNA, 14 nt, Bordetella pertussis
cguacucgccgucg

SEQ ID NO: 2424974 - RNA, 16 nt, Bordetella pertussis
cguacugccauggccc

SEQ ID NO: 2424975 - RNA, 15 nt, Bordetella pertussis
cguacuggcgcggcg

SEQ ID NO: 2424976 - RNA, 17 nt, Bordetella pertussis
cguacuggcgcggcggc

SEQ ID NO: 2424977 - RNA, 18 nt, Bordetella pertussis
cguacuggcgcggcggcc

SEQ ID NO: 2424978 - RNA, 19 nt, Bordetella pertussis
cguacuggcgcggcggcca

SEQ ID NO: 2424979 - RNA, 15 nt, Bordetella pertussis
cguacuucucgucgc

SEQ ID NO: 2424980 - RNA, 24 nt, Bordetella pertussis
cguacuucucgucgcgcauggacg

SEQ ID NO: 2424981 - RNA, 23 nt, Bordetella pertussis
cguacuugaucugcauguacucg

SEQ ID NO: 2424982 - RNA, 19 nt, Bordetella pertussis
cguagaaauacgcgcgcgc

SEQ ID NO: 2424983 - RNA, 20 nt, Bordetella pertussis
cguagaacuucacgccgagg

SEQ ID NO: 2424984 - RNA, 16 nt, Bordetella pertussis
cguagaccgccgcgcc

SEQ ID NO: 2424985 - RNA, 15 nt, Bordetella pertussis
cguagaguucgcugc

SEQ ID NO: 2424986 - RNA, 13 nt, Bordetella pertussis
cguagaugggcag

SEQ ID NO: 2424987 - RNA, 21 nt, Bordetella pertussis
cguagcccagguccagcgcca

SEQ ID NO: 2424988 - RNA, 17 nt, Bordetella pertussis
cguagcccucgcccagg

SEQ ID NO: 2424989 - RNA, 14 nt, Bordetella pertussis
cguagccgcugccg

SEQ ID NO: 2424990 - RNA, 19 nt, Bordetella pertussis
cguagccgcugcgcgcggc

SEQ ID NO: 2424991 - RNA, 14 nt, Bordetella pertussis
cguagccggccagg

SEQ ID NO: 2424992 - RNA, 15 nt, Bordetella pertussis
cguagccggccaggu

SEQ ID NO: 2424993 - RNA, 23 nt, Bordetella pertussis
cguagccgguaucgcggcgcagg

SEQ ID NO: 2424994 - RNA, 14 nt, Bordetella pertussis
cguagccggugcgc

SEQ ID NO: 2424995 - RNA, 15 nt, Bordetella pertussis
cguagccggugcgca

SEQ ID NO: 2424996 - RNA, 17 nt, Bordetella pertussis
cguagccggugcgcagc

SEQ ID NO: 2424997 - RNA, 19 nt, Bordetella pertussis
cguagccggugcgcagcac

SEQ ID NO: 2424998 - RNA, 17 nt, Bordetella pertussis
cguagcgauccgaugcc

SEQ ID NO: 2424999 - RNA, 15 nt, Bordetella pertussis
cguagcgcagcaccg

SEQ ID NO: 2425000 - RNA, 14 nt, Bordetella pertussis
cguagcgcaggcgc

SEQ ID NO: 2425001 - RNA, 22 nt, Bordetella pertussis
cguagcgcaucgcgaugcgcag

SEQ ID NO: 2425002 - RNA, 21 nt, Bordetella pertussis
cguagcgccagcguucggcca

SEQ ID NO: 2425003 - RNA, 23 nt, Bordetella pertussis
cguagcgccagcguucggccacc

SEQ ID NO: 2425004 - RNA, 12 nt, Bordetella pertussis
cguagcgcggcc

SEQ ID NO: 2425005 - RNA, 13 nt, Bordetella pertussis
cguagcgcggccg

SEQ ID NO: 2425006 - RNA, 19 nt, Bordetella pertussis
cgucaggugcagcgagacc

SEQ ID NO: 2425007 - RNA, 17 nt, Bordetella pertussis
cgucaguccguggcgcg

SEQ ID NO: 2425008 - RNA, 18 nt, Bordetella pertussis
cgucaguugggcgcgccc

SEQ ID NO: 2425009 - RNA, 22 nt, Bordetella pertussis
cgucaguugggcgcgcccagcc

SEQ ID NO: 2425010 - RNA, 19 nt, Bordetella pertussis
cgucauaggcuucgcccgc

SEQ ID NO: 2425011 - RNA, 16 nt, Bordetella pertussis
cgucaucaccaagggc

SEQ ID NO: 2425012 - RNA, 15 nt, Bordetella pertussis
cgucaucgccgcggc

SEQ ID NO: 2425013 - RNA, 17 nt, Bordetella pertussis
cgucaucgccgcggcgg

SEQ ID NO: 2425014 - RNA, 17 nt, Bordetella pertussis
cgucaucggugcggccg

SEQ ID NO: 2425015 - RNA, 18 nt, Bordetella pertussis
cgucaucggugcggccgg

SEQ ID NO: 2425016 - RNA, 20 nt, Bordetella pertussis
cgucaucggugcggccggug

SEQ ID NO: 2425017 - RNA, 19 nt, Bordetella pertussis
cgucaucguggccgcgcaa

SEQ ID NO: 2425018 - RNA, 21 nt, Bordetella pertussis
cgucaugaacgucaccccgcc

SEQ ID NO: 2425019 - RNA, 18 nt, Bordetella pertussis
cgucaugcgccaugaacg

SEQ ID NO: 2425020 - RNA, 14 nt, Bordetella pertussis
cgucaugcgccgca

SEQ ID NO: 2425021 - RNA, 15 nt, Bordetella pertussis
cgucaugcgccgcag

SEQ ID NO: 2425022 - RNA, 19 nt, Bordetella pertussis
cgucaugcgccgcagcacc

SEQ ID NO: 2425023 - RNA, 20 nt, Bordetella pertussis
cgucaugcgccgcagcaccu

SEQ ID NO: 2425024 - RNA, 20 nt, Bordetella pertussis
cgucaugcgcuugucgccgc

SEQ ID NO: 2425025 - RNA, 13 nt, Bordetella pertussis
cgucauggccgau

SEQ ID NO: 2425026 - RNA, 21 nt, Bordetella pertussis
cgucauggccuggcccagcuc

SEQ ID NO: 2425027 - RNA, 14 nt, Bordetella pertussis
cgucauggcgccgu

SEQ ID NO: 2425028 - RNA, 15 nt, Bordetella pertussis
cgucauggcggcagg

SEQ ID NO: 2425029 - RNA, 16 nt, Bordetella pertussis
cgucauggucgaccag

SEQ ID NO: 2425030 - RNA, 19 nt, Bordetella pertussis
cgucauggucgaccagcag

SEQ ID NO: 2425031 - RNA, 14 nt, Bordetella pertussis
cgucaugugcagaa

SEQ ID NO: 2425032 - RNA, 17 nt, Bordetella pertussis
cgucaugugcugcggca

SEQ ID NO: 2425033 - RNA, 21 nt, Bordetella pertussis
cgucaugugcugcggcagcca

SEQ ID NO: 2425034 - RNA, 22 nt, Bordetella pertussis
cgucaugugcugcggcagccag

SEQ ID NO: 2425035 - RNA, 20 nt, Bordetella pertussis
cgucauuacccauggcaccg

SEQ ID NO: 2425036 - RNA, 20 nt, Bordetella pertussis
cgucauugcaucgcagcaga

SEQ ID NO: 2425037 - RNA, 23 nt, Bordetella pertussis
cguccaaaacagacaggccggca

SEQ ID NO: 2425038 - RNA, 20 nt, Bordetella pertussis
cguccaagcagacccgcgcc

SEQ ID NO: 2425039 - RNA, 21 nt, Bordetella pertussis
cguccaagcagacccgcgccc

SEQ ID NO: 2425040 - RNA, 22 nt, Bordetella pertussis
cguccaagcagacccgcgccca

SEQ ID NO: 2425041 - RNA, 24 nt, Bordetella pertussis
cguccaauucgagcaggcgcaggc

SEQ ID NO: 2425042 - RNA, 14 nt, Bordetella pertussis
cguccaccaccagg

SEQ ID NO: 2425043 - RNA, 15 nt, Bordetella pertussis
cguccaccaccaggc

SEQ ID NO: 2425044 - RNA, 16 nt, Bordetella pertussis
cguccaccaccaggcc

SEQ ID NO: 2425045 - RNA, 13 nt, Bordetella pertussis
cguccaccgccga

SEQ ID NO: 2425046 - RNA, 17 nt, Bordetella pertussis
cguccaccuugacgcgc

SEQ ID NO: 2425047 - RNA, 19 nt, Bordetella pertussis
cguccacgaaggcagcacc

SEQ ID NO: 2425048 - RNA, 20 nt, Bordetella pertussis
cguccacgaaggcagcaccu

SEQ ID NO: 2425049 - RNA, 14 nt, Bordetella pertussis
cguccacgcccagc

SEQ ID NO: 2425050 - RNA, 18 nt, Bordetella pertussis
cguccacgcccagcgccg

SEQ ID NO: 2425051 - RNA, 20 nt, Bordetella pertussis
cguccacgcccagcgccggc

SEQ ID NO: 2425052 - RNA, 16 nt, Bordetella pertussis
cguccacgccgcgcgc

SEQ ID NO: 2425053 - RNA, 17 nt, Bordetella pertussis
cguccacgccgcgcgcg

SEQ ID NO: 2425054 - RNA, 22 nt, Bordetella pertussis
cguccacgccguggcgcaaggc

SEQ ID NO: 2425055 - RNA, 14 nt, Bordetella pertussis
cguccacggcaucg

SEQ ID NO: 2425056 - RNA, 15 nt, Bordetella pertussis
cguccacggcaucgg

SEQ ID NO: 2425057 - RNA, 20 nt, Bordetella pertussis
cguccacggcaucggccagc

SEQ ID NO: 2425058 - RNA, 21 nt, Bordetella pertussis
cguccacggcaucggccagca

SEQ ID NO: 2425059 - RNA, 21 nt, Bordetella pertussis
cguccacggccugcgcgccga

SEQ ID NO: 2425060 - RNA, 19 nt, Bordetella pertussis
cguccacugaaagaaccgc

SEQ ID NO: 2425061 - RNA, 19 nt, Bordetella pertussis
cguccagagucugccuggc

SEQ ID NO: 2425062 - RNA, 15 nt, Bordetella pertussis
cguccagcacgcggc

SEQ ID NO: 2425063 - RNA, 17 nt, Bordetella pertussis
cguccagcacgcggcgc

SEQ ID NO: 2425064 - RNA, 18 nt, Bordetella pertussis
cguccagcacgcggcgca

SEQ ID NO: 2425065 - RNA, 20 nt, Bordetella pertussis
cguccagcacgcggcgcagc

SEQ ID NO: 2425066 - RNA, 21 nt, Bordetella pertussis
cguccagcacggccgcggccg

SEQ ID NO: 2425067 - RNA, 24 nt, Bordetella pertussis
cguccagcacggccgcggccggca

SEQ ID NO: 2425068 - RNA, 12 nt, Bordetella pertussis
cguccagcagca

SEQ ID NO: 2425069 - RNA, 20 nt, Bordetella pertussis
cguccagccccugcgggccg

SEQ ID NO: 2425070 - RNA, 18 nt, Bordetella pertussis
cguccagcccgugggcgg

SEQ ID NO: 2425071 - RNA, 17 nt, Bordetella pertussis
cguccagccgagccugg

SEQ ID NO: 2425072 - RNA, 18 nt, Bordetella pertussis
cguccagccgagccuggc

SEQ ID NO: 2425073 - RNA, 16 nt, Bordetella pertussis
cguccagccugcccgg

SEQ ID NO: 2425074 - RNA, 18 nt, Bordetella pertussis
cguccagccugcccgggc

SEQ ID NO: 2425075 - RNA, 19 nt, Bordetella pertussis
cguccagcgacuccggccg

SEQ ID NO: 2425076 - RNA, 21 nt, Bordetella pertussis
cguccagcgacucggucagca

SEQ ID NO: 2425077 - RNA, 13 nt, Bordetella pertussis
cguccagcgccgc

SEQ ID NO: 2425078 - RNA, 15 nt, Bordetella pertussis
cguccagcgcgcggc

SEQ ID NO: 2425079 - RNA, 19 nt, Bordetella pertussis
cguccagcgcgcggccucg

SEQ ID NO: 2425080 - RNA, 14 nt, Bordetella pertussis
cguccagcgcggca

SEQ ID NO: 2425081 - RNA, 15 nt, Bordetella pertussis
cguccagcgcggcgc

SEQ ID NO: 2425082 - RNA, 17 nt, Bordetella pertussis
cguccagcgcggcgcca

SEQ ID NO: 2425083 - RNA, 16 nt, Bordetella pertussis
cguccagcggcgcgac

SEQ ID NO: 2425084 - RNA, 15 nt, Bordetella pertussis
cguccagcgucaugc

SEQ ID NO: 2425085 - RNA, 17 nt, Bordetella pertussis
cguccagcguggcgcag

SEQ ID NO: 2425086 - RNA, 18 nt, Bordetella pertussis
cguccaggaagcagccca

SEQ ID NO: 2425087 - RNA, 20 nt, Bordetella pertussis
cguccaggaagcagcccagc

SEQ ID NO: 2425088 - RNA, 21 nt, Bordetella pertussis
cguccaggaagcagcccagca

SEQ ID NO: 2425089 - RNA, 16 nt, Bordetella pertussis
cguccaggcccagcgc

SEQ ID NO: 2425090 - RNA, 20 nt, Bordetella pertussis
cguccaggcccagcgcgucc

SEQ ID NO: 2425091 - RNA, 16 nt, Bordetella pertussis
cguccaggcccuggcg

SEQ ID NO: 2425092 - RNA, 15 nt, Bordetella pertussis
cguccaggcgcaccu

SEQ ID NO: 2425093 - RNA, 12 nt, Bordetella pertussis
cguccaggcgcc

SEQ ID NO: 2425094 - RNA, 17 nt, Bordetella pertussis
cguccaggcgccgcacg

SEQ ID NO: 2425095 - RNA, 14 nt, Bordetella pertussis
cguccaggcgcgcc

SEQ ID NO: 2425096 - RNA, 15 nt, Bordetella pertussis
cguccaggcgcgcca

SEQ ID NO: 2425097 - RNA, 20 nt, Bordetella pertussis
cguccaggcgcgccagccgc

SEQ ID NO: 2425098 - RNA, 21 nt, Bordetella pertussis
cguccaggcgcgccagccgcu

SEQ ID NO: 2425099 - RNA, 12 nt, Bordetella pertussis
cguccaggcggc

SEQ ID NO: 2425100 - RNA, 20 nt, Bordetella pertussis
cguccaggcggccaucgccg

SEQ ID NO: 2425101 - RNA, 12 nt, Bordetella pertussis
cguccaggcggu

SEQ ID NO: 2425102 - RNA, 18 nt, Bordetella pertussis
cguccaggugcggcggcg

SEQ ID NO: 2425103 - RNA, 20 nt, Bordetella pertussis
cguccaggugcggcggcgac

SEQ ID NO: 2425104 - RNA, 19 nt, Bordetella pertussis
cguccagguugagucugga

SEQ ID NO: 2425105 - RNA, 17 nt, Bordetella pertussis
cguccagguugcccgag

SEQ ID NO: 2425106 - RNA, 22 nt, Bordetella pertussis
cguccagguugcccgagcgcga

SEQ ID NO: 2425107 - RNA, 21 nt, Bordetella pertussis
cguccagguugucggccaugc

SEQ ID NO: 2425108 - RNA, 17 nt, Bordetella pertussis
cguccagucccguggcg

SEQ ID NO: 2425109 - RNA, 19 nt, Bordetella pertussis
cguccaucgacgcggcgac

SEQ ID NO: 2425110 - RNA, 21 nt, Bordetella pertussis
cguccaucuggaccgcgcgcg

SEQ ID NO: 2425111 - RNA, 17 nt, Bordetella pertussis
cguccaugcagguggca

SEQ ID NO: 2425112 - RNA, 15 nt, Bordetella pertussis
cguccaugccggcca

SEQ ID NO: 2425113 - RNA, 17 nt, Bordetella pertussis
cguccaugccggccaug

SEQ ID NO: 2425114 - RNA, 19 nt, Bordetella pertussis
cguccaugcggaggcuuug

SEQ ID NO: 2425115 - RNA, 18 nt, Bordetella pertussis
cguccauggcgugccagg

SEQ ID NO: 2425116 - RNA, 17 nt, Bordetella pertussis
cguccauuagggcccag

SEQ ID NO: 2425117 - RNA, 18 nt, Bordetella pertussis
cguccauuagggcccagc

SEQ ID NO: 2425118 - RNA, 14 nt, Bordetella pertussis
cgucgaccgccucg

SEQ ID NO: 2425119 - RNA, 15 nt, Bordetella pertussis
cgucgaccgccucga

SEQ ID NO: 2425120 - RNA, 19 nt, Bordetella pertussis
cgucgaccgccucgacgcc

SEQ ID NO: 2425121 - RNA, 20 nt, Bordetella pertussis
cgucgaccgccucgacgccc

SEQ ID NO: 2425122 - RNA, 18 nt, Bordetella pertussis
cgucgaccgcgggcgcgc

SEQ ID NO: 2425123 - RNA, 20 nt, Bordetella pertussis
cgucgaccgcgggcgcgcgc

SEQ ID NO: 2425124 - RNA, 15 nt, Bordetella pertussis
cgucgaccucgagca

SEQ ID NO: 2425125 - RNA, 12 nt, Bordetella pertussis
cgucgacgccga

SEQ ID NO: 2425126 - RNA, 16 nt, Bordetella pertussis
cgucgacggugcgcgc

SEQ ID NO: 2425127 - RNA, 18 nt, Bordetella pertussis
cgucgacggugcgcgcca

SEQ ID NO: 2425128 - RNA, 23 nt, Bordetella pertussis
cgucgacguaccaagccugcuua

SEQ ID NO: 2425129 - RNA, 21 nt, Bordetella pertussis
cgucgacguccugguggaccu

SEQ ID NO: 2425130 - RNA, 14 nt, Bordetella pertussis
cgucgacgucggug

SEQ ID NO: 2425131 - RNA, 21 nt, Bordetella pertussis
cgucgacgucggugacggcgu

SEQ ID NO: 2425132 - RNA, 19 nt, Bordetella pertussis
cgucgacguugcgcgacag

SEQ ID NO: 2425133 - RNA, 14 nt, Bordetella pertussis
cgucgagcaccgug

SEQ ID NO: 2425134 - RNA, 21 nt, Bordetella pertussis
cgucgagcaccgugaccugcg

SEQ ID NO: 2425135 - RNA, 15 nt, Bordetella pertussis
cgucgagcagcgcau

SEQ ID NO: 2425136 - RNA, 16 nt, Bordetella pertussis
cgucgagcaggccggc

SEQ ID NO: 2425137 - RNA, 17 nt, Bordetella pertussis
cgucgagcaggccggcg

SEQ ID NO: 2425138 - RNA, 17 nt, Bordetella pertussis
cgucgagccgggccacg

SEQ ID NO: 2425139 - RNA, 19 nt, Bordetella pertussis
cgucgagccgggccacgcg

SEQ ID NO: 2425140 - RNA, 14 nt, Bordetella pertussis
cgucgagccgggcg

SEQ ID NO: 2425141 - RNA, 17 nt, Bordetella pertussis
cgucgagccgggcgccg

SEQ ID NO: 2425142 - RNA, 19 nt, Bordetella pertussis
cgucgagccgggcgccgau

SEQ ID NO: 2425143 - RNA, 24 nt, Bordetella pertussis
cgucgagccgggcgccgauccagc

SEQ ID NO: 2425144 - RNA, 14 nt, Bordetella pertussis
cgucgagccggucc

SEQ ID NO: 2425145 - RNA, 13 nt, Bordetella pertussis
cgucgagcgcggc

SEQ ID NO: 2425146 - RNA, 15 nt, Bordetella pertussis
cgucgagcgcggcca

SEQ ID NO: 2425147 - RNA, 18 nt, Bordetella pertussis
cgucgagcgcggccaggc

SEQ ID NO: 2425148 - RNA, 22 nt, Bordetella pertussis
cgucgaggaucaaggcccggau

SEQ ID NO: 2425149 - RNA, 16 nt, Bordetella pertussis
cgucgaggucagcggc

SEQ ID NO: 2425150 - RNA, 18 nt, Bordetella pertussis
cgucgaguucgagcacgg

SEQ ID NO: 2425151 - RNA, 14 nt, Bordetella pertussis
cgucgaucagcgcg

SEQ ID NO: 2425152 - RNA, 16 nt, Bordetella pertussis
cgucgaucaggcccag

SEQ ID NO: 2425153 - RNA, 21 nt, Bordetella pertussis
cgucgaucaggcccagcacga

SEQ ID NO: 2425154 - RNA, 22 nt, Bordetella pertussis
cgucgaucaugaugcgcugggc

SEQ ID NO: 2425155 - RNA, 14 nt, Bordetella pertussis
cgucgaucauggcg

SEQ ID NO: 2425156 - RNA, 17 nt, Bordetella pertussis
cgucgaucauggcgccg

SEQ ID NO: 2425157 - RNA, 17 nt, Bordetella pertussis
cgucgauccggcagcag

SEQ ID NO: 2425158 - RNA, 19 nt, Bordetella pertussis
cgucgauccggcagcagca

SEQ ID NO: 2425159 - RNA, 13 nt, Bordetella pertussis
cgucgaucggcgc

SEQ ID NO: 2425160 - RNA, 17 nt, Bordetella pertussis
cgucgaucggcgcgccc

SEQ ID NO: 2425161 - RNA, 15 nt, Bordetella pertussis
cgucgaucuucgccu

SEQ ID NO: 2425162 - RNA, 22 nt, Bordetella pertussis
cgucgaugaaauauugggcugg

SEQ ID NO: 2425163 - RNA, 14 nt, Bordetella pertussis
cgucgaugaccagc

SEQ ID NO: 2425164 - RNA, 20 nt, Bordetella pertussis
cgucgaugaccagcgccggc

SEQ ID NO: 2425165 - RNA, 15 nt, Bordetella pertussis
cgucgaugccgacca

SEQ ID NO: 2425166 - RNA, 18 nt, Bordetella pertussis
cgucgaugccgaccaggc

SEQ ID NO: 2425167 - RNA, 14 nt, Bordetella pertussis
cgucgaugcgcgcg

SEQ ID NO: 2425168 - RNA, 15 nt, Bordetella pertussis
cgucgaugcgcgcgc

SEQ ID NO: 2425169 - RNA, 16 nt, Bordetella pertussis
cgucgaugcgcgcgcg

SEQ ID NO: 2425170 - RNA, 19 nt, Bordetella pertussis
cgucgaugcgcgcgcggau

SEQ ID NO: 2425171 - RNA, 20 nt, Bordetella pertussis
cgucgauguagagggucugg

SEQ ID NO: 2425172 - RNA, 16 nt, Bordetella pertussis
cgucgcaaaccugccg

SEQ ID NO: 2425173 - RNA, 13 nt, Bordetella pertussis
cgucgcaaagccg

SEQ ID NO: 2425174 - RNA, 21 nt, Bordetella pertussis
cgucgcacuggguggccagcg

SEQ ID NO: 2425175 - RNA, 16 nt, Bordetella pertussis
cgucgcagcacgccca

SEQ ID NO: 2425176 - RNA, 17 nt, Bordetella pertussis
cgucgccaaagcgcagc

SEQ ID NO: 2425177 - RNA, 21 nt, Bordetella pertussis
cgucgccaaagcgcagcguga

SEQ ID NO: 2425178 - RNA, 12 nt, Bordetella pertussis
cgucgccaccgc

SEQ ID NO: 2425179 - RNA, 14 nt, Bordetella pertussis
cgucgccagcgacg

SEQ ID NO: 2425180 - RNA, 22 nt, Bordetella pertussis
cgucgccagggcgaugaccggc

SEQ ID NO: 2425181 - RNA, 17 nt, Bordetella pertussis
cgucgccaugcggcugg

SEQ ID NO: 2425182 - RNA, 18 nt, Bordetella pertussis
cgucgccaugcggcuggc

SEQ ID NO: 2425183 - RNA, 21 nt, Bordetella pertussis
cgucgccaugcggcuggccga

SEQ ID NO: 2425184 - RNA, 12 nt, Bordetella pertussis
cgucgcccacau

SEQ ID NO: 2425185 - RNA, 21 nt, Bordetella pertussis
cgucgcccacauagaccggcu

SEQ ID NO: 2425186 - RNA, 16 nt, Bordetella pertussis
cgucgcccggggcggc

SEQ ID NO: 2425187 - RNA, 20 nt, Bordetella pertussis
cgucgcccggggcggcgucg

SEQ ID NO: 2425188 - RNA, 20 nt, Bordetella pertussis
cgucgcccuugauggccucg

SEQ ID NO: 2425189 - RNA, 23 nt, Bordetella pertussis
cgucgccgaucggcuugccgcgc

SEQ ID NO: 2425190 - RNA, 16 nt, Bordetella pertussis
cgucgccgcccacggc

SEQ ID NO: 2425191 - RNA, 16 nt, Bordetella pertussis
cgucgccgcccaugcg

SEQ ID NO: 2425192 - RNA, 22 nt, Bordetella pertussis
cgucgccgcccaugcgcauggc

SEQ ID NO: 2425193 - RNA, 16 nt, Bordetella pertussis
cgucgccgcccugcug

SEQ ID NO: 2425194 - RNA, 15 nt, Bordetella pertussis
cgucgccgcgcacga

SEQ ID NO: 2425195 - RNA, 12 nt, Bordetella pertussis
cgucgccgcgcc

SEQ ID NO: 2425196 - RNA, 13 nt, Bordetella pertussis
cgucgccgcgccg

SEQ ID NO: 2425197 - RNA, 14 nt, Bordetella pertussis
cgucgccgcgcggc

SEQ ID NO: 2425198 - RNA, 16 nt, Bordetella pertussis
cgucgccgcuggccag

SEQ ID NO: 2425199 - RNA, 14 nt, Bordetella pertussis
cgucgccggccagg

SEQ ID NO: 2425200 - RNA, 14 nt, Bordetella pertussis
cgucgccggcgcug

SEQ ID NO: 2425201 - RNA, 16 nt, Bordetella pertussis
cgucgccggcgcugcu

SEQ ID NO: 2425202 - RNA, 14 nt, Bordetella pertussis
cgucgccggcguug

SEQ ID NO: 2425203 - RNA, 21 nt, Bordetella pertussis
cgucgccugcccgcacgggcc

SEQ ID NO: 2425204 - RNA, 20 nt, Bordetella pertussis
cgucgccuggucgacgccgg

SEQ ID NO: 2425205 - RNA, 21 nt, Bordetella pertussis
cgucgccuggucgacgccggc

SEQ ID NO: 2425206 - RNA, 17 nt, Bordetella pertussis
cgucgccuucggcggcg

SEQ ID NO: 2425207 - RNA, 19 nt, Bordetella pertussis
cgucgcgaaacccucccac

SEQ ID NO: 2425208 - RNA, 15 nt, Bordetella pertussis
cgucgcgaccgccgc

SEQ ID NO: 2425209 - RNA, 15 nt, Bordetella pertussis
cgucgcgaugcgcca

SEQ ID NO: 2425210 - RNA, 21 nt, Bordetella pertussis
cgucgcgaugcgccaggcgcu

SEQ ID NO: 2425211 - RNA, 18 nt, Bordetella pertussis
cgucgcgcacccgcaggc

SEQ ID NO: 2425212 - RNA, 13 nt, Bordetella pertussis
cgucgcgcagcag

SEQ ID NO: 2425213 - RNA, 14 nt, Bordetella pertussis
cgucgcgcagcagg

SEQ ID NO: 2425214 - RNA, 23 nt, Bordetella pertussis
cgucgcgcagcaggguggccacg

SEQ ID NO: 2425215 - RNA, 17 nt, Bordetella pertussis
cgucgcgccaggccggc

SEQ ID NO: 2425216 - RNA, 14 nt, Bordetella pertussis
cgucgcgcgcacgc

SEQ ID NO: 2425217 - RNA, 12 nt, Bordetella pertussis
cgucgcgcgcca

SEQ ID NO: 2425218 - RNA, 18 nt, Bordetella pertussis
cgucgcgcgccaggcggu

SEQ ID NO: 2425219 - RNA, 14 nt, Bordetella pertussis
cgucgcgcggcggc

SEQ ID NO: 2425220 - RNA, 15 nt, Bordetella pertussis
cgucgcgcggcggca

SEQ ID NO: 2425221 - RNA, 14 nt, Bordetella pertussis
cgucgcgcucggac

SEQ ID NO: 2425222 - RNA, 12 nt, Bordetella pertussis
cgucgcgcugca

SEQ ID NO: 2425223 - RNA, 15 nt, Bordetella pertussis
cgucgcgcuggcccc

SEQ ID NO: 2425224 - RNA, 17 nt, Bordetella pertussis
cgucgcgcuggccccag

SEQ ID NO: 2425225 - RNA, 14 nt, Bordetella pertussis
cgucgcgcuggggc

SEQ ID NO: 2425226 - RNA, 16 nt, Bordetella pertussis
cgucgcgcuggggcag

SEQ ID NO: 2425227 - RNA, 14 nt, Bordetella pertussis
cgucgcggaccucc

SEQ ID NO: 2425228 - RNA, 19 nt, Bordetella pertussis
cgucgcggaccuccugguc

SEQ ID NO: 2425229 - RNA, 13 nt, Bordetella pertussis
cgucgcggcgucg

SEQ ID NO: 2425230 - RNA, 15 nt, Bordetella pertussis
cgucgcgguccagca

SEQ ID NO: 2425231 - RNA, 20 nt, Bordetella pertussis
cgucgcgguccagcaccagg

SEQ ID NO: 2425232 - RNA, 14 nt, Bordetella pertussis
cgucgucgccgucg

SEQ ID NO: 2425233 - RNA, 16 nt, Bordetella pertussis
cgucgucgguggggca

SEQ ID NO: 2425234 - RNA, 21 nt, Bordetella pertussis
cgucgucgguggggcaggucg

SEQ ID NO: 2425235 - RNA, 23 nt, Bordetella pertussis
cgucgucguucugcguggcggcg

SEQ ID NO: 2425236 - RNA, 21 nt, Bordetella pertussis
cgucgugcagcgugggcucga

SEQ ID NO: 2425237 - RNA, 23 nt, Bordetella pertussis
cgucgugcccucgggaaacaggc

SEQ ID NO: 2425238 - RNA, 18 nt, Bordetella pertussis
cgucgugcgccuggcggc

SEQ ID NO: 2425239 - RNA, 16 nt, Bordetella pertussis
cgucguggggcgcggc

SEQ ID NO: 2425240 - RNA, 19 nt, Bordetella pertussis
cgucguggggcgcggcggc

SEQ ID NO: 2425241 - RNA, 15 nt, Bordetella pertussis
cgucguugcgccgau

SEQ ID NO: 2425242 - RNA, 20 nt, Bordetella pertussis
cgucguuucccagcaagccg

SEQ ID NO: 2425243 - RNA, 21 nt, Bordetella pertussis
cgucuacaggcccagcgccag

SEQ ID NO: 2425244 - RNA, 23 nt, Bordetella pertussis
cgucuacaggcccagcgccagca

SEQ ID NO: 2425245 - RNA, 14 nt, Bordetella pertussis
cgucuacgcgaacc

SEQ ID NO: 2425246 - RNA, 22 nt, Bordetella pertussis
cgucuccacgccgccgaccucg

SEQ ID NO: 2425247 - RNA, 17 nt, Bordetella pertussis
cgucuccagcgccggca

SEQ ID NO: 2425248 - RNA, 13 nt, Bordetella pertussis
cgucuccagcgcg

SEQ ID NO: 2425249 - RNA, 17 nt, Bordetella pertussis
cgucucgaacgccgcgu

SEQ ID NO: 2425250 - RNA, 11 nt, Bordetella pertussis
cgucucgccca

SEQ ID NO: 2425251 - RNA, 20 nt, Bordetella pertussis
cgucucgcccacccccggca

SEQ ID NO: 2425252 - RNA, 14 nt, Bordetella pertussis
cgucucgcccaggc

SEQ ID NO: 2425253 - RNA, 20 nt, Bordetella pertussis
cgucucgcccaggcccagca

SEQ ID NO: 2425254 - RNA, 14 nt, Bordetella pertussis
cgucucgcgcgcca

SEQ ID NO: 2425255 - RNA, 15 nt, Bordetella pertussis
cgucucgcgcgccag

SEQ ID NO: 2425256 - RNA, 16 nt, Bordetella pertussis
cgucucgcgcgccagg

SEQ ID NO: 2425257 - RNA, 17 nt, Bordetella pertussis
cgucucgcgcgccaggu

SEQ ID NO: 2425258 - RNA, 23 nt, Bordetella pertussis
cgucucgguggaggacgccgacc

SEQ ID NO: 2425259 - RNA, 12 nt, Bordetella pertussis
cgucugagcgcc

SEQ ID NO: 2425260 - RNA, 15 nt, Bordetella pertussis
cgucugagcgccggg

SEQ ID NO: 2425261 - RNA, 13 nt, Bordetella pertussis
cgucugcgcaucg

SEQ ID NO: 2425262 - RNA, 22 nt, Bordetella pertussis
cgucugcgcaucgaugcggccu

SEQ ID NO: 2425263 - RNA, 18 nt, Bordetella pertussis
cgucugcgccgccgcgug

SEQ ID NO: 2425264 - RNA, 20 nt, Bordetella pertussis
cgucugcgccgccgcguggc

SEQ ID NO: 2425265 - RNA, 20 nt, Bordetella pertussis
cgucugcuacaccgugcugg

SEQ ID NO: 2425266 - RNA, 13 nt, Bordetella pertussis
cgucugcucgccg

SEQ ID NO: 2425267 - RNA, 17 nt, Bordetella pertussis
cgucuggagcggccugg

SEQ ID NO: 2425268 - RNA, 18 nt, Bordetella pertussis
cgucuggcacgcuugccg

SEQ ID NO: 2425269 - RNA, 15 nt, Bordetella pertussis
cgucuggcggcagcu

SEQ ID NO: 2425270 - RNA, 23 nt, Bordetella pertussis
cgucugggcgugaaaggccagcg

SEQ ID NO: 2425271 - RNA, 18 nt, Bordetella pertussis
cgucuucaguugacgccg

SEQ ID NO: 2425272 - RNA, 20 nt, Bordetella pertussis
cgucuucaguugacgccggc

SEQ ID NO: 2425273 - RNA, 16 nt, Bordetella pertussis
cgucuucgccgaccag

SEQ ID NO: 2425274 - RNA, 17 nt, Bordetella pertussis
cgucuucgccgaccagc

SEQ ID NO: 2425275 - RNA, 17 nt, Bordetella pertussis
cgucuucggcgcggcgg

SEQ ID NO: 2425276 - RNA, 16 nt, Bordetella pertussis
cgucuucguacagccu

SEQ ID NO: 2425277 - RNA, 22 nt, Bordetella pertussis
cgucuugaggauaucggccagg

SEQ ID NO: 2425278 - RNA, 16 nt, Bordetella pertussis
cgucuugcccgccagc

SEQ ID NO: 2425279 - RNA, 17 nt, Bordetella pertussis
cgucuugcccgccagcg

SEQ ID NO: 2425280 - RNA, 21 nt, Bordetella pertussis
cgucuugcccgccagcgcggc

SEQ ID NO: 2425281 - RNA, 22 nt, Bordetella pertussis
cgucuugcccgccagcgcggcu

SEQ ID NO: 2425282 - RNA, 18 nt, Bordetella pertussis
cgucuugcgcccgcaucg

SEQ ID NO: 2425283 - RNA, 16 nt, Bordetella pertussis
cgucuuuucguccucg

SEQ ID NO: 2425284 - RNA, 14 nt, Bordetella pertussis
cgugaaagcuccac

SEQ ID NO: 2425285 - RNA, 16 nt, Bordetella pertussis
cgugaaaggccagcgg

SEQ ID NO: 2425286 - RNA, 17 nt, Bordetella pertussis
cgugaaaggccagcggc

SEQ ID NO: 2425287 - RNA, 18 nt, Bordetella pertussis
cgugaaaggccagcggcg

SEQ ID NO: 2425288 - RNA, 15 nt, Bordetella pertussis
cgugaacgccccggc

SEQ ID NO: 2425289 - RNA, 16 nt, Bordetella pertussis
cgugaacggcucgagc

SEQ ID NO: 2425290 - RNA, 23 nt, Bordetella pertussis
cgugaagccguccuugagggcgc

SEQ ID NO: 2425291 - RNA, 17 nt, Bordetella pertussis
cgugaagccuucggucg

SEQ ID NO: 2425292 - RNA, 13 nt, Bordetella pertussis
cgugaagcgccgc

SEQ ID NO: 2425293 - RNA, 20 nt, Bordetella pertussis
cgugaaggugccggacgccc

SEQ ID NO: 2425294 - RNA, 14 nt, Bordetella pertussis
cgugaagucggccg

SEQ ID NO: 2425295 - RNA, 18 nt, Bordetella pertussis
cgugaauaccgcgcacag

SEQ ID NO: 2425296 - RNA, 14 nt, Bordetella pertussis
cgugaccagcugca

SEQ ID NO: 2425297 - RNA, 19 nt, Bordetella pertussis
cgugacccggggcaggaag

SEQ ID NO: 2425298 - RNA, 16 nt, Bordetella pertussis
cgugaccgacaggccu

SEQ ID NO: 2425299 - RNA, 17 nt, Bordetella pertussis
cgugaccgacaggccug

SEQ ID NO: 2425300 - RNA, 18 nt, Bordetella pertussis
cgugaccgcgacgcgccu

SEQ ID NO: 2425301 - RNA, 17 nt, Bordetella pertussis
cgugaccggacugucca

SEQ ID NO: 2425302 - RNA, 21 nt, Bordetella pertussis
cgugaccggacuguccacgca

SEQ ID NO: 2425303 - RNA, 16 nt, Bordetella pertussis
cgugaccugcgucugc

SEQ ID NO: 2425304 - RNA, 20 nt, Bordetella pertussis
cgugaccugcgucugcgugc

SEQ ID NO: 2425305 - RNA, 14 nt, Bordetella pertussis
cgugaccugcucgu

SEQ ID NO: 2425306 - RNA, 19 nt, Bordetella pertussis
cgugacgauauccaggcgc

SEQ ID NO: 2425307 - RNA, 15 nt, Bordetella pertussis
cgugacgcugacccu

SEQ ID NO: 2425308 - RNA, 18 nt, Bordetella pertussis
cgugacgcugacccuggc

SEQ ID NO: 2425309 - RNA, 16 nt, Bordetella pertussis
cgugacgcugauggcc

SEQ ID NO: 2425310 - RNA, 20 nt, Bordetella pertussis
cgugacgcugauggccgcca

SEQ ID NO: 2425311 - RNA, 22 nt, Bordetella pertussis
cgugacgcuggagauggcgccg

SEQ ID NO: 2425312 - RNA, 13 nt, Bordetella pertussis
cgugacgcuggcc

SEQ ID NO: 2425313 - RNA, 17 nt, Bordetella pertussis
cgugacgcuggcccugu

SEQ ID NO: 2425314 - RNA, 13 nt, Bordetella pertussis
cgugacggcggcg

SEQ ID NO: 2425315 - RNA, 19 nt, Bordetella pertussis
cgugacggcggcgcgcgga

SEQ ID NO: 2425316 - RNA, 16 nt, Bordetella pertussis
cgugacguugagcgcc

SEQ ID NO: 2425317 - RNA, 16 nt, Bordetella pertussis
cgugacguugccgcgc

SEQ ID NO: 2425318 - RNA, 17 nt, Bordetella pertussis
cgugacguugccgcgcg

SEQ ID NO: 2425319 - RNA, 18 nt, Bordetella pertussis
cgugacguugccgcgcgc

SEQ ID NO: 2425320 - RNA, 14 nt, Bordetella pertussis
cgugacuucggccg

SEQ ID NO: 2425321 - RNA, 16 nt, Bordetella pertussis
cgugacuucggccgcc

SEQ ID NO: 2425322 - RNA, 20 nt, Bordetella pertussis
cgugacuucggccgccagcc

SEQ ID NO: 2425323 - RNA, 21 nt, Bordetella pertussis
cgugacuucggccgccagccg

SEQ ID NO: 2425324 - RNA, 15 nt, Bordetella pertussis
cgugagcacgacguu

SEQ ID NO: 2425325 - RNA, 13 nt, Bordetella pertussis
cgugagcgccgcc

SEQ ID NO: 2425326 - RNA, 14 nt, Bordetella pertussis
cgugagcgccgccg

SEQ ID NO: 2425327 - RNA, 17 nt, Bordetella pertussis
cgugagcgccgccgcca

SEQ ID NO: 2425328 - RNA, 18 nt, Bordetella pertussis
cgugagcgccgccgccau

SEQ ID NO: 2425329 - RNA, 14 nt, Bordetella pertussis
cgugagcgccucga

SEQ ID NO: 2425330 - RNA, 16 nt, Bordetella pertussis
cgugauaguccacccc

SEQ ID NO: 2425331 - RNA, 16 nt, Bordetella pertussis
cgugauauagaccagc

SEQ ID NO: 2425332 - RNA, 21 nt, Bordetella pertussis
cgugauauagaccagcagcuc

SEQ ID NO: 2425333 - RNA, 18 nt, Bordetella pertussis
cgugaucgaccgccagca

SEQ ID NO: 2425334 - RNA, 20 nt, Bordetella pertussis
cgugaucgaccgccagcagg

SEQ ID NO: 2425335 - RNA, 14 nt, Bordetella pertussis
cgugaucgccagcg

SEQ ID NO: 2425336 - RNA, 17 nt, Bordetella pertussis
cgugaucgccagcgccg

SEQ ID NO: 2425337 - RNA, 23 nt, Bordetella pertussis
cgugaucgccagcgccgggguca

SEQ ID NO: 2425338 - RNA, 15 nt, Bordetella pertussis
cgugaucggcgcaac

SEQ ID NO: 2425339 - RNA, 22 nt, Bordetella pertussis
cgugaucggcgcaaccggcccg

SEQ ID NO: 2425340 - RNA, 17 nt, Bordetella pertussis
cgugaucuugaugccgc

SEQ ID NO: 2425341 - RNA, 23 nt, Bordetella pertussis
cgugaucuugaugccgcccagca

SEQ ID NO: 2425342 - RNA, 17 nt, Bordetella pertussis
cgugaugcccaggcccu

SEQ ID NO: 2425343 - RNA, 21 nt, Bordetella pertussis
cgugaugcccaggcccuggcu

SEQ ID NO: 2425344 - RNA, 14 nt, Bordetella pertussis
cgugaugccccagg

SEQ ID NO: 2425345 - RNA, 18 nt, Bordetella pertussis
cgugcgcccauggcgcgc

SEQ ID NO: 2425346 - RNA, 20 nt, Bordetella pertussis
cgugcgcccauggcgcgcag

SEQ ID NO: 2425347 - RNA, 12 nt, Bordetella pertussis
cgugcgccccgc

SEQ ID NO: 2425348 - RNA, 15 nt, Bordetella pertussis
cgugcgccccgccuc

SEQ ID NO: 2425349 - RNA, 14 nt, Bordetella pertussis
cgugcgcccgacgc

SEQ ID NO: 2425350 - RNA, 13 nt, Bordetella pertussis
cgugcgccgggcg

SEQ ID NO: 2425351 - RNA, 14 nt, Bordetella pertussis
cgugcgccgggcgu

SEQ ID NO: 2425352 - RNA, 13 nt, Bordetella pertussis
cgugcgccgggcu

SEQ ID NO: 2425353 - RNA, 17 nt, Bordetella pertussis
cgugcgccuguccccgc

SEQ ID NO: 2425354 - RNA, 17 nt, Bordetella pertussis
cgugcgcgaccgcgcgg

SEQ ID NO: 2425355 - RNA, 18 nt, Bordetella pertussis
cgugcgcgaccgcgcggc

SEQ ID NO: 2425356 - RNA, 16 nt, Bordetella pertussis
cgugcgcgaccuccgg

SEQ ID NO: 2425357 - RNA, 14 nt, Bordetella pertussis
cgugcgcgagcugg

SEQ ID NO: 2425358 - RNA, 16 nt, Bordetella pertussis
cgugcgcgagcugguc

SEQ ID NO: 2425359 - RNA, 20 nt, Bordetella pertussis
cgugcgcgagggcuucgacu

SEQ ID NO: 2425360 - RNA, 15 nt, Bordetella pertussis
cgugcgcgcccgaug

SEQ ID NO: 2425361 - RNA, 19 nt, Bordetella pertussis
cgugcgcgcccgaugcccc

SEQ ID NO: 2425362 - RNA, 13 nt, Bordetella pertussis
cgugcgcgcgcca

SEQ ID NO: 2425363 - RNA, 15 nt, Bordetella pertussis
cgugcgcggccgcgc

SEQ ID NO: 2425364 - RNA, 20 nt, Bordetella pertussis
cgugcgcggcgagccgcgcg

SEQ ID NO: 2425365 - RNA, 18 nt, Bordetella pertussis
cgugcgcgggcgccaucg

SEQ ID NO: 2425366 - RNA, 21 nt, Bordetella pertussis
cgugcgcgguucaggcuugca

SEQ ID NO: 2425367 - RNA, 16 nt, Bordetella pertussis
cgugcgcuggcugggc

SEQ ID NO: 2425368 - RNA, 18 nt, Bordetella pertussis
cgugcgcuggcugggccu

SEQ ID NO: 2425369 - RNA, 21 nt, Bordetella pertussis
cgugcgcuugcgcauggccgg

SEQ ID NO: 2425370 - RNA, 22 nt, Bordetella pertussis
cgugcgcuugcgcauggccggu

SEQ ID NO: 2425371 - RNA, 19 nt, Bordetella pertussis
cgugcggacacugacgugg

SEQ ID NO: 2425372 - RNA, 16 nt, Bordetella pertussis
cgugcggaugcagcag

SEQ ID NO: 2425373 - RNA, 20 nt, Bordetella pertussis
cgugcggauggucgagcgcc

SEQ ID NO: 2425374 - RNA, 21 nt, Bordetella pertussis
cgugcggauggucgagcgccu

SEQ ID NO: 2425375 - RNA, 16 nt, Bordetella pertussis
cgugcggcacgcacag

SEQ ID NO: 2425376 - RNA, 21 nt, Bordetella pertussis
cgugcggcacgcacagcaugc

SEQ ID NO: 2425377 - RNA, 16 nt, Bordetella pertussis
cgugcggcccagccgc

SEQ ID NO: 2425378 - RNA, 16 nt, Bordetella pertussis
cgugcggccgcagcag

SEQ ID NO: 2425379 - RNA, 17 nt, Bordetella pertussis
cgugcggccgcagcagu

SEQ ID NO: 2425380 - RNA, 14 nt, Bordetella pertussis
cgugcgggccugca

SEQ ID NO: 2425381 - RNA, 15 nt, Bordetella pertussis
cgugcgggccugcag

SEQ ID NO: 2425382 - RNA, 19 nt, Bordetella pertussis
cgugcggggaccggcaccc

SEQ ID NO: 2425383 - RNA, 20 nt, Bordetella pertussis
cgugcggggcggcaggucgc

SEQ ID NO: 2425384 - RNA, 15 nt, Bordetella pertussis
cgugcgggugccugu

SEQ ID NO: 2425385 - RNA, 22 nt, Bordetella pertussis
cgugcgguucgucagggccgca

SEQ ID NO: 2425386 - RNA, 14 nt, Bordetella pertussis
cgugcgugaccacg

SEQ ID NO: 2425387 - RNA, 16 nt, Bordetella pertussis
cgugcgugacgcugga

SEQ ID NO: 2425388 - RNA, 13 nt, Bordetella pertussis
cgugcgugccgac

SEQ ID NO: 2425389 - RNA, 16 nt, Bordetella pertussis
cgugcgugcgccuguc

SEQ ID NO: 2425390 - RNA, 17 nt, Bordetella pertussis
cgugcguuucggacccg

SEQ ID NO: 2425391 - RNA, 16 nt, Bordetella pertussis
cgugcucaucggcagg

SEQ ID NO: 2425392 - RNA, 17 nt, Bordetella pertussis
cgugcucaucggcaggc

SEQ ID NO: 2425393 - RNA, 19 nt, Bordetella pertussis
cgugcucaucggcaggccg

SEQ ID NO: 2425394 - RNA, 22 nt, Bordetella pertussis
cgugcucaucggcaggccggcg

SEQ ID NO: 2425395 - RNA, 17 nt, Bordetella pertussis
cgugcuccagaacgcgc

SEQ ID NO: 2425396 - RNA, 18 nt, Bordetella pertussis
cgugcuccagaacgcgcc

SEQ ID NO: 2425397 - RNA, 19 nt, Bordetella pertussis
cgugcuccagaacgcgccg

SEQ ID NO: 2425398 - RNA, 14 nt, Bordetella pertussis
cgugcugaacgcgc

SEQ ID NO: 2425399 - RNA, 17 nt, Bordetella pertussis
cgugcugcaccugcguc

SEQ ID NO: 2425400 - RNA, 13 nt, Bordetella pertussis
cgugcugcagggc

SEQ ID NO: 2425401 - RNA, 20 nt, Bordetella pertussis
cgugcugcgcguggccauca

SEQ ID NO: 2425402 - RNA, 23 nt, Bordetella pertussis
cgugcugcggcugaucaccgccg

SEQ ID NO: 2425403 - RNA, 16 nt, Bordetella pertussis
cgugcugcugcaggcg

SEQ ID NO: 2425404 - RNA, 12 nt, Bordetella pertussis
cgugcuggaggu

SEQ ID NO: 2425405 - RNA, 13 nt, Bordetella pertussis
cgugcuggccgac

SEQ ID NO: 2425406 - RNA, 14 nt, Bordetella pertussis
cgugcuggccgacg

SEQ ID NO: 2425407 - RNA, 19 nt, Bordetella pertussis
cgugcuggcgcagcagcgc

SEQ ID NO: 2425408 - RNA, 21 nt, Bordetella pertussis
cgugcuggcgcagcagcgccg

SEQ ID NO: 2425409 - RNA, 13 nt, Bordetella pertussis
cgugcuggcgcgu

SEQ ID NO: 2425410 - RNA, 16 nt, Bordetella pertussis
cgugcugggcggccag

SEQ ID NO: 2425411 - RNA, 18 nt, Bordetella pertussis
cgugcugggcggccaggc

SEQ ID NO: 2425412 - RNA, 23 nt, Bordetella pertussis
cgugcuggucauugaccugcuug

SEQ ID NO: 2425413 - RNA, 21 nt, Bordetella pertussis
cgugcuguaccucagccugcu

SEQ ID NO: 2425414 - RNA, 14 nt, Bordetella pertussis
cgugcuugccgccg

SEQ ID NO: 2425415 - RNA, 18 nt, Bordetella pertussis
cgugcuugccgccggacg

SEQ ID NO: 2425416 - RNA, 18 nt, Bordetella pertussis
cguggacaggcaccugcg

SEQ ID NO: 2425417 - RNA, 21 nt, Bordetella pertussis
cguggacgaauacgcuggcgc

SEQ ID NO: 2425418 - RNA, 18 nt, Bordetella pertussis
cguggacgugcgcgaccg

SEQ ID NO: 2425419 - RNA, 19 nt, Bordetella pertussis
cguggacgugcgcgaccgc

SEQ ID NO: 2425420 - RNA, 15 nt, Bordetella pertussis
cguggacucgauggc

SEQ ID NO: 2425421 - RNA, 16 nt, Bordetella pertussis
cguggacucgauggcg

SEQ ID NO: 2425422 - RNA, 20 nt, Bordetella pertussis
cguggacucgauggcgcagg

SEQ ID NO: 2425423 - RNA, 20 nt, Bordetella pertussis
cguggaugaugcgcgagccg

SEQ ID NO: 2425424 - RNA, 21 nt, Bordetella pertussis
cguggaugaugcgcgagccgc

SEQ ID NO: 2425425 - RNA, 18 nt, Bordetella pertussis
cguggaugauggucugcc

SEQ ID NO: 2425426 - RNA, 19 nt, Bordetella pertussis
cguggauuuugcggaaggc

SEQ ID NO: 2425427 - RNA, 17 nt, Bordetella pertussis
cguggcaggugcggccg

SEQ ID NO: 2425428 - RNA, 14 nt, Bordetella pertussis
cguggccaagggcg

SEQ ID NO: 2425429 - RNA, 16 nt, Bordetella pertussis
cguggccaagggcgcc

SEQ ID NO: 2425430 - RNA, 19 nt, Bordetella pertussis
cguggccaagggcgccgcg

SEQ ID NO: 2425431 - RNA, 20 nt, Bordetella pertussis
cguggccaagggcgccgcgc

SEQ ID NO: 2425432 - RNA, 23 nt, Bordetella pertussis
cguggccaagggcgccgcgccgg

SEQ ID NO: 2425433 - RNA, 13 nt, Bordetella pertussis
cguggccaccagg

SEQ ID NO: 2425434 - RNA, 14 nt, Bordetella pertussis
cguggccaccaggc

SEQ ID NO: 2425435 - RNA, 16 nt, Bordetella pertussis
cguggccaccaggcgc

SEQ ID NO: 2425436 - RNA, 18 nt, Bordetella pertussis
cguggccacggccgcgau

SEQ ID NO: 2425437 - RNA, 14 nt, Bordetella pertussis
cguggccagcacgg

SEQ ID NO: 2425438 - RNA, 18 nt, Bordetella pertussis
cguggccagcacggcgca

SEQ ID NO: 2425439 - RNA, 22 nt, Bordetella pertussis
cguggccagcacggcgcacacc

SEQ ID NO: 2425440 - RNA, 13 nt, Bordetella pertussis
cguggccaucaac

SEQ ID NO: 2425441 - RNA, 17 nt, Bordetella pertussis
cguggcccagcaccgcc

SEQ ID NO: 2425442 - RNA, 17 nt, Bordetella pertussis
cguggcccagccgcaug

SEQ ID NO: 2425443 - RNA, 20 nt, Bordetella pertussis
cguggcccagccgcaugccg

SEQ ID NO: 2425444 - RNA, 14 nt, Bordetella pertussis
cguggcccagccgg

SEQ ID NO: 2425445 - RNA, 16 nt, Bordetella pertussis
cguggccccaggcgug

SEQ ID NO: 2425446 - RNA, 18 nt, Bordetella pertussis
cguggcccgcgugacggc

SEQ ID NO: 2425447 - RNA, 21 nt, Bordetella pertussis
cguggcccgcgugacggccgc

SEQ ID NO: 2425448 - RNA, 14 nt, Bordetella pertussis
cguggccgccacca

SEQ ID NO: 2425449 - RNA, 17 nt, Bordetella pertussis
cguggccgccaccagcg

SEQ ID NO: 2425450 - RNA, 21 nt, Bordetella pertussis
cguggccgcgcaaggccugcu

SEQ ID NO: 2425451 - RNA, 19 nt, Bordetella pertussis
cguggccgcuucggcggcc

SEQ ID NO: 2425452 - RNA, 23 nt, Bordetella pertussis
cguggccgcuucggcggccaugg

SEQ ID NO: 2425453 - RNA, 14 nt, Bordetella pertussis
cguggccggcaucg

SEQ ID NO: 2425454 - RNA, 13 nt, Bordetella pertussis
cguggccggcggg

SEQ ID NO: 2425455 - RNA, 17 nt, Bordetella pertussis
cguggccgggcccggcg

SEQ ID NO: 2425456 - RNA, 22 nt, Bordetella pertussis
cguggccgggcccggcgcgccu

SEQ ID NO: 2425457 - RNA, 18 nt, Bordetella pertussis
cguggccgugcgaggcga

SEQ ID NO: 2425458 - RNA, 19 nt, Bordetella pertussis
cguguugcgugcgagcaga

SEQ ID NO: 2425459 - RNA, 16 nt, Bordetella pertussis
cguguuguccuggaca

SEQ ID NO: 2425460 - RNA, 19 nt, Bordetella pertussis
cguguugucuuuuuucauc

SEQ ID NO: 2425461 - RNA, 22 nt, Bordetella pertussis
cguguuguucagguuggcaacg

SEQ ID NO: 2425462 - RNA, 18 nt, Bordetella pertussis
cguuaugguucggccucg

SEQ ID NO: 2425463 - RNA, 14 nt, Bordetella pertussis
cguucaagucgccc

SEQ ID NO: 2425464 - RNA, 19 nt, Bordetella pertussis
cguucacgcccgagauggc

SEQ ID NO: 2425465 - RNA, 17 nt, Bordetella pertussis
cguucacgccggcgcgc

SEQ ID NO: 2425466 - RNA, 20 nt, Bordetella pertussis
cguucacgccggcgcgccgg

SEQ ID NO: 2425467 - RNA, 15 nt, Bordetella pertussis
cguucacgcgcagcg

SEQ ID NO: 2425468 - RNA, 16 nt, Bordetella pertussis
cguucacgcgcagcgu

SEQ ID NO: 2425469 - RNA, 22 nt, Bordetella pertussis
cguucacguagaaauacgcgcg

SEQ ID NO: 2425470 - RNA, 12 nt, Bordetella pertussis
cguucagcagca

SEQ ID NO: 2425471 - RNA, 16 nt, Bordetella pertussis
cguucagcgggcgcgc

SEQ ID NO: 2425472 - RNA, 18 nt, Bordetella pertussis
cguucagcgggcgcgccc

SEQ ID NO: 2425473 - RNA, 19 nt, Bordetella pertussis
cguucagcgggcgcgcccg

SEQ ID NO: 2425474 - RNA, 22 nt, Bordetella pertussis
cguucagcgggcgcgcccggcg

SEQ ID NO: 2425475 - RNA, 15 nt, Bordetella pertussis
cguucaggcgcggcu

SEQ ID NO: 2425476 - RNA, 19 nt, Bordetella pertussis
cguucagggacgggccagc

SEQ ID NO: 2425477 - RNA, 16 nt, Bordetella pertussis
cguucagggcgccgcg

SEQ ID NO: 2425478 - RNA, 22 nt, Bordetella pertussis
cguucagggcgccgcggcggcg

SEQ ID NO: 2425479 - RNA, 21 nt, Bordetella pertussis
cguucaucagcgcgcgcagcc

SEQ ID NO: 2425480 - RNA, 17 nt, Bordetella pertussis
cguucaugccgaccacg

SEQ ID NO: 2425481 - RNA, 16 nt, Bordetella pertussis
cguucaugucgcgggu

SEQ ID NO: 2425482 - RNA, 22 nt, Bordetella pertussis
cguucaugucgcgggugcgggc

SEQ ID NO: 2425483 - RNA, 20 nt, Bordetella pertussis
cguuccagaugcgcagcagg

SEQ ID NO: 2425484 - RNA, 13 nt, Bordetella pertussis
cguuccagcaugu

SEQ ID NO: 2425485 - RNA, 15 nt, Bordetella pertussis
cguuccagcugcuuc

SEQ ID NO: 2425486 - RNA, 21 nt, Bordetella pertussis
cguuccaugacguccagcgcc

SEQ ID NO: 2425487 - RNA, 20 nt, Bordetella pertussis
cguuccccaucaucugcggc

SEQ ID NO: 2425488 - RNA, 14 nt, Bordetella pertussis
cguucccgccgggc

SEQ ID NO: 2425489 - RNA, 15 nt, Bordetella pertussis
cguucccgccgggcu

SEQ ID NO: 2425490 - RNA, 21 nt, Bordetella pertussis
cguucccgccgggcuccucgc

SEQ ID NO: 2425491 - RNA, 19 nt, Bordetella pertussis
cguucccuacccgccgggc

SEQ ID NO: 2425492 - RNA, 13 nt, Bordetella pertussis
cguuccggccgcg

SEQ ID NO: 2425493 - RNA, 18 nt, Bordetella pertussis
cguuccggccgcgccagc

SEQ ID NO: 2425494 - RNA, 13 nt, Bordetella pertussis
cguuccuggcgcu

SEQ ID NO: 2425495 - RNA, 17 nt, Bordetella pertussis
cguucgaaagccagcgc

SEQ ID NO: 2425496 - RNA, 15 nt, Bordetella pertussis
cguucgaaguccgcg

SEQ ID NO: 2425497 - RNA, 18 nt, Bordetella pertussis
cguucgacuucguccggc

SEQ ID NO: 2425498 - RNA, 19 nt, Bordetella pertussis
cguucgcaccagucccgca

SEQ ID NO: 2425499 - RNA, 15 nt, Bordetella pertussis
cguucgcccgugccg

SEQ ID NO: 2425500 - RNA, 13 nt, Bordetella pertussis
cguucgccgucga

SEQ ID NO: 2425501 - RNA, 21 nt, Bordetella pertussis
cguucgcgccaggcgccgggc

SEQ ID NO: 2425502 - RNA, 14 nt, Bordetella pertussis
cguucgcgccgcgu

SEQ ID NO: 2425503 - RNA, 15 nt, Bordetella pertussis
cguucgcgcugccca

SEQ ID NO: 2425504 - RNA, 12 nt, Bordetella pertussis
cguucgcggccc

SEQ ID NO: 2425505 - RNA, 12 nt, Bordetella pertussis
cguucggccacu

SEQ ID NO: 2425506 - RNA, 17 nt, Bordetella pertussis
cguucggccacuuccug

SEQ ID NO: 2425507 - RNA, 12 nt, Bordetella pertussis
cguucggccagc

SEQ ID NO: 2425508 - RNA, 16 nt, Bordetella pertussis
cguucggccagcccca

SEQ ID NO: 2425509 - RNA, 15 nt, Bordetella pertussis
cguucggccagcgcg

SEQ ID NO: 2425510 - RNA, 23 nt, Bordetella pertussis
cguucggccagcgcgcggcgcag

SEQ ID NO: 2425511 - RNA, 22 nt, Bordetella pertussis
cguucgggcggcaggugcgcca

SEQ ID NO: 2425512 - RNA, 20 nt, Bordetella pertussis
cguucggggacaggcaccca

SEQ ID NO: 2425513 - RNA, 16 nt, Bordetella pertussis
cguucggggcgucgcu

SEQ ID NO: 2425514 - RNA, 19 nt, Bordetella pertussis
cguucggggcgucgcugcu

SEQ ID NO: 2425515 - RNA, 21 nt, Bordetella pertussis
cguucggugcgcagcggcagg

SEQ ID NO: 2425516 - RNA, 22 nt, Bordetella pertussis
cguucggugcgcagcggcaggc

SEQ ID NO: 2425517 - RNA, 17 nt, Bordetella pertussis
cguucguauugcugcug

SEQ ID NO: 2425518 - RNA, 19 nt, Bordetella pertussis
cguucguauugcugcugcu

SEQ ID NO: 2425519 - RNA, 19 nt, Bordetella pertussis
cguucucagccgcccgccg

SEQ ID NO: 2425520 - RNA, 22 nt, Bordetella pertussis
cguucucagccgcccgccgggc

SEQ ID NO: 2425521 - RNA, 14 nt, Bordetella pertussis
cguucuccagcgcc

SEQ ID NO: 2425522 - RNA, 15 nt, Bordetella pertussis
cguucuccagcgccg

SEQ ID NO: 2425523 - RNA, 16 nt, Bordetella pertussis
cguucucgacccgcuc

SEQ ID NO: 2425524 - RNA, 23 nt, Bordetella pertussis
cguucucgacccgcucggccacg

SEQ ID NO: 2425525 - RNA, 14 nt, Bordetella pertussis
cguucugcagcgcg

SEQ ID NO: 2425526 - RNA, 20 nt, Bordetella pertussis
cguucugcagcgcggugcgg

SEQ ID NO: 2425527 - RNA, 14 nt, Bordetella pertussis
cguucugcgcgccc

SEQ ID NO: 2425528 - RNA, 18 nt, Bordetella pertussis
cguucugcgcgcccgugu

SEQ ID NO: 2425529 - RNA, 20 nt, Bordetella pertussis
cguucugcguggcggcgucg

SEQ ID NO: 2425530 - RNA, 22 nt, Bordetella pertussis
cguucuggcgcagcaaggcgcg

SEQ ID NO: 2425531 - RNA, 23 nt, Bordetella pertussis
cguucuggcgcagcaaggcgcgc

SEQ ID NO: 2425532 - RNA, 18 nt, Bordetella pertussis
cguucuggcugcgcgccu

SEQ ID NO: 2425533 - RNA, 16 nt, Bordetella pertussis
cguucugggagcgcgg

SEQ ID NO: 2425534 - RNA, 23 nt, Bordetella pertussis
cguucugggagcgcgggccgccg

SEQ ID NO: 2425535 - RNA, 18 nt, Bordetella pertussis
cguucuggucagccgugu

SEQ ID NO: 2425536 - RNA, 17 nt, Bordetella pertussis
cguucuuccgcacgccg

SEQ ID NO: 2425537 - RNA, 17 nt, Bordetella pertussis
cguugaagcgcagccac

SEQ ID NO: 2425538 - RNA, 15 nt, Bordetella pertussis
cguugaaguccggau

SEQ ID NO: 2425539 - RNA, 15 nt, Bordetella pertussis
cguugaccggcuggc

SEQ ID NO: 2425540 - RNA, 13 nt, Bordetella pertussis
cguugaccuugcc

SEQ ID NO: 2425541 - RNA, 18 nt, Bordetella pertussis
cguugacggggacgccgg

SEQ ID NO: 2425542 - RNA, 22 nt, Bordetella pertussis
cguugacucuaguucuauauag

SEQ ID NO: 2425543 - RNA, 17 nt, Bordetella pertussis
cguugagcagcaugugc

SEQ ID NO: 2425544 - RNA, 19 nt, Bordetella pertussis
cguugaggguuucgacgcc

SEQ ID NO: 2425545 - RNA, 14 nt, Bordetella pertussis
cguugauccagcgc

SEQ ID NO: 2425546 - RNA, 18 nt, Bordetella pertussis
cguugaucucgcccagca

SEQ ID NO: 2425547 - RNA, 21 nt, Bordetella pertussis
cguugaugaugaucggcgcca

SEQ ID NO: 2425548 - RNA, 14 nt, Bordetella pertussis
cguugauggggccg

SEQ ID NO: 2425549 - RNA, 18 nt, Bordetella pertussis
cguugauggggccgcgcc

SEQ ID NO: 2425550 - RNA, 17 nt, Bordetella pertussis
cguugaugguccgcagg

SEQ ID NO: 2425551 - RNA, 18 nt, Bordetella pertussis
cguugcagcccagcgcga

SEQ ID NO: 2425552 - RNA, 22 nt, Bordetella pertussis
cguugcauaccucgauggcggu

SEQ ID NO: 2425553 - RNA, 23 nt, Bordetella pertussis
cguugcauaccucgauggcggug

SEQ ID NO: 2425554 - RNA, 13 nt, Bordetella pertussis
cguugccagccca

SEQ ID NO: 2425555 - RNA, 18 nt, Bordetella pertussis
cguugccgaagcgucggc

SEQ ID NO: 2425556 - RNA, 23 nt, Bordetella pertussis
cguugccgaagcgucggccugca

SEQ ID NO: 2425557 - RNA, 14 nt, Bordetella pertussis
cguugccgcgcgcg

SEQ ID NO: 2425558 - RNA, 11 nt, Bordetella pertussis
cguugccggcc

SEQ ID NO: 2425559 - RNA, 13 nt, Bordetella pertussis
cguugccggccag

SEQ ID NO: 2425560 - RNA, 14 nt, Bordetella pertussis
cguugccggugcgc

SEQ ID NO: 2425561 - RNA, 14 nt, Bordetella pertussis
cguugcgccugcca

SEQ ID NO: 2425562 - RNA, 17 nt, Bordetella pertussis
cguugcgcgacaggccc

SEQ ID NO: 2425563 - RNA, 19 nt, Bordetella pertussis
cguugcgcgacaggcccgc

SEQ ID NO: 2425564 - RNA, 18 nt, Bordetella pertussis
cguugcggcagcggccca

SEQ ID NO: 2425565 - RNA, 14 nt, Bordetella pertussis
cguugcggcccgcc

SEQ ID NO: 2425566 - RNA, 15 nt, Bordetella pertussis
cguugcggcccgccg

SEQ ID NO: 2425567 - RNA, 18 nt, Bordetella pertussis
cguugcggcccgccgacu

SEQ ID NO: 2425568 - RNA, 21 nt, Bordetella pertussis
cguugcggcccgccgacuggg

SEQ ID NO: 2425569 - RNA, 22 nt, Bordetella pertussis
cguugcggcccgccgacugggc

SEQ ID NO: 2425570 - RNA, 13 nt, Bordetella pertussis
cguugcggcgccu

SEQ ID NO: 2425571 - RNA, 17 nt, Bordetella pertussis
cucaccgcgccgggcgu

SEQ ID NO: 2425572 - RNA, 22 nt, Bordetella pertussis
cucaccuuuccgaucagcugcg

SEQ ID NO: 2425573 - RNA, 19 nt, Bordetella pertussis
cucacgaugcgaucgucgc

SEQ ID NO: 2425574 - RNA, 14 nt, Bordetella pertussis
cucacgcaaggccg

SEQ ID NO: 2425575 - RNA, 21 nt, Bordetella pertussis
cucacgcccagucccaggccg

SEQ ID NO: 2425576 - RNA, 13 nt, Bordetella pertussis
cucacgccccgcc

SEQ ID NO: 2425577 - RNA, 14 nt, Bordetella pertussis
cucacgccccgccc

SEQ ID NO: 2425578 - RNA, 23 nt, Bordetella pertussis
cucacgcccgugucgccgucggu

SEQ ID NO: 2425579 - RNA, 19 nt, Bordetella pertussis
cucacggggcugucgcgcg

SEQ ID NO: 2425580 - RNA, 21 nt, Bordetella pertussis
cucacggggcugucgcgcgca

SEQ ID NO: 2425581 - RNA, 20 nt, Bordetella pertussis
cucacuccauagcgccgcuc

SEQ ID NO: 2425582 - RNA, 17 nt, Bordetella pertussis
cucacugcccgcgccgu

SEQ ID NO: 2425583 - RNA, 13 nt, Bordetella pertussis
cucagcaccaggc

SEQ ID NO: 2425584 - RNA, 16 nt, Bordetella pertussis
cucagcaccaggccgc

SEQ ID NO: 2425585 - RNA, 18 nt, Bordetella pertussis
cucagcaccaggccgccg

SEQ ID NO: 2425586 - RNA, 13 nt, Bordetella pertussis
cucagcagcgcca

SEQ ID NO: 2425587 - RNA, 22 nt, Bordetella pertussis
cucagcagcgccagggccaggc

SEQ ID NO: 2425588 - RNA, 23 nt, Bordetella pertussis
cucagcagcgccagggccaggcc

SEQ ID NO: 2425589 - RNA, 17 nt, Bordetella pertussis
cucagcaugcgcugggc

SEQ ID NO: 2425590 - RNA, 14 nt, Bordetella pertussis
cucagccaucauca

SEQ ID NO: 2425591 - RNA, 16 nt, Bordetella pertussis
cucagcccgcaccgcc

SEQ ID NO: 2425592 - RNA, 12 nt, Bordetella pertussis
cucagcccgccu

SEQ ID NO: 2425593 - RNA, 14 nt, Bordetella pertussis
cucagcccgccugg

SEQ ID NO: 2425594 - RNA, 23 nt, Bordetella pertussis
cucagcccgcguucaggcgcggc

SEQ ID NO: 2425595 - RNA, 12 nt, Bordetella pertussis
cucagcccggcg

SEQ ID NO: 2425596 - RNA, 16 nt, Bordetella pertussis
cucagcccggcgaggu

SEQ ID NO: 2425597 - RNA, 20 nt, Bordetella pertussis
cucagcccuugacgcguacg

SEQ ID NO: 2425598 - RNA, 19 nt, Bordetella pertussis
cucagccuugucgcgggca

SEQ ID NO: 2425599 - RNA, 22 nt, Bordetella pertussis
cucagcgcgccgcgccgggcgc

SEQ ID NO: 2425600 - RNA, 17 nt, Bordetella pertussis
cucagcgcggcgcggcc

SEQ ID NO: 2425601 - RNA, 21 nt, Bordetella pertussis
cucagcgcggcgcggccagca

SEQ ID NO: 2425602 - RNA, 22 nt, Bordetella pertussis
cucagcgcggcgcggccagcag

SEQ ID NO: 2425603 - RNA, 16 nt, Bordetella pertussis
cucagcgggcugcugg

SEQ ID NO: 2425604 - RNA, 19 nt, Bordetella pertussis
cucagcguuuccagggcgc

SEQ ID NO: 2425605 - RNA, 22 nt, Bordetella pertussis
cucagcguuuccagggcgcgcc

SEQ ID NO: 2425606 - RNA, 23 nt, Bordetella pertussis
cucagcguuuccagggcgcgccg

SEQ ID NO: 2425607 - RNA, 13 nt, Bordetella pertussis
cucaggaaccagc

SEQ ID NO: 2425608 - RNA, 18 nt, Bordetella pertussis
cucaggcccgcggcgcca

SEQ ID NO: 2425609 - RNA, 23 nt, Bordetella pertussis
cucaggccgaggcugcgcgcgcc

SEQ ID NO: 2425610 - RNA, 15 nt, Bordetella pertussis
cucaggccgccggcg

SEQ ID NO: 2425611 - RNA, 15 nt, Bordetella pertussis
cucaggccgcugggc

SEQ ID NO: 2425612 - RNA, 15 nt, Bordetella pertussis
cucaggccggcgccu

SEQ ID NO: 2425613 - RNA, 22 nt, Bordetella pertussis
cucaggcgcggauugaugucgc

SEQ ID NO: 2425614 - RNA, 15 nt, Bordetella pertussis
cucaggcggccaggg

SEQ ID NO: 2425615 - RNA, 18 nt, Bordetella pertussis
cucaggcggccagggccu

SEQ ID NO: 2425616 - RNA, 21 nt, Bordetella pertussis
cucaggcggugacgcccugcc

SEQ ID NO: 2425617 - RNA, 20 nt, Bordetella pertussis
cucagggcggggugccugca

SEQ ID NO: 2425618 - RNA, 15 nt, Bordetella pertussis
cucaggguacggcga

SEQ ID NO: 2425619 - RNA, 17 nt, Bordetella pertussis
cucagguagaccacgcg

SEQ ID NO: 2425620 - RNA, 21 nt, Bordetella pertussis
cucagguagaccacgcgcugc

SEQ ID NO: 2425621 - RNA, 22 nt, Bordetella pertussis
cucaggucgaacaggcuggugg

SEQ ID NO: 2425622 - RNA, 22 nt, Bordetella pertussis
cucaguccagcuggcccuggca

SEQ ID NO: 2425623 - RNA, 18 nt, Bordetella pertussis
cucagucgggcagcgccc

SEQ ID NO: 2425624 - RNA, 21 nt, Bordetella pertussis
cucagucgggcagcgcccgcg

SEQ ID NO: 2425625 - RNA, 19 nt, Bordetella pertussis
cucauaggcaucgaccagc

SEQ ID NO: 2425626 - RNA, 14 nt, Bordetella pertussis
cucauccaggcgcg

SEQ ID NO: 2425627 - RNA, 20 nt, Bordetella pertussis
cucauccccgcgugccuguc

SEQ ID NO: 2425628 - RNA, 22 nt, Bordetella pertussis
cucaucccgauuucggagcggc

SEQ ID NO: 2425629 - RNA, 21 nt, Bordetella pertussis
cucaucggcaggccggcgcgc

SEQ ID NO: 2425630 - RNA, 22 nt, Bordetella pertussis
cucaucggcaggccggcgcgcg

SEQ ID NO: 2425631 - RNA, 13 nt, Bordetella pertussis
cucaugaccagcg

SEQ ID NO: 2425632 - RNA, 20 nt, Bordetella pertussis
cucaugcgggacaggcgcca

SEQ ID NO: 2425633 - RNA, 17 nt, Bordetella pertussis
cucauggcggcacgaau

SEQ ID NO: 2425634 - RNA, 23 nt, Bordetella pertussis
cucauggcggcacgaaugugguc

SEQ ID NO: 2425635 - RNA, 21 nt, Bordetella pertussis
cucauguugggggcgaagacg

SEQ ID NO: 2425636 - RNA, 16 nt, Bordetella pertussis
cucauucggcgcgcuc

SEQ ID NO: 2425637 - RNA, 14 nt, Bordetella pertussis
cucauuggcgcgcu

SEQ ID NO: 2425638 - RNA, 17 nt, Bordetella pertussis
cucauuggcgcgcuuga

SEQ ID NO: 2425639 - RNA, 23 nt, Bordetella pertussis
cuccaaugaaaaaccccgccagg

SEQ ID NO: 2425640 - RNA, 22 nt, Bordetella pertussis
cuccacagccacugcggcccga

SEQ ID NO: 2425641 - RNA, 14 nt, Bordetella pertussis
cuccaccagcaccg

SEQ ID NO: 2425642 - RNA, 17 nt, Bordetella pertussis
cuccaccagcaccggca

SEQ ID NO: 2425643 - RNA, 17 nt, Bordetella pertussis
cuccacccccgggcgca

SEQ ID NO: 2425644 - RNA, 17 nt, Bordetella pertussis
cuccaccgggcugaaca

SEQ ID NO: 2425645 - RNA, 19 nt, Bordetella pertussis
cuccacgcacaccgcccga

SEQ ID NO: 2425646 - RNA, 22 nt, Bordetella pertussis
cuccacggaauggucaagcggc

SEQ ID NO: 2425647 - RNA, 16 nt, Bordetella pertussis
cuccacgugcggcagg

SEQ ID NO: 2425648 - RNA, 15 nt, Bordetella pertussis
cuccagaacgcgccg

SEQ ID NO: 2425649 - RNA, 13 nt, Bordetella pertussis
cuccagagcgcgc

SEQ ID NO: 2425650 - RNA, 14 nt, Bordetella pertussis
cuccagagcgcgca

SEQ ID NO: 2425651 - RNA, 16 nt, Bordetella pertussis
cuccagagcgcgcaca

SEQ ID NO: 2425652 - RNA, 14 nt, Bordetella pertussis
cuccagcaccugca

SEQ ID NO: 2425653 - RNA, 13 nt, Bordetella pertussis
cuccagcagggac

SEQ ID NO: 2425654 - RNA, 14 nt, Bordetella pertussis
cuccagcagggacu

SEQ ID NO: 2425655 - RNA, 14 nt, Bordetella pertussis
cuccagcaucgccg

SEQ ID NO: 2425656 - RNA, 17 nt, Bordetella pertussis
cuccagcaucgccgcca

SEQ ID NO: 2425657 - RNA, 19 nt, Bordetella pertussis
cuccagcaucgccgccagc

SEQ ID NO: 2425658 - RNA, 16 nt, Bordetella pertussis
cuccagccaggcgcgc

SEQ ID NO: 2425659 - RNA, 17 nt, Bordetella pertussis
cuccagccaggcgcgca

SEQ ID NO: 2425660 - RNA, 23 nt, Bordetella pertussis
cuccagcccgauaugcagccgca

SEQ ID NO: 2425661 - RNA, 18 nt, Bordetella pertussis
cuccagcccuucgcccgc

SEQ ID NO: 2425662 - RNA, 12 nt, Bordetella pertussis
cuccagccgcag

SEQ ID NO: 2425663 - RNA, 13 nt, Bordetella pertussis
cuccagccggguc

SEQ ID NO: 2425664 - RNA, 17 nt, Bordetella pertussis
cuccagcgccagcacag

SEQ ID NO: 2425665 - RNA, 13 nt, Bordetella pertussis
cuccagcgcggcg

SEQ ID NO: 2425666 - RNA, 24 nt, Bordetella pertussis
cuccagcgcgucggccaggcgcca

SEQ ID NO: 2425667 - RNA, 18 nt, Bordetella pertussis
cuccagcgcuucgugcag

SEQ ID NO: 2425668 - RNA, 20 nt, Bordetella pertussis
cuccagcgcuucgugcagcg

SEQ ID NO: 2425669 - RNA, 19 nt, Bordetella pertussis
cuccagcgucauggccugg

SEQ ID NO: 2425670 - RNA, 20 nt, Bordetella pertussis
cuccagcgucauggccuggc

SEQ ID NO: 2425671 - RNA, 23 nt, Bordetella pertussis
cuccagcgugucgaacaccaggu

SEQ ID NO: 2425672 - RNA, 14 nt, Bordetella pertussis
cuccagcucagcag

SEQ ID NO: 2425673 - RNA, 23 nt, Bordetella pertussis
cuccagcuggcgcaccaggcugg

SEQ ID NO: 2425674 - RNA, 20 nt, Bordetella pertussis
cuccaggaaagcgccgccgc

SEQ ID NO: 2425675 - RNA, 19 nt, Bordetella pertussis
cuccaggaugagcgccugc

SEQ ID NO: 2425676 - RNA, 21 nt, Bordetella pertussis
cuccaggaugcgcgacaccgu

SEQ ID NO: 2425677 - RNA, 15 nt, Bordetella pertussis
cuccaggcccaggcg

SEQ ID NO: 2425678 - RNA, 22 nt, Bordetella pertussis
cuccaggcccaggcgacccagc

SEQ ID NO: 2425679 - RNA, 18 nt, Bordetella pertussis
cuccaggccgcccagccg

SEQ ID NO: 2425680 - RNA, 12 nt, Bordetella pertussis
cuccaggccggc

SEQ ID NO: 2425681 - RNA, 18 nt, Bordetella pertussis
cuccaggccggcaugcgc

SEQ ID NO: 2425682 - RNA, 20 nt, Bordetella pertussis
cuccaggccggcaugcgccg

SEQ ID NO: 2425683 - RNA, 21 nt, Bordetella pertussis
cucgacgaagcccgugucggc

SEQ ID NO: 2425684 - RNA, 19 nt, Bordetella pertussis
cucgacgaugcccugcgcc

SEQ ID NO: 2425685 - RNA, 23 nt, Bordetella pertussis
cucgacgaugcccugcgccagcg

SEQ ID NO: 2425686 - RNA, 20 nt, Bordetella pertussis
cucgacgauggccggggcgu

SEQ ID NO: 2425687 - RNA, 17 nt, Bordetella pertussis
cucgacgcaaucggcga

SEQ ID NO: 2425688 - RNA, 19 nt, Bordetella pertussis
cucgacgccaucucgcgcg

SEQ ID NO: 2425689 - RNA, 13 nt, Bordetella pertussis
cucgacggcgcgc

SEQ ID NO: 2425690 - RNA, 20 nt, Bordetella pertussis
cucgacguaagugcccaggc

SEQ ID NO: 2425691 - RNA, 22 nt, Bordetella pertussis
cucgacguaagugcccaggccc

SEQ ID NO: 2425692 - RNA, 17 nt, Bordetella pertussis
cucgacuucggccgaca

SEQ ID NO: 2425693 - RNA, 18 nt, Bordetella pertussis
cucgagcaagggccagac

SEQ ID NO: 2425694 - RNA, 13 nt, Bordetella pertussis
cucgagcaugcgg

SEQ ID NO: 2425695 - RNA, 17 nt, Bordetella pertussis
cucgagcaugcgggcca

SEQ ID NO: 2425696 - RNA, 12 nt, Bordetella pertussis
cucgagccggcu

SEQ ID NO: 2425697 - RNA, 14 nt, Bordetella pertussis
cucgagccggcucc

SEQ ID NO: 2425698 - RNA, 19 nt, Bordetella pertussis
cucgagcgccugcagcgug

SEQ ID NO: 2425699 - RNA, 17 nt, Bordetella pertussis
cucgagcggcagcagcg

SEQ ID NO: 2425700 - RNA, 20 nt, Bordetella pertussis
cucgagcuggcuggccagcg

SEQ ID NO: 2425701 - RNA, 22 nt, Bordetella pertussis
cucgaggaaccagccgucggca

SEQ ID NO: 2425702 - RNA, 13 nt, Bordetella pertussis
cucgaggccaggc

SEQ ID NO: 2425703 - RNA, 14 nt, Bordetella pertussis
cucgaggcggcgca

SEQ ID NO: 2425704 - RNA, 19 nt, Bordetella pertussis
cucgagguaggcgggacug

SEQ ID NO: 2425705 - RNA, 23 nt, Bordetella pertussis
cucgaggugcacgugggcacgcc

SEQ ID NO: 2425706 - RNA, 17 nt, Bordetella pertussis
cucgaguuugcggucca

SEQ ID NO: 2425707 - RNA, 17 nt, Bordetella pertussis
cucgauaugcagcaccg

SEQ ID NO: 2425708 - RNA, 16 nt, Bordetella pertussis
cucgaucaccaccggc

SEQ ID NO: 2425709 - RNA, 20 nt, Bordetella pertussis
cucgaucaccaccggcaagg

SEQ ID NO: 2425710 - RNA, 23 nt, Bordetella pertussis
cucgaucagcgaaugcgacagcg

SEQ ID NO: 2425711 - RNA, 14 nt, Bordetella pertussis
cucgauccgggccu

SEQ ID NO: 2425712 - RNA, 19 nt, Bordetella pertussis
cucgauccgggccuggcgu

SEQ ID NO: 2425713 - RNA, 14 nt, Bordetella pertussis
cucgaucgccgccg

SEQ ID NO: 2425714 - RNA, 16 nt, Bordetella pertussis
cucgaucgccgccggc

SEQ ID NO: 2425715 - RNA, 18 nt, Bordetella pertussis
cucgaucugguuggccac

SEQ ID NO: 2425716 - RNA, 17 nt, Bordetella pertussis
cucgaucuucucgacgg

SEQ ID NO: 2425717 - RNA, 20 nt, Bordetella pertussis
cucgaugaaggugcgcagca

SEQ ID NO: 2425718 - RNA, 23 nt, Bordetella pertussis
cucgaugaaggugcgcagcaggu

SEQ ID NO: 2425719 - RNA, 11 nt, Bordetella pertussis
cucgaugaugg

SEQ ID NO: 2425720 - RNA, 19 nt, Bordetella pertussis
cucgaugcaauagcgcccg

SEQ ID NO: 2425721 - RNA, 22 nt, Bordetella pertussis
cucgaugcaauagcgcccgccu

SEQ ID NO: 2425722 - RNA, 13 nt, Bordetella pertussis
cucgaugcccagc

SEQ ID NO: 2425723 - RNA, 13 nt, Bordetella pertussis
cucgaugcgcgcc

SEQ ID NO: 2425724 - RNA, 14 nt, Bordetella pertussis
cucgaugcgcgcca

SEQ ID NO: 2425725 - RNA, 21 nt, Bordetella pertussis
cucgaugcggucggccgcgcc

SEQ ID NO: 2425726 - RNA, 14 nt, Bordetella pertussis
cucgauggccucgg

SEQ ID NO: 2425727 - RNA, 20 nt, Bordetella pertussis
cucgauggcgcaggcgcgcc

SEQ ID NO: 2425728 - RNA, 14 nt, Bordetella pertussis
cucgaugggcgcgc

SEQ ID NO: 2425729 - RNA, 16 nt, Bordetella pertussis
cucgaugggcgcgcgc

SEQ ID NO: 2425730 - RNA, 21 nt, Bordetella pertussis
cucgaugggcgcgcgcaucgg

SEQ ID NO: 2425731 - RNA, 14 nt, Bordetella pertussis
cucgaugguggcga

SEQ ID NO: 2425732 - RNA, 15 nt, Bordetella pertussis
cucgaugucaucgcc

SEQ ID NO: 2425733 - RNA, 18 nt, Bordetella pertussis
cucgauguggcgcuggcg

SEQ ID NO: 2425734 - RNA, 15 nt, Bordetella pertussis
cucgauugaccagca

SEQ ID NO: 2425735 - RNA, 16 nt, Bordetella pertussis
cucgauugaccagcac

SEQ ID NO: 2425736 - RNA, 20 nt, Bordetella pertussis
cucgauugaccagcaccagc

SEQ ID NO: 2425737 - RNA, 22 nt, Bordetella pertussis
cucgcaagugcuggcccgccag

SEQ ID NO: 2425738 - RNA, 18 nt, Bordetella pertussis
cucgcacacgcgcugggc

SEQ ID NO: 2425739 - RNA, 19 nt, Bordetella pertussis
cucgcacacgcgcugggcg

SEQ ID NO: 2425740 - RNA, 22 nt, Bordetella pertussis
cucgcacaguucgugcaccagc

SEQ ID NO: 2425741 - RNA, 17 nt, Bordetella pertussis
cucgcacgugacgccgg

SEQ ID NO: 2425742 - RNA, 23 nt, Bordetella pertussis
cucgcaggccugcugcagcguga

SEQ ID NO: 2425743 - RNA, 16 nt, Bordetella pertussis
cucgcaucggccugca

SEQ ID NO: 2425744 - RNA, 13 nt, Bordetella pertussis
cucgccagcggca

SEQ ID NO: 2425745 - RNA, 19 nt, Bordetella pertussis
cucgccagcggcagcgcgc

SEQ ID NO: 2425746 - RNA, 23 nt, Bordetella pertussis
cucgcccacauagcggccggcgc

SEQ ID NO: 2425747 - RNA, 16 nt, Bordetella pertussis
cucgcccagcaggucc

SEQ ID NO: 2425748 - RNA, 14 nt, Bordetella pertussis
cucgcccagcgagc

SEQ ID NO: 2425749 - RNA, 20 nt, Bordetella pertussis
cucgcccagcgagccggcca

SEQ ID NO: 2425750 - RNA, 16 nt, Bordetella pertussis
cucgcccagcggcgcc

SEQ ID NO: 2425751 - RNA, 15 nt, Bordetella pertussis
cucgcccaggccggg

SEQ ID NO: 2425752 - RNA, 20 nt, Bordetella pertussis
cucgcccaugaucagggccg

SEQ ID NO: 2425753 - RNA, 20 nt, Bordetella pertussis
cucgcccccgaaggccgcgc

SEQ ID NO: 2425754 - RNA, 21 nt, Bordetella pertussis
cucgcccccgaaggccgcgcc

SEQ ID NO: 2425755 - RNA, 20 nt, Bordetella pertussis
cucgccccggcgcgcagcgc

SEQ ID NO: 2425756 - RNA, 14 nt, Bordetella pertussis
cucgcccgaccugc

SEQ ID NO: 2425757 - RNA, 17 nt, Bordetella pertussis
cucgcccgaccugcugg

SEQ ID NO: 2425758 - RNA, 19 nt, Bordetella pertussis
cucgcccgaucggccggcc

SEQ ID NO: 2425759 - RNA, 18 nt, Bordetella pertussis
cucgcccucgcgccacca

SEQ ID NO: 2425760 - RNA, 15 nt, Bordetella pertussis
cucgcccugcucgcg

SEQ ID NO: 2425761 - RNA, 14 nt, Bordetella pertussis
cucgcccuggcgca

SEQ ID NO: 2425762 - RNA, 22 nt, Bordetella pertussis
cucgcccuugcggcgaggcuuu

SEQ ID NO: 2425763 - RNA, 17 nt, Bordetella pertussis
cucgccgaacugccggc

SEQ ID NO: 2425764 - RNA, 20 nt, Bordetella pertussis
cucgccgaacugccggcgcg

SEQ ID NO: 2425765 - RNA, 17 nt, Bordetella pertussis
cucgccgagccgggcca

SEQ ID NO: 2425766 - RNA, 21 nt, Bordetella pertussis
cucgccgagccgggccaugcg

SEQ ID NO: 2425767 - RNA, 12 nt, Bordetella pertussis
cucgccgcccag

SEQ ID NO: 2425768 - RNA, 13 nt, Bordetella pertussis
cucgccgcccagc

SEQ ID NO: 2425769 - RNA, 14 nt, Bordetella pertussis
cucgccgcccagcc

SEQ ID NO: 2425770 - RNA, 19 nt, Bordetella pertussis
cucgccgcccagccggccg

SEQ ID NO: 2425771 - RNA, 12 nt, Bordetella pertussis
cucgccgcgcac

SEQ ID NO: 2425772 - RNA, 15 nt, Bordetella pertussis
cucgccgcgccagcu

SEQ ID NO: 2425773 - RNA, 16 nt, Bordetella pertussis
cucgccgcgcgacagc

SEQ ID NO: 2425774 - RNA, 16 nt, Bordetella pertussis
cucgccgcuccggcau

SEQ ID NO: 2425775 - RNA, 14 nt, Bordetella pertussis
cucgccggccagcg

SEQ ID NO: 2425776 - RNA, 15 nt, Bordetella pertussis
cucgccggcccugcc

SEQ ID NO: 2425777 - RNA, 22 nt, Bordetella pertussis
cucgccggcccugccgcccugg

SEQ ID NO: 2425778 - RNA, 23 nt, Bordetella pertussis
cucgccggcccugccgcccuggc

SEQ ID NO: 2425779 - RNA, 15 nt, Bordetella pertussis
cucgccggccgcgcc

SEQ ID NO: 2425780 - RNA, 20 nt, Bordetella pertussis
cucgccggccgcgcccagcg

SEQ ID NO: 2425781 - RNA, 16 nt, Bordetella pertussis
cucgccggccuggcgc

SEQ ID NO: 2425782 - RNA, 16 nt, Bordetella pertussis
cucgccggcgcgcagg

SEQ ID NO: 2425783 - RNA, 17 nt, Bordetella pertussis
cucgccggcgcgcaggc

SEQ ID NO: 2425784 - RNA, 19 nt, Bordetella pertussis
cucgccggcgcgcaggcag

SEQ ID NO: 2425785 - RNA, 12 nt, Bordetella pertussis
cucgccggcgcu

SEQ ID NO: 2425786 - RNA, 13 nt, Bordetella pertussis
cucgccggucgcg

SEQ ID NO: 2425787 - RNA, 16 nt, Bordetella pertussis
cucgccguugucgacg

SEQ ID NO: 2425788 - RNA, 17 nt, Bordetella pertussis
cucgccuccccaggcca

SEQ ID NO: 2425789 - RNA, 20 nt, Bordetella pertussis
cucgccuccccaggccagcu

SEQ ID NO: 2425790 - RNA, 17 nt, Bordetella pertussis
cucgcgaaagcacgcca

SEQ ID NO: 2425791 - RNA, 15 nt, Bordetella pertussis
cucgcgcaccgacac

SEQ ID NO: 2425792 - RNA, 13 nt, Bordetella pertussis
cucgcgcagcagg

SEQ ID NO: 2425793 - RNA, 13 nt, Bordetella pertussis
cucgcgcagcgug

SEQ ID NO: 2425794 - RNA, 22 nt, Bordetella pertussis
cucgcgcagcgugaccgacagg

SEQ ID NO: 2425795 - RNA, 14 nt, Bordetella pertussis
cucgcgccaccaug

SEQ ID NO: 2425796 - RNA, 13 nt, Bordetella pertussis
cucggcgggcggc

SEQ ID NO: 2425797 - RNA, 14 nt, Bordetella pertussis
cucggcgggcggcg

SEQ ID NO: 2425798 - RNA, 15 nt, Bordetella pertussis
cucggcgggcggcgc

SEQ ID NO: 2425799 - RNA, 21 nt, Bordetella pertussis
cucggcgggcggcgccagcgg

SEQ ID NO: 2425800 - RNA, 14 nt, Bordetella pertussis
cucggcggucagcg

SEQ ID NO: 2425801 - RNA, 21 nt, Bordetella pertussis
cucggcggucagcgcggcgcc

SEQ ID NO: 2425802 - RNA, 22 nt, Bordetella pertussis
cucggcgguugcccgccccgug

SEQ ID NO: 2425803 - RNA, 21 nt, Bordetella pertussis
cucggcguccucgcgguccug

SEQ ID NO: 2425804 - RNA, 16 nt, Bordetella pertussis
cucggcuuccugccgc

SEQ ID NO: 2425805 - RNA, 15 nt, Bordetella pertussis
cucgggaaacaggcc

SEQ ID NO: 2425806 - RNA, 21 nt, Bordetella pertussis
cucgggaaugaugcagcugua

SEQ ID NO: 2425807 - RNA, 15 nt, Bordetella pertussis
cucgggacgcaggcc

SEQ ID NO: 2425808 - RNA, 20 nt, Bordetella pertussis
cucgggauaggccucggcca

SEQ ID NO: 2425809 - RNA, 23 nt, Bordetella pertussis
cucgggauaggccucggccaccu

SEQ ID NO: 2425810 - RNA, 23 nt, Bordetella pertussis
cucgggcagcagcagggccaggc

SEQ ID NO: 2425811 - RNA, 16 nt, Bordetella pertussis
cucgggcaugcgccug

SEQ ID NO: 2425812 - RNA, 21 nt, Bordetella pertussis
cucgggcaugcgccugcgcca

SEQ ID NO: 2425813 - RNA, 17 nt, Bordetella pertussis
cucgggcgacaggcgcg

SEQ ID NO: 2425814 - RNA, 21 nt, Bordetella pertussis
cucgggcgaggucagcccggc

SEQ ID NO: 2425815 - RNA, 17 nt, Bordetella pertussis
cucgggcgcauugccgc

SEQ ID NO: 2425816 - RNA, 14 nt, Bordetella pertussis
cucgggcgucaugc

SEQ ID NO: 2425817 - RNA, 17 nt, Bordetella pertussis
cucgggcgucaugcgcu

SEQ ID NO: 2425818 - RNA, 14 nt, Bordetella pertussis
cucgggcugcggcu

SEQ ID NO: 2425819 - RNA, 22 nt, Bordetella pertussis
cucgggcugggugaagccaagc

SEQ ID NO: 2425820 - RNA, 20 nt, Bordetella pertussis
cucggggaaauugacggcgc

SEQ ID NO: 2425821 - RNA, 23 nt, Bordetella pertussis
cucggggaaauugacggcgcucu

SEQ ID NO: 2425822 - RNA, 19 nt, Bordetella pertussis
cucggguuucuugcugcug

SEQ ID NO: 2425823 - RNA, 22 nt, Bordetella pertussis
cucgguaucgucggacaacgcc

SEQ ID NO: 2425824 - RNA, 16 nt, Bordetella pertussis
cucggucagcacgaac

SEQ ID NO: 2425825 - RNA, 14 nt, Bordetella pertussis
cucggucagcgcca

SEQ ID NO: 2425826 - RNA, 17 nt, Bordetella pertussis
cucggucagcgccaggg

SEQ ID NO: 2425827 - RNA, 19 nt, Bordetella pertussis
cucggucagcgccagggug

SEQ ID NO: 2425828 - RNA, 13 nt, Bordetella pertussis
cucggucagggug

SEQ ID NO: 2425829 - RNA, 22 nt, Bordetella pertussis
cucggucauguccagcgccagg

SEQ ID NO: 2425830 - RNA, 23 nt, Bordetella pertussis
cucggucauguccagcgccaggc

SEQ ID NO: 2425831 - RNA, 22 nt, Bordetella pertussis
cucggucgucagcacgcccugg

SEQ ID NO: 2425832 - RNA, 23 nt, Bordetella pertussis
cucggucgucagcacgcccuggc

SEQ ID NO: 2425833 - RNA, 18 nt, Bordetella pertussis
cucggucucgugcgugcg

SEQ ID NO: 2425834 - RNA, 14 nt, Bordetella pertussis
cucggugaugaugg

SEQ ID NO: 2425835 - RNA, 16 nt, Bordetella pertussis
cucggugcagcccagc

SEQ ID NO: 2425836 - RNA, 18 nt, Bordetella pertussis
cucggugcagcccagcac

SEQ ID NO: 2425837 - RNA, 23 nt, Bordetella pertussis
cucggugcgccgccgccgcggcc

SEQ ID NO: 2425838 - RNA, 16 nt, Bordetella pertussis
cucggugcgcgcgccc

SEQ ID NO: 2425839 - RNA, 19 nt, Bordetella pertussis
cucggugcgcgcgcccacc

SEQ ID NO: 2425840 - RNA, 17 nt, Bordetella pertussis
cucggugcgggccggcg

SEQ ID NO: 2425841 - RNA, 18 nt, Bordetella pertussis
cucggugcgggccggcgc

SEQ ID NO: 2425842 - RNA, 22 nt, Bordetella pertussis
cucggugcgggccggcgcgccu

SEQ ID NO: 2425843 - RNA, 12 nt, Bordetella pertussis
cucggugcugcu

SEQ ID NO: 2425844 - RNA, 21 nt, Bordetella pertussis
cucggugcuguuucgcgagga

SEQ ID NO: 2425845 - RNA, 16 nt, Bordetella pertussis
cucgguggaggacgcc

SEQ ID NO: 2425846 - RNA, 19 nt, Bordetella pertussis
cucgguggaggacgccgac

SEQ ID NO: 2425847 - RNA, 17 nt, Bordetella pertussis
cucguauucgcccggau

SEQ ID NO: 2425848 - RNA, 22 nt, Bordetella pertussis
cucguauugugcaugcgcgcca

SEQ ID NO: 2425849 - RNA, 20 nt, Bordetella pertussis
cucguccagguugcccgagc

SEQ ID NO: 2425850 - RNA, 13 nt, Bordetella pertussis
cucguccaucgcc

SEQ ID NO: 2425851 - RNA, 15 nt, Bordetella pertussis
cucguccaugccggc

SEQ ID NO: 2425852 - RNA, 17 nt, Bordetella pertussis
cucguccaugccggcca

SEQ ID NO: 2425853 - RNA, 18 nt, Bordetella pertussis
cucguccccacggggacu

SEQ ID NO: 2425854 - RNA, 19 nt, Bordetella pertussis
cucguccgucucgcccagg

SEQ ID NO: 2425855 - RNA, 20 nt, Bordetella pertussis
cucguccgucucgcccaggc

SEQ ID NO: 2425856 - RNA, 18 nt, Bordetella pertussis
cucgucgaccacgccggc

SEQ ID NO: 2425857 - RNA, 13 nt, Bordetella pertussis
cucgucgaccgcc

SEQ ID NO: 2425858 - RNA, 20 nt, Bordetella pertussis
cucgucgaccgccucgacgc

SEQ ID NO: 2425859 - RNA, 16 nt, Bordetella pertussis
cucgucgacgcggccg

SEQ ID NO: 2425860 - RNA, 14 nt, Bordetella pertussis
cucgucgccaugcg

SEQ ID NO: 2425861 - RNA, 12 nt, Bordetella pertussis
cucgucgcgcau

SEQ ID NO: 2425862 - RNA, 19 nt, Bordetella pertussis
cucgucggucagcucaaga

SEQ ID NO: 2425863 - RNA, 20 nt, Bordetella pertussis
cucgucggucaugcccaugc

SEQ ID NO: 2425864 - RNA, 13 nt, Bordetella pertussis
cucgucguccagc

SEQ ID NO: 2425865 - RNA, 19 nt, Bordetella pertussis
cucgugcagcaggggcugc

SEQ ID NO: 2425866 - RNA, 21 nt, Bordetella pertussis
cucgugccccgcaugcgcaga

SEQ ID NO: 2425867 - RNA, 14 nt, Bordetella pertussis
cucgugcugcugca

SEQ ID NO: 2425868 - RNA, 20 nt, Bordetella pertussis
cucgugcugcugcaggcgcg

SEQ ID NO: 2425869 - RNA, 14 nt, Bordetella pertussis
cucguggcgcgccu

SEQ ID NO: 2425870 - RNA, 17 nt, Bordetella pertussis
cucguggcgcgccucca

SEQ ID NO: 2425871 - RNA, 18 nt, Bordetella pertussis
cucgugguaguacaaggc

SEQ ID NO: 2425872 - RNA, 15 nt, Bordetella pertussis
cucguuccagaugcg

SEQ ID NO: 2425873 - RNA, 14 nt, Bordetella pertussis
cucguugacgccga

SEQ ID NO: 2425874 - RNA, 17 nt, Bordetella pertussis
cucguugcccgcggucg

SEQ ID NO: 2425875 - RNA, 12 nt, Bordetella pertussis
cucguuggccag

SEQ ID NO: 2425876 - RNA, 13 nt, Bordetella pertussis
cucguuggccagc

SEQ ID NO: 2425877 - RNA, 14 nt, Bordetella pertussis
cucguuggccagcg

SEQ ID NO: 2425878 - RNA, 15 nt, Bordetella pertussis
cucguuggccagcgc

SEQ ID NO: 2425879 - RNA, 16 nt, Bordetella pertussis
cucguuggccagcgcg

SEQ ID NO: 2425880 - RNA, 13 nt, Bordetella pertussis
cucuacaccauca

SEQ ID NO: 2425881 - RNA, 21 nt, Bordetella pertussis
cucuaccaacccugccuccag

SEQ ID NO: 2425882 - RNA, 13 nt, Bordetella pertussis
cucuacuggcuga

SEQ ID NO: 2425883 - RNA, 16 nt, Bordetella pertussis
cucuaguucuauauag

SEQ ID NO: 2425884 - RNA, 18 nt, Bordetella pertussis
cucuaugcgguguugcuc

SEQ ID NO: 2425885 - RNA, 17 nt, Bordetella pertussis
cucuaugucgccggcca

SEQ ID NO: 2425886 - RNA, 18 nt, Bordetella pertussis
cucuaugucgccggccag

SEQ ID NO: 2425887 - RNA, 16 nt, Bordetella pertussis
cucuauucggccaacg

SEQ ID NO: 2425888 - RNA, 23 nt, Bordetella pertussis
cucuauucggccaacggcuggcu

SEQ ID NO: 2425889 - RNA, 20 nt, Bordetella pertussis
cucuccacuggccuucuuca

SEQ ID NO: 2425890 - RNA, 19 nt, Bordetella pertussis
cucuccgugcaucggcacg

SEQ ID NO: 2425891 - RNA, 20 nt, Bordetella pertussis
cucucgaagaagcagccgcg

SEQ ID NO: 2425892 - RNA, 14 nt, Bordetella pertussis
cucugaucgcgcug

SEQ ID NO: 2425893 - RNA, 21 nt, Bordetella pertussis
cucugcaccuugggcgccugc

SEQ ID NO: 2425894 - RNA, 19 nt, Bordetella pertussis
cucugcccgaagcggcccg

SEQ ID NO: 2425895 - RNA, 20 nt, Bordetella pertussis
cucugccgugggacaggcac

SEQ ID NO: 2425896 - RNA, 22 nt, Bordetella pertussis
cucugcucugucacucaacagu

SEQ ID NO: 2425897 - RNA, 13 nt, Bordetella pertussis
cucuggcacacca

SEQ ID NO: 2425898 - RNA, 19 nt, Bordetella pertussis
cucuggcacaccagcgcca

SEQ ID NO: 2425899 - RNA, 20 nt, Bordetella pertussis
cucuggcacaccagcgccag

SEQ ID NO: 2425900 - RNA, 22 nt, Bordetella pertussis
cucuggcacaccagcgccagga

SEQ ID NO: 2425901 - RNA, 16 nt, Bordetella pertussis
cucuggcugacgaugu

SEQ ID NO: 2425902 - RNA, 19 nt, Bordetella pertussis
cucugguaacucaugccua

SEQ ID NO: 2425903 - RNA, 13 nt, Bordetella pertussis
cucugguccaggc

SEQ ID NO: 2425904 - RNA, 17 nt, Bordetella pertussis
cucuucaaaaccaugga

SEQ ID NO: 2425905 - RNA, 14 nt, Bordetella pertussis
cucuucagcccggc

SEQ ID NO: 2425906 - RNA, 17 nt, Bordetella pertussis
cucuucagcccggcgcg

SEQ ID NO: 2425907 - RNA, 13 nt, Bordetella pertussis
cucuuccccgucg

SEQ ID NO: 2425908 - RNA, 15 nt, Bordetella pertussis
cucuuccguuggcca

SEQ ID NO: 2425909 - RNA, 18 nt, Bordetella pertussis
cugaugccguaccaggug

SEQ ID NO: 2425910 - RNA, 22 nt, Bordetella pertussis
cugaugccugucccgcacgcag

SEQ ID NO: 2425911 - RNA, 13 nt, Bordetella pertussis
cugaugcgcggcg

SEQ ID NO: 2425912 - RNA, 16 nt, Bordetella pertussis
cugaugcgcggcgggc

SEQ ID NO: 2425913 - RNA, 14 nt, Bordetella pertussis
cugaugcuggucag

SEQ ID NO: 2425914 - RNA, 19 nt, Bordetella pertussis
cugaugcuggucagccugg

SEQ ID NO: 2425915 - RNA, 21 nt, Bordetella pertussis
cugaugcuggucagccugggc

SEQ ID NO: 2425916 - RNA, 22 nt, Bordetella pertussis
cugauggccgccagcggcuggc

SEQ ID NO: 2425917 - RNA, 16 nt, Bordetella pertussis
cugauucacaggcccg

SEQ ID NO: 2425918 - RNA, 19 nt, Bordetella pertussis
cugauucacaggcccgcgc

SEQ ID NO: 2425919 - RNA, 16 nt, Bordetella pertussis
cugauucccaggcccg

SEQ ID NO: 2425920 - RNA, 18 nt, Bordetella pertussis
cugauucccaggcccggc

SEQ ID NO: 2425921 - RNA, 16 nt, Bordetella pertussis
cugcaaccagcucagc

SEQ ID NO: 2425922 - RNA, 21 nt, Bordetella pertussis
cugcaagauuucauggcgucu

SEQ ID NO: 2425923 - RNA, 23 nt, Bordetella pertussis
cugcaagauuucauggcgucugc

SEQ ID NO: 2425924 - RNA, 15 nt, Bordetella pertussis
cugcaaggcccgccc

SEQ ID NO: 2425925 - RNA, 13 nt, Bordetella pertussis
cugcaaggccggc

SEQ ID NO: 2425926 - RNA, 15 nt, Bordetella pertussis
cugcaaggccggcgg

SEQ ID NO: 2425927 - RNA, 17 nt, Bordetella pertussis
cugcaaggccggcggca

SEQ ID NO: 2425928 - RNA, 14 nt, Bordetella pertussis
cugcaaggccugcu

SEQ ID NO: 2425929 - RNA, 15 nt, Bordetella pertussis
cugcaaggccugcug

SEQ ID NO: 2425930 - RNA, 16 nt, Bordetella pertussis
cugcaaggccugcugc

SEQ ID NO: 2425931 - RNA, 15 nt, Bordetella pertussis
cugcaagguggcgug

SEQ ID NO: 2425932 - RNA, 22 nt, Bordetella pertussis
cugcaagguggcgugcagcagg

SEQ ID NO: 2425933 - RNA, 23 nt, Bordetella pertussis
cugcaagguggcgugcagcaggu

SEQ ID NO: 2425934 - RNA, 14 nt, Bordetella pertussis
cugcaaguccagcg

SEQ ID NO: 2425935 - RNA, 19 nt, Bordetella pertussis
cugcaaguccagcguggug

SEQ ID NO: 2425936 - RNA, 21 nt, Bordetella pertussis
cugcaagucuucuucagcaug

SEQ ID NO: 2425937 - RNA, 16 nt, Bordetella pertussis
cugcaaugcggccagg

SEQ ID NO: 2425938 - RNA, 17 nt, Bordetella pertussis
cugcaaugcggccaggc

SEQ ID NO: 2425939 - RNA, 19 nt, Bordetella pertussis
cugcaauucgccgaugcgg

SEQ ID NO: 2425940 - RNA, 14 nt, Bordetella pertussis
cugcacccacacuu

SEQ ID NO: 2425941 - RNA, 22 nt, Bordetella pertussis
cugcacccacacuuggccggcg

SEQ ID NO: 2425942 - RNA, 18 nt, Bordetella pertussis
cugcaccggcgccacggc

SEQ ID NO: 2425943 - RNA, 14 nt, Bordetella pertussis
cugcaccgucaggu

SEQ ID NO: 2425944 - RNA, 17 nt, Bordetella pertussis
cugcaccucaggaugcc

SEQ ID NO: 2425945 - RNA, 19 nt, Bordetella pertussis
cugcaccucaggaugcccg

SEQ ID NO: 2425946 - RNA, 13 nt, Bordetella pertussis
cugcaccugccug

SEQ ID NO: 2425947 - RNA, 14 nt, Bordetella pertussis
cugcaccugccugc

SEQ ID NO: 2425948 - RNA, 15 nt, Bordetella pertussis
cugcaccugccugcc

SEQ ID NO: 2425949 - RNA, 18 nt, Bordetella pertussis
cugcaccugccugccgcc

SEQ ID NO: 2425950 - RNA, 17 nt, Bordetella pertussis
cugcaccuugggcgccu

SEQ ID NO: 2425951 - RNA, 19 nt, Bordetella pertussis
cugcaccuugggcgccugc

SEQ ID NO: 2425952 - RNA, 21 nt, Bordetella pertussis
cugcaccuugggcgccugcgg

SEQ ID NO: 2425953 - RNA, 18 nt, Bordetella pertussis
cugcaccuuguacugguc

SEQ ID NO: 2425954 - RNA, 23 nt, Bordetella pertussis
cugcaccuuguacuggucgcgca

SEQ ID NO: 2425955 - RNA, 23 nt, Bordetella pertussis
cugcacgaagcggaugcgccgcc

SEQ ID NO: 2425956 - RNA, 13 nt, Bordetella pertussis
cugcacgaggcgc

SEQ ID NO: 2425957 - RNA, 20 nt, Bordetella pertussis
cugcacgaggcgcucggccu

SEQ ID NO: 2425958 - RNA, 13 nt, Bordetella pertussis
cugcacgauggcg

SEQ ID NO: 2425959 - RNA, 15 nt, Bordetella pertussis
cugcacgauggcgcc

SEQ ID NO: 2425960 - RNA, 19 nt, Bordetella pertussis
cugcacgauggcgccggcu

SEQ ID NO: 2425961 - RNA, 21 nt, Bordetella pertussis
cugcacgauguugccgccggc

SEQ ID NO: 2425962 - RNA, 18 nt, Bordetella pertussis
cugcacgauuccgccuac

SEQ ID NO: 2425963 - RNA, 18 nt, Bordetella pertussis
cugcacgccgggcgcgcu

SEQ ID NO: 2425964 - RNA, 18 nt, Bordetella pertussis
cugcacgcgcgcgggcgc

SEQ ID NO: 2425965 - RNA, 22 nt, Bordetella pertussis
cugcacgcgcgcgggcgcgccg

SEQ ID NO: 2425966 - RNA, 23 nt, Bordetella pertussis
cugcacgcgcgcgggcgcgccgu

SEQ ID NO: 2425967 - RNA, 17 nt, Bordetella pertussis
cugcacgcgcgcgugca

SEQ ID NO: 2425968 - RNA, 17 nt, Bordetella pertussis
cugcacgcggccgcgca

SEQ ID NO: 2425969 - RNA, 18 nt, Bordetella pertussis
cugcacgcggccgcgcag

SEQ ID NO: 2425970 - RNA, 19 nt, Bordetella pertussis
cugcacgcggccgcgcagg

SEQ ID NO: 2425971 - RNA, 14 nt, Bordetella pertussis
cugcacgcgggcgc

SEQ ID NO: 2425972 - RNA, 15 nt, Bordetella pertussis
cugcacgcgggcgcu

SEQ ID NO: 2425973 - RNA, 18 nt, Bordetella pertussis
cugcacgcgguccacgcc

SEQ ID NO: 2425974 - RNA, 19 nt, Bordetella pertussis
cugcacgcgguccacgccg

SEQ ID NO: 2425975 - RNA, 16 nt, Bordetella pertussis
cugcacgcucuugagc

SEQ ID NO: 2425976 - RNA, 21 nt, Bordetella pertussis
cugcacgcucuugagcgcggc

SEQ ID NO: 2425977 - RNA, 15 nt, Bordetella pertussis
cugcacgcuguacug

SEQ ID NO: 2425978 - RNA, 14 nt, Bordetella pertussis
cugcacggccuugu

SEQ ID NO: 2425979 - RNA, 16 nt, Bordetella pertussis
cugcacggcggaaugc

SEQ ID NO: 2425980 - RNA, 17 nt, Bordetella pertussis
cugcacggugggcagca

SEQ ID NO: 2425981 - RNA, 20 nt, Bordetella pertussis
cugcacggugggcagcagca

SEQ ID NO: 2425982 - RNA, 22 nt, Bordetella pertussis
cugcacggugggcagcagcacg

SEQ ID NO: 2425983 - RNA, 15 nt, Bordetella pertussis
cugcacgucccaguc

SEQ ID NO: 2425984 - RNA, 22 nt, Bordetella pertussis
cugcacgucccagucgccgcgc

SEQ ID NO: 2425985 - RNA, 17 nt, Bordetella pertussis
cugcacuugcgaacggc

SEQ ID NO: 2425986 - RNA, 20 nt, Bordetella pertussis
cugcacuugcgaacggccgc

SEQ ID NO: 2425987 - RNA, 17 nt, Bordetella pertussis
cugcagcacgcaccagg

SEQ ID NO: 2425988 - RNA, 18 nt, Bordetella pertussis
cugcagcacgcaccaggc

SEQ ID NO: 2425989 - RNA, 18 nt, Bordetella pertussis
cugcagcacgcuggccuu

SEQ ID NO: 2425990 - RNA, 19 nt, Bordetella pertussis
cugcagcacggccacggcc

SEQ ID NO: 2425991 - RNA, 23 nt, Bordetella pertussis
cugcagcacggccacggccggca

SEQ ID NO: 2425992 - RNA, 14 nt, Bordetella pertussis
cugcagcagcgccu

SEQ ID NO: 2425993 - RNA, 19 nt, Bordetella pertussis
cugcagcagcggcagcucg

SEQ ID NO: 2425994 - RNA, 23 nt, Bordetella pertussis
cugcagcagcggcagcucggcga

SEQ ID NO: 2425995 - RNA, 17 nt, Bordetella pertussis
cugcagcagcguggccg

SEQ ID NO: 2425996 - RNA, 20 nt, Bordetella pertussis
cugcagcagcguggccgcca

SEQ ID NO: 2425997 - RNA, 21 nt, Bordetella pertussis
cugcagcagcguggccgccac

SEQ ID NO: 2425998 - RNA, 17 nt, Bordetella pertussis
cugcagcaggcgcacca

SEQ ID NO: 2425999 - RNA, 20 nt, Bordetella pertussis
cugcagcaggcgcaccagcg

SEQ ID NO: 2426000 - RNA, 14 nt, Bordetella pertussis
cugcagcaugaccg

SEQ ID NO: 2426001 - RNA, 21 nt, Bordetella pertussis
cugcagcaugaccgacaggcg

SEQ ID NO: 2426002 - RNA, 15 nt, Bordetella pertussis
cugcagccacuggaa

SEQ ID NO: 2426003 - RNA, 18 nt, Bordetella pertussis
cugcagccacuggaacag

SEQ ID NO: 2426004 - RNA, 23 nt, Bordetella pertussis
cugcagccacuggaacagcuugg

SEQ ID NO: 2426005 - RNA, 15 nt, Bordetella pertussis
cugcagccagaucuc

SEQ ID NO: 2426006 - RNA, 16 nt, Bordetella pertussis
cugcagccaguugggc

SEQ ID NO: 2426007 - RNA, 20 nt, Bordetella pertussis
cugcagccauucggccacuu

SEQ ID NO: 2426008 - RNA, 15 nt, Bordetella pertussis
cugcagcccggccag

SEQ ID NO: 2426009 - RNA, 22 nt, Bordetella pertussis
cugcagcccggccagagccugg

SEQ ID NO: 2426010 - RNA, 15 nt, Bordetella pertussis
cugcagcgcaccacc

SEQ ID NO: 2426011 - RNA, 16 nt, Bordetella pertussis
cugcagcgccgccugg

SEQ ID NO: 2426012 - RNA, 15 nt, Bordetella pertussis
cugcagcgcgcgcgc

SEQ ID NO: 2426013 - RNA, 13 nt, Bordetella pertussis
cugcagcgucugc

SEQ ID NO: 2426014 - RNA, 17 nt, Bordetella pertussis
cugcagcgucuggcacg

SEQ ID NO: 2426015 - RNA, 23 nt, Bordetella pertussis
cugcagcugcuugcccaggccgg

SEQ ID NO: 2426016 - RNA, 17 nt, Bordetella pertussis
cugcagcuugcgcgcca

SEQ ID NO: 2426017 - RNA, 18 nt, Bordetella pertussis
cugcagcuugcgcgccag

SEQ ID NO: 2426018 - RNA, 17 nt, Bordetella pertussis
cugcaggaagccugcgc

SEQ ID NO: 2426019 - RNA, 19 nt, Bordetella pertussis
cugcaggaagccugcgcgc

SEQ ID NO: 2426020 - RNA, 20 nt, Bordetella pertussis
cugcaggaaguccuucagcc

SEQ ID NO: 2426021 - RNA, 23 nt, Bordetella pertussis
cugccccggcagagacagauacc

SEQ ID NO: 2426022 - RNA, 22 nt, Bordetella pertussis
cugccccuauaccccguacuug

SEQ ID NO: 2426023 - RNA, 19 nt, Bordetella pertussis
cugcccgaagcgcagcacc

SEQ ID NO: 2426024 - RNA, 20 nt, Bordetella pertussis
cugcccgaagcgcagcacca

SEQ ID NO: 2426025 - RNA, 14 nt, Bordetella pertussis
cugcccgaagcggc

SEQ ID NO: 2426026 - RNA, 16 nt, Bordetella pertussis
cugcccgaagcggccc

SEQ ID NO: 2426027 - RNA, 19 nt, Bordetella pertussis
cugcccgaagcggcccggg

SEQ ID NO: 2426028 - RNA, 14 nt, Bordetella pertussis
cugcccgacggcgc

SEQ ID NO: 2426029 - RNA, 16 nt, Bordetella pertussis
cugcccgacggcgccg

SEQ ID NO: 2426030 - RNA, 17 nt, Bordetella pertussis
cugcccgacggcgccga

SEQ ID NO: 2426031 - RNA, 18 nt, Bordetella pertussis
cugcccgacggcgccgau

SEQ ID NO: 2426032 - RNA, 21 nt, Bordetella pertussis
cugcccgacggcgccgauccg

SEQ ID NO: 2426033 - RNA, 18 nt, Bordetella pertussis
cugcccgagaccgcccgc

SEQ ID NO: 2426034 - RNA, 21 nt, Bordetella pertussis
cugcccgagaccgcccgcugc

SEQ ID NO: 2426035 - RNA, 18 nt, Bordetella pertussis
cugcccgcaacgccgccc

SEQ ID NO: 2426036 - RNA, 14 nt, Bordetella pertussis
cugcccgcacgggc

SEQ ID NO: 2426037 - RNA, 16 nt, Bordetella pertussis
cugcccgcacgggccg

SEQ ID NO: 2426038 - RNA, 17 nt, Bordetella pertussis
cugcccgcacgggccga

SEQ ID NO: 2426039 - RNA, 18 nt, Bordetella pertussis
cugcccgcauccgacucc

SEQ ID NO: 2426040 - RNA, 19 nt, Bordetella pertussis
cugcccgccuggucgcugg

SEQ ID NO: 2426041 - RNA, 17 nt, Bordetella pertussis
cugcccgggcagcaccg

SEQ ID NO: 2426042 - RNA, 19 nt, Bordetella pertussis
cugcccgggcagcaccgcu

SEQ ID NO: 2426043 - RNA, 22 nt, Bordetella pertussis
cugcccguacgucaaggccugc

SEQ ID NO: 2426044 - RNA, 13 nt, Bordetella pertussis
cugcccgucgggc

SEQ ID NO: 2426045 - RNA, 16 nt, Bordetella pertussis
cugcccgucuauggcc

SEQ ID NO: 2426046 - RNA, 20 nt, Bordetella pertussis
cugcccgucuauggccugca

SEQ ID NO: 2426047 - RNA, 13 nt, Bordetella pertussis
cugcccgugcggg

SEQ ID NO: 2426048 - RNA, 20 nt, Bordetella pertussis
cugcccgugcgugcgccugu

SEQ ID NO: 2426049 - RNA, 21 nt, Bordetella pertussis
cugcccgugcgugcgccuguc

SEQ ID NO: 2426050 - RNA, 14 nt, Bordetella pertussis
cugcccgugcgugu

SEQ ID NO: 2426051 - RNA, 20 nt, Bordetella pertussis
cugcccgugcgugugccugu

SEQ ID NO: 2426052 - RNA, 16 nt, Bordetella pertussis
cugcccucgcccgugc

SEQ ID NO: 2426053 - RNA, 17 nt, Bordetella pertussis
cugcccucgcccgugcg

SEQ ID NO: 2426054 - RNA, 16 nt, Bordetella pertussis
cugcccucgccucggc

SEQ ID NO: 2426055 - RNA, 15 nt, Bordetella pertussis
cugcccucgggcgac

SEQ ID NO: 2426056 - RNA, 16 nt, Bordetella pertussis
cugcccucgggcgaca

SEQ ID NO: 2426057 - RNA, 18 nt, Bordetella pertussis
cugcccucggucagcgcc

SEQ ID NO: 2426058 - RNA, 22 nt, Bordetella pertussis
cugcccugcaugaccgccgcca

SEQ ID NO: 2426059 - RNA, 23 nt, Bordetella pertussis
cugcccugcggcuugggcccggc

SEQ ID NO: 2426060 - RNA, 23 nt, Bordetella pertussis
cugcccuggacgucugagcgccg

SEQ ID NO: 2426061 - RNA, 16 nt, Bordetella pertussis
cugcccuggaucagga

SEQ ID NO: 2426062 - RNA, 19 nt, Bordetella pertussis
cugcccuggaucaggaugg

SEQ ID NO: 2426063 - RNA, 16 nt, Bordetella pertussis
cugcccuggcccaggc

SEQ ID NO: 2426064 - RNA, 17 nt, Bordetella pertussis
cugcccuggcccaggcc

SEQ ID NO: 2426065 - RNA, 15 nt, Bordetella pertussis
cugccgaaacgcugg

SEQ ID NO: 2426066 - RNA, 17 nt, Bordetella pertussis
cugccgaaacgcuggcg

SEQ ID NO: 2426067 - RNA, 22 nt, Bordetella pertussis
cugccgaauucguuggugccca

SEQ ID NO: 2426068 - RNA, 15 nt, Bordetella pertussis
cugccgagacggccg

SEQ ID NO: 2426069 - RNA, 17 nt, Bordetella pertussis
cugccgagacggccgcc

SEQ ID NO: 2426070 - RNA, 16 nt, Bordetella pertussis
cugccgauacgggcgc

SEQ ID NO: 2426071 - RNA, 19 nt, Bordetella pertussis
cugccgauacgggcgcggc

SEQ ID NO: 2426072 - RNA, 21 nt, Bordetella pertussis
cugccgaucaagagccuggag

SEQ ID NO: 2426073 - RNA, 18 nt, Bordetella pertussis
cugccgaucgugcacgcc

SEQ ID NO: 2426074 - RNA, 20 nt, Bordetella pertussis
cugccgaucgugcacgcccg

SEQ ID NO: 2426075 - RNA, 18 nt, Bordetella pertussis
cugccgcacuucgggcca

SEQ ID NO: 2426076 - RNA, 17 nt, Bordetella pertussis
cugccgcaucccgcccc

SEQ ID NO: 2426077 - RNA, 18 nt, Bordetella pertussis
cugccgcaucccgccccc

SEQ ID NO: 2426078 - RNA, 21 nt, Bordetella pertussis
cugccgcaucccgcccccgcc

SEQ ID NO: 2426079 - RNA, 20 nt, Bordetella pertussis
cugccgccaagggcgcgcca

SEQ ID NO: 2426080 - RNA, 13 nt, Bordetella pertussis
cugccgcccgagc

SEQ ID NO: 2426081 - RNA, 21 nt, Bordetella pertussis
cugccgcccgagcuggccggc

SEQ ID NO: 2426082 - RNA, 23 nt, Bordetella pertussis
cugccgcccgagcuggccggcga

SEQ ID NO: 2426083 - RNA, 14 nt, Bordetella pertussis
cugccgcccuggcg

SEQ ID NO: 2426084 - RNA, 16 nt, Bordetella pertussis
cugccgcccuggcgca

SEQ ID NO: 2426085 - RNA, 18 nt, Bordetella pertussis
cugccgccgaugugcggc

SEQ ID NO: 2426086 - RNA, 13 nt, Bordetella pertussis
cugccgccggcga

SEQ ID NO: 2426087 - RNA, 21 nt, Bordetella pertussis
cugccgcgcauuugccgcggc

SEQ ID NO: 2426088 - RNA, 14 nt, Bordetella pertussis
cugccgcgcccggc

SEQ ID NO: 2426089 - RNA, 15 nt, Bordetella pertussis
cugccgcgcccggcg

SEQ ID NO: 2426090 - RNA, 17 nt, Bordetella pertussis
cugccgcgcccggcggc

SEQ ID NO: 2426091 - RNA, 22 nt, Bordetella pertussis
cugccgcgcccggcggccaggc

SEQ ID NO: 2426092 - RNA, 14 nt, Bordetella pertussis
cugccgcgccgacc

SEQ ID NO: 2426093 - RNA, 16 nt, Bordetella pertussis
cugccgcgccgaccgg

SEQ ID NO: 2426094 - RNA, 20 nt, Bordetella pertussis
cugccgcgcgauccggcgug

SEQ ID NO: 2426095 - RNA, 14 nt, Bordetella pertussis
cugccgcgcgccgg

SEQ ID NO: 2426096 - RNA, 21 nt, Bordetella pertussis
cugccgcgcgccggcgccggc

SEQ ID NO: 2426097 - RNA, 14 nt, Bordetella pertussis
cugccgcgcguacg

SEQ ID NO: 2426098 - RNA, 20 nt, Bordetella pertussis
cugccgcgcguacgcggcgc

SEQ ID NO: 2426099 - RNA, 19 nt, Bordetella pertussis
cugccgcggauugccgucc

SEQ ID NO: 2426100 - RNA, 23 nt, Bordetella pertussis
cugccgcugaucuuccugggcga

SEQ ID NO: 2426101 - RNA, 16 nt, Bordetella pertussis
cugccgcugcccaccu

SEQ ID NO: 2426102 - RNA, 13 nt, Bordetella pertussis
cugccggaccugg

SEQ ID NO: 2426103 - RNA, 16 nt, Bordetella pertussis
cugccggaccugggca

SEQ ID NO: 2426104 - RNA, 22 nt, Bordetella pertussis
cugccggcauugcccaccacgg

SEQ ID NO: 2426105 - RNA, 22 nt, Bordetella pertussis
cugccggccgaccggcgcgcgc

SEQ ID NO: 2426106 - RNA, 23 nt, Bordetella pertussis
cugccggccgaccggcgcgcgcg

SEQ ID NO: 2426107 - RNA, 12 nt, Bordetella pertussis
cugccggccggc

SEQ ID NO: 2426108 - RNA, 14 nt, Bordetella pertussis
cugccggccggcca

SEQ ID NO: 2426109 - RNA, 17 nt, Bordetella pertussis
cugccggccggccagua

SEQ ID NO: 2426110 - RNA, 13 nt, Bordetella pertussis
cugccggccuggc

SEQ ID NO: 2426111 - RNA, 14 nt, Bordetella pertussis
cugccggccuggcu

SEQ ID NO: 2426112 - RNA, 23 nt, Bordetella pertussis
cugccggcgcgccucggcgcgcg

SEQ ID NO: 2426113 - RNA, 16 nt, Bordetella pertussis
cugccggcgcgggcgc

SEQ ID NO: 2426114 - RNA, 23 nt, Bordetella pertussis
cugccggcgcgggcgcaggcguu

SEQ ID NO: 2426115 - RNA, 14 nt, Bordetella pertussis
cugccggcggccua

SEQ ID NO: 2426116 - RNA, 19 nt, Bordetella pertussis
cugccggcguccugcggcg

SEQ ID NO: 2426117 - RNA, 21 nt, Bordetella pertussis
cugccggcguccugcggcggc

SEQ ID NO: 2426118 - RNA, 17 nt, Bordetella pertussis
cugccgggacaggcacc

SEQ ID NO: 2426119 - RNA, 14 nt, Bordetella pertussis
cugccgggcaugaa

SEQ ID NO: 2426120 - RNA, 22 nt, Bordetella pertussis
cugccgggcucggccaccaugc

SEQ ID NO: 2426121 - RNA, 17 nt, Bordetella pertussis
cugccggggcacccagg

SEQ ID NO: 2426122 - RNA, 18 nt, Bordetella pertussis
cugccggggcacccaggc

SEQ ID NO: 2426123 - RNA, 20 nt, Bordetella pertussis
cugccgguaaccgacgcagc

SEQ ID NO: 2426124 - RNA, 22 nt, Bordetella pertussis
cugccgguaaccgacgcagcgc

SEQ ID NO: 2426125 - RNA, 16 nt, Bordetella pertussis
cugccguagcccaggu

SEQ ID NO: 2426126 - RNA, 18 nt, Bordetella pertussis
cugccguagcccaggucc

SEQ ID NO: 2426127 - RNA, 19 nt, Bordetella pertussis
cugccguagcccaggucca

SEQ ID NO: 2426128 - RNA, 22 nt, Bordetella pertussis
cugccguagcccagguccagcg

SEQ ID NO: 2426129 - RNA, 17 nt, Bordetella pertussis
cugccguccuugugcca

SEQ ID NO: 2426130 - RNA, 16 nt, Bordetella pertussis
cugccgucgccaaagc

SEQ ID NO: 2426131 - RNA, 15 nt, Bordetella pertussis
cugccgucggccagc

SEQ ID NO: 2426132 - RNA, 16 nt, Bordetella pertussis
cugccgucggccagcu

SEQ ID NO: 2426133 - RNA, 15 nt, Bordetella pertussis
cugcucacgccccgc

SEQ ID NO: 2426134 - RNA, 17 nt, Bordetella pertussis
cugcucacgccccgccc

SEQ ID NO: 2426135 - RNA, 23 nt, Bordetella pertussis
cugcucacgccccgcccucuucc

SEQ ID NO: 2426136 - RNA, 16 nt, Bordetella pertussis
cugcuccacgugcggc

SEQ ID NO: 2426137 - RNA, 19 nt, Bordetella pertussis
cugcuccacgugcggcagg

SEQ ID NO: 2426138 - RNA, 19 nt, Bordetella pertussis
cugcucgacagcagcccgc

SEQ ID NO: 2426139 - RNA, 20 nt, Bordetella pertussis
cugcucgacagcagcccgcu

SEQ ID NO: 2426140 - RNA, 20 nt, Bordetella pertussis
cugcucgagcaugcgggcca

SEQ ID NO: 2426141 - RNA, 21 nt, Bordetella pertussis
cugcucgaucugguuggccac

SEQ ID NO: 2426142 - RNA, 22 nt, Bordetella pertussis
cugcucgaucugguuggccaca

SEQ ID NO: 2426143 - RNA, 15 nt, Bordetella pertussis
cugcucgcaggccug

SEQ ID NO: 2426144 - RNA, 23 nt, Bordetella pertussis
cugcucgcccacauagcggccgg

SEQ ID NO: 2426145 - RNA, 14 nt, Bordetella pertussis
cugcucgccgcgcg

SEQ ID NO: 2426146 - RNA, 17 nt, Bordetella pertussis
cugcucgccgcgcgaca

SEQ ID NO: 2426147 - RNA, 18 nt, Bordetella pertussis
cugcucgccggccagcgc

SEQ ID NO: 2426148 - RNA, 21 nt, Bordetella pertussis
cugcucgcgcagcguggcggc

SEQ ID NO: 2426149 - RNA, 23 nt, Bordetella pertussis
cugcucgcgcagcguggcggcga

SEQ ID NO: 2426150 - RNA, 17 nt, Bordetella pertussis
cugcucgcggcacugau

SEQ ID NO: 2426151 - RNA, 21 nt, Bordetella pertussis
cugcucggcgaugcgccauac

SEQ ID NO: 2426152 - RNA, 12 nt, Bordetella pertussis
cugcucgggcgc

SEQ ID NO: 2426153 - RNA, 16 nt, Bordetella pertussis
cugcucgggcgccucg

SEQ ID NO: 2426154 - RNA, 19 nt, Bordetella pertussis
cugcucgggcgccucgucc

SEQ ID NO: 2426155 - RNA, 17 nt, Bordetella pertussis
cugcucggugcucuggc

SEQ ID NO: 2426156 - RNA, 18 nt, Bordetella pertussis
cugcucggugcucuggcc

SEQ ID NO: 2426157 - RNA, 22 nt, Bordetella pertussis
cugcucgugcaucaucugggcg

SEQ ID NO: 2426158 - RNA, 17 nt, Bordetella pertussis
cugcucguucugcgcgc

SEQ ID NO: 2426159 - RNA, 19 nt, Bordetella pertussis
cugcucguucugcgcgccc

SEQ ID NO: 2426160 - RNA, 19 nt, Bordetella pertussis
cugcucguugcgcaagccg

SEQ ID NO: 2426161 - RNA, 21 nt, Bordetella pertussis
cugcucguugcgcaagccgcc

SEQ ID NO: 2426162 - RNA, 18 nt, Bordetella pertussis
cugcucuuggcgccggac

SEQ ID NO: 2426163 - RNA, 18 nt, Bordetella pertussis
cugcugacaggcgucugc

SEQ ID NO: 2426164 - RNA, 15 nt, Bordetella pertussis
cugcugaccgacggc

SEQ ID NO: 2426165 - RNA, 17 nt, Bordetella pertussis
cugcugaccgacggccu

SEQ ID NO: 2426166 - RNA, 21 nt, Bordetella pertussis
cugcugcaauucgccgaugcg

SEQ ID NO: 2426167 - RNA, 13 nt, Bordetella pertussis
cugcugcacgcgc

SEQ ID NO: 2426168 - RNA, 16 nt, Bordetella pertussis
cugcugcacgcgcgcg

SEQ ID NO: 2426169 - RNA, 21 nt, Bordetella pertussis
cugcugcacgugaugcaggcg

SEQ ID NO: 2426170 - RNA, 14 nt, Bordetella pertussis
cugcugcagccacu

SEQ ID NO: 2426171 - RNA, 13 nt, Bordetella pertussis
cugcugcaggccg

SEQ ID NO: 2426172 - RNA, 16 nt, Bordetella pertussis
cugcugcaggccggcg

SEQ ID NO: 2426173 - RNA, 17 nt, Bordetella pertussis
cugcugcaggccggcgc

SEQ ID NO: 2426174 - RNA, 14 nt, Bordetella pertussis
cugcugcaggcgcg

SEQ ID NO: 2426175 - RNA, 16 nt, Bordetella pertussis
cugcugcaggcgcggg

SEQ ID NO: 2426176 - RNA, 21 nt, Bordetella pertussis
cugcugcccgaagcgcagcac

SEQ ID NO: 2426177 - RNA, 22 nt, Bordetella pertussis
cugcugcccgaagcgcagcacc

SEQ ID NO: 2426178 - RNA, 12 nt, Bordetella pertussis
cugcugcccgcc

SEQ ID NO: 2426179 - RNA, 16 nt, Bordetella pertussis
cugcugcccgccgccg

SEQ ID NO: 2426180 - RNA, 20 nt, Bordetella pertussis
cugcugcccgccgccgccca

SEQ ID NO: 2426181 - RNA, 22 nt, Bordetella pertussis
cugcugcccgccgccgcccacg

SEQ ID NO: 2426182 - RNA, 23 nt, Bordetella pertussis
cugcugcccgccgccgcccacgc

SEQ ID NO: 2426183 - RNA, 20 nt, Bordetella pertussis
cugcugcgagacgcgcucgc

SEQ ID NO: 2426184 - RNA, 22 nt, Bordetella pertussis
cugcugcgagacgcgcucgcgc

SEQ ID NO: 2426185 - RNA, 14 nt, Bordetella pertussis
cugcugcgccgucu

SEQ ID NO: 2426186 - RNA, 12 nt, Bordetella pertussis
cugcugcgccug

SEQ ID NO: 2426187 - RNA, 17 nt, Bordetella pertussis
cugcugcgccuggccgc

SEQ ID NO: 2426188 - RNA, 16 nt, Bordetella pertussis
cugcugcgccuggcgg

SEQ ID NO: 2426189 - RNA, 18 nt, Bordetella pertussis
cugcugcgccuggcggac

SEQ ID NO: 2426190 - RNA, 13 nt, Bordetella pertussis
cugcugcggcacg

SEQ ID NO: 2426191 - RNA, 13 nt, Bordetella pertussis
cugcugcguggua

SEQ ID NO: 2426192 - RNA, 19 nt, Bordetella pertussis
cugcugcuggaccuggcca

SEQ ID NO: 2426193 - RNA, 12 nt, Bordetella pertussis
cugcugcuggcu

SEQ ID NO: 2426194 - RNA, 15 nt, Bordetella pertussis
cugcugcuggcugcc

SEQ ID NO: 2426195 - RNA, 17 nt, Bordetella pertussis
cugcugcuggcugcccu

SEQ ID NO: 2426196 - RNA, 18 nt, Bordetella pertussis
cugcugcuggcugcccug

SEQ ID NO: 2426197 - RNA, 14 nt, Bordetella pertussis
cugcugcuggcuuc

SEQ ID NO: 2426198 - RNA, 13 nt, Bordetella pertussis
cugcuggaccugg

SEQ ID NO: 2426199 - RNA, 14 nt, Bordetella pertussis
cugcuggaccuggc

SEQ ID NO: 2426200 - RNA, 19 nt, Bordetella pertussis
cugcuggaccuggccacca

SEQ ID NO: 2426201 - RNA, 15 nt, Bordetella pertussis
cugcuggagaucgcc

SEQ ID NO: 2426202 - RNA, 17 nt, Bordetella pertussis
cugcuggagaucgccga

SEQ ID NO: 2426203 - RNA, 20 nt, Bordetella pertussis
cugcuggagaucgccgagcg

SEQ ID NO: 2426204 - RNA, 22 nt, Bordetella pertussis
cugcuggagaucgccgagcggc

SEQ ID NO: 2426205 - RNA, 15 nt, Bordetella pertussis
cugcuggaggccggc

SEQ ID NO: 2426206 - RNA, 18 nt, Bordetella pertussis
cugcuggaggccggcgug

SEQ ID NO: 2426207 - RNA, 14 nt, Bordetella pertussis
cugcuggccaagcg

SEQ ID NO: 2426208 - RNA, 19 nt, Bordetella pertussis
cugcuggccaagcgcgccg

SEQ ID NO: 2426209 - RNA, 22 nt, Bordetella pertussis
cugcuggccaagcgcgccggcu

SEQ ID NO: 2426210 - RNA, 16 nt, Bordetella pertussis
cugcuggccaccgucg

SEQ ID NO: 2426211 - RNA, 16 nt, Bordetella pertussis
cugcuggccgccggcg

SEQ ID NO: 2426212 - RNA, 19 nt, Bordetella pertussis
cugcuggccgccggcgcgg

SEQ ID NO: 2426213 - RNA, 15 nt, Bordetella pertussis
cugcuggccggccag

SEQ ID NO: 2426214 - RNA, 16 nt, Bordetella pertussis
cugcuggccggccagc

SEQ ID NO: 2426215 - RNA, 21 nt, Bordetella pertussis
cugcuggccggccccauccuc

SEQ ID NO: 2426216 - RNA, 13 nt, Bordetella pertussis
cugcuggcgcgca

SEQ ID NO: 2426217 - RNA, 14 nt, Bordetella pertussis
cugcuggcgcgcca

SEQ ID NO: 2426218 - RNA, 22 nt, Bordetella pertussis
cugcuggcgcgucggcgcgcgc

SEQ ID NO: 2426219 - RNA, 14 nt, Bordetella pertussis
cugcuggcggcgcu

SEQ ID NO: 2426220 - RNA, 16 nt, Bordetella pertussis
cugcuggcugcccugg

SEQ ID NO: 2426221 - RNA, 19 nt, Bordetella pertussis
cugcuggcugcccuggcgc

SEQ ID NO: 2426222 - RNA, 19 nt, Bordetella pertussis
cugcuggcuucggcgcugg

SEQ ID NO: 2426223 - RNA, 18 nt, Bordetella pertussis
cugcugggccgcgcucga

SEQ ID NO: 2426224 - RNA, 13 nt, Bordetella pertussis
cugcugggccggc

SEQ ID NO: 2426225 - RNA, 19 nt, Bordetella pertussis
cugcugggccggcgcgcgc

SEQ ID NO: 2426226 - RNA, 20 nt, Bordetella pertussis
cugcugggccggcgcgcgca

SEQ ID NO: 2426227 - RNA, 14 nt, Bordetella pertussis
cugcugggcgccau

SEQ ID NO: 2426228 - RNA, 23 nt, Bordetella pertussis
cugcugggcgccaugcgcccggc

SEQ ID NO: 2426229 - RNA, 18 nt, Bordetella pertussis
cugcugggguggagcgcg

SEQ ID NO: 2426230 - RNA, 19 nt, Bordetella pertussis
cugcugggguggagcgcgg

SEQ ID NO: 2426231 - RNA, 23 nt, Bordetella pertussis
cugcugggguggagcgcggcgcu

SEQ ID NO: 2426232 - RNA, 17 nt, Bordetella pertussis
cugcugguacagcccca

SEQ ID NO: 2426233 - RNA, 21 nt, Bordetella pertussis
cugcugguacagccccagcgc

SEQ ID NO: 2426234 - RNA, 16 nt, Bordetella pertussis
cugcuggucggccucg

SEQ ID NO: 2426235 - RNA, 17 nt, Bordetella pertussis
cugcuggugcuggugcu

SEQ ID NO: 2426236 - RNA, 16 nt, Bordetella pertussis
cugcugucgcgcgacu

SEQ ID NO: 2426237 - RNA, 21 nt, Bordetella pertussis
cugcugugcgauggcacggca

SEQ ID NO: 2426238 - RNA, 19 nt, Bordetella pertussis
cugcugugcgccggggcgc

SEQ ID NO: 2426239 - RNA, 16 nt, Bordetella pertussis
cugcuguucaccuuca

SEQ ID NO: 2426240 - RNA, 14 nt, Bordetella pertussis
cugcuguugcgcgu

SEQ ID NO: 2426241 - RNA, 15 nt, Bordetella pertussis
cugcuguugcgcgug

SEQ ID NO: 2426242 - RNA, 16 nt, Bordetella pertussis
cugcuguuggcguggc

SEQ ID NO: 2426243 - RNA, 19 nt, Bordetella pertussis
cugcuucauccaggcgcuc

SEQ ID NO: 2426244 - RNA, 13 nt, Bordetella pertussis
cugcuugaagacg

SEQ ID NO: 2426245 - RNA, 20 nt, Bordetella pertussis
cugcuugaagacgcccaggu

SEQ ID NO: 2426246 - RNA, 20 nt, Bordetella pertussis
cuggcagaugcgcgccaggc

SEQ ID NO: 2426247 - RNA, 14 nt, Bordetella pertussis
cuggcagcuggcgc

SEQ ID NO: 2426248 - RNA, 17 nt, Bordetella pertussis
cuggcagcuggcgcggg

SEQ ID NO: 2426249 - RNA, 23 nt, Bordetella pertussis
cuggcagguguuguugcacgacg

SEQ ID NO: 2426250 - RNA, 16 nt, Bordetella pertussis
cuggcagugcgccugg

SEQ ID NO: 2426251 - RNA, 15 nt, Bordetella pertussis
cuggcaucagggcga

SEQ ID NO: 2426252 - RNA, 22 nt, Bordetella pertussis
cuggcaugugccaccgcccagg

SEQ ID NO: 2426253 - RNA, 23 nt, Bordetella pertussis
cuggcaugugccaccgcccaggc

SEQ ID NO: 2426254 - RNA, 15 nt, Bordetella pertussis
cuggcauugacgacg

SEQ ID NO: 2426255 - RNA, 16 nt, Bordetella pertussis
cuggccaagcgcgccg

SEQ ID NO: 2426256 - RNA, 17 nt, Bordetella pertussis
cuggccaagcgcgccgg

SEQ ID NO: 2426257 - RNA, 15 nt, Bordetella pertussis
cuggccaaugccuau

SEQ ID NO: 2426258 - RNA, 22 nt, Bordetella pertussis
cuggccaaugccuauuggcugu

SEQ ID NO: 2426259 - RNA, 13 nt, Bordetella pertussis
cuggccacaagcg

SEQ ID NO: 2426260 - RNA, 19 nt, Bordetella pertussis
cuggccacccgacagcucg

SEQ ID NO: 2426261 - RNA, 22 nt, Bordetella pertussis
cuggccaccgaagcggcguucu

SEQ ID NO: 2426262 - RNA, 16 nt, Bordetella pertussis
cuggccaccgucgcca

SEQ ID NO: 2426263 - RNA, 15 nt, Bordetella pertussis
cuggccacgcugcug

SEQ ID NO: 2426264 - RNA, 14 nt, Bordetella pertussis
cuggccacuggccg

SEQ ID NO: 2426265 - RNA, 22 nt, Bordetella pertussis
cuggccacuggccgcgcucagg

SEQ ID NO: 2426266 - RNA, 18 nt, Bordetella pertussis
cuggccagauagcccagg

SEQ ID NO: 2426267 - RNA, 22 nt, Bordetella pertussis
cuggccagauagcccaggcggg

SEQ ID NO: 2426268 - RNA, 18 nt, Bordetella pertussis
cuggccagccgcucgcgc

SEQ ID NO: 2426269 - RNA, 18 nt, Bordetella pertussis
cuggccagcgguucgucg

SEQ ID NO: 2426270 - RNA, 16 nt, Bordetella pertussis
cuggccaucaccgccu

SEQ ID NO: 2426271 - RNA, 17 nt, Bordetella pertussis
cuggccaucaccgccuc

SEQ ID NO: 2426272 - RNA, 20 nt, Bordetella pertussis
cuggccaucaccgccuccgg

SEQ ID NO: 2426273 - RNA, 23 nt, Bordetella pertussis
cuggccaucaccgccuccgggua

SEQ ID NO: 2426274 - RNA, 19 nt, Bordetella pertussis
cuggccaucuaugucggcu

SEQ ID NO: 2426275 - RNA, 17 nt, Bordetella pertussis
cuggccaugccgucgcg

SEQ ID NO: 2426276 - RNA, 20 nt, Bordetella pertussis
cuggccaugccgucgcgcac

SEQ ID NO: 2426277 - RNA, 21 nt, Bordetella pertussis
cuggccauuccuuccgggccc

SEQ ID NO: 2426278 - RNA, 20 nt, Bordetella pertussis
cuggcccacaucgucgcgcu

SEQ ID NO: 2426279 - RNA, 13 nt, Bordetella pertussis
cuggcccacgcgc

SEQ ID NO: 2426280 - RNA, 14 nt, Bordetella pertussis
cuggcccacgcgca

SEQ ID NO: 2426281 - RNA, 17 nt, Bordetella pertussis
cuggcccacgcgcacga

SEQ ID NO: 2426282 - RNA, 20 nt, Bordetella pertussis
cuggcccacucggugcgcgc

SEQ ID NO: 2426283 - RNA, 19 nt, Bordetella pertussis
cuggcccagaccaagcgcc

SEQ ID NO: 2426284 - RNA, 22 nt, Bordetella pertussis
cuggcccagaccaagcgccaca

SEQ ID NO: 2426285 - RNA, 10 nt, Bordetella pertussis
cuggcccagc

SEQ ID NO: 2426286 - RNA, 16 nt, Bordetella pertussis
cuggcccagcuccagc

SEQ ID NO: 2426287 - RNA, 17 nt, Bordetella pertussis
cuggcccagcuccagcu

SEQ ID NO: 2426288 - RNA, 21 nt, Bordetella pertussis
cuggcccagcuccagcuggcg

SEQ ID NO: 2426289 - RNA, 22 nt, Bordetella pertussis
cuggcccagcuccagcuggcgc

SEQ ID NO: 2426290 - RNA, 23 nt, Bordetella pertussis
cuggcccagcuccagcuggcgca

SEQ ID NO: 2426291 - RNA, 14 nt, Bordetella pertussis
cuggcccagcuggg

SEQ ID NO: 2426292 - RNA, 15 nt, Bordetella pertussis
cuggcccagcugggc

SEQ ID NO: 2426293 - RNA, 19 nt, Bordetella pertussis
cuggcccagcugggcggcg

SEQ ID NO: 2426294 - RNA, 13 nt, Bordetella pertussis
cuggcccaggccg

SEQ ID NO: 2426295 - RNA, 15 nt, Bordetella pertussis
cuggcccaggcgggc

SEQ ID NO: 2426296 - RNA, 23 nt, Bordetella pertussis
cuggcccaguucgcgcagcagcu

SEQ ID NO: 2426297 - RNA, 20 nt, Bordetella pertussis
cuggcccaugaacaggcacg

SEQ ID NO: 2426298 - RNA, 14 nt, Bordetella pertussis
cuggccccaggcgc

SEQ ID NO: 2426299 - RNA, 23 nt, Bordetella pertussis
cuggcccgaacggcccauccauc

SEQ ID NO: 2426300 - RNA, 14 nt, Bordetella pertussis
cuggcccgccagca

SEQ ID NO: 2426301 - RNA, 21 nt, Bordetella pertussis
cuggcccgccagcaaggcggc

SEQ ID NO: 2426302 - RNA, 16 nt, Bordetella pertussis
cuggcccgcgcgagcg

SEQ ID NO: 2426303 - RNA, 18 nt, Bordetella pertussis
cuggcccggcaccgucca

SEQ ID NO: 2426304 - RNA, 14 nt, Bordetella pertussis
cuggcccgucaugg

SEQ ID NO: 2426305 - RNA, 16 nt, Bordetella pertussis
cuggcccgucaugggc

SEQ ID NO: 2426306 - RNA, 17 nt, Bordetella pertussis
cuggcccgucaugggcg

SEQ ID NO: 2426307 - RNA, 21 nt, Bordetella pertussis
cuggcccgucaugggcggggc

SEQ ID NO: 2426308 - RNA, 14 nt, Bordetella pertussis
cuggcccgucaugu

SEQ ID NO: 2426309 - RNA, 14 nt, Bordetella pertussis
cuggcccuggcaga

SEQ ID NO: 2426310 - RNA, 19 nt, Bordetella pertussis
cuggcccuggcgggccgga

SEQ ID NO: 2426311 - RNA, 18 nt, Bordetella pertussis
cuggccgaacgccgccgc

SEQ ID NO: 2426312 - RNA, 13 nt, Bordetella pertussis
cuggccgacaagg

SEQ ID NO: 2426313 - RNA, 14 nt, Bordetella pertussis
cuggccgagcgcgg

SEQ ID NO: 2426314 - RNA, 15 nt, Bordetella pertussis
cuggccgagcgcggc

SEQ ID NO: 2426315 - RNA, 16 nt, Bordetella pertussis
cuggccgagcgcggca

SEQ ID NO: 2426316 - RNA, 22 nt, Bordetella pertussis
cuggccgagcgcggcaugcgca

SEQ ID NO: 2426317 - RNA, 15 nt, Bordetella pertussis
cuggccgaucaccug

SEQ ID NO: 2426318 - RNA, 17 nt, Bordetella pertussis
cuggccgaucaccugca

SEQ ID NO: 2426319 - RNA, 21 nt, Bordetella pertussis
cuggccgaucaccugcaggcc

SEQ ID NO: 2426320 - RNA, 17 nt, Bordetella pertussis
cuggccgauggucagca

SEQ ID NO: 2426321 - RNA, 19 nt, Bordetella pertussis
cuggccgauggucagcaug

SEQ ID NO: 2426322 - RNA, 17 nt, Bordetella pertussis
cuggccgaugucgccgc

SEQ ID NO: 2426323 - RNA, 21 nt, Bordetella pertussis
cuggccgaugucgccgccugc

SEQ ID NO: 2426324 - RNA, 19 nt, Bordetella pertussis
cuggccgauuucgcgcgcc

SEQ ID NO: 2426325 - RNA, 23 nt, Bordetella pertussis
cuggccgauuucgcgcgccagcg

SEQ ID NO: 2426326 - RNA, 22 nt, Bordetella pertussis
cuggccgccauggcgcuggcag

SEQ ID NO: 2426327 - RNA, 15 nt, Bordetella pertussis
cuggccgcccagcgc

SEQ ID NO: 2426328 - RNA, 19 nt, Bordetella pertussis
cuggccgcccagcgccugc

SEQ ID NO: 2426329 - RNA, 20 nt, Bordetella pertussis
cuggccgcccgcggccugca

SEQ ID NO: 2426330 - RNA, 14 nt, Bordetella pertussis
cuggccgccgcgcu

SEQ ID NO: 2426331 - RNA, 18 nt, Bordetella pertussis
cuggccgccgcgcucacc

SEQ ID NO: 2426332 - RNA, 17 nt, Bordetella pertussis
cuggccgccgcggccuc

SEQ ID NO: 2426333 - RNA, 22 nt, Bordetella pertussis
cuggccgccgcggccucggccg

SEQ ID NO: 2426334 - RNA, 17 nt, Bordetella pertussis
cuggccgccgcgggcgc

SEQ ID NO: 2426335 - RNA, 19 nt, Bordetella pertussis
cuggccgccgcgggcgccg

SEQ ID NO: 2426336 - RNA, 14 nt, Bordetella pertussis
cuggccgccugcug

SEQ ID NO: 2426337 - RNA, 16 nt, Bordetella pertussis
cuggccgccugcugcg

SEQ ID NO: 2426338 - RNA, 18 nt, Bordetella pertussis
cuggccgccugcugcgcc

SEQ ID NO: 2426339 - RNA, 19 nt, Bordetella pertussis
cuggccgccugcugcgccg

SEQ ID NO: 2426340 - RNA, 12 nt, Bordetella pertussis
cuggccgcgaca

SEQ ID NO: 2426341 - RNA, 17 nt, Bordetella pertussis
cuggccgcgaugcauga

SEQ ID NO: 2426342 - RNA, 23 nt, Bordetella pertussis
cuggccgcgaugcaugaaccgca

SEQ ID NO: 2426343 - RNA, 11 nt, Bordetella pertussis
cuggccgcgcc

SEQ ID NO: 2426344 - RNA, 19 nt, Bordetella pertussis
cuggccgcgccgcuggcgg

SEQ ID NO: 2426345 - RNA, 20 nt, Bordetella pertussis
cuggccgcgccgcuggcggc

SEQ ID NO: 2426346 - RNA, 16 nt, Bordetella pertussis
cuggccgcgccguucg

SEQ ID NO: 2426347 - RNA, 17 nt, Bordetella pertussis
cuggccgcgcgccugcu

SEQ ID NO: 2426348 - RNA, 18 nt, Bordetella pertussis
cuggccgcgcgccugcuc

SEQ ID NO: 2426349 - RNA, 20 nt, Bordetella pertussis
cuggccgcgcucagccuugu

SEQ ID NO: 2426350 - RNA, 16 nt, Bordetella pertussis
cuggccgcgcucaggc

SEQ ID NO: 2426351 - RNA, 17 nt, Bordetella pertussis
cuggccgcgcuggcggc

SEQ ID NO: 2426352 - RNA, 19 nt, Bordetella pertussis
cuggccggccaacagcucg

SEQ ID NO: 2426353 - RNA, 21 nt, Bordetella pertussis
cuggccggccaacagcucgcg

SEQ ID NO: 2426354 - RNA, 23 nt, Bordetella pertussis
cuggccggccaacagcucgcgcc

SEQ ID NO: 2426355 - RNA, 21 nt, Bordetella pertussis
cuggccggccccauccucauc

SEQ ID NO: 2426356 - RNA, 16 nt, Bordetella pertussis
cuggccggccuggcgc

SEQ ID NO: 2426357 - RNA, 13 nt, Bordetella pertussis
cuggccggcgccg

SEQ ID NO: 2426358 - RNA, 13 nt, Bordetella pertussis
cuggcgcggcggc

SEQ ID NO: 2426359 - RNA, 21 nt, Bordetella pertussis
cuggcgcggcggccaggcgua

SEQ ID NO: 2426360 - RNA, 13 nt, Bordetella pertussis
cuggcgcggcugg

SEQ ID NO: 2426361 - RNA, 17 nt, Bordetella pertussis
cuggcgcgguccacgcg

SEQ ID NO: 2426362 - RNA, 18 nt, Bordetella pertussis
cuggcgcgguccacgcgg

SEQ ID NO: 2426363 - RNA, 22 nt, Bordetella pertussis
cuggcgcgguccacgcgggcau

SEQ ID NO: 2426364 - RNA, 15 nt, Bordetella pertussis
cuggcgcgucaggcc

SEQ ID NO: 2426365 - RNA, 16 nt, Bordetella pertussis
cuggcgcgucaggccg

SEQ ID NO: 2426366 - RNA, 20 nt, Bordetella pertussis
cuggcgcgucaggccgggca

SEQ ID NO: 2426367 - RNA, 16 nt, Bordetella pertussis
cuggcgcgucggcgcg

SEQ ID NO: 2426368 - RNA, 18 nt, Bordetella pertussis
cuggcgcgucggcgcgcg

SEQ ID NO: 2426369 - RNA, 13 nt, Bordetella pertussis
cuggcgcgucugg

SEQ ID NO: 2426370 - RNA, 15 nt, Bordetella pertussis
cuggcgcgucuggag

SEQ ID NO: 2426371 - RNA, 16 nt, Bordetella pertussis
cuggcgcguggccgcc

SEQ ID NO: 2426372 - RNA, 18 nt, Bordetella pertussis
cuggcgcguggccgccac

SEQ ID NO: 2426373 - RNA, 23 nt, Bordetella pertussis
cuggcgcguggccgccacgccuu

SEQ ID NO: 2426374 - RNA, 16 nt, Bordetella pertussis
cuggcgcuccucgcgc

SEQ ID NO: 2426375 - RNA, 17 nt, Bordetella pertussis
cuggcgcuccucgcgcg

SEQ ID NO: 2426376 - RNA, 19 nt, Bordetella pertussis
cuggcgcuccucgcgcgcg

SEQ ID NO: 2426377 - RNA, 22 nt, Bordetella pertussis
cuggcgcuccucgcgcgcggac

SEQ ID NO: 2426378 - RNA, 17 nt, Bordetella pertussis
cuggcgcucgggcgcgg

SEQ ID NO: 2426379 - RNA, 18 nt, Bordetella pertussis
cuggcgcucgggcgcggc

SEQ ID NO: 2426380 - RNA, 18 nt, Bordetella pertussis
cuggcgcugcagcgucug

SEQ ID NO: 2426381 - RNA, 11 nt, Bordetella pertussis
cuggcgcugcc

SEQ ID NO: 2426382 - RNA, 16 nt, Bordetella pertussis
cuggcgcugccgacca

SEQ ID NO: 2426383 - RNA, 17 nt, Bordetella pertussis
cuggcgcugccgaccag

SEQ ID NO: 2426384 - RNA, 18 nt, Bordetella pertussis
cuggcgcugccgaccagc

SEQ ID NO: 2426385 - RNA, 19 nt, Bordetella pertussis
cuggcgcugccgaccagca

SEQ ID NO: 2426386 - RNA, 15 nt, Bordetella pertussis
cuggcgcuggccgcc

SEQ ID NO: 2426387 - RNA, 21 nt, Bordetella pertussis
cuggcgcuguuucccuuccug

SEQ ID NO: 2426388 - RNA, 22 nt, Bordetella pertussis
cuggcgcuguuuccgggccugg

SEQ ID NO: 2426389 - RNA, 18 nt, Bordetella pertussis
cuggcgcuugcccgugcg

SEQ ID NO: 2426390 - RNA, 17 nt, Bordetella pertussis
cuggcgcuuggccagcu

SEQ ID NO: 2426391 - RNA, 20 nt, Bordetella pertussis
cuggcgcuuggccagcuggc

SEQ ID NO: 2426392 - RNA, 14 nt, Bordetella pertussis
cuggcggacgaugg

SEQ ID NO: 2426393 - RNA, 17 nt, Bordetella pertussis
cuggcggaucucggcca

SEQ ID NO: 2426394 - RNA, 20 nt, Bordetella pertussis
cuggcggaucucggccagca

SEQ ID NO: 2426395 - RNA, 21 nt, Bordetella pertussis
cuggcggaucucggccagcag

SEQ ID NO: 2426396 - RNA, 23 nt, Bordetella pertussis
cuggcggaucucggccagcagcg

SEQ ID NO: 2426397 - RNA, 17 nt, Bordetella pertussis
cuggcggcagcucgcgc

SEQ ID NO: 2426398 - RNA, 18 nt, Bordetella pertussis
cuggcggcagcucgcgcu

SEQ ID NO: 2426399 - RNA, 19 nt, Bordetella pertussis
cuggcggcagcucgcgcug

SEQ ID NO: 2426400 - RNA, 13 nt, Bordetella pertussis
cuggcggcccugc

SEQ ID NO: 2426401 - RNA, 16 nt, Bordetella pertussis
cuggcggccgcccagc

SEQ ID NO: 2426402 - RNA, 15 nt, Bordetella pertussis
cuggcggccgugccu

SEQ ID NO: 2426403 - RNA, 15 nt, Bordetella pertussis
cuggcggcgcagcac

SEQ ID NO: 2426404 - RNA, 19 nt, Bordetella pertussis
cuggcggcgcagcaccagg

SEQ ID NO: 2426405 - RNA, 22 nt, Bordetella pertussis
cuggcggcgcaggccgcgccgg

SEQ ID NO: 2426406 - RNA, 23 nt, Bordetella pertussis
cuggcggcgcaggccgcgccggc

SEQ ID NO: 2426407 - RNA, 19 nt, Bordetella pertussis
cuggcggcgcgcggcuggg

SEQ ID NO: 2426408 - RNA, 20 nt, Bordetella pertussis
cuggcggcgcgcggcugggu

SEQ ID NO: 2426409 - RNA, 13 nt, Bordetella pertussis
cuggcggcgcgcu

SEQ ID NO: 2426410 - RNA, 13 nt, Bordetella pertussis
cuggcggcugcgc

SEQ ID NO: 2426411 - RNA, 18 nt, Bordetella pertussis
cuggcggcugcgggcgca

SEQ ID NO: 2426412 - RNA, 15 nt, Bordetella pertussis
cuggcggcuggucaa

SEQ ID NO: 2426413 - RNA, 19 nt, Bordetella pertussis
cuggcggcugucgggcggc

SEQ ID NO: 2426414 - RNA, 21 nt, Bordetella pertussis
cuggcggcugucgggcggcgc

SEQ ID NO: 2426415 - RNA, 15 nt, Bordetella pertussis
cuggcgggccugggc

SEQ ID NO: 2426416 - RNA, 16 nt, Bordetella pertussis
cuggcgggccugggcg

SEQ ID NO: 2426417 - RNA, 17 nt, Bordetella pertussis
cuggcgguaugcggcgc

SEQ ID NO: 2426418 - RNA, 20 nt, Bordetella pertussis
cuggcggucuuucaccgaca

SEQ ID NO: 2426419 - RNA, 22 nt, Bordetella pertussis
cuggcggugcgccgcaugcggc

SEQ ID NO: 2426420 - RNA, 23 nt, Bordetella pertussis
cuggcggugcgugcgcccauggc

SEQ ID NO: 2426421 - RNA, 23 nt, Bordetella pertussis
cuggcgguggccgcgcaugccag

SEQ ID NO: 2426422 - RNA, 21 nt, Bordetella pertussis
cuggcgguuguugcccaccgc

SEQ ID NO: 2426423 - RNA, 14 nt, Bordetella pertussis
cuggcguacgcugc

SEQ ID NO: 2426424 - RNA, 16 nt, Bordetella pertussis
cuggcguagggcugca

SEQ ID NO: 2426425 - RNA, 18 nt, Bordetella pertussis
cuggcguagggcugcacg

SEQ ID NO: 2426426 - RNA, 15 nt, Bordetella pertussis
cuggcguaugcccac

SEQ ID NO: 2426427 - RNA, 22 nt, Bordetella pertussis
cuggcguccagccugcccgggc

SEQ ID NO: 2426428 - RNA, 16 nt, Bordetella pertussis
cuggcguggccguucg

SEQ ID NO: 2426429 - RNA, 18 nt, Bordetella pertussis
cuggcguucagcgggcgc

SEQ ID NO: 2426430 - RNA, 16 nt, Bordetella pertussis
cuggcguucggcaccg

SEQ ID NO: 2426431 - RNA, 13 nt, Bordetella pertussis
cuggcguucgucg

SEQ ID NO: 2426432 - RNA, 15 nt, Bordetella pertussis
cuggcguucgucgcc

SEQ ID NO: 2426433 - RNA, 13 nt, Bordetella pertussis
cuggcguugcggu

SEQ ID NO: 2426434 - RNA, 20 nt, Bordetella pertussis
cuggcguuugcgcgcgcgcu

SEQ ID NO: 2426435 - RNA, 23 nt, Bordetella pertussis
cuggcguuugcgcgcgcgcuggg

SEQ ID NO: 2426436 - RNA, 18 nt, Bordetella pertussis
cuggcguuuuuccaggaa

SEQ ID NO: 2426437 - RNA, 19 nt, Bordetella pertussis
cuggcguuuuuccaggaaa

SEQ ID NO: 2426438 - RNA, 16 nt, Bordetella pertussis
cuggcuaaaaggaaau

SEQ ID NO: 2426439 - RNA, 16 nt, Bordetella pertussis
cuggcucaggccugca

SEQ ID NO: 2426440 - RNA, 16 nt, Bordetella pertussis
cuggcucagucggccu

SEQ ID NO: 2426441 - RNA, 17 nt, Bordetella pertussis
cuggcucagucggccug

SEQ ID NO: 2426442 - RNA, 24 nt, Bordetella pertussis
cuggcucagucggccuggcgcucc

SEQ ID NO: 2426443 - RNA, 18 nt, Bordetella pertussis
cuggcucccaccggugcg

SEQ ID NO: 2426444 - RNA, 14 nt, Bordetella pertussis
cuggcuccccgggc

SEQ ID NO: 2426445 - RNA, 13 nt, Bordetella pertussis
cuggcucguucgc

SEQ ID NO: 2426446 - RNA, 18 nt, Bordetella pertussis
cuggcucguucgcucggc

SEQ ID NO: 2426447 - RNA, 20 nt, Bordetella pertussis
cuggcucguucgcucggcgu

SEQ ID NO: 2426448 - RNA, 20 nt, Bordetella pertussis
cuggcucuccgugcaucggc

SEQ ID NO: 2426449 - RNA, 22 nt, Bordetella pertussis
cuggcucugaucgcgcuggacc

SEQ ID NO: 2426450 - RNA, 16 nt, Bordetella pertussis
cuggcugagcaggccg

SEQ ID NO: 2426451 - RNA, 23 nt, Bordetella pertussis
cuggcugagcgacaugucgccgc

SEQ ID NO: 2426452 - RNA, 17 nt, Bordetella pertussis
cuggcugaucacagccg

SEQ ID NO: 2426453 - RNA, 15 nt, Bordetella pertussis
cuggcugcccuggcg

SEQ ID NO: 2426454 - RNA, 16 nt, Bordetella pertussis
cuggcugcccuggcgc

SEQ ID NO: 2426455 - RNA, 17 nt, Bordetella pertussis
cuggcugcccuggcgcu

SEQ ID NO: 2426456 - RNA, 15 nt, Bordetella pertussis
cuggcugcgcgccug

SEQ ID NO: 2426457 - RNA, 14 nt, Bordetella pertussis
cuggcuggacgcgc

SEQ ID NO: 2426458 - RNA, 16 nt, Bordetella pertussis
cuggcuggacgcgcgc

SEQ ID NO: 2426459 - RNA, 17 nt, Bordetella pertussis
cuggcuggacgcgcgcg

SEQ ID NO: 2426460 - RNA, 16 nt, Bordetella pertussis
cuggcuggccagccgg

SEQ ID NO: 2426461 - RNA, 15 nt, Bordetella pertussis
cuggcugggccugcu

SEQ ID NO: 2426462 - RNA, 18 nt, Bordetella pertussis
cuggcugggccugcuguc

SEQ ID NO: 2426463 - RNA, 16 nt, Bordetella pertussis
cuggcugggcgcgccg

SEQ ID NO: 2426464 - RNA, 17 nt, Bordetella pertussis
cuggcugggcgcgccgc

SEQ ID NO: 2426465 - RNA, 13 nt, Bordetella pertussis
cuggcuggucagg

SEQ ID NO: 2426466 - RNA, 15 nt, Bordetella pertussis
cuggcugugcccgcc

SEQ ID NO: 2426467 - RNA, 22 nt, Bordetella pertussis
cuggcuguucgccauguucagc

SEQ ID NO: 2426468 - RNA, 16 nt, Bordetella pertussis
cuggcuuacaggccca

SEQ ID NO: 2426469 - RNA, 15 nt, Bordetella pertussis
cuggcuucccggucc

SEQ ID NO: 2426470 - RNA, 12 nt, Bordetella pertussis
cuggcuucgucg

SEQ ID NO: 2426471 - RNA, 15 nt, Bordetella pertussis
cuggggggucaacca

SEQ ID NO: 2426472 - RNA, 21 nt, Bordetella pertussis
cugggggucggucugcgugcg

SEQ ID NO: 2426473 - RNA, 22 nt, Bordetella pertussis
cuggggugccuguccccgcagg

SEQ ID NO: 2426474 - RNA, 23 nt, Bordetella pertussis
cugggucagcuuccagaucgacc

SEQ ID NO: 2426475 - RNA, 23 nt, Bordetella pertussis
cugggucaggucgcugcccagca

SEQ ID NO: 2426476 - RNA, 19 nt, Bordetella pertussis
cugggucugcaccggcuug

SEQ ID NO: 2426477 - RNA, 18 nt, Bordetella pertussis
cugggucugccccauggc

SEQ ID NO: 2426478 - RNA, 13 nt, Bordetella pertussis
cugggugacgcug

SEQ ID NO: 2426479 - RNA, 19 nt, Bordetella pertussis
cugggugacgcuggagcgc

SEQ ID NO: 2426480 - RNA, 19 nt, Bordetella pertussis
cugggugcgccaaucggcg

SEQ ID NO: 2426481 - RNA, 13 nt, Bordetella pertussis
cugggugcgguca

SEQ ID NO: 2426482 - RNA, 15 nt, Bordetella pertussis
cugggugcugccgcc

SEQ ID NO: 2426483 - RNA, 16 nt, Bordetella pertussis
cugggugcuggugcgc

SEQ ID NO: 2426484 - RNA, 13 nt, Bordetella pertussis
cuggguggccagc

SEQ ID NO: 2426485 - RNA, 15 nt, Bordetella pertussis
cuggguggccagcgc

SEQ ID NO: 2426486 - RNA, 20 nt, Bordetella pertussis
cuggguggccagcugcgugg

SEQ ID NO: 2426487 - RNA, 16 nt, Bordetella pertussis
cuggguggcggggcgc

SEQ ID NO: 2426488 - RNA, 17 nt, Bordetella pertussis
cuggguggcggggcgca

SEQ ID NO: 2426489 - RNA, 20 nt, Bordetella pertussis
cuggguguagucgcggccgu

SEQ ID NO: 2426490 - RNA, 14 nt, Bordetella pertussis
cugguaaagggcgc

SEQ ID NO: 2426491 - RNA, 19 nt, Bordetella pertussis
cugguaagaaaccuggccc

SEQ ID NO: 2426492 - RNA, 19 nt, Bordetella pertussis
cugguacagccccagcgcc

SEQ ID NO: 2426493 - RNA, 22 nt, Bordetella pertussis
cugguacagccccagcgccagc

SEQ ID NO: 2426494 - RNA, 16 nt, Bordetella pertussis
cugguacgacagcucg

SEQ ID NO: 2426495 - RNA, 20 nt, Bordetella pertussis
cugguacgacagcucgggga

SEQ ID NO: 2426496 - RNA, 18 nt, Bordetella pertussis
cugguagacaugcucgau

SEQ ID NO: 2426497 - RNA, 19 nt, Bordetella pertussis
cugguagaucagcgcgucg

SEQ ID NO: 2426498 - RNA, 20 nt, Bordetella pertussis
cugguagaucagcgcgucgg

SEQ ID NO: 2426499 - RNA, 19 nt, Bordetella pertussis
cugguaguaaucgcgcgcc

SEQ ID NO: 2426500 - RNA, 17 nt, Bordetella pertussis
cugguaguaggccacug

SEQ ID NO: 2426501 - RNA, 15 nt, Bordetella pertussis
cugguagugcaggcc

SEQ ID NO: 2426502 - RNA, 16 nt, Bordetella pertussis
cugguagugcggcgcc

SEQ ID NO: 2426503 - RNA, 15 nt, Bordetella pertussis
cugguaguuggccag

SEQ ID NO: 2426504 - RNA, 17 nt, Bordetella pertussis
cugguauccggcgcacg

SEQ ID NO: 2426505 - RNA, 19 nt, Bordetella pertussis
cuggucaaccugguguucg

SEQ ID NO: 2426506 - RNA, 15 nt, Bordetella pertussis
cuggucaagggcggc

SEQ ID NO: 2426507 - RNA, 16 nt, Bordetella pertussis
cuggucacccggcgca

SEQ ID NO: 2426508 - RNA, 15 nt, Bordetella pertussis
cuggucaccgccccg

SEQ ID NO: 2426509 - RNA, 23 nt, Bordetella pertussis
cuggucaccgccccgacccugua

SEQ ID NO: 2426510 - RNA, 16 nt, Bordetella pertussis
cuggucagccgugucg

SEQ ID NO: 2426511 - RNA, 13 nt, Bordetella pertussis
cuggucagccugg

SEQ ID NO: 2426512 - RNA, 14 nt, Bordetella pertussis
cuggucagccuggg

SEQ ID NO: 2426513 - RNA, 20 nt, Bordetella pertussis
cuggucagccugggcgccug

SEQ ID NO: 2426514 - RNA, 15 nt, Bordetella pertussis
cuggucagccugggg

SEQ ID NO: 2426515 - RNA, 17 nt, Bordetella pertussis
cuggucagccuggggca

SEQ ID NO: 2426516 - RNA, 13 nt, Bordetella pertussis
cuggucagcgccg

SEQ ID NO: 2426517 - RNA, 16 nt, Bordetella pertussis
cuggucagcgccgacg

SEQ ID NO: 2426518 - RNA, 14 nt, Bordetella pertussis
cuggucaucgccau

SEQ ID NO: 2426519 - RNA, 19 nt, Bordetella pertussis
cuggucaucuacagcgccu

SEQ ID NO: 2426520 - RNA, 19 nt, Bordetella pertussis
cuggucauugaccugcuug

SEQ ID NO: 2426521 - RNA, 14 nt, Bordetella pertussis
cugguccgccgccg

SEQ ID NO: 2426522 - RNA, 16 nt, Bordetella pertussis
cugguccgccgcgacc

SEQ ID NO: 2426523 - RNA, 15 nt, Bordetella pertussis
cugguccugcgugau

SEQ ID NO: 2426524 - RNA, 22 nt, Bordetella pertussis
cuggucgaacgcuuccugggcc

SEQ ID NO: 2426525 - RNA, 23 nt, Bordetella pertussis
cuggucgaacucgaacacgccga

SEQ ID NO: 2426526 - RNA, 21 nt, Bordetella pertussis
cuggucgaaguagaacgccgg

SEQ ID NO: 2426527 - RNA, 14 nt, Bordetella pertussis
cuggucgaccaggc

SEQ ID NO: 2426528 - RNA, 16 nt, Bordetella pertussis
cuggucgaccaggccg

SEQ ID NO: 2426529 - RNA, 18 nt, Bordetella pertussis
cuggucgaccaggccggu

SEQ ID NO: 2426530 - RNA, 17 nt, Bordetella pertussis
cuggucgacgccggcga

SEQ ID NO: 2426531 - RNA, 15 nt, Bordetella pertussis
cuggucgagagccug

SEQ ID NO: 2426532 - RNA, 22 nt, Bordetella pertussis
cuggucgagagccugggcgcgc

SEQ ID NO: 2426533 - RNA, 17 nt, Bordetella pertussis
cuggucgagcgggcgcc

SEQ ID NO: 2426534 - RNA, 22 nt, Bordetella pertussis
cuggucgaucagccccugccau

SEQ ID NO: 2426535 - RNA, 14 nt, Bordetella pertussis
cuggucgaucgaga

SEQ ID NO: 2426536 - RNA, 18 nt, Bordetella pertussis
cuggucgcacgacagcau

SEQ ID NO: 2426537 - RNA, 19 nt, Bordetella pertussis
cuggucgccaucugcugcg

SEQ ID NO: 2426538 - RNA, 15 nt, Bordetella pertussis
cuggucgcgcagcac

SEQ ID NO: 2426539 - RNA, 13 nt, Bordetella pertussis
cuggucgcgcgcc

SEQ ID NO: 2426540 - RNA, 14 nt, Bordetella pertussis
cuggucgcgcgccu

SEQ ID NO: 2426541 - RNA, 13 nt, Bordetella pertussis
cuggucgcgggcc

SEQ ID NO: 2426542 - RNA, 14 nt, Bordetella pertussis
cuggucgcgggcca

SEQ ID NO: 2426543 - RNA, 19 nt, Bordetella pertussis
cuggucgcgggccaggccg

SEQ ID NO: 2426544 - RNA, 14 nt, Bordetella pertussis
cuggucgcuggcgc

SEQ ID NO: 2426545 - RNA, 14 nt, Bordetella pertussis
cuggucggccuuca

SEQ ID NO: 2426546 - RNA, 16 nt, Bordetella pertussis
cuggucgggaugcccc

SEQ ID NO: 2426547 - RNA, 22 nt, Bordetella pertussis
cuggucgggaugccccgcccgc

SEQ ID NO: 2426548 - RNA, 18 nt, Bordetella pertussis
cuggucgggcgugagcgc

SEQ ID NO: 2426549 - RNA, 22 nt, Bordetella pertussis
cuggucgggcgugagcgccucg

SEQ ID NO: 2426550 - RNA, 23 nt, Bordetella pertussis
cuggucguaucgccgcugaugcu

SEQ ID NO: 2426551 - RNA, 15 nt, Bordetella pertussis
cuggucgucgcggcc

SEQ ID NO: 2426552 - RNA, 13 nt, Bordetella pertussis
cuggucgucggcc

SEQ ID NO: 2426553 - RNA, 15 nt, Bordetella pertussis
cuggucgucggccac

SEQ ID NO: 2426554 - RNA, 22 nt, Bordetella pertussis
cuggucuuccgguacgcgcagu

SEQ ID NO: 2426555 - RNA, 19 nt, Bordetella pertussis
cuggugaagucggcccugu

SEQ ID NO: 2426556 - RNA, 19 nt, Bordetella pertussis
cuggugaucgcgcgggcug

SEQ ID NO: 2426557 - RNA, 22 nt, Bordetella pertussis
cuggugauguccugcaggcccg

SEQ ID NO: 2426558 - RNA, 13 nt, Bordetella pertussis
cuggugcaccacg

SEQ ID NO: 2426559 - RNA, 17 nt, Bordetella pertussis
cuggugcaccacgcgcu

SEQ ID NO: 2426560 - RNA, 18 nt, Bordetella pertussis
cuggugcaccacgcgcuc

SEQ ID NO: 2426561 - RNA, 19 nt, Bordetella pertussis
cuggugcaccacgcgcucc

SEQ ID NO: 2426562 - RNA, 23 nt, Bordetella pertussis
cuggugcacgaugcccagggccg

SEQ ID NO: 2426563 - RNA, 21 nt, Bordetella pertussis
cuggugcacgccgauguccac

SEQ ID NO: 2426564 - RNA, 15 nt, Bordetella pertussis
cuggugcagcggcuc

SEQ ID NO: 2426565 - RNA, 23 nt, Bordetella pertussis
cuggugcagcggcucgacgccgu

SEQ ID NO: 2426566 - RNA, 19 nt, Bordetella pertussis
cuggugcccgacgccgcgc

SEQ ID NO: 2426567 - RNA, 20 nt, Bordetella pertussis
cuggugcccguagcagaugc

SEQ ID NO: 2426568 - RNA, 15 nt, Bordetella pertussis
cuggugccgacggcg

SEQ ID NO: 2426569 - RNA, 20 nt, Bordetella pertussis
cuggugcgccgugcccggcg

SEQ ID NO: 2426570 - RNA, 15 nt, Bordetella pertussis
cuggugcgcguccug

SEQ ID NO: 2426571 - RNA, 19 nt, Bordetella pertussis
cuggugcgcguccugggcc

SEQ ID NO: 2426572 - RNA, 23 nt, Bordetella pertussis
cuggugcgcguccugggccgagc

SEQ ID NO: 2426573 - RNA, 21 nt, Bordetella pertussis
cuggugcucaaccucgacgcg

SEQ ID NO: 2426574 - RNA, 13 nt, Bordetella pertussis
cuggugcuggugc

SEQ ID NO: 2426575 - RNA, 17 nt, Bordetella pertussis
cuggugcuggugccgcu

SEQ ID NO: 2426576 - RNA, 23 nt, Bordetella pertussis
cugguggaccugccguucgcgcu

SEQ ID NO: 2426577 - RNA, 16 nt, Bordetella pertussis
cugguggcgauccaug

SEQ ID NO: 2426578 - RNA, 15 nt, Bordetella pertussis
cugguggugccgcgc

SEQ ID NO: 2426579 - RNA, 17 nt, Bordetella pertussis
cugguggugggcgugcc

SEQ ID NO: 2426580 - RNA, 22 nt, Bordetella pertussis
cugguggugggcgugcccucgc

SEQ ID NO: 2426581 - RNA, 14 nt, Bordetella pertussis
cuggugugccuguc

SEQ ID NO: 2426582 - RNA, 16 nt, Bordetella pertussis
cuggugugccuguccc

SEQ ID NO: 2426583 - RNA, 18 nt, Bordetella pertussis
cugguucaggcgagcggc

SEQ ID NO: 2426584 - RNA, 22 nt, Bordetella pertussis
cugugggcgguaaggucgggua

SEQ ID NO: 2426585 - RNA, 17 nt, Bordetella pertussis
cugugggggacaggcac

SEQ ID NO: 2426586 - RNA, 21 nt, Bordetella pertussis
cugugggggacaggcacgccg

SEQ ID NO: 2426587 - RNA, 19 nt, Bordetella pertussis
cuguguaccccgaucggga

SEQ ID NO: 2426588 - RNA, 19 nt, Bordetella pertussis
cugugugcauuuuccucgg

SEQ ID NO: 2426589 - RNA, 21 nt, Bordetella pertussis
cugugugcauuuuccucggcg

SEQ ID NO: 2426590 - RNA, 21 nt, Bordetella pertussis
cuguguugauccgccaauggc

SEQ ID NO: 2426591 - RNA, 13 nt, Bordetella pertussis
cuguucaccuuca

SEQ ID NO: 2426592 - RNA, 21 nt, Bordetella pertussis
cuguucagaaaccugaccucg

SEQ ID NO: 2426593 - RNA, 17 nt, Bordetella pertussis
cuguucagacugcugcc

SEQ ID NO: 2426594 - RNA, 19 nt, Bordetella pertussis
cuguucaggcgcucgaucg

SEQ ID NO: 2426595 - RNA, 19 nt, Bordetella pertussis
cuguucaucaacaugucca

SEQ ID NO: 2426596 - RNA, 14 nt, Bordetella pertussis
cuguuccagccagu

SEQ ID NO: 2426597 - RNA, 22 nt, Bordetella pertussis
cuguuccagccaguacaggcug

SEQ ID NO: 2426598 - RNA, 17 nt, Bordetella pertussis
cuguucccgccgggcca

SEQ ID NO: 2426599 - RNA, 19 nt, Bordetella pertussis
cuguuccugcagggcgucu

SEQ ID NO: 2426600 - RNA, 17 nt, Bordetella pertussis
cuguucgauacggccac

SEQ ID NO: 2426601 - RNA, 17 nt, Bordetella pertussis
cuguucgccgcaccagg

SEQ ID NO: 2426602 - RNA, 20 nt, Bordetella pertussis
cuguucgccgcaccaggccg

SEQ ID NO: 2426603 - RNA, 21 nt, Bordetella pertussis
cuguucgccgcaccaggccgc

SEQ ID NO: 2426604 - RNA, 22 nt, Bordetella pertussis
cuguucgccgcaccaggccgcg

SEQ ID NO: 2426605 - RNA, 14 nt, Bordetella pertussis
cuguucgcgcagca

SEQ ID NO: 2426606 - RNA, 17 nt, Bordetella pertussis
cuguucgcgcagcaggc

SEQ ID NO: 2426607 - RNA, 19 nt, Bordetella pertussis
cuguucgcgcagcaggccg

SEQ ID NO: 2426608 - RNA, 23 nt, Bordetella pertussis
cuguucgcgcagcaggccgcgcg

SEQ ID NO: 2426609 - RNA, 14 nt, Bordetella pertussis
cuguucgcgcggcc

SEQ ID NO: 2426610 - RNA, 15 nt, Bordetella pertussis
cuguucggcggcgcc

SEQ ID NO: 2426611 - RNA, 14 nt, Bordetella pertussis
cuguucggggcagg

SEQ ID NO: 2426612 - RNA, 19 nt, Bordetella pertussis
cuguugaggaugugcagcg

SEQ ID NO: 2426613 - RNA, 19 nt, Bordetella pertussis
cuguugcuccaggccggca

SEQ ID NO: 2426614 - RNA, 23 nt, Bordetella pertussis
cuguugcuggccacccgacagcu

SEQ ID NO: 2426615 - RNA, 19 nt, Bordetella pertussis
cuguuggccgucgccagcg

SEQ ID NO: 2426616 - RNA, 17 nt, Bordetella pertussis
cuguuggcguggcuggc

SEQ ID NO: 2426617 - RNA, 17 nt, Bordetella pertussis
cuguuucccuuccuggc

SEQ ID NO: 2426618 - RNA, 17 nt, Bordetella pertussis
cuuaccgcgccggcucg

SEQ ID NO: 2426619 - RNA, 18 nt, Bordetella pertussis
cuuacgcgguccgcagcg

SEQ ID NO: 2426620 - RNA, 22 nt, Bordetella pertussis
cuuacgcgguccgcagcgcucg

SEQ ID NO: 2426621 - RNA, 18 nt, Bordetella pertussis
cuuacuggaucuuggccu

SEQ ID NO: 2426622 - RNA, 18 nt, Bordetella pertussis
cuuagcgcagcagcgaca

SEQ ID NO: 2426623 - RNA, 17 nt, Bordetella pertussis
cuuaucgcggcgcggcg

SEQ ID NO: 2426624 - RNA, 17 nt, Bordetella pertussis
cuucacauccacugucu

SEQ ID NO: 2426625 - RNA, 12 nt, Bordetella pertussis
cuucaccccgcc

SEQ ID NO: 2426626 - RNA, 17 nt, Bordetella pertussis
cuucaccgaggcgcugc

SEQ ID NO: 2426627 - RNA, 16 nt, Bordetella pertussis
cuucacgacacgccca

SEQ ID NO: 2426628 - RNA, 13 nt, Bordetella pertussis
cuucacguagccg

SEQ ID NO: 2426629 - RNA, 17 nt, Bordetella pertussis
cuucacguagccggcca

SEQ ID NO: 2426630 - RNA, 20 nt, Bordetella pertussis
cuucacguagccggccaggu

SEQ ID NO: 2426631 - RNA, 17 nt, Bordetella pertussis
cuucagcaccagcuccu

SEQ ID NO: 2426632 - RNA, 17 nt, Bordetella pertussis
cuucagcacgcucagca

SEQ ID NO: 2426633 - RNA, 13 nt, Bordetella pertussis
cuucagccagcga

SEQ ID NO: 2426634 - RNA, 17 nt, Bordetella pertussis
cuucagcccggcgcgcc

SEQ ID NO: 2426635 - RNA, 18 nt, Bordetella pertussis
cuucagcccggcgcgcca

SEQ ID NO: 2426636 - RNA, 19 nt, Bordetella pertussis
cuucagcccgggcaugcga

SEQ ID NO: 2426637 - RNA, 15 nt, Bordetella pertussis
cuucagccugggccu

SEQ ID NO: 2426638 - RNA, 19 nt, Bordetella pertussis
cuucagcgggccggcacca

SEQ ID NO: 2426639 - RNA, 17 nt, Bordetella pertussis
cuucagcuacggcuggc

SEQ ID NO: 2426640 - RNA, 21 nt, Bordetella pertussis
cuucagcuuggucacggccuc

SEQ ID NO: 2426641 - RNA, 23 nt, Bordetella pertussis
cuucaggaacauguccaccagcc

SEQ ID NO: 2426642 - RNA, 23 nt, Bordetella pertussis
cuucaggccagugauggccugcu

SEQ ID NO: 2426643 - RNA, 15 nt, Bordetella pertussis
cuucaggcgccgcag

SEQ ID NO: 2426644 - RNA, 16 nt, Bordetella pertussis
cuucaggcgcgcggca

SEQ ID NO: 2426645 - RNA, 21 nt, Bordetella pertussis
cuucaggcuggccugcagguc

SEQ ID NO: 2426646 - RNA, 16 nt, Bordetella pertussis
cuucagggcgccggcg

SEQ ID NO: 2426647 - RNA, 17 nt, Bordetella pertussis
cuucagggcgccggcgu

SEQ ID NO: 2426648 - RNA, 14 nt, Bordetella pertussis
cuucagguagccga

SEQ ID NO: 2426649 - RNA, 21 nt, Bordetella pertussis
cuucagguagguggacacgcc

SEQ ID NO: 2426650 - RNA, 15 nt, Bordetella pertussis
cuucaguuccaggcg

SEQ ID NO: 2426651 - RNA, 15 nt, Bordetella pertussis
cuuccaccgucuggc

SEQ ID NO: 2426652 - RNA, 12 nt, Bordetella pertussis
cuuccagcagca

SEQ ID NO: 2426653 - RNA, 13 nt, Bordetella pertussis
cuuccagcagcau

SEQ ID NO: 2426654 - RNA, 22 nt, Bordetella pertussis
cuuccagcagcaugccgcggug

SEQ ID NO: 2426655 - RNA, 17 nt, Bordetella pertussis
cuuccagcagggcggcg

SEQ ID NO: 2426656 - RNA, 12 nt, Bordetella pertussis
cuuccagcgccc

SEQ ID NO: 2426657 - RNA, 13 nt, Bordetella pertussis
cuuccagcgcccg

SEQ ID NO: 2426658 - RNA, 16 nt, Bordetella pertussis
cuuccagcgcccgcgg

SEQ ID NO: 2426659 - RNA, 12 nt, Bordetella pertussis
cuuccagcgccu

SEQ ID NO: 2426660 - RNA, 14 nt, Bordetella pertussis
cuuccagcgccugc

SEQ ID NO: 2426661 - RNA, 18 nt, Bordetella pertussis
cuuccaggaguucccagc

SEQ ID NO: 2426662 - RNA, 14 nt, Bordetella pertussis
cuuccaggcgcagg

SEQ ID NO: 2426663 - RNA, 17 nt, Bordetella pertussis
cuuccaggcgcccgcca

SEQ ID NO: 2426664 - RNA, 20 nt, Bordetella pertussis
cuuccaguucgcuuuccagg

SEQ ID NO: 2426665 - RNA, 23 nt, Bordetella pertussis
cuuccaguugcgggcgcaccugg

SEQ ID NO: 2426666 - RNA, 16 nt, Bordetella pertussis
cuuccaucuacgugcu

SEQ ID NO: 2426667 - RNA, 20 nt, Bordetella pertussis
cuuccaucuacgugcuggac

SEQ ID NO: 2426668 - RNA, 20 nt, Bordetella pertussis
cuuccaugaggaacggcacc

SEQ ID NO: 2426669 - RNA, 15 nt, Bordetella pertussis
cuucccaggcgaggc

SEQ ID NO: 2426670 - RNA, 21 nt, Bordetella pertussis
cuuccccgaaacucaccgccg

SEQ ID NO: 2426671 - RNA, 15 nt, Bordetella pertussis
cuuccccgucggcgg

SEQ ID NO: 2426672 - RNA, 16 nt, Bordetella pertussis
cuuccccgucggcggc

SEQ ID NO: 2426673 - RNA, 15 nt, Bordetella pertussis
cuucccgguccaggc

SEQ ID NO: 2426674 - RNA, 17 nt, Bordetella pertussis
cuucccgguccaggccg

SEQ ID NO: 2426675 - RNA, 17 nt, Bordetella pertussis
cuuccgcacgccgaccu

SEQ ID NO: 2426676 - RNA, 22 nt, Bordetella pertussis
cuuccgcacgccgaccuggcgc

SEQ ID NO: 2426677 - RNA, 17 nt, Bordetella pertussis
cuuccgccaccgcgccg

SEQ ID NO: 2426678 - RNA, 22 nt, Bordetella pertussis
cuuccggaugagcuacccccug

SEQ ID NO: 2426679 - RNA, 14 nt, Bordetella pertussis
cuuccggcagcggc

SEQ ID NO: 2426680 - RNA, 18 nt, Bordetella pertussis
cuuccggcagcggccagc

SEQ ID NO: 2426681 - RNA, 21 nt, Bordetella pertussis
cuuccggcagcggccagcgcg

SEQ ID NO: 2426682 - RNA, 18 nt, Bordetella pertussis
cuuccggccgggccagua

SEQ ID NO: 2426683 - RNA, 17 nt, Bordetella pertussis
cuuccgggcccgcgccg

SEQ ID NO: 2426684 - RNA, 20 nt, Bordetella pertussis
cuuccgggcccgcgccgacg

SEQ ID NO: 2426685 - RNA, 18 nt, Bordetella pertussis
cuuccgggcgaccccgga

SEQ ID NO: 2426686 - RNA, 22 nt, Bordetella pertussis
cuuccgguacgcgcaguccgca

SEQ ID NO: 2426687 - RNA, 16 nt, Bordetella pertussis
cuuccucggcgcgcgc

SEQ ID NO: 2426688 - RNA, 17 nt, Bordetella pertussis
cuuccucggcgcgcgcg

SEQ ID NO: 2426689 - RNA, 14 nt, Bordetella pertussis
cuuccugaacgacg

SEQ ID NO: 2426690 - RNA, 15 nt, Bordetella pertussis
cuuccugcugacagg

SEQ ID NO: 2426691 - RNA, 12 nt, Bordetella pertussis
cuuccugcugcg

SEQ ID NO: 2426692 - RNA, 14 nt, Bordetella pertussis
cuuccugcugcgcc

SEQ ID NO: 2426693 - RNA, 16 nt, Bordetella pertussis
cuuccuggccaaugcc

SEQ ID NO: 2426694 - RNA, 14 nt, Bordetella pertussis
cuuccugggcgccg

SEQ ID NO: 2426695 - RNA, 21 nt, Bordetella pertussis
cuuccugggcgccggcggcga

SEQ ID NO: 2426696 - RNA, 14 nt, Bordetella pertussis
cuuccugggugcgc

SEQ ID NO: 2426697 - RNA, 18 nt, Bordetella pertussis
cuucuucuuugcccuggc

SEQ ID NO: 2426698 - RNA, 11 nt, Bordetella pertussis
cuucuuggcca

SEQ ID NO: 2426699 - RNA, 12 nt, Bordetella pertussis
cuugaaagaggc

SEQ ID NO: 2426700 - RNA, 19 nt, Bordetella pertussis
cuugaacgccuugcccggg

SEQ ID NO: 2426701 - RNA, 21 nt, Bordetella pertussis
cuugaacgccuugcccgggcu

SEQ ID NO: 2426702 - RNA, 15 nt, Bordetella pertussis
cuugaacggcgcggc

SEQ ID NO: 2426703 - RNA, 16 nt, Bordetella pertussis
cuugaacggcgcggcc

SEQ ID NO: 2426704 - RNA, 16 nt, Bordetella pertussis
cuugaacuccgcggcg

SEQ ID NO: 2426705 - RNA, 16 nt, Bordetella pertussis
cuugaacucggccagc

SEQ ID NO: 2426706 - RNA, 17 nt, Bordetella pertussis
cuugaacucggccagca

SEQ ID NO: 2426707 - RNA, 16 nt, Bordetella pertussis
cuugaagacgcccagg

SEQ ID NO: 2426708 - RNA, 17 nt, Bordetella pertussis
cuugaagacgcccaggu

SEQ ID NO: 2426709 - RNA, 21 nt, Bordetella pertussis
cuugaagcggucgauguccag

SEQ ID NO: 2426710 - RNA, 14 nt, Bordetella pertussis
cuugaccacggcca

SEQ ID NO: 2426711 - RNA, 16 nt, Bordetella pertussis
cuugaccacggccagc

SEQ ID NO: 2426712 - RNA, 18 nt, Bordetella pertussis
cuugaccacggccagcag

SEQ ID NO: 2426713 - RNA, 13 nt, Bordetella pertussis
cuugaccagcagg

SEQ ID NO: 2426714 - RNA, 16 nt, Bordetella pertussis
cuugaccagcaggccg

SEQ ID NO: 2426715 - RNA, 13 nt, Bordetella pertussis
cuugaccagcuug

SEQ ID NO: 2426716 - RNA, 13 nt, Bordetella pertussis
cuugaccaguucg

SEQ ID NO: 2426717 - RNA, 18 nt, Bordetella pertussis
cuugaccaguucgcgcag

SEQ ID NO: 2426718 - RNA, 14 nt, Bordetella pertussis
cuugaccgcaugcu

SEQ ID NO: 2426719 - RNA, 15 nt, Bordetella pertussis
cuugaccgcaugcug

SEQ ID NO: 2426720 - RNA, 16 nt, Bordetella pertussis
cuugaccgcaugcugc

SEQ ID NO: 2426721 - RNA, 14 nt, Bordetella pertussis
cuugaccgccagca

SEQ ID NO: 2426722 - RNA, 21 nt, Bordetella pertussis
cuugaccgccagcauccagcc

SEQ ID NO: 2426723 - RNA, 14 nt, Bordetella pertussis
cuugaccgccucca

SEQ ID NO: 2426724 - RNA, 21 nt, Bordetella pertussis
cuugaccgccuccaggaugag

SEQ ID NO: 2426725 - RNA, 18 nt, Bordetella pertussis
cuugaccuggucggccuu

SEQ ID NO: 2426726 - RNA, 18 nt, Bordetella pertussis
cuugaccuuggcuugcag

SEQ ID NO: 2426727 - RNA, 20 nt, Bordetella pertussis
cuugacgaauuucucggcca

SEQ ID NO: 2426728 - RNA, 17 nt, Bordetella pertussis
cuugacgccgccgaagg

SEQ ID NO: 2426729 - RNA, 13 nt, Bordetella pertussis
cuugacgcgcguu

SEQ ID NO: 2426730 - RNA, 18 nt, Bordetella pertussis
cuugacgcugcucuuggc

SEQ ID NO: 2426731 - RNA, 20 nt, Bordetella pertussis
cuugacggcgcggaucgaac

SEQ ID NO: 2426732 - RNA, 22 nt, Bordetella pertussis
cuugacggucacggucuggccc

SEQ ID NO: 2426733 - RNA, 16 nt, Bordetella pertussis
cuugacgguggccgcg

SEQ ID NO: 2426734 - RNA, 19 nt, Bordetella pertussis
cuugacgguggccgcggcg

SEQ ID NO: 2426735 - RNA, 23 nt, Bordetella pertussis
cuugacguagcggaucgcggcgc

SEQ ID NO: 2426736 - RNA, 16 nt, Bordetella pertussis
cuugacguccagcgac

SEQ ID NO: 2426737 - RNA, 20 nt, Bordetella pertussis
cuugagauagcccuugauca

SEQ ID NO: 2426738 - RNA, 19 nt, Bordetella pertussis
cuugagaugccagcggcgc

SEQ ID NO: 2426739 - RNA, 17 nt, Bordetella pertussis
cuugagcaccacguccu

SEQ ID NO: 2426740 - RNA, 15 nt, Bordetella pertussis
cuugagcacguccag

SEQ ID NO: 2426741 - RNA, 17 nt, Bordetella pertussis
cuugagcacguccagcg

SEQ ID NO: 2426742 - RNA, 21 nt, Bordetella pertussis
cuugagcacguccagcggcgc

SEQ ID NO: 2426743 - RNA, 16 nt, Bordetella pertussis
cuugagcagccacugc

SEQ ID NO: 2426744 - RNA, 17 nt, Bordetella pertussis
cuugagcaucugcggca

SEQ ID NO: 2426745 - RNA, 21 nt, Bordetella pertussis
cuugagcgccagcucggccaa

SEQ ID NO: 2426746 - RNA, 14 nt, Bordetella pertussis
cuugagcggcccgg

SEQ ID NO: 2426747 - RNA, 14 nt, Bordetella pertussis
cuugaggccgcgcg

SEQ ID NO: 2426748 - RNA, 17 nt, Bordetella pertussis
cuugaggccgcgcgccu

SEQ ID NO: 2426749 - RNA, 20 nt, Bordetella pertussis
cuugagggcgcgggccagcu

SEQ ID NO: 2426750 - RNA, 15 nt, Bordetella pertussis
cuugagguaccacag

SEQ ID NO: 2426751 - RNA, 20 nt, Bordetella pertussis
cuugaggucggggugguugu

SEQ ID NO: 2426752 - RNA, 18 nt, Bordetella pertussis
cuugaucagcggcggcac

SEQ ID NO: 2426753 - RNA, 15 nt, Bordetella pertussis
cuugaucagggccac

SEQ ID NO: 2426754 - RNA, 12 nt, Bordetella pertussis
cuugaugcccag

SEQ ID NO: 2426755 - RNA, 14 nt, Bordetella pertussis
cuugaugcccagcu

SEQ ID NO: 2426756 - RNA, 16 nt, Bordetella pertussis
cuugaugccgcccagc

SEQ ID NO: 2426757 - RNA, 20 nt, Bordetella pertussis
cuugaugccgcccagcaugc

SEQ ID NO: 2426758 - RNA, 22 nt, Bordetella pertussis
cuugauggccgggccguggcga

SEQ ID NO: 2426759 - RNA, 17 nt, Bordetella pertussis
cuugauggccucggcgg

SEQ ID NO: 2426760 - RNA, 18 nt, Bordetella pertussis
cuugauggccucggcggc

SEQ ID NO: 2426761 - RNA, 20 nt, Bordetella pertussis
cuugaugggcgaggcgaugc

SEQ ID NO: 2426762 - RNA, 17 nt, Bordetella pertussis
cuugcaggccgcgaaca

SEQ ID NO: 2426763 - RNA, 15 nt, Bordetella pertussis
cuugcaugcgccgca

SEQ ID NO: 2426764 - RNA, 13 nt, Bordetella pertussis
cuugccaggcccg

SEQ ID NO: 2426765 - RNA, 18 nt, Bordetella pertussis
cuugccaggcccggcgcg

SEQ ID NO: 2426766 - RNA, 20 nt, Bordetella pertussis
cuugccaggcccggcgcgca

SEQ ID NO: 2426767 - RNA, 20 nt, Bordetella pertussis
cuugccauaggccagcgccu

SEQ ID NO: 2426768 - RNA, 13 nt, Bordetella pertussis
cuugccauccagc

SEQ ID NO: 2426769 - RNA, 18 nt, Bordetella pertussis
cuugccauccagccaggc

SEQ ID NO: 2426770 - RNA, 22 nt, Bordetella pertussis
cuugccauccagccaggccgca

SEQ ID NO: 2426771 - RNA, 13 nt, Bordetella pertussis
cuugcccacgcca

SEQ ID NO: 2426772 - RNA, 21 nt, Bordetella pertussis
cuugcccacgcgcuccugcuc

SEQ ID NO: 2426773 - RNA, 17 nt, Bordetella pertussis
cuugcccagcagcuccu

SEQ ID NO: 2426774 - RNA, 16 nt, Bordetella pertussis
cuugcccaggccggcg

SEQ ID NO: 2426775 - RNA, 19 nt, Bordetella pertussis
cuugcccaggccggcgcgc

SEQ ID NO: 2426776 - RNA, 19 nt, Bordetella pertussis
cuugcccgagaugcccgac

SEQ ID NO: 2426777 - RNA, 17 nt, Bordetella pertussis
cuugcccgggcuggccg

SEQ ID NO: 2426778 - RNA, 16 nt, Bordetella pertussis
cuugcccgucagcggc

SEQ ID NO: 2426779 - RNA, 16 nt, Bordetella pertussis
cuugcccgucagggua

SEQ ID NO: 2426780 - RNA, 17 nt, Bordetella pertussis
cuugcccuugaauucca

SEQ ID NO: 2426781 - RNA, 15 nt, Bordetella pertussis
cuugccgaccuccag

SEQ ID NO: 2426782 - RNA, 20 nt, Bordetella pertussis
cuugccgaccuccaggccca

SEQ ID NO: 2426783 - RNA, 22 nt, Bordetella pertussis
cuugccgaccuccaggcccagg

SEQ ID NO: 2426784 - RNA, 18 nt, Bordetella pertussis
cuugccgauccagcgccu

SEQ ID NO: 2426785 - RNA, 16 nt, Bordetella pertussis
cuugccgaugcggcgc

SEQ ID NO: 2426786 - RNA, 22 nt, Bordetella pertussis
cuugccgaugcggcgcaugcug

SEQ ID NO: 2426787 - RNA, 14 nt, Bordetella pertussis
cuugccgcagcggc

SEQ ID NO: 2426788 - RNA, 16 nt, Bordetella pertussis
cuugccgcagcggcca

SEQ ID NO: 2426789 - RNA, 19 nt, Bordetella pertussis
cuugccgcagcggccaugg

SEQ ID NO: 2426790 - RNA, 20 nt, Bordetella pertussis
cuugccgcagcggccaugga

SEQ ID NO: 2426791 - RNA, 23 nt, Bordetella pertussis
cuugccgcaggagucgcuccccg

SEQ ID NO: 2426792 - RNA, 20 nt, Bordetella pertussis
cuugccgcccacugccaggc

SEQ ID NO: 2426793 - RNA, 14 nt, Bordetella pertussis
cuugccgcccaggu

SEQ ID NO: 2426794 - RNA, 21 nt, Bordetella pertussis
cuugccgccgccgcgcgcggc

SEQ ID NO: 2426795 - RNA, 22 nt, Bordetella pertussis
cuugccgccgccgcgcgcggca

SEQ ID NO: 2426796 - RNA, 16 nt, Bordetella pertussis
cuugccgccgcgcagg

SEQ ID NO: 2426797 - RNA, 13 nt, Bordetella pertussis
cuugccgccggac

SEQ ID NO: 2426798 - RNA, 19 nt, Bordetella pertussis
cuugccgccggacggcgcc

SEQ ID NO: 2426799 - RNA, 21 nt, Bordetella pertussis
cuugccgccggacggcgccuu

SEQ ID NO: 2426800 - RNA, 13 nt, Bordetella pertussis
cuugccgccgggc

SEQ ID NO: 2426801 - RNA, 22 nt, Bordetella pertussis
cuugccgccgugcgagcacggc

SEQ ID NO: 2426802 - RNA, 14 nt, Bordetella pertussis
cuugccgccgugcu

SEQ ID NO: 2426803 - RNA, 15 nt, Bordetella pertussis
cuugccgccuuccca

SEQ ID NO: 2426804 - RNA, 18 nt, Bordetella pertussis
cuugccgccuucccaggc

SEQ ID NO: 2426805 - RNA, 20 nt, Bordetella pertussis
cuugccgccuucccaggcga

SEQ ID NO: 2426806 - RNA, 14 nt, Bordetella pertussis
cuugccgcgcagcg

SEQ ID NO: 2426807 - RNA, 14 nt, Bordetella pertussis
cuugccgcgcggcg

SEQ ID NO: 2426808 - RNA, 14 nt, Bordetella pertussis
cuugccgcugguga

SEQ ID NO: 2426809 - RNA, 14 nt, Bordetella pertussis
cuugccggccuggc

SEQ ID NO: 2426810 - RNA, 17 nt, Bordetella pertussis
cuugguggggucgaugc

SEQ ID NO: 2426811 - RNA, 16 nt, Bordetella pertussis
cuugguggugccugcu

SEQ ID NO: 2426812 - RNA, 16 nt, Bordetella pertussis
cuuguacaggcgcggc

SEQ ID NO: 2426813 - RNA, 23 nt, Bordetella pertussis
cuuguccaucgcgugcagcgacu

SEQ ID NO: 2426814 - RNA, 14 nt, Bordetella pertussis
cuuguccgccaccc

SEQ ID NO: 2426815 - RNA, 16 nt, Bordetella pertussis
cuuguccuucagcacg

SEQ ID NO: 2426816 - RNA, 16 nt, Bordetella pertussis
cuugucgaugacgcgc

SEQ ID NO: 2426817 - RNA, 22 nt, Bordetella pertussis
cuugucgaugacgcgccgcgcc

SEQ ID NO: 2426818 - RNA, 17 nt, Bordetella pertussis
cuugucgcgcagcgccg

SEQ ID NO: 2426819 - RNA, 18 nt, Bordetella pertussis
cuugugcgccagcgcgaa

SEQ ID NO: 2426820 - RNA, 14 nt, Bordetella pertussis
cuugugcgccgucg

SEQ ID NO: 2426821 - RNA, 15 nt, Bordetella pertussis
cuugugcgucggcuc

SEQ ID NO: 2426822 - RNA, 16 nt, Bordetella pertussis
cuugugcugccaugcc

SEQ ID NO: 2426823 - RNA, 23 nt, Bordetella pertussis
cuuguucgagcgcgcgcaugcgc

SEQ ID NO: 2426824 - RNA, 14 nt, Bordetella pertussis
cuuguucgcgcgcg

SEQ ID NO: 2426825 - RNA, 16 nt, Bordetella pertussis
cuuguucgcgcgcggu

SEQ ID NO: 2426826 - RNA, 21 nt, Bordetella pertussis
cuuguugcgugccgcccagga

SEQ ID NO: 2426827 - RNA, 18 nt, Bordetella pertussis
cuuguugcucuugaccug

SEQ ID NO: 2426828 - RNA, 20 nt, Bordetella pertussis
cuuguuggaaaucgugccgu

SEQ ID NO: 2426829 - RNA, 13 nt, Bordetella pertussis
cuuguuggcgccg

SEQ ID NO: 2426830 - RNA, 18 nt, Bordetella pertussis
cuuguuuuccaucagcuc

SEQ ID NO: 2426831 - RNA, 15 nt, Bordetella pertussis
cuuuauugaaaugaa

SEQ ID NO: 2426832 - RNA, 16 nt, Bordetella pertussis
cuuucaaagaucugcu

SEQ ID NO: 2426833 - RNA, 14 nt, Bordetella pertussis
cuuucaccgacagg

SEQ ID NO: 2426834 - RNA, 17 nt, Bordetella pertussis
cuuucauuucggcgccg

SEQ ID NO: 2426835 - RNA, 22 nt, Bordetella pertussis
cuuuccagcgcgaaaugcccag

SEQ ID NO: 2426836 - RNA, 23 nt, Bordetella pertussis
cuuuccagcgcgaaaugcccagc

SEQ ID NO: 2426837 - RNA, 17 nt, Bordetella pertussis
cuuucccauccuggccg

SEQ ID NO: 2426838 - RNA, 23 nt, Bordetella pertussis
cuuucccgcgccgagcggggccg

SEQ ID NO: 2426839 - RNA, 18 nt, Bordetella pertussis
cuuuccuggccggcgccg

SEQ ID NO: 2426840 - RNA, 20 nt, Bordetella pertussis
cuuucgaucacgaagcccag

SEQ ID NO: 2426841 - RNA, 15 nt, Bordetella pertussis
cuuucgccgcgcgcu

SEQ ID NO: 2426842 - RNA, 21 nt, Bordetella pertussis
cuuucgcgcgcgccugccccg

SEQ ID NO: 2426843 - RNA, 13 nt, Bordetella pertussis
cuuucugcugcuc

SEQ ID NO: 2426844 - RNA, 13 nt, Bordetella pertussis
cuuucugcuugcc

SEQ ID NO: 2426845 - RNA, 22 nt, Bordetella pertussis
cuuucuugagcaacgugcgcac

SEQ ID NO: 2426846 - RNA, 14 nt, Bordetella pertussis
cuuugacgccggcu

SEQ ID NO: 2426847 - RNA, 20 nt, Bordetella pertussis
cuuugcauaagccgcaagca

SEQ ID NO: 2426848 - RNA, 19 nt, Bordetella pertussis
cuuugcauugcggcugggu

SEQ ID NO: 2426849 - RNA, 23 nt, Bordetella pertussis
cuuugcuggccauagggcgacug

SEQ ID NO: 2426850 - RNA, 17 nt, Bordetella pertussis
cuuuggccgcgcgccgg

SEQ ID NO: 2426851 - RNA, 19 nt, Bordetella pertussis
cuuuuccacgcccgccuuc

SEQ ID NO: 2426852 - RNA, 19 nt, Bordetella pertussis
cuuuuuccuugcgggccua

SEQ ID NO: 2426853 - RNA, 22 nt, Bordetella pertussis
cuuuuucuuuugcggcgcggcg

SEQ ID NO: 2426854 - RNA, 16 nt, Bordetella pertussis
gaaaaagcugccggca

SEQ ID NO: 2426855 - RNA, 14 nt, Bordetella pertussis
gaaaacagcaccag

SEQ ID NO: 2426856 - RNA, 16 nt, Bordetella pertussis
gaaaacagcaccagca

SEQ ID NO: 2426857 - RNA, 16 nt, Bordetella pertussis
gaaaaccggcgccugg

SEQ ID NO: 2426858 - RNA, 20 nt, Bordetella pertussis
gaaaagccggcggccgguca

SEQ ID NO: 2426859 - RNA, 22 nt, Bordetella pertussis
gaaaaucggcgaucgccuguau

SEQ ID NO: 2426860 - RNA, 21 nt, Bordetella pertussis
gaaaaugccgcggcaugcugg

SEQ ID NO: 2426861 - RNA, 14 nt, Bordetella pertussis
gaaacacgaugccu

SEQ ID NO: 2426862 - RNA, 14 nt, Bordetella pertussis
gaaacacguccagc

SEQ ID NO: 2426863 - RNA, 17 nt, Bordetella pertussis
gaaacacguccagcgcc

SEQ ID NO: 2426864 - RNA, 20 nt, Bordetella pertussis
gaaacagauugaacugcugg

SEQ ID NO: 2426865 - RNA, 12 nt, Bordetella pertussis
gaaacagcagcg

SEQ ID NO: 2426866 - RNA, 13 nt, Bordetella pertussis
gaaacagcagcgg

SEQ ID NO: 2426867 - RNA, 13 nt, Bordetella pertussis
gaaacagcaucag

SEQ ID NO: 2426868 - RNA, 18 nt, Bordetella pertussis
gaaacagcaucagcggca

SEQ ID NO: 2426869 - RNA, 15 nt, Bordetella pertussis
gaaacagcgaaagca

SEQ ID NO: 2426870 - RNA, 21 nt, Bordetella pertussis
gaaacagguucacgccccgca

SEQ ID NO: 2426871 - RNA, 18 nt, Bordetella pertussis
gaaacauaagucugcgcc

SEQ ID NO: 2426872 - RNA, 16 nt, Bordetella pertussis
gaaacccgcugggcca

SEQ ID NO: 2426873 - RNA, 19 nt, Bordetella pertussis
gaaacccgcugggccagca

SEQ ID NO: 2426874 - RNA, 21 nt, Bordetella pertussis
gaaacccuucgcgcagcaacc

SEQ ID NO: 2426875 - RNA, 22 nt, Bordetella pertussis
gaaaccgccacagcgccgcggc

SEQ ID NO: 2426876 - RNA, 14 nt, Bordetella pertussis
gaaaccggcgacca

SEQ ID NO: 2426877 - RNA, 17 nt, Bordetella pertussis
gaaaccggcgaccaccg

SEQ ID NO: 2426878 - RNA, 18 nt, Bordetella pertussis
gaaaccggcgcgcgcggc

SEQ ID NO: 2426879 - RNA, 18 nt, Bordetella pertussis
gaaaccggugaucagcag

SEQ ID NO: 2426880 - RNA, 20 nt, Bordetella pertussis
gaaaccggugaucagcaggc

SEQ ID NO: 2426881 - RNA, 21 nt, Bordetella pertussis
gaaaccggugaucagcaggcc

SEQ ID NO: 2426882 - RNA, 16 nt, Bordetella pertussis
gaaaccuggcccggca

SEQ ID NO: 2426883 - RNA, 14 nt, Bordetella pertussis
gaaacgcgacgcgc

SEQ ID NO: 2426884 - RNA, 15 nt, Bordetella pertussis
gaaacgcgcagcacc

SEQ ID NO: 2426885 - RNA, 23 nt, Bordetella pertussis
gaaacgcggucaccgagcugagc

SEQ ID NO: 2426886 - RNA, 17 nt, Bordetella pertussis
gaaacgcugcgcgaugc

SEQ ID NO: 2426887 - RNA, 20 nt, Bordetella pertussis
gaaacgcugcgcgaugcgcg

SEQ ID NO: 2426888 - RNA, 14 nt, Bordetella pertussis
gaaacgcuggcgua

SEQ ID NO: 2426889 - RNA, 13 nt, Bordetella pertussis
gaaacggccgggu

SEQ ID NO: 2426890 - RNA, 22 nt, Bordetella pertussis
gaaacgguucuggaucgcgccc

SEQ ID NO: 2426891 - RNA, 18 nt, Bordetella pertussis
gaaacguugcggaucacg

SEQ ID NO: 2426892 - RNA, 14 nt, Bordetella pertussis
gaaacucgcgcagc

SEQ ID NO: 2426893 - RNA, 15 nt, Bordetella pertussis
gaaacucgcgcagcg

SEQ ID NO: 2426894 - RNA, 13 nt, Bordetella pertussis
gaaacugccaucc

SEQ ID NO: 2426895 - RNA, 20 nt, Bordetella pertussis
gaaagaggcauuggcggcgg

SEQ ID NO: 2426896 - RNA, 15 nt, Bordetella pertussis
gaaagaggccaggcc

SEQ ID NO: 2426897 - RNA, 16 nt, Bordetella pertussis
gaaagaggccaggccc

SEQ ID NO: 2426898 - RNA, 13 nt, Bordetella pertussis
gaaagcacgccau

SEQ ID NO: 2426899 - RNA, 23 nt, Bordetella pertussis
gaaagcacggcgaugcugccguc

SEQ ID NO: 2426900 - RNA, 19 nt, Bordetella pertussis
gaaagcaucagcccuaccc

SEQ ID NO: 2426901 - RNA, 15 nt, Bordetella pertussis
gaaagcccggcccca

SEQ ID NO: 2426902 - RNA, 21 nt, Bordetella pertussis
gaaagcccggccccaggccgg

SEQ ID NO: 2426903 - RNA, 17 nt, Bordetella pertussis
gaaagccgauaccgcaa

SEQ ID NO: 2426904 - RNA, 16 nt, Bordetella pertussis
gaaagcgcggccgggc

SEQ ID NO: 2426905 - RNA, 19 nt, Bordetella pertussis
gaaagcgcgucgagcaggc

SEQ ID NO: 2426906 - RNA, 21 nt, Bordetella pertussis
gaaagcgcgucgagcaggccg

SEQ ID NO: 2426907 - RNA, 20 nt, Bordetella pertussis
gaaagcgcugcgccgcggcg

SEQ ID NO: 2426908 - RNA, 13 nt, Bordetella pertussis
gaaagcgucggcu

SEQ ID NO: 2426909 - RNA, 20 nt, Bordetella pertussis
gaaagcuggcguucgucgcc

SEQ ID NO: 2426910 - RNA, 16 nt, Bordetella pertussis
gaaagcuguccacgcc

SEQ ID NO: 2426911 - RNA, 20 nt, Bordetella pertussis
gaaaggccagcggcgguucg

SEQ ID NO: 2426912 - RNA, 20 nt, Bordetella pertussis
gaaaggggcugccgugaggc

SEQ ID NO: 2426913 - RNA, 13 nt, Bordetella pertussis
gaaagguccugga

SEQ ID NO: 2426914 - RNA, 21 nt, Bordetella pertussis
gaaauacaccuuguuggcgcc

SEQ ID NO: 2426915 - RNA, 17 nt, Bordetella pertussis
gaaauauugggcugguc

SEQ ID NO: 2426916 - RNA, 17 nt, Bordetella pertussis
gaaaucaggcgcaucga

SEQ ID NO: 2426917 - RNA, 21 nt, Bordetella pertussis
gaaaucaggcgcaucgacagc

SEQ ID NO: 2426918 - RNA, 22 nt, Bordetella pertussis
gaaauccguaguccagcagcag

SEQ ID NO: 2426919 - RNA, 16 nt, Bordetella pertussis
gaaaucgcggcgcugu

SEQ ID NO: 2426920 - RNA, 21 nt, Bordetella pertussis
gaaaucuucugcgccacggcg

SEQ ID NO: 2426921 - RNA, 18 nt, Bordetella pertussis
gaaaugauaguccugcca

SEQ ID NO: 2426922 - RNA, 19 nt, Bordetella pertussis
gaaaugccgcgcgcagggc

SEQ ID NO: 2426923 - RNA, 23 nt, Bordetella pertussis
gaacgauucuuuccuggccggcg

SEQ ID NO: 2426924 - RNA, 20 nt, Bordetella pertussis
gaacgauuucuucgccuggc

SEQ ID NO: 2426925 - RNA, 17 nt, Bordetella pertussis
gaacgcaauugcguggu

SEQ ID NO: 2426926 - RNA, 22 nt, Bordetella pertussis
gaacgcaauugcgugguggccu

SEQ ID NO: 2426927 - RNA, 21 nt, Bordetella pertussis
gaacgcaugcgugcgcaucag

SEQ ID NO: 2426928 - RNA, 18 nt, Bordetella pertussis
gaacgccaccaggccgau

SEQ ID NO: 2426929 - RNA, 12 nt, Bordetella pertussis
gaacgccagcag

SEQ ID NO: 2426930 - RNA, 13 nt, Bordetella pertussis
gaacgccagcagc

SEQ ID NO: 2426931 - RNA, 14 nt, Bordetella pertussis
gaacgccagcagca

SEQ ID NO: 2426932 - RNA, 17 nt, Bordetella pertussis
gaacgcccggcccaggc

SEQ ID NO: 2426933 - RNA, 21 nt, Bordetella pertussis
gaacgcccggcccaggccggg

SEQ ID NO: 2426934 - RNA, 22 nt, Bordetella pertussis
gaacgcccggcccaggccgggc

SEQ ID NO: 2426935 - RNA, 13 nt, Bordetella pertussis
gaacgccgcgcuc

SEQ ID NO: 2426936 - RNA, 19 nt, Bordetella pertussis
gaacgccgcgcucagcacc

SEQ ID NO: 2426937 - RNA, 22 nt, Bordetella pertussis
gaacgccgcgcucagcaccagg

SEQ ID NO: 2426938 - RNA, 16 nt, Bordetella pertussis
gaacgccgcgcugccu

SEQ ID NO: 2426939 - RNA, 18 nt, Bordetella pertussis
gaacgccgcgcugccuga

SEQ ID NO: 2426940 - RNA, 22 nt, Bordetella pertussis
gaacgccgcgucgcuggccgga

SEQ ID NO: 2426941 - RNA, 22 nt, Bordetella pertussis
gaacgccggcuugggcacacac

SEQ ID NO: 2426942 - RNA, 12 nt, Bordetella pertussis
gaacgccgggcc

SEQ ID NO: 2426943 - RNA, 11 nt, Bordetella pertussis
gaacgccucgg

SEQ ID NO: 2426944 - RNA, 13 nt, Bordetella pertussis
gaacgccugccag

SEQ ID NO: 2426945 - RNA, 14 nt, Bordetella pertussis
gaacgccuugcccg

SEQ ID NO: 2426946 - RNA, 22 nt, Bordetella pertussis
gaacgcgaacccgaucgcgaug

SEQ ID NO: 2426947 - RNA, 18 nt, Bordetella pertussis
gaacgcgacagcgcuggu

SEQ ID NO: 2426948 - RNA, 20 nt, Bordetella pertussis
gaacgcgcauucgucgcugc

SEQ ID NO: 2426949 - RNA, 23 nt, Bordetella pertussis
gaacgcgcauucgucgcugccgc

SEQ ID NO: 2426950 - RNA, 16 nt, Bordetella pertussis
gaacgcgccgcuggcg

SEQ ID NO: 2426951 - RNA, 17 nt, Bordetella pertussis
gaacgcgccgcuggcgu

SEQ ID NO: 2426952 - RNA, 21 nt, Bordetella pertussis
gaacgcgccggcccaggcgcg

SEQ ID NO: 2426953 - RNA, 15 nt, Bordetella pertussis
gaacgcggccagacc

SEQ ID NO: 2426954 - RNA, 15 nt, Bordetella pertussis
gaacgcguccaggcc

SEQ ID NO: 2426955 - RNA, 20 nt, Bordetella pertussis
gaacgcguccaggcccuggc

SEQ ID NO: 2426956 - RNA, 22 nt, Bordetella pertussis
gaacgcgucgcucauggagggg

SEQ ID NO: 2426957 - RNA, 23 nt, Bordetella pertussis
gaacgcgucgcucauggaggggc

SEQ ID NO: 2426958 - RNA, 19 nt, Bordetella pertussis
gaacgcguucaagucgccc

SEQ ID NO: 2426959 - RNA, 22 nt, Bordetella pertussis
gaacgcguucaagucgcccugc

SEQ ID NO: 2426960 - RNA, 19 nt, Bordetella pertussis
gaacgcuuccugggccugc

SEQ ID NO: 2426961 - RNA, 18 nt, Bordetella pertussis
gaacgcuugacggccagg

SEQ ID NO: 2426962 - RNA, 19 nt, Bordetella pertussis
gaacgcuugacggccagga

SEQ ID NO: 2426963 - RNA, 21 nt, Bordetella pertussis
gaacgcuugacggccaggacg

SEQ ID NO: 2426964 - RNA, 16 nt, Bordetella pertussis
gaacggaaacgcccag

SEQ ID NO: 2426965 - RNA, 14 nt, Bordetella pertussis
gaacggcaccagcc

SEQ ID NO: 2426966 - RNA, 16 nt, Bordetella pertussis
gaacggcaccagccgg

SEQ ID NO: 2426967 - RNA, 18 nt, Bordetella pertussis
gaacggcagcagcgcgcc

SEQ ID NO: 2426968 - RNA, 15 nt, Bordetella pertussis
gaacggcagcgcgcg

SEQ ID NO: 2426969 - RNA, 16 nt, Bordetella pertussis
gaacggcagcgcgcgc

SEQ ID NO: 2426970 - RNA, 19 nt, Bordetella pertussis
gaacggcagcgcgcgcgug

SEQ ID NO: 2426971 - RNA, 21 nt, Bordetella pertussis
gaacggcccacgcugucgggg

SEQ ID NO: 2426972 - RNA, 16 nt, Bordetella pertussis
gaacggccccgccagg

SEQ ID NO: 2426973 - RNA, 15 nt, Bordetella pertussis
gaacggccgcccggc

SEQ ID NO: 2426974 - RNA, 20 nt, Bordetella pertussis
gaacggccgcccggcauggg

SEQ ID NO: 2426975 - RNA, 16 nt, Bordetella pertussis
gaacggccgggcgccc

SEQ ID NO: 2426976 - RNA, 14 nt, Bordetella pertussis
gaacggcgcgaagg

SEQ ID NO: 2426977 - RNA, 13 nt, Bordetella pertussis
gaacggcgcggcc

SEQ ID NO: 2426978 - RNA, 17 nt, Bordetella pertussis
gaacggcuugauggcga

SEQ ID NO: 2426979 - RNA, 20 nt, Bordetella pertussis
gaacggcuugauggcgaugu

SEQ ID NO: 2426980 - RNA, 11 nt, Bordetella pertussis
gaacggcuugg

SEQ ID NO: 2426981 - RNA, 16 nt, Bordetella pertussis
gaacggcuuggcgugc

SEQ ID NO: 2426982 - RNA, 13 nt, Bordetella pertussis
gaacgggcggguc

SEQ ID NO: 2426983 - RNA, 19 nt, Bordetella pertussis
gaacggggccgccucggcg

SEQ ID NO: 2426984 - RNA, 20 nt, Bordetella pertussis
gaacggggccgccucggcgg

SEQ ID NO: 2426985 - RNA, 15 nt, Bordetella pertussis
gaacgggguggccgg

SEQ ID NO: 2426986 - RNA, 17 nt, Bordetella pertussis
gaacgggguggccggcg

SEQ ID NO: 2426987 - RNA, 20 nt, Bordetella pertussis
gaacgggguggccggcgcgc

SEQ ID NO: 2426988 - RNA, 23 nt, Bordetella pertussis
gaacgggguggccggcgcgcggc

SEQ ID NO: 2426989 - RNA, 20 nt, Bordetella pertussis
gaacgucaccccgcccugcc

SEQ ID NO: 2426990 - RNA, 22 nt, Bordetella pertussis
gaacgucaccccgcccugcccg

SEQ ID NO: 2426991 - RNA, 23 nt, Bordetella pertussis
gaacgucaccccgcccugcccgg

SEQ ID NO: 2426992 - RNA, 22 nt, Bordetella pertussis
gaacgugccgucgggcgccgca

SEQ ID NO: 2426993 - RNA, 13 nt, Bordetella pertussis
gaacguggccugc

SEQ ID NO: 2426994 - RNA, 14 nt, Bordetella pertussis
gaacguggcggcga

SEQ ID NO: 2426995 - RNA, 17 nt, Bordetella pertussis
gaacguguaggucagcg

SEQ ID NO: 2426996 - RNA, 18 nt, Bordetella pertussis
gaacguuugcggacgggc

SEQ ID NO: 2426997 - RNA, 20 nt, Bordetella pertussis
gaacuauggcgcgcgcacgc

SEQ ID NO: 2426998 - RNA, 18 nt, Bordetella pertussis
gaacuccaggaaagcgcc

SEQ ID NO: 2426999 - RNA, 14 nt, Bordetella pertussis
gaacuccggcggcg

SEQ ID NO: 2427000 - RNA, 13 nt, Bordetella pertussis
gaacuccugcagc

SEQ ID NO: 2427001 - RNA, 21 nt, Bordetella pertussis
gaacuccugcagcacgcuggc

SEQ ID NO: 2427002 - RNA, 16 nt, Bordetella pertussis
gaacucgaacacgccg

SEQ ID NO: 2427003 - RNA, 14 nt, Bordetella pertussis
gaacucgaacgcgu

SEQ ID NO: 2427004 - RNA, 20 nt, Bordetella pertussis
gaacucgauccgggccuggc

SEQ ID NO: 2427005 - RNA, 19 nt, Bordetella pertussis
gaacucgcacacgcgcugg

SEQ ID NO: 2427006 - RNA, 21 nt, Bordetella pertussis
gaacucgcacacgcgcugggc

SEQ ID NO: 2427007 - RNA, 21 nt, Bordetella pertussis
gaacucgccgaacugccggcg

SEQ ID NO: 2427008 - RNA, 19 nt, Bordetella pertussis
gaacucgcgcucggccagc

SEQ ID NO: 2427009 - RNA, 22 nt, Bordetella pertussis
gaacucgcgcucggccagcgcg

SEQ ID NO: 2427010 - RNA, 13 nt, Bordetella pertussis
gaacucggccgca

SEQ ID NO: 2427011 - RNA, 15 nt, Bordetella pertussis
gaacucggccgcaug

SEQ ID NO: 2427012 - RNA, 19 nt, Bordetella pertussis
gaacucggccgcauggcgg

SEQ ID NO: 2427013 - RNA, 14 nt, Bordetella pertussis
gaacucgguggcgg

SEQ ID NO: 2427014 - RNA, 16 nt, Bordetella pertussis
gaacucguuggccagc

SEQ ID NO: 2427015 - RNA, 17 nt, Bordetella pertussis
gaacucguuggccagcg

SEQ ID NO: 2427016 - RNA, 21 nt, Bordetella pertussis
gaacucguuggccagcgcgcc

SEQ ID NO: 2427017 - RNA, 14 nt, Bordetella pertussis
gaacugccggcgcg

SEQ ID NO: 2427018 - RNA, 15 nt, Bordetella pertussis
gaacugcgcggucuu

SEQ ID NO: 2427019 - RNA, 19 nt, Bordetella pertussis
gaacugcuccacgugcggc

SEQ ID NO: 2427020 - RNA, 17 nt, Bordetella pertussis
gaacugcuugcgcgugc

SEQ ID NO: 2427021 - RNA, 20 nt, Bordetella pertussis
gaacugcuugcgcgugcgca

SEQ ID NO: 2427022 - RNA, 23 nt, Bordetella pertussis
gaacugcuugcgcgugcgcaggu

SEQ ID NO: 2427023 - RNA, 16 nt, Bordetella pertussis
gaacugggcgucgucc

SEQ ID NO: 2427024 - RNA, 21 nt, Bordetella pertussis
gaacugggcgucguccugcag

SEQ ID NO: 2427025 - RNA, 15 nt, Bordetella pertussis
gaacugggucugcac

SEQ ID NO: 2427026 - RNA, 11 nt, Bordetella pertussis
gaacugucauu

SEQ ID NO: 2427027 - RNA, 14 nt, Bordetella pertussis
gaacuuggcgcggu

SEQ ID NO: 2427028 - RNA, 21 nt, Bordetella pertussis
gaacuugggaucggccaggcc

SEQ ID NO: 2427029 - RNA, 19 nt, Bordetella pertussis
gaacuuguucuuguugcuc

SEQ ID NO: 2427030 - RNA, 18 nt, Bordetella pertussis
gaagaaauagcccgcggc

SEQ ID NO: 2427031 - RNA, 13 nt, Bordetella pertussis
gaagaaccgccgc

SEQ ID NO: 2427032 - RNA, 15 nt, Bordetella pertussis
gaagaagcagccgcg

SEQ ID NO: 2427033 - RNA, 22 nt, Bordetella pertussis
gaagacaugcugcgacagcagg

SEQ ID NO: 2427034 - RNA, 15 nt, Bordetella pertussis
gaagacauggcgcgc

SEQ ID NO: 2427035 - RNA, 16 nt, Bordetella pertussis
gaagggauagcgccgu

SEQ ID NO: 2427036 - RNA, 20 nt, Bordetella pertussis
gaagggcaccgugaugucgc

SEQ ID NO: 2427037 - RNA, 12 nt, Bordetella pertussis
gaagggcagcag

SEQ ID NO: 2427038 - RNA, 14 nt, Bordetella pertussis
gaagggcagcagca

SEQ ID NO: 2427039 - RNA, 15 nt, Bordetella pertussis
gaagggcagcagcag

SEQ ID NO: 2427040 - RNA, 12 nt, Bordetella pertussis
gaagggcggcgc

SEQ ID NO: 2427041 - RNA, 16 nt, Bordetella pertussis
gaagggcuggccggcc

SEQ ID NO: 2427042 - RNA, 23 nt, Bordetella pertussis
gaagggcuggccggccaacagcu

SEQ ID NO: 2427043 - RNA, 13 nt, Bordetella pertussis
gaaggggcggcuu

SEQ ID NO: 2427044 - RNA, 20 nt, Bordetella pertussis
gaaggggcggcuucaggcgc

SEQ ID NO: 2427045 - RNA, 16 nt, Bordetella pertussis
gaaggguugcaguucg

SEQ ID NO: 2427046 - RNA, 18 nt, Bordetella pertussis
gaagguccacggcauggc

SEQ ID NO: 2427047 - RNA, 15 nt, Bordetella pertussis
gaaggucugggccag

SEQ ID NO: 2427048 - RNA, 22 nt, Bordetella pertussis
gaaggucuggucgcacgacagc

SEQ ID NO: 2427049 - RNA, 16 nt, Bordetella pertussis
gaaggugcggaucacg

SEQ ID NO: 2427050 - RNA, 18 nt, Bordetella pertussis
gaagguuucgcugcgcac

SEQ ID NO: 2427051 - RNA, 22 nt, Bordetella pertussis
gaagguuucguagccgccgacg

SEQ ID NO: 2427052 - RNA, 23 nt, Bordetella pertussis
gaagguuucguagccgccgacga

SEQ ID NO: 2427053 - RNA, 17 nt, Bordetella pertussis
gaaguaaucgcccggcg

SEQ ID NO: 2427054 - RNA, 13 nt, Bordetella pertussis
gaaguacacggcc

SEQ ID NO: 2427055 - RNA, 18 nt, Bordetella pertussis
gaaguacacggccagcac

SEQ ID NO: 2427056 - RNA, 14 nt, Bordetella pertussis
gaaguacagcuuga

SEQ ID NO: 2427057 - RNA, 16 nt, Bordetella pertussis
gaaguaggcggccagg

SEQ ID NO: 2427058 - RNA, 20 nt, Bordetella pertussis
gaaguaggcggccaggccga

SEQ ID NO: 2427059 - RNA, 19 nt, Bordetella pertussis
gaagucagccggugccagu

SEQ ID NO: 2427060 - RNA, 20 nt, Bordetella pertussis
gaaguccggaucccaggccg

SEQ ID NO: 2427061 - RNA, 21 nt, Bordetella pertussis
gaaguccggaucccaggccgg

SEQ ID NO: 2427062 - RNA, 18 nt, Bordetella pertussis
gaaguccugcaucgccau

SEQ ID NO: 2427063 - RNA, 20 nt, Bordetella pertussis
gaaguccugguuggccucgc

SEQ ID NO: 2427064 - RNA, 13 nt, Bordetella pertussis
gaaguccuucagc

SEQ ID NO: 2427065 - RNA, 19 nt, Bordetella pertussis
gaagucgcggcccgccagg

SEQ ID NO: 2427066 - RNA, 12 nt, Bordetella pertussis
gaagucggccgg

SEQ ID NO: 2427067 - RNA, 23 nt, Bordetella pertussis
gaagucggccggcaaggucagca

SEQ ID NO: 2427068 - RNA, 22 nt, Bordetella pertussis
gaagucggcgcgcgcuucaccc

SEQ ID NO: 2427069 - RNA, 18 nt, Bordetella pertussis
gaagucggcucgucgaac

SEQ ID NO: 2427070 - RNA, 13 nt, Bordetella pertussis
gaagucgggcacc

SEQ ID NO: 2427071 - RNA, 16 nt, Bordetella pertussis
gaagugccuguccccg

SEQ ID NO: 2427072 - RNA, 22 nt, Bordetella pertussis
gaagugcgcccccauguccagg

SEQ ID NO: 2427073 - RNA, 17 nt, Bordetella pertussis
gaaguugcggccgugcg

SEQ ID NO: 2427074 - RNA, 13 nt, Bordetella pertussis
gaauaaucgccgg

SEQ ID NO: 2427075 - RNA, 14 nt, Bordetella pertussis
gaauaccgccagcu

SEQ ID NO: 2427076 - RNA, 20 nt, Bordetella pertussis
gaauaccgccagcucggccu

SEQ ID NO: 2427077 - RNA, 22 nt, Bordetella pertussis
gaaucaauacgaaaaccaggcu

SEQ ID NO: 2427078 - RNA, 18 nt, Bordetella pertussis
gaauccaccggcgcgcgc

SEQ ID NO: 2427079 - RNA, 17 nt, Bordetella pertussis
gaauccgcaacccagca

SEQ ID NO: 2427080 - RNA, 21 nt, Bordetella pertussis
gaauccgcaacccagcagcgg

SEQ ID NO: 2427081 - RNA, 14 nt, Bordetella pertussis
gaauccggccagca

SEQ ID NO: 2427082 - RNA, 22 nt, Bordetella pertussis
gaauccggccagcacgccggcg

SEQ ID NO: 2427083 - RNA, 17 nt, Bordetella pertussis
gaauccggggugccugu

SEQ ID NO: 2427084 - RNA, 18 nt, Bordetella pertussis
gaauccguaagcgcugga

SEQ ID NO: 2427085 - RNA, 17 nt, Bordetella pertussis
gaauccuggcgacggcc

SEQ ID NO: 2427086 - RNA, 20 nt, Bordetella pertussis
gaauccuggcgacggccugc

SEQ ID NO: 2427087 - RNA, 20 nt, Bordetella pertussis
gaaucgcccgggcgccggca

SEQ ID NO: 2427088 - RNA, 14 nt, Bordetella pertussis
gaaucggcgcgagc

SEQ ID NO: 2427089 - RNA, 21 nt, Bordetella pertussis
gaaucgucaugaacgucaccc

SEQ ID NO: 2427090 - RNA, 17 nt, Bordetella pertussis
gaaucgucgaccagcag

SEQ ID NO: 2427091 - RNA, 12 nt, Bordetella pertussis
gaaucugcuugc

SEQ ID NO: 2427092 - RNA, 22 nt, Bordetella pertussis
gaaugaacagcuugcuguccag

SEQ ID NO: 2427093 - RNA, 20 nt, Bordetella pertussis
gaaugaagcgcgacaugacg

SEQ ID NO: 2427094 - RNA, 21 nt, Bordetella pertussis
gaaugacgguggugucggcgg

SEQ ID NO: 2427095 - RNA, 16 nt, Bordetella pertussis
gaaugagcgcgcugcu

SEQ ID NO: 2427096 - RNA, 18 nt, Bordetella pertussis
gaaugccugguaggcgag

SEQ ID NO: 2427097 - RNA, 21 nt, Bordetella pertussis
gaaugcgacagcgacagccag

SEQ ID NO: 2427098 - RNA, 14 nt, Bordetella pertussis
gaaugcgccuggcg

SEQ ID NO: 2427099 - RNA, 15 nt, Bordetella pertussis
gaaugcggcgacagg

SEQ ID NO: 2427100 - RNA, 14 nt, Bordetella pertussis
gaaugcggguguug

SEQ ID NO: 2427101 - RNA, 16 nt, Bordetella pertussis
gaauggcgcgauccag

SEQ ID NO: 2427102 - RNA, 17 nt, Bordetella pertussis
gaauggcgcgauccagu

SEQ ID NO: 2427103 - RNA, 16 nt, Bordetella pertussis
gaauggcugcgcgccg

SEQ ID NO: 2427104 - RNA, 18 nt, Bordetella pertussis
gaauggucaagcggcugc

SEQ ID NO: 2427105 - RNA, 17 nt, Bordetella pertussis
gaauguauuggcccagu

SEQ ID NO: 2427106 - RNA, 19 nt, Bordetella pertussis
gaauguauuggcccaguug

SEQ ID NO: 2427107 - RNA, 20 nt, Bordetella pertussis
gaaugucaccccugcgcugc

SEQ ID NO: 2427108 - RNA, 17 nt, Bordetella pertussis
gaaugucccacaggcgc

SEQ ID NO: 2427109 - RNA, 19 nt, Bordetella pertussis
gaaugucccacaggcgcgc

SEQ ID NO: 2427110 - RNA, 23 nt, Bordetella pertussis
gaaugucccacaggcgcgcggcg

SEQ ID NO: 2427111 - RNA, 19 nt, Bordetella pertussis
gaaugugcgagggcucgac

SEQ ID NO: 2427112 - RNA, 21 nt, Bordetella pertussis
gaauuccagccaggccucggc

SEQ ID NO: 2427113 - RNA, 17 nt, Bordetella pertussis
gaauuccgguucaccau

SEQ ID NO: 2427114 - RNA, 14 nt, Bordetella pertussis
gaauuccucgccgc

SEQ ID NO: 2427115 - RNA, 19 nt, Bordetella pertussis
gaauuccucgcggcugucc

SEQ ID NO: 2427116 - RNA, 16 nt, Bordetella pertussis
gaauugcgggccggcg

SEQ ID NO: 2427117 - RNA, 13 nt, Bordetella pertussis
gaauugcuggagc

SEQ ID NO: 2427118 - RNA, 13 nt, Bordetella pertussis
gaauuggcgccca

SEQ ID NO: 2427119 - RNA, 16 nt, Bordetella pertussis
gaauuuuucuuccagu

SEQ ID NO: 2427120 - RNA, 15 nt, Bordetella pertussis
gacaacaagccgggc

SEQ ID NO: 2427121 - RNA, 23 nt, Bordetella pertussis
gacaacaggucguggcccagccg

SEQ ID NO: 2427122 - RNA, 15 nt, Bordetella pertussis
gacaacgcgcgccac

SEQ ID NO: 2427123 - RNA, 16 nt, Bordetella pertussis
gacaacugcgcgaaug

SEQ ID NO: 2427124 - RNA, 12 nt, Bordetella pertussis
gacaaggcgcgc

SEQ ID NO: 2427125 - RNA, 17 nt, Bordetella pertussis
gacacagcggcgcgagc

SEQ ID NO: 2427126 - RNA, 19 nt, Bordetella pertussis
gacaccaaccugcuggcca

SEQ ID NO: 2427127 - RNA, 20 nt, Bordetella pertussis
gacaccaaggggcggaucgu

SEQ ID NO: 2427128 - RNA, 14 nt, Bordetella pertussis
gacacccgcggcca

SEQ ID NO: 2427129 - RNA, 18 nt, Bordetella pertussis
gacacccggucggcccag

SEQ ID NO: 2427130 - RNA, 20 nt, Bordetella pertussis
gacaccgcaggugccugucc

SEQ ID NO: 2427131 - RNA, 20 nt, Bordetella pertussis
gacaccgucaggaagcccga

SEQ ID NO: 2427132 - RNA, 20 nt, Bordetella pertussis
gacaccgugaaggugccgga

SEQ ID NO: 2427133 - RNA, 22 nt, Bordetella pertussis
gacaccgugcgauggaacucgu

SEQ ID NO: 2427134 - RNA, 19 nt, Bordetella pertussis
gacaccguuuuggcaggcu

SEQ ID NO: 2427135 - RNA, 21 nt, Bordetella pertussis
gacaccguuuuggcaggcugg

SEQ ID NO: 2427136 - RNA, 22 nt, Bordetella pertussis
gacaccguuuuggcaggcuggc

SEQ ID NO: 2427137 - RNA, 17 nt, Bordetella pertussis
gacacgcagcugaacga

SEQ ID NO: 2427138 - RNA, 15 nt, Bordetella pertussis
gacacgcaugcaggu

SEQ ID NO: 2427139 - RNA, 13 nt, Bordetella pertussis
gacacgcccagca

SEQ ID NO: 2427140 - RNA, 17 nt, Bordetella pertussis
gacacgcccagcaggcu

SEQ ID NO: 2427141 - RNA, 17 nt, Bordetella pertussis
gacacgcuagggcgugg

SEQ ID NO: 2427142 - RNA, 19 nt, Bordetella pertussis
gacacgcuagggcguggcg

SEQ ID NO: 2427143 - RNA, 15 nt, Bordetella pertussis
gacacggcggugccg

SEQ ID NO: 2427144 - RNA, 19 nt, Bordetella pertussis
gacacggcggugccgcgca

SEQ ID NO: 2427145 - RNA, 22 nt, Bordetella pertussis
gacacuucggucgcguaguccg

SEQ ID NO: 2427146 - RNA, 18 nt, Bordetella pertussis
gacagaccguagcgcagg

SEQ ID NO: 2427147 - RNA, 22 nt, Bordetella pertussis
gacagaccguagcgcaggcgcu

SEQ ID NO: 2427148 - RNA, 16 nt, Bordetella pertussis
gacagggcgucgucgg

SEQ ID NO: 2427149 - RNA, 21 nt, Bordetella pertussis
gacaggguccagguggcccgc

SEQ ID NO: 2427150 - RNA, 17 nt, Bordetella pertussis
gacagggugccuguccc

SEQ ID NO: 2427151 - RNA, 19 nt, Bordetella pertussis
gacagguagcggucgccgc

SEQ ID NO: 2427152 - RNA, 21 nt, Bordetella pertussis
gacagguagcggucgccgcgg

SEQ ID NO: 2427153 - RNA, 15 nt, Bordetella pertussis
gacaggucggcgccc

SEQ ID NO: 2427154 - RNA, 18 nt, Bordetella pertussis
gacaggucggcgcccacg

SEQ ID NO: 2427155 - RNA, 17 nt, Bordetella pertussis
gacagugcccugacccg

SEQ ID NO: 2427156 - RNA, 19 nt, Bordetella pertussis
gacagugcccugacccgcu

SEQ ID NO: 2427157 - RNA, 21 nt, Bordetella pertussis
gacagugcccugacccgcugg

SEQ ID NO: 2427158 - RNA, 18 nt, Bordetella pertussis
gacauagacgcgcagcgg

SEQ ID NO: 2427159 - RNA, 21 nt, Bordetella pertussis
gacauagagauuguccagcgg

SEQ ID NO: 2427160 - RNA, 23 nt, Bordetella pertussis
gacauagagauuguccagcggca

SEQ ID NO: 2427161 - RNA, 12 nt, Bordetella pertussis
gacauaggagag

SEQ ID NO: 2427162 - RNA, 15 nt, Bordetella pertussis
gacaucagccauugc

SEQ ID NO: 2427163 - RNA, 17 nt, Bordetella pertussis
gacaucgccgcugcgca

SEQ ID NO: 2427164 - RNA, 20 nt, Bordetella pertussis
gacaucggggucgaucgcau

SEQ ID NO: 2427165 - RNA, 23 nt, Bordetella pertussis
gacaugacgauggucuugccgcc

SEQ ID NO: 2427166 - RNA, 22 nt, Bordetella pertussis
gacaugcacgauauuggcgucg

SEQ ID NO: 2427167 - RNA, 15 nt, Bordetella pertussis
gacaugcccgccggc

SEQ ID NO: 2427168 - RNA, 20 nt, Bordetella pertussis
gacaugcucgaugccggccu

SEQ ID NO: 2427169 - RNA, 18 nt, Bordetella pertussis
gacaugcugcgacagcag

SEQ ID NO: 2427170 - RNA, 13 nt, Bordetella pertussis
gacaugcuggccc

SEQ ID NO: 2427171 - RNA, 20 nt, Bordetella pertussis
gacaugcuggcccagcuggg

SEQ ID NO: 2427172 - RNA, 21 nt, Bordetella pertussis
gacaugcuggcccagcugggc

SEQ ID NO: 2427173 - RNA, 17 nt, Bordetella pertussis
gacauggccacggcccu

SEQ ID NO: 2427174 - RNA, 20 nt, Bordetella pertussis
gacauggccacggcccuggu

SEQ ID NO: 2427175 - RNA, 12 nt, Bordetella pertussis
gacauggcgcgc

SEQ ID NO: 2427176 - RNA, 17 nt, Bordetella pertussis
gacauggcgcgcgccag

SEQ ID NO: 2427177 - RNA, 20 nt, Bordetella pertussis
gacauugucaagcagcgccg

SEQ ID NO: 2427178 - RNA, 19 nt, Bordetella pertussis
gaccaaccugaccgccuuc

SEQ ID NO: 2427179 - RNA, 20 nt, Bordetella pertussis
gaccaagcgccacagcgcca

SEQ ID NO: 2427180 - RNA, 14 nt, Bordetella pertussis
gaccaagcugcgcg

SEQ ID NO: 2427181 - RNA, 20 nt, Bordetella pertussis
gaccaagcugcgcgaggacc

SEQ ID NO: 2427182 - RNA, 18 nt, Bordetella pertussis
gaccaauacgccgccaug

SEQ ID NO: 2427183 - RNA, 22 nt, Bordetella pertussis
gaccaccacgcuggcuucgucg

SEQ ID NO: 2427184 - RNA, 14 nt, Bordetella pertussis
gaccaccagcacca

SEQ ID NO: 2427185 - RNA, 18 nt, Bordetella pertussis
gaccaccagcaccaugcc

SEQ ID NO: 2427186 - RNA, 15 nt, Bordetella pertussis
gaccaccagcaccga

SEQ ID NO: 2427187 - RNA, 18 nt, Bordetella pertussis
gaccaccagcaucgcgcc

SEQ ID NO: 2427188 - RNA, 22 nt, Bordetella pertussis
gaccaccagcaucgcgccuucg

SEQ ID NO: 2427189 - RNA, 15 nt, Bordetella pertussis
gaccaccagcgcacu

SEQ ID NO: 2427190 - RNA, 13 nt, Bordetella pertussis
gaccaccagcguc

SEQ ID NO: 2427191 - RNA, 21 nt, Bordetella pertussis
gaccaccagcgucaccagcag

SEQ ID NO: 2427192 - RNA, 17 nt, Bordetella pertussis
gaccaccaggccgccua

SEQ ID NO: 2427193 - RNA, 19 nt, Bordetella pertussis
gaccaccaggccgccuaug

SEQ ID NO: 2427194 - RNA, 16 nt, Bordetella pertussis
gaccacccgcgccagg

SEQ ID NO: 2427195 - RNA, 14 nt, Bordetella pertussis
gaccaccggcuugg

SEQ ID NO: 2427196 - RNA, 17 nt, Bordetella pertussis
gaccaccgucuugcccg

SEQ ID NO: 2427197 - RNA, 22 nt, Bordetella pertussis
gaccaccgucuugcccgccagc

SEQ ID NO: 2427198 - RNA, 13 nt, Bordetella pertussis
gaccaccugcacc

SEQ ID NO: 2427199 - RNA, 17 nt, Bordetella pertussis
gaccaccugcaccgccg

SEQ ID NO: 2427200 - RNA, 22 nt, Bordetella pertussis
gaccaccugcucggugagcggc

SEQ ID NO: 2427201 - RNA, 14 nt, Bordetella pertussis
gaccaccuugcccc

SEQ ID NO: 2427202 - RNA, 19 nt, Bordetella pertussis
gaccacgaccuuggcggcc

SEQ ID NO: 2427203 - RNA, 22 nt, Bordetella pertussis
gaccacgaccuuggcggccgac

SEQ ID NO: 2427204 - RNA, 23 nt, Bordetella pertussis
gaccacgaccuuggcggccgaca

SEQ ID NO: 2427205 - RNA, 17 nt, Bordetella pertussis
gaccacgauggccggcg

SEQ ID NO: 2427206 - RNA, 18 nt, Bordetella pertussis
gaccacgauggccggcgc

SEQ ID NO: 2427207 - RNA, 19 nt, Bordetella pertussis
gaccacgauggccggcgcg

SEQ ID NO: 2427208 - RNA, 21 nt, Bordetella pertussis
gaccacgcccuggaucagggu

SEQ ID NO: 2427209 - RNA, 14 nt, Bordetella pertussis
gaccacgccggcgg

SEQ ID NO: 2427210 - RNA, 18 nt, Bordetella pertussis
gaccacgccggcggccau

SEQ ID NO: 2427211 - RNA, 19 nt, Bordetella pertussis
gaccacgccggcggucacg

SEQ ID NO: 2427212 - RNA, 21 nt, Bordetella pertussis
gaccacgcgcgcgccgccggc

SEQ ID NO: 2427213 - RNA, 12 nt, Bordetella pertussis
gaccacgcgcug

SEQ ID NO: 2427214 - RNA, 16 nt, Bordetella pertussis
gaccacgcggcggugc

SEQ ID NO: 2427215 - RNA, 20 nt, Bordetella pertussis
gaccacgcugggccagaccg

SEQ ID NO: 2427216 - RNA, 21 nt, Bordetella pertussis
gaccacgcugggccagaccgc

SEQ ID NO: 2427217 - RNA, 13 nt, Bordetella pertussis
gaccacggccagc

SEQ ID NO: 2427218 - RNA, 14 nt, Bordetella pertussis
gaccacggccagca

SEQ ID NO: 2427219 - RNA, 16 nt, Bordetella pertussis
gaccacggccagcagc

SEQ ID NO: 2427220 - RNA, 17 nt, Bordetella pertussis
gaccacggccagcagca

SEQ ID NO: 2427221 - RNA, 13 nt, Bordetella pertussis
gaccacggcgcgc

SEQ ID NO: 2427222 - RNA, 15 nt, Bordetella pertussis
gaccacggcgcgccc

SEQ ID NO: 2427223 - RNA, 18 nt, Bordetella pertussis
gaccacggcgcgcccgca

SEQ ID NO: 2427224 - RNA, 14 nt, Bordetella pertussis
gaccacggcggcuu

SEQ ID NO: 2427225 - RNA, 21 nt, Bordetella pertussis
gaccacggcggcuucggccgu

SEQ ID NO: 2427226 - RNA, 16 nt, Bordetella pertussis
gaccacggucuggcgc

SEQ ID NO: 2427227 - RNA, 13 nt, Bordetella pertussis
gaccacgucgacc

SEQ ID NO: 2427228 - RNA, 19 nt, Bordetella pertussis
gaccacguggaugaugguc

SEQ ID NO: 2427229 - RNA, 13 nt, Bordetella pertussis
gaccacuggcaga

SEQ ID NO: 2427230 - RNA, 16 nt, Bordetella pertussis
gaccacuggcagaccg

SEQ ID NO: 2427231 - RNA, 20 nt, Bordetella pertussis
gaccagcaccagcgccugcc

SEQ ID NO: 2427232 - RNA, 21 nt, Bordetella pertussis
gaccagcaccagcgccugccg

SEQ ID NO: 2427233 - RNA, 16 nt, Bordetella pertussis
gaccagcaccggcacg

SEQ ID NO: 2427234 - RNA, 20 nt, Bordetella pertussis
gaccagcacgagauguccau

SEQ ID NO: 2427235 - RNA, 18 nt, Bordetella pertussis
gaccagcacgauccagcc

SEQ ID NO: 2427236 - RNA, 18 nt, Bordetella pertussis
gaccagcacgauggucag

SEQ ID NO: 2427237 - RNA, 10 nt, Bordetella pertussis
gaccagcagc

SEQ ID NO: 2427238 - RNA, 19 nt, Bordetella pertussis
gaccagcagcaccgugccg

SEQ ID NO: 2427239 - RNA, 14 nt, Bordetella pertussis
gaccagcagccggu

SEQ ID NO: 2427240 - RNA, 16 nt, Bordetella pertussis
gaccagcagcgccggg

SEQ ID NO: 2427241 - RNA, 17 nt, Bordetella pertussis
gaccagcagcgccgggg

SEQ ID NO: 2427242 - RNA, 23 nt, Bordetella pertussis
gaccagcagcggguugcgcgcca

SEQ ID NO: 2427243 - RNA, 14 nt, Bordetella pertussis
gaccagcaggccca

SEQ ID NO: 2427244 - RNA, 19 nt, Bordetella pertussis
gaccagcaguugcgccagu

SEQ ID NO: 2427245 - RNA, 22 nt, Bordetella pertussis
gaccagcaguugcgccaguucg

SEQ ID NO: 2427246 - RNA, 15 nt, Bordetella pertussis
gaccagcccggccgc

SEQ ID NO: 2427247 - RNA, 17 nt, Bordetella pertussis
gaccagcccggccgcca

SEQ ID NO: 2427248 - RNA, 20 nt, Bordetella pertussis
gaccagcccggccgccagca

SEQ ID NO: 2427249 - RNA, 16 nt, Bordetella pertussis
gaccagcccguccugg

SEQ ID NO: 2427250 - RNA, 14 nt, Bordetella pertussis
gaccagcgacagca

SEQ ID NO: 2427251 - RNA, 17 nt, Bordetella pertussis
gaccagcgaguugaagg

SEQ ID NO: 2427252 - RNA, 13 nt, Bordetella pertussis
gaccagcgccggc

SEQ ID NO: 2427253 - RNA, 14 nt, Bordetella pertussis
gaccagcgccggcg

SEQ ID NO: 2427254 - RNA, 15 nt, Bordetella pertussis
gaccagcgccggcgc

SEQ ID NO: 2427255 - RNA, 12 nt, Bordetella pertussis
gaccagcgcgcg

SEQ ID NO: 2427256 - RNA, 13 nt, Bordetella pertussis
gaccagcgcgcgc

SEQ ID NO: 2427257 - RNA, 15 nt, Bordetella pertussis
gaccagcgcgcgccg

SEQ ID NO: 2427258 - RNA, 17 nt, Bordetella pertussis
gaccagcgcgcgccggc

SEQ ID NO: 2427259 - RNA, 18 nt, Bordetella pertussis
gaccagcgcgcggugccg

SEQ ID NO: 2427260 - RNA, 22 nt, Bordetella pertussis
gaccagcgcgcggugccgccug

SEQ ID NO: 2427261 - RNA, 14 nt, Bordetella pertussis
gacccuggcgcgcg

SEQ ID NO: 2427262 - RNA, 20 nt, Bordetella pertussis
gacccuguacaagcgcacgc

SEQ ID NO: 2427263 - RNA, 21 nt, Bordetella pertussis
gacccuuucauuucggcgccg

SEQ ID NO: 2427264 - RNA, 22 nt, Bordetella pertussis
gacccuuucauuucggcgccgc

SEQ ID NO: 2427265 - RNA, 14 nt, Bordetella pertussis
gaccgaacggccgg

SEQ ID NO: 2427266 - RNA, 15 nt, Bordetella pertussis
gaccgaacggccggu

SEQ ID NO: 2427267 - RNA, 13 nt, Bordetella pertussis
gaccgacagcaca

SEQ ID NO: 2427268 - RNA, 12 nt, Bordetella pertussis
gaccgacgccgu

SEQ ID NO: 2427269 - RNA, 15 nt, Bordetella pertussis
gaccgacggcaucgu

SEQ ID NO: 2427270 - RNA, 16 nt, Bordetella pertussis
gaccgagcccggcacc

SEQ ID NO: 2427271 - RNA, 14 nt, Bordetella pertussis
gaccgagccggcca

SEQ ID NO: 2427272 - RNA, 15 nt, Bordetella pertussis
gaccgagccggccag

SEQ ID NO: 2427273 - RNA, 17 nt, Bordetella pertussis
gaccgagccggccagcg

SEQ ID NO: 2427274 - RNA, 18 nt, Bordetella pertussis
gaccgagccggccagcgc

SEQ ID NO: 2427275 - RNA, 23 nt, Bordetella pertussis
gaccgagccggccagcgccuggg

SEQ ID NO: 2427276 - RNA, 13 nt, Bordetella pertussis
gaccgagcgcgcc

SEQ ID NO: 2427277 - RNA, 14 nt, Bordetella pertussis
gaccgagcgcgccc

SEQ ID NO: 2427278 - RNA, 15 nt, Bordetella pertussis
gaccgagcgcgcccg

SEQ ID NO: 2427279 - RNA, 16 nt, Bordetella pertussis
gaccgagcgcgcccgc

SEQ ID NO: 2427280 - RNA, 13 nt, Bordetella pertussis
gaccgagggcgcg

SEQ ID NO: 2427281 - RNA, 20 nt, Bordetella pertussis
gaccgagguguagaacucgg

SEQ ID NO: 2427282 - RNA, 22 nt, Bordetella pertussis
gaccgauucgaacucgccgaac

SEQ ID NO: 2427283 - RNA, 16 nt, Bordetella pertussis
gaccgauucgcgcacc

SEQ ID NO: 2427284 - RNA, 18 nt, Bordetella pertussis
gaccgcacgauggcgcgc

SEQ ID NO: 2427285 - RNA, 20 nt, Bordetella pertussis
gaccgcacgauggcgcgcga

SEQ ID NO: 2427286 - RNA, 13 nt, Bordetella pertussis
gaccgcaugcggc

SEQ ID NO: 2427287 - RNA, 18 nt, Bordetella pertussis
gaccgcaugcugcagcug

SEQ ID NO: 2427288 - RNA, 13 nt, Bordetella pertussis
gaccgccagcagg

SEQ ID NO: 2427289 - RNA, 14 nt, Bordetella pertussis
gaccgccagcaggc

SEQ ID NO: 2427290 - RNA, 12 nt, Bordetella pertussis
gaccgccagcau

SEQ ID NO: 2427291 - RNA, 14 nt, Bordetella pertussis
gaccgccagcaucc

SEQ ID NO: 2427292 - RNA, 14 nt, Bordetella pertussis
gaccgcccgcugcu

SEQ ID NO: 2427293 - RNA, 13 nt, Bordetella pertussis
gaccgccgccacg

SEQ ID NO: 2427294 - RNA, 18 nt, Bordetella pertussis
gaccgccgccagcagcgc

SEQ ID NO: 2427295 - RNA, 14 nt, Bordetella pertussis
gaccgccgccuugg

SEQ ID NO: 2427296 - RNA, 18 nt, Bordetella pertussis
gaccgccgcgccgguggc

SEQ ID NO: 2427297 - RNA, 17 nt, Bordetella pertussis
gaccgccggcaccagcg

SEQ ID NO: 2427298 - RNA, 13 nt, Bordetella pertussis
gaccgccggccgg

SEQ ID NO: 2427299 - RNA, 17 nt, Bordetella pertussis
gaccgccggccggugca

SEQ ID NO: 2427300 - RNA, 17 nt, Bordetella pertussis
gaccgccgggacaggca

SEQ ID NO: 2427301 - RNA, 19 nt, Bordetella pertussis
gaccgccgggacaggcacc

SEQ ID NO: 2427302 - RNA, 17 nt, Bordetella pertussis
gaccgccuccagcgcgg

SEQ ID NO: 2427303 - RNA, 18 nt, Bordetella pertussis
gaccgccuccagcgcggc

SEQ ID NO: 2427304 - RNA, 19 nt, Bordetella pertussis
gaccgccuccagcgcggcg

SEQ ID NO: 2427305 - RNA, 22 nt, Bordetella pertussis
gaccgccuccagcgcggcgggc

SEQ ID NO: 2427306 - RNA, 15 nt, Bordetella pertussis
gaccgccuccaggau

SEQ ID NO: 2427307 - RNA, 20 nt, Bordetella pertussis
gaccgccucgacgcccgggc

SEQ ID NO: 2427308 - RNA, 21 nt, Bordetella pertussis
gaccgccucgacgcccgggcg

SEQ ID NO: 2427309 - RNA, 22 nt, Bordetella pertussis
gaccgccucgacgcccgggcgg

SEQ ID NO: 2427310 - RNA, 15 nt, Bordetella pertussis
gaccgccucgaucgc

SEQ ID NO: 2427311 - RNA, 17 nt, Bordetella pertussis
gaccgcgaaccggugcu

SEQ ID NO: 2427312 - RNA, 19 nt, Bordetella pertussis
gaccgcgaaccggugcugg

SEQ ID NO: 2427313 - RNA, 22 nt, Bordetella pertussis
gaccgcgaaccggugcuggugc

SEQ ID NO: 2427314 - RNA, 13 nt, Bordetella pertussis
gaccgcgaagccg

SEQ ID NO: 2427315 - RNA, 16 nt, Bordetella pertussis
gaccgcgaagcgcgcc

SEQ ID NO: 2427316 - RNA, 17 nt, Bordetella pertussis
gaccgcgaagcgcgcca

SEQ ID NO: 2427317 - RNA, 20 nt, Bordetella pertussis
gaccgcgaagcgcgccagca

SEQ ID NO: 2427318 - RNA, 14 nt, Bordetella pertussis
gaccgcgacccgau

SEQ ID NO: 2427319 - RNA, 15 nt, Bordetella pertussis
gaccgcgacgcgccu

SEQ ID NO: 2427320 - RNA, 19 nt, Bordetella pertussis
gaccgcgccugggggcugg

SEQ ID NO: 2427321 - RNA, 22 nt, Bordetella pertussis
gaccgcgccugggggcuggagg

SEQ ID NO: 2427322 - RNA, 14 nt, Bordetella pertussis
gaccgcgcgcgacg

SEQ ID NO: 2427323 - RNA, 12 nt, Bordetella pertussis
gaccgcgcggcg

SEQ ID NO: 2427324 - RNA, 21 nt, Bordetella pertussis
gaccgcgcgguggccgccgcg

SEQ ID NO: 2427325 - RNA, 18 nt, Bordetella pertussis
gaccgcggacgccauggc

SEQ ID NO: 2427326 - RNA, 20 nt, Bordetella pertussis
gaccgcggacgccauggcgg

SEQ ID NO: 2427327 - RNA, 14 nt, Bordetella pertussis
gaccgcggccgcgc

SEQ ID NO: 2427328 - RNA, 16 nt, Bordetella pertussis
gaccgcggccgcgcug

SEQ ID NO: 2427329 - RNA, 18 nt, Bordetella pertussis
gaccgcggccgcgcuggc

SEQ ID NO: 2427330 - RNA, 22 nt, Bordetella pertussis
gaccgcggcgaucucgucgacc

SEQ ID NO: 2427331 - RNA, 21 nt, Bordetella pertussis
gaccgcgggcgcgcgccccgc

SEQ ID NO: 2427332 - RNA, 22 nt, Bordetella pertussis
gaccgcguaguugucggcgcag

SEQ ID NO: 2427333 - RNA, 20 nt, Bordetella pertussis
gaccgcguugaccggcuggc

SEQ ID NO: 2427334 - RNA, 18 nt, Bordetella pertussis
gaccgcuuccgagaaggc

SEQ ID NO: 2427335 - RNA, 17 nt, Bordetella pertussis
gaccgcuuccgccaccg

SEQ ID NO: 2427336 - RNA, 17 nt, Bordetella pertussis
gaccgcuucggucagcu

SEQ ID NO: 2427337 - RNA, 22 nt, Bordetella pertussis
gaccgcuucggucagcugcugu

SEQ ID NO: 2427338 - RNA, 16 nt, Bordetella pertussis
gaccggcaagcgcucg

SEQ ID NO: 2427339 - RNA, 23 nt, Bordetella pertussis
gaccggcaagcgcucgccggcgc

SEQ ID NO: 2427340 - RNA, 16 nt, Bordetella pertussis
gaccggcacccgcuac

SEQ ID NO: 2427341 - RNA, 21 nt, Bordetella pertussis
gaccggcacccgcuaccccgg

SEQ ID NO: 2427342 - RNA, 14 nt, Bordetella pertussis
gaccggcaccuggg

SEQ ID NO: 2427343 - RNA, 15 nt, Bordetella pertussis
gaccggcaccugggc

SEQ ID NO: 2427344 - RNA, 17 nt, Bordetella pertussis
gaccggcagggugccca

SEQ ID NO: 2427345 - RNA, 15 nt, Bordetella pertussis
gaccggccaggcgcg

SEQ ID NO: 2427346 - RNA, 12 nt, Bordetella pertussis
gaccggcgccgg

SEQ ID NO: 2427347 - RNA, 13 nt, Bordetella pertussis
gaccggcgccugc

SEQ ID NO: 2427348 - RNA, 19 nt, Bordetella pertussis
gaccggcgccugcggcaug

SEQ ID NO: 2427349 - RNA, 20 nt, Bordetella pertussis
gaccggcgcgaacaccggca

SEQ ID NO: 2427350 - RNA, 14 nt, Bordetella pertussis
gaccggcgcggccu

SEQ ID NO: 2427351 - RNA, 12 nt, Bordetella pertussis
gaccggcggcgc

SEQ ID NO: 2427352 - RNA, 17 nt, Bordetella pertussis
gaccggcgugacgcgcg

SEQ ID NO: 2427353 - RNA, 18 nt, Bordetella pertussis
gaccggcguguccagcgg

SEQ ID NO: 2427354 - RNA, 20 nt, Bordetella pertussis
gaccggcguguccagcggcg

SEQ ID NO: 2427355 - RNA, 23 nt, Bordetella pertussis
gaccggcguguccagcggcgcca

SEQ ID NO: 2427356 - RNA, 21 nt, Bordetella pertussis
gaccggcuauaccgggcuggu

SEQ ID NO: 2427357 - RNA, 17 nt, Bordetella pertussis
gaccggcuccggccgcu

SEQ ID NO: 2427358 - RNA, 19 nt, Bordetella pertussis
gaccggcucgaucgccgcc

SEQ ID NO: 2427359 - RNA, 20 nt, Bordetella pertussis
gaccggcucgaucgccgccg

SEQ ID NO: 2427360 - RNA, 21 nt, Bordetella pertussis
gaccggcucgaucgccgccgg

SEQ ID NO: 2427361 - RNA, 22 nt, Bordetella pertussis
gaccggcucgaucgccgccggc

SEQ ID NO: 2427362 - RNA, 14 nt, Bordetella pertussis
gaccggcuggcgca

SEQ ID NO: 2427363 - RNA, 15 nt, Bordetella pertussis
gaccggcuggcgcac

SEQ ID NO: 2427364 - RNA, 17 nt, Bordetella pertussis
gaccggcuggcgcacgu

SEQ ID NO: 2427365 - RNA, 19 nt, Bordetella pertussis
gaccggcuucccguggcug

SEQ ID NO: 2427366 - RNA, 17 nt, Bordetella pertussis
gaccgggaauggcgccg

SEQ ID NO: 2427367 - RNA, 18 nt, Bordetella pertussis
gaccgggaauggcgccgu

SEQ ID NO: 2427368 - RNA, 19 nt, Bordetella pertussis
gaccggggcguccaccgcc

SEQ ID NO: 2427369 - RNA, 21 nt, Bordetella pertussis
gaccggggcguccaccgccga

SEQ ID NO: 2427370 - RNA, 21 nt, Bordetella pertussis
gaccgggucgggcgucugccc

SEQ ID NO: 2427371 - RNA, 14 nt, Bordetella pertussis
gaccgggucgucgg

SEQ ID NO: 2427372 - RNA, 17 nt, Bordetella pertussis
gaccgggucgucgggcg

SEQ ID NO: 2427373 - RNA, 18 nt, Bordetella pertussis
gaccgggucgucgggcgg

SEQ ID NO: 2427374 - RNA, 16 nt, Bordetella pertussis
gacgaccccgccgugc

SEQ ID NO: 2427375 - RNA, 21 nt, Bordetella pertussis
gacgaccuugcccgucagcgg

SEQ ID NO: 2427376 - RNA, 22 nt, Bordetella pertussis
gacgacgaaacccgggccgucg

SEQ ID NO: 2427377 - RNA, 13 nt, Bordetella pertussis
gacgacgcagcgu

SEQ ID NO: 2427378 - RNA, 14 nt, Bordetella pertussis
gacgacgcagcgug

SEQ ID NO: 2427379 - RNA, 15 nt, Bordetella pertussis
gacgacggccggcgc

SEQ ID NO: 2427380 - RNA, 15 nt, Bordetella pertussis
gacgacuacgcgcug

SEQ ID NO: 2427381 - RNA, 18 nt, Bordetella pertussis
gacgacuacgcgcuggcg

SEQ ID NO: 2427382 - RNA, 19 nt, Bordetella pertussis
gacgacuacgcgcuggcgc

SEQ ID NO: 2427383 - RNA, 23 nt, Bordetella pertussis
gacgacuugaucagggccacggc

SEQ ID NO: 2427384 - RNA, 16 nt, Bordetella pertussis
gacgagaaugcgccgu

SEQ ID NO: 2427385 - RNA, 13 nt, Bordetella pertussis
gacgagacaggcg

SEQ ID NO: 2427386 - RNA, 15 nt, Bordetella pertussis
gacgagacaggcgcg

SEQ ID NO: 2427387 - RNA, 18 nt, Bordetella pertussis
gacgagacaggcgcgcca

SEQ ID NO: 2427388 - RNA, 18 nt, Bordetella pertussis
gacgagaguuucggcgac

SEQ ID NO: 2427389 - RNA, 13 nt, Bordetella pertussis
gacgagaucgcgc

SEQ ID NO: 2427390 - RNA, 18 nt, Bordetella pertussis
gacgagaucgcgccuacc

SEQ ID NO: 2427391 - RNA, 19 nt, Bordetella pertussis
gacgagaugccgaugaugg

SEQ ID NO: 2427392 - RNA, 15 nt, Bordetella pertussis
gacgagcgcaccaug

SEQ ID NO: 2427393 - RNA, 13 nt, Bordetella pertussis
gacgagcgcagca

SEQ ID NO: 2427394 - RNA, 13 nt, Bordetella pertussis
gacgaggcgcugu

SEQ ID NO: 2427395 - RNA, 14 nt, Bordetella pertussis
gacgagggccggcg

SEQ ID NO: 2427396 - RNA, 15 nt, Bordetella pertussis
gacgagggccggcgc

SEQ ID NO: 2427397 - RNA, 12 nt, Bordetella pertussis
gacgagggcgcc

SEQ ID NO: 2427398 - RNA, 14 nt, Bordetella pertussis
gacgagggcgccau

SEQ ID NO: 2427399 - RNA, 19 nt, Bordetella pertussis
gacgaguugcucggagccc

SEQ ID NO: 2427400 - RNA, 23 nt, Bordetella pertussis
gacgaguugcucggagcccagug

SEQ ID NO: 2427401 - RNA, 18 nt, Bordetella pertussis
gacgauauccaggcgcgu

SEQ ID NO: 2427402 - RNA, 19 nt, Bordetella pertussis
gacgauaucgcgaaagcgg

SEQ ID NO: 2427403 - RNA, 13 nt, Bordetella pertussis
gacgaucaggagg

SEQ ID NO: 2427404 - RNA, 22 nt, Bordetella pertussis
gacgaucaggcccuggggccgc

SEQ ID NO: 2427405 - RNA, 16 nt, Bordetella pertussis
gacgaucauccaggcc

SEQ ID NO: 2427406 - RNA, 19 nt, Bordetella pertussis
gacgaucccggccacggga

SEQ ID NO: 2427407 - RNA, 15 nt, Bordetella pertussis
gacgaucggccugaa

SEQ ID NO: 2427408 - RNA, 22 nt, Bordetella pertussis
gacgaucggccugaaccaggcc

SEQ ID NO: 2427409 - RNA, 14 nt, Bordetella pertussis
gacgaucucgcccu

SEQ ID NO: 2427410 - RNA, 23 nt, Bordetella pertussis
gacgaugagcugguccaccaccu

SEQ ID NO: 2427411 - RNA, 13 nt, Bordetella pertussis
gacgaugcccagg

SEQ ID NO: 2427412 - RNA, 17 nt, Bordetella pertussis
gacgaugcccaggucgu

SEQ ID NO: 2427413 - RNA, 17 nt, Bordetella pertussis
gacgaugcccugcgcca

SEQ ID NO: 2427414 - RNA, 21 nt, Bordetella pertussis
gacgaugcccugcgccagcgc

SEQ ID NO: 2427415 - RNA, 22 nt, Bordetella pertussis
gacgaugcccugcgccagcgcc

SEQ ID NO: 2427416 - RNA, 11 nt, Bordetella pertussis
gacgaugccgc

SEQ ID NO: 2427417 - RNA, 15 nt, Bordetella pertussis
gacgaugccgcccac

SEQ ID NO: 2427418 - RNA, 16 nt, Bordetella pertussis
gacgaugccgcccacg

SEQ ID NO: 2427419 - RNA, 18 nt, Bordetella pertussis
gacgaugccgcccacgcc

SEQ ID NO: 2427420 - RNA, 17 nt, Bordetella pertussis
gacgaugcgcgaagcgc

SEQ ID NO: 2427421 - RNA, 14 nt, Bordetella pertussis
gacgauggccggau

SEQ ID NO: 2427422 - RNA, 18 nt, Bordetella pertussis
gacgauggccugugcggc

SEQ ID NO: 2427423 - RNA, 11 nt, Bordetella pertussis
gacgauggcgg

SEQ ID NO: 2427424 - RNA, 19 nt, Bordetella pertussis
gacgauggcgggguuggcc

SEQ ID NO: 2427425 - RNA, 22 nt, Bordetella pertussis
gacgauggucuugccgccgugc

SEQ ID NO: 2427426 - RNA, 14 nt, Bordetella pertussis
gacgauggugccgg

SEQ ID NO: 2427427 - RNA, 16 nt, Bordetella pertussis
gacgauggugccggcc

SEQ ID NO: 2427428 - RNA, 19 nt, Bordetella pertussis
gacgauggugccggccguc

SEQ ID NO: 2427429 - RNA, 20 nt, Bordetella pertussis
gacgauggugcgcaggggcu

SEQ ID NO: 2427430 - RNA, 21 nt, Bordetella pertussis
gacgauggugcgcaggggcuc

SEQ ID NO: 2427431 - RNA, 20 nt, Bordetella pertussis
gacgauguagaucuggcgcg

SEQ ID NO: 2427432 - RNA, 17 nt, Bordetella pertussis
gacgaugucgccgccgc

SEQ ID NO: 2427433 - RNA, 17 nt, Bordetella pertussis
gacgauguucaggccau

SEQ ID NO: 2427434 - RNA, 23 nt, Bordetella pertussis
gacgcaaaaacgcccggcgcggu

SEQ ID NO: 2427435 - RNA, 14 nt, Bordetella pertussis
gacgcaaccggucg

SEQ ID NO: 2427436 - RNA, 18 nt, Bordetella pertussis
gacgcaaccggucggccg

SEQ ID NO: 2427437 - RNA, 16 nt, Bordetella pertussis
gacgcaaucggcgaag

SEQ ID NO: 2427438 - RNA, 19 nt, Bordetella pertussis
gacgcaccuuucugcugcu

SEQ ID NO: 2427439 - RNA, 20 nt, Bordetella pertussis
gacgcaccuuucugcugcuc

SEQ ID NO: 2427440 - RNA, 14 nt, Bordetella pertussis
gacgcagaccacgc

SEQ ID NO: 2427441 - RNA, 19 nt, Bordetella pertussis
gacgcagaccacgccggcg

SEQ ID NO: 2427442 - RNA, 22 nt, Bordetella pertussis
gacgcagaccacgccggcgguc

SEQ ID NO: 2427443 - RNA, 22 nt, Bordetella pertussis
gacgcagcacggcuugcgcgcc

SEQ ID NO: 2427444 - RNA, 14 nt, Bordetella pertussis
gacgcagcagccgc

SEQ ID NO: 2427445 - RNA, 14 nt, Bordetella pertussis
gacgcagccgcccg

SEQ ID NO: 2427446 - RNA, 14 nt, Bordetella pertussis
gacgcagcgcaccg

SEQ ID NO: 2427447 - RNA, 16 nt, Bordetella pertussis
gacgcagcgugcgacg

SEQ ID NO: 2427448 - RNA, 17 nt, Bordetella pertussis
gacgcaggagucggagg

SEQ ID NO: 2427449 - RNA, 13 nt, Bordetella pertussis
gacgcaggcccag

SEQ ID NO: 2427450 - RNA, 16 nt, Bordetella pertussis
gacgcaggcccagcca

SEQ ID NO: 2427451 - RNA, 17 nt, Bordetella pertussis
gacgcaggcccagccag

SEQ ID NO: 2427452 - RNA, 19 nt, Bordetella pertussis
gacgcaggcccagccagcc

SEQ ID NO: 2427453 - RNA, 12 nt, Bordetella pertussis
gacgcaggcgcc

SEQ ID NO: 2427454 - RNA, 13 nt, Bordetella pertussis
gacgcaggcgccg

SEQ ID NO: 2427455 - RNA, 17 nt, Bordetella pertussis
gacgcaggcgccgcacc

SEQ ID NO: 2427456 - RNA, 20 nt, Bordetella pertussis
gacgcauauccaggcggcgc

SEQ ID NO: 2427457 - RNA, 17 nt, Bordetella pertussis
gacgcaugucagcgccu

SEQ ID NO: 2427458 - RNA, 18 nt, Bordetella pertussis
gacgcaugucagcgccug

SEQ ID NO: 2427459 - RNA, 20 nt, Bordetella pertussis
gacgcaugucagcgccuggc

SEQ ID NO: 2427460 - RNA, 18 nt, Bordetella pertussis
gacgccaagaccgcggcc

SEQ ID NO: 2427461 - RNA, 19 nt, Bordetella pertussis
gacgccaagaccgcggccg

SEQ ID NO: 2427462 - RNA, 20 nt, Bordetella pertussis
gacgccaagaccgcggccgc

SEQ ID NO: 2427463 - RNA, 22 nt, Bordetella pertussis
gacgccaagaccgcggccgcgc

SEQ ID NO: 2427464 - RNA, 17 nt, Bordetella pertussis
gacgccaccagugcgcc

SEQ ID NO: 2427465 - RNA, 20 nt, Bordetella pertussis
gacgccaccagugcgccggc

SEQ ID NO: 2427466 - RNA, 15 nt, Bordetella pertussis
gacgccagcccgccg

SEQ ID NO: 2427467 - RNA, 17 nt, Bordetella pertussis
gacgccagcgcgccaug

SEQ ID NO: 2427468 - RNA, 20 nt, Bordetella pertussis
gacgccagcgcgccauggcc

SEQ ID NO: 2427469 - RNA, 20 nt, Bordetella pertussis
gacgccaucuugcaggcgcc

SEQ ID NO: 2427470 - RNA, 22 nt, Bordetella pertussis
gacgccaucuugcaggcgccag

SEQ ID NO: 2427471 - RNA, 19 nt, Bordetella pertussis
gacgccauggcggcggcca

SEQ ID NO: 2427472 - RNA, 21 nt, Bordetella pertussis
gacgccauggcggcggccacg

SEQ ID NO: 2427473 - RNA, 16 nt, Bordetella pertussis
gacgcccagccugccg

SEQ ID NO: 2427474 - RNA, 17 nt, Bordetella pertussis
gacgcccagccugccgg

SEQ ID NO: 2427475 - RNA, 18 nt, Bordetella pertussis
gacgcccagccugccggc

SEQ ID NO: 2427476 - RNA, 21 nt, Bordetella pertussis
gacgcccagccugccggcggc

SEQ ID NO: 2427477 - RNA, 12 nt, Bordetella pertussis
gacgcccaggcc

SEQ ID NO: 2427478 - RNA, 17 nt, Bordetella pertussis
gacgcccaggcccaccg

SEQ ID NO: 2427479 - RNA, 15 nt, Bordetella pertussis
gacgcccagguccga

SEQ ID NO: 2427480 - RNA, 16 nt, Bordetella pertussis
gacgcccgcgcccagu

SEQ ID NO: 2427481 - RNA, 14 nt, Bordetella pertussis
gacgcccgggcggc

SEQ ID NO: 2427482 - RNA, 20 nt, Bordetella pertussis
gacgcccugaacuauggcgc

SEQ ID NO: 2427483 - RNA, 17 nt, Bordetella pertussis
gacgcccugccauucgg

SEQ ID NO: 2427484 - RNA, 13 nt, Bordetella pertussis
gacgcccuggccu

SEQ ID NO: 2427485 - RNA, 13 nt, Bordetella pertussis
gacgcccuggcgc

SEQ ID NO: 2427486 - RNA, 14 nt, Bordetella pertussis
gacgcccuggcgca

SEQ ID NO: 2427487 - RNA, 17 nt, Bordetella pertussis
gacgcugauggccgcca

SEQ ID NO: 2427488 - RNA, 14 nt, Bordetella pertussis
gacgcuggagaugg

SEQ ID NO: 2427489 - RNA, 19 nt, Bordetella pertussis
gacgcuggagauggcgccg

SEQ ID NO: 2427490 - RNA, 17 nt, Bordetella pertussis
gacgcuggagcgcggcg

SEQ ID NO: 2427491 - RNA, 19 nt, Bordetella pertussis
gacgcuggagcgcggcggc

SEQ ID NO: 2427492 - RNA, 23 nt, Bordetella pertussis
gacgcuguagaggcgcggcucgc

SEQ ID NO: 2427493 - RNA, 16 nt, Bordetella pertussis
gacgcugucgcgcccg

SEQ ID NO: 2427494 - RNA, 19 nt, Bordetella pertussis
gacgcuuucggggcgcaag

SEQ ID NO: 2427495 - RNA, 14 nt, Bordetella pertussis
gacggacuggcugg

SEQ ID NO: 2427496 - RNA, 15 nt, Bordetella pertussis
gacggacuggcuggu

SEQ ID NO: 2427497 - RNA, 14 nt, Bordetella pertussis
gacggacuggugca

SEQ ID NO: 2427498 - RNA, 19 nt, Bordetella pertussis
gacggacuggugcaacucc

SEQ ID NO: 2427499 - RNA, 16 nt, Bordetella pertussis
gacggauacaccaggu

SEQ ID NO: 2427500 - RNA, 22 nt, Bordetella pertussis
gacggaugccgucuuggcgggc

SEQ ID NO: 2427501 - RNA, 23 nt, Bordetella pertussis
gacggauucccagcuccacgcac

SEQ ID NO: 2427502 - RNA, 22 nt, Bordetella pertussis
gacggauucgcccagggucgga

SEQ ID NO: 2427503 - RNA, 17 nt, Bordetella pertussis
gacggcaagaucgccgg

SEQ ID NO: 2427504 - RNA, 21 nt, Bordetella pertussis
gacggcaaugccugcgcgaug

SEQ ID NO: 2427505 - RNA, 13 nt, Bordetella pertussis
gacggcagaugga

SEQ ID NO: 2427506 - RNA, 13 nt, Bordetella pertussis
gacggcagcaccg

SEQ ID NO: 2427507 - RNA, 14 nt, Bordetella pertussis
gacggcagcaccgc

SEQ ID NO: 2427508 - RNA, 16 nt, Bordetella pertussis
gacggcagcaccgcca

SEQ ID NO: 2427509 - RNA, 22 nt, Bordetella pertussis
gacggcagccccgggugcaggu

SEQ ID NO: 2427510 - RNA, 23 nt, Bordetella pertussis
gacggcaucgauuucucgcugcu

SEQ ID NO: 2427511 - RNA, 18 nt, Bordetella pertussis
gacggcauggcggccagc

SEQ ID NO: 2427512 - RNA, 19 nt, Bordetella pertussis
gacggcauggcggccagcu

SEQ ID NO: 2427513 - RNA, 20 nt, Bordetella pertussis
gacggccagcaggagcccgc

SEQ ID NO: 2427514 - RNA, 13 nt, Bordetella pertussis
gacggccagcgcg

SEQ ID NO: 2427515 - RNA, 16 nt, Bordetella pertussis
gacggccagcgcgacg

SEQ ID NO: 2427516 - RNA, 23 nt, Bordetella pertussis
gacggccagcgcgacgggcaccg

SEQ ID NO: 2427517 - RNA, 14 nt, Bordetella pertussis
gacggccagcgcgc

SEQ ID NO: 2427518 - RNA, 17 nt, Bordetella pertussis
gacggccagcgcgcgug

SEQ ID NO: 2427519 - RNA, 14 nt, Bordetella pertussis
gacggccaggacgg

SEQ ID NO: 2427520 - RNA, 16 nt, Bordetella pertussis
gacggccaggacggca

SEQ ID NO: 2427521 - RNA, 16 nt, Bordetella pertussis
gacggccaggggcagc

SEQ ID NO: 2427522 - RNA, 16 nt, Bordetella pertussis
gacggccauccggcca

SEQ ID NO: 2427523 - RNA, 18 nt, Bordetella pertussis
gacggccauccggccacg

SEQ ID NO: 2427524 - RNA, 22 nt, Bordetella pertussis
gacggccauucagaccggguug

SEQ ID NO: 2427525 - RNA, 19 nt, Bordetella pertussis
gacggccccagcgccgcga

SEQ ID NO: 2427526 - RNA, 23 nt, Bordetella pertussis
gacggccccagcgccgcgagcgc

SEQ ID NO: 2427527 - RNA, 20 nt, Bordetella pertussis
gacggccgcaagcuggccga

SEQ ID NO: 2427528 - RNA, 15 nt, Bordetella pertussis
gacggccgccacgcc

SEQ ID NO: 2427529 - RNA, 14 nt, Bordetella pertussis
gacggccgccgacg

SEQ ID NO: 2427530 - RNA, 18 nt, Bordetella pertussis
gacggccgccgacgccgc

SEQ ID NO: 2427531 - RNA, 19 nt, Bordetella pertussis
gacggccgccgacgccgcc

SEQ ID NO: 2427532 - RNA, 21 nt, Bordetella pertussis
gacggccgccgacgccgccac

SEQ ID NO: 2427533 - RNA, 16 nt, Bordetella pertussis
gacggccggcgcgugc

SEQ ID NO: 2427534 - RNA, 20 nt, Bordetella pertussis
gacggccggcgcgugcuggc

SEQ ID NO: 2427535 - RNA, 18 nt, Bordetella pertussis
gacggccucccgccgccc

SEQ ID NO: 2427536 - RNA, 16 nt, Bordetella pertussis
gacggccuccgcgccg

SEQ ID NO: 2427537 - RNA, 15 nt, Bordetella pertussis
gacggccucggccag

SEQ ID NO: 2427538 - RNA, 22 nt, Bordetella pertussis
gacggccucguccucgucggcg

SEQ ID NO: 2427539 - RNA, 18 nt, Bordetella pertussis
gacggccugccaccgaca

SEQ ID NO: 2427540 - RNA, 19 nt, Bordetella pertussis
gacggcgcacccgcggcgc

SEQ ID NO: 2427541 - RNA, 19 nt, Bordetella pertussis
gacggcgcccugcagggca

SEQ ID NO: 2427542 - RNA, 15 nt, Bordetella pertussis
gacggcgccgauccg

SEQ ID NO: 2427543 - RNA, 16 nt, Bordetella pertussis
gacggcgccgauccgg

SEQ ID NO: 2427544 - RNA, 14 nt, Bordetella pertussis
gacggcgccguccg

SEQ ID NO: 2427545 - RNA, 20 nt, Bordetella pertussis
gacggcgccguccgcaucgc

SEQ ID NO: 2427546 - RNA, 19 nt, Bordetella pertussis
gacggcgccgugcuggagg

SEQ ID NO: 2427547 - RNA, 18 nt, Bordetella pertussis
gacggcgccuggcgcaug

SEQ ID NO: 2427548 - RNA, 20 nt, Bordetella pertussis
gacggcgccuugacgcugcu

SEQ ID NO: 2427549 - RNA, 18 nt, Bordetella pertussis
gacggcgcggaucgugcg

SEQ ID NO: 2427550 - RNA, 20 nt, Bordetella pertussis
gacggcgcggaucgugcgcc

SEQ ID NO: 2427551 - RNA, 22 nt, Bordetella pertussis
gacggcgcggaucgugcgccac

SEQ ID NO: 2427552 - RNA, 16 nt, Bordetella pertussis
gacggcgcggcgaucg

SEQ ID NO: 2427553 - RNA, 21 nt, Bordetella pertussis
gacggcgcggcgaucggcccg

SEQ ID NO: 2427554 - RNA, 13 nt, Bordetella pertussis
gacggcgcgggca

SEQ ID NO: 2427555 - RNA, 21 nt, Bordetella pertussis
gacggcgcucuugguggugcc

SEQ ID NO: 2427556 - RNA, 14 nt, Bordetella pertussis
gacggcgcuggcga

SEQ ID NO: 2427557 - RNA, 19 nt, Bordetella pertussis
gacggcgcuggcgagcaug

SEQ ID NO: 2427558 - RNA, 20 nt, Bordetella pertussis
gacggcgcuggcgagcaugg

SEQ ID NO: 2427559 - RNA, 12 nt, Bordetella pertussis
gacggcgcuggg

SEQ ID NO: 2427560 - RNA, 20 nt, Bordetella pertussis
gacggcgcuggggaagcgcu

SEQ ID NO: 2427561 - RNA, 22 nt, Bordetella pertussis
gacggcgcuggggaagcgcucg

SEQ ID NO: 2427562 - RNA, 14 nt, Bordetella pertussis
gacggcggcgcgcg

SEQ ID NO: 2427563 - RNA, 21 nt, Bordetella pertussis
gacggcggcgcggcgccagcg

SEQ ID NO: 2427564 - RNA, 16 nt, Bordetella pertussis
gacggcggcuggacgc

SEQ ID NO: 2427565 - RNA, 18 nt, Bordetella pertussis
gacggcgggaccggcgau

SEQ ID NO: 2427566 - RNA, 22 nt, Bordetella pertussis
gacggcgggaccggcgauggcg

SEQ ID NO: 2427567 - RNA, 14 nt, Bordetella pertussis
gacggcgggcgccc

SEQ ID NO: 2427568 - RNA, 16 nt, Bordetella pertussis
gacggcgggcgccccg

SEQ ID NO: 2427569 - RNA, 24 nt, Bordetella pertussis
gacggcgggcgccccgaucggcgc

SEQ ID NO: 2427570 - RNA, 17 nt, Bordetella pertussis
gacggcguagccgaucu

SEQ ID NO: 2427571 - RNA, 22 nt, Bordetella pertussis
gacggcguagccgaucuggccc

SEQ ID NO: 2427572 - RNA, 23 nt, Bordetella pertussis
gacggcguagccgaucuggcccu

SEQ ID NO: 2427573 - RNA, 15 nt, Bordetella pertussis
gacggcgucgggcag

SEQ ID NO: 2427574 - RNA, 16 nt, Bordetella pertussis
gacggcgucgggcagc

SEQ ID NO: 2427575 - RNA, 20 nt, Bordetella pertussis
gacggcgugcugcgcguggc

SEQ ID NO: 2427576 - RNA, 17 nt, Bordetella pertussis
gacggcuacacccugcu

SEQ ID NO: 2427577 - RNA, 19 nt, Bordetella pertussis
gacggcucgcgcucgcccg

SEQ ID NO: 2427578 - RNA, 21 nt, Bordetella pertussis
gacggcuggagauacuggccg

SEQ ID NO: 2427579 - RNA, 22 nt, Bordetella pertussis
gacggcuggagauacuggccga

SEQ ID NO: 2427580 - RNA, 16 nt, Bordetella pertussis
gacggcuucgaccacg

SEQ ID NO: 2427581 - RNA, 17 nt, Bordetella pertussis
gacggcuucgaccacgc

SEQ ID NO: 2427582 - RNA, 18 nt, Bordetella pertussis
gacggcuugaccacggcc

SEQ ID NO: 2427583 - RNA, 20 nt, Bordetella pertussis
gacggcuugaccacggccag

SEQ ID NO: 2427584 - RNA, 14 nt, Bordetella pertussis
gacgggaauccgcu

SEQ ID NO: 2427585 - RNA, 18 nt, Bordetella pertussis
gacgggaauccgcugcgc

SEQ ID NO: 2427586 - RNA, 19 nt, Bordetella pertussis
gacgggaauccgcugcgcc

SEQ ID NO: 2427587 - RNA, 21 nt, Bordetella pertussis
gacgggaauccgcugcgccga

SEQ ID NO: 2427588 - RNA, 21 nt, Bordetella pertussis
gacgggcaccgacacgcuggc

SEQ ID NO: 2427589 - RNA, 12 nt, Bordetella pertussis
gacgggcaggcc

SEQ ID NO: 2427590 - RNA, 15 nt, Bordetella pertussis
gacgggcaggcccag

SEQ ID NO: 2427591 - RNA, 17 nt, Bordetella pertussis
gacgggcaggcccagcc

SEQ ID NO: 2427592 - RNA, 21 nt, Bordetella pertussis
gacgggcaggcccagccagcg

SEQ ID NO: 2427593 - RNA, 18 nt, Bordetella pertussis
gacgggccagccccggcg

SEQ ID NO: 2427594 - RNA, 22 nt, Bordetella pertussis
gacgggccagccccggcgcgcc

SEQ ID NO: 2427595 - RNA, 12 nt, Bordetella pertussis
gacgggccaggc

SEQ ID NO: 2427596 - RNA, 13 nt, Bordetella pertussis
gacgggccaggcc

SEQ ID NO: 2427597 - RNA, 15 nt, Bordetella pertussis
gacgggccaggccga

SEQ ID NO: 2427598 - RNA, 16 nt, Bordetella pertussis
gacgggccaggccgau

SEQ ID NO: 2427599 - RNA, 20 nt, Bordetella pertussis
gacuggacgaugagcugguc

SEQ ID NO: 2427600 - RNA, 18 nt, Bordetella pertussis
gacuggauauggcgccgc

SEQ ID NO: 2427601 - RNA, 14 nt, Bordetella pertussis
gacuggcaccggca

SEQ ID NO: 2427602 - RNA, 15 nt, Bordetella pertussis
gacuggcaccggcaa

SEQ ID NO: 2427603 - RNA, 14 nt, Bordetella pertussis
gacuggcaccggcc

SEQ ID NO: 2427604 - RNA, 17 nt, Bordetella pertussis
gacuggcaccggccgac

SEQ ID NO: 2427605 - RNA, 15 nt, Bordetella pertussis
gacuggcagugcgcg

SEQ ID NO: 2427606 - RNA, 19 nt, Bordetella pertussis
gacuggcccaggcgggcca

SEQ ID NO: 2427607 - RNA, 16 nt, Bordetella pertussis
gacuggccgcgccgcu

SEQ ID NO: 2427608 - RNA, 18 nt, Bordetella pertussis
gacuggccgcgccgcugg

SEQ ID NO: 2427609 - RNA, 21 nt, Bordetella pertussis
gacuggcgagcacccgcaggc

SEQ ID NO: 2427610 - RNA, 11 nt, Bordetella pertussis
gacuggcgcgc

SEQ ID NO: 2427611 - RNA, 13 nt, Bordetella pertussis
gacuggcucccac

SEQ ID NO: 2427612 - RNA, 17 nt, Bordetella pertussis
gacuggcucccgcugac

SEQ ID NO: 2427613 - RNA, 18 nt, Bordetella pertussis
gacuggcucccgcugacu

SEQ ID NO: 2427614 - RNA, 16 nt, Bordetella pertussis
gacuggcuggucaggc

SEQ ID NO: 2427615 - RNA, 18 nt, Bordetella pertussis
gacugggcgucgcucugc

SEQ ID NO: 2427616 - RNA, 22 nt, Bordetella pertussis
gacugggcuugccggugcucgg

SEQ ID NO: 2427617 - RNA, 14 nt, Bordetella pertussis
gacugggugcgccu

SEQ ID NO: 2427618 - RNA, 20 nt, Bordetella pertussis
gacuggugcaacuccacgcc

SEQ ID NO: 2427619 - RNA, 22 nt, Bordetella pertussis
gacuggugcaacuccacgcccu

SEQ ID NO: 2427620 - RNA, 21 nt, Bordetella pertussis
gacuguccggcaacaccaacc

SEQ ID NO: 2427621 - RNA, 20 nt, Bordetella pertussis
gacuuagaaguccaugccgc

SEQ ID NO: 2427622 - RNA, 19 nt, Bordetella pertussis
gacuucaccgaggcgcugc

SEQ ID NO: 2427623 - RNA, 21 nt, Bordetella pertussis
gacuucaccgaggcgcugccc

SEQ ID NO: 2427624 - RNA, 20 nt, Bordetella pertussis
gacuucaccgugaugggcgc

SEQ ID NO: 2427625 - RNA, 19 nt, Bordetella pertussis
gacuucagguagguggaca

SEQ ID NO: 2427626 - RNA, 20 nt, Bordetella pertussis
gacuuccucgacccgcgccu

SEQ ID NO: 2427627 - RNA, 14 nt, Bordetella pertussis
gacuucgacggcag

SEQ ID NO: 2427628 - RNA, 12 nt, Bordetella pertussis
gacuucgcccgg

SEQ ID NO: 2427629 - RNA, 16 nt, Bordetella pertussis
gacuucgccgaucgag

SEQ ID NO: 2427630 - RNA, 19 nt, Bordetella pertussis
gacuucggccgccagccgg

SEQ ID NO: 2427631 - RNA, 13 nt, Bordetella pertussis
gacuucggcggcc

SEQ ID NO: 2427632 - RNA, 15 nt, Bordetella pertussis
gacuucggcggccau

SEQ ID NO: 2427633 - RNA, 20 nt, Bordetella pertussis
gacuucggcggccaugccga

SEQ ID NO: 2427634 - RNA, 21 nt, Bordetella pertussis
gacuucggucagcuugccgcc

SEQ ID NO: 2427635 - RNA, 14 nt, Bordetella pertussis
gacuucguccggcg

SEQ ID NO: 2427636 - RNA, 20 nt, Bordetella pertussis
gacuucgucgaucauggcgc

SEQ ID NO: 2427637 - RNA, 17 nt, Bordetella pertussis
gacuucguguucgcggc

SEQ ID NO: 2427638 - RNA, 19 nt, Bordetella pertussis
gacuucguguucgcggccg

SEQ ID NO: 2427639 - RNA, 20 nt, Bordetella pertussis
gacuucguguucgcggccgg

SEQ ID NO: 2427640 - RNA, 18 nt, Bordetella pertussis
gacuugcggcacgugccg

SEQ ID NO: 2427641 - RNA, 18 nt, Bordetella pertussis
gacuugggcaggccuucg

SEQ ID NO: 2427642 - RNA, 20 nt, Bordetella pertussis
gagaaaccgauggugccggg

SEQ ID NO: 2427643 - RNA, 18 nt, Bordetella pertussis
gagaaagaagcccccgcg

SEQ ID NO: 2427644 - RNA, 13 nt, Bordetella pertussis
gagaaaggccgcc

SEQ ID NO: 2427645 - RNA, 16 nt, Bordetella pertussis
gagaacgcggccgcga

SEQ ID NO: 2427646 - RNA, 22 nt, Bordetella pertussis
gagaagauuucccagagcuggg

SEQ ID NO: 2427647 - RNA, 13 nt, Bordetella pertussis
gagaagcgccgcg

SEQ ID NO: 2427648 - RNA, 19 nt, Bordetella pertussis
gagaaggagcgagcgauga

SEQ ID NO: 2427649 - RNA, 24 nt, Bordetella pertussis
gagaaggcgguguagaccaccagc

SEQ ID NO: 2427650 - RNA, 22 nt, Bordetella pertussis
gagaagggcuugaccagggcgg

SEQ ID NO: 2427651 - RNA, 14 nt, Bordetella pertussis
gagaagucaucgau

SEQ ID NO: 2427652 - RNA, 21 nt, Bordetella pertussis
gagaaugcccaggaugcccuu

SEQ ID NO: 2427653 - RNA, 13 nt, Bordetella pertussis
gagaauggcgcga

SEQ ID NO: 2427654 - RNA, 14 nt, Bordetella pertussis
gagacaggcgcgcc

SEQ ID NO: 2427655 - RNA, 16 nt, Bordetella pertussis
gagacaggcgcgccau

SEQ ID NO: 2427656 - RNA, 12 nt, Bordetella pertussis
gagacaucaugc

SEQ ID NO: 2427657 - RNA, 18 nt, Bordetella pertussis
gagaccacgauggccggc

SEQ ID NO: 2427658 - RNA, 19 nt, Bordetella pertussis
gagaccacgauggccggcg

SEQ ID NO: 2427659 - RNA, 12 nt, Bordetella pertussis
gagaccagcagc

SEQ ID NO: 2427660 - RNA, 12 nt, Bordetella pertussis
gagaccgcccgc

SEQ ID NO: 2427661 - RNA, 15 nt, Bordetella pertussis
gagaccgcccgcugc

SEQ ID NO: 2427662 - RNA, 12 nt, Bordetella pertussis
gagaccggcaug

SEQ ID NO: 2427663 - RNA, 18 nt, Bordetella pertussis
gagaccggcgccugcggc

SEQ ID NO: 2427664 - RNA, 19 nt, Bordetella pertussis
gagaccggguugcccggca

SEQ ID NO: 2427665 - RNA, 23 nt, Bordetella pertussis
gagacgaaggcgccggccaggcc

SEQ ID NO: 2427666 - RNA, 19 nt, Bordetella pertussis
gagacgcugucgcgcccgg

SEQ ID NO: 2427667 - RNA, 21 nt, Bordetella pertussis
gagacggaugcuugcggggca

SEQ ID NO: 2427668 - RNA, 14 nt, Bordetella pertussis
gagacggccgccga

SEQ ID NO: 2427669 - RNA, 19 nt, Bordetella pertussis
gagacggucaccgcgccca

SEQ ID NO: 2427670 - RNA, 14 nt, Bordetella pertussis
gagacguagccgcu

SEQ ID NO: 2427671 - RNA, 16 nt, Bordetella pertussis
gagacguagccgcugc

SEQ ID NO: 2427672 - RNA, 14 nt, Bordetella pertussis
gagacgucuucgua

SEQ ID NO: 2427673 - RNA, 19 nt, Bordetella pertussis
gagagccugggcgcgcgcc

SEQ ID NO: 2427674 - RNA, 22 nt, Bordetella pertussis
gagaggcugaaggggcuccccu

SEQ ID NO: 2427675 - RNA, 18 nt, Bordetella pertussis
gagaguucauccacagcc

SEQ ID NO: 2427676 - RNA, 19 nt, Bordetella pertussis
gagaguucggugucggcgu

SEQ ID NO: 2427677 - RNA, 16 nt, Bordetella pertussis
gagaucaugaccacgu

SEQ ID NO: 2427678 - RNA, 14 nt, Bordetella pertussis
gagaucgccgccga

SEQ ID NO: 2427679 - RNA, 18 nt, Bordetella pertussis
gagaugccagcggcgcag

SEQ ID NO: 2427680 - RNA, 21 nt, Bordetella pertussis
gagauggccuuuuccaggcgu

SEQ ID NO: 2427681 - RNA, 16 nt, Bordetella pertussis
gagauggcgcaggcgc

SEQ ID NO: 2427682 - RNA, 18 nt, Bordetella pertussis
gagauggcgcaggcgcgc

SEQ ID NO: 2427683 - RNA, 15 nt, Bordetella pertussis
gagauggcgugcacg

SEQ ID NO: 2427684 - RNA, 14 nt, Bordetella pertussis
gagauggguacagc

SEQ ID NO: 2427685 - RNA, 16 nt, Bordetella pertussis
gagauggguacagcgc

SEQ ID NO: 2427686 - RNA, 19 nt, Bordetella pertussis
gagauggguacagcgcgcc

SEQ ID NO: 2427687 - RNA, 19 nt, Bordetella pertussis
gagauguccauggccugca

SEQ ID NO: 2427688 - RNA, 23 nt, Bordetella pertussis
gagaugugcggcguggcggggcg

SEQ ID NO: 2427689 - RNA, 14 nt, Bordetella pertussis
gagauuguccagcg

SEQ ID NO: 2427690 - RNA, 13 nt, Bordetella pertussis
gagauugugcagc

SEQ ID NO: 2427691 - RNA, 14 nt, Bordetella pertussis
gagcaagcgcugga

SEQ ID NO: 2427692 - RNA, 15 nt, Bordetella pertussis
gagcaagggccagac

SEQ ID NO: 2427693 - RNA, 17 nt, Bordetella pertussis
gagcaaucaagggccuu

SEQ ID NO: 2427694 - RNA, 22 nt, Bordetella pertussis
gagcaauugccggaucagcgcc

SEQ ID NO: 2427695 - RNA, 13 nt, Bordetella pertussis
gagcaccacggcg

SEQ ID NO: 2427696 - RNA, 15 nt, Bordetella pertussis
gagcaccacggcgcg

SEQ ID NO: 2427697 - RNA, 22 nt, Bordetella pertussis
gagcaccacguccuggggcgcg

SEQ ID NO: 2427698 - RNA, 14 nt, Bordetella pertussis
gagcacccgcaggc

SEQ ID NO: 2427699 - RNA, 15 nt, Bordetella pertussis
gagcacccgcaggcg

SEQ ID NO: 2427700 - RNA, 16 nt, Bordetella pertussis
gagcacccgcaggcgg

SEQ ID NO: 2427701 - RNA, 17 nt, Bordetella pertussis
gagcaccgagaccgggc

SEQ ID NO: 2427702 - RNA, 14 nt, Bordetella pertussis
gagcacgcggcgcg

SEQ ID NO: 2427703 - RNA, 15 nt, Bordetella pertussis
gagcacggcgcggcu

SEQ ID NO: 2427704 - RNA, 19 nt, Bordetella pertussis
gagcacggcguggcgcgca

SEQ ID NO: 2427705 - RNA, 20 nt, Bordetella pertussis
gagcacggcguggcgcgcac

SEQ ID NO: 2427706 - RNA, 21 nt, Bordetella pertussis
gagcacggcguggcgcgcaca

SEQ ID NO: 2427707 - RNA, 22 nt, Bordetella pertussis
gagcacggcguggcgcgcacac

SEQ ID NO: 2427708 - RNA, 20 nt, Bordetella pertussis
gagcacgguuucgccgugcu

SEQ ID NO: 2427709 - RNA, 17 nt, Bordetella pertussis
gagcacguccagcggcg

SEQ ID NO: 2427710 - RNA, 16 nt, Bordetella pertussis
gagcagaugcgacugg

SEQ ID NO: 2427711 - RNA, 21 nt, Bordetella pertussis
gagcagaugcgacuggcggcu

SEQ ID NO: 2427712 - RNA, 15 nt, Bordetella pertussis
gagcgccacgccagc

SEQ ID NO: 2427713 - RNA, 20 nt, Bordetella pertussis
gagcgccacgccagcggcga

SEQ ID NO: 2427714 - RNA, 21 nt, Bordetella pertussis
gagcgccacgccagcggcgag

SEQ ID NO: 2427715 - RNA, 13 nt, Bordetella pertussis
gagcgccacgccg

SEQ ID NO: 2427716 - RNA, 13 nt, Bordetella pertussis
gagcgccagggcc

SEQ ID NO: 2427717 - RNA, 14 nt, Bordetella pertussis
gagcgccagggccu

SEQ ID NO: 2427718 - RNA, 16 nt, Bordetella pertussis
gagcgccagggccucc

SEQ ID NO: 2427719 - RNA, 20 nt, Bordetella pertussis
gagcgccgacgggccgguca

SEQ ID NO: 2427720 - RNA, 15 nt, Bordetella pertussis
gagcgccgccaggcc

SEQ ID NO: 2427721 - RNA, 17 nt, Bordetella pertussis
gagcgccgccaggccgu

SEQ ID NO: 2427722 - RNA, 14 nt, Bordetella pertussis
gagcgccgcgcucc

SEQ ID NO: 2427723 - RNA, 15 nt, Bordetella pertussis
gagcgccgcgcucca

SEQ ID NO: 2427724 - RNA, 17 nt, Bordetella pertussis
gagcgccggggcguggc

SEQ ID NO: 2427725 - RNA, 14 nt, Bordetella pertussis
gagcgccugggcgg

SEQ ID NO: 2427726 - RNA, 19 nt, Bordetella pertussis
gagcgcgaaauccagcgcg

SEQ ID NO: 2427727 - RNA, 21 nt, Bordetella pertussis
gagcgcgaaauccagcgcgcc

SEQ ID NO: 2427728 - RNA, 16 nt, Bordetella pertussis
gagcgcgacagcacca

SEQ ID NO: 2427729 - RNA, 13 nt, Bordetella pertussis
gagcgcgccagca

SEQ ID NO: 2427730 - RNA, 14 nt, Bordetella pertussis
gagcgcgccagcac

SEQ ID NO: 2427731 - RNA, 16 nt, Bordetella pertussis
gagcgcgccagcacgg

SEQ ID NO: 2427732 - RNA, 13 nt, Bordetella pertussis
gagcgcgccgccg

SEQ ID NO: 2427733 - RNA, 22 nt, Bordetella pertussis
gagcgcgccgccguaggacagc

SEQ ID NO: 2427734 - RNA, 20 nt, Bordetella pertussis
gagcgcggcauagcccaggc

SEQ ID NO: 2427735 - RNA, 18 nt, Bordetella pertussis
gagcgcggcaugcgcaug

SEQ ID NO: 2427736 - RNA, 23 nt, Bordetella pertussis
gagcgcggcaugcgcaugcugga

SEQ ID NO: 2427737 - RNA, 14 nt, Bordetella pertussis
gagcgcggccaggc

SEQ ID NO: 2427738 - RNA, 15 nt, Bordetella pertussis
gagcgcggccaggcg

SEQ ID NO: 2427739 - RNA, 14 nt, Bordetella pertussis
gagcgcggccucgc

SEQ ID NO: 2427740 - RNA, 24 nt, Bordetella pertussis
gagcgcggccucgccggccuggcg

SEQ ID NO: 2427741 - RNA, 15 nt, Bordetella pertussis
gagcgcggcgcgcgc

SEQ ID NO: 2427742 - RNA, 15 nt, Bordetella pertussis
gagcgcggcgcuggc

SEQ ID NO: 2427743 - RNA, 17 nt, Bordetella pertussis
gagcgcggcgcuggcgu

SEQ ID NO: 2427744 - RNA, 12 nt, Bordetella pertussis
gagcgcggcggc

SEQ ID NO: 2427745 - RNA, 14 nt, Bordetella pertussis
gagcgcggcggcgu

SEQ ID NO: 2427746 - RNA, 13 nt, Bordetella pertussis
gagcgcggcgggu

SEQ ID NO: 2427747 - RNA, 15 nt, Bordetella pertussis
gagcgcgggccgccg

SEQ ID NO: 2427748 - RNA, 19 nt, Bordetella pertussis
gagcgcgggccgccgcaca

SEQ ID NO: 2427749 - RNA, 20 nt, Bordetella pertussis
gagcgcguggaaccgccgcu

SEQ ID NO: 2427750 - RNA, 14 nt, Bordetella pertussis
gagcggcagcagcg

SEQ ID NO: 2427751 - RNA, 21 nt, Bordetella pertussis
gagcggccagcaagcgcgcca

SEQ ID NO: 2427752 - RNA, 23 nt, Bordetella pertussis
gagcggccagcaagcgcgccaug

SEQ ID NO: 2427753 - RNA, 18 nt, Bordetella pertussis
gagcggccagccugccgc

SEQ ID NO: 2427754 - RNA, 12 nt, Bordetella pertussis
gagcggcccggg

SEQ ID NO: 2427755 - RNA, 14 nt, Bordetella pertussis
gagcggcccgggcg

SEQ ID NO: 2427756 - RNA, 13 nt, Bordetella pertussis
gagcggccuggcc

SEQ ID NO: 2427757 - RNA, 21 nt, Bordetella pertussis
gagcggccuggccccgcgcga

SEQ ID NO: 2427758 - RNA, 19 nt, Bordetella pertussis
gagcggcggcuucgcgcag

SEQ ID NO: 2427759 - RNA, 20 nt, Bordetella pertussis
gagcggcgugcgcgugcaug

SEQ ID NO: 2427760 - RNA, 17 nt, Bordetella pertussis
gagcggcguggcgccga

SEQ ID NO: 2427761 - RNA, 20 nt, Bordetella pertussis
gagcggcguggcgccgaccc

SEQ ID NO: 2427762 - RNA, 17 nt, Bordetella pertussis
gagcgggcaugggcccc

SEQ ID NO: 2427763 - RNA, 13 nt, Bordetella pertussis
gagcgggccagcg

SEQ ID NO: 2427764 - RNA, 22 nt, Bordetella pertussis
gagcgggccagcgcggccaggu

SEQ ID NO: 2427765 - RNA, 17 nt, Bordetella pertussis
gagcgggcccgacagcg

SEQ ID NO: 2427766 - RNA, 22 nt, Bordetella pertussis
gagcgggugaugcugcagcgca

SEQ ID NO: 2427767 - RNA, 22 nt, Bordetella pertussis
gagcggucgaagaaggccuugg

SEQ ID NO: 2427768 - RNA, 17 nt, Bordetella pertussis
gagcgguugaaauccuu

SEQ ID NO: 2427769 - RNA, 14 nt, Bordetella pertussis
gagcguaagcccac

SEQ ID NO: 2427770 - RNA, 19 nt, Bordetella pertussis
gagcuccugcucgauccgg

SEQ ID NO: 2427771 - RNA, 13 nt, Bordetella pertussis
gagcucgauggcu

SEQ ID NO: 2427772 - RNA, 18 nt, Bordetella pertussis
gagcucgggugggccggc

SEQ ID NO: 2427773 - RNA, 19 nt, Bordetella pertussis
gagcucgggugggccggcu

SEQ ID NO: 2427774 - RNA, 20 nt, Bordetella pertussis
gagcucguguagggccuggc

SEQ ID NO: 2427775 - RNA, 18 nt, Bordetella pertussis
gagcucuaugucgccggc

SEQ ID NO: 2427776 - RNA, 20 nt, Bordetella pertussis
gagcucuaugucgccggcca

SEQ ID NO: 2427777 - RNA, 15 nt, Bordetella pertussis
gagcugagcaccagc

SEQ ID NO: 2427778 - RNA, 21 nt, Bordetella pertussis
gagcugagcaccagcagcccc

SEQ ID NO: 2427779 - RNA, 16 nt, Bordetella pertussis
gagcugaugcucgccc

SEQ ID NO: 2427780 - RNA, 15 nt, Bordetella pertussis
gagcugcacaagguc

SEQ ID NO: 2427781 - RNA, 16 nt, Bordetella pertussis
gagcugcacccacacu

SEQ ID NO: 2427782 - RNA, 16 nt, Bordetella pertussis
gagcugcagcccggcc

SEQ ID NO: 2427783 - RNA, 13 nt, Bordetella pertussis
gagcugccaggcu

SEQ ID NO: 2427784 - RNA, 12 nt, Bordetella pertussis
gagcugcgcgac

SEQ ID NO: 2427785 - RNA, 17 nt, Bordetella pertussis
gagcugcgcgugcacga

SEQ ID NO: 2427786 - RNA, 20 nt, Bordetella pertussis
gagcugcgcgugcacgaccu

SEQ ID NO: 2427787 - RNA, 14 nt, Bordetella pertussis
gagcugcggcgcgg

SEQ ID NO: 2427788 - RNA, 16 nt, Bordetella pertussis
gagcugcggcgcggcg

SEQ ID NO: 2427789 - RNA, 19 nt, Bordetella pertussis
gagcugcgucuugagcagg

SEQ ID NO: 2427790 - RNA, 16 nt, Bordetella pertussis
gagcugcucaccucga

SEQ ID NO: 2427791 - RNA, 17 nt, Bordetella pertussis
gagcuggcgcagguccu

SEQ ID NO: 2427792 - RNA, 11 nt, Bordetella pertussis
gagcuggcgcu

SEQ ID NO: 2427793 - RNA, 19 nt, Bordetella pertussis
gagcuggggccgcgcgcca

SEQ ID NO: 2427794 - RNA, 19 nt, Bordetella pertussis
gagcuggucgaacgcuucc

SEQ ID NO: 2427795 - RNA, 14 nt, Bordetella pertussis
gagcuggugauggu

SEQ ID NO: 2427796 - RNA, 14 nt, Bordetella pertussis
gagcuuggccggug

SEQ ID NO: 2427797 - RNA, 13 nt, Bordetella pertussis
gaggaaagcggcc

SEQ ID NO: 2427798 - RNA, 17 nt, Bordetella pertussis
gaggaaccagccgucgg

SEQ ID NO: 2427799 - RNA, 18 nt, Bordetella pertussis
gaggaaccagccgucggc

SEQ ID NO: 2427800 - RNA, 15 nt, Bordetella pertussis
gaggaacgccgcgcu

SEQ ID NO: 2427801 - RNA, 20 nt, Bordetella pertussis
gaggaacgccgcgcucagca

SEQ ID NO: 2427802 - RNA, 23 nt, Bordetella pertussis
gaggaacgccgcgcucagcacca

SEQ ID NO: 2427803 - RNA, 16 nt, Bordetella pertussis
gaggaacggcaccagc

SEQ ID NO: 2427804 - RNA, 17 nt, Bordetella pertussis
gaggaacggcaccagcc

SEQ ID NO: 2427805 - RNA, 19 nt, Bordetella pertussis
gaggaacggcaccagccgg

SEQ ID NO: 2427806 - RNA, 21 nt, Bordetella pertussis
gaggaacuggacggcgcuggg

SEQ ID NO: 2427807 - RNA, 22 nt, Bordetella pertussis
gaggaacugggcgccggccagg

SEQ ID NO: 2427808 - RNA, 23 nt, Bordetella pertussis
gaggaacugggcgccggccagga

SEQ ID NO: 2427809 - RNA, 17 nt, Bordetella pertussis
gaggaaggcccgcgucu

SEQ ID NO: 2427810 - RNA, 21 nt, Bordetella pertussis
gaggacaggggccucaugacg

SEQ ID NO: 2427811 - RNA, 19 nt, Bordetella pertussis
gaggaccuguggcgcaccc

SEQ ID NO: 2427812 - RNA, 22 nt, Bordetella pertussis
gaggacgccgaccucggcaccg

SEQ ID NO: 2427813 - RNA, 14 nt, Bordetella pertussis
gaggagccggcggg

SEQ ID NO: 2427814 - RNA, 15 nt, Bordetella pertussis
gaggagccggcgggc

SEQ ID NO: 2427815 - RNA, 14 nt, Bordetella pertussis
gaggagguggcugg

SEQ ID NO: 2427816 - RNA, 16 nt, Bordetella pertussis
gaggauaucggccagg

SEQ ID NO: 2427817 - RNA, 17 nt, Bordetella pertussis
gaggauaucggccaggc

SEQ ID NO: 2427818 - RNA, 19 nt, Bordetella pertussis
gaggauaucggccaggcgc

SEQ ID NO: 2427819 - RNA, 16 nt, Bordetella pertussis
gaggaugcgcgcggcc

SEQ ID NO: 2427820 - RNA, 15 nt, Bordetella pertussis
gaggauggcgaggug

SEQ ID NO: 2427821 - RNA, 21 nt, Bordetella pertussis
gaggauguucaugaccgccgc

SEQ ID NO: 2427822 - RNA, 15 nt, Bordetella pertussis
gaggcaaucagcccc

SEQ ID NO: 2427823 - RNA, 16 nt, Bordetella pertussis
gaggcaaucagcccca

SEQ ID NO: 2427824 - RNA, 19 nt, Bordetella pertussis
gaggcaaucagccccaggc

SEQ ID NO: 2427825 - RNA, 21 nt, Bordetella pertussis
gaggcaaucagccccaggcgc

SEQ ID NO: 2427826 - RNA, 12 nt, Bordetella pertussis
gagguggcgggc

SEQ ID NO: 2427827 - RNA, 14 nt, Bordetella pertussis
gagguggcgggcga

SEQ ID NO: 2427828 - RNA, 21 nt, Bordetella pertussis
gaguagaaguaggcggccagg

SEQ ID NO: 2427829 - RNA, 22 nt, Bordetella pertussis
gaguagccgcucagguagacca

SEQ ID NO: 2427830 - RNA, 16 nt, Bordetella pertussis
gaguagcggcgcaacc

SEQ ID NO: 2427831 - RNA, 21 nt, Bordetella pertussis
gaguagcggcgcaacccggcc

SEQ ID NO: 2427832 - RNA, 13 nt, Bordetella pertussis
gaguaggccggca

SEQ ID NO: 2427833 - RNA, 13 nt, Bordetella pertussis
gagucgccccgac

SEQ ID NO: 2427834 - RNA, 19 nt, Bordetella pertussis
gagucggcgccgcgcagca

SEQ ID NO: 2427835 - RNA, 22 nt, Bordetella pertussis
gagucguauucggaccagggcu

SEQ ID NO: 2427836 - RNA, 13 nt, Bordetella pertussis
gagucgugcagga

SEQ ID NO: 2427837 - RNA, 18 nt, Bordetella pertussis
gagugauuguccugcacg

SEQ ID NO: 2427838 - RNA, 13 nt, Bordetella pertussis
gagugcaggcccg

SEQ ID NO: 2427839 - RNA, 16 nt, Bordetella pertussis
gagugcccauggagac

SEQ ID NO: 2427840 - RNA, 13 nt, Bordetella pertussis
gagugcgaggacg

SEQ ID NO: 2427841 - RNA, 17 nt, Bordetella pertussis
gagugcgaggacgaccu

SEQ ID NO: 2427842 - RNA, 16 nt, Bordetella pertussis
gaguuccgcgacgcgg

SEQ ID NO: 2427843 - RNA, 14 nt, Bordetella pertussis
gaguucgcugcgaa

SEQ ID NO: 2427844 - RNA, 23 nt, Bordetella pertussis
gaguucgcugcgaaacagcagcg

SEQ ID NO: 2427845 - RNA, 18 nt, Bordetella pertussis
gaguucggcgcgcccgcc

SEQ ID NO: 2427846 - RNA, 21 nt, Bordetella pertussis
gaguucgucgucgccaccgcc

SEQ ID NO: 2427847 - RNA, 15 nt, Bordetella pertussis
gaguucuggcaucag

SEQ ID NO: 2427848 - RNA, 17 nt, Bordetella pertussis
gaguugaggaugcgcgc

SEQ ID NO: 2427849 - RNA, 21 nt, Bordetella pertussis
gaguugcccgaaggcagcggc

SEQ ID NO: 2427850 - RNA, 22 nt, Bordetella pertussis
gaguuggcagaguggcaggagg

SEQ ID NO: 2427851 - RNA, 22 nt, Bordetella pertussis
gauaaaccgguggugcugcugg

SEQ ID NO: 2427852 - RNA, 16 nt, Bordetella pertussis
gauacaaggugccugu

SEQ ID NO: 2427853 - RNA, 21 nt, Bordetella pertussis
gauacaaggugccuguccccg

SEQ ID NO: 2427854 - RNA, 17 nt, Bordetella pertussis
gauacagcuuggcgcgc

SEQ ID NO: 2427855 - RNA, 19 nt, Bordetella pertussis
gauaccaacugccugcagc

SEQ ID NO: 2427856 - RNA, 16 nt, Bordetella pertussis
gauaccacgcgcggcg

SEQ ID NO: 2427857 - RNA, 17 nt, Bordetella pertussis
gauaccacgcgcggcgg

SEQ ID NO: 2427858 - RNA, 18 nt, Bordetella pertussis
gauaccacgcgcggcggc

SEQ ID NO: 2427859 - RNA, 19 nt, Bordetella pertussis
gauaccacgcgcggcggcg

SEQ ID NO: 2427860 - RNA, 20 nt, Bordetella pertussis
gauaccacgcgcggcggcgg

SEQ ID NO: 2427861 - RNA, 15 nt, Bordetella pertussis
gauaccggagcggcu

SEQ ID NO: 2427862 - RNA, 15 nt, Bordetella pertussis
gauaccggcauggca

SEQ ID NO: 2427863 - RNA, 20 nt, Bordetella pertussis
gauaccggcauggcagcaga

SEQ ID NO: 2427864 - RNA, 12 nt, Bordetella pertussis
gauaccgucgcg

SEQ ID NO: 2427865 - RNA, 18 nt, Bordetella pertussis
gauaccgucuuggcaguc

SEQ ID NO: 2427866 - RNA, 16 nt, Bordetella pertussis
gauacgacacgccgcg

SEQ ID NO: 2427867 - RNA, 23 nt, Bordetella pertussis
gauacgccgggcgcguggcccgc

SEQ ID NO: 2427868 - RNA, 13 nt, Bordetella pertussis
gauacgcgccgcc

SEQ ID NO: 2427869 - RNA, 18 nt, Bordetella pertussis
gauacgcgccgccuggcc

SEQ ID NO: 2427870 - RNA, 14 nt, Bordetella pertussis
gauacgcgugcgcg

SEQ ID NO: 2427871 - RNA, 19 nt, Bordetella pertussis
gauacgcuggaagagaccg

SEQ ID NO: 2427872 - RNA, 14 nt, Bordetella pertussis
gauacugcgcaugg

SEQ ID NO: 2427873 - RNA, 20 nt, Bordetella pertussis
gauacugcgcaugggcgcag

SEQ ID NO: 2427874 - RNA, 21 nt, Bordetella pertussis
gauacugcgcaugggcgcagg

SEQ ID NO: 2427875 - RNA, 17 nt, Bordetella pertussis
gauacuguucgccgcac

SEQ ID NO: 2427876 - RNA, 23 nt, Bordetella pertussis
gauacuguucgccgcaccaggcc

SEQ ID NO: 2427877 - RNA, 21 nt, Bordetella pertussis
gauagacauugcccagcacca

SEQ ID NO: 2427878 - RNA, 14 nt, Bordetella pertussis
gauagacccuccuc

SEQ ID NO: 2427879 - RNA, 15 nt, Bordetella pertussis
gauagauggccaggu

SEQ ID NO: 2427880 - RNA, 23 nt, Bordetella pertussis
gauagauggccagguggcggcgg

SEQ ID NO: 2427881 - RNA, 21 nt, Bordetella pertussis
gauagcccagcaccugcaggc

SEQ ID NO: 2427882 - RNA, 12 nt, Bordetella pertussis
gauagcccaggc

SEQ ID NO: 2427883 - RNA, 21 nt, Bordetella pertussis
gauagcccuugaucagcggcg

SEQ ID NO: 2427884 - RNA, 22 nt, Bordetella pertussis
gauagcccuugaucagcggcgg

SEQ ID NO: 2427885 - RNA, 15 nt, Bordetella pertussis
gauagccgcgcgccu

SEQ ID NO: 2427886 - RNA, 23 nt, Bordetella pertussis
gauagccgcgcgccugcagcagc

SEQ ID NO: 2427887 - RNA, 18 nt, Bordetella pertussis
gauagcgccgcgcaucga

SEQ ID NO: 2427888 - RNA, 17 nt, Bordetella pertussis
gauagcgccguaccagc

SEQ ID NO: 2427889 - RNA, 18 nt, Bordetella pertussis
gauagcgccguaccagcg

SEQ ID NO: 2427890 - RNA, 17 nt, Bordetella pertussis
gauagcggaugaugggc

SEQ ID NO: 2427891 - RNA, 18 nt, Bordetella pertussis
gauagcgggccugcagca

SEQ ID NO: 2427892 - RNA, 21 nt, Bordetella pertussis
gauagcgggccugcagcauga

SEQ ID NO: 2427893 - RNA, 16 nt, Bordetella pertussis
gauaggcggccaggcu

SEQ ID NO: 2427894 - RNA, 15 nt, Bordetella pertussis
gauaggugcgcagcc

SEQ ID NO: 2427895 - RNA, 15 nt, Bordetella pertussis
gauaguccagcaccg

SEQ ID NO: 2427896 - RNA, 20 nt, Bordetella pertussis
gauagucgcggaugcgcgcc

SEQ ID NO: 2427897 - RNA, 20 nt, Bordetella pertussis
gauagucggaguagggcagc

SEQ ID NO: 2427898 - RNA, 12 nt, Bordetella pertussis
gauauccacgcc

SEQ ID NO: 2427899 - RNA, 21 nt, Bordetella pertussis
gauauccagguaggcggcgcg

SEQ ID NO: 2427900 - RNA, 15 nt, Bordetella pertussis
gauauccaucuggcc

SEQ ID NO: 2427901 - RNA, 16 nt, Bordetella pertussis
gauaucccgcucggcu

SEQ ID NO: 2427902 - RNA, 23 nt, Bordetella pertussis
gauaucccgcucggcuggagcuc

SEQ ID NO: 2427903 - RNA, 18 nt, Bordetella pertussis
gauauccuugcgcucgcc

SEQ ID NO: 2427904 - RNA, 14 nt, Bordetella pertussis
gauaucggccaggc

SEQ ID NO: 2427905 - RNA, 23 nt, Bordetella pertussis
gauaugcgagacgaaggcgccgg

SEQ ID NO: 2427906 - RNA, 14 nt, Bordetella pertussis
gauaugcgccaggc

SEQ ID NO: 2427907 - RNA, 12 nt, Bordetella pertussis
gauauggccagg

SEQ ID NO: 2427908 - RNA, 14 nt, Bordetella pertussis
gauauggccggcgc

SEQ ID NO: 2427909 - RNA, 13 nt, Bordetella pertussis
gauaugggccuga

SEQ ID NO: 2427910 - RNA, 18 nt, Bordetella pertussis
gauaugggcgagcaggcc

SEQ ID NO: 2427911 - RNA, 13 nt, Bordetella pertussis
gauaugggcggcc

SEQ ID NO: 2427912 - RNA, 23 nt, Bordetella pertussis
gauauuggcgaacgugcgcgcca

SEQ ID NO: 2427913 - RNA, 21 nt, Bordetella pertussis
gauauugggggucagcgccga

SEQ ID NO: 2427914 - RNA, 22 nt, Bordetella pertussis
gaucaaaaucgugacgcuggcc

SEQ ID NO: 2427915 - RNA, 19 nt, Bordetella pertussis
gaucaacgugcgccaggca

SEQ ID NO: 2427916 - RNA, 20 nt, Bordetella pertussis
gaucaacgugcgccaggcaa

SEQ ID NO: 2427917 - RNA, 12 nt, Bordetella pertussis
gaucaagcggcc

SEQ ID NO: 2427918 - RNA, 18 nt, Bordetella pertussis
gaucaagcggcccgcgcc

SEQ ID NO: 2427919 - RNA, 19 nt, Bordetella pertussis
gaucaagcggcccgcgccc

SEQ ID NO: 2427920 - RNA, 20 nt, Bordetella pertussis
gaucaagggguggcuguccc

SEQ ID NO: 2427921 - RNA, 18 nt, Bordetella pertussis
gaucacauaggccggcac

SEQ ID NO: 2427922 - RNA, 13 nt, Bordetella pertussis
gaucaccaccggc

SEQ ID NO: 2427923 - RNA, 18 nt, Bordetella pertussis
gaucaccacgcccgcgcc

SEQ ID NO: 2427924 - RNA, 21 nt, Bordetella pertussis
gaucaccacgcccgcgccgca

SEQ ID NO: 2427925 - RNA, 13 nt, Bordetella pertussis
gaucacccacagc

SEQ ID NO: 2427926 - RNA, 21 nt, Bordetella pertussis
gaucacccacagcagcgcgcc

SEQ ID NO: 2427927 - RNA, 12 nt, Bordetella pertussis
gaucacccagcg

SEQ ID NO: 2427928 - RNA, 22 nt, Bordetella pertussis
gaucacccagcggcuggccacu

SEQ ID NO: 2427929 - RNA, 12 nt, Bordetella pertussis
gaucaccgcaug

SEQ ID NO: 2427930 - RNA, 13 nt, Bordetella pertussis
gaucaccgccaug

SEQ ID NO: 2427931 - RNA, 14 nt, Bordetella pertussis
gaucaccgccaugg

SEQ ID NO: 2427932 - RNA, 17 nt, Bordetella pertussis
gaucaccgccgcgccgc

SEQ ID NO: 2427933 - RNA, 18 nt, Bordetella pertussis
gaucaccgccgcgccgcu

SEQ ID NO: 2427934 - RNA, 20 nt, Bordetella pertussis
gaucaccgccgcggcgaugc

SEQ ID NO: 2427935 - RNA, 17 nt, Bordetella pertussis
gaucaccguuuggccug

SEQ ID NO: 2427936 - RNA, 20 nt, Bordetella pertussis
gaucaccguuuggccugccc

SEQ ID NO: 2427937 - RNA, 21 nt, Bordetella pertussis
gaucaccugcaggcccaccgg

SEQ ID NO: 2427938 - RNA, 17 nt, Bordetella pertussis
gaucacgaacagcgcca

SEQ ID NO: 2427939 - RNA, 19 nt, Bordetella pertussis
gauccgaugaugcccagga

SEQ ID NO: 2427940 - RNA, 17 nt, Bordetella pertussis
gauccgcaccggcgugc

SEQ ID NO: 2427941 - RNA, 18 nt, Bordetella pertussis
gauccgccaauggcggau

SEQ ID NO: 2427942 - RNA, 22 nt, Bordetella pertussis
gauccgccaauggcggaugcgc

SEQ ID NO: 2427943 - RNA, 23 nt, Bordetella pertussis
gauccgccaauggcggaugcgcc

SEQ ID NO: 2427944 - RNA, 15 nt, Bordetella pertussis
gauccgccgcggcca

SEQ ID NO: 2427945 - RNA, 16 nt, Bordetella pertussis
gauccgccgcggccag

SEQ ID NO: 2427946 - RNA, 18 nt, Bordetella pertussis
gauccgcgacgcccuggc

SEQ ID NO: 2427947 - RNA, 15 nt, Bordetella pertussis
gauccgcgccaggcg

SEQ ID NO: 2427948 - RNA, 20 nt, Bordetella pertussis
gauccgcggguauucgaagg

SEQ ID NO: 2427949 - RNA, 17 nt, Bordetella pertussis
gauccggacugaacgcg

SEQ ID NO: 2427950 - RNA, 15 nt, Bordetella pertussis
gauccggcagcagca

SEQ ID NO: 2427951 - RNA, 15 nt, Bordetella pertussis
gauccggcgaccgac

SEQ ID NO: 2427952 - RNA, 17 nt, Bordetella pertussis
gauccggcgaccgacgg

SEQ ID NO: 2427953 - RNA, 18 nt, Bordetella pertussis
gauccggcgaccgacggc

SEQ ID NO: 2427954 - RNA, 17 nt, Bordetella pertussis
gauccggcgcuggcgca

SEQ ID NO: 2427955 - RNA, 18 nt, Bordetella pertussis
gauccgguaugccugcca

SEQ ID NO: 2427956 - RNA, 15 nt, Bordetella pertussis
gauccggucgcccgc

SEQ ID NO: 2427957 - RNA, 12 nt, Bordetella pertussis
gauccgguugac

SEQ ID NO: 2427958 - RNA, 14 nt, Bordetella pertussis
gauccgguugacga

SEQ ID NO: 2427959 - RNA, 16 nt, Bordetella pertussis
gauccgguugacgauc

SEQ ID NO: 2427960 - RNA, 22 nt, Bordetella pertussis
gauccgguugacgaucucgccc

SEQ ID NO: 2427961 - RNA, 15 nt, Bordetella pertussis
gauccgugcggcgcg

SEQ ID NO: 2427962 - RNA, 13 nt, Bordetella pertussis
gauccucgccagc

SEQ ID NO: 2427963 - RNA, 16 nt, Bordetella pertussis
gauccucgccagcggc

SEQ ID NO: 2427964 - RNA, 18 nt, Bordetella pertussis
gauccucgccagcggcag

SEQ ID NO: 2427965 - RNA, 16 nt, Bordetella pertussis
gauccugcccaccgcc

SEQ ID NO: 2427966 - RNA, 14 nt, Bordetella pertussis
gauccugcggcgcg

SEQ ID NO: 2427967 - RNA, 15 nt, Bordetella pertussis
gauccugcugguggc

SEQ ID NO: 2427968 - RNA, 15 nt, Bordetella pertussis
gauccuuggugccgu

SEQ ID NO: 2427969 - RNA, 21 nt, Bordetella pertussis
gaucgaacgccucgggcgcaa

SEQ ID NO: 2427970 - RNA, 21 nt, Bordetella pertussis
gaucgaacgggaauggcggac

SEQ ID NO: 2427971 - RNA, 16 nt, Bordetella pertussis
gaucgacaacaagccg

SEQ ID NO: 2427972 - RNA, 20 nt, Bordetella pertussis
gaucgacaacaagccgggcg

SEQ ID NO: 2427973 - RNA, 22 nt, Bordetella pertussis
gaucgacaacaagccgggcgcc

SEQ ID NO: 2427974 - RNA, 13 nt, Bordetella pertussis
gaucgacgcgaug

SEQ ID NO: 2427975 - RNA, 20 nt, Bordetella pertussis
gaucgacgcgauguccagcu

SEQ ID NO: 2427976 - RNA, 21 nt, Bordetella pertussis
gaucgacgcgauguccagcuc

SEQ ID NO: 2427977 - RNA, 16 nt, Bordetella pertussis
gaucgacugccccaug

SEQ ID NO: 2427978 - RNA, 22 nt, Bordetella pertussis
gaucgacugccccauggcaugc

SEQ ID NO: 2427979 - RNA, 21 nt, Bordetella pertussis
gaucgagaaguuggcgggcgc

SEQ ID NO: 2427980 - RNA, 17 nt, Bordetella pertussis
gaucgaguaggccggca

SEQ ID NO: 2427981 - RNA, 20 nt, Bordetella pertussis
gaucgaguggugcgcggucc

SEQ ID NO: 2427982 - RNA, 15 nt, Bordetella pertussis
gaucgaucagccagc

SEQ ID NO: 2427983 - RNA, 21 nt, Bordetella pertussis
gaucgaucagccagccggcgg

SEQ ID NO: 2427984 - RNA, 15 nt, Bordetella pertussis
gaucgauccagaaga

SEQ ID NO: 2427985 - RNA, 19 nt, Bordetella pertussis
gaucgcacacaccgcguca

SEQ ID NO: 2427986 - RNA, 14 nt, Bordetella pertussis
gaucgcaucgcggc

SEQ ID NO: 2427987 - RNA, 20 nt, Bordetella pertussis
gaucgcauuucucggccugg

SEQ ID NO: 2427988 - RNA, 22 nt, Bordetella pertussis
gaucgcauuucucggccugggc

SEQ ID NO: 2427989 - RNA, 19 nt, Bordetella pertussis
gaucgccaacgucggcagc

SEQ ID NO: 2427990 - RNA, 22 nt, Bordetella pertussis
gaucgccaacgucggcagccag

SEQ ID NO: 2427991 - RNA, 12 nt, Bordetella pertussis
gaucgccaccag

SEQ ID NO: 2427992 - RNA, 16 nt, Bordetella pertussis
gaucgccaccagcguc

SEQ ID NO: 2427993 - RNA, 12 nt, Bordetella pertussis
gaucgccagcag

SEQ ID NO: 2427994 - RNA, 13 nt, Bordetella pertussis
gaucgccagcgcc

SEQ ID NO: 2427995 - RNA, 14 nt, Bordetella pertussis
gaucgccagcgccg

SEQ ID NO: 2427996 - RNA, 15 nt, Bordetella pertussis
gaucgccagcgccgg

SEQ ID NO: 2427997 - RNA, 22 nt, Bordetella pertussis
gaucgccaggucggccagccgg

SEQ ID NO: 2427998 - RNA, 12 nt, Bordetella pertussis
gaucgcccgcgu

SEQ ID NO: 2427999 - RNA, 20 nt, Bordetella pertussis
gaucgccgaagucggcgcgc

SEQ ID NO: 2428000 - RNA, 15 nt, Bordetella pertussis
gaucgccgacaggau

SEQ ID NO: 2428001 - RNA, 13 nt, Bordetella pertussis
gaucgccgcaugg

SEQ ID NO: 2428002 - RNA, 16 nt, Bordetella pertussis
gaucgccgccggcacg

SEQ ID NO: 2428003 - RNA, 19 nt, Bordetella pertussis
gaucgccgccuucaucguc

SEQ ID NO: 2428004 - RNA, 14 nt, Bordetella pertussis
gaucgccggcaacg

SEQ ID NO: 2428005 - RNA, 14 nt, Bordetella pertussis
gaucgccggcgccc

SEQ ID NO: 2428006 - RNA, 14 nt, Bordetella pertussis
gaucgccggcuacg

SEQ ID NO: 2428007 - RNA, 16 nt, Bordetella pertussis
gaucgccgggcaggca

SEQ ID NO: 2428008 - RNA, 20 nt, Bordetella pertussis
gaucgccgguagcgcugggc

SEQ ID NO: 2428009 - RNA, 18 nt, Bordetella pertussis
gaucgccggugaugcgau

SEQ ID NO: 2428010 - RNA, 21 nt, Bordetella pertussis
gaucgccucggggcucguggu

SEQ ID NO: 2428011 - RNA, 15 nt, Bordetella pertussis
gaucgccuggggcgg

SEQ ID NO: 2428012 - RNA, 16 nt, Bordetella pertussis
gaucgccuggggcggg

SEQ ID NO: 2428013 - RNA, 18 nt, Bordetella pertussis
gaucgccuggggcgggcg

SEQ ID NO: 2428014 - RNA, 19 nt, Bordetella pertussis
gaucgccuggggcgggcgc

SEQ ID NO: 2428015 - RNA, 16 nt, Bordetella pertussis
gaucgcgcacagcaug

SEQ ID NO: 2428016 - RNA, 23 nt, Bordetella pertussis
gaucgcgcacagcauggccacca

SEQ ID NO: 2428017 - RNA, 14 nt, Bordetella pertussis
gaucgcgcagcacc

SEQ ID NO: 2428018 - RNA, 12 nt, Bordetella pertussis
gaucgcgcagcg

SEQ ID NO: 2428019 - RNA, 20 nt, Bordetella pertussis
gaucgcgcagcgccuggccg

SEQ ID NO: 2428020 - RNA, 16 nt, Bordetella pertussis
gaucgcgccaggcgua

SEQ ID NO: 2428021 - RNA, 22 nt, Bordetella pertussis
gaucgcgcccagcgagcugcgc

SEQ ID NO: 2428022 - RNA, 13 nt, Bordetella pertussis
gaucgcgccgacg

SEQ ID NO: 2428023 - RNA, 16 nt, Bordetella pertussis
gaucgcgccgacgacc

SEQ ID NO: 2428024 - RNA, 12 nt, Bordetella pertussis
gaucgcgccggc

SEQ ID NO: 2428025 - RNA, 14 nt, Bordetella pertussis
gaucgcgccggccu

SEQ ID NO: 2428026 - RNA, 14 nt, Bordetella pertussis
gaucgcgccguccg

SEQ ID NO: 2428027 - RNA, 20 nt, Bordetella pertussis
gaucgcgccuaccggcgccg

SEQ ID NO: 2428028 - RNA, 13 nt, Bordetella pertussis
gaucgcgcgggcu

SEQ ID NO: 2428029 - RNA, 14 nt, Bordetella pertussis
gaucgcggccagcg

SEQ ID NO: 2428030 - RNA, 12 nt, Bordetella pertussis
gaucgcggcgcg

SEQ ID NO: 2428031 - RNA, 15 nt, Bordetella pertussis
gaucgcggcgcggcu

SEQ ID NO: 2428032 - RNA, 15 nt, Bordetella pertussis
gaucgcggcgcuggc

SEQ ID NO: 2428033 - RNA, 16 nt, Bordetella pertussis
gaucgcggcgcuggcg

SEQ ID NO: 2428034 - RNA, 15 nt, Bordetella pertussis
gaucgcggcuccagc

SEQ ID NO: 2428035 - RNA, 23 nt, Bordetella pertussis
gaucgcgucggccaaggccggcg

SEQ ID NO: 2428036 - RNA, 18 nt, Bordetella pertussis
gaucggagaaaucgccgc

SEQ ID NO: 2428037 - RNA, 23 nt, Bordetella pertussis
gaucggagaaaucgccgccggcg

SEQ ID NO: 2428038 - RNA, 22 nt, Bordetella pertussis
gaucggcacgauuuuucgcugu

SEQ ID NO: 2428039 - RNA, 12 nt, Bordetella pertussis
gaucggccacga

SEQ ID NO: 2428040 - RNA, 11 nt, Bordetella pertussis
gaucggccagg

SEQ ID NO: 2428041 - RNA, 12 nt, Bordetella pertussis
gaucggccaggc

SEQ ID NO: 2428042 - RNA, 15 nt, Bordetella pertussis
gaucggccaggccgg

SEQ ID NO: 2428043 - RNA, 16 nt, Bordetella pertussis
gaucggcccggcgccg

SEQ ID NO: 2428044 - RNA, 19 nt, Bordetella pertussis
gaucggcccgggcguggcg

SEQ ID NO: 2428045 - RNA, 16 nt, Bordetella pertussis
gaucggccggccgggc

SEQ ID NO: 2428046 - RNA, 23 nt, Bordetella pertussis
gaucggccucggucucgugcgug

SEQ ID NO: 2428047 - RNA, 19 nt, Bordetella pertussis
gaucggcgcaaccggcccg

SEQ ID NO: 2428048 - RNA, 22 nt, Bordetella pertussis
gaucggcgccaugaucgccggc

SEQ ID NO: 2428049 - RNA, 18 nt, Bordetella pertussis
gaucggcgccgcgcgcgg

SEQ ID NO: 2428050 - RNA, 15 nt, Bordetella pertussis
gaucggcgccuggcc

SEQ ID NO: 2428051 - RNA, 22 nt, Bordetella pertussis
gaucggcgccuggccgcccagc

SEQ ID NO: 2428052 - RNA, 13 nt, Bordetella pertussis
gaucggcgcgccc

SEQ ID NO: 2428053 - RNA, 16 nt, Bordetella pertussis
gaugauccugcuggug

SEQ ID NO: 2428054 - RNA, 18 nt, Bordetella pertussis
gaugaucggcgccaugau

SEQ ID NO: 2428055 - RNA, 20 nt, Bordetella pertussis
gaugaucuacgcgcgcgccg

SEQ ID NO: 2428056 - RNA, 22 nt, Bordetella pertussis
gaugaucuacgcgcgcgccggc

SEQ ID NO: 2428057 - RNA, 14 nt, Bordetella pertussis
gaugaugauguuca

SEQ ID NO: 2428058 - RNA, 14 nt, Bordetella pertussis
gaugaugcagcaca

SEQ ID NO: 2428059 - RNA, 16 nt, Bordetella pertussis
gaugaugcccaggauc

SEQ ID NO: 2428060 - RNA, 14 nt, Bordetella pertussis
gaugauggaggcca

SEQ ID NO: 2428061 - RNA, 17 nt, Bordetella pertussis
gaugauggcguccgcgu

SEQ ID NO: 2428062 - RNA, 19 nt, Bordetella pertussis
gaugauggcguccgcgucg

SEQ ID NO: 2428063 - RNA, 19 nt, Bordetella pertussis
gaugauggggucgccgggc

SEQ ID NO: 2428064 - RNA, 20 nt, Bordetella pertussis
gaugauggucggugccgccg

SEQ ID NO: 2428065 - RNA, 22 nt, Bordetella pertussis
gaugauguucauacgcgcgcuc

SEQ ID NO: 2428066 - RNA, 16 nt, Bordetella pertussis
gaugcaauagcgcccg

SEQ ID NO: 2428067 - RNA, 13 nt, Bordetella pertussis
gaugcacccaggc

SEQ ID NO: 2428068 - RNA, 16 nt, Bordetella pertussis
gaugcacccaggcgcc

SEQ ID NO: 2428069 - RNA, 13 nt, Bordetella pertussis
gaugcaccggcca

SEQ ID NO: 2428070 - RNA, 14 nt, Bordetella pertussis
gaugcaccggccag

SEQ ID NO: 2428071 - RNA, 15 nt, Bordetella pertussis
gaugcaccggccagu

SEQ ID NO: 2428072 - RNA, 17 nt, Bordetella pertussis
gaugcaccggccagucg

SEQ ID NO: 2428073 - RNA, 18 nt, Bordetella pertussis
gaugcacggaacgugccg

SEQ ID NO: 2428074 - RNA, 18 nt, Bordetella pertussis
gaugcacguagcgcagca

SEQ ID NO: 2428075 - RNA, 19 nt, Bordetella pertussis
gaugcacguagcgcagcac

SEQ ID NO: 2428076 - RNA, 12 nt, Bordetella pertussis
gaugcagcacgu

SEQ ID NO: 2428077 - RNA, 17 nt, Bordetella pertussis
gaugcagcacgucggcg

SEQ ID NO: 2428078 - RNA, 20 nt, Bordetella pertussis
gaugcagcacgucggcgucg

SEQ ID NO: 2428079 - RNA, 16 nt, Bordetella pertussis
gaugcaggucggggcg

SEQ ID NO: 2428080 - RNA, 18 nt, Bordetella pertussis
gaugcaugaaccgcagcg

SEQ ID NO: 2428081 - RNA, 20 nt, Bordetella pertussis
gaugcaugaaccgcagcgcc

SEQ ID NO: 2428082 - RNA, 13 nt, Bordetella pertussis
gaugccagcggcg

SEQ ID NO: 2428083 - RNA, 15 nt, Bordetella pertussis
gaugccagcggcgca

SEQ ID NO: 2428084 - RNA, 20 nt, Bordetella pertussis
gaugccagcggcgcagccgg

SEQ ID NO: 2428085 - RNA, 20 nt, Bordetella pertussis
gaugccagugaaacgcgacg

SEQ ID NO: 2428086 - RNA, 20 nt, Bordetella pertussis
gaugccaguuguaguggugu

SEQ ID NO: 2428087 - RNA, 12 nt, Bordetella pertussis
gaugcccaccag

SEQ ID NO: 2428088 - RNA, 14 nt, Bordetella pertussis
gaugcccaccagcc

SEQ ID NO: 2428089 - RNA, 13 nt, Bordetella pertussis
gaugcccagcgcc

SEQ ID NO: 2428090 - RNA, 14 nt, Bordetella pertussis
gaugcccagcgcca

SEQ ID NO: 2428091 - RNA, 16 nt, Bordetella pertussis
gaugcccagcgccagg

SEQ ID NO: 2428092 - RNA, 17 nt, Bordetella pertussis
gaugcccagcgccaggg

SEQ ID NO: 2428093 - RNA, 16 nt, Bordetella pertussis
gaugcccaggcccgcc

SEQ ID NO: 2428094 - RNA, 13 nt, Bordetella pertussis
gaugcccagggcc

SEQ ID NO: 2428095 - RNA, 15 nt, Bordetella pertussis
gaugcccagggccgc

SEQ ID NO: 2428096 - RNA, 18 nt, Bordetella pertussis
gaugcccagggccgcgcc

SEQ ID NO: 2428097 - RNA, 16 nt, Bordetella pertussis
gaugcccaugcgcugc

SEQ ID NO: 2428098 - RNA, 17 nt, Bordetella pertussis
gaugcccaugcgcugcg

SEQ ID NO: 2428099 - RNA, 19 nt, Bordetella pertussis
gaugcccaugcgcugcgcc

SEQ ID NO: 2428100 - RNA, 13 nt, Bordetella pertussis
gaugccccagguc

SEQ ID NO: 2428101 - RNA, 19 nt, Bordetella pertussis
gaugccccaguccaggccg

SEQ ID NO: 2428102 - RNA, 22 nt, Bordetella pertussis
gaugccccaguccaggccggcc

SEQ ID NO: 2428103 - RNA, 19 nt, Bordetella pertussis
gaugcccgaggcggcgcgg

SEQ ID NO: 2428104 - RNA, 12 nt, Bordetella pertussis
gaugcccgcgca

SEQ ID NO: 2428105 - RNA, 15 nt, Bordetella pertussis
gaugcccgcgcacca

SEQ ID NO: 2428106 - RNA, 13 nt, Bordetella pertussis
gaugcccgcgggc

SEQ ID NO: 2428107 - RNA, 15 nt, Bordetella pertussis
gaugcccgcgggcau

SEQ ID NO: 2428108 - RNA, 18 nt, Bordetella pertussis
gaugcccucgcgcacggu

SEQ ID NO: 2428109 - RNA, 19 nt, Bordetella pertussis
gaugcccugcgccagcgcc

SEQ ID NO: 2428110 - RNA, 21 nt, Bordetella pertussis
gaugcccugcgccagcgccuc

SEQ ID NO: 2428111 - RNA, 20 nt, Bordetella pertussis
gaugcccuggguggcggggc

SEQ ID NO: 2428112 - RNA, 16 nt, Bordetella pertussis
gaugccgaacagccag

SEQ ID NO: 2428113 - RNA, 19 nt, Bordetella pertussis
gaugccgaacagccagggc

SEQ ID NO: 2428114 - RNA, 19 nt, Bordetella pertussis
gaugccgaacugucgcgcc

SEQ ID NO: 2428115 - RNA, 13 nt, Bordetella pertussis
gaugccgaccagg

SEQ ID NO: 2428116 - RNA, 14 nt, Bordetella pertussis
gaugccgaccaggc

SEQ ID NO: 2428117 - RNA, 16 nt, Bordetella pertussis
gaugccgaccaggccc

SEQ ID NO: 2428118 - RNA, 22 nt, Bordetella pertussis
gaugccgaccaggcugcgcgcc

SEQ ID NO: 2428119 - RNA, 23 nt, Bordetella pertussis
gaugccgaccgaagaggagcugc

SEQ ID NO: 2428120 - RNA, 18 nt, Bordetella pertussis
gaugccgaucgccgacag

SEQ ID NO: 2428121 - RNA, 21 nt, Bordetella pertussis
gaugccgcagauggccagcag

SEQ ID NO: 2428122 - RNA, 12 nt, Bordetella pertussis
gaugccgccaug

SEQ ID NO: 2428123 - RNA, 13 nt, Bordetella pertussis
gaugccgccaugc

SEQ ID NO: 2428124 - RNA, 15 nt, Bordetella pertussis
gaugccgccaugcgc

SEQ ID NO: 2428125 - RNA, 21 nt, Bordetella pertussis
gaugccgccaugcgccagcag

SEQ ID NO: 2428126 - RNA, 22 nt, Bordetella pertussis
gaugccgccaugcgccagcagg

SEQ ID NO: 2428127 - RNA, 23 nt, Bordetella pertussis
gaugccgccaugcgccagcagga

SEQ ID NO: 2428128 - RNA, 15 nt, Bordetella pertussis
gaugccgcccacgcc

SEQ ID NO: 2428129 - RNA, 16 nt, Bordetella pertussis
gaugccgcccacgcca

SEQ ID NO: 2428130 - RNA, 13 nt, Bordetella pertussis
gaugccgcccagc

SEQ ID NO: 2428131 - RNA, 17 nt, Bordetella pertussis
gaugccgcccagcaugc

SEQ ID NO: 2428132 - RNA, 23 nt, Bordetella pertussis
gaugccgcccagcaugcgcgcga

SEQ ID NO: 2428133 - RNA, 17 nt, Bordetella pertussis
gaugccgcccgcaugca

SEQ ID NO: 2428134 - RNA, 22 nt, Bordetella pertussis
gaugccgcccgugcagaagcug

SEQ ID NO: 2428135 - RNA, 16 nt, Bordetella pertussis
gaugccgccgccgacg

SEQ ID NO: 2428136 - RNA, 18 nt, Bordetella pertussis
gaugccgccggcgggcaa

SEQ ID NO: 2428137 - RNA, 14 nt, Bordetella pertussis
gaugccgcgcaccu

SEQ ID NO: 2428138 - RNA, 14 nt, Bordetella pertussis
gaugccggccagca

SEQ ID NO: 2428139 - RNA, 17 nt, Bordetella pertussis
gaugccggccagcagcg

SEQ ID NO: 2428140 - RNA, 15 nt, Bordetella pertussis
gaugccggccucggc

SEQ ID NO: 2428141 - RNA, 16 nt, Bordetella pertussis
gaugccggcgcugcgc

SEQ ID NO: 2428142 - RNA, 19 nt, Bordetella pertussis
gaugccggcggccugcacg

SEQ ID NO: 2428143 - RNA, 20 nt, Bordetella pertussis
gaugccggcguggcgcgcaa

SEQ ID NO: 2428144 - RNA, 22 nt, Bordetella pertussis
gaugccggcguucuggucagcc

SEQ ID NO: 2428145 - RNA, 20 nt, Bordetella pertussis
gaugccggucuccagcgcgu

SEQ ID NO: 2428146 - RNA, 18 nt, Bordetella pertussis
gaugccgguucgggcggg

SEQ ID NO: 2428147 - RNA, 15 nt, Bordetella pertussis
gaugccguaccaggu

SEQ ID NO: 2428148 - RNA, 16 nt, Bordetella pertussis
gaugccguaccaggug

SEQ ID NO: 2428149 - RNA, 22 nt, Bordetella pertussis
gaugccguaccaggugcgcaug

SEQ ID NO: 2428150 - RNA, 19 nt, Bordetella pertussis
gaugccguaggugcgcgcc

SEQ ID NO: 2428151 - RNA, 23 nt, Bordetella pertussis
gaugccguaggugcgcgccacau

SEQ ID NO: 2428152 - RNA, 20 nt, Bordetella pertussis
gaugccguccacgccgcgcg

SEQ ID NO: 2428153 - RNA, 22 nt, Bordetella pertussis
gaugccguccacgccgcgcgcg

SEQ ID NO: 2428154 - RNA, 20 nt, Bordetella pertussis
gaugccgucgaaggccgcaa

SEQ ID NO: 2428155 - RNA, 15 nt, Bordetella pertussis
gaugccgucgagcgc

SEQ ID NO: 2428156 - RNA, 20 nt, Bordetella pertussis
gaugccgucgagcgcggcca

SEQ ID NO: 2428157 - RNA, 21 nt, Bordetella pertussis
gaugccgucgagcgcggccag

SEQ ID NO: 2428158 - RNA, 14 nt, Bordetella pertussis
gaugccgucggccu

SEQ ID NO: 2428159 - RNA, 17 nt, Bordetella pertussis
gaugccgucggccugga

SEQ ID NO: 2428160 - RNA, 13 nt, Bordetella pertussis
gaugccgucuugg

SEQ ID NO: 2428161 - RNA, 19 nt, Bordetella pertussis
gaugccguucuugcccgag

SEQ ID NO: 2428162 - RNA, 16 nt, Bordetella pertussis
gaugccguuggccgcg

SEQ ID NO: 2428163 - RNA, 21 nt, Bordetella pertussis
gaugccguuggccgcgaaggc

SEQ ID NO: 2428164 - RNA, 13 nt, Bordetella pertussis
gaugccugucccg

SEQ ID NO: 2428165 - RNA, 18 nt, Bordetella pertussis
gaugccuugguggggucg

SEQ ID NO: 2428166 - RNA, 14 nt, Bordetella pertussis
gauggccggccugc

SEQ ID NO: 2428167 - RNA, 14 nt, Bordetella pertussis
gauggccggcgcga

SEQ ID NO: 2428168 - RNA, 21 nt, Bordetella pertussis
gauggccgggagcggccagca

SEQ ID NO: 2428169 - RNA, 17 nt, Bordetella pertussis
gauggccgggccguggc

SEQ ID NO: 2428170 - RNA, 20 nt, Bordetella pertussis
gauggccucgcugccagggu

SEQ ID NO: 2428171 - RNA, 21 nt, Bordetella pertussis
gauggccucgcugccagggug

SEQ ID NO: 2428172 - RNA, 19 nt, Bordetella pertussis
gauggccucggcauggcgc

SEQ ID NO: 2428173 - RNA, 23 nt, Bordetella pertussis
gauggccucggcauggcgcgcgc

SEQ ID NO: 2428174 - RNA, 21 nt, Bordetella pertussis
gauggccugcucgcccacaua

SEQ ID NO: 2428175 - RNA, 22 nt, Bordetella pertussis
gauggccuuggaguagccgcuc

SEQ ID NO: 2428176 - RNA, 19 nt, Bordetella pertussis
gauggccuuuuccaggcgu

SEQ ID NO: 2428177 - RNA, 22 nt, Bordetella pertussis
gauggccuuuuccaggcgugcc

SEQ ID NO: 2428178 - RNA, 16 nt, Bordetella pertussis
gauggcgaaacuggcc

SEQ ID NO: 2428179 - RNA, 21 nt, Bordetella pertussis
gauggcgauguccagcgagcg

SEQ ID NO: 2428180 - RNA, 14 nt, Bordetella pertussis
gauggcgcagcggg

SEQ ID NO: 2428181 - RNA, 18 nt, Bordetella pertussis
gauggcgcaggcgcgcca

SEQ ID NO: 2428182 - RNA, 20 nt, Bordetella pertussis
gauggcgcaggcgcgccagg

SEQ ID NO: 2428183 - RNA, 23 nt, Bordetella pertussis
gauggcgccaccuucgccgcgca

SEQ ID NO: 2428184 - RNA, 12 nt, Bordetella pertussis
gauggcgccagc

SEQ ID NO: 2428185 - RNA, 16 nt, Bordetella pertussis
gauggcgccggccagc

SEQ ID NO: 2428186 - RNA, 23 nt, Bordetella pertussis
gauggcgccggccagcgcgccgg

SEQ ID NO: 2428187 - RNA, 13 nt, Bordetella pertussis
gauggcgccuucg

SEQ ID NO: 2428188 - RNA, 17 nt, Bordetella pertussis
gauggcgcgcgccacca

SEQ ID NO: 2428189 - RNA, 12 nt, Bordetella pertussis
gauggcgcgcgg

SEQ ID NO: 2428190 - RNA, 14 nt, Bordetella pertussis
gauggcgcgcggcu

SEQ ID NO: 2428191 - RNA, 18 nt, Bordetella pertussis
gauggcgcgcggcugggg

SEQ ID NO: 2428192 - RNA, 19 nt, Bordetella pertussis
gauggcgcgcggcuggggc

SEQ ID NO: 2428193 - RNA, 21 nt, Bordetella pertussis
gauggcgcuugugcgucggcu

SEQ ID NO: 2428194 - RNA, 14 nt, Bordetella pertussis
gauggcggccaggg

SEQ ID NO: 2428195 - RNA, 15 nt, Bordetella pertussis
gauggcggccagggc

SEQ ID NO: 2428196 - RNA, 17 nt, Bordetella pertussis
gauggcggccgccagcg

SEQ ID NO: 2428197 - RNA, 18 nt, Bordetella pertussis
gauggcggccgccagcgc

SEQ ID NO: 2428198 - RNA, 19 nt, Bordetella pertussis
gauggcggccgccagcgcc

SEQ ID NO: 2428199 - RNA, 22 nt, Bordetella pertussis
gauggcggccgccagcgccaug

SEQ ID NO: 2428200 - RNA, 14 nt, Bordetella pertussis
gauggcggcgcugg

SEQ ID NO: 2428201 - RNA, 17 nt, Bordetella pertussis
gauggcggcgcuggcgu

SEQ ID NO: 2428202 - RNA, 11 nt, Bordetella pertussis
gauggcggcgg

SEQ ID NO: 2428203 - RNA, 13 nt, Bordetella pertussis
gauggcggcggcg

SEQ ID NO: 2428204 - RNA, 20 nt, Bordetella pertussis
gauggcgggguuggccgcca

SEQ ID NO: 2428205 - RNA, 23 nt, Bordetella pertussis
gauggcgggguuggccgccagga

SEQ ID NO: 2428206 - RNA, 12 nt, Bordetella pertussis
gauggcgguggu

SEQ ID NO: 2428207 - RNA, 14 nt, Bordetella pertussis
gauggcggugguga

SEQ ID NO: 2428208 - RNA, 15 nt, Bordetella pertussis
gauggcgguggugau

SEQ ID NO: 2428209 - RNA, 17 nt, Bordetella pertussis
gauggcguacagcaggg

SEQ ID NO: 2428210 - RNA, 21 nt, Bordetella pertussis
gauggcguacagcagggugcc

SEQ ID NO: 2428211 - RNA, 23 nt, Bordetella pertussis
gauggcguacagcagggugccug

SEQ ID NO: 2428212 - RNA, 20 nt, Bordetella pertussis
gauggcguaggcggccuuga

SEQ ID NO: 2428213 - RNA, 18 nt, Bordetella pertussis
gauggcguccagcagcag

SEQ ID NO: 2428214 - RNA, 16 nt, Bordetella pertussis
gauggcgucugcccgu

SEQ ID NO: 2428215 - RNA, 14 nt, Bordetella pertussis
gauggcguugaugu

SEQ ID NO: 2428216 - RNA, 17 nt, Bordetella pertussis
gauggcguugcgcacca

SEQ ID NO: 2428217 - RNA, 16 nt, Bordetella pertussis
gauggcucgggcagca

SEQ ID NO: 2428218 - RNA, 13 nt, Bordetella pertussis
gauggcuggccga

SEQ ID NO: 2428219 - RNA, 20 nt, Bordetella pertussis
gauggcuuccugcggcacga

SEQ ID NO: 2428220 - RNA, 19 nt, Bordetella pertussis
gauggcuucgcgcacaucc

SEQ ID NO: 2428221 - RNA, 14 nt, Bordetella pertussis
gauggcuuuggcga

SEQ ID NO: 2428222 - RNA, 18 nt, Bordetella pertussis
gaugggauacgccgugcu

SEQ ID NO: 2428223 - RNA, 23 nt, Bordetella pertussis
gaugggauacgccgugcuguacc

SEQ ID NO: 2428224 - RNA, 13 nt, Bordetella pertussis
gaugggcaggccc

SEQ ID NO: 2428225 - RNA, 12 nt, Bordetella pertussis
gaugggccaccc

SEQ ID NO: 2428226 - RNA, 21 nt, Bordetella pertussis
gaugggccguccggccgugcc

SEQ ID NO: 2428227 - RNA, 19 nt, Bordetella pertussis
gaugggccugcccauggcc

SEQ ID NO: 2428228 - RNA, 14 nt, Bordetella pertussis
gaugggcgcaucca

SEQ ID NO: 2428229 - RNA, 13 nt, Bordetella pertussis
gaugggcgcgcgc

SEQ ID NO: 2428230 - RNA, 17 nt, Bordetella pertussis
gaugggcgcgcgcaucg

SEQ ID NO: 2428231 - RNA, 13 nt, Bordetella pertussis
gaugggcgcggcg

SEQ ID NO: 2428232 - RNA, 18 nt, Bordetella pertussis
gaugggcgcggcgcgcgc

SEQ ID NO: 2428233 - RNA, 21 nt, Bordetella pertussis
gaugggcgcggcgcgcgccga

SEQ ID NO: 2428234 - RNA, 12 nt, Bordetella pertussis
gaugggcggcga

SEQ ID NO: 2428235 - RNA, 20 nt, Bordetella pertussis
gauggggcagccauccucgc

SEQ ID NO: 2428236 - RNA, 15 nt, Bordetella pertussis
gauggggccauggca

SEQ ID NO: 2428237 - RNA, 15 nt, Bordetella pertussis
gauggggccgucgcc

SEQ ID NO: 2428238 - RNA, 19 nt, Bordetella pertussis
gauggggucgggccgcgcg

SEQ ID NO: 2428239 - RNA, 17 nt, Bordetella pertussis
gauggguacagcgcgcc

SEQ ID NO: 2428240 - RNA, 18 nt, Bordetella pertussis
gauggguacagcgcgccc

SEQ ID NO: 2428241 - RNA, 19 nt, Bordetella pertussis
gauggguacagcgcgcccg

SEQ ID NO: 2428242 - RNA, 20 nt, Bordetella pertussis
gauggguacagcgcgcccga

SEQ ID NO: 2428243 - RNA, 22 nt, Bordetella pertussis
gauggguacgccggccugacgc

SEQ ID NO: 2428244 - RNA, 18 nt, Bordetella pertussis
gaugguagaugcgcgcga

SEQ ID NO: 2428245 - RNA, 16 nt, Bordetella pertussis
gaugguaucggccggg

SEQ ID NO: 2428246 - RNA, 13 nt, Bordetella pertussis
gauggucaccacc

SEQ ID NO: 2428247 - RNA, 19 nt, Bordetella pertussis
gauggucaccacccgcacg

SEQ ID NO: 2428248 - RNA, 14 nt, Bordetella pertussis
gauggucagcaugu

SEQ ID NO: 2428249 - RNA, 22 nt, Bordetella pertussis
gauggucgcggccgaggccagc

SEQ ID NO: 2428250 - RNA, 22 nt, Bordetella pertussis
gauggugaacgccaccaggccg

SEQ ID NO: 2428251 - RNA, 22 nt, Bordetella pertussis
gauggugccgccgcccgacagc

SEQ ID NO: 2428252 - RNA, 20 nt, Bordetella pertussis
gauggugccgguggugccca

SEQ ID NO: 2428253 - RNA, 16 nt, Bordetella pertussis
gaugguggauccgccg

SEQ ID NO: 2428254 - RNA, 20 nt, Bordetella pertussis
gaugguggggcuggccgccg

SEQ ID NO: 2428255 - RNA, 17 nt, Bordetella pertussis
gauguaccagcccagcc

SEQ ID NO: 2428256 - RNA, 16 nt, Bordetella pertussis
gauguagcccauggcc

SEQ ID NO: 2428257 - RNA, 14 nt, Bordetella pertussis
gauguagcccaugu

SEQ ID NO: 2428258 - RNA, 16 nt, Bordetella pertussis
gauguagcccauguuc

SEQ ID NO: 2428259 - RNA, 14 nt, Bordetella pertussis
gauguagccgaccc

SEQ ID NO: 2428260 - RNA, 21 nt, Bordetella pertussis
gauguagccgacccgcaccga

SEQ ID NO: 2428261 - RNA, 16 nt, Bordetella pertussis
gauguaggccagguuc

SEQ ID NO: 2428262 - RNA, 14 nt, Bordetella pertussis
gauguagggcagcu

SEQ ID NO: 2428263 - RNA, 18 nt, Bordetella pertussis
gauguccagcgccagcag

SEQ ID NO: 2428264 - RNA, 15 nt, Bordetella pertussis
gauguccauggccug

SEQ ID NO: 2428265 - RNA, 20 nt, Bordetella pertussis
gauguccgcgucggccgcgu

SEQ ID NO: 2428266 - RNA, 17 nt, Bordetella pertussis
gaugucgaacagcugca

SEQ ID NO: 2428267 - RNA, 18 nt, Bordetella pertussis
gaugucgaacagcugcag

SEQ ID NO: 2428268 - RNA, 20 nt, Bordetella pertussis
gaugucgccgccgcgcacca

SEQ ID NO: 2428269 - RNA, 16 nt, Bordetella pertussis
gaugucgccgucggca

SEQ ID NO: 2428270 - RNA, 16 nt, Bordetella pertussis
gaugucgcgcaccgcc

SEQ ID NO: 2428271 - RNA, 19 nt, Bordetella pertussis
gaugucgcgcaccgccugc

SEQ ID NO: 2428272 - RNA, 14 nt, Bordetella pertussis
gaugucgcgcgccu

SEQ ID NO: 2428273 - RNA, 15 nt, Bordetella pertussis
gaugucgcgcgccug

SEQ ID NO: 2428274 - RNA, 13 nt, Bordetella pertussis
gaugucggccagg

SEQ ID NO: 2428275 - RNA, 22 nt, Bordetella pertussis
gaugucggccuucugcgccagc

SEQ ID NO: 2428276 - RNA, 20 nt, Bordetella pertussis
gaugucgugaucgccagcgc

SEQ ID NO: 2428277 - RNA, 17 nt, Bordetella pertussis
gaugugacggaccuugu

SEQ ID NO: 2428278 - RNA, 23 nt, Bordetella pertussis
gaugugcagcgcacgguccaggc

SEQ ID NO: 2428279 - RNA, 15 nt, Bordetella pertussis
gcaacgccacgcgcg

SEQ ID NO: 2428280 - RNA, 18 nt, Bordetella pertussis
gcaacgccacgcgcggau

SEQ ID NO: 2428281 - RNA, 13 nt, Bordetella pertussis
gcaacgccagcag

SEQ ID NO: 2428282 - RNA, 15 nt, Bordetella pertussis
gcaacgccagcaggc

SEQ ID NO: 2428283 - RNA, 16 nt, Bordetella pertussis
gcaacgccagcaggcg

SEQ ID NO: 2428284 - RNA, 22 nt, Bordetella pertussis
gcaacgccagcaggcgaaacgc

SEQ ID NO: 2428285 - RNA, 14 nt, Bordetella pertussis
gcaacgccgccacc

SEQ ID NO: 2428286 - RNA, 20 nt, Bordetella pertussis
gcaacgccgccaccagggcg

SEQ ID NO: 2428287 - RNA, 18 nt, Bordetella pertussis
gcaacgccgcccguccgg

SEQ ID NO: 2428288 - RNA, 20 nt, Bordetella pertussis
gcaacgccgcccguccgggc

SEQ ID NO: 2428289 - RNA, 21 nt, Bordetella pertussis
gcaacgccgcccguccgggcg

SEQ ID NO: 2428290 - RNA, 15 nt, Bordetella pertussis
gcaacgccgccggca

SEQ ID NO: 2428291 - RNA, 21 nt, Bordetella pertussis
gcaacgccgccggcagggcca

SEQ ID NO: 2428292 - RNA, 16 nt, Bordetella pertussis
gcaacgccggcggcac

SEQ ID NO: 2428293 - RNA, 17 nt, Bordetella pertussis
gcaacgccgggccgcgc

SEQ ID NO: 2428294 - RNA, 20 nt, Bordetella pertussis
gcaacgccgggccgcgccgc

SEQ ID NO: 2428295 - RNA, 22 nt, Bordetella pertussis
gcaacgccgggucgaggucgau

SEQ ID NO: 2428296 - RNA, 16 nt, Bordetella pertussis
gcaacgcgcgcgcgca

SEQ ID NO: 2428297 - RNA, 20 nt, Bordetella pertussis
gcaacgcgcgcgcgcacagg

SEQ ID NO: 2428298 - RNA, 16 nt, Bordetella pertussis
gcaacgggccggccgc

SEQ ID NO: 2428299 - RNA, 21 nt, Bordetella pertussis
gcaacgggccggccgccggcg

SEQ ID NO: 2428300 - RNA, 14 nt, Bordetella pertussis
gcaacgggucgcgc

SEQ ID NO: 2428301 - RNA, 17 nt, Bordetella pertussis
gcaacgggucgcgcagc

SEQ ID NO: 2428302 - RNA, 18 nt, Bordetella pertussis
gcaacggugagccggcca

SEQ ID NO: 2428303 - RNA, 14 nt, Bordetella pertussis
gcaacgucgaacag

SEQ ID NO: 2428304 - RNA, 15 nt, Bordetella pertussis
gcaacgugcaggcca

SEQ ID NO: 2428305 - RNA, 17 nt, Bordetella pertussis
gcaacguugcugcagcg

SEQ ID NO: 2428306 - RNA, 17 nt, Bordetella pertussis
gcaacuccacgcccugc

SEQ ID NO: 2428307 - RNA, 23 nt, Bordetella pertussis
gcaacuccacgcccugcaccguc

SEQ ID NO: 2428308 - RNA, 17 nt, Bordetella pertussis
gcaacucggccaccugg

SEQ ID NO: 2428309 - RNA, 16 nt, Bordetella pertussis
gcaacucuuccccguc

SEQ ID NO: 2428310 - RNA, 14 nt, Bordetella pertussis
gcaacugguuggcc

SEQ ID NO: 2428311 - RNA, 17 nt, Bordetella pertussis
gcaagaaucgacucggc

SEQ ID NO: 2428312 - RNA, 16 nt, Bordetella pertussis
gcaagacgcccaggcc

SEQ ID NO: 2428313 - RNA, 17 nt, Bordetella pertussis
gcaagacgcggcagggc

SEQ ID NO: 2428314 - RNA, 15 nt, Bordetella pertussis
gcaagaucgccggcu

SEQ ID NO: 2428315 - RNA, 14 nt, Bordetella pertussis
gcaagaugccggcc

SEQ ID NO: 2428316 - RNA, 20 nt, Bordetella pertussis
gcaagauuucauggcgucug

SEQ ID NO: 2428317 - RNA, 16 nt, Bordetella pertussis
gcaagcaagccccagg

SEQ ID NO: 2428318 - RNA, 17 nt, Bordetella pertussis
gcaagcagcgagagcgc

SEQ ID NO: 2428319 - RNA, 18 nt, Bordetella pertussis
gcaagcagggaugccggu

SEQ ID NO: 2428320 - RNA, 20 nt, Bordetella pertussis
gcaagcauuugcgcgacggc

SEQ ID NO: 2428321 - RNA, 21 nt, Bordetella pertussis
gcaagccagcacguaaucgaa

SEQ ID NO: 2428322 - RNA, 12 nt, Bordetella pertussis
gcaagccagggc

SEQ ID NO: 2428323 - RNA, 16 nt, Bordetella pertussis
gcaagccagggcagga

SEQ ID NO: 2428324 - RNA, 13 nt, Bordetella pertussis
gcaagcccaccgg

SEQ ID NO: 2428325 - RNA, 16 nt, Bordetella pertussis
gcaagcccaccgggcc

SEQ ID NO: 2428326 - RNA, 19 nt, Bordetella pertussis
gcaagcccaccgggccggc

SEQ ID NO: 2428327 - RNA, 20 nt, Bordetella pertussis
gcaagcccaccgggccggcc

SEQ ID NO: 2428328 - RNA, 21 nt, Bordetella pertussis
gcaagcccaccgggccggccu

SEQ ID NO: 2428329 - RNA, 14 nt, Bordetella pertussis
gcaagccccaggca

SEQ ID NO: 2428330 - RNA, 15 nt, Bordetella pertussis
gcaagccccaggcag

SEQ ID NO: 2428331 - RNA, 14 nt, Bordetella pertussis
gcaagccgauccgc

SEQ ID NO: 2428332 - RNA, 15 nt, Bordetella pertussis
gcaagccgcccgcgg

SEQ ID NO: 2428333 - RNA, 16 nt, Bordetella pertussis
gcaagccgcccgcggc

SEQ ID NO: 2428334 - RNA, 15 nt, Bordetella pertussis
gcaagccggccgcgc

SEQ ID NO: 2428335 - RNA, 18 nt, Bordetella pertussis
gcaagccggccgcgcggc

SEQ ID NO: 2428336 - RNA, 17 nt, Bordetella pertussis
gcaagccuugcggcccu

SEQ ID NO: 2428337 - RNA, 15 nt, Bordetella pertussis
gcaagcgcucggcca

SEQ ID NO: 2428338 - RNA, 15 nt, Bordetella pertussis
gcaagcgcuggaugg

SEQ ID NO: 2428339 - RNA, 13 nt, Bordetella pertussis
gcaagcggccggc

SEQ ID NO: 2428340 - RNA, 16 nt, Bordetella pertussis
gcaagcggccggccug

SEQ ID NO: 2428341 - RNA, 17 nt, Bordetella pertussis
gcaagcggcguggggcc

SEQ ID NO: 2428342 - RNA, 20 nt, Bordetella pertussis
gcaagcggcguggggccggc

SEQ ID NO: 2428343 - RNA, 20 nt, Bordetella pertussis
gcaagcguacguaccaggcc

SEQ ID NO: 2428344 - RNA, 14 nt, Bordetella pertussis
gcaagcugcugcug

SEQ ID NO: 2428345 - RNA, 18 nt, Bordetella pertussis
gcaagcugcuggcgcgcc

SEQ ID NO: 2428346 - RNA, 23 nt, Bordetella pertussis
gcaagcugcuggcgcgccaggcg

SEQ ID NO: 2428347 - RNA, 14 nt, Bordetella pertussis
gcaagcuggcggcg

SEQ ID NO: 2428348 - RNA, 20 nt, Bordetella pertussis
gcaagcuggcggcgcgcggc

SEQ ID NO: 2428349 - RNA, 21 nt, Bordetella pertussis
gcaagcuggcggcgcgcggcu

SEQ ID NO: 2428350 - RNA, 17 nt, Bordetella pertussis
gcaaggaaguggccgag

SEQ ID NO: 2428351 - RNA, 19 nt, Bordetella pertussis
gcaaggaaguggccgagcg

SEQ ID NO: 2428352 - RNA, 14 nt, Bordetella pertussis
gcaaggacaaggcg

SEQ ID NO: 2428353 - RNA, 18 nt, Bordetella pertussis
gcaaggcaugcgccagcg

SEQ ID NO: 2428354 - RNA, 19 nt, Bordetella pertussis
gcaaggcaugcgccagcgc

SEQ ID NO: 2428355 - RNA, 20 nt, Bordetella pertussis
gcaaggcaugcgccagcgcc

SEQ ID NO: 2428356 - RNA, 17 nt, Bordetella pertussis
gcaaggcccgccgcggc

SEQ ID NO: 2428357 - RNA, 21 nt, Bordetella pertussis
gcaaggcccgccgcggcaggc

SEQ ID NO: 2428358 - RNA, 22 nt, Bordetella pertussis
gcaaggcccgccgcggcaggcc

SEQ ID NO: 2428359 - RNA, 12 nt, Bordetella pertussis
gcaaggccgcga

SEQ ID NO: 2428360 - RNA, 20 nt, Bordetella pertussis
gcaaggccgcgaacgcgccg

SEQ ID NO: 2428361 - RNA, 15 nt, Bordetella pertussis
gcaaggccggcggca

SEQ ID NO: 2428362 - RNA, 21 nt, Bordetella pertussis
gcaaggccggcggcacgcugc

SEQ ID NO: 2428363 - RNA, 18 nt, Bordetella pertussis
gcaaggccugcucgggcg

SEQ ID NO: 2428364 - RNA, 14 nt, Bordetella pertussis
gcaaggcgcgccac

SEQ ID NO: 2428365 - RNA, 17 nt, Bordetella pertussis
gcaaggcggcaaacccg

SEQ ID NO: 2428366 - RNA, 14 nt, Bordetella pertussis
gcaaggcggcccgg

SEQ ID NO: 2428367 - RNA, 15 nt, Bordetella pertussis
gcaaggcggcccggc

SEQ ID NO: 2428368 - RNA, 16 nt, Bordetella pertussis
gcaaggcggcccggcc

SEQ ID NO: 2428369 - RNA, 18 nt, Bordetella pertussis
gcaaggcggcccggccgc

SEQ ID NO: 2428370 - RNA, 18 nt, Bordetella pertussis
gcaaggcgggcuggucgc

SEQ ID NO: 2428371 - RNA, 17 nt, Bordetella pertussis
gcaaggcgucggccagg

SEQ ID NO: 2428372 - RNA, 20 nt, Bordetella pertussis
gcaaggcgucggccaggccg

SEQ ID NO: 2428373 - RNA, 12 nt, Bordetella pertussis
gcaagggccaga

SEQ ID NO: 2428374 - RNA, 15 nt, Bordetella pertussis
gcaagggccccagca

SEQ ID NO: 2428375 - RNA, 22 nt, Bordetella pertussis
gcaagggccccccggcgcggcc

SEQ ID NO: 2428376 - RNA, 23 nt, Bordetella pertussis
gcaagggccccccggcgcggccg

SEQ ID NO: 2428377 - RNA, 14 nt, Bordetella pertussis
gcaaggggccagcc

SEQ ID NO: 2428378 - RNA, 21 nt, Bordetella pertussis
gcaaggggccagccuggcgcc

SEQ ID NO: 2428379 - RNA, 17 nt, Bordetella pertussis
gcaaggggccggcgccg

SEQ ID NO: 2428380 - RNA, 16 nt, Bordetella pertussis
gcaagggggacuggca

SEQ ID NO: 2428381 - RNA, 22 nt, Bordetella pertussis
gcaagggggacuggcaccggca

SEQ ID NO: 2428382 - RNA, 17 nt, Bordetella pertussis
gcaagggguccguggcg

SEQ ID NO: 2428383 - RNA, 23 nt, Bordetella pertussis
gcaagguagccgaugaccggcca

SEQ ID NO: 2428384 - RNA, 19 nt, Bordetella pertussis
gcaagguccaggcgcgcaa

SEQ ID NO: 2428385 - RNA, 13 nt, Bordetella pertussis
gcaaggugaucga

SEQ ID NO: 2428386 - RNA, 17 nt, Bordetella pertussis
gcaagguggcgugcagc

SEQ ID NO: 2428387 - RNA, 20 nt, Bordetella pertussis
gcaagguggcgugcagcagg

SEQ ID NO: 2428388 - RNA, 15 nt, Bordetella pertussis
gcaagucagcccgcg

SEQ ID NO: 2428389 - RNA, 17 nt, Bordetella pertussis
gcaagucagcccgcguc

SEQ ID NO: 2428390 - RNA, 18 nt, Bordetella pertussis
gcaaguccagcgugguga

SEQ ID NO: 2428391 - RNA, 16 nt, Bordetella pertussis
gcaagucgacgcugau

SEQ ID NO: 2428392 - RNA, 23 nt, Bordetella pertussis
gcacauggcgcgccggccggugg

SEQ ID NO: 2428393 - RNA, 17 nt, Bordetella pertussis
gcacauugccguacgcc

SEQ ID NO: 2428394 - RNA, 19 nt, Bordetella pertussis
gcacauuggaguaguggcc

SEQ ID NO: 2428395 - RNA, 19 nt, Bordetella pertussis
gcaccaaucuugccaggcc

SEQ ID NO: 2428396 - RNA, 22 nt, Bordetella pertussis
gcaccaaucuugccaggcccgg

SEQ ID NO: 2428397 - RNA, 13 nt, Bordetella pertussis
gcaccacaucgcc

SEQ ID NO: 2428398 - RNA, 14 nt, Bordetella pertussis
gcaccacaucgccg

SEQ ID NO: 2428399 - RNA, 16 nt, Bordetella pertussis
gcaccacaucgccggc

SEQ ID NO: 2428400 - RNA, 17 nt, Bordetella pertussis
gcaccacaucgccggcg

SEQ ID NO: 2428401 - RNA, 19 nt, Bordetella pertussis
gcaccacaucgccggcggc

SEQ ID NO: 2428402 - RNA, 18 nt, Bordetella pertussis
gcaccaccaccaugugcu

SEQ ID NO: 2428403 - RNA, 14 nt, Bordetella pertussis
gcaccaccaccgcc

SEQ ID NO: 2428404 - RNA, 15 nt, Bordetella pertussis
gcaccaccagcaccg

SEQ ID NO: 2428405 - RNA, 22 nt, Bordetella pertussis
gcaccaccagcaccgccacgcg

SEQ ID NO: 2428406 - RNA, 12 nt, Bordetella pertussis
gcaccaccuggc

SEQ ID NO: 2428407 - RNA, 15 nt, Bordetella pertussis
gcaccacgaccggcu

SEQ ID NO: 2428408 - RNA, 13 nt, Bordetella pertussis
gcaccacgcgcuc

SEQ ID NO: 2428409 - RNA, 15 nt, Bordetella pertussis
gcaccacgcgcucca

SEQ ID NO: 2428410 - RNA, 16 nt, Bordetella pertussis
gcaccacgcgcuccau

SEQ ID NO: 2428411 - RNA, 19 nt, Bordetella pertussis
gcaccacggcaucggcgcc

SEQ ID NO: 2428412 - RNA, 20 nt, Bordetella pertussis
gcaccacggcaucggcgccg

SEQ ID NO: 2428413 - RNA, 17 nt, Bordetella pertussis
gcaccacggcggccagg

SEQ ID NO: 2428414 - RNA, 20 nt, Bordetella pertussis
gcaccacgggcucgcugacc

SEQ ID NO: 2428415 - RNA, 17 nt, Bordetella pertussis
gcaccagcacaucgacg

SEQ ID NO: 2428416 - RNA, 20 nt, Bordetella pertussis
gcaccagcacaucgacgucg

SEQ ID NO: 2428417 - RNA, 19 nt, Bordetella pertussis
gcaccagcagccccagcgu

SEQ ID NO: 2428418 - RNA, 20 nt, Bordetella pertussis
gcaccagcagccccagcguc

SEQ ID NO: 2428419 - RNA, 11 nt, Bordetella pertussis
gcaccagcagg

SEQ ID NO: 2428420 - RNA, 16 nt, Bordetella pertussis
gcaccagcaggccggu

SEQ ID NO: 2428421 - RNA, 22 nt, Bordetella pertussis
gcaccagccauucgauggcggc

SEQ ID NO: 2428422 - RNA, 14 nt, Bordetella pertussis
gcaccagcccgaug

SEQ ID NO: 2428423 - RNA, 22 nt, Bordetella pertussis
gcaccagcccgaugcgccaggc

SEQ ID NO: 2428424 - RNA, 14 nt, Bordetella pertussis
gcaccagccgggcu

SEQ ID NO: 2428425 - RNA, 16 nt, Bordetella pertussis
gcaccagcgaggcggc

SEQ ID NO: 2428426 - RNA, 21 nt, Bordetella pertussis
gcaccagcgcauugccgccgc

SEQ ID NO: 2428427 - RNA, 14 nt, Bordetella pertussis
gcaccagcgccacg

SEQ ID NO: 2428428 - RNA, 14 nt, Bordetella pertussis
gcaccagcgccgac

SEQ ID NO: 2428429 - RNA, 12 nt, Bordetella pertussis
gcaccagcgcgc

SEQ ID NO: 2428430 - RNA, 14 nt, Bordetella pertussis
gcaccagcgcgccg

SEQ ID NO: 2428431 - RNA, 16 nt, Bordetella pertussis
gcaccagcgcgccgau

SEQ ID NO: 2428432 - RNA, 15 nt, Bordetella pertussis
gcaccagcgcgccgc

SEQ ID NO: 2428433 - RNA, 23 nt, Bordetella pertussis
gcaccagcgcgccgcgcgcggcg

SEQ ID NO: 2428434 - RNA, 16 nt, Bordetella pertussis
gcaccagcuuggccug

SEQ ID NO: 2428435 - RNA, 21 nt, Bordetella pertussis
gcaccagcuuggccugcggau

SEQ ID NO: 2428436 - RNA, 18 nt, Bordetella pertussis
gcaccaggaacagcaacg

SEQ ID NO: 2428437 - RNA, 20 nt, Bordetella pertussis
gcaccaggauccccagcaca

SEQ ID NO: 2428438 - RNA, 16 nt, Bordetella pertussis
gcaccaggauuccugc

SEQ ID NO: 2428439 - RNA, 23 nt, Bordetella pertussis
gcaccaggauuccugcgaggaca

SEQ ID NO: 2428440 - RNA, 18 nt, Bordetella pertussis
gcaccaggccacccgccg

SEQ ID NO: 2428441 - RNA, 22 nt, Bordetella pertussis
gcaccaggccacccgccguacc

SEQ ID NO: 2428442 - RNA, 13 nt, Bordetella pertussis
gcaccaggcccau

SEQ ID NO: 2428443 - RNA, 14 nt, Bordetella pertussis
gcaccaggcccaug

SEQ ID NO: 2428444 - RNA, 18 nt, Bordetella pertussis
gcaccaggcccaugaagg

SEQ ID NO: 2428445 - RNA, 20 nt, Bordetella pertussis
gcaccaggccgaacuucagc

SEQ ID NO: 2428446 - RNA, 18 nt, Bordetella pertussis
gcaccaggccgccggcca

SEQ ID NO: 2428447 - RNA, 21 nt, Bordetella pertussis
gcaccaggccgccggccagcg

SEQ ID NO: 2428448 - RNA, 22 nt, Bordetella pertussis
gcaccaggccgccggccagcgc

SEQ ID NO: 2428449 - RNA, 13 nt, Bordetella pertussis
gcaccaggccgcg

SEQ ID NO: 2428450 - RNA, 16 nt, Bordetella pertussis
gcaccaggccgcggcg

SEQ ID NO: 2428451 - RNA, 18 nt, Bordetella pertussis
gcaccaggccugccugau

SEQ ID NO: 2428452 - RNA, 19 nt, Bordetella pertussis
gcaccaggcgcacggcggc

SEQ ID NO: 2428453 - RNA, 14 nt, Bordetella pertussis
gcaccaggcgcggc

SEQ ID NO: 2428454 - RNA, 15 nt, Bordetella pertussis
gcaccaggcgcggcg

SEQ ID NO: 2428455 - RNA, 18 nt, Bordetella pertussis
gcaccaggcgcggcguau

SEQ ID NO: 2428456 - RNA, 14 nt, Bordetella pertussis
gcaccaggcgcucg

SEQ ID NO: 2428457 - RNA, 16 nt, Bordetella pertussis
gcaccaggcgcucgcg

SEQ ID NO: 2428458 - RNA, 20 nt, Bordetella pertussis
gcaccaggcuggggccgagc

SEQ ID NO: 2428459 - RNA, 23 nt, Bordetella pertussis
gcaccaggcuuugcgcgccaugc

SEQ ID NO: 2428460 - RNA, 17 nt, Bordetella pertussis
gcaccagggcgcgcagc

SEQ ID NO: 2428461 - RNA, 20 nt, Bordetella pertussis
gcaccagggcgcgcagcagg

SEQ ID NO: 2428462 - RNA, 22 nt, Bordetella pertussis
gcaccagggcgcgcagcaggcc

SEQ ID NO: 2428463 - RNA, 21 nt, Bordetella pertussis
gcaccagguccuggcggccgc

SEQ ID NO: 2428464 - RNA, 20 nt, Bordetella pertussis
gcaccagguugcauccggcc

SEQ ID NO: 2428465 - RNA, 22 nt, Bordetella pertussis
gcaccagguugcauccggcccg

SEQ ID NO: 2428466 - RNA, 20 nt, Bordetella pertussis
gcaccagguuggcgauggcg

SEQ ID NO: 2428467 - RNA, 16 nt, Bordetella pertussis
gcaccagucccgcacc

SEQ ID NO: 2428468 - RNA, 16 nt, Bordetella pertussis
gcaccagugcgccggc

SEQ ID NO: 2428469 - RNA, 18 nt, Bordetella pertussis
gcaccagugcgccggcgc

SEQ ID NO: 2428470 - RNA, 21 nt, Bordetella pertussis
gcaccagugcgccggcgcggc

SEQ ID NO: 2428471 - RNA, 20 nt, Bordetella pertussis
gcaccaguuucucggccacu

SEQ ID NO: 2428472 - RNA, 21 nt, Bordetella pertussis
gcaccaguuucucggccacuu

SEQ ID NO: 2428473 - RNA, 20 nt, Bordetella pertussis
gcaccaguuuucucauggcc

SEQ ID NO: 2428474 - RNA, 22 nt, Bordetella pertussis
gcaccaguuuucucauggccgc

SEQ ID NO: 2428475 - RNA, 14 nt, Bordetella pertussis
gcaccaucgccgcc

SEQ ID NO: 2428476 - RNA, 16 nt, Bordetella pertussis
gcaccaucgccgccug

SEQ ID NO: 2428477 - RNA, 16 nt, Bordetella pertussis
gcaccaugccgauggc

SEQ ID NO: 2428478 - RNA, 17 nt, Bordetella pertussis
gcaccaugccgauggcg

SEQ ID NO: 2428479 - RNA, 19 nt, Bordetella pertussis
gcaccaugccgauggcggu

SEQ ID NO: 2428480 - RNA, 14 nt, Bordetella pertussis
gcaccaugccgggg

SEQ ID NO: 2428481 - RNA, 19 nt, Bordetella pertussis
gcaccaugcgcaccaggcg

SEQ ID NO: 2428482 - RNA, 16 nt, Bordetella pertussis
gcaccaugcgcagcaa

SEQ ID NO: 2428483 - RNA, 18 nt, Bordetella pertussis
gcaccaugcgcagcaaca

SEQ ID NO: 2428484 - RNA, 19 nt, Bordetella pertussis
gcaccauggcgcccacggc

SEQ ID NO: 2428485 - RNA, 23 nt, Bordetella pertussis
gcaccaugggcucgugcagcagg

SEQ ID NO: 2428486 - RNA, 23 nt, Bordetella pertussis
gcaccaugugcgagagcuccagc

SEQ ID NO: 2428487 - RNA, 15 nt, Bordetella pertussis
gcaccauugccggcg

SEQ ID NO: 2428488 - RNA, 18 nt, Bordetella pertussis
gcaccauugccggcgcgc

SEQ ID NO: 2428489 - RNA, 20 nt, Bordetella pertussis
gcacccacacuuggccggcg

SEQ ID NO: 2428490 - RNA, 13 nt, Bordetella pertussis
gcacccagccgga

SEQ ID NO: 2428491 - RNA, 21 nt, Bordetella pertussis
gcacccagccggacccgcgcc

SEQ ID NO: 2428492 - RNA, 22 nt, Bordetella pertussis
gcacccagccggacccgcgccg

SEQ ID NO: 2428493 - RNA, 12 nt, Bordetella pertussis
gcacccaggcgc

SEQ ID NO: 2428494 - RNA, 16 nt, Bordetella pertussis
gcacccaggcgccgau

SEQ ID NO: 2428495 - RNA, 13 nt, Bordetella pertussis
gcacccaggcggg

SEQ ID NO: 2428496 - RNA, 18 nt, Bordetella pertussis
gcacccaggcgggcuggc

SEQ ID NO: 2428497 - RNA, 19 nt, Bordetella pertussis
gcacccaggcgggcuggcg

SEQ ID NO: 2428498 - RNA, 20 nt, Bordetella pertussis
gcacccaggcgggcuggcgu

SEQ ID NO: 2428499 - RNA, 13 nt, Bordetella pertussis
gcaccccagcacc

SEQ ID NO: 2428500 - RNA, 14 nt, Bordetella pertussis
gcaccccagcaccc

SEQ ID NO: 2428501 - RNA, 19 nt, Bordetella pertussis
gcaccccagcaccccgucg

SEQ ID NO: 2428502 - RNA, 17 nt, Bordetella pertussis
gcacccccgaccgagcc

SEQ ID NO: 2428503 - RNA, 16 nt, Bordetella pertussis
gcaccccggcgccgcg

SEQ ID NO: 2428504 - RNA, 18 nt, Bordetella pertussis
gcaccccggcgccgcguu

SEQ ID NO: 2428505 - RNA, 17 nt, Bordetella pertussis
gcaccggggcagggcgg

SEQ ID NO: 2428506 - RNA, 22 nt, Bordetella pertussis
gcaccggguaauggcgcuccag

SEQ ID NO: 2428507 - RNA, 23 nt, Bordetella pertussis
gcaccggguaauggcgcuccagc

SEQ ID NO: 2428508 - RNA, 21 nt, Bordetella pertussis
gcaccguauccucgaucagcg

SEQ ID NO: 2428509 - RNA, 13 nt, Bordetella pertussis
gcaccgucacgcg

SEQ ID NO: 2428510 - RNA, 21 nt, Bordetella pertussis
gcaccgucacgcgcuccagcg

SEQ ID NO: 2428511 - RNA, 12 nt, Bordetella pertussis
gcaccguccagc

SEQ ID NO: 2428512 - RNA, 18 nt, Bordetella pertussis
gcaccgucgccagggcga

SEQ ID NO: 2428513 - RNA, 19 nt, Bordetella pertussis
gcaccgugaugcgcgccgc

SEQ ID NO: 2428514 - RNA, 20 nt, Bordetella pertussis
gcaccgugaugcgcgccgcu

SEQ ID NO: 2428515 - RNA, 22 nt, Bordetella pertussis
gcaccgugaugcgcgccgcucu

SEQ ID NO: 2428516 - RNA, 23 nt, Bordetella pertussis
gcaccgugaugcgcgccgcucuu

SEQ ID NO: 2428517 - RNA, 20 nt, Bordetella pertussis
gcaccucacggugaccgggu

SEQ ID NO: 2428518 - RNA, 17 nt, Bordetella pertussis
gcaccucgacgcagccu

SEQ ID NO: 2428519 - RNA, 21 nt, Bordetella pertussis
gcaccucggacgagacaggcg

SEQ ID NO: 2428520 - RNA, 13 nt, Bordetella pertussis
gcaccucggccgg

SEQ ID NO: 2428521 - RNA, 14 nt, Bordetella pertussis
gcaccucggccggg

SEQ ID NO: 2428522 - RNA, 22 nt, Bordetella pertussis
gcaccucggccggggcggucaa

SEQ ID NO: 2428523 - RNA, 12 nt, Bordetella pertussis
gcaccucggcgc

SEQ ID NO: 2428524 - RNA, 13 nt, Bordetella pertussis
gcaccucggcgcc

SEQ ID NO: 2428525 - RNA, 14 nt, Bordetella pertussis
gcaccucggcgccc

SEQ ID NO: 2428526 - RNA, 18 nt, Bordetella pertussis
gcaccucggcgcccagcu

SEQ ID NO: 2428527 - RNA, 21 nt, Bordetella pertussis
gcaccucggcgcccagcugcu

SEQ ID NO: 2428528 - RNA, 16 nt, Bordetella pertussis
gcaccucggcgccgcg

SEQ ID NO: 2428529 - RNA, 19 nt, Bordetella pertussis
gcaccucggcgccgcggcg

SEQ ID NO: 2428530 - RNA, 20 nt, Bordetella pertussis
gcaccucggcguggcgggga

SEQ ID NO: 2428531 - RNA, 19 nt, Bordetella pertussis
gcaccucggggcgcggccg

SEQ ID NO: 2428532 - RNA, 20 nt, Bordetella pertussis
gcaccucggggcgcggccgg

SEQ ID NO: 2428533 - RNA, 15 nt, Bordetella pertussis
gcaccucggggugca

SEQ ID NO: 2428534 - RNA, 19 nt, Bordetella pertussis
gcaccucguaaguggcggc

SEQ ID NO: 2428535 - RNA, 20 nt, Bordetella pertussis
gcaccucguaaguggcggcg

SEQ ID NO: 2428536 - RNA, 16 nt, Bordetella pertussis
gcaccugaacaccggc

SEQ ID NO: 2428537 - RNA, 17 nt, Bordetella pertussis
gcaccugaacaccggcg

SEQ ID NO: 2428538 - RNA, 21 nt, Bordetella pertussis
gcaccugaacaccggcgcgcc

SEQ ID NO: 2428539 - RNA, 22 nt, Bordetella pertussis
gcaccugaacaccggcgcgccu

SEQ ID NO: 2428540 - RNA, 23 nt, Bordetella pertussis
gcaccugaacaccggcgcgccug

SEQ ID NO: 2428541 - RNA, 23 nt, Bordetella pertussis
gcaccugcaagauuucauggcgu

SEQ ID NO: 2428542 - RNA, 18 nt, Bordetella pertussis
gcaccugcaggccgccgg

SEQ ID NO: 2428543 - RNA, 19 nt, Bordetella pertussis
gcaccugcaggccgccggc

SEQ ID NO: 2428544 - RNA, 22 nt, Bordetella pertussis
gcaccugcaggccgccggccag

SEQ ID NO: 2428545 - RNA, 18 nt, Bordetella pertussis
gcaccugcagggucagcc

SEQ ID NO: 2428546 - RNA, 21 nt, Bordetella pertussis
gcaccugcagggucagcccgc

SEQ ID NO: 2428547 - RNA, 13 nt, Bordetella pertussis
gcaccugccgacu

SEQ ID NO: 2428548 - RNA, 14 nt, Bordetella pertussis
gcaccugccgacuu

SEQ ID NO: 2428549 - RNA, 13 nt, Bordetella pertussis
gcaccugccugcc

SEQ ID NO: 2428550 - RNA, 17 nt, Bordetella pertussis
gcaccugccugccgccu

SEQ ID NO: 2428551 - RNA, 18 nt, Bordetella pertussis
gcaccugccugccgccug

SEQ ID NO: 2428552 - RNA, 19 nt, Bordetella pertussis
gcaccugccugccgccugc

SEQ ID NO: 2428553 - RNA, 17 nt, Bordetella pertussis
gcaccugcgaccgagcc

SEQ ID NO: 2428554 - RNA, 17 nt, Bordetella pertussis
gcaccugcgucugcacg

SEQ ID NO: 2428555 - RNA, 15 nt, Bordetella pertussis
gcaccugcugcggca

SEQ ID NO: 2428556 - RNA, 15 nt, Bordetella pertussis
gcaccugcuugagca

SEQ ID NO: 2428557 - RNA, 13 nt, Bordetella pertussis
gcaccugggaggg

SEQ ID NO: 2428558 - RNA, 20 nt, Bordetella pertussis
gcaccugggaggggccggcu

SEQ ID NO: 2428559 - RNA, 21 nt, Bordetella pertussis
gcaccugggaggggccggcuu

SEQ ID NO: 2428560 - RNA, 17 nt, Bordetella pertussis
gcaccugggcgucgauc

SEQ ID NO: 2428561 - RNA, 18 nt, Bordetella pertussis
gcaccugguggcgcuggc

SEQ ID NO: 2428562 - RNA, 16 nt, Bordetella pertussis
gcaccuguucggcggc

SEQ ID NO: 2428563 - RNA, 21 nt, Bordetella pertussis
gcaccuguucggcggcgccca

SEQ ID NO: 2428564 - RNA, 22 nt, Bordetella pertussis
gcaccuguucggcggcgcccau

SEQ ID NO: 2428565 - RNA, 13 nt, Bordetella pertussis
gcaccuucgcgca

SEQ ID NO: 2428566 - RNA, 15 nt, Bordetella pertussis
gcaccuucgcgcagc

SEQ ID NO: 2428567 - RNA, 17 nt, Bordetella pertussis
gcaccuucgcgcagcgg

SEQ ID NO: 2428568 - RNA, 18 nt, Bordetella pertussis
gcaccuucgcgcagcggc

SEQ ID NO: 2428569 - RNA, 21 nt, Bordetella pertussis
gcaccuucugccgccaggcau

SEQ ID NO: 2428570 - RNA, 20 nt, Bordetella pertussis
gcaccuugaccuggucggcc

SEQ ID NO: 2428571 - RNA, 15 nt, Bordetella pertussis
gcaccuuggcccggc

SEQ ID NO: 2428572 - RNA, 21 nt, Bordetella pertussis
gcaccuuguacuggucgcgca

SEQ ID NO: 2428573 - RNA, 18 nt, Bordetella pertussis
gcaccuuucugcugcucg

SEQ ID NO: 2428574 - RNA, 18 nt, Bordetella pertussis
gcaccuuuuuccuugcgg

SEQ ID NO: 2428575 - RNA, 18 nt, Bordetella pertussis
gcacgaaaagccgcggcc

SEQ ID NO: 2428576 - RNA, 20 nt, Bordetella pertussis
gcacgaaaagccgcggccgc

SEQ ID NO: 2428577 - RNA, 14 nt, Bordetella pertussis
gcacgaaccacagg

SEQ ID NO: 2428578 - RNA, 20 nt, Bordetella pertussis
gcacgaacgacacccggucg

SEQ ID NO: 2428579 - RNA, 15 nt, Bordetella pertussis
gcacgaagcggaugc

SEQ ID NO: 2428580 - RNA, 16 nt, Bordetella pertussis
gcacgaagcggcaucg

SEQ ID NO: 2428581 - RNA, 15 nt, Bordetella pertussis
gcacgaagggcagca

SEQ ID NO: 2428582 - RNA, 17 nt, Bordetella pertussis
gcacgaagggcagcagc

SEQ ID NO: 2428583 - RNA, 22 nt, Bordetella pertussis
gcacgaaguacucgccggcgcu

SEQ ID NO: 2428584 - RNA, 23 nt, Bordetella pertussis
gcacgacagcaucuuggccgcca

SEQ ID NO: 2428585 - RNA, 15 nt, Bordetella pertussis
gcacgaccaggccgu

SEQ ID NO: 2428586 - RNA, 18 nt, Bordetella pertussis
gcacgaccaggccguggc

SEQ ID NO: 2428587 - RNA, 22 nt, Bordetella pertussis
gcacgaccaggccguggcccag

SEQ ID NO: 2428588 - RNA, 14 nt, Bordetella pertussis
gcacgaccugcgca

SEQ ID NO: 2428589 - RNA, 15 nt, Bordetella pertussis
gcacgaccugcgcau

SEQ ID NO: 2428590 - RNA, 14 nt, Bordetella pertussis
gcacgacgacggcc

SEQ ID NO: 2428591 - RNA, 16 nt, Bordetella pertussis
gcacgacgacggccgg

SEQ ID NO: 2428592 - RNA, 14 nt, Bordetella pertussis
gcacgacgaucggc

SEQ ID NO: 2428593 - RNA, 15 nt, Bordetella pertussis
gcacgacgcugaugc

SEQ ID NO: 2428594 - RNA, 16 nt, Bordetella pertussis
gcacgacgucgcgcgg

SEQ ID NO: 2428595 - RNA, 18 nt, Bordetella pertussis
gcacgacgucgcgcggau

SEQ ID NO: 2428596 - RNA, 15 nt, Bordetella pertussis
gcacgacgucgucgg

SEQ ID NO: 2428597 - RNA, 22 nt, Bordetella pertussis
gcacgacguggccuaccacgca

SEQ ID NO: 2428598 - RNA, 17 nt, Bordetella pertussis
gcacgacuacggcggac

SEQ ID NO: 2428599 - RNA, 22 nt, Bordetella pertussis
gcacgacuacggcggacuggcc

SEQ ID NO: 2428600 - RNA, 15 nt, Bordetella pertussis
gcacgagaucgccug

SEQ ID NO: 2428601 - RNA, 19 nt, Bordetella pertussis
gcacgagauguccauggcc

SEQ ID NO: 2428602 - RNA, 18 nt, Bordetella pertussis
gcacgaggcgcucggccu

SEQ ID NO: 2428603 - RNA, 17 nt, Bordetella pertussis
gcacgauauuggcgucg

SEQ ID NO: 2428604 - RNA, 19 nt, Bordetella pertussis
gcacgauauuggcgucggc

SEQ ID NO: 2428605 - RNA, 19 nt, Bordetella pertussis
gcacgaucaccgccgcggc

SEQ ID NO: 2428606 - RNA, 20 nt, Bordetella pertussis
gcacgaucaccgccgcggcg

SEQ ID NO: 2428607 - RNA, 17 nt, Bordetella pertussis
gcacgaucacgaacagc

SEQ ID NO: 2428608 - RNA, 15 nt, Bordetella pertussis
gcacgauccagccgu

SEQ ID NO: 2428609 - RNA, 16 nt, Bordetella pertussis
gcacgaucgcgccggc

SEQ ID NO: 2428610 - RNA, 17 nt, Bordetella pertussis
gcacgaucgcgccggcc

SEQ ID NO: 2428611 - RNA, 20 nt, Bordetella pertussis
gcacgaucgcgccggccugg

SEQ ID NO: 2428612 - RNA, 14 nt, Bordetella pertussis
gcacgaucgcggcg

SEQ ID NO: 2428613 - RNA, 18 nt, Bordetella pertussis
gcacgaucgcggcgcugg

SEQ ID NO: 2428614 - RNA, 19 nt, Bordetella pertussis
gcacgaucgcggcgcuggc

SEQ ID NO: 2428615 - RNA, 18 nt, Bordetella pertussis
gcacgaucggcgccuggc

SEQ ID NO: 2428616 - RNA, 15 nt, Bordetella pertussis
gcacgaucuggcgcg

SEQ ID NO: 2428617 - RNA, 15 nt, Bordetella pertussis
gcacgcggcgcagca

SEQ ID NO: 2428618 - RNA, 15 nt, Bordetella pertussis
gcacgcggcgcggca

SEQ ID NO: 2428619 - RNA, 17 nt, Bordetella pertussis
gcacgcggcgcggcagg

SEQ ID NO: 2428620 - RNA, 14 nt, Bordetella pertussis
gcacgcggcuucgc

SEQ ID NO: 2428621 - RNA, 15 nt, Bordetella pertussis
gcacgcgggcgcuga

SEQ ID NO: 2428622 - RNA, 17 nt, Bordetella pertussis
gcacgcgggcgcugacg

SEQ ID NO: 2428623 - RNA, 18 nt, Bordetella pertussis
gcacgcgggcgcugacgc

SEQ ID NO: 2428624 - RNA, 16 nt, Bordetella pertussis
gcacgcgguccacgcc

SEQ ID NO: 2428625 - RNA, 19 nt, Bordetella pertussis
gcacgcgguccacgccggg

SEQ ID NO: 2428626 - RNA, 17 nt, Bordetella pertussis
gcacgcguaugcccugc

SEQ ID NO: 2428627 - RNA, 17 nt, Bordetella pertussis
gcacgcguucgggcggc

SEQ ID NO: 2428628 - RNA, 18 nt, Bordetella pertussis
gcacgcguucgggcggca

SEQ ID NO: 2428629 - RNA, 15 nt, Bordetella pertussis
gcacgcucagcaugc

SEQ ID NO: 2428630 - RNA, 19 nt, Bordetella pertussis
gcacgcucagcaugcgcug

SEQ ID NO: 2428631 - RNA, 22 nt, Bordetella pertussis
gcacgcucagcaugcgcugggc

SEQ ID NO: 2428632 - RNA, 17 nt, Bordetella pertussis
gcacgcucuacacggcc

SEQ ID NO: 2428633 - RNA, 18 nt, Bordetella pertussis
gcacgcucuacacggccg

SEQ ID NO: 2428634 - RNA, 19 nt, Bordetella pertussis
gcacgcucuacacggccgc

SEQ ID NO: 2428635 - RNA, 21 nt, Bordetella pertussis
gcacgcucuacacggccgcca

SEQ ID NO: 2428636 - RNA, 24 nt, Bordetella pertussis
gcacgcucugcaccuugggcgccu

SEQ ID NO: 2428637 - RNA, 20 nt, Bordetella pertussis
gcacgcucuugagcgcggcc

SEQ ID NO: 2428638 - RNA, 23 nt, Bordetella pertussis
gcacgcucuugagcgcggccucg

SEQ ID NO: 2428639 - RNA, 20 nt, Bordetella pertussis
gcacgcugaccgaagcgggc

SEQ ID NO: 2428640 - RNA, 18 nt, Bordetella pertussis
gcacgcugaucgccggcg

SEQ ID NO: 2428641 - RNA, 12 nt, Bordetella pertussis
gcacgcugcgca

SEQ ID NO: 2428642 - RNA, 16 nt, Bordetella pertussis
gcacgcugcgcaggcg

SEQ ID NO: 2428643 - RNA, 19 nt, Bordetella pertussis
gcacgcugcgcaggcgcgc

SEQ ID NO: 2428644 - RNA, 13 nt, Bordetella pertussis
gcacgcuggcgcc

SEQ ID NO: 2428645 - RNA, 16 nt, Bordetella pertussis
gcacgcuggcgcccgc

SEQ ID NO: 2428646 - RNA, 18 nt, Bordetella pertussis
gcacgcuggcgcccgccu

SEQ ID NO: 2428647 - RNA, 15 nt, Bordetella pertussis
gcacgcuggcguuga

SEQ ID NO: 2428648 - RNA, 21 nt, Bordetella pertussis
gcacgcuggcguugacguggc

SEQ ID NO: 2428649 - RNA, 22 nt, Bordetella pertussis
gcacgcugggcgaggcgcuggc

SEQ ID NO: 2428650 - RNA, 23 nt, Bordetella pertussis
gcacgcugggcgaggcgcuggcc

SEQ ID NO: 2428651 - RNA, 14 nt, Bordetella pertussis
gcacggacagcccg

SEQ ID NO: 2428652 - RNA, 17 nt, Bordetella pertussis
gcacggacagcccgcgc

SEQ ID NO: 2428653 - RNA, 22 nt, Bordetella pertussis
gcacggacagcccgcgcuggcg

SEQ ID NO: 2428654 - RNA, 17 nt, Bordetella pertussis
gcacggcaaaacggugc

SEQ ID NO: 2428655 - RNA, 20 nt, Bordetella pertussis
gcacggcacgccucgccggc

SEQ ID NO: 2428656 - RNA, 15 nt, Bordetella pertussis
gcacggccacggccg

SEQ ID NO: 2428657 - RNA, 14 nt, Bordetella pertussis
gcacggccagcacc

SEQ ID NO: 2428658 - RNA, 17 nt, Bordetella pertussis
gcacggccagcaccaug

SEQ ID NO: 2428659 - RNA, 22 nt, Bordetella pertussis
gcacggccagcaccaugggcuc

SEQ ID NO: 2428660 - RNA, 15 nt, Bordetella pertussis
gcacggccagcggcg

SEQ ID NO: 2428661 - RNA, 16 nt, Bordetella pertussis
gcacggccagcggcga

SEQ ID NO: 2428662 - RNA, 13 nt, Bordetella pertussis
gcacggccgcggc

SEQ ID NO: 2428663 - RNA, 17 nt, Bordetella pertussis
gcacggccgcggccggc

SEQ ID NO: 2428664 - RNA, 13 nt, Bordetella pertussis
gcacggccggcca

SEQ ID NO: 2428665 - RNA, 18 nt, Bordetella pertussis
gcacggccggccaggcgc

SEQ ID NO: 2428666 - RNA, 17 nt, Bordetella pertussis
gcacggccggccugcag

SEQ ID NO: 2428667 - RNA, 21 nt, Bordetella pertussis
gcacggccgucaacagcaugg

SEQ ID NO: 2428668 - RNA, 18 nt, Bordetella pertussis
gcacggccuugucgcgcc

SEQ ID NO: 2428669 - RNA, 17 nt, Bordetella pertussis
gcacggcgaugcugccg

SEQ ID NO: 2428670 - RNA, 23 nt, Bordetella pertussis
gcacggcgaugcugccgucgcca

SEQ ID NO: 2428671 - RNA, 15 nt, Bordetella pertussis
gcacggcgcacacca

SEQ ID NO: 2428672 - RNA, 19 nt, Bordetella pertussis
gcacggcgcacaccaucag

SEQ ID NO: 2428673 - RNA, 21 nt, Bordetella pertussis
gcacggcgcacaccaucagcu

SEQ ID NO: 2428674 - RNA, 14 nt, Bordetella pertussis
gcacggcgcccugc

SEQ ID NO: 2428675 - RNA, 13 nt, Bordetella pertussis
gcacggcgcggcu

SEQ ID NO: 2428676 - RNA, 14 nt, Bordetella pertussis
gcacggcgcggcug

SEQ ID NO: 2428677 - RNA, 15 nt, Bordetella pertussis
gcacggcggcgauca

SEQ ID NO: 2428678 - RNA, 13 nt, Bordetella pertussis
gcacggcguggcg

SEQ ID NO: 2428679 - RNA, 16 nt, Bordetella pertussis
gcacggcguggcgcgc

SEQ ID NO: 2428680 - RNA, 17 nt, Bordetella pertussis
gcacggcguggcgcgca

SEQ ID NO: 2428681 - RNA, 17 nt, Bordetella pertussis
gcacggcuugcgcgccu

SEQ ID NO: 2428682 - RNA, 19 nt, Bordetella pertussis
gcacgggcagacgccaucu

SEQ ID NO: 2428683 - RNA, 16 nt, Bordetella pertussis
gcacgggccgacggcc

SEQ ID NO: 2428684 - RNA, 20 nt, Bordetella pertussis
gcacgggccgacggccucgg

SEQ ID NO: 2428685 - RNA, 14 nt, Bordetella pertussis
gcacgggcgaggcg

SEQ ID NO: 2428686 - RNA, 17 nt, Bordetella pertussis
gcacgggcgagggcugc

SEQ ID NO: 2428687 - RNA, 14 nt, Bordetella pertussis
gcacgggcgccugu

SEQ ID NO: 2428688 - RNA, 13 nt, Bordetella pertussis
gcacgggcgcugc

SEQ ID NO: 2428689 - RNA, 18 nt, Bordetella pertussis
gcacgggcgcugcccagg

SEQ ID NO: 2428690 - RNA, 19 nt, Bordetella pertussis
gcacgggcgcugcccagga

SEQ ID NO: 2428691 - RNA, 12 nt, Bordetella pertussis
gcacggggacag

SEQ ID NO: 2428692 - RNA, 13 nt, Bordetella pertussis
gcacggggacagg

SEQ ID NO: 2428693 - RNA, 15 nt, Bordetella pertussis
gcacggggacaggca

SEQ ID NO: 2428694 - RNA, 16 nt, Bordetella pertussis
gcacggggacaggcac

SEQ ID NO: 2428695 - RNA, 15 nt, Bordetella pertussis
gcacggggacuggca

SEQ ID NO: 2428696 - RNA, 23 nt, Bordetella pertussis
gcacggggacuggcaccggccga

SEQ ID NO: 2428697 - RNA, 22 nt, Bordetella pertussis
gcacggggacuggcacgcgcug

SEQ ID NO: 2428698 - RNA, 17 nt, Bordetella pertussis
gcacggggcugucgagg

SEQ ID NO: 2428699 - RNA, 15 nt, Bordetella pertussis
gcacgguccaggcgg

SEQ ID NO: 2428700 - RNA, 20 nt, Bordetella pertussis
gcacgguccaggcggccgcg

SEQ ID NO: 2428701 - RNA, 21 nt, Bordetella pertussis
gcacgguccaggcggccgcgg

SEQ ID NO: 2428702 - RNA, 21 nt, Bordetella pertussis
gcacggucgaagaucuucggc

SEQ ID NO: 2428703 - RNA, 12 nt, Bordetella pertussis
gcacggucggcg

SEQ ID NO: 2428704 - RNA, 19 nt, Bordetella pertussis
gcacggucugcaccugcgu

SEQ ID NO: 2428705 - RNA, 12 nt, Bordetella pertussis
gcacggugccgc

SEQ ID NO: 2428706 - RNA, 21 nt, Bordetella pertussis
gcacggugcgcacgauggggc

SEQ ID NO: 2428707 - RNA, 16 nt, Bordetella pertussis
gcacgguggacaggcu

SEQ ID NO: 2428708 - RNA, 17 nt, Bordetella pertussis
gcacgguggcgaaggcc

SEQ ID NO: 2428709 - RNA, 14 nt, Bordetella pertussis
gcacgguggcgccc

SEQ ID NO: 2428710 - RNA, 17 nt, Bordetella pertussis
gcacgguggcgcccggc

SEQ ID NO: 2428711 - RNA, 18 nt, Bordetella pertussis
gcacgguggcgcccggcg

SEQ ID NO: 2428712 - RNA, 22 nt, Bordetella pertussis
gcacgguggcgcccggcggcgc

SEQ ID NO: 2428713 - RNA, 17 nt, Bordetella pertussis
gcacggugggcagcagc

SEQ ID NO: 2428714 - RNA, 19 nt, Bordetella pertussis
gcacggugggcagcagcac

SEQ ID NO: 2428715 - RNA, 22 nt, Bordetella pertussis
gcacggugggcagcagcacgcc

SEQ ID NO: 2428716 - RNA, 24 nt, Bordetella pertussis
gcacggugggcagcagcacgccca

SEQ ID NO: 2428717 - RNA, 21 nt, Bordetella pertussis
gcacgguguugaccaccacgc

SEQ ID NO: 2428718 - RNA, 17 nt, Bordetella pertussis
gcacgguuucgccgugc

SEQ ID NO: 2428719 - RNA, 16 nt, Bordetella pertussis
gcacguaaucgaagcc

SEQ ID NO: 2428720 - RNA, 14 nt, Bordetella pertussis
gcacguaccaggcg

SEQ ID NO: 2428721 - RNA, 18 nt, Bordetella pertussis
gcacguaccaggcgcuga

SEQ ID NO: 2428722 - RNA, 19 nt, Bordetella pertussis
gcacguaccaggcgcugac

SEQ ID NO: 2428723 - RNA, 13 nt, Bordetella pertussis
gcacguagcgcag

SEQ ID NO: 2428724 - RNA, 22 nt, Bordetella pertussis
gcacguagcgcagcaccggcag

SEQ ID NO: 2428725 - RNA, 17 nt, Bordetella pertussis
gcacguaguacagcagc

SEQ ID NO: 2428726 - RNA, 22 nt, Bordetella pertussis
gcacguaguacagcagcagcac

SEQ ID NO: 2428727 - RNA, 15 nt, Bordetella pertussis
gcacgucauccuggg

SEQ ID NO: 2428728 - RNA, 20 nt, Bordetella pertussis
gcacgucauccugggcgcgc

SEQ ID NO: 2428729 - RNA, 21 nt, Bordetella pertussis
gcacgucauccugggcgcgcg

SEQ ID NO: 2428730 - RNA, 18 nt, Bordetella pertussis
gcagcaaccggaacacca

SEQ ID NO: 2428731 - RNA, 19 nt, Bordetella pertussis
gcagcaaccggaacaccag

SEQ ID NO: 2428732 - RNA, 12 nt, Bordetella pertussis
gcagcaacgccg

SEQ ID NO: 2428733 - RNA, 13 nt, Bordetella pertussis
gcagcaacgccgg

SEQ ID NO: 2428734 - RNA, 15 nt, Bordetella pertussis
gcagcaacgccggcg

SEQ ID NO: 2428735 - RNA, 13 nt, Bordetella pertussis
gcagcaacgcggc

SEQ ID NO: 2428736 - RNA, 14 nt, Bordetella pertussis
gcagcaacgcggcg

SEQ ID NO: 2428737 - RNA, 15 nt, Bordetella pertussis
gcagcaacgcggcgu

SEQ ID NO: 2428738 - RNA, 12 nt, Bordetella pertussis
gcagcaacggug

SEQ ID NO: 2428739 - RNA, 19 nt, Bordetella pertussis
gcagcaacggugagccggc

SEQ ID NO: 2428740 - RNA, 21 nt, Bordetella pertussis
gcagcaacggugagccggcca

SEQ ID NO: 2428741 - RNA, 23 nt, Bordetella pertussis
gcagcaacggugagccggccacc

SEQ ID NO: 2428742 - RNA, 16 nt, Bordetella pertussis
gcagcaagcccaccgg

SEQ ID NO: 2428743 - RNA, 14 nt, Bordetella pertussis
gcagcaagcugcug

SEQ ID NO: 2428744 - RNA, 16 nt, Bordetella pertussis
gcagcaagcugcugcu

SEQ ID NO: 2428745 - RNA, 18 nt, Bordetella pertussis
gcagcaaggcgcgccacc

SEQ ID NO: 2428746 - RNA, 16 nt, Bordetella pertussis
gcagcaagucagcccg

SEQ ID NO: 2428747 - RNA, 21 nt, Bordetella pertussis
gcagcaagucagcccgcgucg

SEQ ID NO: 2428748 - RNA, 18 nt, Bordetella pertussis
gcagcaauugccccagca

SEQ ID NO: 2428749 - RNA, 21 nt, Bordetella pertussis
gcagcaauugccccagcacga

SEQ ID NO: 2428750 - RNA, 17 nt, Bordetella pertussis
gcagcacauagggcgag

SEQ ID NO: 2428751 - RNA, 19 nt, Bordetella pertussis
gcagcaccacaucgccggc

SEQ ID NO: 2428752 - RNA, 22 nt, Bordetella pertussis
gcagcaccacaucgccggcggc

SEQ ID NO: 2428753 - RNA, 15 nt, Bordetella pertussis
gcagcaccagcaugu

SEQ ID NO: 2428754 - RNA, 22 nt, Bordetella pertussis
gcagcaccaggcuuugcgcgcc

SEQ ID NO: 2428755 - RNA, 13 nt, Bordetella pertussis
gcagcaccgccag

SEQ ID NO: 2428756 - RNA, 15 nt, Bordetella pertussis
gcagcaccgccagcg

SEQ ID NO: 2428757 - RNA, 22 nt, Bordetella pertussis
gcagcaccgccagcgcgucguc

SEQ ID NO: 2428758 - RNA, 17 nt, Bordetella pertussis
gcagcaccgccaugugc

SEQ ID NO: 2428759 - RNA, 13 nt, Bordetella pertussis
gcagcaccgcgcg

SEQ ID NO: 2428760 - RNA, 17 nt, Bordetella pertussis
gcagcaccgcgcgcacg

SEQ ID NO: 2428761 - RNA, 13 nt, Bordetella pertussis
gcagcaccggcag

SEQ ID NO: 2428762 - RNA, 14 nt, Bordetella pertussis
gcagcaccggcgug

SEQ ID NO: 2428763 - RNA, 20 nt, Bordetella pertussis
gcagcaccggcgugagcgcc

SEQ ID NO: 2428764 - RNA, 19 nt, Bordetella pertussis
gcagcaccggggcagggcg

SEQ ID NO: 2428765 - RNA, 18 nt, Bordetella pertussis
gcagcaccucggcguggc

SEQ ID NO: 2428766 - RNA, 21 nt, Bordetella pertussis
gcagcaccucggcguggcggg

SEQ ID NO: 2428767 - RNA, 18 nt, Bordetella pertussis
gcagcaccuucugccgcc

SEQ ID NO: 2428768 - RNA, 21 nt, Bordetella pertussis
gcagcaccuucugccgccagg

SEQ ID NO: 2428769 - RNA, 22 nt, Bordetella pertussis
gcagcaccuucugccgccaggc

SEQ ID NO: 2428770 - RNA, 23 nt, Bordetella pertussis
gcagcaccuucugccgccaggca

SEQ ID NO: 2428771 - RNA, 19 nt, Bordetella pertussis
gcagcaccuugaccugguc

SEQ ID NO: 2428772 - RNA, 16 nt, Bordetella pertussis
gcagcacgaucgcggc

SEQ ID NO: 2428773 - RNA, 13 nt, Bordetella pertussis
gcagcacgauggc

SEQ ID NO: 2428774 - RNA, 15 nt, Bordetella pertussis
gcagcacgauggggc

SEQ ID NO: 2428775 - RNA, 14 nt, Bordetella pertussis
gcagcacgcaccag

SEQ ID NO: 2428776 - RNA, 16 nt, Bordetella pertussis
gcagcacgcaccaggc

SEQ ID NO: 2428777 - RNA, 18 nt, Bordetella pertussis
gcagcacgcaccaggcgc

SEQ ID NO: 2428778 - RNA, 14 nt, Bordetella pertussis
gcagcacgcagaug

SEQ ID NO: 2428779 - RNA, 14 nt, Bordetella pertussis
gcagcacgcccaga

SEQ ID NO: 2428780 - RNA, 14 nt, Bordetella pertussis
gcagcacgcccagu

SEQ ID NO: 2428781 - RNA, 16 nt, Bordetella pertussis
gcagcacgcccauggu

SEQ ID NO: 2428782 - RNA, 16 nt, Bordetella pertussis
gcagcacgcccgcgcg

SEQ ID NO: 2428783 - RNA, 13 nt, Bordetella pertussis
gcagcacgccgau

SEQ ID NO: 2428784 - RNA, 14 nt, Bordetella pertussis
gcagcacgccgcgc

SEQ ID NO: 2428785 - RNA, 21 nt, Bordetella pertussis
gcagcacgccgcgccaggcau

SEQ ID NO: 2428786 - RNA, 13 nt, Bordetella pertussis
gcagcacgcgcac

SEQ ID NO: 2428787 - RNA, 15 nt, Bordetella pertussis
gcagcacgcgcacca

SEQ ID NO: 2428788 - RNA, 16 nt, Bordetella pertussis
gcagcacgcgcaccag

SEQ ID NO: 2428789 - RNA, 20 nt, Bordetella pertussis
gcagcacgcgcaccaggccu

SEQ ID NO: 2428790 - RNA, 15 nt, Bordetella pertussis
gcagcacgcugcgcg

SEQ ID NO: 2428791 - RNA, 14 nt, Bordetella pertussis
gcagcacgcuggcc

SEQ ID NO: 2428792 - RNA, 19 nt, Bordetella pertussis
gcagcacggccacggccgg

SEQ ID NO: 2428793 - RNA, 17 nt, Bordetella pertussis
gcagcacgucggcgucg

SEQ ID NO: 2428794 - RNA, 23 nt, Bordetella pertussis
gcagcacgucguagcgcugcagc

SEQ ID NO: 2428795 - RNA, 22 nt, Bordetella pertussis
gcagcagaauguauuggcccag

SEQ ID NO: 2428796 - RNA, 18 nt, Bordetella pertussis
gcagcagacgcuucaggc

SEQ ID NO: 2428797 - RNA, 21 nt, Bordetella pertussis
gcagcagacgcuucaggccgu

SEQ ID NO: 2428798 - RNA, 13 nt, Bordetella pertussis
gcagcagauugcc

SEQ ID NO: 2428799 - RNA, 21 nt, Bordetella pertussis
gcagcagauugccgcgcggcg

SEQ ID NO: 2428800 - RNA, 13 nt, Bordetella pertussis
gcagcagcacgcc

SEQ ID NO: 2428801 - RNA, 14 nt, Bordetella pertussis
gcagcagcacggcc

SEQ ID NO: 2428802 - RNA, 12 nt, Bordetella pertussis
gcagcagcagcg

SEQ ID NO: 2428803 - RNA, 13 nt, Bordetella pertussis
gcagcagcagcgc

SEQ ID NO: 2428804 - RNA, 24 nt, Bordetella pertussis
gcagcagcgagaacagccacacgc

SEQ ID NO: 2428805 - RNA, 14 nt, Bordetella pertussis
gcagcagcgagccc

SEQ ID NO: 2428806 - RNA, 17 nt, Bordetella pertussis
gcagcagcgccgcgccg

SEQ ID NO: 2428807 - RNA, 15 nt, Bordetella pertussis
gcagcagcgccggca

SEQ ID NO: 2428808 - RNA, 21 nt, Bordetella pertussis
gcagcagcgccggcaggcgcg

SEQ ID NO: 2428809 - RNA, 13 nt, Bordetella pertussis
gcagcagcgccuu

SEQ ID NO: 2428810 - RNA, 13 nt, Bordetella pertussis
gcagcagcgcgcc

SEQ ID NO: 2428811 - RNA, 16 nt, Bordetella pertussis
gcagcagcgcgguggc

SEQ ID NO: 2428812 - RNA, 20 nt, Bordetella pertussis
gcagcagcggcagcucggcg

SEQ ID NO: 2428813 - RNA, 20 nt, Bordetella pertussis
gcagcagcguggccgccacc

SEQ ID NO: 2428814 - RNA, 21 nt, Bordetella pertussis
gcagcagcguggccgccacca

SEQ ID NO: 2428815 - RNA, 15 nt, Bordetella pertussis
gcagcagcuugccga

SEQ ID NO: 2428816 - RNA, 16 nt, Bordetella pertussis
gcagcagcuugccgac

SEQ ID NO: 2428817 - RNA, 13 nt, Bordetella pertussis
gcagcaggccagg

SEQ ID NO: 2428818 - RNA, 22 nt, Bordetella pertussis
gcagcaggccaggaagcggcgc

SEQ ID NO: 2428819 - RNA, 13 nt, Bordetella pertussis
gcagcaggcccau

SEQ ID NO: 2428820 - RNA, 16 nt, Bordetella pertussis
gcagcaggcccaugcc

SEQ ID NO: 2428821 - RNA, 14 nt, Bordetella pertussis
gcagcaggcccucc

SEQ ID NO: 2428822 - RNA, 21 nt, Bordetella pertussis
gcagcaggcccuccggcgcca

SEQ ID NO: 2428823 - RNA, 12 nt, Bordetella pertussis
gcagcaggccgc

SEQ ID NO: 2428824 - RNA, 15 nt, Bordetella pertussis
gcagcaggccgcgcg

SEQ ID NO: 2428825 - RNA, 17 nt, Bordetella pertussis
gcagcaggccgcgcgug

SEQ ID NO: 2428826 - RNA, 18 nt, Bordetella pertussis
gcagcaggccgcgcgugc

SEQ ID NO: 2428827 - RNA, 12 nt, Bordetella pertussis
gcagcaggccgu

SEQ ID NO: 2428828 - RNA, 22 nt, Bordetella pertussis
gcagcaggccguaaccggccag

SEQ ID NO: 2428829 - RNA, 18 nt, Bordetella pertussis
gcagcaggccguugccgc

SEQ ID NO: 2428830 - RNA, 12 nt, Bordetella pertussis
gcagcaggcgca

SEQ ID NO: 2428831 - RNA, 19 nt, Bordetella pertussis
gcagcaggcgcaccagcgc

SEQ ID NO: 2428832 - RNA, 19 nt, Bordetella pertussis
gcagcaggcgcgcggccuc

SEQ ID NO: 2428833 - RNA, 15 nt, Bordetella pertussis
gcagcaggcgcgugc

SEQ ID NO: 2428834 - RNA, 16 nt, Bordetella pertussis
gcagcaggcgcgugcu

SEQ ID NO: 2428835 - RNA, 20 nt, Bordetella pertussis
gcagcaggcgcucggccagc

SEQ ID NO: 2428836 - RNA, 18 nt, Bordetella pertussis
gcagcaggcugccgccgg

SEQ ID NO: 2428837 - RNA, 16 nt, Bordetella pertussis
gcagcaggcuggccac

SEQ ID NO: 2428838 - RNA, 14 nt, Bordetella pertussis
gcagcaggcugggc

SEQ ID NO: 2428839 - RNA, 16 nt, Bordetella pertussis
gcagcaggcugggcga

SEQ ID NO: 2428840 - RNA, 14 nt, Bordetella pertussis
gcagcagggccacg

SEQ ID NO: 2428841 - RNA, 16 nt, Bordetella pertussis
gcagcagggccacgcc

SEQ ID NO: 2428842 - RNA, 23 nt, Bordetella pertussis
gcagcagggccacgcccaggccg

SEQ ID NO: 2428843 - RNA, 15 nt, Bordetella pertussis
gcagcagggccaggc

SEQ ID NO: 2428844 - RNA, 19 nt, Bordetella pertussis
gcagcgcaucgccgcaggc

SEQ ID NO: 2428845 - RNA, 13 nt, Bordetella pertussis
gcagcgccaccgg

SEQ ID NO: 2428846 - RNA, 14 nt, Bordetella pertussis
gcagcgccaccggc

SEQ ID NO: 2428847 - RNA, 20 nt, Bordetella pertussis
gcagcgccaccguggccacg

SEQ ID NO: 2428848 - RNA, 13 nt, Bordetella pertussis
gcagcgccagggc

SEQ ID NO: 2428849 - RNA, 14 nt, Bordetella pertussis
gcagcgccagggcc

SEQ ID NO: 2428850 - RNA, 18 nt, Bordetella pertussis
gcagcgccagggccaggc

SEQ ID NO: 2428851 - RNA, 19 nt, Bordetella pertussis
gcagcgccagggccaggcc

SEQ ID NO: 2428852 - RNA, 13 nt, Bordetella pertussis
gcagcgcccaggc

SEQ ID NO: 2428853 - RNA, 15 nt, Bordetella pertussis
gcagcgcccaggcga

SEQ ID NO: 2428854 - RNA, 16 nt, Bordetella pertussis
gcagcgcccgcgccau

SEQ ID NO: 2428855 - RNA, 11 nt, Bordetella pertussis
gcagcgccgca

SEQ ID NO: 2428856 - RNA, 18 nt, Bordetella pertussis
gcagcgccgcaacccgcu

SEQ ID NO: 2428857 - RNA, 16 nt, Bordetella pertussis
gcagcgccgccaccuc

SEQ ID NO: 2428858 - RNA, 14 nt, Bordetella pertussis
gcagcgccgccagc

SEQ ID NO: 2428859 - RNA, 15 nt, Bordetella pertussis
gcagcgccgccagca

SEQ ID NO: 2428860 - RNA, 14 nt, Bordetella pertussis
gcagcgccgccugg

SEQ ID NO: 2428861 - RNA, 17 nt, Bordetella pertussis
gcagcgccgccugguag

SEQ ID NO: 2428862 - RNA, 12 nt, Bordetella pertussis
gcagcgccgcgc

SEQ ID NO: 2428863 - RNA, 14 nt, Bordetella pertussis
gcagcgccgcgcgc

SEQ ID NO: 2428864 - RNA, 13 nt, Bordetella pertussis
gcagcgccggcag

SEQ ID NO: 2428865 - RNA, 16 nt, Bordetella pertussis
gcagcgccggcaggcg

SEQ ID NO: 2428866 - RNA, 22 nt, Bordetella pertussis
gcagcgccggcaggcgcgccag

SEQ ID NO: 2428867 - RNA, 12 nt, Bordetella pertussis
gcagcgccggcu

SEQ ID NO: 2428868 - RNA, 15 nt, Bordetella pertussis
gcagcgccggcuggg

SEQ ID NO: 2428869 - RNA, 16 nt, Bordetella pertussis
gcagcgccggcugggc

SEQ ID NO: 2428870 - RNA, 17 nt, Bordetella pertussis
gcagcgccggcugggcg

SEQ ID NO: 2428871 - RNA, 17 nt, Bordetella pertussis
gcagcgccgggaucggc

SEQ ID NO: 2428872 - RNA, 12 nt, Bordetella pertussis
gcagcgccgggg

SEQ ID NO: 2428873 - RNA, 18 nt, Bordetella pertussis
gcagcgccggggggcgca

SEQ ID NO: 2428874 - RNA, 21 nt, Bordetella pertussis
gcagcgccucgggauuagccu

SEQ ID NO: 2428875 - RNA, 15 nt, Bordetella pertussis
gcagcgccugcaggc

SEQ ID NO: 2428876 - RNA, 15 nt, Bordetella pertussis
gcagcgccugccgcg

SEQ ID NO: 2428877 - RNA, 14 nt, Bordetella pertussis
gcagcgccuggccg

SEQ ID NO: 2428878 - RNA, 15 nt, Bordetella pertussis
gcagcgccuggccga

SEQ ID NO: 2428879 - RNA, 17 nt, Bordetella pertussis
gcagcgccuggccgagc

SEQ ID NO: 2428880 - RNA, 19 nt, Bordetella pertussis
gcagcgccuggccgagcgc

SEQ ID NO: 2428881 - RNA, 17 nt, Bordetella pertussis
gcagcgccuugcggcgc

SEQ ID NO: 2428882 - RNA, 23 nt, Bordetella pertussis
gcagcgccuugcggcgcuuggcg

SEQ ID NO: 2428883 - RNA, 13 nt, Bordetella pertussis
gcagcgcgaccgg

SEQ ID NO: 2428884 - RNA, 15 nt, Bordetella pertussis
gcagcgcgaccgggc

SEQ ID NO: 2428885 - RNA, 22 nt, Bordetella pertussis
gcagcgcgacuucgcgaaagcg

SEQ ID NO: 2428886 - RNA, 15 nt, Bordetella pertussis
gcagcgcgccaggcg

SEQ ID NO: 2428887 - RNA, 17 nt, Bordetella pertussis
gcagcgcgccaggcgcu

SEQ ID NO: 2428888 - RNA, 19 nt, Bordetella pertussis
gcagcgcgccaggcgcugc

SEQ ID NO: 2428889 - RNA, 20 nt, Bordetella pertussis
gcagcgcgccaggcgcugcg

SEQ ID NO: 2428890 - RNA, 23 nt, Bordetella pertussis
gcagcgcgccgccgauguugaac

SEQ ID NO: 2428891 - RNA, 13 nt, Bordetella pertussis
gcagcgcgccgga

SEQ ID NO: 2428892 - RNA, 14 nt, Bordetella pertussis
gcagcgcgccgggc

SEQ ID NO: 2428893 - RNA, 15 nt, Bordetella pertussis
gcagcgcgccgggcg

SEQ ID NO: 2428894 - RNA, 23 nt, Bordetella pertussis
gcagcgcgccgggcgggucggcg

SEQ ID NO: 2428895 - RNA, 20 nt, Bordetella pertussis
gcagcgcgcgcgcgcgggcg

SEQ ID NO: 2428896 - RNA, 12 nt, Bordetella pertussis
gcagcgcggcac

SEQ ID NO: 2428897 - RNA, 17 nt, Bordetella pertussis
gcagcgcggcacgcugc

SEQ ID NO: 2428898 - RNA, 12 nt, Bordetella pertussis
gcagcgcggccg

SEQ ID NO: 2428899 - RNA, 13 nt, Bordetella pertussis
gcagcgcggccgg

SEQ ID NO: 2428900 - RNA, 15 nt, Bordetella pertussis
gcagcgcggccggca

SEQ ID NO: 2428901 - RNA, 18 nt, Bordetella pertussis
gcagcgcggccggcacca

SEQ ID NO: 2428902 - RNA, 13 nt, Bordetella pertussis
gcagcgcggcggc

SEQ ID NO: 2428903 - RNA, 18 nt, Bordetella pertussis
gcagcgcggcggcgaccg

SEQ ID NO: 2428904 - RNA, 13 nt, Bordetella pertussis
gcagcgcggucau

SEQ ID NO: 2428905 - RNA, 18 nt, Bordetella pertussis
gcagcgcggucaugccga

SEQ ID NO: 2428906 - RNA, 16 nt, Bordetella pertussis
gcagcgcguccugcca

SEQ ID NO: 2428907 - RNA, 20 nt, Bordetella pertussis
gcagcgcgugugguuggcgc

SEQ ID NO: 2428908 - RNA, 23 nt, Bordetella pertussis
gcagcgcgugugguuggcgcugc

SEQ ID NO: 2428909 - RNA, 14 nt, Bordetella pertussis
gcagcggacggcgc

SEQ ID NO: 2428910 - RNA, 16 nt, Bordetella pertussis
gcagcggacggcgcgg

SEQ ID NO: 2428911 - RNA, 21 nt, Bordetella pertussis
gcagcggacgguagcgcacgc

SEQ ID NO: 2428912 - RNA, 22 nt, Bordetella pertussis
gcagcggacgguagcgcacgca

SEQ ID NO: 2428913 - RNA, 19 nt, Bordetella pertussis
gcagcggacguuggccgau

SEQ ID NO: 2428914 - RNA, 20 nt, Bordetella pertussis
gcagcggacucauaauccgu

SEQ ID NO: 2428915 - RNA, 15 nt, Bordetella pertussis
gcagcggagcgacgg

SEQ ID NO: 2428916 - RNA, 18 nt, Bordetella pertussis
gcagcggagcgacggcag

SEQ ID NO: 2428917 - RNA, 15 nt, Bordetella pertussis
gcagcggaugccgcc

SEQ ID NO: 2428918 - RNA, 12 nt, Bordetella pertussis
gcagcggcagca

SEQ ID NO: 2428919 - RNA, 18 nt, Bordetella pertussis
gcagcggcagcagcagcg

SEQ ID NO: 2428920 - RNA, 18 nt, Bordetella pertussis
gcagcggcagcauggcgc

SEQ ID NO: 2428921 - RNA, 20 nt, Bordetella pertussis
gcagcggcagcauggcgcgc

SEQ ID NO: 2428922 - RNA, 13 nt, Bordetella pertussis
gcagcggcagcgc

SEQ ID NO: 2428923 - RNA, 21 nt, Bordetella pertussis
gcagcggcagcucggcgaagc

SEQ ID NO: 2428924 - RNA, 14 nt, Bordetella pertussis
gcagcggcaggccc

SEQ ID NO: 2428925 - RNA, 15 nt, Bordetella pertussis
gcagcggcaggcccu

SEQ ID NO: 2428926 - RNA, 13 nt, Bordetella pertussis
gcagcggcaggcg

SEQ ID NO: 2428927 - RNA, 14 nt, Bordetella pertussis
gcagcggcaggcgg

SEQ ID NO: 2428928 - RNA, 16 nt, Bordetella pertussis
gcagcggcaggcggcu

SEQ ID NO: 2428929 - RNA, 12 nt, Bordetella pertussis
gcagcggcaggu

SEQ ID NO: 2428930 - RNA, 16 nt, Bordetella pertussis
gcagcggcaucacgcc

SEQ ID NO: 2428931 - RNA, 17 nt, Bordetella pertussis
gcagcggcaucacgccg

SEQ ID NO: 2428932 - RNA, 12 nt, Bordetella pertussis
gcagcggccagc

SEQ ID NO: 2428933 - RNA, 15 nt, Bordetella pertussis
gcagcggccagcgcg

SEQ ID NO: 2428934 - RNA, 20 nt, Bordetella pertussis
gcagcggccagcgcggcggc

SEQ ID NO: 2428935 - RNA, 18 nt, Bordetella pertussis
gcagcggccauggacgag

SEQ ID NO: 2428936 - RNA, 14 nt, Bordetella pertussis
gcagcggccgcgcg

SEQ ID NO: 2428937 - RNA, 21 nt, Bordetella pertussis
gcagcggccgcgcgggcggcc

SEQ ID NO: 2428938 - RNA, 16 nt, Bordetella pertussis
gcagcggcgacggcgc

SEQ ID NO: 2428939 - RNA, 22 nt, Bordetella pertussis
gcagcggcgccaugcgcaccac

SEQ ID NO: 2428940 - RNA, 18 nt, Bordetella pertussis
gcagcggcgcgcgcaggu

SEQ ID NO: 2428941 - RNA, 12 nt, Bordetella pertussis
gcagcggcggca

SEQ ID NO: 2428942 - RNA, 14 nt, Bordetella pertussis
gcagcggcggcacg

SEQ ID NO: 2428943 - RNA, 19 nt, Bordetella pertussis
gcagcggcggcacgguggc

SEQ ID NO: 2428944 - RNA, 13 nt, Bordetella pertussis
gcagcggcggcgc

SEQ ID NO: 2428945 - RNA, 21 nt, Bordetella pertussis
gcagcggcuccccuggucagg

SEQ ID NO: 2428946 - RNA, 20 nt, Bordetella pertussis
gcagcggcucgacgccguac

SEQ ID NO: 2428947 - RNA, 20 nt, Bordetella pertussis
gcagcggcuucaugccggcg

SEQ ID NO: 2428948 - RNA, 18 nt, Bordetella pertussis
gcagcgggcccgucgcgc

SEQ ID NO: 2428949 - RNA, 15 nt, Bordetella pertussis
gcagcgggccgcagc

SEQ ID NO: 2428950 - RNA, 17 nt, Bordetella pertussis
gcagcggguugcgcgcc

SEQ ID NO: 2428951 - RNA, 20 nt, Bordetella pertussis
gcagcggguugcgcgccagc

SEQ ID NO: 2428952 - RNA, 21 nt, Bordetella pertussis
gcagcggguugcgcgccagcu

SEQ ID NO: 2428953 - RNA, 18 nt, Bordetella pertussis
gcagcguaucgcccgcgc

SEQ ID NO: 2428954 - RNA, 19 nt, Bordetella pertussis
gcagcguaucgcccgcgcg

SEQ ID NO: 2428955 - RNA, 22 nt, Bordetella pertussis
gcagcgucaauccgccgccagc

SEQ ID NO: 2428956 - RNA, 17 nt, Bordetella pertussis
gcagcgucgcggcgucg

SEQ ID NO: 2428957 - RNA, 14 nt, Bordetella pertussis
gcagcgucugcgca

SEQ ID NO: 2428958 - RNA, 20 nt, Bordetella pertussis
gcaggccaggaagcggcgca

SEQ ID NO: 2428959 - RNA, 20 nt, Bordetella pertussis
gcaggccaggcucagcaggg

SEQ ID NO: 2428960 - RNA, 13 nt, Bordetella pertussis
gcaggccaucgcg

SEQ ID NO: 2428961 - RNA, 19 nt, Bordetella pertussis
gcaggccaucgcggucgau

SEQ ID NO: 2428962 - RNA, 21 nt, Bordetella pertussis
gcaggccaugcucguccaucg

SEQ ID NO: 2428963 - RNA, 16 nt, Bordetella pertussis
gcaggccauugcuggc

SEQ ID NO: 2428964 - RNA, 17 nt, Bordetella pertussis
gcaggccauugcuggcg

SEQ ID NO: 2428965 - RNA, 19 nt, Bordetella pertussis
gcaggcccaccagggccag

SEQ ID NO: 2428966 - RNA, 20 nt, Bordetella pertussis
gcaggcccaccagggccagc

SEQ ID NO: 2428967 - RNA, 13 nt, Bordetella pertussis
gcaggcccaccgg

SEQ ID NO: 2428968 - RNA, 14 nt, Bordetella pertussis
gcaggcccaccggc

SEQ ID NO: 2428969 - RNA, 17 nt, Bordetella pertussis
gcaggcccaccggcaug

SEQ ID NO: 2428970 - RNA, 13 nt, Bordetella pertussis
gcaggcccagcca

SEQ ID NO: 2428971 - RNA, 20 nt, Bordetella pertussis
gcaggcccagccagcccugg

SEQ ID NO: 2428972 - RNA, 21 nt, Bordetella pertussis
gcaggcccagccagcccuggc

SEQ ID NO: 2428973 - RNA, 16 nt, Bordetella pertussis
gcaggcccagccagcg

SEQ ID NO: 2428974 - RNA, 20 nt, Bordetella pertussis
gcaggcccagccagcggugc

SEQ ID NO: 2428975 - RNA, 15 nt, Bordetella pertussis
gcaggcccaugacga

SEQ ID NO: 2428976 - RNA, 20 nt, Bordetella pertussis
gcaggcccaugauccgcacc

SEQ ID NO: 2428977 - RNA, 22 nt, Bordetella pertussis
gcaggccccgcuacguguccug

SEQ ID NO: 2428978 - RNA, 13 nt, Bordetella pertussis
gcaggcccgacag

SEQ ID NO: 2428979 - RNA, 15 nt, Bordetella pertussis
gcaggcccgacagga

SEQ ID NO: 2428980 - RNA, 11 nt, Bordetella pertussis
gcaggcccggc

SEQ ID NO: 2428981 - RNA, 14 nt, Bordetella pertussis
gcaggcccggcgcg

SEQ ID NO: 2428982 - RNA, 18 nt, Bordetella pertussis
gcaggcccuccggcgcca

SEQ ID NO: 2428983 - RNA, 19 nt, Bordetella pertussis
gcaggcccuggagaucgcc

SEQ ID NO: 2428984 - RNA, 13 nt, Bordetella pertussis
gcaggcccugggc

SEQ ID NO: 2428985 - RNA, 17 nt, Bordetella pertussis
gcaggcccugggccagc

SEQ ID NO: 2428986 - RNA, 22 nt, Bordetella pertussis
gcaggcccugggccagcagcug

SEQ ID NO: 2428987 - RNA, 23 nt, Bordetella pertussis
gcaggcccugggcgagguagggc

SEQ ID NO: 2428988 - RNA, 18 nt, Bordetella pertussis
gcaggcccuugaucaggc

SEQ ID NO: 2428989 - RNA, 14 nt, Bordetella pertussis
gcaggccgaaaccg

SEQ ID NO: 2428990 - RNA, 17 nt, Bordetella pertussis
gcaggccgacgcgcugu

SEQ ID NO: 2428991 - RNA, 21 nt, Bordetella pertussis
gcaggccgaggaccugcuggc

SEQ ID NO: 2428992 - RNA, 23 nt, Bordetella pertussis
gcaggccgaggaccugcuggcgu

SEQ ID NO: 2428993 - RNA, 17 nt, Bordetella pertussis
gcaggccgauguagccc

SEQ ID NO: 2428994 - RNA, 20 nt, Bordetella pertussis
gcaggccgauguagcccaug

SEQ ID NO: 2428995 - RNA, 16 nt, Bordetella pertussis
gcaggccgcagcgggc

SEQ ID NO: 2428996 - RNA, 13 nt, Bordetella pertussis
gcaggccgccgcc

SEQ ID NO: 2428997 - RNA, 14 nt, Bordetella pertussis
gcaggccgccgccg

SEQ ID NO: 2428998 - RNA, 18 nt, Bordetella pertussis
gcaggccgccgccgguga

SEQ ID NO: 2428999 - RNA, 19 nt, Bordetella pertussis
gcaggccgccgccggugau

SEQ ID NO: 2429000 - RNA, 13 nt, Bordetella pertussis
gcaggccgccggc

SEQ ID NO: 2429001 - RNA, 17 nt, Bordetella pertussis
gcaggccgccggccagc

SEQ ID NO: 2429002 - RNA, 15 nt, Bordetella pertussis
gcaggccgccggccu

SEQ ID NO: 2429003 - RNA, 14 nt, Bordetella pertussis
gcaggccgcgaaca

SEQ ID NO: 2429004 - RNA, 11 nt, Bordetella pertussis
gcaggccgcgc

SEQ ID NO: 2429005 - RNA, 15 nt, Bordetella pertussis
gcaggccgcgcagca

SEQ ID NO: 2429006 - RNA, 16 nt, Bordetella pertussis
gcaggccgcgcagcac

SEQ ID NO: 2429007 - RNA, 14 nt, Bordetella pertussis
gcaggccgcgccac

SEQ ID NO: 2429008 - RNA, 16 nt, Bordetella pertussis
gcaggccgcgccacag

SEQ ID NO: 2429009 - RNA, 20 nt, Bordetella pertussis
gcaggccgcgccacaggcgc

SEQ ID NO: 2429010 - RNA, 14 nt, Bordetella pertussis
gcaggccgcgcgca

SEQ ID NO: 2429011 - RNA, 18 nt, Bordetella pertussis
gcaggccgcgcgcaucca

SEQ ID NO: 2429012 - RNA, 21 nt, Bordetella pertussis
gcaggccgcgcgcauccaggu

SEQ ID NO: 2429013 - RNA, 14 nt, Bordetella pertussis
gcaggccgcgcugc

SEQ ID NO: 2429014 - RNA, 15 nt, Bordetella pertussis
gcaggccgcgcugcc

SEQ ID NO: 2429015 - RNA, 14 nt, Bordetella pertussis
gcaggccgcggcca

SEQ ID NO: 2429016 - RNA, 17 nt, Bordetella pertussis
gcaggccgcggccaggc

SEQ ID NO: 2429017 - RNA, 22 nt, Bordetella pertussis
gcaggccgcggccaggcccaug

SEQ ID NO: 2429018 - RNA, 13 nt, Bordetella pertussis
gcaggccggcgcg

SEQ ID NO: 2429019 - RNA, 15 nt, Bordetella pertussis
gcaggccggcgcgca

SEQ ID NO: 2429020 - RNA, 16 nt, Bordetella pertussis
gcaggccggcgcgcau

SEQ ID NO: 2429021 - RNA, 16 nt, Bordetella pertussis
gcaggccggcgcgcgc

SEQ ID NO: 2429022 - RNA, 15 nt, Bordetella pertussis
gcaggccggcggcca

SEQ ID NO: 2429023 - RNA, 20 nt, Bordetella pertussis
gcaggccggcggccagcgcg

SEQ ID NO: 2429024 - RNA, 14 nt, Bordetella pertussis
gcaggccggcggcg

SEQ ID NO: 2429025 - RNA, 20 nt, Bordetella pertussis
gcaggccggcguucaccagg

SEQ ID NO: 2429026 - RNA, 12 nt, Bordetella pertussis
gcaggccgggca

SEQ ID NO: 2429027 - RNA, 17 nt, Bordetella pertussis
gcaggccguaaccggcc

SEQ ID NO: 2429028 - RNA, 15 nt, Bordetella pertussis
gcaggccguugccgc

SEQ ID NO: 2429029 - RNA, 18 nt, Bordetella pertussis
gcaggccguuggccgcgc

SEQ ID NO: 2429030 - RNA, 21 nt, Bordetella pertussis
gcaggccguuggccgcgcggu

SEQ ID NO: 2429031 - RNA, 20 nt, Bordetella pertussis
gcaggccucgcccgaucggc

SEQ ID NO: 2429032 - RNA, 15 nt, Bordetella pertussis
gcaggccugcacgac

SEQ ID NO: 2429033 - RNA, 17 nt, Bordetella pertussis
gcaggccugcacgacgg

SEQ ID NO: 2429034 - RNA, 18 nt, Bordetella pertussis
gcaggccugcugcagcgu

SEQ ID NO: 2429035 - RNA, 13 nt, Bordetella pertussis
gcaggccuggucg

SEQ ID NO: 2429036 - RNA, 16 nt, Bordetella pertussis
gcaggccuggucgagc

SEQ ID NO: 2429037 - RNA, 12 nt, Bordetella pertussis
gcaggcgaaacg

SEQ ID NO: 2429038 - RNA, 17 nt, Bordetella pertussis
gcaggcgaaacgccagc

SEQ ID NO: 2429039 - RNA, 21 nt, Bordetella pertussis
gcaggcgaaacgccagcccga

SEQ ID NO: 2429040 - RNA, 22 nt, Bordetella pertussis
gcaggcgaaacgccagcccgac

SEQ ID NO: 2429041 - RNA, 12 nt, Bordetella pertussis
gcaggcgcacca

SEQ ID NO: 2429042 - RNA, 15 nt, Bordetella pertussis
gcaggcgcaccagcg

SEQ ID NO: 2429043 - RNA, 17 nt, Bordetella pertussis
gcaggcgcaccagcgcg

SEQ ID NO: 2429044 - RNA, 18 nt, Bordetella pertussis
gcaggcgcaccagcgcgc

SEQ ID NO: 2429045 - RNA, 19 nt, Bordetella pertussis
gcaggcgcaccagcgcgcc

SEQ ID NO: 2429046 - RNA, 16 nt, Bordetella pertussis
gcaggcgcacgccgcc

SEQ ID NO: 2429047 - RNA, 12 nt, Bordetella pertussis
gcaggcgcaggc

SEQ ID NO: 2429048 - RNA, 16 nt, Bordetella pertussis
gcaggcgcaggccgcg

SEQ ID NO: 2429049 - RNA, 17 nt, Bordetella pertussis
gcaggcgcaggccgcgc

SEQ ID NO: 2429050 - RNA, 18 nt, Bordetella pertussis
gcaggcgcaggccgcgcg

SEQ ID NO: 2429051 - RNA, 12 nt, Bordetella pertussis
gcaggcgccagu

SEQ ID NO: 2429052 - RNA, 19 nt, Bordetella pertussis
gcaggcgccgccgcccggc

SEQ ID NO: 2429053 - RNA, 21 nt, Bordetella pertussis
gcaggcgccgccgcccggcaa

SEQ ID NO: 2429054 - RNA, 12 nt, Bordetella pertussis
gcaggcgccggc

SEQ ID NO: 2429055 - RNA, 14 nt, Bordetella pertussis
gcaggcgccugccc

SEQ ID NO: 2429056 - RNA, 23 nt, Bordetella pertussis
gcaggcgccugcucacgccccgc

SEQ ID NO: 2429057 - RNA, 19 nt, Bordetella pertussis
gcaggcgccuucggcgcgg

SEQ ID NO: 2429058 - RNA, 20 nt, Bordetella pertussis
gcaggcgccuucggcgcggc

SEQ ID NO: 2429059 - RNA, 21 nt, Bordetella pertussis
gcaggcgccuucggcgcggcg

SEQ ID NO: 2429060 - RNA, 19 nt, Bordetella pertussis
gcaggcgccuuucccgcgc

SEQ ID NO: 2429061 - RNA, 21 nt, Bordetella pertussis
gcaggcgccuuucccgcgccg

SEQ ID NO: 2429062 - RNA, 23 nt, Bordetella pertussis
gcaggcgcgagcgccgggcgccg

SEQ ID NO: 2429063 - RNA, 15 nt, Bordetella pertussis
gcaggcgcgaggugg

SEQ ID NO: 2429064 - RNA, 16 nt, Bordetella pertussis
gcaggcgcgccgggcc

SEQ ID NO: 2429065 - RNA, 19 nt, Bordetella pertussis
gcaggcgcgccgggccggc

SEQ ID NO: 2429066 - RNA, 12 nt, Bordetella pertussis
gcaggcgcgcgc

SEQ ID NO: 2429067 - RNA, 14 nt, Bordetella pertussis
gcaggcgcgcgccu

SEQ ID NO: 2429068 - RNA, 14 nt, Bordetella pertussis
gcaggcgcgcggug

SEQ ID NO: 2429069 - RNA, 22 nt, Bordetella pertussis
gcaggcgcgcucaggccgccgg

SEQ ID NO: 2429070 - RNA, 20 nt, Bordetella pertussis
gcaggcgcgugaggucgcgc

SEQ ID NO: 2429071 - RNA, 13 nt, Bordetella pertussis
gcaggcgcgugcu

SEQ ID NO: 2429072 - RNA, 14 nt, Bordetella pertussis
gcaggucggcgcgg

SEQ ID NO: 2429073 - RNA, 13 nt, Bordetella pertussis
gcaggucggggcg

SEQ ID NO: 2429074 - RNA, 19 nt, Bordetella pertussis
gcaggucggggcgcucgag

SEQ ID NO: 2429075 - RNA, 14 nt, Bordetella pertussis
gcaggucggucgcc

SEQ ID NO: 2429076 - RNA, 20 nt, Bordetella pertussis
gcaggucggugcacacgccu

SEQ ID NO: 2429077 - RNA, 13 nt, Bordetella pertussis
gcaggucgucgag

SEQ ID NO: 2429078 - RNA, 19 nt, Bordetella pertussis
gcaggucgucgagccgggc

SEQ ID NO: 2429079 - RNA, 19 nt, Bordetella pertussis
gcaggucugcacgaggcgc

SEQ ID NO: 2429080 - RNA, 15 nt, Bordetella pertussis
gcaggucuucgggcg

SEQ ID NO: 2429081 - RNA, 17 nt, Bordetella pertussis
gcaggugaugcgcgcgg

SEQ ID NO: 2429082 - RNA, 20 nt, Bordetella pertussis
gcaggugaugcgcgcggcca

SEQ ID NO: 2429083 - RNA, 15 nt, Bordetella pertussis
gcaggugcacgcacg

SEQ ID NO: 2429084 - RNA, 18 nt, Bordetella pertussis
gcaggugccccacgccga

SEQ ID NO: 2429085 - RNA, 17 nt, Bordetella pertussis
gcaggugccgccggcgc

SEQ ID NO: 2429086 - RNA, 13 nt, Bordetella pertussis
gcaggugcggccg

SEQ ID NO: 2429087 - RNA, 15 nt, Bordetella pertussis
gcaggugcggccgca

SEQ ID NO: 2429088 - RNA, 17 nt, Bordetella pertussis
gcaggugcggccgcagc

SEQ ID NO: 2429089 - RNA, 16 nt, Bordetella pertussis
gcagguggaucgacga

SEQ ID NO: 2429090 - RNA, 18 nt, Bordetella pertussis
gcagguggcgcuguccgg

SEQ ID NO: 2429091 - RNA, 17 nt, Bordetella pertussis
gcagguggggcagcagg

SEQ ID NO: 2429092 - RNA, 21 nt, Bordetella pertussis
gcagguggggcagcaggccgg

SEQ ID NO: 2429093 - RNA, 14 nt, Bordetella pertussis
gcagguucugcgcg

SEQ ID NO: 2429094 - RNA, 18 nt, Bordetella pertussis
gcagguucugcgcguccu

SEQ ID NO: 2429095 - RNA, 15 nt, Bordetella pertussis
gcaguacaggcgcgu

SEQ ID NO: 2429096 - RNA, 23 nt, Bordetella pertussis
gcaguacccaguacgagaacgcg

SEQ ID NO: 2429097 - RNA, 14 nt, Bordetella pertussis
gcaguacgagcggc

SEQ ID NO: 2429098 - RNA, 17 nt, Bordetella pertussis
gcaguacguacgcccgg

SEQ ID NO: 2429099 - RNA, 19 nt, Bordetella pertussis
gcaguacguacgcccggcc

SEQ ID NO: 2429100 - RNA, 14 nt, Bordetella pertussis
gcaguagcgcucga

SEQ ID NO: 2429101 - RNA, 23 nt, Bordetella pertussis
gcaguaucccggccaggcgccgg

SEQ ID NO: 2429102 - RNA, 18 nt, Bordetella pertussis
gcaguaucuggugcgcgu

SEQ ID NO: 2429103 - RNA, 19 nt, Bordetella pertussis
gcaguaugcaaccggcacg

SEQ ID NO: 2429104 - RNA, 20 nt, Bordetella pertussis
gcaguaugcaaccggcacgu

SEQ ID NO: 2429105 - RNA, 17 nt, Bordetella pertussis
gcaguccugcgaucagu

SEQ ID NO: 2429106 - RNA, 14 nt, Bordetella pertussis
gcaguccuggcugg

SEQ ID NO: 2429107 - RNA, 17 nt, Bordetella pertussis
gcaguccuucagcuuga

SEQ ID NO: 2429108 - RNA, 18 nt, Bordetella pertussis
gcagucgcgcacgaagcc

SEQ ID NO: 2429109 - RNA, 19 nt, Bordetella pertussis
gcagucgcgcacgaagccg

SEQ ID NO: 2429110 - RNA, 14 nt, Bordetella pertussis
gcagucgcgcagcc

SEQ ID NO: 2429111 - RNA, 13 nt, Bordetella pertussis
gcagucggcagga

SEQ ID NO: 2429112 - RNA, 15 nt, Bordetella pertussis
gcagucggggccgca

SEQ ID NO: 2429113 - RNA, 20 nt, Bordetella pertussis
gcagucggggccgcagcugg

SEQ ID NO: 2429114 - RNA, 23 nt, Bordetella pertussis
gcagucggggccgcagcuggacu

SEQ ID NO: 2429115 - RNA, 21 nt, Bordetella pertussis
gcagugccugcgaacgcccgg

SEQ ID NO: 2429116 - RNA, 23 nt, Bordetella pertussis
gcagugccugcgaacgcccggcc

SEQ ID NO: 2429117 - RNA, 21 nt, Bordetella pertussis
gcagugcgcgcgcccccagcg

SEQ ID NO: 2429118 - RNA, 23 nt, Bordetella pertussis
gcagugcgcgcgcccccagcgcc

SEQ ID NO: 2429119 - RNA, 23 nt, Bordetella pertussis
gcagugggccaguucgcggcgca

SEQ ID NO: 2429120 - RNA, 20 nt, Bordetella pertussis
gcagugguggugcagcggca

SEQ ID NO: 2429121 - RNA, 21 nt, Bordetella pertussis
gcagugguggugcagcggcag

SEQ ID NO: 2429122 - RNA, 16 nt, Bordetella pertussis
gcagugugccuguccc

SEQ ID NO: 2429123 - RNA, 22 nt, Bordetella pertussis
gcagugugccugucccagcggg

SEQ ID NO: 2429124 - RNA, 16 nt, Bordetella pertussis
gcaguguuucggccug

SEQ ID NO: 2429125 - RNA, 15 nt, Bordetella pertussis
gcaguucggccgcca

SEQ ID NO: 2429126 - RNA, 16 nt, Bordetella pertussis
gcaguucggccggcgg

SEQ ID NO: 2429127 - RNA, 15 nt, Bordetella pertussis
gcaguucggcgucgg

SEQ ID NO: 2429128 - RNA, 18 nt, Bordetella pertussis
gcaguucggcgucggugc

SEQ ID NO: 2429129 - RNA, 17 nt, Bordetella pertussis
gcaguucgggguccagc

SEQ ID NO: 2429130 - RNA, 18 nt, Bordetella pertussis
gcaguucggucagcgcgg

SEQ ID NO: 2429131 - RNA, 19 nt, Bordetella pertussis
gcaguucggucagcgcggc

SEQ ID NO: 2429132 - RNA, 20 nt, Bordetella pertussis
gcaguucggucagcgcggcg

SEQ ID NO: 2429133 - RNA, 19 nt, Bordetella pertussis
gcaguugaacacgcggugc

SEQ ID NO: 2429134 - RNA, 20 nt, Bordetella pertussis
gcaguugaacacgcggugca

SEQ ID NO: 2429135 - RNA, 14 nt, Bordetella pertussis
gcaguugcagcaug

SEQ ID NO: 2429136 - RNA, 15 nt, Bordetella pertussis
gcaguugcagcauga

SEQ ID NO: 2429137 - RNA, 12 nt, Bordetella pertussis
gcaguugccgaa

SEQ ID NO: 2429138 - RNA, 13 nt, Bordetella pertussis
gcaguugcgccag

SEQ ID NO: 2429139 - RNA, 20 nt, Bordetella pertussis
gcaguugcgucuccagcgcg

SEQ ID NO: 2429140 - RNA, 16 nt, Bordetella pertussis
gcaguugcuggcggcc

SEQ ID NO: 2429141 - RNA, 21 nt, Bordetella pertussis
gcaguugcuggcggccgugcc

SEQ ID NO: 2429142 - RNA, 13 nt, Bordetella pertussis
gcaguuggcggcg

SEQ ID NO: 2429143 - RNA, 19 nt, Bordetella pertussis
gcauacaacuucagccagc

SEQ ID NO: 2429144 - RNA, 22 nt, Bordetella pertussis
gcauacagggcggugcgcucga

SEQ ID NO: 2429145 - RNA, 15 nt, Bordetella pertussis
gcauacccugcgcgc

SEQ ID NO: 2429146 - RNA, 16 nt, Bordetella pertussis
gcauacccugcgcgcc

SEQ ID NO: 2429147 - RNA, 18 nt, Bordetella pertussis
gcauacccugcgcgccgc

SEQ ID NO: 2429148 - RNA, 16 nt, Bordetella pertussis
gcauaccggccgcggg

SEQ ID NO: 2429149 - RNA, 15 nt, Bordetella pertussis
gcauaccuuggcgcc

SEQ ID NO: 2429150 - RNA, 19 nt, Bordetella pertussis
gcauacgccgauggcgcgg

SEQ ID NO: 2429151 - RNA, 14 nt, Bordetella pertussis
gcauacgccgcuga

SEQ ID NO: 2429152 - RNA, 21 nt, Bordetella pertussis
gcauacgccgcugauggcggu

SEQ ID NO: 2429153 - RNA, 20 nt, Bordetella pertussis
gcauacggacgagcgcagca

SEQ ID NO: 2429154 - RNA, 15 nt, Bordetella pertussis
gcauacucgaugccc

SEQ ID NO: 2429155 - RNA, 22 nt, Bordetella pertussis
gcauacucggaagacauggcgc

SEQ ID NO: 2429156 - RNA, 24 nt, Bordetella pertussis
gcauagcaguugacccauaccagc

SEQ ID NO: 2429157 - RNA, 15 nt, Bordetella pertussis
gcauagcccaggccg

SEQ ID NO: 2429158 - RNA, 20 nt, Bordetella pertussis
gcauagcccaggccgccggc

SEQ ID NO: 2429159 - RNA, 14 nt, Bordetella pertussis
gcauagcgcgccac

SEQ ID NO: 2429160 - RNA, 19 nt, Bordetella pertussis
gcauagcguuuuguacucu

SEQ ID NO: 2429161 - RNA, 21 nt, Bordetella pertussis
gcauaggacgccaccagugcg

SEQ ID NO: 2429162 - RNA, 13 nt, Bordetella pertussis
gcauaggcggcgc

SEQ ID NO: 2429163 - RNA, 17 nt, Bordetella pertussis
gcauaggcggcgcaggc

SEQ ID NO: 2429164 - RNA, 20 nt, Bordetella pertussis
gcauaggcggcgcaggccag

SEQ ID NO: 2429165 - RNA, 20 nt, Bordetella pertussis
gcauagguaucggcccgcgc

SEQ ID NO: 2429166 - RNA, 22 nt, Bordetella pertussis
gcauagguaucggcccgcgcca

SEQ ID NO: 2429167 - RNA, 24 nt, Bordetella pertussis
gcauagguaucggcccgcgccagc

SEQ ID NO: 2429168 - RNA, 14 nt, Bordetella pertussis
gcauauccaggcgg

SEQ ID NO: 2429169 - RNA, 21 nt, Bordetella pertussis
gcauaucgucgcugcggccgg

SEQ ID NO: 2429170 - RNA, 16 nt, Bordetella pertussis
gcaucaacacgcugga

SEQ ID NO: 2429171 - RNA, 12 nt, Bordetella pertussis
gcaucaccagcu

SEQ ID NO: 2429172 - RNA, 20 nt, Bordetella pertussis
gcaucacgccgguguucucg

SEQ ID NO: 2429173 - RNA, 21 nt, Bordetella pertussis
gcaucacgccgguguucucgc

SEQ ID NO: 2429174 - RNA, 19 nt, Bordetella pertussis
gcaucacgcuggccgcgcc

SEQ ID NO: 2429175 - RNA, 22 nt, Bordetella pertussis
gcaucacgcuggccgcgcccgc

SEQ ID NO: 2429176 - RNA, 17 nt, Bordetella pertussis
gcaucagcagacccugg

SEQ ID NO: 2429177 - RNA, 21 nt, Bordetella pertussis
gcaucagcagacccuggcgcg

SEQ ID NO: 2429178 - RNA, 22 nt, Bordetella pertussis
gcaucagcagacccuggcgcgc

SEQ ID NO: 2429179 - RNA, 12 nt, Bordetella pertussis
gcaucagcggca

SEQ ID NO: 2429180 - RNA, 19 nt, Bordetella pertussis
gcaucaggggcucggccag

SEQ ID NO: 2429181 - RNA, 14 nt, Bordetella pertussis
gcaucaguucaggc

SEQ ID NO: 2429182 - RNA, 17 nt, Bordetella pertussis
gcaucaguucaggcugg

SEQ ID NO: 2429183 - RNA, 19 nt, Bordetella pertussis
gcaucaguucaggcuggcg

SEQ ID NO: 2429184 - RNA, 20 nt, Bordetella pertussis
gcaugaccgcggacgccaug

SEQ ID NO: 2429185 - RNA, 23 nt, Bordetella pertussis
gcaugaccgcggacgccauggcg

SEQ ID NO: 2429186 - RNA, 15 nt, Bordetella pertussis
gcaugaccucggccu

SEQ ID NO: 2429187 - RNA, 14 nt, Bordetella pertussis
gcaugaccugcagg

SEQ ID NO: 2429188 - RNA, 17 nt, Bordetella pertussis
gcaugacggccaggaug

SEQ ID NO: 2429189 - RNA, 19 nt, Bordetella pertussis
gcaugacggccaggauggc

SEQ ID NO: 2429190 - RNA, 20 nt, Bordetella pertussis
gcaugacggccaggauggcg

SEQ ID NO: 2429191 - RNA, 21 nt, Bordetella pertussis
gcaugacggccaggauggcgu

SEQ ID NO: 2429192 - RNA, 17 nt, Bordetella pertussis
gcaugacggcgucgagc

SEQ ID NO: 2429193 - RNA, 15 nt, Bordetella pertussis
gcaugacggggucgg

SEQ ID NO: 2429194 - RNA, 20 nt, Bordetella pertussis
gcaugacggggucggggcag

SEQ ID NO: 2429195 - RNA, 22 nt, Bordetella pertussis
gcaugaucuugccgaccgcguc

SEQ ID NO: 2429196 - RNA, 17 nt, Bordetella pertussis
gcaugaugcugccgggc

SEQ ID NO: 2429197 - RNA, 18 nt, Bordetella pertussis
gcaugaugcugccgggca

SEQ ID NO: 2429198 - RNA, 13 nt, Bordetella pertussis
gcaugauggccgg

SEQ ID NO: 2429199 - RNA, 14 nt, Bordetella pertussis
gcaugauggccggc

SEQ ID NO: 2429200 - RNA, 15 nt, Bordetella pertussis
gcaugauggccggcc

SEQ ID NO: 2429201 - RNA, 24 nt, Bordetella pertussis
gcaugaugucgcgggcccgcucgg

SEQ ID NO: 2429202 - RNA, 21 nt, Bordetella pertussis
gcaugauuccugucgcgcugc

SEQ ID NO: 2429203 - RNA, 17 nt, Bordetella pertussis
gcaugcaagacaggccg

SEQ ID NO: 2429204 - RNA, 14 nt, Bordetella pertussis
gcaugcacgauggu

SEQ ID NO: 2429205 - RNA, 16 nt, Bordetella pertussis
gcaugccaccacaagg

SEQ ID NO: 2429206 - RNA, 15 nt, Bordetella pertussis
gcaugccagcuugca

SEQ ID NO: 2429207 - RNA, 20 nt, Bordetella pertussis
gcaugccagcuugcaggcgc

SEQ ID NO: 2429208 - RNA, 18 nt, Bordetella pertussis
gcaugccauagucgcgca

SEQ ID NO: 2429209 - RNA, 20 nt, Bordetella pertussis
gcaugcccauuuccaccacg

SEQ ID NO: 2429210 - RNA, 20 nt, Bordetella pertussis
gcaugccccaacggcgcacc

SEQ ID NO: 2429211 - RNA, 21 nt, Bordetella pertussis
gcaugccccaacggcgcaccg

SEQ ID NO: 2429212 - RNA, 23 nt, Bordetella pertussis
gcaugccccaacggcgcaccguc

SEQ ID NO: 2429213 - RNA, 17 nt, Bordetella pertussis
gcaugcccgaccgcaug

SEQ ID NO: 2429214 - RNA, 20 nt, Bordetella pertussis
gcaugcccgaccgcaugggc

SEQ ID NO: 2429215 - RNA, 17 nt, Bordetella pertussis
gcaugccgaccaccagc

SEQ ID NO: 2429216 - RNA, 18 nt, Bordetella pertussis
gcaugccgaccaccagca

SEQ ID NO: 2429217 - RNA, 20 nt, Bordetella pertussis
gcaugccgaccaccagcacc

SEQ ID NO: 2429218 - RNA, 23 nt, Bordetella pertussis
gcaugccgaccaccagcaccgau

SEQ ID NO: 2429219 - RNA, 17 nt, Bordetella pertussis
gcaugccgaucagcggg

SEQ ID NO: 2429220 - RNA, 18 nt, Bordetella pertussis
gcaugccgaucagcgggc

SEQ ID NO: 2429221 - RNA, 16 nt, Bordetella pertussis
gcaugccgcgguggcg

SEQ ID NO: 2429222 - RNA, 19 nt, Bordetella pertussis
gcaugccgcgguggcgggc

SEQ ID NO: 2429223 - RNA, 12 nt, Bordetella pertussis
gcaugccgcugc

SEQ ID NO: 2429224 - RNA, 19 nt, Bordetella pertussis
gcaugccgcugcaggucgg

SEQ ID NO: 2429225 - RNA, 21 nt, Bordetella pertussis
gcaugccgcugcaggucggga

SEQ ID NO: 2429226 - RNA, 22 nt, Bordetella pertussis
gcaugccggcauaggcggcgca

SEQ ID NO: 2429227 - RNA, 23 nt, Bordetella pertussis
gcaugccggcauaggcggcgcag

SEQ ID NO: 2429228 - RNA, 16 nt, Bordetella pertussis
gcaugccggcgaugau

SEQ ID NO: 2429229 - RNA, 13 nt, Bordetella pertussis
gcaugccguccac

SEQ ID NO: 2429230 - RNA, 19 nt, Bordetella pertussis
gcaugccguccacgcccag

SEQ ID NO: 2429231 - RNA, 16 nt, Bordetella pertussis
gcaugccgucgagcgc

SEQ ID NO: 2429232 - RNA, 18 nt, Bordetella pertussis
gcaugccgucgagcgcga

SEQ ID NO: 2429233 - RNA, 16 nt, Bordetella pertussis
gcaugcgaaagccggc

SEQ ID NO: 2429234 - RNA, 17 nt, Bordetella pertussis
gcaugcgacaugagcug

SEQ ID NO: 2429235 - RNA, 21 nt, Bordetella pertussis
gcaugcgaggaaugcggcggg

SEQ ID NO: 2429236 - RNA, 20 nt, Bordetella pertussis
gcaugcgcagcgcgucggcg

SEQ ID NO: 2429237 - RNA, 22 nt, Bordetella pertussis
gcaugcgcagcgcgucggcgcg

SEQ ID NO: 2429238 - RNA, 12 nt, Bordetella pertussis
gcaugcgccagc

SEQ ID NO: 2429239 - RNA, 13 nt, Bordetella pertussis
gcaugcgccagcc

SEQ ID NO: 2429240 - RNA, 15 nt, Bordetella pertussis
gcaugcgccagccag

SEQ ID NO: 2429241 - RNA, 16 nt, Bordetella pertussis
gcaugcgccagccagc

SEQ ID NO: 2429242 - RNA, 17 nt, Bordetella pertussis
gcaugcgccagccagcg

SEQ ID NO: 2429243 - RNA, 19 nt, Bordetella pertussis
gcaugcgccagccagcgca

SEQ ID NO: 2429244 - RNA, 14 nt, Bordetella pertussis
gcaugcgccagcgc

SEQ ID NO: 2429245 - RNA, 15 nt, Bordetella pertussis
gcaugcgccagcgcc

SEQ ID NO: 2429246 - RNA, 18 nt, Bordetella pertussis
gcaugcgccgcaccagcg

SEQ ID NO: 2429247 - RNA, 21 nt, Bordetella pertussis
gcaugcgccgcaccagcggcg

SEQ ID NO: 2429248 - RNA, 16 nt, Bordetella pertussis
gcaugcgccggcccgg

SEQ ID NO: 2429249 - RNA, 12 nt, Bordetella pertussis
gcaugcgccugc

SEQ ID NO: 2429250 - RNA, 15 nt, Bordetella pertussis
gcaugcgccugcgcc

SEQ ID NO: 2429251 - RNA, 22 nt, Bordetella pertussis
gcaugcgccugucccaggcgcu

SEQ ID NO: 2429252 - RNA, 17 nt, Bordetella pertussis
gcaugcgcgaacgcgcg

SEQ ID NO: 2429253 - RNA, 11 nt, Bordetella pertussis
gcaugcgcgcg

SEQ ID NO: 2429254 - RNA, 14 nt, Bordetella pertussis
gcaugcgcgcggcc

SEQ ID NO: 2429255 - RNA, 15 nt, Bordetella pertussis
gcaugcgcgcggccu

SEQ ID NO: 2429256 - RNA, 21 nt, Bordetella pertussis
gcaugcgcggcgggacggcca

SEQ ID NO: 2429257 - RNA, 22 nt, Bordetella pertussis
gcaugcgcggcgggacggccau

SEQ ID NO: 2429258 - RNA, 17 nt, Bordetella pertussis
gcaugcgcgucuccagc

SEQ ID NO: 2429259 - RNA, 20 nt, Bordetella pertussis
gcaugcgcgucuccagcgcc

SEQ ID NO: 2429260 - RNA, 21 nt, Bordetella pertussis
gcaugcgcgucuccagcgccg

SEQ ID NO: 2429261 - RNA, 22 nt, Bordetella pertussis
gcaugcgcgucuccagcgccgg

SEQ ID NO: 2429262 - RNA, 21 nt, Bordetella pertussis
gcaugcggcacaaccuggcgc

SEQ ID NO: 2429263 - RNA, 19 nt, Bordetella pertussis
gcaugcggcgccugucccg

SEQ ID NO: 2429264 - RNA, 15 nt, Bordetella pertussis
gcaugcggcggacuc

SEQ ID NO: 2429265 - RNA, 13 nt, Bordetella pertussis
gcaugcgggccau

SEQ ID NO: 2429266 - RNA, 21 nt, Bordetella pertussis
gcaugcgguuucucagcgcgc

SEQ ID NO: 2429267 - RNA, 22 nt, Bordetella pertussis
gcaugcgguuucucagcgcgcu

SEQ ID NO: 2429268 - RNA, 15 nt, Bordetella pertussis
gcaugcgugaagccc

SEQ ID NO: 2429269 - RNA, 22 nt, Bordetella pertussis
gcaugcgugaagcccauggcgu

SEQ ID NO: 2429270 - RNA, 19 nt, Bordetella pertussis
gcaugcucuggcacaccag

SEQ ID NO: 2429271 - RNA, 23 nt, Bordetella pertussis
gcaugcucuggcacaccagcgcc

SEQ ID NO: 2429272 - RNA, 16 nt, Bordetella pertussis
gcaugcugcagcugcu

SEQ ID NO: 2429273 - RNA, 19 nt, Bordetella pertussis
gcaugcugcgcgagguggg

SEQ ID NO: 2429274 - RNA, 20 nt, Bordetella pertussis
gcaugcugcgcgaggugggc

SEQ ID NO: 2429275 - RNA, 14 nt, Bordetella pertussis
gcaugcuggagaug

SEQ ID NO: 2429276 - RNA, 13 nt, Bordetella pertussis
gcaugcugguugg

SEQ ID NO: 2429277 - RNA, 20 nt, Bordetella pertussis
gcaugcugguugggcucggu

SEQ ID NO: 2429278 - RNA, 21 nt, Bordetella pertussis
gcaugcugguugggcucgguc

SEQ ID NO: 2429279 - RNA, 15 nt, Bordetella pertussis
gcauggacugcaggc

SEQ ID NO: 2429280 - RNA, 20 nt, Bordetella pertussis
gcauggacugcaggcgcugc

SEQ ID NO: 2429281 - RNA, 21 nt, Bordetella pertussis
gcauggacugcaggcgcugcg

SEQ ID NO: 2429282 - RNA, 14 nt, Bordetella pertussis
gcauggagaccggc

SEQ ID NO: 2429283 - RNA, 15 nt, Bordetella pertussis
gcauggagaccggcg

SEQ ID NO: 2429284 - RNA, 13 nt, Bordetella pertussis
gcauggcagcaga

SEQ ID NO: 2429285 - RNA, 21 nt, Bordetella pertussis
gcauggcagcagaucggcggc

SEQ ID NO: 2429286 - RNA, 19 nt, Bordetella pertussis
gcauggccaaugccauugg

SEQ ID NO: 2429287 - RNA, 14 nt, Bordetella pertussis
gcauggccaccagg

SEQ ID NO: 2429288 - RNA, 16 nt, Bordetella pertussis
gcauggccaccaggua

SEQ ID NO: 2429289 - RNA, 23 nt, Bordetella pertussis
gcauggccaccagguagggcagc

SEQ ID NO: 2429290 - RNA, 13 nt, Bordetella pertussis
gcauggccagcac

SEQ ID NO: 2429291 - RNA, 17 nt, Bordetella pertussis
gcauggccagcgcgcag

SEQ ID NO: 2429292 - RNA, 20 nt, Bordetella pertussis
gcauggccagcgcgcaggug

SEQ ID NO: 2429293 - RNA, 13 nt, Bordetella pertussis
gcauggccaggaa

SEQ ID NO: 2429294 - RNA, 19 nt, Bordetella pertussis
gcauggccggcaggucgau

SEQ ID NO: 2429295 - RNA, 13 nt, Bordetella pertussis
gcauggccggcgu

SEQ ID NO: 2429296 - RNA, 13 nt, Bordetella pertussis
gccaaagcacagg

SEQ ID NO: 2429297 - RNA, 14 nt, Bordetella pertussis
gccaaagcgcagcg

SEQ ID NO: 2429298 - RNA, 21 nt, Bordetella pertussis
gccaacacgauccacggccgg

SEQ ID NO: 2429299 - RNA, 17 nt, Bordetella pertussis
gccaacagcucgcgcca

SEQ ID NO: 2429300 - RNA, 18 nt, Bordetella pertussis
gccaacagcucgcgccag

SEQ ID NO: 2429301 - RNA, 19 nt, Bordetella pertussis
gccaacagcucgcgccagg

SEQ ID NO: 2429302 - RNA, 18 nt, Bordetella pertussis
gccaaccccgagggcgcg

SEQ ID NO: 2429303 - RNA, 20 nt, Bordetella pertussis
gccaaccccgagggcgcggc

SEQ ID NO: 2429304 - RNA, 21 nt, Bordetella pertussis
gccaaccccgagggcgcggcg

SEQ ID NO: 2429305 - RNA, 14 nt, Bordetella pertussis
gccaacccgccauc

SEQ ID NO: 2429306 - RNA, 23 nt, Bordetella pertussis
gccaacccggccucagcggccgc

SEQ ID NO: 2429307 - RNA, 13 nt, Bordetella pertussis
gccaacccucgca

SEQ ID NO: 2429308 - RNA, 23 nt, Bordetella pertussis
gccaacccucgcacggccgucaa

SEQ ID NO: 2429309 - RNA, 18 nt, Bordetella pertussis
gccaacgauuccgcgucc

SEQ ID NO: 2429310 - RNA, 19 nt, Bordetella pertussis
gccaacgcacaagggcccc

SEQ ID NO: 2429311 - RNA, 17 nt, Bordetella pertussis
gccaacgccacgcccau

SEQ ID NO: 2429312 - RNA, 13 nt, Bordetella pertussis
gccaacgcggcgc

SEQ ID NO: 2429313 - RNA, 18 nt, Bordetella pertussis
gccaacgcggcgcgugca

SEQ ID NO: 2429314 - RNA, 21 nt, Bordetella pertussis
gccaacggaagagggcggggc

SEQ ID NO: 2429315 - RNA, 22 nt, Bordetella pertussis
gccaacggcuggcugggcgcgc

SEQ ID NO: 2429316 - RNA, 20 nt, Bordetella pertussis
gccaacgggauccggcagca

SEQ ID NO: 2429317 - RNA, 15 nt, Bordetella pertussis
gccaacgucggcagc

SEQ ID NO: 2429318 - RNA, 16 nt, Bordetella pertussis
gccaacgucggcagcc

SEQ ID NO: 2429319 - RNA, 17 nt, Bordetella pertussis
gccaacgucggcagcca

SEQ ID NO: 2429320 - RNA, 18 nt, Bordetella pertussis
gccaagaccgcggccgcg

SEQ ID NO: 2429321 - RNA, 23 nt, Bordetella pertussis
gccaagaccgcggccgcgcuggc

SEQ ID NO: 2429322 - RNA, 22 nt, Bordetella pertussis
gccaagacgcggggacaggcac

SEQ ID NO: 2429323 - RNA, 23 nt, Bordetella pertussis
gccaagacgguaucugucccggc

SEQ ID NO: 2429324 - RNA, 17 nt, Bordetella pertussis
gccaagauccagcuuca

SEQ ID NO: 2429325 - RNA, 12 nt, Bordetella pertussis
gccaagauggcc

SEQ ID NO: 2429326 - RNA, 21 nt, Bordetella pertussis
gccaagcagcgccugccgcgu

SEQ ID NO: 2429327 - RNA, 13 nt, Bordetella pertussis
gccaagcgcgccg

SEQ ID NO: 2429328 - RNA, 15 nt, Bordetella pertussis
gccaagcgcgccggc

SEQ ID NO: 2429329 - RNA, 13 nt, Bordetella pertussis
gccaagcggcagg

SEQ ID NO: 2429330 - RNA, 18 nt, Bordetella pertussis
gccaagcugcuggccggc

SEQ ID NO: 2429331 - RNA, 13 nt, Bordetella pertussis
gccaagcuggaga

SEQ ID NO: 2429332 - RNA, 22 nt, Bordetella pertussis
gccaagcuggagaagcgccgcg

SEQ ID NO: 2429333 - RNA, 17 nt, Bordetella pertussis
gccaaggagacacgcua

SEQ ID NO: 2429334 - RNA, 21 nt, Bordetella pertussis
gccaaggcauuggcgccgcgc

SEQ ID NO: 2429335 - RNA, 22 nt, Bordetella pertussis
gccaaggcauuggcgccgcgcu

SEQ ID NO: 2429336 - RNA, 21 nt, Bordetella pertussis
gccaaggccggcgcgucgcgc

SEQ ID NO: 2429337 - RNA, 14 nt, Bordetella pertussis
gccaagggcgccgc

SEQ ID NO: 2429338 - RNA, 16 nt, Bordetella pertussis
gccaagggcgccgcgc

SEQ ID NO: 2429339 - RNA, 15 nt, Bordetella pertussis
gccaagggcgcgcca

SEQ ID NO: 2429340 - RNA, 16 nt, Bordetella pertussis
gccaagggcgcgccag

SEQ ID NO: 2429341 - RNA, 16 nt, Bordetella pertussis
gccaagggcgugcgcu

SEQ ID NO: 2429342 - RNA, 22 nt, Bordetella pertussis
gccaaggugccuguccccgcgg

SEQ ID NO: 2429343 - RNA, 23 nt, Bordetella pertussis
gccaagugggcauagcguuuugu

SEQ ID NO: 2429344 - RNA, 21 nt, Bordetella pertussis
gccaauagcgguggcgggcca

SEQ ID NO: 2429345 - RNA, 16 nt, Bordetella pertussis
gccaaucagauggcgc

SEQ ID NO: 2429346 - RNA, 20 nt, Bordetella pertussis
gccaaucagauggcgcagcg

SEQ ID NO: 2429347 - RNA, 19 nt, Bordetella pertussis
gccaaucaugcgcugcugg

SEQ ID NO: 2429348 - RNA, 18 nt, Bordetella pertussis
gccaaucggccugcuggu

SEQ ID NO: 2429349 - RNA, 15 nt, Bordetella pertussis
gccaaucggcguuga

SEQ ID NO: 2429350 - RNA, 16 nt, Bordetella pertussis
gccaaucugccgcuga

SEQ ID NO: 2429351 - RNA, 17 nt, Bordetella pertussis
gccaaugccauuggugc

SEQ ID NO: 2429352 - RNA, 18 nt, Bordetella pertussis
gccaaugccgcgguugcg

SEQ ID NO: 2429353 - RNA, 14 nt, Bordetella pertussis
gccaaugcgccgcg

SEQ ID NO: 2429354 - RNA, 18 nt, Bordetella pertussis
gccaaugcgccgcgccaa

SEQ ID NO: 2429355 - RNA, 16 nt, Bordetella pertussis
gccaauggccgcggcg

SEQ ID NO: 2429356 - RNA, 23 nt, Bordetella pertussis
gccaauggccggugagauccagc

SEQ ID NO: 2429357 - RNA, 15 nt, Bordetella pertussis
gccaauggcggaugc

SEQ ID NO: 2429358 - RNA, 16 nt, Bordetella pertussis
gccaauugcuugccug

SEQ ID NO: 2429359 - RNA, 19 nt, Bordetella pertussis
gccaauugcuugccugucc

SEQ ID NO: 2429360 - RNA, 20 nt, Bordetella pertussis
gccaauugcuugccuguccc

SEQ ID NO: 2429361 - RNA, 19 nt, Bordetella pertussis
gccacaaagggcgugucuc

SEQ ID NO: 2429362 - RNA, 20 nt, Bordetella pertussis
gccacaaagggcgugucucu

SEQ ID NO: 2429363 - RNA, 17 nt, Bordetella pertussis
gccacaauugccagccu

SEQ ID NO: 2429364 - RNA, 20 nt, Bordetella pertussis
gccacaccagguugucggcg

SEQ ID NO: 2429365 - RNA, 22 nt, Bordetella pertussis
gccacaccagguugucggcgcc

SEQ ID NO: 2429366 - RNA, 23 nt, Bordetella pertussis
gccacaccagguugucggcgcca

SEQ ID NO: 2429367 - RNA, 23 nt, Bordetella pertussis
gccacaccgcugcgggaggugcc

SEQ ID NO: 2429368 - RNA, 15 nt, Bordetella pertussis
gccacacgaggaccg

SEQ ID NO: 2429369 - RNA, 13 nt, Bordetella pertussis
gccacacgaucag

SEQ ID NO: 2429370 - RNA, 16 nt, Bordetella pertussis
gccacacgaucagcgc

SEQ ID NO: 2429371 - RNA, 18 nt, Bordetella pertussis
gccacacgcugaagcgcc

SEQ ID NO: 2429372 - RNA, 20 nt, Bordetella pertussis
gccacacgcugaagcgccgc

SEQ ID NO: 2429373 - RNA, 22 nt, Bordetella pertussis
gccacacgcugaagcgccgcca

SEQ ID NO: 2429374 - RNA, 16 nt, Bordetella pertussis
gccacacgggcgccug

SEQ ID NO: 2429375 - RNA, 18 nt, Bordetella pertussis
gccacacgggcgccugcc

SEQ ID NO: 2429376 - RNA, 21 nt, Bordetella pertussis
gccacacgggcgccugccgca

SEQ ID NO: 2429377 - RNA, 15 nt, Bordetella pertussis
gccacagauuggcca

SEQ ID NO: 2429378 - RNA, 21 nt, Bordetella pertussis
gccacagcaugaccucggccu

SEQ ID NO: 2429379 - RNA, 20 nt, Bordetella pertussis
gccacagcgccaucgcgcgc

SEQ ID NO: 2429380 - RNA, 14 nt, Bordetella pertussis
gccacagcgcgugg

SEQ ID NO: 2429381 - RNA, 15 nt, Bordetella pertussis
gccacaggcgcuugc

SEQ ID NO: 2429382 - RNA, 17 nt, Bordetella pertussis
gccacaggcgcuugcca

SEQ ID NO: 2429383 - RNA, 14 nt, Bordetella pertussis
gccacaggcugacg

SEQ ID NO: 2429384 - RNA, 15 nt, Bordetella pertussis
gccacaggcugacgc

SEQ ID NO: 2429385 - RNA, 23 nt, Bordetella pertussis
gccacagggccugacgcucaucc

SEQ ID NO: 2429386 - RNA, 15 nt, Bordetella pertussis
gccacaggugcgcgg

SEQ ID NO: 2429387 - RNA, 18 nt, Bordetella pertussis
gccacaggugcgcggcgc

SEQ ID NO: 2429388 - RNA, 20 nt, Bordetella pertussis
gccacaggugcgcggcgcgc

SEQ ID NO: 2429389 - RNA, 18 nt, Bordetella pertussis
gccacauaaucgucggca

SEQ ID NO: 2429390 - RNA, 15 nt, Bordetella pertussis
gccacaucacgccgg

SEQ ID NO: 2429391 - RNA, 12 nt, Bordetella pertussis
gccacaucaucg

SEQ ID NO: 2429392 - RNA, 14 nt, Bordetella pertussis
gccacauccugcac

SEQ ID NO: 2429393 - RNA, 15 nt, Bordetella pertussis
gccacauccugcacg

SEQ ID NO: 2429394 - RNA, 22 nt, Bordetella pertussis
gccacaucgaauuugaacagcc

SEQ ID NO: 2429395 - RNA, 16 nt, Bordetella pertussis
gccacauggucgccca

SEQ ID NO: 2429396 - RNA, 22 nt, Bordetella pertussis
gccaccaaaaacggucugccgc

SEQ ID NO: 2429397 - RNA, 15 nt, Bordetella pertussis
gccaccaacgaaggc

SEQ ID NO: 2429398 - RNA, 21 nt, Bordetella pertussis
gccaccaacgaaggcauccag

SEQ ID NO: 2429399 - RNA, 22 nt, Bordetella pertussis
gccaccacaaggauggacuggc

SEQ ID NO: 2429400 - RNA, 15 nt, Bordetella pertussis
gccaccaccaggccc

SEQ ID NO: 2429401 - RNA, 12 nt, Bordetella pertussis
gccaccaccggc

SEQ ID NO: 2429402 - RNA, 20 nt, Bordetella pertussis
gccaccaccggcacgccggc

SEQ ID NO: 2429403 - RNA, 23 nt, Bordetella pertussis
gccaccaccggcacgccggcggc

SEQ ID NO: 2429404 - RNA, 14 nt, Bordetella pertussis
gccaccaccgucuc

SEQ ID NO: 2429405 - RNA, 21 nt, Bordetella pertussis
gccaccaccgucucgaacgcc

SEQ ID NO: 2429406 - RNA, 15 nt, Bordetella pertussis
gccaccaccucggcc

SEQ ID NO: 2429407 - RNA, 21 nt, Bordetella pertussis
gccaccaccucggugccgugg

SEQ ID NO: 2429408 - RNA, 21 nt, Bordetella pertussis
gccacgaccggcucgaucgcc

SEQ ID NO: 2429409 - RNA, 16 nt, Bordetella pertussis
gccacgacgccgucgc

SEQ ID NO: 2429410 - RNA, 22 nt, Bordetella pertussis
gccacgaucccgucauggcggc

SEQ ID NO: 2429411 - RNA, 20 nt, Bordetella pertussis
gccacgaugauggaggccag

SEQ ID NO: 2429412 - RNA, 21 nt, Bordetella pertussis
gccacgaugauggaggccagg

SEQ ID NO: 2429413 - RNA, 16 nt, Bordetella pertussis
gccacgauguugcgca

SEQ ID NO: 2429414 - RNA, 18 nt, Bordetella pertussis
gccacgauguugcgcagg

SEQ ID NO: 2429415 - RNA, 13 nt, Bordetella pertussis
gccacgcaggcgg

SEQ ID NO: 2429416 - RNA, 14 nt, Bordetella pertussis
gccacgcaggcggg

SEQ ID NO: 2429417 - RNA, 18 nt, Bordetella pertussis
gccacgcaggcgggcgcc

SEQ ID NO: 2429418 - RNA, 19 nt, Bordetella pertussis
gccacgcaggcgggcgccg

SEQ ID NO: 2429419 - RNA, 20 nt, Bordetella pertussis
gccacgcaggcgggcgccgc

SEQ ID NO: 2429420 - RNA, 21 nt, Bordetella pertussis
gccacgcaggcgggcgccgcg

SEQ ID NO: 2429421 - RNA, 23 nt, Bordetella pertussis
gccacgcccaagucgaguucggc

SEQ ID NO: 2429422 - RNA, 17 nt, Bordetella pertussis
gccacgcccacgcgccg

SEQ ID NO: 2429423 - RNA, 18 nt, Bordetella pertussis
gccacgcccacgcgccgc

SEQ ID NO: 2429424 - RNA, 20 nt, Bordetella pertussis
gccacgcccacgcgccgcca

SEQ ID NO: 2429425 - RNA, 20 nt, Bordetella pertussis
gccacgcccacuuccucggc

SEQ ID NO: 2429426 - RNA, 14 nt, Bordetella pertussis
gccacgcccaggcc

SEQ ID NO: 2429427 - RNA, 17 nt, Bordetella pertussis
gccacgcccaggccgcu

SEQ ID NO: 2429428 - RNA, 18 nt, Bordetella pertussis
gccacgcccaggccgcuu

SEQ ID NO: 2429429 - RNA, 21 nt, Bordetella pertussis
gccacgcccaggccguggcgc

SEQ ID NO: 2429430 - RNA, 23 nt, Bordetella pertussis
gccacgcccaggccguggcgcac

SEQ ID NO: 2429431 - RNA, 21 nt, Bordetella pertussis
gccacgcccgucucgcgcgcc

SEQ ID NO: 2429432 - RNA, 14 nt, Bordetella pertussis
gccacgcccuggca

SEQ ID NO: 2429433 - RNA, 17 nt, Bordetella pertussis
gccacgcccuggcagcu

SEQ ID NO: 2429434 - RNA, 20 nt, Bordetella pertussis
gccacgcccuggcagcuggc

SEQ ID NO: 2429435 - RNA, 23 nt, Bordetella pertussis
gccacgcccuggcagcuggcgcg

SEQ ID NO: 2429436 - RNA, 12 nt, Bordetella pertussis
gccacgcccugu

SEQ ID NO: 2429437 - RNA, 16 nt, Bordetella pertussis
gccacgccggccacga

SEQ ID NO: 2429438 - RNA, 21 nt, Bordetella pertussis
gccacgccggccacgaacggc

SEQ ID NO: 2429439 - RNA, 13 nt, Bordetella pertussis
gccacgccggccg

SEQ ID NO: 2429440 - RNA, 16 nt, Bordetella pertussis
gccacgccggccgccu

SEQ ID NO: 2429441 - RNA, 18 nt, Bordetella pertussis
gccacgccggccgccugg

SEQ ID NO: 2429442 - RNA, 20 nt, Bordetella pertussis
gccacgccggccgccuggcc

SEQ ID NO: 2429443 - RNA, 14 nt, Bordetella pertussis
gccacgccggccgg

SEQ ID NO: 2429444 - RNA, 17 nt, Bordetella pertussis
gccacgccggcgcgccg

SEQ ID NO: 2429445 - RNA, 20 nt, Bordetella pertussis
gccacgccggcgcgccggcc

SEQ ID NO: 2429446 - RNA, 22 nt, Bordetella pertussis
gccacgccggcgcgccggccgc

SEQ ID NO: 2429447 - RNA, 15 nt, Bordetella pertussis
gccacgccgucagcg

SEQ ID NO: 2429448 - RNA, 13 nt, Bordetella pertussis
gccacgccuggcc

SEQ ID NO: 2429449 - RNA, 18 nt, Bordetella pertussis
gccacgccuuguucgcgc

SEQ ID NO: 2429450 - RNA, 20 nt, Bordetella pertussis
gccacgccuuguucgcgcgc

SEQ ID NO: 2429451 - RNA, 15 nt, Bordetella pertussis
gccacgcgagcccgc

SEQ ID NO: 2429452 - RNA, 12 nt, Bordetella pertussis
gccacgcgcaac

SEQ ID NO: 2429453 - RNA, 13 nt, Bordetella pertussis
gccacgcgcaacg

SEQ ID NO: 2429454 - RNA, 19 nt, Bordetella pertussis
gccacgcgcaacgccgcca

SEQ ID NO: 2429455 - RNA, 20 nt, Bordetella pertussis
gccacgcgcacauuggagua

SEQ ID NO: 2429456 - RNA, 17 nt, Bordetella pertussis
gccacgcgcacggccag

SEQ ID NO: 2429457 - RNA, 18 nt, Bordetella pertussis
gccacgcgcacggccagc

SEQ ID NO: 2429458 - RNA, 12 nt, Bordetella pertussis
gccacgcgccgc

SEQ ID NO: 2429459 - RNA, 13 nt, Bordetella pertussis
gccacgcgccgcc

SEQ ID NO: 2429460 - RNA, 14 nt, Bordetella pertussis
gccacgcgccgccc

SEQ ID NO: 2429461 - RNA, 16 nt, Bordetella pertussis
gccacgcgccgcccgg

SEQ ID NO: 2429462 - RNA, 21 nt, Bordetella pertussis
gccacgcgccgugcagacggc

SEQ ID NO: 2429463 - RNA, 23 nt, Bordetella pertussis
gccacgcgccgugcagacggcgg

SEQ ID NO: 2429464 - RNA, 20 nt, Bordetella pertussis
gccacgcgcgauccgcgcca

SEQ ID NO: 2429465 - RNA, 21 nt, Bordetella pertussis
gccacgcgcgauccgcgccag

SEQ ID NO: 2429466 - RNA, 17 nt, Bordetella pertussis
gccacgcgcgcuggcgc

SEQ ID NO: 2429467 - RNA, 18 nt, Bordetella pertussis
gccacgcgcgcuggcgcc

SEQ ID NO: 2429468 - RNA, 19 nt, Bordetella pertussis
gccacgcgcgcuggcgccc

SEQ ID NO: 2429469 - RNA, 22 nt, Bordetella pertussis
gccacgcgcggaucggccacga

SEQ ID NO: 2429470 - RNA, 12 nt, Bordetella pertussis
gccacgcgcugc

SEQ ID NO: 2429471 - RNA, 12 nt, Bordetella pertussis
gccacgcgcugu

SEQ ID NO: 2429472 - RNA, 13 nt, Bordetella pertussis
gccacgcgcuugc

SEQ ID NO: 2429473 - RNA, 20 nt, Bordetella pertussis
gccacgcgcuugcgcgccac

SEQ ID NO: 2429474 - RNA, 21 nt, Bordetella pertussis
gccacgcgcuugcgcgccacg

SEQ ID NO: 2429475 - RNA, 14 nt, Bordetella pertussis
gccacgcgggcgug

SEQ ID NO: 2429476 - RNA, 19 nt, Bordetella pertussis
gccacgcgggcguggucau

SEQ ID NO: 2429477 - RNA, 18 nt, Bordetella pertussis
gccacgcgguccagcccc

SEQ ID NO: 2429478 - RNA, 21 nt, Bordetella pertussis
gccacgcgguccagccccugc

SEQ ID NO: 2429479 - RNA, 15 nt, Bordetella pertussis
gccacgcugcccugc

SEQ ID NO: 2429480 - RNA, 17 nt, Bordetella pertussis
gccacgcugcccugcug

SEQ ID NO: 2429481 - RNA, 18 nt, Bordetella pertussis
gccacgcugcccugcugc

SEQ ID NO: 2429482 - RNA, 16 nt, Bordetella pertussis
gccacgcuggccgcgc

SEQ ID NO: 2429483 - RNA, 19 nt, Bordetella pertussis
gccacgcuggccgcgcugg

SEQ ID NO: 2429484 - RNA, 20 nt, Bordetella pertussis
gccacgcuggccgcgcuggc

SEQ ID NO: 2429485 - RNA, 20 nt, Bordetella pertussis
gccacgcuguuuucggccga

SEQ ID NO: 2429486 - RNA, 21 nt, Bordetella pertussis
gccacggcaaugucgcaggcc

SEQ ID NO: 2429487 - RNA, 23 nt, Bordetella pertussis
gccacggcaggcgccugcccugc

SEQ ID NO: 2429488 - RNA, 16 nt, Bordetella pertussis
gccacggccgcgaucg

SEQ ID NO: 2429489 - RNA, 14 nt, Bordetella pertussis
gccacggccggcag

SEQ ID NO: 2429490 - RNA, 14 nt, Bordetella pertussis
gccacggccgggcc

SEQ ID NO: 2429491 - RNA, 18 nt, Bordetella pertussis
gccacggccugcccgggc

SEQ ID NO: 2429492 - RNA, 19 nt, Bordetella pertussis
gccacggccugcccgggcg

SEQ ID NO: 2429493 - RNA, 13 nt, Bordetella pertussis
gccacggcgauga

SEQ ID NO: 2429494 - RNA, 22 nt, Bordetella pertussis
gccacggcgaugaacagcggca

SEQ ID NO: 2429495 - RNA, 14 nt, Bordetella pertussis
gccacggcgggccg

SEQ ID NO: 2429496 - RNA, 18 nt, Bordetella pertussis
gccacggcgggccggcuc

SEQ ID NO: 2429497 - RNA, 13 nt, Bordetella pertussis
gccacggcgguga

SEQ ID NO: 2429498 - RNA, 18 nt, Bordetella pertussis
gccacggcggugaccacc

SEQ ID NO: 2429499 - RNA, 22 nt, Bordetella pertussis
gccacggcggugcugaacgccu

SEQ ID NO: 2429500 - RNA, 18 nt, Bordetella pertussis
gccacggcgucgaugcgc

SEQ ID NO: 2429501 - RNA, 22 nt, Bordetella pertussis
gccacggcgucgaugcgcgcgc

SEQ ID NO: 2429502 - RNA, 16 nt, Bordetella pertussis
gccacggcgucgccgg

SEQ ID NO: 2429503 - RNA, 18 nt, Bordetella pertussis
gccacggcgucgccggcc

SEQ ID NO: 2429504 - RNA, 20 nt, Bordetella pertussis
gccacggcgucgccggccag

SEQ ID NO: 2429505 - RNA, 23 nt, Bordetella pertussis
gccacggcgucgccggccaggca

SEQ ID NO: 2429506 - RNA, 24 nt, Bordetella pertussis
gccacggcgucgccggccaggcaa

SEQ ID NO: 2429507 - RNA, 12 nt, Bordetella pertussis
gccacggcugga

SEQ ID NO: 2429508 - RNA, 19 nt, Bordetella pertussis
gccacggcuucgcccagcg

SEQ ID NO: 2429509 - RNA, 21 nt, Bordetella pertussis
gccacgggauguccgcgucgg

SEQ ID NO: 2429510 - RNA, 14 nt, Bordetella pertussis
gccacgggcccgcg

SEQ ID NO: 2429511 - RNA, 20 nt, Bordetella pertussis
gccacgggcccgcgcagacg

SEQ ID NO: 2429512 - RNA, 21 nt, Bordetella pertussis
gccacgggcgucaccggcgag

SEQ ID NO: 2429513 - RNA, 15 nt, Bordetella pertussis
gccacggucggcacg

SEQ ID NO: 2429514 - RNA, 21 nt, Bordetella pertussis
gccacgucacggaucagccgc

SEQ ID NO: 2429515 - RNA, 23 nt, Bordetella pertussis
gccacgucauaggcuucgcccgc

SEQ ID NO: 2429516 - RNA, 13 nt, Bordetella pertussis
gccacguccagca

SEQ ID NO: 2429517 - RNA, 16 nt, Bordetella pertussis
gccacguccagcacgg

SEQ ID NO: 2429518 - RNA, 18 nt, Bordetella pertussis
gccacguccagcacggcc

SEQ ID NO: 2429519 - RNA, 13 nt, Bordetella pertussis
gccacgucgaccu

SEQ ID NO: 2429520 - RNA, 13 nt, Bordetella pertussis
gccagcagcacgu

SEQ ID NO: 2429521 - RNA, 13 nt, Bordetella pertussis
gccagcagcaggc

SEQ ID NO: 2429522 - RNA, 16 nt, Bordetella pertussis
gccagcagcaggccgu

SEQ ID NO: 2429523 - RNA, 21 nt, Bordetella pertussis
gccagcagcgacggccccagc

SEQ ID NO: 2429524 - RNA, 22 nt, Bordetella pertussis
gccagcagcgacggccccagcg

SEQ ID NO: 2429525 - RNA, 18 nt, Bordetella pertussis
gccagcagcgcaucgcgc

SEQ ID NO: 2429526 - RNA, 24 nt, Bordetella pertussis
gccagcagcgcaucgcgcgcgccg

SEQ ID NO: 2429527 - RNA, 19 nt, Bordetella pertussis
gccagcagcgccgccagca

SEQ ID NO: 2429528 - RNA, 20 nt, Bordetella pertussis
gccagcagcgccggaaagcu

SEQ ID NO: 2429529 - RNA, 15 nt, Bordetella pertussis
gccagcagcgccugg

SEQ ID NO: 2429530 - RNA, 22 nt, Bordetella pertussis
gccagcagcgcgugcagccagc

SEQ ID NO: 2429531 - RNA, 13 nt, Bordetella pertussis
gccagcagcgggc

SEQ ID NO: 2429532 - RNA, 14 nt, Bordetella pertussis
gccagcagcgggcu

SEQ ID NO: 2429533 - RNA, 15 nt, Bordetella pertussis
gccagcagcgggcug

SEQ ID NO: 2429534 - RNA, 23 nt, Bordetella pertussis
gccagcagcgggcuggggcaggc

SEQ ID NO: 2429535 - RNA, 15 nt, Bordetella pertussis
gccagcagcucggcc

SEQ ID NO: 2429536 - RNA, 18 nt, Bordetella pertussis
gccagcagcucggccacc

SEQ ID NO: 2429537 - RNA, 18 nt, Bordetella pertussis
gccagcagcucggcgacc

SEQ ID NO: 2429538 - RNA, 22 nt, Bordetella pertussis
gccagcagcucggcgaccaggc

SEQ ID NO: 2429539 - RNA, 13 nt, Bordetella pertussis
gccagcagcuggc

SEQ ID NO: 2429540 - RNA, 15 nt, Bordetella pertussis
gccagcagcuggcgc

SEQ ID NO: 2429541 - RNA, 17 nt, Bordetella pertussis
gccagcagcuggcgcag

SEQ ID NO: 2429542 - RNA, 19 nt, Bordetella pertussis
gccagcagcuugagcgaau

SEQ ID NO: 2429543 - RNA, 11 nt, Bordetella pertussis
gccagcaggcc

SEQ ID NO: 2429544 - RNA, 14 nt, Bordetella pertussis
gccagcaggcccug

SEQ ID NO: 2429545 - RNA, 21 nt, Bordetella pertussis
gccagcaggcccugggccagc

SEQ ID NO: 2429546 - RNA, 20 nt, Bordetella pertussis
gccagcaggcgaaacgccag

SEQ ID NO: 2429547 - RNA, 13 nt, Bordetella pertussis
gccagcaggcgcu

SEQ ID NO: 2429548 - RNA, 15 nt, Bordetella pertussis
gccagcaggcgcucg

SEQ ID NO: 2429549 - RNA, 16 nt, Bordetella pertussis
gccagcaggcgcucgg

SEQ ID NO: 2429550 - RNA, 16 nt, Bordetella pertussis
gccagcaggcgcuggu

SEQ ID NO: 2429551 - RNA, 19 nt, Bordetella pertussis
gccagcaggcucagcgggc

SEQ ID NO: 2429552 - RNA, 19 nt, Bordetella pertussis
gccagcagggucagcggcc

SEQ ID NO: 2429553 - RNA, 20 nt, Bordetella pertussis
gccagcagggucagcggccg

SEQ ID NO: 2429554 - RNA, 16 nt, Bordetella pertussis
gccagcaggucgcgca

SEQ ID NO: 2429555 - RNA, 19 nt, Bordetella pertussis
gccagcaggucgcgcacgc

SEQ ID NO: 2429556 - RNA, 22 nt, Bordetella pertussis
gccagcaggucgcgcacgcugg

SEQ ID NO: 2429557 - RNA, 23 nt, Bordetella pertussis
gccagcaggucgcgcacgcuggc

SEQ ID NO: 2429558 - RNA, 23 nt, Bordetella pertussis
gccagcaguguuucggccugcuc

SEQ ID NO: 2429559 - RNA, 22 nt, Bordetella pertussis
gccagcaguucgggguccagca

SEQ ID NO: 2429560 - RNA, 23 nt, Bordetella pertussis
gccagcaguucgggguccagcaa

SEQ ID NO: 2429561 - RNA, 17 nt, Bordetella pertussis
gccagcauacccugcgc

SEQ ID NO: 2429562 - RNA, 20 nt, Bordetella pertussis
gccagcauacccugcgcgcc

SEQ ID NO: 2429563 - RNA, 21 nt, Bordetella pertussis
gccagcauacccugcgcgccg

SEQ ID NO: 2429564 - RNA, 22 nt, Bordetella pertussis
gccagcauacccugcgcgccgc

SEQ ID NO: 2429565 - RNA, 14 nt, Bordetella pertussis
gccagcauccagcc

SEQ ID NO: 2429566 - RNA, 16 nt, Bordetella pertussis
gccagcauccagccga

SEQ ID NO: 2429567 - RNA, 20 nt, Bordetella pertussis
gccagcauccagccgaucag

SEQ ID NO: 2429568 - RNA, 19 nt, Bordetella pertussis
gccagcaucggcucgagca

SEQ ID NO: 2429569 - RNA, 22 nt, Bordetella pertussis
gccagcaugacggggucggggc

SEQ ID NO: 2429570 - RNA, 23 nt, Bordetella pertussis
gccagcaugacggggucggggca

SEQ ID NO: 2429571 - RNA, 13 nt, Bordetella pertussis
gccagcaugauca

SEQ ID NO: 2429572 - RNA, 17 nt, Bordetella pertussis
gccagcaugaucaugcc

SEQ ID NO: 2429573 - RNA, 14 nt, Bordetella pertussis
gccagcaugcgcgc

SEQ ID NO: 2429574 - RNA, 15 nt, Bordetella pertussis
gccagcaugcgcgcg

SEQ ID NO: 2429575 - RNA, 17 nt, Bordetella pertussis
gccagcaugcgcgcggc

SEQ ID NO: 2429576 - RNA, 19 nt, Bordetella pertussis
gccagcaugcgcgcggccu

SEQ ID NO: 2429577 - RNA, 15 nt, Bordetella pertussis
gccagcaugcugggu

SEQ ID NO: 2429578 - RNA, 13 nt, Bordetella pertussis
gccagcauggccg

SEQ ID NO: 2429579 - RNA, 16 nt, Bordetella pertussis
gccagcauggccgugg

SEQ ID NO: 2429580 - RNA, 18 nt, Bordetella pertussis
gccagcauggccguggcg

SEQ ID NO: 2429581 - RNA, 20 nt, Bordetella pertussis
gccagcauggccguggcgug

SEQ ID NO: 2429582 - RNA, 22 nt, Bordetella pertussis
gccagcauggcggccaggcgcg

SEQ ID NO: 2429583 - RNA, 13 nt, Bordetella pertussis
gccagcauggcgu

SEQ ID NO: 2429584 - RNA, 21 nt, Bordetella pertussis
gccagcauggcgucgaaacgc

SEQ ID NO: 2429585 - RNA, 16 nt, Bordetella pertussis
gccagcauuaccagca

SEQ ID NO: 2429586 - RNA, 23 nt, Bordetella pertussis
gccagcauuaccagcaacgcgcc

SEQ ID NO: 2429587 - RNA, 21 nt, Bordetella pertussis
gccagccaccccgucaucgcc

SEQ ID NO: 2429588 - RNA, 13 nt, Bordetella pertussis
gccagccacgccg

SEQ ID NO: 2429589 - RNA, 16 nt, Bordetella pertussis
gccagccacgccggcg

SEQ ID NO: 2429590 - RNA, 20 nt, Bordetella pertussis
gccagccacgccggcgcgcc

SEQ ID NO: 2429591 - RNA, 14 nt, Bordetella pertussis
gccagccacgcgcg

SEQ ID NO: 2429592 - RNA, 16 nt, Bordetella pertussis
gccagccacgcgcgcu

SEQ ID NO: 2429593 - RNA, 18 nt, Bordetella pertussis
gccagccacgcgcgcugg

SEQ ID NO: 2429594 - RNA, 19 nt, Bordetella pertussis
gccagccacgcgcgcuggc

SEQ ID NO: 2429595 - RNA, 22 nt, Bordetella pertussis
gccagccacgcgcgcuggcgcc

SEQ ID NO: 2429596 - RNA, 12 nt, Bordetella pertussis
gccagccagcgc

SEQ ID NO: 2429597 - RNA, 16 nt, Bordetella pertussis
gccagccagcgcaugc

SEQ ID NO: 2429598 - RNA, 18 nt, Bordetella pertussis
gccagccagcgccgcagc

SEQ ID NO: 2429599 - RNA, 13 nt, Bordetella pertussis
gccagccaggcgg

SEQ ID NO: 2429600 - RNA, 15 nt, Bordetella pertussis
gccagccauugccgc

SEQ ID NO: 2429601 - RNA, 19 nt, Bordetella pertussis
gccagccauugccgcacga

SEQ ID NO: 2429602 - RNA, 21 nt, Bordetella pertussis
gccagcccacaagccguacag

SEQ ID NO: 2429603 - RNA, 14 nt, Bordetella pertussis
gccagcccaccagc

SEQ ID NO: 2429604 - RNA, 21 nt, Bordetella pertussis
gccagcccaccagcgccacgc

SEQ ID NO: 2429605 - RNA, 22 nt, Bordetella pertussis
gccagccccaccuugcccagca

SEQ ID NO: 2429606 - RNA, 14 nt, Bordetella pertussis
gccagccccggcgc

SEQ ID NO: 2429607 - RNA, 16 nt, Bordetella pertussis
gccagccccggcgcgc

SEQ ID NO: 2429608 - RNA, 17 nt, Bordetella pertussis
gccagccccggcgcgcc

SEQ ID NO: 2429609 - RNA, 18 nt, Bordetella pertussis
gccagccccggcgcgccg

SEQ ID NO: 2429610 - RNA, 18 nt, Bordetella pertussis
gccagcccgacggccagc

SEQ ID NO: 2429611 - RNA, 15 nt, Bordetella pertussis
gccagcccgaggcac

SEQ ID NO: 2429612 - RNA, 13 nt, Bordetella pertussis
gccagcccgcccg

SEQ ID NO: 2429613 - RNA, 16 nt, Bordetella pertussis
gccagcccgcccgcga

SEQ ID NO: 2429614 - RNA, 20 nt, Bordetella pertussis
gccagcccgcccgcgagcgg

SEQ ID NO: 2429615 - RNA, 13 nt, Bordetella pertussis
gccagcccgccgc

SEQ ID NO: 2429616 - RNA, 14 nt, Bordetella pertussis
gccagcccgccggc

SEQ ID NO: 2429617 - RNA, 20 nt, Bordetella pertussis
gccagcccgccggcgcgcgc

SEQ ID NO: 2429618 - RNA, 15 nt, Bordetella pertussis
gccagcccgcgcgcg

SEQ ID NO: 2429619 - RNA, 13 nt, Bordetella pertussis
gccagcccuggcc

SEQ ID NO: 2429620 - RNA, 15 nt, Bordetella pertussis
gccagcccuggccca

SEQ ID NO: 2429621 - RNA, 17 nt, Bordetella pertussis
gccagcccuggcccagc

SEQ ID NO: 2429622 - RNA, 18 nt, Bordetella pertussis
gccagcccuggcccagcg

SEQ ID NO: 2429623 - RNA, 15 nt, Bordetella pertussis
gccagccgccgcgcg

SEQ ID NO: 2429624 - RNA, 12 nt, Bordetella pertussis
gccagccgcgcc

SEQ ID NO: 2429625 - RNA, 13 nt, Bordetella pertussis
gccagccgcgccu

SEQ ID NO: 2429626 - RNA, 18 nt, Bordetella pertussis
gccagccgcgccugcagc

SEQ ID NO: 2429627 - RNA, 23 nt, Bordetella pertussis
gccagccgcgccugcagcagcgg

SEQ ID NO: 2429628 - RNA, 16 nt, Bordetella pertussis
gccagccgcgcgaccu

SEQ ID NO: 2429629 - RNA, 13 nt, Bordetella pertussis
gccagccgcucgc

SEQ ID NO: 2429630 - RNA, 15 nt, Bordetella pertussis
gccagccgcucgcgc

SEQ ID NO: 2429631 - RNA, 18 nt, Bordetella pertussis
gccagccgcuggcgauca

SEQ ID NO: 2429632 - RNA, 24 nt, Bordetella pertussis
gccagccgcuggcgaucaggccgc

SEQ ID NO: 2429633 - RNA, 22 nt, Bordetella pertussis
gccagcgcgguugacugcagcc

SEQ ID NO: 2429634 - RNA, 20 nt, Bordetella pertussis
gccagcgcgucgagcagcgc

SEQ ID NO: 2429635 - RNA, 16 nt, Bordetella pertussis
gccagcgcgucgcgua

SEQ ID NO: 2429636 - RNA, 18 nt, Bordetella pertussis
gccagcgcuguccaggcc

SEQ ID NO: 2429637 - RNA, 19 nt, Bordetella pertussis
gccagcgcuguccaggccg

SEQ ID NO: 2429638 - RNA, 20 nt, Bordetella pertussis
gccagcgcuguccaggccgg

SEQ ID NO: 2429639 - RNA, 16 nt, Bordetella pertussis
gccagcgcuucgggca

SEQ ID NO: 2429640 - RNA, 22 nt, Bordetella pertussis
gccagcgcuucgggcagcucgc

SEQ ID NO: 2429641 - RNA, 23 nt, Bordetella pertussis
gccagcgcuucgggcagcucgcg

SEQ ID NO: 2429642 - RNA, 21 nt, Bordetella pertussis
gccagcggaugaugcggcgcc

SEQ ID NO: 2429643 - RNA, 10 nt, Bordetella pertussis
gccagcggca

SEQ ID NO: 2429644 - RNA, 14 nt, Bordetella pertussis
gccagcggcagcgc

SEQ ID NO: 2429645 - RNA, 18 nt, Bordetella pertussis
gccagcggcagcgcgcag

SEQ ID NO: 2429646 - RNA, 20 nt, Bordetella pertussis
gccagcggcagcgcgcagga

SEQ ID NO: 2429647 - RNA, 22 nt, Bordetella pertussis
gccagcggcagcgcgcaggaca

SEQ ID NO: 2429648 - RNA, 16 nt, Bordetella pertussis
gccagcggcaggacgg

SEQ ID NO: 2429649 - RNA, 14 nt, Bordetella pertussis
gccagcggcaggcc

SEQ ID NO: 2429650 - RNA, 18 nt, Bordetella pertussis
gccagcggcaggcccagc

SEQ ID NO: 2429651 - RNA, 14 nt, Bordetella pertussis
gccagcggcagggg

SEQ ID NO: 2429652 - RNA, 19 nt, Bordetella pertussis
gccagcggcaggggcucgc

SEQ ID NO: 2429653 - RNA, 21 nt, Bordetella pertussis
gccagcggcaggggcucgcgc

SEQ ID NO: 2429654 - RNA, 21 nt, Bordetella pertussis
gccagcggcauugcccagguu

SEQ ID NO: 2429655 - RNA, 16 nt, Bordetella pertussis
gccagcggccgauagc

SEQ ID NO: 2429656 - RNA, 15 nt, Bordetella pertussis
gccagcggccgucgc

SEQ ID NO: 2429657 - RNA, 22 nt, Bordetella pertussis
gccagcggcgacugccccagcg

SEQ ID NO: 2429658 - RNA, 15 nt, Bordetella pertussis
gccagcggcgagcaa

SEQ ID NO: 2429659 - RNA, 12 nt, Bordetella pertussis
gccagcggcgca

SEQ ID NO: 2429660 - RNA, 14 nt, Bordetella pertussis
gccagcggcgcagc

SEQ ID NO: 2429661 - RNA, 15 nt, Bordetella pertussis
gccagcggcgcagcc

SEQ ID NO: 2429662 - RNA, 16 nt, Bordetella pertussis
gccagcggcgcagccg

SEQ ID NO: 2429663 - RNA, 18 nt, Bordetella pertussis
gccagcggcgcagccggc

SEQ ID NO: 2429664 - RNA, 15 nt, Bordetella pertussis
gccagcggcuggcgc

SEQ ID NO: 2429665 - RNA, 17 nt, Bordetella pertussis
gccagcggcuggcgccg

SEQ ID NO: 2429666 - RNA, 13 nt, Bordetella pertussis
gccagcggggccg

SEQ ID NO: 2429667 - RNA, 18 nt, Bordetella pertussis
gccagcggugcgcggcgc

SEQ ID NO: 2429668 - RNA, 19 nt, Bordetella pertussis
gccagcggugcgcggcgca

SEQ ID NO: 2429669 - RNA, 20 nt, Bordetella pertussis
gccagcggugcgcggcgcag

SEQ ID NO: 2429670 - RNA, 21 nt, Bordetella pertussis
gccagcggugcgcggcgcagc

SEQ ID NO: 2429671 - RNA, 18 nt, Bordetella pertussis
gccagcgguucgucggcg

SEQ ID NO: 2429672 - RNA, 19 nt, Bordetella pertussis
gccagcgguucgucggcgc

SEQ ID NO: 2429673 - RNA, 20 nt, Bordetella pertussis
gccagcgguucgucggcgcu

SEQ ID NO: 2429674 - RNA, 15 nt, Bordetella pertussis
gccagcgucagcgca

SEQ ID NO: 2429675 - RNA, 13 nt, Bordetella pertussis
gccagcgucaggc

SEQ ID NO: 2429676 - RNA, 16 nt, Bordetella pertussis
gccagcgucaggcugg

SEQ ID NO: 2429677 - RNA, 16 nt, Bordetella pertussis
gccagcgugcccagcg

SEQ ID NO: 2429678 - RNA, 18 nt, Bordetella pertussis
gccagcgugcccagcgag

SEQ ID NO: 2429679 - RNA, 13 nt, Bordetella pertussis
gccagcgugccgg

SEQ ID NO: 2429680 - RNA, 14 nt, Bordetella pertussis
gccagcgugccggu

SEQ ID NO: 2429681 - RNA, 17 nt, Bordetella pertussis
gccagcguggggacgcg

SEQ ID NO: 2429682 - RNA, 20 nt, Bordetella pertussis
gccagcguggggacgcgggc

SEQ ID NO: 2429683 - RNA, 21 nt, Bordetella pertussis
gccagcguggggacgcgggcc

SEQ ID NO: 2429684 - RNA, 22 nt, Bordetella pertussis
gccagcguggggacgcgggcca

SEQ ID NO: 2429685 - RNA, 17 nt, Bordetella pertussis
gccagcguucggccacc

SEQ ID NO: 2429686 - RNA, 20 nt, Bordetella pertussis
gccagcguucggccacccgg

SEQ ID NO: 2429687 - RNA, 22 nt, Bordetella pertussis
gccagcguucggccacccggcc

SEQ ID NO: 2429688 - RNA, 23 nt, Bordetella pertussis
gccagcguucggccacccggccc

SEQ ID NO: 2429689 - RNA, 18 nt, Bordetella pertussis
gccagcuccaccgggcug

SEQ ID NO: 2429690 - RNA, 17 nt, Bordetella pertussis
gccagcuccagccgcag

SEQ ID NO: 2429691 - RNA, 14 nt, Bordetella pertussis
gccagcuccaggua

SEQ ID NO: 2429692 - RNA, 15 nt, Bordetella pertussis
gccagcucgacgcgc

SEQ ID NO: 2429693 - RNA, 14 nt, Bordetella pertussis
gccagcucgcgcag

SEQ ID NO: 2429694 - RNA, 21 nt, Bordetella pertussis
gccagcucgcgcagcaggccg

SEQ ID NO: 2429695 - RNA, 21 nt, Bordetella pertussis
gccagcucgcguugcaccgcg

SEQ ID NO: 2429696 - RNA, 12 nt, Bordetella pertussis
gccagcucggcc

SEQ ID NO: 2429697 - RNA, 15 nt, Bordetella pertussis
gccagcucggccaag

SEQ ID NO: 2429698 - RNA, 19 nt, Bordetella pertussis
gccagcucggccaaggcau

SEQ ID NO: 2429699 - RNA, 15 nt, Bordetella pertussis
gccagcucggccugc

SEQ ID NO: 2429700 - RNA, 23 nt, Bordetella pertussis
gccagcucggcggccgccugcgc

SEQ ID NO: 2429701 - RNA, 19 nt, Bordetella pertussis
gccagcucuucgagcgcgg

SEQ ID NO: 2429702 - RNA, 22 nt, Bordetella pertussis
gccagcucuucgagcgcggcgc

SEQ ID NO: 2429703 - RNA, 20 nt, Bordetella pertussis
gccagcugaccucgcccagg

SEQ ID NO: 2429704 - RNA, 17 nt, Bordetella pertussis
gccagcugcaugcgcac

SEQ ID NO: 2429705 - RNA, 24 nt, Bordetella pertussis
gccagcugcaugcgcacggacagc

SEQ ID NO: 2429706 - RNA, 15 nt, Bordetella pertussis
gccagcugcgcagcg

SEQ ID NO: 2429707 - RNA, 17 nt, Bordetella pertussis
gccagcugcgcccccuc

SEQ ID NO: 2429708 - RNA, 17 nt, Bordetella pertussis
gccagcugcguggcgac

SEQ ID NO: 2429709 - RNA, 18 nt, Bordetella pertussis
gccagcuggaccgccugg

SEQ ID NO: 2429710 - RNA, 19 nt, Bordetella pertussis
gccagcuggcgcguggccg

SEQ ID NO: 2429711 - RNA, 22 nt, Bordetella pertussis
gccagcuggcggcgcagcacca

SEQ ID NO: 2429712 - RNA, 16 nt, Bordetella pertussis
gccagcugggcgaucu

SEQ ID NO: 2429713 - RNA, 15 nt, Bordetella pertussis
gccagcuugaccgcc

SEQ ID NO: 2429714 - RNA, 17 nt, Bordetella pertussis
gccagcuugaccgccag

SEQ ID NO: 2429715 - RNA, 18 nt, Bordetella pertussis
gccagcuugacguccagc

SEQ ID NO: 2429716 - RNA, 19 nt, Bordetella pertussis
gccagcuugacguccagcc

SEQ ID NO: 2429717 - RNA, 20 nt, Bordetella pertussis
gccagcuugacguccagcca

SEQ ID NO: 2429718 - RNA, 16 nt, Bordetella pertussis
gccagcuugagcaggc

SEQ ID NO: 2429719 - RNA, 19 nt, Bordetella pertussis
gccagcuugagcaggcgcg

SEQ ID NO: 2429720 - RNA, 23 nt, Bordetella pertussis
gccagcuugagcaggcgcgagcg

SEQ ID NO: 2429721 - RNA, 24 nt, Bordetella pertussis
gccagcuugcaggcgccuucggcg

SEQ ID NO: 2429722 - RNA, 19 nt, Bordetella pertussis
gccagcuugcgcgccuugg

SEQ ID NO: 2429723 - RNA, 21 nt, Bordetella pertussis
gccagcuugcgcgccuuggcg

SEQ ID NO: 2429724 - RNA, 15 nt, Bordetella pertussis
gccagcuuggccagg

SEQ ID NO: 2429725 - RNA, 16 nt, Bordetella pertussis
gccagcuuggccaggc

SEQ ID NO: 2429726 - RNA, 17 nt, Bordetella pertussis
gccagcuuggccaggcu

SEQ ID NO: 2429727 - RNA, 18 nt, Bordetella pertussis
gccagcuuggugcucagu

SEQ ID NO: 2429728 - RNA, 19 nt, Bordetella pertussis
gccagcuuguagcggccau

SEQ ID NO: 2429729 - RNA, 22 nt, Bordetella pertussis
gccagcuuguagcggccaucgg

SEQ ID NO: 2429730 - RNA, 18 nt, Bordetella pertussis
gccaggaaagccggcguc

SEQ ID NO: 2429731 - RNA, 19 nt, Bordetella pertussis
gccaggaaagccggcguca

SEQ ID NO: 2429732 - RNA, 18 nt, Bordetella pertussis
gccaggaacagcgccggc

SEQ ID NO: 2429733 - RNA, 22 nt, Bordetella pertussis
gccaggaacagcgccggcagcg

SEQ ID NO: 2429734 - RNA, 17 nt, Bordetella pertussis
gccaggaagaucggccc

SEQ ID NO: 2429735 - RNA, 19 nt, Bordetella pertussis
gccaggaagaucggcccgg

SEQ ID NO: 2429736 - RNA, 21 nt, Bordetella pertussis
gccaggaagaucggcccggcg

SEQ ID NO: 2429737 - RNA, 19 nt, Bordetella pertussis
gccaggaagccgugcgcaa

SEQ ID NO: 2429738 - RNA, 15 nt, Bordetella pertussis
gccaggaagcgcgcc

SEQ ID NO: 2429739 - RNA, 17 nt, Bordetella pertussis
gccaggaagcgcgccgc

SEQ ID NO: 2429740 - RNA, 18 nt, Bordetella pertussis
gccaggaagcggcgcacc

SEQ ID NO: 2429741 - RNA, 17 nt, Bordetella pertussis
gccaggaccgaggugcc

SEQ ID NO: 2429742 - RNA, 21 nt, Bordetella pertussis
gccaggaccgaggugccagcc

SEQ ID NO: 2429743 - RNA, 21 nt, Bordetella pertussis
gccaggacgaucccggccacg

SEQ ID NO: 2429744 - RNA, 16 nt, Bordetella pertussis
gccaggacggugucgc

SEQ ID NO: 2429745 - RNA, 15 nt, Bordetella pertussis
gccagggcagggcgc

SEQ ID NO: 2429746 - RNA, 17 nt, Bordetella pertussis
gccagggcagggcgccg

SEQ ID NO: 2429747 - RNA, 12 nt, Bordetella pertussis
gccagggccacg

SEQ ID NO: 2429748 - RNA, 13 nt, Bordetella pertussis
gccagggccacgc

SEQ ID NO: 2429749 - RNA, 14 nt, Bordetella pertussis
gccagggccaggcc

SEQ ID NO: 2429750 - RNA, 16 nt, Bordetella pertussis
gccagggccaggccgc

SEQ ID NO: 2429751 - RNA, 18 nt, Bordetella pertussis
gccagggccauguggcgc

SEQ ID NO: 2429752 - RNA, 21 nt, Bordetella pertussis
gccagggccauguggcgcagc

SEQ ID NO: 2429753 - RNA, 16 nt, Bordetella pertussis
gccagggccccuccgg

SEQ ID NO: 2429754 - RNA, 16 nt, Bordetella pertussis
gccagggccgccgcgc

SEQ ID NO: 2429755 - RNA, 18 nt, Bordetella pertussis
gccagggccgccgcgccc

SEQ ID NO: 2429756 - RNA, 19 nt, Bordetella pertussis
gccagggccgccgcgccca

SEQ ID NO: 2429757 - RNA, 21 nt, Bordetella pertussis
gccagggccgccgcgcccagc

SEQ ID NO: 2429758 - RNA, 13 nt, Bordetella pertussis
gccagggccucgc

SEQ ID NO: 2429759 - RNA, 22 nt, Bordetella pertussis
gccagggccucgcgggccuugg

SEQ ID NO: 2429760 - RNA, 22 nt, Bordetella pertussis
gccagggcgaugaccggcaagc

SEQ ID NO: 2429761 - RNA, 23 nt, Bordetella pertussis
gccagggcgaugaccggcaagcg

SEQ ID NO: 2429762 - RNA, 21 nt, Bordetella pertussis
gccagggcgaugcggcggccg

SEQ ID NO: 2429763 - RNA, 13 nt, Bordetella pertussis
gccagggcgccgc

SEQ ID NO: 2429764 - RNA, 14 nt, Bordetella pertussis
gccagggcgccgcg

SEQ ID NO: 2429765 - RNA, 20 nt, Bordetella pertussis
gccagggcgccugccccggc

SEQ ID NO: 2429766 - RNA, 14 nt, Bordetella pertussis
gccagggcgcggau

SEQ ID NO: 2429767 - RNA, 22 nt, Bordetella pertussis
gccagggcgcggaucaugggcu

SEQ ID NO: 2429768 - RNA, 13 nt, Bordetella pertussis
gccagggcggcga

SEQ ID NO: 2429769 - RNA, 20 nt, Bordetella pertussis
gccagggcggcgacuucgcc

SEQ ID NO: 2429770 - RNA, 13 nt, Bordetella pertussis
gccagggcggcug

SEQ ID NO: 2429771 - RNA, 17 nt, Bordetella pertussis
gccaggggaugacgggc

SEQ ID NO: 2429772 - RNA, 20 nt, Bordetella pertussis
gccaggggaugacgggcgag

SEQ ID NO: 2429773 - RNA, 15 nt, Bordetella pertussis
gccagggucugcugg

SEQ ID NO: 2429774 - RNA, 18 nt, Bordetella pertussis
gccagggucugcuggucg

SEQ ID NO: 2429775 - RNA, 15 nt, Bordetella pertussis
gccagggugaccugg

SEQ ID NO: 2429776 - RNA, 17 nt, Bordetella pertussis
gccagggugaccuggcg

SEQ ID NO: 2429777 - RNA, 19 nt, Bordetella pertussis
gccagggugaccuggcgcg

SEQ ID NO: 2429778 - RNA, 20 nt, Bordetella pertussis
gccagggugaccuggcgcgc

SEQ ID NO: 2429779 - RNA, 16 nt, Bordetella pertussis
gccagggugcaccagg

SEQ ID NO: 2429780 - RNA, 15 nt, Bordetella pertussis
gccagggugccccgc

SEQ ID NO: 2429781 - RNA, 17 nt, Bordetella pertussis
gccagggugccccgccg

SEQ ID NO: 2429782 - RNA, 18 nt, Bordetella pertussis
gccagggugccccgccgg

SEQ ID NO: 2429783 - RNA, 21 nt, Bordetella pertussis
gccaggguuugcuggcgcagc

SEQ ID NO: 2429784 - RNA, 15 nt, Bordetella pertussis
gccagguaagcuggc

SEQ ID NO: 2429785 - RNA, 17 nt, Bordetella pertussis
gccagguaagcuggcgc

SEQ ID NO: 2429786 - RNA, 19 nt, Bordetella pertussis
gccagguacaggccgccgg

SEQ ID NO: 2429787 - RNA, 20 nt, Bordetella pertussis
gccagguacaggccgccggu

SEQ ID NO: 2429788 - RNA, 16 nt, Bordetella pertussis
gccagguaggccggcg

SEQ ID NO: 2429789 - RNA, 21 nt, Bordetella pertussis
gccagguauugcggggcggcg

SEQ ID NO: 2429790 - RNA, 17 nt, Bordetella pertussis
gccagguauugcucggc

SEQ ID NO: 2429791 - RNA, 22 nt, Bordetella pertussis
gccagguccacauccgcgcugc

SEQ ID NO: 2429792 - RNA, 20 nt, Bordetella pertussis
gccagguccguguucgacgc

SEQ ID NO: 2429793 - RNA, 14 nt, Bordetella pertussis
gccaggucgcgcac

SEQ ID NO: 2429794 - RNA, 21 nt, Bordetella pertussis
gccaggucgcgcaccaggucg

SEQ ID NO: 2429795 - RNA, 14 nt, Bordetella pertussis
gccaggucgcgcau

SEQ ID NO: 2429796 - RNA, 14 nt, Bordetella pertussis
gccaggucggccag

SEQ ID NO: 2429797 - RNA, 15 nt, Bordetella pertussis
gccaggucggccagc

SEQ ID NO: 2429798 - RNA, 17 nt, Bordetella pertussis
gccaggucggccagccg

SEQ ID NO: 2429799 - RNA, 18 nt, Bordetella pertussis
gccaggucggccagccgg

SEQ ID NO: 2429800 - RNA, 19 nt, Bordetella pertussis
gccaggucggccagccggc

SEQ ID NO: 2429801 - RNA, 16 nt, Bordetella pertussis
gccaggucggcggcca

SEQ ID NO: 2429802 - RNA, 21 nt, Bordetella pertussis
gccaggucggcggccagcgcg

SEQ ID NO: 2429803 - RNA, 15 nt, Bordetella pertussis
gccaggugcacagcg

SEQ ID NO: 2429804 - RNA, 16 nt, Bordetella pertussis
gccaggugcacagcgu

SEQ ID NO: 2429805 - RNA, 12 nt, Bordetella pertussis
gccaggugcgcc

SEQ ID NO: 2429806 - RNA, 20 nt, Bordetella pertussis
gccagguggacagcgccagc

SEQ ID NO: 2429807 - RNA, 14 nt, Bordetella pertussis
gccagguggcgaug

SEQ ID NO: 2429808 - RNA, 23 nt, Bordetella pertussis
gccagguggcgaugccgggcacg

SEQ ID NO: 2429809 - RNA, 15 nt, Bordetella pertussis
gccagguggcggcgg

SEQ ID NO: 2429810 - RNA, 16 nt, Bordetella pertussis
gccagguggcggcggc

SEQ ID NO: 2429811 - RNA, 13 nt, Bordetella pertussis
gccaggugggcca

SEQ ID NO: 2429812 - RNA, 17 nt, Bordetella pertussis
gccagguucgccuggcg

SEQ ID NO: 2429813 - RNA, 18 nt, Bordetella pertussis
gccagguucgccuggcgg

SEQ ID NO: 2429814 - RNA, 20 nt, Bordetella pertussis
gccagguucgccuggcgggg

SEQ ID NO: 2429815 - RNA, 22 nt, Bordetella pertussis
gccagguucuggucgaacuggc

SEQ ID NO: 2429816 - RNA, 21 nt, Bordetella pertussis
gccagguugggugcgccgccg

SEQ ID NO: 2429817 - RNA, 13 nt, Bordetella pertussis
gccaguacaggcu

SEQ ID NO: 2429818 - RNA, 15 nt, Bordetella pertussis
gccaguacaggcugc

SEQ ID NO: 2429819 - RNA, 18 nt, Bordetella pertussis
gccaguaccugacccugc

SEQ ID NO: 2429820 - RNA, 20 nt, Bordetella pertussis
gccaguaccugacccugcgc

SEQ ID NO: 2429821 - RNA, 22 nt, Bordetella pertussis
gccaguacgucggacagggccc

SEQ ID NO: 2429822 - RNA, 15 nt, Bordetella pertussis
gccaguagcgccggc

SEQ ID NO: 2429823 - RNA, 17 nt, Bordetella pertussis
gccaguagcgccggcuu

SEQ ID NO: 2429824 - RNA, 14 nt, Bordetella pertussis
gccaguagcgugug

SEQ ID NO: 2429825 - RNA, 19 nt, Bordetella pertussis
gccaguagcgugugcagga

SEQ ID NO: 2429826 - RNA, 19 nt, Bordetella pertussis
gccaguaggcgccccaggc

SEQ ID NO: 2429827 - RNA, 19 nt, Bordetella pertussis
gccaguccagcgcgccgcg

SEQ ID NO: 2429828 - RNA, 15 nt, Bordetella pertussis
gccaguccauccagc

SEQ ID NO: 2429829 - RNA, 16 nt, Bordetella pertussis
gccaguccauccagcg

SEQ ID NO: 2429830 - RNA, 22 nt, Bordetella pertussis
gccaguccccauguggggacag

SEQ ID NO: 2429831 - RNA, 14 nt, Bordetella pertussis
gccagucccccgcg

SEQ ID NO: 2429832 - RNA, 20 nt, Bordetella pertussis
gccagucccccgcggggaca

SEQ ID NO: 2429833 - RNA, 21 nt, Bordetella pertussis
gccagucccccgcggggacag

SEQ ID NO: 2429834 - RNA, 18 nt, Bordetella pertussis
gccaguccccgcagggac

SEQ ID NO: 2429835 - RNA, 15 nt, Bordetella pertussis
gccaguccccgcaug

SEQ ID NO: 2429836 - RNA, 17 nt, Bordetella pertussis
gccaguccccgcauggg

SEQ ID NO: 2429837 - RNA, 19 nt, Bordetella pertussis
gccaguccccgcaugggga

SEQ ID NO: 2429838 - RNA, 21 nt, Bordetella pertussis
gccaguccccgcauggggacu

SEQ ID NO: 2429839 - RNA, 19 nt, Bordetella pertussis
gccaguccccgcggggaca

SEQ ID NO: 2429840 - RNA, 13 nt, Bordetella pertussis
gccaguccccugc

SEQ ID NO: 2429841 - RNA, 16 nt, Bordetella pertussis
gccaguccccugcggg

SEQ ID NO: 2429842 - RNA, 14 nt, Bordetella pertussis
gccaguccgcagcg

SEQ ID NO: 2429843 - RNA, 16 nt, Bordetella pertussis
gccaguccgcagcgca

SEQ ID NO: 2429844 - RNA, 18 nt, Bordetella pertussis
gccaguccgcgcucgccc

SEQ ID NO: 2429845 - RNA, 19 nt, Bordetella pertussis
gccaguccgcgcucgccca

SEQ ID NO: 2429846 - RNA, 14 nt, Bordetella pertussis
gccagucgccgcgg

SEQ ID NO: 2429847 - RNA, 15 nt, Bordetella pertussis
gccagucgccgcggu

SEQ ID NO: 2429848 - RNA, 15 nt, Bordetella pertussis
gccagucgcgcagca

SEQ ID NO: 2429849 - RNA, 15 nt, Bordetella pertussis
gccagucgcggugca

SEQ ID NO: 2429850 - RNA, 18 nt, Bordetella pertussis
gccagucguucagcgucu

SEQ ID NO: 2429851 - RNA, 16 nt, Bordetella pertussis
gccagucuccaggcuc

SEQ ID NO: 2429852 - RNA, 22 nt, Bordetella pertussis
gccagucuccaggcucaggcgg

SEQ ID NO: 2429853 - RNA, 22 nt, Bordetella pertussis
gccagugaaacgcgacgcgccg

SEQ ID NO: 2429854 - RNA, 23 nt, Bordetella pertussis
gccagugaaacgcgacgcgccgg

SEQ ID NO: 2429855 - RNA, 13 nt, Bordetella pertussis
gccagugauggcc

SEQ ID NO: 2429856 - RNA, 16 nt, Bordetella pertussis
gccagugccucagguc

SEQ ID NO: 2429857 - RNA, 16 nt, Bordetella pertussis
gccaguggcgcggcgu

SEQ ID NO: 2429858 - RNA, 15 nt, Bordetella pertussis
gccaugccggccccg

SEQ ID NO: 2429859 - RNA, 14 nt, Bordetella pertussis
gccaugccgggcaa

SEQ ID NO: 2429860 - RNA, 18 nt, Bordetella pertussis
gccaugccgucaccggcu

SEQ ID NO: 2429861 - RNA, 21 nt, Bordetella pertussis
gccaugccgucaccggcuacg

SEQ ID NO: 2429862 - RNA, 14 nt, Bordetella pertussis
gccaugccguccug

SEQ ID NO: 2429863 - RNA, 18 nt, Bordetella pertussis
gccaugccguccugcugc

SEQ ID NO: 2429864 - RNA, 20 nt, Bordetella pertussis
gccaugccguccugcugcgg

SEQ ID NO: 2429865 - RNA, 14 nt, Bordetella pertussis
gccaugccgucgcg

SEQ ID NO: 2429866 - RNA, 15 nt, Bordetella pertussis
gccaugccgucgcgc

SEQ ID NO: 2429867 - RNA, 14 nt, Bordetella pertussis
gccaugccgucugg

SEQ ID NO: 2429868 - RNA, 18 nt, Bordetella pertussis
gccaugccgucuggcggc

SEQ ID NO: 2429869 - RNA, 19 nt, Bordetella pertussis
gccaugccgucuggcggca

SEQ ID NO: 2429870 - RNA, 16 nt, Bordetella pertussis
gccaugcgacagcccg

SEQ ID NO: 2429871 - RNA, 17 nt, Bordetella pertussis
gccaugcgacagcccgg

SEQ ID NO: 2429872 - RNA, 19 nt, Bordetella pertussis
gccaugcgacagcccggga

SEQ ID NO: 2429873 - RNA, 20 nt, Bordetella pertussis
gccaugcgauacagcuuggc

SEQ ID NO: 2429874 - RNA, 21 nt, Bordetella pertussis
gccaugcgauaggcgaagcgc

SEQ ID NO: 2429875 - RNA, 15 nt, Bordetella pertussis
gccaugcgaugcugc

SEQ ID NO: 2429876 - RNA, 22 nt, Bordetella pertussis
gccaugcgaugcugcagggccu

SEQ ID NO: 2429877 - RNA, 23 nt, Bordetella pertussis
gccaugcgaugcugcagggccug

SEQ ID NO: 2429878 - RNA, 16 nt, Bordetella pertussis
gccaugcgcaccaccg

SEQ ID NO: 2429879 - RNA, 13 nt, Bordetella pertussis
gccaugcgcaugg

SEQ ID NO: 2429880 - RNA, 18 nt, Bordetella pertussis
gccaugcgcauggccagc

SEQ ID NO: 2429881 - RNA, 19 nt, Bordetella pertussis
gccaugcgcauggccagcg

SEQ ID NO: 2429882 - RNA, 23 nt, Bordetella pertussis
gccaugcgcauggccagcgcgca

SEQ ID NO: 2429883 - RNA, 14 nt, Bordetella pertussis
gccaugcgccagca

SEQ ID NO: 2429884 - RNA, 17 nt, Bordetella pertussis
gccaugcgccagcagga

SEQ ID NO: 2429885 - RNA, 15 nt, Bordetella pertussis
gccaugcgcgccagc

SEQ ID NO: 2429886 - RNA, 16 nt, Bordetella pertussis
gccaugcgcgccagca

SEQ ID NO: 2429887 - RNA, 16 nt, Bordetella pertussis
gccaugcggacgccag

SEQ ID NO: 2429888 - RNA, 22 nt, Bordetella pertussis
gccaugcggacgccagcccugg

SEQ ID NO: 2429889 - RNA, 17 nt, Bordetella pertussis
gccaugcggaugaacga

SEQ ID NO: 2429890 - RNA, 13 nt, Bordetella pertussis
gccaugcggcgcc

SEQ ID NO: 2429891 - RNA, 14 nt, Bordetella pertussis
gccaugcggcgcca

SEQ ID NO: 2429892 - RNA, 15 nt, Bordetella pertussis
gccaugcgggucagg

SEQ ID NO: 2429893 - RNA, 19 nt, Bordetella pertussis
gccaugcgggucaggccgc

SEQ ID NO: 2429894 - RNA, 22 nt, Bordetella pertussis
gccaugcgggucaggccgccgu

SEQ ID NO: 2429895 - RNA, 17 nt, Bordetella pertussis
gccaugcguaucggcag

SEQ ID NO: 2429896 - RNA, 12 nt, Bordetella pertussis
gccaugcucagc

SEQ ID NO: 2429897 - RNA, 17 nt, Bordetella pertussis
gccaugcucagcagcac

SEQ ID NO: 2429898 - RNA, 23 nt, Bordetella pertussis
gccaugcucgcgcacagcgcgca

SEQ ID NO: 2429899 - RNA, 22 nt, Bordetella pertussis
gccaugcucguccaucgccugc

SEQ ID NO: 2429900 - RNA, 14 nt, Bordetella pertussis
gccaugcugggcca

SEQ ID NO: 2429901 - RNA, 20 nt, Bordetella pertussis
gccaugcugggcgggcuggu

SEQ ID NO: 2429902 - RNA, 16 nt, Bordetella pertussis
gccauggaagcggcag

SEQ ID NO: 2429903 - RNA, 22 nt, Bordetella pertussis
gccauggacgagggccggcgcc

SEQ ID NO: 2429904 - RNA, 16 nt, Bordetella pertussis
gccauggacgaguugc

SEQ ID NO: 2429905 - RNA, 12 nt, Bordetella pertussis
gccauggaggcg

SEQ ID NO: 2429906 - RNA, 15 nt, Bordetella pertussis
gccauggaggcgcag

SEQ ID NO: 2429907 - RNA, 22 nt, Bordetella pertussis
gccauggaggcgcagcgcggca

SEQ ID NO: 2429908 - RNA, 14 nt, Bordetella pertussis
gccauggaugcgcg

SEQ ID NO: 2429909 - RNA, 14 nt, Bordetella pertussis
gccauggcacaggc

SEQ ID NO: 2429910 - RNA, 17 nt, Bordetella pertussis
gccauggcacaggccau

SEQ ID NO: 2429911 - RNA, 21 nt, Bordetella pertussis
gccauggcacaggccaucggc

SEQ ID NO: 2429912 - RNA, 15 nt, Bordetella pertussis
gccauggcagggcgc

SEQ ID NO: 2429913 - RNA, 18 nt, Bordetella pertussis
gccauggcagggcgccgc

SEQ ID NO: 2429914 - RNA, 19 nt, Bordetella pertussis
gccauggcagggcgccgcg

SEQ ID NO: 2429915 - RNA, 22 nt, Bordetella pertussis
gccauggcaguacguacgcccg

SEQ ID NO: 2429916 - RNA, 18 nt, Bordetella pertussis
gccauggccagcuugacc

SEQ ID NO: 2429917 - RNA, 17 nt, Bordetella pertussis
gccauggcccuugccgc

SEQ ID NO: 2429918 - RNA, 18 nt, Bordetella pertussis
gccauggcccuugccgcc

SEQ ID NO: 2429919 - RNA, 20 nt, Bordetella pertussis
gccauggcccuugccgccuu

SEQ ID NO: 2429920 - RNA, 23 nt, Bordetella pertussis
gccauggccgccacacgaggacc

SEQ ID NO: 2429921 - RNA, 17 nt, Bordetella pertussis
gccauggccgcgcggcg

SEQ ID NO: 2429922 - RNA, 18 nt, Bordetella pertussis
gccauggccgcgcggcgc

SEQ ID NO: 2429923 - RNA, 19 nt, Bordetella pertussis
gccauggccgcgcggcgcc

SEQ ID NO: 2429924 - RNA, 15 nt, Bordetella pertussis
gccauggccggccgc

SEQ ID NO: 2429925 - RNA, 18 nt, Bordetella pertussis
gccauggccggccgccgg

SEQ ID NO: 2429926 - RNA, 14 nt, Bordetella pertussis
gccauggccggcgu

SEQ ID NO: 2429927 - RNA, 20 nt, Bordetella pertussis
gccauggccggcguugccgu

SEQ ID NO: 2429928 - RNA, 12 nt, Bordetella pertussis
gccauggcgcgc

SEQ ID NO: 2429929 - RNA, 13 nt, Bordetella pertussis
gccauggcgcgca

SEQ ID NO: 2429930 - RNA, 21 nt, Bordetella pertussis
gccauggcgcgcagauugcgc

SEQ ID NO: 2429931 - RNA, 22 nt, Bordetella pertussis
gccauggcgcgcagauugcgcu

SEQ ID NO: 2429932 - RNA, 14 nt, Bordetella pertussis
gccauggcgcuggc

SEQ ID NO: 2429933 - RNA, 16 nt, Bordetella pertussis
gccauggcgcuggcag

SEQ ID NO: 2429934 - RNA, 22 nt, Bordetella pertussis
gccauggcgcuggcaggcgccu

SEQ ID NO: 2429935 - RNA, 13 nt, Bordetella pertussis
gccauggcgcugu

SEQ ID NO: 2429936 - RNA, 20 nt, Bordetella pertussis
gccauggcgcuguuggccgg

SEQ ID NO: 2429937 - RNA, 18 nt, Bordetella pertussis
gccauggcggccgccgcc

SEQ ID NO: 2429938 - RNA, 14 nt, Bordetella pertussis
gccauggcggccgg

SEQ ID NO: 2429939 - RNA, 15 nt, Bordetella pertussis
gccauggcggccggc

SEQ ID NO: 2429940 - RNA, 14 nt, Bordetella pertussis
gccauggcggcgcc

SEQ ID NO: 2429941 - RNA, 16 nt, Bordetella pertussis
gccauggcggcgccca

SEQ ID NO: 2429942 - RNA, 13 nt, Bordetella pertussis
gccauggcggcgg

SEQ ID NO: 2429943 - RNA, 14 nt, Bordetella pertussis
gccauggcggcggc

SEQ ID NO: 2429944 - RNA, 15 nt, Bordetella pertussis
gccauggcggcggcc

SEQ ID NO: 2429945 - RNA, 18 nt, Bordetella pertussis
gccauggcggcggccacg

SEQ ID NO: 2429946 - RNA, 19 nt, Bordetella pertussis
gccauggcggcggccacga

SEQ ID NO: 2429947 - RNA, 13 nt, Bordetella pertussis
gccauggucgcga

SEQ ID NO: 2429948 - RNA, 15 nt, Bordetella pertussis
gccauggucgcgacc

SEQ ID NO: 2429949 - RNA, 16 nt, Bordetella pertussis
gccauggucgcgacca

SEQ ID NO: 2429950 - RNA, 20 nt, Bordetella pertussis
gccauggucgcgaccaccgu

SEQ ID NO: 2429951 - RNA, 22 nt, Bordetella pertussis
gccauggucucccccucggccu

SEQ ID NO: 2429952 - RNA, 18 nt, Bordetella pertussis
gccauggugaacggcccc

SEQ ID NO: 2429953 - RNA, 13 nt, Bordetella pertussis
gccauggugccgc

SEQ ID NO: 2429954 - RNA, 16 nt, Bordetella pertussis
gccauggugccgcgca

SEQ ID NO: 2429955 - RNA, 17 nt, Bordetella pertussis
gccauggugccgcgcag

SEQ ID NO: 2429956 - RNA, 14 nt, Bordetella pertussis
gccauguagauggc

SEQ ID NO: 2429957 - RNA, 21 nt, Bordetella pertussis
gccauguauaacguggcgcgc

SEQ ID NO: 2429958 - RNA, 13 nt, Bordetella pertussis
gccauguccuggc

SEQ ID NO: 2429959 - RNA, 20 nt, Bordetella pertussis
gccauguccuggcaggccgc

SEQ ID NO: 2429960 - RNA, 21 nt, Bordetella pertussis
gccauguccuggcaggccgcu

SEQ ID NO: 2429961 - RNA, 18 nt, Bordetella pertussis
gccaugugcgccgcgccg

SEQ ID NO: 2429962 - RNA, 19 nt, Bordetella pertussis
gccaugugcgccgcgccgu

SEQ ID NO: 2429963 - RNA, 22 nt, Bordetella pertussis
gccaugugcgccgcgccguaca

SEQ ID NO: 2429964 - RNA, 19 nt, Bordetella pertussis
gccaugugcguugccagcc

SEQ ID NO: 2429965 - RNA, 20 nt, Bordetella pertussis
gccaugugcguugccagccc

SEQ ID NO: 2429966 - RNA, 14 nt, Bordetella pertussis
gccauguggcgacg

SEQ ID NO: 2429967 - RNA, 18 nt, Bordetella pertussis
gccauguggcgacgccca

SEQ ID NO: 2429968 - RNA, 23 nt, Bordetella pertussis
gccauguggcgacgcccagccug

SEQ ID NO: 2429969 - RNA, 15 nt, Bordetella pertussis
gccauguggcgcagc

SEQ ID NO: 2429970 - RNA, 16 nt, Bordetella pertussis
gccauguggcgcagcg

SEQ ID NO: 2429971 - RNA, 18 nt, Bordetella pertussis
gcccacucacgcaaggcc

SEQ ID NO: 2429972 - RNA, 23 nt, Bordetella pertussis
gcccacucacgcaaggccgacug

SEQ ID NO: 2429973 - RNA, 18 nt, Bordetella pertussis
gcccacucagggcggggu

SEQ ID NO: 2429974 - RNA, 19 nt, Bordetella pertussis
gcccacucggugcgcgcgc

SEQ ID NO: 2429975 - RNA, 17 nt, Bordetella pertussis
gcccacugccaggcgag

SEQ ID NO: 2429976 - RNA, 18 nt, Bordetella pertussis
gcccacugccaggcgagc

SEQ ID NO: 2429977 - RNA, 21 nt, Bordetella pertussis
gcccacuggaucgccgaucgg

SEQ ID NO: 2429978 - RNA, 17 nt, Bordetella pertussis
gcccacuuccucggcgc

SEQ ID NO: 2429979 - RNA, 18 nt, Bordetella pertussis
gcccacuuccucggcgcg

SEQ ID NO: 2429980 - RNA, 17 nt, Bordetella pertussis
gcccagacuggcguagu

SEQ ID NO: 2429981 - RNA, 16 nt, Bordetella pertussis
gcccagaucugccgca

SEQ ID NO: 2429982 - RNA, 19 nt, Bordetella pertussis
gcccagaucugccgcaaug

SEQ ID NO: 2429983 - RNA, 16 nt, Bordetella pertussis
gcccagcaaggguucg

SEQ ID NO: 2429984 - RNA, 22 nt, Bordetella pertussis
gcccagcaauuaugcguggccg

SEQ ID NO: 2429985 - RNA, 15 nt, Bordetella pertussis
gcccagcaccacggc

SEQ ID NO: 2429986 - RNA, 17 nt, Bordetella pertussis
gcccagcaccacgggcu

SEQ ID NO: 2429987 - RNA, 22 nt, Bordetella pertussis
gcccagcaccacgggcucgcug

SEQ ID NO: 2429988 - RNA, 13 nt, Bordetella pertussis
gcccagcaccagg

SEQ ID NO: 2429989 - RNA, 15 nt, Bordetella pertussis
gcccagcaccaggcc

SEQ ID NO: 2429990 - RNA, 12 nt, Bordetella pertussis
gcccagcaccgc

SEQ ID NO: 2429991 - RNA, 16 nt, Bordetella pertussis
gcccagcaccgccacc

SEQ ID NO: 2429992 - RNA, 17 nt, Bordetella pertussis
gcccagcaccgccaccg

SEQ ID NO: 2429993 - RNA, 19 nt, Bordetella pertussis
gcccagcaccgccgccagu

SEQ ID NO: 2429994 - RNA, 20 nt, Bordetella pertussis
gcccagcaccucgacgcagc

SEQ ID NO: 2429995 - RNA, 15 nt, Bordetella pertussis
gcccagcaccugcag

SEQ ID NO: 2429996 - RNA, 16 nt, Bordetella pertussis
gcccagcaccugcagg

SEQ ID NO: 2429997 - RNA, 18 nt, Bordetella pertussis
gcccagcaccugcaggcc

SEQ ID NO: 2429998 - RNA, 22 nt, Bordetella pertussis
gcccagcaccugcaggccgccg

SEQ ID NO: 2429999 - RNA, 16 nt, Bordetella pertussis
gcccagcaccuuggca

SEQ ID NO: 2430000 - RNA, 14 nt, Bordetella pertussis
gcccagcacgacga

SEQ ID NO: 2430001 - RNA, 15 nt, Bordetella pertussis
gcccagcacgacgaa

SEQ ID NO: 2430002 - RNA, 22 nt, Bordetella pertussis
gcccagcacgacgaagaacacc

SEQ ID NO: 2430003 - RNA, 20 nt, Bordetella pertussis
gcccagcacgaugagcauga

SEQ ID NO: 2430004 - RNA, 12 nt, Bordetella pertussis
gcccagcacgcc

SEQ ID NO: 2430005 - RNA, 16 nt, Bordetella pertussis
gcccagcacgccgcgc

SEQ ID NO: 2430006 - RNA, 18 nt, Bordetella pertussis
gcccagcacgccgcgcuc

SEQ ID NO: 2430007 - RNA, 15 nt, Bordetella pertussis
gcccagcacgcgcgc

SEQ ID NO: 2430008 - RNA, 16 nt, Bordetella pertussis
gcccagcacgcgcgcc

SEQ ID NO: 2430009 - RNA, 19 nt, Bordetella pertussis
gcccagcacgcgcgccagc

SEQ ID NO: 2430010 - RNA, 20 nt, Bordetella pertussis
gcccagcacgcgcgccagcu

SEQ ID NO: 2430011 - RNA, 21 nt, Bordetella pertussis
gcccagcacgcgcgccagcug

SEQ ID NO: 2430012 - RNA, 22 nt, Bordetella pertussis
gcccagcagauaccggcauggc

SEQ ID NO: 2430013 - RNA, 12 nt, Bordetella pertussis
gcccagcagcgc

SEQ ID NO: 2430014 - RNA, 15 nt, Bordetella pertussis
gcccagcagcgccac

SEQ ID NO: 2430015 - RNA, 16 nt, Bordetella pertussis
gcccagcagcuccucg

SEQ ID NO: 2430016 - RNA, 18 nt, Bordetella pertussis
gcccagcagcuccucggc

SEQ ID NO: 2430017 - RNA, 22 nt, Bordetella pertussis
gcccagcaggcuuucgcacagc

SEQ ID NO: 2430018 - RNA, 19 nt, Bordetella pertussis
gcccagcagguccugcacg

SEQ ID NO: 2430019 - RNA, 15 nt, Bordetella pertussis
gcccagcaucaggcc

SEQ ID NO: 2430020 - RNA, 18 nt, Bordetella pertussis
gcccagcaucaggcccga

SEQ ID NO: 2430021 - RNA, 21 nt, Bordetella pertussis
gcccagcaucaggcccgacuu

SEQ ID NO: 2430022 - RNA, 17 nt, Bordetella pertussis
gcccagcauccgcgcca

SEQ ID NO: 2430023 - RNA, 19 nt, Bordetella pertussis
gcccagcauccgcgccagg

SEQ ID NO: 2430024 - RNA, 22 nt, Bordetella pertussis
gcccagcauccgcgccaggaug

SEQ ID NO: 2430025 - RNA, 16 nt, Bordetella pertussis
gcccagcaugcgcgcg

SEQ ID NO: 2430026 - RNA, 17 nt, Bordetella pertussis
gcccagcaugcgcgcga

SEQ ID NO: 2430027 - RNA, 12 nt, Bordetella pertussis
gcccagcauggu

SEQ ID NO: 2430028 - RNA, 17 nt, Bordetella pertussis
gcccagcauggucggca

SEQ ID NO: 2430029 - RNA, 21 nt, Bordetella pertussis
gcccagcauuucgcgugcgug

SEQ ID NO: 2430030 - RNA, 14 nt, Bordetella pertussis
gcccagccacacca

SEQ ID NO: 2430031 - RNA, 16 nt, Bordetella pertussis
gcccagccacaccagg

SEQ ID NO: 2430032 - RNA, 17 nt, Bordetella pertussis
gcccagccagcccuggc

SEQ ID NO: 2430033 - RNA, 21 nt, Bordetella pertussis
gcccagccagcccuggcccag

SEQ ID NO: 2430034 - RNA, 14 nt, Bordetella pertussis
gcccagccagcggu

SEQ ID NO: 2430035 - RNA, 14 nt, Bordetella pertussis
gcccagccaggcgc

SEQ ID NO: 2430036 - RNA, 16 nt, Bordetella pertussis
gcccagccaggcgcca

SEQ ID NO: 2430037 - RNA, 17 nt, Bordetella pertussis
gcccagccaggcgccag

SEQ ID NO: 2430038 - RNA, 18 nt, Bordetella pertussis
gcccagccaggcgccagc

SEQ ID NO: 2430039 - RNA, 19 nt, Bordetella pertussis
gcccagccaggcgccagcg

SEQ ID NO: 2430040 - RNA, 21 nt, Bordetella pertussis
gcccagccaggcgccagcggc

SEQ ID NO: 2430041 - RNA, 22 nt, Bordetella pertussis
gcccagccaggcgccagcggca

SEQ ID NO: 2430042 - RNA, 17 nt, Bordetella pertussis
gcccagccccgcggccg

SEQ ID NO: 2430043 - RNA, 23 nt, Bordetella pertussis
gcccagccccgcggccgcgguca

SEQ ID NO: 2430044 - RNA, 13 nt, Bordetella pertussis
gcccagcccggcu

SEQ ID NO: 2430045 - RNA, 14 nt, Bordetella pertussis
gcccagcccggcuu

SEQ ID NO: 2430046 - RNA, 14 nt, Bordetella pertussis
gcccagcccugccc

SEQ ID NO: 2430047 - RNA, 15 nt, Bordetella pertussis
gcccagcccugcccg

SEQ ID NO: 2430048 - RNA, 14 nt, Bordetella pertussis
gcccagccgcagca

SEQ ID NO: 2430049 - RNA, 16 nt, Bordetella pertussis
gcccagccgcagcagg

SEQ ID NO: 2430050 - RNA, 17 nt, Bordetella pertussis
gcccagccgcagcaggc

SEQ ID NO: 2430051 - RNA, 22 nt, Bordetella pertussis
gcccagccgcagcaggcgcucg

SEQ ID NO: 2430052 - RNA, 18 nt, Bordetella pertussis
gcccagccgcaugccggc

SEQ ID NO: 2430053 - RNA, 20 nt, Bordetella pertussis
gcccagccgcaugccggcga

SEQ ID NO: 2430054 - RNA, 22 nt, Bordetella pertussis
gcccagccgcaugccggcgaug

SEQ ID NO: 2430055 - RNA, 17 nt, Bordetella pertussis
gcccagccgccugagca

SEQ ID NO: 2430056 - RNA, 19 nt, Bordetella pertussis
gcccagccgccugagcaca

SEQ ID NO: 2430057 - RNA, 14 nt, Bordetella pertussis
gcccagccgcgcca

SEQ ID NO: 2430058 - RNA, 16 nt, Bordetella pertussis
gcccagccgcgccagg

SEQ ID NO: 2430059 - RNA, 20 nt, Bordetella pertussis
gcccagccgcgccagggcgc

SEQ ID NO: 2430060 - RNA, 17 nt, Bordetella pertussis
gcccagccgcgccauca

SEQ ID NO: 2430061 - RNA, 15 nt, Bordetella pertussis
gcccagccgcucggc

SEQ ID NO: 2430062 - RNA, 17 nt, Bordetella pertussis
gcccagccgcucggcca

SEQ ID NO: 2430063 - RNA, 13 nt, Bordetella pertussis
gcccagccggccg

SEQ ID NO: 2430064 - RNA, 11 nt, Bordetella pertussis
gcccagccggu

SEQ ID NO: 2430065 - RNA, 17 nt, Bordetella pertussis
gcccagccggugcgcgg

SEQ ID NO: 2430066 - RNA, 19 nt, Bordetella pertussis
gcccagccggugcgcggcu

SEQ ID NO: 2430067 - RNA, 15 nt, Bordetella pertussis
gcccagccugccggc

SEQ ID NO: 2430068 - RNA, 16 nt, Bordetella pertussis
gcccagccugccggcg

SEQ ID NO: 2430069 - RNA, 20 nt, Bordetella pertussis
gcccagccugccggcggccu

SEQ ID NO: 2430070 - RNA, 18 nt, Bordetella pertussis
gcccagcgagaucagcac

SEQ ID NO: 2430071 - RNA, 15 nt, Bordetella pertussis
gcccagcgagccggc

SEQ ID NO: 2430072 - RNA, 16 nt, Bordetella pertussis
gcccagcgagccggcc

SEQ ID NO: 2430073 - RNA, 17 nt, Bordetella pertussis
gcccagcgagccggcca

SEQ ID NO: 2430074 - RNA, 18 nt, Bordetella pertussis
gcccagcgagccggccag

SEQ ID NO: 2430075 - RNA, 18 nt, Bordetella pertussis
gcccagcgagcggggcug

SEQ ID NO: 2430076 - RNA, 20 nt, Bordetella pertussis
gcccagcgagcggggcuggu

SEQ ID NO: 2430077 - RNA, 22 nt, Bordetella pertussis
gcccagcgagcggggcuggucg

SEQ ID NO: 2430078 - RNA, 13 nt, Bordetella pertussis
gcccagcgagcug

SEQ ID NO: 2430079 - RNA, 14 nt, Bordetella pertussis
gcccagcgagcugg

SEQ ID NO: 2430080 - RNA, 22 nt, Bordetella pertussis
gcccagcgcauaggacgccacc

SEQ ID NO: 2430081 - RNA, 23 nt, Bordetella pertussis
gcccagcgcauaggacgccacca

SEQ ID NO: 2430082 - RNA, 13 nt, Bordetella pertussis
gcccagcgccagc

SEQ ID NO: 2430083 - RNA, 14 nt, Bordetella pertussis
gcccagcgccagca

SEQ ID NO: 2430084 - RNA, 14 nt, Bordetella pertussis
gcccaggcugggcc

SEQ ID NO: 2430085 - RNA, 15 nt, Bordetella pertussis
gcccaggcugggcca

SEQ ID NO: 2430086 - RNA, 14 nt, Bordetella pertussis
gcccagggcagcgg

SEQ ID NO: 2430087 - RNA, 16 nt, Bordetella pertussis
gcccagggcagcggcc

SEQ ID NO: 2430088 - RNA, 19 nt, Bordetella pertussis
gcccagggcagcggccaga

SEQ ID NO: 2430089 - RNA, 15 nt, Bordetella pertussis
gcccagggccgcgcc

SEQ ID NO: 2430090 - RNA, 17 nt, Bordetella pertussis
gcccagggccgcgccgg

SEQ ID NO: 2430091 - RNA, 13 nt, Bordetella pertussis
gcccagggcgaug

SEQ ID NO: 2430092 - RNA, 13 nt, Bordetella pertussis
gcccaggggccgg

SEQ ID NO: 2430093 - RNA, 16 nt, Bordetella pertussis
gcccaggggccggcgc

SEQ ID NO: 2430094 - RNA, 19 nt, Bordetella pertussis
gcccaggggccggcgcgcc

SEQ ID NO: 2430095 - RNA, 21 nt, Bordetella pertussis
gcccaggggccggcgcgccgc

SEQ ID NO: 2430096 - RNA, 22 nt, Bordetella pertussis
gcccaggggccggcgcgccgcg

SEQ ID NO: 2430097 - RNA, 23 nt, Bordetella pertussis
gcccagguacaucauccccagcg

SEQ ID NO: 2430098 - RNA, 15 nt, Bordetella pertussis
gcccaggucaucgcc

SEQ ID NO: 2430099 - RNA, 17 nt, Bordetella pertussis
gcccaggucaucgccag

SEQ ID NO: 2430100 - RNA, 22 nt, Bordetella pertussis
gcccaggucaucgccaggcgcg

SEQ ID NO: 2430101 - RNA, 23 nt, Bordetella pertussis
gcccaggucaucgccaggcgcgu

SEQ ID NO: 2430102 - RNA, 16 nt, Bordetella pertussis
gcccagguccagcgcc

SEQ ID NO: 2430103 - RNA, 17 nt, Bordetella pertussis
gcccagguccagcgcca

SEQ ID NO: 2430104 - RNA, 18 nt, Bordetella pertussis
gcccagguccagcgccac

SEQ ID NO: 2430105 - RNA, 21 nt, Bordetella pertussis
gcccagguccagcgccacggc

SEQ ID NO: 2430106 - RNA, 17 nt, Bordetella pertussis
gcccagguccugcgcca

SEQ ID NO: 2430107 - RNA, 19 nt, Bordetella pertussis
gcccagguccugcgccagc

SEQ ID NO: 2430108 - RNA, 22 nt, Bordetella pertussis
gcccagguccugcgccagcuug

SEQ ID NO: 2430109 - RNA, 15 nt, Bordetella pertussis
gcccaggucggacgc

SEQ ID NO: 2430110 - RNA, 16 nt, Bordetella pertussis
gcccaggucggacgcg

SEQ ID NO: 2430111 - RNA, 18 nt, Bordetella pertussis
gcccaggucggacgcgcc

SEQ ID NO: 2430112 - RNA, 15 nt, Bordetella pertussis
gcccaggucguugcg

SEQ ID NO: 2430113 - RNA, 16 nt, Bordetella pertussis
gcccaggugcgggagc

SEQ ID NO: 2430114 - RNA, 21 nt, Bordetella pertussis
gcccaggugcgggagccggca

SEQ ID NO: 2430115 - RNA, 20 nt, Bordetella pertussis
gcccagguugaaggccgcga

SEQ ID NO: 2430116 - RNA, 21 nt, Bordetella pertussis
gcccagguugcggccgccacc

SEQ ID NO: 2430117 - RNA, 22 nt, Bordetella pertussis
gcccagguugcucgccucgaug

SEQ ID NO: 2430118 - RNA, 17 nt, Bordetella pertussis
gcccaguacggccugca

SEQ ID NO: 2430119 - RNA, 18 nt, Bordetella pertussis
gcccaguauggugaccgg

SEQ ID NO: 2430120 - RNA, 22 nt, Bordetella pertussis
gcccaguauggugaccggcgug

SEQ ID NO: 2430121 - RNA, 16 nt, Bordetella pertussis
gcccaguccagggugu

SEQ ID NO: 2430122 - RNA, 20 nt, Bordetella pertussis
gcccagucccaggccgacca

SEQ ID NO: 2430123 - RNA, 17 nt, Bordetella pertussis
gcccagucguccagcac

SEQ ID NO: 2430124 - RNA, 18 nt, Bordetella pertussis
gcccagucguccagcacg

SEQ ID NO: 2430125 - RNA, 22 nt, Bordetella pertussis
gcccaguuccacgcggccgugg

SEQ ID NO: 2430126 - RNA, 16 nt, Bordetella pertussis
gcccaguucgcgcagc

SEQ ID NO: 2430127 - RNA, 21 nt, Bordetella pertussis
gcccaguucgcgcagcagcuu

SEQ ID NO: 2430128 - RNA, 15 nt, Bordetella pertussis
gcccaguucgcggcc

SEQ ID NO: 2430129 - RNA, 20 nt, Bordetella pertussis
gcccaguucgcggccggccg

SEQ ID NO: 2430130 - RNA, 21 nt, Bordetella pertussis
gcccaguucgcggccggccgg

SEQ ID NO: 2430131 - RNA, 17 nt, Bordetella pertussis
gcccaguucggcgacga

SEQ ID NO: 2430132 - RNA, 14 nt, Bordetella pertussis
gcccaguucggcgc

SEQ ID NO: 2430133 - RNA, 18 nt, Bordetella pertussis
gcccaguucggcgcgcgu

SEQ ID NO: 2430134 - RNA, 18 nt, Bordetella pertussis
gcccaguugaaucggcgc

SEQ ID NO: 2430135 - RNA, 19 nt, Bordetella pertussis
gcccaguugaaucggcgcg

SEQ ID NO: 2430136 - RNA, 21 nt, Bordetella pertussis
gcccaguugacgaugcccagg

SEQ ID NO: 2430137 - RNA, 17 nt, Bordetella pertussis
gcccaguugcuggccca

SEQ ID NO: 2430138 - RNA, 18 nt, Bordetella pertussis
gcccaguugcuggcccag

SEQ ID NO: 2430139 - RNA, 22 nt, Bordetella pertussis
gcccaguuucgcgaccaccagg

SEQ ID NO: 2430140 - RNA, 14 nt, Bordetella pertussis
gcccauagauggaa

SEQ ID NO: 2430141 - RNA, 15 nt, Bordetella pertussis
gcccauaugccgccg

SEQ ID NO: 2430142 - RNA, 16 nt, Bordetella pertussis
gcccauaugccgccgg

SEQ ID NO: 2430143 - RNA, 14 nt, Bordetella pertussis
gcccaucaggccga

SEQ ID NO: 2430144 - RNA, 16 nt, Bordetella pertussis
gcccaucaggccgaug

SEQ ID NO: 2430145 - RNA, 24 nt, Bordetella pertussis
gcccaucaggugaaacagcagcgg

SEQ ID NO: 2430146 - RNA, 13 nt, Bordetella pertussis
gcccaucaggugg

SEQ ID NO: 2430147 - RNA, 18 nt, Bordetella pertussis
gcccauccaucugguggu

SEQ ID NO: 2430148 - RNA, 20 nt, Bordetella pertussis
gcccauccaucugguggugc

SEQ ID NO: 2430149 - RNA, 13 nt, Bordetella pertussis
gcccaucgcgcug

SEQ ID NO: 2430150 - RNA, 17 nt, Bordetella pertussis
gcccaucgcgcugacga

SEQ ID NO: 2430151 - RNA, 21 nt, Bordetella pertussis
gcccaucgcggucaucggcga

SEQ ID NO: 2430152 - RNA, 15 nt, Bordetella pertussis
gcccaucgugcgcga

SEQ ID NO: 2430153 - RNA, 23 nt, Bordetella pertussis
gcccaucgugcgcgaucuugccg

SEQ ID NO: 2430154 - RNA, 16 nt, Bordetella pertussis
gcccaucucggccgcg

SEQ ID NO: 2430155 - RNA, 14 nt, Bordetella pertussis
gcccaucugguuga

SEQ ID NO: 2430156 - RNA, 17 nt, Bordetella pertussis
gcccaucugguugagca

SEQ ID NO: 2430157 - RNA, 21 nt, Bordetella pertussis
gcccaucugguugagcagcac

SEQ ID NO: 2430158 - RNA, 15 nt, Bordetella pertussis
gcccaugaacaggca

SEQ ID NO: 2430159 - RNA, 21 nt, Bordetella pertussis
gcccaugaacaggcacgacgc

SEQ ID NO: 2430160 - RNA, 17 nt, Bordetella pertussis
gcccaugaaggcggcca

SEQ ID NO: 2430161 - RNA, 19 nt, Bordetella pertussis
gcccaugaaggcggccagc

SEQ ID NO: 2430162 - RNA, 17 nt, Bordetella pertussis
gcccaugaccggcgugu

SEQ ID NO: 2430163 - RNA, 22 nt, Bordetella pertussis
gcccaugaccggcguguccagc

SEQ ID NO: 2430164 - RNA, 23 nt, Bordetella pertussis
gcccaugacgaccuugcggccgc

SEQ ID NO: 2430165 - RNA, 16 nt, Bordetella pertussis
gcccaugacgccggug

SEQ ID NO: 2430166 - RNA, 18 nt, Bordetella pertussis
gcccaugaucagggccgu

SEQ ID NO: 2430167 - RNA, 19 nt, Bordetella pertussis
gcccaugaucagggccgug

SEQ ID NO: 2430168 - RNA, 22 nt, Bordetella pertussis
gcccaugaucagggccgugccc

SEQ ID NO: 2430169 - RNA, 17 nt, Bordetella pertussis
gcccaugauggugccgg

SEQ ID NO: 2430170 - RNA, 15 nt, Bordetella pertussis
gcccaugccgccaug

SEQ ID NO: 2430171 - RNA, 17 nt, Bordetella pertussis
gcccaugccgccaugca

SEQ ID NO: 2430172 - RNA, 17 nt, Bordetella pertussis
gcccaugccgcccgcca

SEQ ID NO: 2430173 - RNA, 12 nt, Bordetella pertussis
gcccaugccgcg

SEQ ID NO: 2430174 - RNA, 13 nt, Bordetella pertussis
gcccaugccgcgc

SEQ ID NO: 2430175 - RNA, 22 nt, Bordetella pertussis
gcccaugccgcggacccaggcc

SEQ ID NO: 2430176 - RNA, 16 nt, Bordetella pertussis
gcccaugcgaucggcc

SEQ ID NO: 2430177 - RNA, 18 nt, Bordetella pertussis
gcccaugcgaucggccuc

SEQ ID NO: 2430178 - RNA, 19 nt, Bordetella pertussis
gcccaugcgaucggccucg

SEQ ID NO: 2430179 - RNA, 19 nt, Bordetella pertussis
gcccaugcgcauggccagc

SEQ ID NO: 2430180 - RNA, 22 nt, Bordetella pertussis
gcccaugcgcauggccagcaca

SEQ ID NO: 2430181 - RNA, 15 nt, Bordetella pertussis
gcccaugcgcuggcg

SEQ ID NO: 2430182 - RNA, 16 nt, Bordetella pertussis
gcccaugcgcuggcgc

SEQ ID NO: 2430183 - RNA, 17 nt, Bordetella pertussis
gcccaugcgcuggcgca

SEQ ID NO: 2430184 - RNA, 20 nt, Bordetella pertussis
gcccaugcgcuggcgcaagg

SEQ ID NO: 2430185 - RNA, 22 nt, Bordetella pertussis
gcccaugcgcuggcgcaaggac

SEQ ID NO: 2430186 - RNA, 22 nt, Bordetella pertussis
gcccaugcgggcguagaaagcc

SEQ ID NO: 2430187 - RNA, 17 nt, Bordetella pertussis
gcccauggccagggagg

SEQ ID NO: 2430188 - RNA, 13 nt, Bordetella pertussis
gcccauggcgcgc

SEQ ID NO: 2430189 - RNA, 16 nt, Bordetella pertussis
gcccauggcgcgcagc

SEQ ID NO: 2430190 - RNA, 21 nt, Bordetella pertussis
gcccauggggugcuccugcca

SEQ ID NO: 2430191 - RNA, 20 nt, Bordetella pertussis
gcccauggucaggacgacga

SEQ ID NO: 2430192 - RNA, 19 nt, Bordetella pertussis
gcccauguagaacgccagg

SEQ ID NO: 2430193 - RNA, 18 nt, Bordetella pertussis
gcccauguugaacugcag

SEQ ID NO: 2430194 - RNA, 22 nt, Bordetella pertussis
gcccauguugaacugcaggccg

SEQ ID NO: 2430195 - RNA, 15 nt, Bordetella pertussis
gcccauuccgagcgg

SEQ ID NO: 2430196 - RNA, 19 nt, Bordetella pertussis
gccccgcaaggggccggcg

SEQ ID NO: 2430197 - RNA, 14 nt, Bordetella pertussis
gccccgcagggccc

SEQ ID NO: 2430198 - RNA, 21 nt, Bordetella pertussis
gccccgcagggcccgcaucgg

SEQ ID NO: 2430199 - RNA, 18 nt, Bordetella pertussis
gccccgcaucugcggggc

SEQ ID NO: 2430200 - RNA, 21 nt, Bordetella pertussis
gccccgccacgucgccggcgu

SEQ ID NO: 2430201 - RNA, 22 nt, Bordetella pertussis
gccccgccacgucgccggcguu

SEQ ID NO: 2430202 - RNA, 16 nt, Bordetella pertussis
gccccgccaugcgcag

SEQ ID NO: 2430203 - RNA, 11 nt, Bordetella pertussis
gccccgcccgc

SEQ ID NO: 2430204 - RNA, 18 nt, Bordetella pertussis
gccccgcccgcgucacga

SEQ ID NO: 2430205 - RNA, 17 nt, Bordetella pertussis
gccccgccgggacacac

SEQ ID NO: 2430206 - RNA, 20 nt, Bordetella pertussis
gccccgccgggacacacgcu

SEQ ID NO: 2430207 - RNA, 14 nt, Bordetella pertussis
gccccgccgggccg

SEQ ID NO: 2430208 - RNA, 21 nt, Bordetella pertussis
gccccgccgggccgcgcccac

SEQ ID NO: 2430209 - RNA, 20 nt, Bordetella pertussis
gccccgccucgacgaugccc

SEQ ID NO: 2430210 - RNA, 22 nt, Bordetella pertussis
gccccgccucgacgaugcccug

SEQ ID NO: 2430211 - RNA, 17 nt, Bordetella pertussis
gccccgccugcgccagg

SEQ ID NO: 2430212 - RNA, 22 nt, Bordetella pertussis
gccccgccugcgccaggugggc

SEQ ID NO: 2430213 - RNA, 18 nt, Bordetella pertussis
gccccgcgacccagaacc

SEQ ID NO: 2430214 - RNA, 19 nt, Bordetella pertussis
gccccgcgaggggcccuug

SEQ ID NO: 2430215 - RNA, 14 nt, Bordetella pertussis
gccccgcgcgagcg

SEQ ID NO: 2430216 - RNA, 15 nt, Bordetella pertussis
gccccgcgcgagcgc

SEQ ID NO: 2430217 - RNA, 24 nt, Bordetella pertussis
gccccgcgcgagcgcaagcaccgc

SEQ ID NO: 2430218 - RNA, 21 nt, Bordetella pertussis
gccccgcggccgcggucagcc

SEQ ID NO: 2430219 - RNA, 18 nt, Bordetella pertussis
gccccgcuggccgucgcc

SEQ ID NO: 2430220 - RNA, 22 nt, Bordetella pertussis
gccccgcuggccgucgccgccc

SEQ ID NO: 2430221 - RNA, 16 nt, Bordetella pertussis
gccccgcuucgggccg

SEQ ID NO: 2430222 - RNA, 22 nt, Bordetella pertussis
gccccgcuucgggccggauggc

SEQ ID NO: 2430223 - RNA, 15 nt, Bordetella pertussis
gccccggcaccaucg

SEQ ID NO: 2430224 - RNA, 18 nt, Bordetella pertussis
gccccggcaccaucgccg

SEQ ID NO: 2430225 - RNA, 19 nt, Bordetella pertussis
gccccggcaccaucgccgc

SEQ ID NO: 2430226 - RNA, 20 nt, Bordetella pertussis
gccccggcaccaucgccgcc

SEQ ID NO: 2430227 - RNA, 21 nt, Bordetella pertussis
gccccggcaccaucgccgccu

SEQ ID NO: 2430228 - RNA, 23 nt, Bordetella pertussis
gccccggcaccaucgccgccugc

SEQ ID NO: 2430229 - RNA, 14 nt, Bordetella pertussis
gccccggcccggcg

SEQ ID NO: 2430230 - RNA, 21 nt, Bordetella pertussis
gccccggccgaucgcgccguc

SEQ ID NO: 2430231 - RNA, 16 nt, Bordetella pertussis
gccccggccgcccccg

SEQ ID NO: 2430232 - RNA, 18 nt, Bordetella pertussis
gccccggccgcccccgac

SEQ ID NO: 2430233 - RNA, 16 nt, Bordetella pertussis
gccccggccucccgga

SEQ ID NO: 2430234 - RNA, 18 nt, Bordetella pertussis
gccccggccucgcggcgc

SEQ ID NO: 2430235 - RNA, 12 nt, Bordetella pertussis
gccccggcgcgc

SEQ ID NO: 2430236 - RNA, 14 nt, Bordetella pertussis
gccccggcgcgcag

SEQ ID NO: 2430237 - RNA, 18 nt, Bordetella pertussis
gccccggcgcgcagcgcc

SEQ ID NO: 2430238 - RNA, 21 nt, Bordetella pertussis
gccccggcgcgcagcgccugc

SEQ ID NO: 2430239 - RNA, 19 nt, Bordetella pertussis
gccccggcgcgccggccgc

SEQ ID NO: 2430240 - RNA, 14 nt, Bordetella pertussis
gccccggcgcggcg

SEQ ID NO: 2430241 - RNA, 19 nt, Bordetella pertussis
gccccggcgcggcgcgcgc

SEQ ID NO: 2430242 - RNA, 21 nt, Bordetella pertussis
gccccggcgcggcgcgcgccg

SEQ ID NO: 2430243 - RNA, 19 nt, Bordetella pertussis
gccccggcucccgcgccau

SEQ ID NO: 2430244 - RNA, 21 nt, Bordetella pertussis
gccccggcucccgcgccauug

SEQ ID NO: 2430245 - RNA, 17 nt, Bordetella pertussis
gccccgguagucgccgg

SEQ ID NO: 2430246 - RNA, 19 nt, Bordetella pertussis
gccccguccuuacuugcgc

SEQ ID NO: 2430247 - RNA, 14 nt, Bordetella pertussis
gccccgucggccgu

SEQ ID NO: 2430248 - RNA, 17 nt, Bordetella pertussis
gccccgugcaccaugcc

SEQ ID NO: 2430249 - RNA, 22 nt, Bordetella pertussis
gccccgugcaccaugccgacga

SEQ ID NO: 2430250 - RNA, 20 nt, Bordetella pertussis
gccccgugccgcggcgcggc

SEQ ID NO: 2430251 - RNA, 21 nt, Bordetella pertussis
gccccgugccgcggcgcggcc

SEQ ID NO: 2430252 - RNA, 20 nt, Bordetella pertussis
gccccguugucgccgcggcc

SEQ ID NO: 2430253 - RNA, 21 nt, Bordetella pertussis
gccccguugucgccgcggccg

SEQ ID NO: 2430254 - RNA, 22 nt, Bordetella pertussis
gccccguugucgccgcggccgg

SEQ ID NO: 2430255 - RNA, 20 nt, Bordetella pertussis
gccccguuucguaaggcugc

SEQ ID NO: 2430256 - RNA, 15 nt, Bordetella pertussis
gccccuagcgccgcg

SEQ ID NO: 2430257 - RNA, 17 nt, Bordetella pertussis
gccccuccggcgccgcc

SEQ ID NO: 2430258 - RNA, 21 nt, Bordetella pertussis
gccccuccgggucgcggcacg

SEQ ID NO: 2430259 - RNA, 20 nt, Bordetella pertussis
gccccucgcggaugaccugg

SEQ ID NO: 2430260 - RNA, 14 nt, Bordetella pertussis
gccccucgcggggc

SEQ ID NO: 2430261 - RNA, 22 nt, Bordetella pertussis
gccccucgcggggcccuugugc

SEQ ID NO: 2430262 - RNA, 22 nt, Bordetella pertussis
gccccucggcgggcuugucgcu

SEQ ID NO: 2430263 - RNA, 16 nt, Bordetella pertussis
gccccugcccugcggc

SEQ ID NO: 2430264 - RNA, 14 nt, Bordetella pertussis
gccccugcgggccg

SEQ ID NO: 2430265 - RNA, 19 nt, Bordetella pertussis
gccccugcggggacaggca

SEQ ID NO: 2430266 - RNA, 20 nt, Bordetella pertussis
gccccugcggggacaggcac

SEQ ID NO: 2430267 - RNA, 21 nt, Bordetella pertussis
gccccugcggggacaggcacc

SEQ ID NO: 2430268 - RNA, 17 nt, Bordetella pertussis
gccccuguccucgcagg

SEQ ID NO: 2430269 - RNA, 23 nt, Bordetella pertussis
gccccuugcccaacgcggcgucg

SEQ ID NO: 2430270 - RNA, 13 nt, Bordetella pertussis
gcccgaaacgcgc

SEQ ID NO: 2430271 - RNA, 15 nt, Bordetella pertussis
gcccgaaacgcgcag

SEQ ID NO: 2430272 - RNA, 17 nt, Bordetella pertussis
gcccgaaacgcgcagca

SEQ ID NO: 2430273 - RNA, 18 nt, Bordetella pertussis
gcccgaaacgcgcagcac

SEQ ID NO: 2430274 - RNA, 23 nt, Bordetella pertussis
gcccgaaacgcgcagcaccggcg

SEQ ID NO: 2430275 - RNA, 21 nt, Bordetella pertussis
gcccgaaagguccuggagacg

SEQ ID NO: 2430276 - RNA, 14 nt, Bordetella pertussis
gcccgaaccggcau

SEQ ID NO: 2430277 - RNA, 18 nt, Bordetella pertussis
gcccgaaccggcaucccu

SEQ ID NO: 2430278 - RNA, 20 nt, Bordetella pertussis
gcccgaagauuuccucgcgc

SEQ ID NO: 2430279 - RNA, 23 nt, Bordetella pertussis
gcccgaagauuuccucgcgcacc

SEQ ID NO: 2430280 - RNA, 13 nt, Bordetella pertussis
gcccgaagcgcag

SEQ ID NO: 2430281 - RNA, 14 nt, Bordetella pertussis
gcccgaagcgcagc

SEQ ID NO: 2430282 - RNA, 14 nt, Bordetella pertussis
gcccgaaggcagcg

SEQ ID NO: 2430283 - RNA, 16 nt, Bordetella pertussis
gcccgaaggcagcggc

SEQ ID NO: 2430284 - RNA, 21 nt, Bordetella pertussis
gcccgaaggcagcggcacauc

SEQ ID NO: 2430285 - RNA, 17 nt, Bordetella pertussis
gcccgaauuccagcucu

SEQ ID NO: 2430286 - RNA, 15 nt, Bordetella pertussis
gcccgacagcacgcc

SEQ ID NO: 2430287 - RNA, 13 nt, Bordetella pertussis
gcccgacagcgcc

SEQ ID NO: 2430288 - RNA, 14 nt, Bordetella pertussis
gcccgacagcgccc

SEQ ID NO: 2430289 - RNA, 16 nt, Bordetella pertussis
gcccgacagcgccccg

SEQ ID NO: 2430290 - RNA, 15 nt, Bordetella pertussis
gcccgaccgcauggg

SEQ ID NO: 2430291 - RNA, 16 nt, Bordetella pertussis
gcccgaccgcaugggc

SEQ ID NO: 2430292 - RNA, 17 nt, Bordetella pertussis
gcccgaccugcuggcgc

SEQ ID NO: 2430293 - RNA, 20 nt, Bordetella pertussis
gcccgaccugcuggcgcgca

SEQ ID NO: 2430294 - RNA, 19 nt, Bordetella pertussis
gcccgacgacaacccgaac

SEQ ID NO: 2430295 - RNA, 21 nt, Bordetella pertussis
gcccgacgacgacuacuggca

SEQ ID NO: 2430296 - RNA, 17 nt, Bordetella pertussis
gcccgacgaggagccgg

SEQ ID NO: 2430297 - RNA, 22 nt, Bordetella pertussis
gcccgacgaggagccggcgggc

SEQ ID NO: 2430298 - RNA, 15 nt, Bordetella pertussis
gcccgacgccgcgcg

SEQ ID NO: 2430299 - RNA, 18 nt, Bordetella pertussis
gcccgacggacuggcugg

SEQ ID NO: 2430300 - RNA, 15 nt, Bordetella pertussis
gcccgacggccagcg

SEQ ID NO: 2430301 - RNA, 17 nt, Bordetella pertussis
gcccgacggccagcgcg

SEQ ID NO: 2430302 - RNA, 12 nt, Bordetella pertussis
gcccgacggcgc

SEQ ID NO: 2430303 - RNA, 16 nt, Bordetella pertussis
gcccgacggcgccgau

SEQ ID NO: 2430304 - RNA, 20 nt, Bordetella pertussis
gcccgacggcgccgauccgg

SEQ ID NO: 2430305 - RNA, 13 nt, Bordetella pertussis
gcccgacggcgcg

SEQ ID NO: 2430306 - RNA, 18 nt, Bordetella pertussis
gcccgacggcgcgcccgc

SEQ ID NO: 2430307 - RNA, 21 nt, Bordetella pertussis
gcccgacggcgcgcccgccgc

SEQ ID NO: 2430308 - RNA, 21 nt, Bordetella pertussis
gcccgccccauugggacgcca

SEQ ID NO: 2430309 - RNA, 23 nt, Bordetella pertussis
gcccgccccauugggacgccagc

SEQ ID NO: 2430310 - RNA, 13 nt, Bordetella pertussis
gcccgccccggcg

SEQ ID NO: 2430311 - RNA, 15 nt, Bordetella pertussis
gcccgccccggcgca

SEQ ID NO: 2430312 - RNA, 17 nt, Bordetella pertussis
gcccgccccgugcacca

SEQ ID NO: 2430313 - RNA, 13 nt, Bordetella pertussis
gcccgcccgacga

SEQ ID NO: 2430314 - RNA, 22 nt, Bordetella pertussis
gcccgcccgacgaggagccggc

SEQ ID NO: 2430315 - RNA, 15 nt, Bordetella pertussis
gcccgcccgcgagcg

SEQ ID NO: 2430316 - RNA, 22 nt, Bordetella pertussis
gcccgcccgcgagcggccagcc

SEQ ID NO: 2430317 - RNA, 13 nt, Bordetella pertussis
gcccgcccgcgcc

SEQ ID NO: 2430318 - RNA, 23 nt, Bordetella pertussis
gcccgcccgcugaccggccuggu

SEQ ID NO: 2430319 - RNA, 11 nt, Bordetella pertussis
gcccgcccugg

SEQ ID NO: 2430320 - RNA, 14 nt, Bordetella pertussis
gcccgcccugggca

SEQ ID NO: 2430321 - RNA, 15 nt, Bordetella pertussis
gcccgcccugggcag

SEQ ID NO: 2430322 - RNA, 16 nt, Bordetella pertussis
gcccgcccugggcagc

SEQ ID NO: 2430323 - RNA, 23 nt, Bordetella pertussis
gcccgcccugggcagcauucugg

SEQ ID NO: 2430324 - RNA, 22 nt, Bordetella pertussis
gcccgccgacgaaaugccggcg

SEQ ID NO: 2430325 - RNA, 16 nt, Bordetella pertussis
gcccgccgacugggcu

SEQ ID NO: 2430326 - RNA, 15 nt, Bordetella pertussis
gcccgccgagucggc

SEQ ID NO: 2430327 - RNA, 21 nt, Bordetella pertussis
gcccgccgagucggcgauggc

SEQ ID NO: 2430328 - RNA, 23 nt, Bordetella pertussis
gcccgccgagucggcgauggcgc

SEQ ID NO: 2430329 - RNA, 22 nt, Bordetella pertussis
gcccgccgauccacucggccag

SEQ ID NO: 2430330 - RNA, 24 nt, Bordetella pertussis
gcccgccgauccacucggccagcg

SEQ ID NO: 2430331 - RNA, 14 nt, Bordetella pertussis
gcccgccgccgggc

SEQ ID NO: 2430332 - RNA, 22 nt, Bordetella pertussis
gcccgccgccgggcgcgcgccg

SEQ ID NO: 2430333 - RNA, 15 nt, Bordetella pertussis
gcccgccgcggcagg

SEQ ID NO: 2430334 - RNA, 16 nt, Bordetella pertussis
gcccgccgcggcaggc

SEQ ID NO: 2430335 - RNA, 14 nt, Bordetella pertussis
gcccgccgcgucgg

SEQ ID NO: 2430336 - RNA, 15 nt, Bordetella pertussis
gcccgccggcacccg

SEQ ID NO: 2430337 - RNA, 19 nt, Bordetella pertussis
gcccgccggcacccggcuc

SEQ ID NO: 2430338 - RNA, 13 nt, Bordetella pertussis
gcccgccggcgcg

SEQ ID NO: 2430339 - RNA, 21 nt, Bordetella pertussis
gcccgccggcgcgcgcgcgcc

SEQ ID NO: 2430340 - RNA, 23 nt, Bordetella pertussis
gcccgccggcgcgcgcgcgccgc

SEQ ID NO: 2430341 - RNA, 14 nt, Bordetella pertussis
gcccgccguggcca

SEQ ID NO: 2430342 - RNA, 21 nt, Bordetella pertussis
gcccgccguggccaagggcgc

SEQ ID NO: 2430343 - RNA, 23 nt, Bordetella pertussis
gcccgccguggccaagggcgccg

SEQ ID NO: 2430344 - RNA, 14 nt, Bordetella pertussis
gcccgccucaggcc

SEQ ID NO: 2430345 - RNA, 17 nt, Bordetella pertussis
gcccgccucaggccgga

SEQ ID NO: 2430346 - RNA, 13 nt, Bordetella pertussis
gcccgccugcagc

SEQ ID NO: 2430347 - RNA, 17 nt, Bordetella pertussis
gcccgccugcagcagcg

SEQ ID NO: 2430348 - RNA, 14 nt, Bordetella pertussis
gcccgccugccggc

SEQ ID NO: 2430349 - RNA, 21 nt, Bordetella pertussis
gcccgccugccggccuggcuc

SEQ ID NO: 2430350 - RNA, 14 nt, Bordetella pertussis
gcccgccugcgcca

SEQ ID NO: 2430351 - RNA, 19 nt, Bordetella pertussis
gcccgccugcguggcgggc

SEQ ID NO: 2430352 - RNA, 17 nt, Bordetella pertussis
gcccgccuggcgccgcg

SEQ ID NO: 2430353 - RNA, 17 nt, Bordetella pertussis
gcccgccuggucgcugg

SEQ ID NO: 2430354 - RNA, 18 nt, Bordetella pertussis
gcccgccuggucgcuggc

SEQ ID NO: 2430355 - RNA, 16 nt, Bordetella pertussis
gcccgccuucagcggg

SEQ ID NO: 2430356 - RNA, 18 nt, Bordetella pertussis
gcccgccuucagcgggcc

SEQ ID NO: 2430357 - RNA, 19 nt, Bordetella pertussis
gcccgccuucagcgggccg

SEQ ID NO: 2430358 - RNA, 22 nt, Bordetella pertussis
gcccgccuucagcgggccggca

SEQ ID NO: 2430359 - RNA, 12 nt, Bordetella pertussis
gcccgccuucgc

SEQ ID NO: 2430360 - RNA, 16 nt, Bordetella pertussis
gcccgccuucgcugac

SEQ ID NO: 2430361 - RNA, 19 nt, Bordetella pertussis
gcccgccuucgcugacgcg

SEQ ID NO: 2430362 - RNA, 18 nt, Bordetella pertussis
gcccgcgaaagcgggcaa

SEQ ID NO: 2430363 - RNA, 17 nt, Bordetella pertussis
gcccgcgaagcagccgg

SEQ ID NO: 2430364 - RNA, 21 nt, Bordetella pertussis
gcccgcgaagcagccggccaa

SEQ ID NO: 2430365 - RNA, 22 nt, Bordetella pertussis
gcccgcgaagcagccggccaag

SEQ ID NO: 2430366 - RNA, 14 nt, Bordetella pertussis
gcccgcgacgcugg

SEQ ID NO: 2430367 - RNA, 17 nt, Bordetella pertussis
gcccgcgagcggccagc

SEQ ID NO: 2430368 - RNA, 18 nt, Bordetella pertussis
gcccgcgagcggccagcc

SEQ ID NO: 2430369 - RNA, 19 nt, Bordetella pertussis
gcccgcgagcggccagccu

SEQ ID NO: 2430370 - RNA, 24 nt, Bordetella pertussis
gcccgcgagcggccagccugccgc

SEQ ID NO: 2430371 - RNA, 13 nt, Bordetella pertussis
gcccgcgauaugc

SEQ ID NO: 2430372 - RNA, 17 nt, Bordetella pertussis
gcccgcgcaccaggcgc

SEQ ID NO: 2430373 - RNA, 19 nt, Bordetella pertussis
gcccgcgcaccaggcgcgg

SEQ ID NO: 2430374 - RNA, 15 nt, Bordetella pertussis
gcccgcgcacgcccg

SEQ ID NO: 2430375 - RNA, 17 nt, Bordetella pertussis
gcccgcgcacgcccgcg

SEQ ID NO: 2430376 - RNA, 13 nt, Bordetella pertussis
gcccgcgcagacg

SEQ ID NO: 2430377 - RNA, 17 nt, Bordetella pertussis
gcccgcgcagacgggcc

SEQ ID NO: 2430378 - RNA, 13 nt, Bordetella pertussis
gcccgcgccacca

SEQ ID NO: 2430379 - RNA, 16 nt, Bordetella pertussis
gcccgcgccaccaccg

SEQ ID NO: 2430380 - RNA, 15 nt, Bordetella pertussis
gcccgcgccagcgcc

SEQ ID NO: 2430381 - RNA, 19 nt, Bordetella pertussis
gcccgcgccagcgccacgc

SEQ ID NO: 2430382 - RNA, 20 nt, Bordetella pertussis
gcccgcgccagcgccacgcc

SEQ ID NO: 2430383 - RNA, 13 nt, Bordetella pertussis
gcccgcgccaucg

SEQ ID NO: 2430384 - RNA, 21 nt, Bordetella pertussis
gcccgcgccaucgcgucgacg

SEQ ID NO: 2430385 - RNA, 13 nt, Bordetella pertussis
gcccgcgcccagc

SEQ ID NO: 2430386 - RNA, 14 nt, Bordetella pertussis
gcccgcgccgaagu

SEQ ID NO: 2430387 - RNA, 22 nt, Bordetella pertussis
gcccgcgccgaaguugcggccg

SEQ ID NO: 2430388 - RNA, 13 nt, Bordetella pertussis
gcccgcgccgacg

SEQ ID NO: 2430389 - RNA, 13 nt, Bordetella pertussis
gcccgcgccgcaa

SEQ ID NO: 2430390 - RNA, 15 nt, Bordetella pertussis
gcccgcgccgcguca

SEQ ID NO: 2430391 - RNA, 16 nt, Bordetella pertussis
gcccgcgccgcgucau

SEQ ID NO: 2430392 - RNA, 15 nt, Bordetella pertussis
gcccgcgccgggguu

SEQ ID NO: 2430393 - RNA, 13 nt, Bordetella pertussis
gcccgcgccguac

SEQ ID NO: 2430394 - RNA, 14 nt, Bordetella pertussis
gcccgcgcgagcgg

SEQ ID NO: 2430395 - RNA, 22 nt, Bordetella pertussis
gcccgcgcgagcggcgugcgcg

SEQ ID NO: 2430396 - RNA, 14 nt, Bordetella pertussis
gcccgcgcgccugc

SEQ ID NO: 2430397 - RNA, 15 nt, Bordetella pertussis
gcccgcgcgccugca

SEQ ID NO: 2430398 - RNA, 14 nt, Bordetella pertussis
gcccgcgcgcgagc

SEQ ID NO: 2430399 - RNA, 19 nt, Bordetella pertussis
gcccgcgcgcgagcugcgc

SEQ ID NO: 2430400 - RNA, 15 nt, Bordetella pertussis
gcccgcgcggccagc

SEQ ID NO: 2430401 - RNA, 18 nt, Bordetella pertussis
gcccgcgcggccagcgcc

SEQ ID NO: 2430402 - RNA, 20 nt, Bordetella pertussis
gcccgcgcggccagcgccgg

SEQ ID NO: 2430403 - RNA, 21 nt, Bordetella pertussis
gcccgcgcggccagcgccggc

SEQ ID NO: 2430404 - RNA, 23 nt, Bordetella pertussis
gcccgcgcggccagcgccggcgc

SEQ ID NO: 2430405 - RNA, 21 nt, Bordetella pertussis
gcccgcgcgguauugcgccac

SEQ ID NO: 2430406 - RNA, 15 nt, Bordetella pertussis
gcccgcgcuggcgca

SEQ ID NO: 2430407 - RNA, 16 nt, Bordetella pertussis
gcccgcgcuggcgcag

SEQ ID NO: 2430408 - RNA, 17 nt, Bordetella pertussis
gcccgcgcuggcgcagc

SEQ ID NO: 2430409 - RNA, 19 nt, Bordetella pertussis
gcccgcgcuggcgcagcag

SEQ ID NO: 2430410 - RNA, 21 nt, Bordetella pertussis
gcccgcgcuggcgcagcaggc

SEQ ID NO: 2430411 - RNA, 21 nt, Bordetella pertussis
gcccgcgcuguugcuccaggc

SEQ ID NO: 2430412 - RNA, 24 nt, Bordetella pertussis
gcccgcgcuguugcuccaggccgg

SEQ ID NO: 2430413 - RNA, 19 nt, Bordetella pertussis
gcccgcggaaagcuggcgu

SEQ ID NO: 2430414 - RNA, 12 nt, Bordetella pertussis
gcccgcggccag

SEQ ID NO: 2430415 - RNA, 13 nt, Bordetella pertussis
gcccgcggccagc

SEQ ID NO: 2430416 - RNA, 14 nt, Bordetella pertussis
gcccgcggccagcc

SEQ ID NO: 2430417 - RNA, 16 nt, Bordetella pertussis
gcccgcggccagccac

SEQ ID NO: 2430418 - RNA, 21 nt, Bordetella pertussis
gcccgcggccagccacgccgg

SEQ ID NO: 2430419 - RNA, 17 nt, Bordetella pertussis
gcccgcggccgcgucau

SEQ ID NO: 2430420 - RNA, 22 nt, Bordetella pertussis
gcccgcggccugcagaccagca

SEQ ID NO: 2430421 - RNA, 15 nt, Bordetella pertussis
gcccggcgagcaugg

SEQ ID NO: 2430422 - RNA, 21 nt, Bordetella pertussis
gcccggcgagguugcaggcca

SEQ ID NO: 2430423 - RNA, 11 nt, Bordetella pertussis
gcccggcgcca

SEQ ID NO: 2430424 - RNA, 12 nt, Bordetella pertussis
gcccggcgccac

SEQ ID NO: 2430425 - RNA, 13 nt, Bordetella pertussis
gcccggcgccacc

SEQ ID NO: 2430426 - RNA, 14 nt, Bordetella pertussis
gcccggcgccaucu

SEQ ID NO: 2430427 - RNA, 12 nt, Bordetella pertussis
gcccggcgccgc

SEQ ID NO: 2430428 - RNA, 14 nt, Bordetella pertussis
gcccggcgccgcgc

SEQ ID NO: 2430429 - RNA, 14 nt, Bordetella pertussis
gcccggcgccggug

SEQ ID NO: 2430430 - RNA, 17 nt, Bordetella pertussis
gcccggcgccggugggc

SEQ ID NO: 2430431 - RNA, 12 nt, Bordetella pertussis
gcccggcgcgau

SEQ ID NO: 2430432 - RNA, 11 nt, Bordetella pertussis
gcccggcgcgc

SEQ ID NO: 2430433 - RNA, 13 nt, Bordetella pertussis
gcccggcgcgcau

SEQ ID NO: 2430434 - RNA, 14 nt, Bordetella pertussis
gcccggcgcgcauc

SEQ ID NO: 2430435 - RNA, 14 nt, Bordetella pertussis
gcccggcgcgccac

SEQ ID NO: 2430436 - RNA, 21 nt, Bordetella pertussis
gcccggcgcgccuuacgcggc

SEQ ID NO: 2430437 - RNA, 19 nt, Bordetella pertussis
gcccggcggaucacccagc

SEQ ID NO: 2430438 - RNA, 20 nt, Bordetella pertussis
gcccggcggaucacccagcg

SEQ ID NO: 2430439 - RNA, 14 nt, Bordetella pertussis
gcccggcggccagg

SEQ ID NO: 2430440 - RNA, 16 nt, Bordetella pertussis
gcccggcggccaggcc

SEQ ID NO: 2430441 - RNA, 20 nt, Bordetella pertussis
gcccggcggccaggccggcg

SEQ ID NO: 2430442 - RNA, 21 nt, Bordetella pertussis
gcccggcggccaggccggcgc

SEQ ID NO: 2430443 - RNA, 23 nt, Bordetella pertussis
gcccggcggccaggccggcgcgc

SEQ ID NO: 2430444 - RNA, 13 nt, Bordetella pertussis
gcccggcggccau

SEQ ID NO: 2430445 - RNA, 13 nt, Bordetella pertussis
gcccggcggcgcg

SEQ ID NO: 2430446 - RNA, 14 nt, Bordetella pertussis
gcccggcggcgcgc

SEQ ID NO: 2430447 - RNA, 16 nt, Bordetella pertussis
gcccggcggcgcgccg

SEQ ID NO: 2430448 - RNA, 18 nt, Bordetella pertussis
gcccggcggcgcgccgcc

SEQ ID NO: 2430449 - RNA, 19 nt, Bordetella pertussis
gcccggcggcgcgccgccg

SEQ ID NO: 2430450 - RNA, 20 nt, Bordetella pertussis
gcccggcggcgcgccgccgg

SEQ ID NO: 2430451 - RNA, 24 nt, Bordetella pertussis
gcccggcggcgcgccgccgggccu

SEQ ID NO: 2430452 - RNA, 15 nt, Bordetella pertussis
gcccggcggcgcggc

SEQ ID NO: 2430453 - RNA, 18 nt, Bordetella pertussis
gcccggcggcgcggcgag

SEQ ID NO: 2430454 - RNA, 22 nt, Bordetella pertussis
gcccggcggcgcggcgagcacg

SEQ ID NO: 2430455 - RNA, 23 nt, Bordetella pertussis
gcccggcggcgcggcgagcacgg

SEQ ID NO: 2430456 - RNA, 14 nt, Bordetella pertussis
gcccggcgggaaca

SEQ ID NO: 2430457 - RNA, 17 nt, Bordetella pertussis
gcccggcgggaacaggc

SEQ ID NO: 2430458 - RNA, 19 nt, Bordetella pertussis
gcccggcgggaacaggcac

SEQ ID NO: 2430459 - RNA, 20 nt, Bordetella pertussis
gcccggcgggaacaggcacc

SEQ ID NO: 2430460 - RNA, 22 nt, Bordetella pertussis
gcccggcgggaacaggcaccga

SEQ ID NO: 2430461 - RNA, 13 nt, Bordetella pertussis
gcccggcgggccg

SEQ ID NO: 2430462 - RNA, 14 nt, Bordetella pertussis
gcccggcgggccgg

SEQ ID NO: 2430463 - RNA, 15 nt, Bordetella pertussis
gcccggcgggccggc

SEQ ID NO: 2430464 - RNA, 16 nt, Bordetella pertussis
gcccggcgggccggcu

SEQ ID NO: 2430465 - RNA, 17 nt, Bordetella pertussis
gcccggcggugaccugg

SEQ ID NO: 2430466 - RNA, 18 nt, Bordetella pertussis
gcccggcggugaccuggg

SEQ ID NO: 2430467 - RNA, 12 nt, Bordetella pertussis
gcccggcguagc

SEQ ID NO: 2430468 - RNA, 18 nt, Bordetella pertussis
gcccggcgugacgcugac

SEQ ID NO: 2430469 - RNA, 22 nt, Bordetella pertussis
gcccggcgugacgcugacccug

SEQ ID NO: 2430470 - RNA, 22 nt, Bordetella pertussis
gcccggcgugcccagggccacg

SEQ ID NO: 2430471 - RNA, 15 nt, Bordetella pertussis
gcccggcgugcugag

SEQ ID NO: 2430472 - RNA, 21 nt, Bordetella pertussis
gcccggcucgccgagccgggc

SEQ ID NO: 2430473 - RNA, 12 nt, Bordetella pertussis
gcccggcucgcu

SEQ ID NO: 2430474 - RNA, 12 nt, Bordetella pertussis
gcccggcugcuc

SEQ ID NO: 2430475 - RNA, 15 nt, Bordetella pertussis
gcccggcuucgauca

SEQ ID NO: 2430476 - RNA, 19 nt, Bordetella pertussis
gcccggcuucgaucaugcc

SEQ ID NO: 2430477 - RNA, 22 nt, Bordetella pertussis
gcccggcuucgaucaugcccgc

SEQ ID NO: 2430478 - RNA, 17 nt, Bordetella pertussis
gcccgggaaacucgcgc

SEQ ID NO: 2430479 - RNA, 20 nt, Bordetella pertussis
gcccgggaaacucgcgcagc

SEQ ID NO: 2430480 - RNA, 21 nt, Bordetella pertussis
gcccgggaaacucgcgcagcg

SEQ ID NO: 2430481 - RNA, 14 nt, Bordetella pertussis
gcccgggcaccagg

SEQ ID NO: 2430482 - RNA, 19 nt, Bordetella pertussis
gcccgggcaggcucagccc

SEQ ID NO: 2430483 - RNA, 22 nt, Bordetella pertussis
gcccgggccgucuacaggccca

SEQ ID NO: 2430484 - RNA, 20 nt, Bordetella pertussis
gcccgggcgagauggcgugc

SEQ ID NO: 2430485 - RNA, 21 nt, Bordetella pertussis
gcccgggcgagauggcgugca

SEQ ID NO: 2430486 - RNA, 23 nt, Bordetella pertussis
gcccgggcgagauggcgugcacg

SEQ ID NO: 2430487 - RNA, 14 nt, Bordetella pertussis
gcccgggcgccggc

SEQ ID NO: 2430488 - RNA, 13 nt, Bordetella pertussis
gcccgggcgccug

SEQ ID NO: 2430489 - RNA, 15 nt, Bordetella pertussis
gcccgggcgccugcg

SEQ ID NO: 2430490 - RNA, 22 nt, Bordetella pertussis
gcccgggcgccugcgccaccug

SEQ ID NO: 2430491 - RNA, 14 nt, Bordetella pertussis
gcccgggcgcgcug

SEQ ID NO: 2430492 - RNA, 18 nt, Bordetella pertussis
gcccgggcgugccugcuu

SEQ ID NO: 2430493 - RNA, 17 nt, Bordetella pertussis
gcccgggcguggcgucg

SEQ ID NO: 2430494 - RNA, 17 nt, Bordetella pertussis
gcccgggcugauccgca

SEQ ID NO: 2430495 - RNA, 21 nt, Bordetella pertussis
gcccgggcugcugcacgcgcg

SEQ ID NO: 2430496 - RNA, 13 nt, Bordetella pertussis
gcccgggcuggcc

SEQ ID NO: 2430497 - RNA, 17 nt, Bordetella pertussis
gcccgggcuggccgccu

SEQ ID NO: 2430498 - RNA, 18 nt, Bordetella pertussis
gcccgggcuggccgccug

SEQ ID NO: 2430499 - RNA, 21 nt, Bordetella pertussis
gcccgggguugccaagauggc

SEQ ID NO: 2430500 - RNA, 15 nt, Bordetella pertussis
gcccggguacggcag

SEQ ID NO: 2430501 - RNA, 22 nt, Bordetella pertussis
gcccgggugaucaguccgacga

SEQ ID NO: 2430502 - RNA, 13 nt, Bordetella pertussis
gcccgggugccug

SEQ ID NO: 2430503 - RNA, 12 nt, Bordetella pertussis
gcccgggugggc

SEQ ID NO: 2430504 - RNA, 19 nt, Bordetella pertussis
gcccgggugggcggcaucg

SEQ ID NO: 2430505 - RNA, 22 nt, Bordetella pertussis
gcccggguuuuuuuuggcguac

SEQ ID NO: 2430506 - RNA, 15 nt, Bordetella pertussis
gcccgguaggccacg

SEQ ID NO: 2430507 - RNA, 18 nt, Bordetella pertussis
gcccgguauuccucgacg

SEQ ID NO: 2430508 - RNA, 22 nt, Bordetella pertussis
gcccggucguggcugaccagca

SEQ ID NO: 2430509 - RNA, 19 nt, Bordetella pertussis
gcccggugaucgaguaggc

SEQ ID NO: 2430510 - RNA, 16 nt, Bordetella pertussis
gcccggugcgcgcagg

SEQ ID NO: 2430511 - RNA, 18 nt, Bordetella pertussis
gcccggugcgcgcagggc

SEQ ID NO: 2430512 - RNA, 18 nt, Bordetella pertussis
gcccggugcguaccagcc

SEQ ID NO: 2430513 - RNA, 21 nt, Bordetella pertussis
gcccggugcguaccagcccag

SEQ ID NO: 2430514 - RNA, 16 nt, Bordetella pertussis
gcccgguucgccgucg

SEQ ID NO: 2430515 - RNA, 14 nt, Bordetella pertussis
gcccgguucgugcc

SEQ ID NO: 2430516 - RNA, 21 nt, Bordetella pertussis
gcccgguucgugccgggcagc

SEQ ID NO: 2430517 - RNA, 15 nt, Bordetella pertussis
gcccgguucugcggc

SEQ ID NO: 2430518 - RNA, 16 nt, Bordetella pertussis
gcccgguucugcggcg

SEQ ID NO: 2430519 - RNA, 20 nt, Bordetella pertussis
gcccguacgucaaggccugc

SEQ ID NO: 2430520 - RNA, 22 nt, Bordetella pertussis
gcccguacgucaaggccugccc

SEQ ID NO: 2430521 - RNA, 23 nt, Bordetella pertussis
gcccguagcuggaccccuugcgg

SEQ ID NO: 2430522 - RNA, 15 nt, Bordetella pertussis
gcccgucagcggcgc

SEQ ID NO: 2430523 - RNA, 19 nt, Bordetella pertussis
gcccgucagcggcgcgccc

SEQ ID NO: 2430524 - RNA, 15 nt, Bordetella pertussis
gcccgucaggguacg

SEQ ID NO: 2430525 - RNA, 23 nt, Bordetella pertussis
gcccgucaggguacgcucgacga

SEQ ID NO: 2430526 - RNA, 14 nt, Bordetella pertussis
gcccgucaguccgu

SEQ ID NO: 2430527 - RNA, 19 nt, Bordetella pertussis
gcccgucaugcgccgcagc

SEQ ID NO: 2430528 - RNA, 20 nt, Bordetella pertussis
gcccgucaugcgccgcagca

SEQ ID NO: 2430529 - RNA, 14 nt, Bordetella pertussis
gcccgucaugggcg

SEQ ID NO: 2430530 - RNA, 19 nt, Bordetella pertussis
gcccgucaugggcggggcc

SEQ ID NO: 2430531 - RNA, 22 nt, Bordetella pertussis
gcccgucaugggcggggccaca

SEQ ID NO: 2430532 - RNA, 16 nt, Bordetella pertussis
gcccguccgggcggcg

SEQ ID NO: 2430533 - RNA, 17 nt, Bordetella pertussis
gcccguccgggcggcgu

SEQ ID NO: 2430534 - RNA, 22 nt, Bordetella pertussis
gcccugcggcuugggcccggcg

SEQ ID NO: 2430535 - RNA, 15 nt, Bordetella pertussis
gcccugcguggcgca

SEQ ID NO: 2430536 - RNA, 17 nt, Bordetella pertussis
gcccugcguggcgcagu

SEQ ID NO: 2430537 - RNA, 23 nt, Bordetella pertussis
gcccugcguggcgcagugggcca

SEQ ID NO: 2430538 - RNA, 18 nt, Bordetella pertussis
gcccugcgugugccuguc

SEQ ID NO: 2430539 - RNA, 20 nt, Bordetella pertussis
gcccugcucccacgaacgcc

SEQ ID NO: 2430540 - RNA, 15 nt, Bordetella pertussis
gcccugcucgaucug

SEQ ID NO: 2430541 - RNA, 16 nt, Bordetella pertussis
gcccugcucgcgcagc

SEQ ID NO: 2430542 - RNA, 16 nt, Bordetella pertussis
gcccugcugcccgccg

SEQ ID NO: 2430543 - RNA, 17 nt, Bordetella pertussis
gcccugcugcccgccgc

SEQ ID NO: 2430544 - RNA, 16 nt, Bordetella pertussis
gcccugcugcugcagc

SEQ ID NO: 2430545 - RNA, 18 nt, Bordetella pertussis
gcccugcugcugcagcca

SEQ ID NO: 2430546 - RNA, 14 nt, Bordetella pertussis
gcccugcuggcgca

SEQ ID NO: 2430547 - RNA, 16 nt, Bordetella pertussis
gcccugcuggcgcagu

SEQ ID NO: 2430548 - RNA, 23 nt, Bordetella pertussis
gcccugcugggguggagcgcggc

SEQ ID NO: 2430549 - RNA, 17 nt, Bordetella pertussis
gcccuggagaucgccgc

SEQ ID NO: 2430550 - RNA, 18 nt, Bordetella pertussis
gcccuggagaucgccgcc

SEQ ID NO: 2430551 - RNA, 19 nt, Bordetella pertussis
gcccuggagaucgccgccg

SEQ ID NO: 2430552 - RNA, 20 nt, Bordetella pertussis
gcccuggaucaggaugggcg

SEQ ID NO: 2430553 - RNA, 15 nt, Bordetella pertussis
gcccuggauggccug

SEQ ID NO: 2430554 - RNA, 16 nt, Bordetella pertussis
gcccuggauggccugg

SEQ ID NO: 2430555 - RNA, 14 nt, Bordetella pertussis
gcccuggauggcgg

SEQ ID NO: 2430556 - RNA, 15 nt, Bordetella pertussis
gcccuggauggcggc

SEQ ID NO: 2430557 - RNA, 17 nt, Bordetella pertussis
gcccuggauggcggccg

SEQ ID NO: 2430558 - RNA, 18 nt, Bordetella pertussis
gcccuggauggcggccgc

SEQ ID NO: 2430559 - RNA, 20 nt, Bordetella pertussis
gcccuggauggcggccgcca

SEQ ID NO: 2430560 - RNA, 24 nt, Bordetella pertussis
gcccuggauggcggccgccagcgc

SEQ ID NO: 2430561 - RNA, 11 nt, Bordetella pertussis
gcccuggccac

SEQ ID NO: 2430562 - RNA, 16 nt, Bordetella pertussis
gcccuggccacgcugc

SEQ ID NO: 2430563 - RNA, 17 nt, Bordetella pertussis
gcccuggccacgcugcu

SEQ ID NO: 2430564 - RNA, 15 nt, Bordetella pertussis
gcccuggcccaggcc

SEQ ID NO: 2430565 - RNA, 20 nt, Bordetella pertussis
gcccuggcccaggccgaacc

SEQ ID NO: 2430566 - RNA, 10 nt, Bordetella pertussis
gcccuggccg

SEQ ID NO: 2430567 - RNA, 20 nt, Bordetella pertussis
gcccuggccgcgccguucgg

SEQ ID NO: 2430568 - RNA, 20 nt, Bordetella pertussis
gcccuggccuucgaccugcc

SEQ ID NO: 2430569 - RNA, 13 nt, Bordetella pertussis
gcccuggcgcagg

SEQ ID NO: 2430570 - RNA, 16 nt, Bordetella pertussis
gcccuggcgcaggccg

SEQ ID NO: 2430571 - RNA, 20 nt, Bordetella pertussis
gcccuggcgcaggccggcgg

SEQ ID NO: 2430572 - RNA, 19 nt, Bordetella pertussis
gcccuggcgccgcggccgg

SEQ ID NO: 2430573 - RNA, 22 nt, Bordetella pertussis
gcccuggcgcgaggcggcgacg

SEQ ID NO: 2430574 - RNA, 14 nt, Bordetella pertussis
gcccuggcgcggcg

SEQ ID NO: 2430575 - RNA, 21 nt, Bordetella pertussis
gcccuggcgcggcggcgucaa

SEQ ID NO: 2430576 - RNA, 17 nt, Bordetella pertussis
gcccuggcgcugcagcg

SEQ ID NO: 2430577 - RNA, 19 nt, Bordetella pertussis
gcccuggcgcugcagcguc

SEQ ID NO: 2430578 - RNA, 16 nt, Bordetella pertussis
gcccuggcggcgcagu

SEQ ID NO: 2430579 - RNA, 13 nt, Bordetella pertussis
gcccuggcggcgg

SEQ ID NO: 2430580 - RNA, 17 nt, Bordetella pertussis
gcccuggcguggcgcgc

SEQ ID NO: 2430581 - RNA, 18 nt, Bordetella pertussis
gcccuggcguggcgcgcg

SEQ ID NO: 2430582 - RNA, 19 nt, Bordetella pertussis
gcccuggcguggcgcgcgc

SEQ ID NO: 2430583 - RNA, 13 nt, Bordetella pertussis
gcccuggcguucg

SEQ ID NO: 2430584 - RNA, 19 nt, Bordetella pertussis
gcccuggcguucgcgcgcg

SEQ ID NO: 2430585 - RNA, 23 nt, Bordetella pertussis
gcccuggcguucgcgcgcggggu

SEQ ID NO: 2430586 - RNA, 15 nt, Bordetella pertussis
gcccuggcugagcga

SEQ ID NO: 2430587 - RNA, 16 nt, Bordetella pertussis
gcccuggcuggccagc

SEQ ID NO: 2430588 - RNA, 17 nt, Bordetella pertussis
gcccuggcuggccagcc

SEQ ID NO: 2430589 - RNA, 19 nt, Bordetella pertussis
gcccugggcagcauucugg

SEQ ID NO: 2430590 - RNA, 23 nt, Bordetella pertussis
gcccugggcagcauucuggugca

SEQ ID NO: 2430591 - RNA, 13 nt, Bordetella pertussis
gcccugggccagc

SEQ ID NO: 2430592 - RNA, 19 nt, Bordetella pertussis
gcccugggccagcagcugg

SEQ ID NO: 2430593 - RNA, 14 nt, Bordetella pertussis
gcccugggccagcc

SEQ ID NO: 2430594 - RNA, 16 nt, Bordetella pertussis
gcccugggccagccag

SEQ ID NO: 2430595 - RNA, 17 nt, Bordetella pertussis
gcccugggccagccagc

SEQ ID NO: 2430596 - RNA, 18 nt, Bordetella pertussis
gcccugggccagccagcg

SEQ ID NO: 2430597 - RNA, 19 nt, Bordetella pertussis
gcccugggccagccagcgc

SEQ ID NO: 2430598 - RNA, 21 nt, Bordetella pertussis
gcccugggccagccagcgccg

SEQ ID NO: 2430599 - RNA, 22 nt, Bordetella pertussis
gcccugggcgagguagggcgcg

SEQ ID NO: 2430600 - RNA, 15 nt, Bordetella pertussis
gcccugggcgcggcg

SEQ ID NO: 2430601 - RNA, 17 nt, Bordetella pertussis
gcccugggcgcggcggu

SEQ ID NO: 2430602 - RNA, 19 nt, Bordetella pertussis
gcccugggcuuuggcuugg

SEQ ID NO: 2430603 - RNA, 16 nt, Bordetella pertussis
gcccuggggccgcggc

SEQ ID NO: 2430604 - RNA, 19 nt, Bordetella pertussis
gcccuggggccgcggcgcg

SEQ ID NO: 2430605 - RNA, 20 nt, Bordetella pertussis
gcccuggggccgcggcgcgc

SEQ ID NO: 2430606 - RNA, 12 nt, Bordetella pertussis
gcccuggggcgc

SEQ ID NO: 2430607 - RNA, 17 nt, Bordetella pertussis
gcccuggguggcggggc

SEQ ID NO: 2430608 - RNA, 18 nt, Bordetella pertussis
gcccuggguggcggggcg

SEQ ID NO: 2430609 - RNA, 15 nt, Bordetella pertussis
gcccuggucaucgcc

SEQ ID NO: 2430610 - RNA, 18 nt, Bordetella pertussis
gcccuggucaucgccaug

SEQ ID NO: 2430611 - RNA, 22 nt, Bordetella pertussis
gcccuggucaucgccaugcugc

SEQ ID NO: 2430612 - RNA, 18 nt, Bordetella pertussis
gcccugguggcagagggc

SEQ ID NO: 2430613 - RNA, 23 nt, Bordetella pertussis
gcccugucggccgaaccgcgcag

SEQ ID NO: 2430614 - RNA, 21 nt, Bordetella pertussis
gcccugucggugaugauccug

SEQ ID NO: 2430615 - RNA, 21 nt, Bordetella pertussis
gcccuguguccacgaacgcga

SEQ ID NO: 2430616 - RNA, 17 nt, Bordetella pertussis
gcccuguucgcgcggcc

SEQ ID NO: 2430617 - RNA, 19 nt, Bordetella pertussis
gcccuguucgcgcggcccg

SEQ ID NO: 2430618 - RNA, 14 nt, Bordetella pertussis
gcccuucaggccag

SEQ ID NO: 2430619 - RNA, 13 nt, Bordetella pertussis
gcccuucgcggcu

SEQ ID NO: 2430620 - RNA, 19 nt, Bordetella pertussis
gcccuucgcggcuggucgc

SEQ ID NO: 2430621 - RNA, 20 nt, Bordetella pertussis
gcccuugagcacggcgcggc

SEQ ID NO: 2430622 - RNA, 21 nt, Bordetella pertussis
gcccuugagcacggcgcggcu

SEQ ID NO: 2430623 - RNA, 16 nt, Bordetella pertussis
gcccuugaucagcggc

SEQ ID NO: 2430624 - RNA, 17 nt, Bordetella pertussis
gcccuugaucagcggcg

SEQ ID NO: 2430625 - RNA, 18 nt, Bordetella pertussis
gcccuugaucaggcgcau

SEQ ID NO: 2430626 - RNA, 16 nt, Bordetella pertussis
gcccuugaugccgucg

SEQ ID NO: 2430627 - RNA, 16 nt, Bordetella pertussis
gcccuugauggccucg

SEQ ID NO: 2430628 - RNA, 17 nt, Bordetella pertussis
gcccuugauggccucgg

SEQ ID NO: 2430629 - RNA, 21 nt, Bordetella pertussis
gcccuugauggccucggcggc

SEQ ID NO: 2430630 - RNA, 19 nt, Bordetella pertussis
gcccuugccagggccuggc

SEQ ID NO: 2430631 - RNA, 21 nt, Bordetella pertussis
gcccuugccagggccuggcac

SEQ ID NO: 2430632 - RNA, 17 nt, Bordetella pertussis
gcccuugcgcgaacggc

SEQ ID NO: 2430633 - RNA, 21 nt, Bordetella pertussis
gcccuugcgcgaaggccgccc

SEQ ID NO: 2430634 - RNA, 14 nt, Bordetella pertussis
gcccuugcggcgag

SEQ ID NO: 2430635 - RNA, 12 nt, Bordetella pertussis
gcccuuggcggc

SEQ ID NO: 2430636 - RNA, 13 nt, Bordetella pertussis
gcccuuggcggcc

SEQ ID NO: 2430637 - RNA, 14 nt, Bordetella pertussis
gcccuuggcggccu

SEQ ID NO: 2430638 - RNA, 15 nt, Bordetella pertussis
gcccuuggcggccuu

SEQ ID NO: 2430639 - RNA, 13 nt, Bordetella pertussis
gcccuugggggcc

SEQ ID NO: 2430640 - RNA, 15 nt, Bordetella pertussis
gcccuugugcguugg

SEQ ID NO: 2430641 - RNA, 15 nt, Bordetella pertussis
gcccuugugcugcca

SEQ ID NO: 2430642 - RNA, 23 nt, Bordetella pertussis
gcccuugugcugccaugccgcgc

SEQ ID NO: 2430643 - RNA, 17 nt, Bordetella pertussis
gcccuuguggccgccga

SEQ ID NO: 2430644 - RNA, 19 nt, Bordetella pertussis
gcccuuguggccgccgaac

SEQ ID NO: 2430645 - RNA, 22 nt, Bordetella pertussis
gcccuuguggccgccgaacggc

SEQ ID NO: 2430646 - RNA, 18 nt, Bordetella pertussis
gcccuuugcauugcggcu

SEQ ID NO: 2430647 - RNA, 15 nt, Bordetella pertussis
gccgaccggcgcgcg

SEQ ID NO: 2430648 - RNA, 16 nt, Bordetella pertussis
gccgaccgggccgacc

SEQ ID NO: 2430649 - RNA, 19 nt, Bordetella pertussis
gccgaccgggccgaccagg

SEQ ID NO: 2430650 - RNA, 21 nt, Bordetella pertussis
gccgaccgggccgaccaggcc

SEQ ID NO: 2430651 - RNA, 23 nt, Bordetella pertussis
gccgaccgggccgaccaggccgg

SEQ ID NO: 2430652 - RNA, 12 nt, Bordetella pertussis
gccgaccuccag

SEQ ID NO: 2430653 - RNA, 15 nt, Bordetella pertussis
gccgaccuccaggcc

SEQ ID NO: 2430654 - RNA, 16 nt, Bordetella pertussis
gccgaccuccaggccc

SEQ ID NO: 2430655 - RNA, 17 nt, Bordetella pertussis
gccgaccuccaggccca

SEQ ID NO: 2430656 - RNA, 20 nt, Bordetella pertussis
gccgaccuccaggcccaggc

SEQ ID NO: 2430657 - RNA, 23 nt, Bordetella pertussis
gccgaccucuucguugucgcgcg

SEQ ID NO: 2430658 - RNA, 14 nt, Bordetella pertussis
gccgaccuggcgcc

SEQ ID NO: 2430659 - RNA, 19 nt, Bordetella pertussis
gccgaccuggcgcccgacg

SEQ ID NO: 2430660 - RNA, 17 nt, Bordetella pertussis
gccgacgaaagcggcaa

SEQ ID NO: 2430661 - RNA, 16 nt, Bordetella pertussis
gccgacgaggcgcugu

SEQ ID NO: 2430662 - RNA, 18 nt, Bordetella pertussis
gccgacgaugaccaucac

SEQ ID NO: 2430663 - RNA, 15 nt, Bordetella pertussis
gccgacgaugccgcc

SEQ ID NO: 2430664 - RNA, 18 nt, Bordetella pertussis
gccgacgaugccgccgcc

SEQ ID NO: 2430665 - RNA, 23 nt, Bordetella pertussis
gccgacgaugccggucuccagcg

SEQ ID NO: 2430666 - RNA, 14 nt, Bordetella pertussis
gccgacgaugucgc

SEQ ID NO: 2430667 - RNA, 17 nt, Bordetella pertussis
gccgacgaugucgccgc

SEQ ID NO: 2430668 - RNA, 21 nt, Bordetella pertussis
gccgacgaugucgccgccgcg

SEQ ID NO: 2430669 - RNA, 13 nt, Bordetella pertussis
gccgacgccgcca

SEQ ID NO: 2430670 - RNA, 15 nt, Bordetella pertussis
gccgacgcgccgggc

SEQ ID NO: 2430671 - RNA, 16 nt, Bordetella pertussis
gccgacgcgccgggcc

SEQ ID NO: 2430672 - RNA, 17 nt, Bordetella pertussis
gccgacgcgccgggcca

SEQ ID NO: 2430673 - RNA, 20 nt, Bordetella pertussis
gccgacgcgccgggccacga

SEQ ID NO: 2430674 - RNA, 22 nt, Bordetella pertussis
gccgacgcgccgggccacgagc

SEQ ID NO: 2430675 - RNA, 13 nt, Bordetella pertussis
gccgacgcgcugg

SEQ ID NO: 2430676 - RNA, 14 nt, Bordetella pertussis
gccgacgcgcuggc

SEQ ID NO: 2430677 - RNA, 15 nt, Bordetella pertussis
gccgacgcgcugguc

SEQ ID NO: 2430678 - RNA, 22 nt, Bordetella pertussis
gccgacgcgcugguccgccgcc

SEQ ID NO: 2430679 - RNA, 23 nt, Bordetella pertussis
gccgacgcgcugguccgccgccg

SEQ ID NO: 2430680 - RNA, 16 nt, Bordetella pertussis
gccgacgcgcuguccg

SEQ ID NO: 2430681 - RNA, 12 nt, Bordetella pertussis
gccgacgcucca

SEQ ID NO: 2430682 - RNA, 14 nt, Bordetella pertussis
gccgacgcuccaga

SEQ ID NO: 2430683 - RNA, 18 nt, Bordetella pertussis
gccgacggcaagaucgcc

SEQ ID NO: 2430684 - RNA, 21 nt, Bordetella pertussis
gccgacggcaagaucgccggc

SEQ ID NO: 2430685 - RNA, 22 nt, Bordetella pertussis
gccgacggcaagaucgccggcu

SEQ ID NO: 2430686 - RNA, 14 nt, Bordetella pertussis
gccgacggcauggc

SEQ ID NO: 2430687 - RNA, 17 nt, Bordetella pertussis
gccgacggcauggccgg

SEQ ID NO: 2430688 - RNA, 20 nt, Bordetella pertussis
gccgacggcauggccggcag

SEQ ID NO: 2430689 - RNA, 19 nt, Bordetella pertussis
gccgacggcauggcggcca

SEQ ID NO: 2430690 - RNA, 13 nt, Bordetella pertussis
gccgacggccucg

SEQ ID NO: 2430691 - RNA, 16 nt, Bordetella pertussis
gccgacggccucggcc

SEQ ID NO: 2430692 - RNA, 13 nt, Bordetella pertussis
gccgacggcgccc

SEQ ID NO: 2430693 - RNA, 16 nt, Bordetella pertussis
gccgacggcgcccugc

SEQ ID NO: 2430694 - RNA, 21 nt, Bordetella pertussis
gccgacggcggcgcggcgcca

SEQ ID NO: 2430695 - RNA, 19 nt, Bordetella pertussis
gccgacggcucgcgcucgc

SEQ ID NO: 2430696 - RNA, 15 nt, Bordetella pertussis
gccgacgggccgguc

SEQ ID NO: 2430697 - RNA, 16 nt, Bordetella pertussis
gccgacgggcggcugc

SEQ ID NO: 2430698 - RNA, 22 nt, Bordetella pertussis
gccgacggggugccuguccccg

SEQ ID NO: 2430699 - RNA, 17 nt, Bordetella pertussis
gccgacguagucgcgcc

SEQ ID NO: 2430700 - RNA, 18 nt, Bordetella pertussis
gccgacguagucgcgcca

SEQ ID NO: 2430701 - RNA, 17 nt, Bordetella pertussis
gccgacguggaccgcgc

SEQ ID NO: 2430702 - RNA, 19 nt, Bordetella pertussis
gccgacguggaccgcgcgg

SEQ ID NO: 2430703 - RNA, 21 nt, Bordetella pertussis
gccgacucgaaacgggcggcg

SEQ ID NO: 2430704 - RNA, 22 nt, Bordetella pertussis
gccgacugcuguacgacagcaa

SEQ ID NO: 2430705 - RNA, 15 nt, Bordetella pertussis
gccgacuggaugaag

SEQ ID NO: 2430706 - RNA, 22 nt, Bordetella pertussis
gccgacugggcuugccggugcu

SEQ ID NO: 2430707 - RNA, 18 nt, Bordetella pertussis
gccgacugggugcgccug

SEQ ID NO: 2430708 - RNA, 19 nt, Bordetella pertussis
gccgacuuccugggugcgc

SEQ ID NO: 2430709 - RNA, 23 nt, Bordetella pertussis
gccgacuuccugggugcgccaau

SEQ ID NO: 2430710 - RNA, 19 nt, Bordetella pertussis
gccgagaaauccagcgcgc

SEQ ID NO: 2430711 - RNA, 21 nt, Bordetella pertussis
gccgagaagauuucccagagc

SEQ ID NO: 2430712 - RNA, 14 nt, Bordetella pertussis
gccgagacggccgc

SEQ ID NO: 2430713 - RNA, 15 nt, Bordetella pertussis
gccgagaugccguuc

SEQ ID NO: 2430714 - RNA, 19 nt, Bordetella pertussis
gccgagauggacgcguucu

SEQ ID NO: 2430715 - RNA, 21 nt, Bordetella pertussis
gccgagaugugcggcguggcg

SEQ ID NO: 2430716 - RNA, 22 nt, Bordetella pertussis
gccgagaugugcggcguggcgg

SEQ ID NO: 2430717 - RNA, 18 nt, Bordetella pertussis
gccgagcagaucgccaac

SEQ ID NO: 2430718 - RNA, 13 nt, Bordetella pertussis
gccgagcagaugc

SEQ ID NO: 2430719 - RNA, 14 nt, Bordetella pertussis
gccgagcccgcguc

SEQ ID NO: 2430720 - RNA, 15 nt, Bordetella pertussis
gccgagcccgcgucg

SEQ ID NO: 2430721 - RNA, 22 nt, Bordetella pertussis
gccgagcccgcgucggcgcggu

SEQ ID NO: 2430722 - RNA, 22 nt, Bordetella pertussis
gccgagccgccccggcgcggcg

SEQ ID NO: 2430723 - RNA, 23 nt, Bordetella pertussis
gccgagccgccccggcgcggcgc

SEQ ID NO: 2430724 - RNA, 13 nt, Bordetella pertussis
gccgagccgcugu

SEQ ID NO: 2430725 - RNA, 15 nt, Bordetella pertussis
gccgagccgcugucg

SEQ ID NO: 2430726 - RNA, 16 nt, Bordetella pertussis
gccgagccgcugucgc

SEQ ID NO: 2430727 - RNA, 21 nt, Bordetella pertussis
gccgagccgcugucgcaggcg

SEQ ID NO: 2430728 - RNA, 13 nt, Bordetella pertussis
gccgagccuggcg

SEQ ID NO: 2430729 - RNA, 14 nt, Bordetella pertussis
gccgagccuggcgu

SEQ ID NO: 2430730 - RNA, 19 nt, Bordetella pertussis
gccgagccuggcguagggc

SEQ ID NO: 2430731 - RNA, 18 nt, Bordetella pertussis
gccgagcgcaccccggcc

SEQ ID NO: 2430732 - RNA, 14 nt, Bordetella pertussis
gccgagcgcgccag

SEQ ID NO: 2430733 - RNA, 15 nt, Bordetella pertussis
gccgagcgcgccagc

SEQ ID NO: 2430734 - RNA, 17 nt, Bordetella pertussis
gccgagcgcgccagcac

SEQ ID NO: 2430735 - RNA, 18 nt, Bordetella pertussis
gccgagcgcugcgccaac

SEQ ID NO: 2430736 - RNA, 21 nt, Bordetella pertussis
gccgagcggcaucugcaguuu

SEQ ID NO: 2430737 - RNA, 16 nt, Bordetella pertussis
gccgagcgggccagcg

SEQ ID NO: 2430738 - RNA, 17 nt, Bordetella pertussis
gccgagcgggccagcgc

SEQ ID NO: 2430739 - RNA, 17 nt, Bordetella pertussis
gccgagcggggccgcgc

SEQ ID NO: 2430740 - RNA, 14 nt, Bordetella pertussis
gccgagcgugccgg

SEQ ID NO: 2430741 - RNA, 15 nt, Bordetella pertussis
gccgagcgugccggg

SEQ ID NO: 2430742 - RNA, 23 nt, Bordetella pertussis
gccgagcgugccgggaugcugcu

SEQ ID NO: 2430743 - RNA, 13 nt, Bordetella pertussis
gccgaggaucagc

SEQ ID NO: 2430744 - RNA, 20 nt, Bordetella pertussis
gccgaggaucuggccggcgc

SEQ ID NO: 2430745 - RNA, 23 nt, Bordetella pertussis
gccgaggaucuggccggcgcugg

SEQ ID NO: 2430746 - RNA, 15 nt, Bordetella pertussis
gccgaggccagcgug

SEQ ID NO: 2430747 - RNA, 14 nt, Bordetella pertussis
gccgaggccagguu

SEQ ID NO: 2430748 - RNA, 13 nt, Bordetella pertussis
gccgaggcgccgc

SEQ ID NO: 2430749 - RNA, 15 nt, Bordetella pertussis
gccgaggcgccgccg

SEQ ID NO: 2430750 - RNA, 16 nt, Bordetella pertussis
gccgaggcgccgccgu

SEQ ID NO: 2430751 - RNA, 18 nt, Bordetella pertussis
gccgaggcggugggcagg

SEQ ID NO: 2430752 - RNA, 20 nt, Bordetella pertussis
gccgaggcggugggcagggc

SEQ ID NO: 2430753 - RNA, 22 nt, Bordetella pertussis
gccgaggcggugggcagggcgg

SEQ ID NO: 2430754 - RNA, 12 nt, Bordetella pertussis
gccgaggcugcg

SEQ ID NO: 2430755 - RNA, 13 nt, Bordetella pertussis
gccgaggcugcgc

SEQ ID NO: 2430756 - RNA, 16 nt, Bordetella pertussis
gccgaggcugcgcgcg

SEQ ID NO: 2430757 - RNA, 17 nt, Bordetella pertussis
gccgaggcugcgcgcgc

SEQ ID NO: 2430758 - RNA, 20 nt, Bordetella pertussis
gccgaggcuucgauggcggc

SEQ ID NO: 2430759 - RNA, 21 nt, Bordetella pertussis
gccgaggcuucgauggcggcg

SEQ ID NO: 2430760 - RNA, 16 nt, Bordetella pertussis
gccgaugcgguaggcc

SEQ ID NO: 2430761 - RNA, 21 nt, Bordetella pertussis
gccgaugcgguaggcccagca

SEQ ID NO: 2430762 - RNA, 15 nt, Bordetella pertussis
gccgaugcguccgcc

SEQ ID NO: 2430763 - RNA, 19 nt, Bordetella pertussis
gccgaugcguccgccgugc

SEQ ID NO: 2430764 - RNA, 20 nt, Bordetella pertussis
gccgaugcguccgccgugca

SEQ ID NO: 2430765 - RNA, 12 nt, Bordetella pertussis
gccgaugcuggu

SEQ ID NO: 2430766 - RNA, 19 nt, Bordetella pertussis
gccgaugcuuagcgcagca

SEQ ID NO: 2430767 - RNA, 22 nt, Bordetella pertussis
gccgaugcuuagcgcagcagcg

SEQ ID NO: 2430768 - RNA, 19 nt, Bordetella pertussis
gccgauggcaucgccccgg

SEQ ID NO: 2430769 - RNA, 23 nt, Bordetella pertussis
gccgauggcauggggcaggcgca

SEQ ID NO: 2430770 - RNA, 24 nt, Bordetella pertussis
gccgauggcauggggcaggcgcag

SEQ ID NO: 2430771 - RNA, 16 nt, Bordetella pertussis
gccgauggccucgcug

SEQ ID NO: 2430772 - RNA, 21 nt, Bordetella pertussis
gccgauggccucgcugccagg

SEQ ID NO: 2430773 - RNA, 22 nt, Bordetella pertussis
gccgauggccucgcugccaggg

SEQ ID NO: 2430774 - RNA, 21 nt, Bordetella pertussis
gccgauggcgccaccuucgcc

SEQ ID NO: 2430775 - RNA, 14 nt, Bordetella pertussis
gccgauggcgccgc

SEQ ID NO: 2430776 - RNA, 15 nt, Bordetella pertussis
gccgauggcgccgcu

SEQ ID NO: 2430777 - RNA, 19 nt, Bordetella pertussis
gccgauggcgccgcugucg

SEQ ID NO: 2430778 - RNA, 17 nt, Bordetella pertussis
gccgauggcgcgcggcu

SEQ ID NO: 2430779 - RNA, 18 nt, Bordetella pertussis
gccgauggcgcgcggcug

SEQ ID NO: 2430780 - RNA, 20 nt, Bordetella pertussis
gccgauggcgcgcggcuggg

SEQ ID NO: 2430781 - RNA, 17 nt, Bordetella pertussis
gccgauggcgcggccgc

SEQ ID NO: 2430782 - RNA, 19 nt, Bordetella pertussis
gccgauggcgcggccgcca

SEQ ID NO: 2430783 - RNA, 13 nt, Bordetella pertussis
gccgauggcggug

SEQ ID NO: 2430784 - RNA, 16 nt, Bordetella pertussis
gccgauggcguccagc

SEQ ID NO: 2430785 - RNA, 23 nt, Bordetella pertussis
gccgauggcguccagcagcagga

SEQ ID NO: 2430786 - RNA, 20 nt, Bordetella pertussis
gccgauggucagcgugucgc

SEQ ID NO: 2430787 - RNA, 23 nt, Bordetella pertussis
gccgauguaugacuugaccgcau

SEQ ID NO: 2430788 - RNA, 22 nt, Bordetella pertussis
gccgauguccacgaaggcgccg

SEQ ID NO: 2430789 - RNA, 23 nt, Bordetella pertussis
gccgauguccacgaaggcgccga

SEQ ID NO: 2430790 - RNA, 16 nt, Bordetella pertussis
gccgaugucgaacagc

SEQ ID NO: 2430791 - RNA, 22 nt, Bordetella pertussis
gccgaugucgaacagcugcagc

SEQ ID NO: 2430792 - RNA, 22 nt, Bordetella pertussis
gccgaugucgaccauguccgcg

SEQ ID NO: 2430793 - RNA, 15 nt, Bordetella pertussis
gccgaugucgccgcc

SEQ ID NO: 2430794 - RNA, 16 nt, Bordetella pertussis
gccgaugucgccgccu

SEQ ID NO: 2430795 - RNA, 17 nt, Bordetella pertussis
gccgaugucgccgccug

SEQ ID NO: 2430796 - RNA, 18 nt, Bordetella pertussis
gccgauguugaacagcug

SEQ ID NO: 2430797 - RNA, 20 nt, Bordetella pertussis
gccgauguuguuggccgcca

SEQ ID NO: 2430798 - RNA, 13 nt, Bordetella pertussis
gccgauuccagcg

SEQ ID NO: 2430799 - RNA, 14 nt, Bordetella pertussis
gccgauucgaccug

SEQ ID NO: 2430800 - RNA, 18 nt, Bordetella pertussis
gccgauucgaccugcuug

SEQ ID NO: 2430801 - RNA, 14 nt, Bordetella pertussis
gccgauugaggcca

SEQ ID NO: 2430802 - RNA, 19 nt, Bordetella pertussis
gccgauugaggccagcacg

SEQ ID NO: 2430803 - RNA, 21 nt, Bordetella pertussis
gccgauugaggccagcacgcc

SEQ ID NO: 2430804 - RNA, 21 nt, Bordetella pertussis
gccgauugugcaugacggcca

SEQ ID NO: 2430805 - RNA, 23 nt, Bordetella pertussis
gccgauugugcaugacggccagg

SEQ ID NO: 2430806 - RNA, 15 nt, Bordetella pertussis
gccgauuucgccgcc

SEQ ID NO: 2430807 - RNA, 17 nt, Bordetella pertussis
gccgauuucgccgccgc

SEQ ID NO: 2430808 - RNA, 23 nt, Bordetella pertussis
gccgauuucgccgccgccaucgu

SEQ ID NO: 2430809 - RNA, 16 nt, Bordetella pertussis
gccgauuucgcgcgcc

SEQ ID NO: 2430810 - RNA, 20 nt, Bordetella pertussis
gccgauuucgcgcgccagcg

SEQ ID NO: 2430811 - RNA, 16 nt, Bordetella pertussis
gccgauuucggccgcc

SEQ ID NO: 2430812 - RNA, 19 nt, Bordetella pertussis
gccgauuucggccgccggc

SEQ ID NO: 2430813 - RNA, 22 nt, Bordetella pertussis
gccgauuucggccgccggcgag

SEQ ID NO: 2430814 - RNA, 22 nt, Bordetella pertussis
gccgcaaaucaaugaaaaagcc

SEQ ID NO: 2430815 - RNA, 14 nt, Bordetella pertussis
gccgcaacaggcag

SEQ ID NO: 2430816 - RNA, 21 nt, Bordetella pertussis
gccgcaacaggcagcugcgcg

SEQ ID NO: 2430817 - RNA, 17 nt, Bordetella pertussis
gccgcaaccagggagcc

SEQ ID NO: 2430818 - RNA, 15 nt, Bordetella pertussis
gccgcaacccacccc

SEQ ID NO: 2430819 - RNA, 20 nt, Bordetella pertussis
gccgcaacccacccccagca

SEQ ID NO: 2430820 - RNA, 22 nt, Bordetella pertussis
gccgcaacccacccccagcagc

SEQ ID NO: 2430821 - RNA, 23 nt, Bordetella pertussis
gccgcaacccgcuuuuuccugcu

SEQ ID NO: 2430822 - RNA, 14 nt, Bordetella pertussis
gccgcaacgccggg

SEQ ID NO: 2430823 - RNA, 15 nt, Bordetella pertussis
gccgcaacgccgggc

SEQ ID NO: 2430824 - RNA, 20 nt, Bordetella pertussis
gccgcaagcaagccccaggc

SEQ ID NO: 2430825 - RNA, 22 nt, Bordetella pertussis
gccgcaagcguacguaccaggc

SEQ ID NO: 2430826 - RNA, 14 nt, Bordetella pertussis
gccgcaagcuggcg

SEQ ID NO: 2430827 - RNA, 15 nt, Bordetella pertussis
gccgcaagcuggcgg

SEQ ID NO: 2430828 - RNA, 16 nt, Bordetella pertussis
gccgcaagcuggcggc

SEQ ID NO: 2430829 - RNA, 19 nt, Bordetella pertussis
gccgcaagcuggcggcgcg

SEQ ID NO: 2430830 - RNA, 20 nt, Bordetella pertussis
gccgcaagcuggcggcgcgc

SEQ ID NO: 2430831 - RNA, 23 nt, Bordetella pertussis
gccgcaaucgaugaagaucaggc

SEQ ID NO: 2430832 - RNA, 17 nt, Bordetella pertussis
gccgcacaucgucgacg

SEQ ID NO: 2430833 - RNA, 12 nt, Bordetella pertussis
gccgcaccagcg

SEQ ID NO: 2430834 - RNA, 18 nt, Bordetella pertussis
gccgcaccagcgcauugc

SEQ ID NO: 2430835 - RNA, 16 nt, Bordetella pertussis
gccgcaccagcggcga

SEQ ID NO: 2430836 - RNA, 13 nt, Bordetella pertussis
gccgcaccaggcc

SEQ ID NO: 2430837 - RNA, 14 nt, Bordetella pertussis
gccgcaccaggccg

SEQ ID NO: 2430838 - RNA, 15 nt, Bordetella pertussis
gccgcaccaggccgc

SEQ ID NO: 2430839 - RNA, 17 nt, Bordetella pertussis
gccgcaccaggccgcgg

SEQ ID NO: 2430840 - RNA, 20 nt, Bordetella pertussis
gccgcaccaggccgcggcgc

SEQ ID NO: 2430841 - RNA, 16 nt, Bordetella pertussis
gccgcacccgaugacg

SEQ ID NO: 2430842 - RNA, 15 nt, Bordetella pertussis
gccgcacgaucgcgc

SEQ ID NO: 2430843 - RNA, 18 nt, Bordetella pertussis
gccgcacgaucgcgccgg

SEQ ID NO: 2430844 - RNA, 19 nt, Bordetella pertussis
gccgcacgaucgcgccggc

SEQ ID NO: 2430845 - RNA, 16 nt, Bordetella pertussis
gccgcacgcccgccug

SEQ ID NO: 2430846 - RNA, 21 nt, Bordetella pertussis
gccgcacgccggucgccagcg

SEQ ID NO: 2430847 - RNA, 12 nt, Bordetella pertussis
gccgcacgcgcg

SEQ ID NO: 2430848 - RNA, 14 nt, Bordetella pertussis
gccgcacgcgcggc

SEQ ID NO: 2430849 - RNA, 13 nt, Bordetella pertussis
gccgcacgcggcc

SEQ ID NO: 2430850 - RNA, 15 nt, Bordetella pertussis
gccgcacgcggccgc

SEQ ID NO: 2430851 - RNA, 22 nt, Bordetella pertussis
gccgcacgcucuacacggccgc

SEQ ID NO: 2430852 - RNA, 24 nt, Bordetella pertussis
gccgcacgcucuacacggccgcca

SEQ ID NO: 2430853 - RNA, 14 nt, Bordetella pertussis
gccgcacgggcgcc

SEQ ID NO: 2430854 - RNA, 15 nt, Bordetella pertussis
gccgcacgguggcgc

SEQ ID NO: 2430855 - RNA, 17 nt, Bordetella pertussis
gccgcacgguggcgccg

SEQ ID NO: 2430856 - RNA, 23 nt, Bordetella pertussis
gccgcacugaucuuucagcgcga

SEQ ID NO: 2430857 - RNA, 14 nt, Bordetella pertussis
gccgcacuggguga

SEQ ID NO: 2430858 - RNA, 17 nt, Bordetella pertussis
gccgcacugggugacgc

SEQ ID NO: 2430859 - RNA, 20 nt, Bordetella pertussis
gccgcacugggugacgcugg

SEQ ID NO: 2430860 - RNA, 21 nt, Bordetella pertussis
gccgcacugggugacgcugga

SEQ ID NO: 2430861 - RNA, 22 nt, Bordetella pertussis
gccgcacugggugacgcuggag

SEQ ID NO: 2430862 - RNA, 16 nt, Bordetella pertussis
gccgcacuucgggcca

SEQ ID NO: 2430863 - RNA, 15 nt, Bordetella pertussis
gccgcagaacagcag

SEQ ID NO: 2430864 - RNA, 17 nt, Bordetella pertussis
gccgcagaacagcagcg

SEQ ID NO: 2430865 - RNA, 21 nt, Bordetella pertussis
gccgcagaacagcagcgugau

SEQ ID NO: 2430866 - RNA, 17 nt, Bordetella pertussis
gccgcagauggccagca

SEQ ID NO: 2430867 - RNA, 16 nt, Bordetella pertussis
gccgcagauggcguag

SEQ ID NO: 2430868 - RNA, 23 nt, Bordetella pertussis
gccgcagauggcguaggcggccu

SEQ ID NO: 2430869 - RNA, 20 nt, Bordetella pertussis
gccgcagaugucaguccuca

SEQ ID NO: 2430870 - RNA, 17 nt, Bordetella pertussis
gccgcagauuuccagcg

SEQ ID NO: 2430871 - RNA, 23 nt, Bordetella pertussis
gccgcagcaauugccccagcacg

SEQ ID NO: 2430872 - RNA, 16 nt, Bordetella pertussis
gccgccagcaccugcu

SEQ ID NO: 2430873 - RNA, 18 nt, Bordetella pertussis
gccgccagcaccugcuug

SEQ ID NO: 2430874 - RNA, 15 nt, Bordetella pertussis
gccgccagcacgcca

SEQ ID NO: 2430875 - RNA, 12 nt, Bordetella pertussis
gccgccagcagc

SEQ ID NO: 2430876 - RNA, 14 nt, Bordetella pertussis
gccgccagcagcgc

SEQ ID NO: 2430877 - RNA, 16 nt, Bordetella pertussis
gccgccagcauggcgg

SEQ ID NO: 2430878 - RNA, 18 nt, Bordetella pertussis
gccgccagcauggcggcc

SEQ ID NO: 2430879 - RNA, 21 nt, Bordetella pertussis
gccgccagcauggcggccagg

SEQ ID NO: 2430880 - RNA, 22 nt, Bordetella pertussis
gccgccagcauggcggccaggc

SEQ ID NO: 2430881 - RNA, 18 nt, Bordetella pertussis
gccgccagcauggcgucg

SEQ ID NO: 2430882 - RNA, 16 nt, Bordetella pertussis
gccgccagccaccccg

SEQ ID NO: 2430883 - RNA, 15 nt, Bordetella pertussis
gccgccagcccgagg

SEQ ID NO: 2430884 - RNA, 16 nt, Bordetella pertussis
gccgccagccgcuggc

SEQ ID NO: 2430885 - RNA, 17 nt, Bordetella pertussis
gccgccagccgcuggcg

SEQ ID NO: 2430886 - RNA, 13 nt, Bordetella pertussis
gccgccagccggc

SEQ ID NO: 2430887 - RNA, 18 nt, Bordetella pertussis
gccgccagccggcccagc

SEQ ID NO: 2430888 - RNA, 14 nt, Bordetella pertussis
gccgccagcgccau

SEQ ID NO: 2430889 - RNA, 22 nt, Bordetella pertussis
gccgccagcgccuggaccugga

SEQ ID NO: 2430890 - RNA, 13 nt, Bordetella pertussis
gccgccagcgcgc

SEQ ID NO: 2430891 - RNA, 15 nt, Bordetella pertussis
gccgccagcgcgccg

SEQ ID NO: 2430892 - RNA, 18 nt, Bordetella pertussis
gccgccagcgcgccgccc

SEQ ID NO: 2430893 - RNA, 15 nt, Bordetella pertussis
gccgccagcgcgcgc

SEQ ID NO: 2430894 - RNA, 12 nt, Bordetella pertussis
gccgccagcggc

SEQ ID NO: 2430895 - RNA, 13 nt, Bordetella pertussis
gccgccagcggcu

SEQ ID NO: 2430896 - RNA, 16 nt, Bordetella pertussis
gccgccagcggcuggc

SEQ ID NO: 2430897 - RNA, 13 nt, Bordetella pertussis
gccgccagcggga

SEQ ID NO: 2430898 - RNA, 13 nt, Bordetella pertussis
gccgccaggacuu

SEQ ID NO: 2430899 - RNA, 22 nt, Bordetella pertussis
gccgccaggacuucgucgauca

SEQ ID NO: 2430900 - RNA, 15 nt, Bordetella pertussis
gccgccaggcauuga

SEQ ID NO: 2430901 - RNA, 17 nt, Bordetella pertussis
gccgccagggccgagcc

SEQ ID NO: 2430902 - RNA, 23 nt, Bordetella pertussis
gccgccagguagcggguggccga

SEQ ID NO: 2430903 - RNA, 14 nt, Bordetella pertussis
gccgccaggucggc

SEQ ID NO: 2430904 - RNA, 20 nt, Bordetella pertussis
gccgccaggucggccaccgc

SEQ ID NO: 2430905 - RNA, 15 nt, Bordetella pertussis
gccgccauaggcgcg

SEQ ID NO: 2430906 - RNA, 16 nt, Bordetella pertussis
gccgccauaggcgcgc

SEQ ID NO: 2430907 - RNA, 17 nt, Bordetella pertussis
gccgccauaggcgcgca

SEQ ID NO: 2430908 - RNA, 20 nt, Bordetella pertussis
gccgccauaggcgcgcacca

SEQ ID NO: 2430909 - RNA, 14 nt, Bordetella pertussis
gccgccaucauccu

SEQ ID NO: 2430910 - RNA, 20 nt, Bordetella pertussis
gccgccaucauccuggucga

SEQ ID NO: 2430911 - RNA, 13 nt, Bordetella pertussis
gccgccaugcagc

SEQ ID NO: 2430912 - RNA, 16 nt, Bordetella pertussis
gccgccaugcagcugg

SEQ ID NO: 2430913 - RNA, 17 nt, Bordetella pertussis
gccgccaugcgccagca

SEQ ID NO: 2430914 - RNA, 20 nt, Bordetella pertussis
gccgccaugcgccagcagga

SEQ ID NO: 2430915 - RNA, 16 nt, Bordetella pertussis
gccgccauggcgcugg

SEQ ID NO: 2430916 - RNA, 18 nt, Bordetella pertussis
gccgccauggcgcuggca

SEQ ID NO: 2430917 - RNA, 14 nt, Bordetella pertussis
gccgccauggcggc

SEQ ID NO: 2430918 - RNA, 19 nt, Bordetella pertussis
gccgccauggcggcgccca

SEQ ID NO: 2430919 - RNA, 16 nt, Bordetella pertussis
gccgccauggucgcga

SEQ ID NO: 2430920 - RNA, 21 nt, Bordetella pertussis
gccgccauggucgcgaccacc

SEQ ID NO: 2430921 - RNA, 13 nt, Bordetella pertussis
gccgccauggugc

SEQ ID NO: 2430922 - RNA, 22 nt, Bordetella pertussis
gccgccauggugccgcgcaggc

SEQ ID NO: 2430923 - RNA, 21 nt, Bordetella pertussis
gccgccauguauaacguggcg

SEQ ID NO: 2430924 - RNA, 23 nt, Bordetella pertussis
gccgccauguauaacguggcgcg

SEQ ID NO: 2430925 - RNA, 12 nt, Bordetella pertussis
gccgcccaccgu

SEQ ID NO: 2430926 - RNA, 22 nt, Bordetella pertussis
gccgcccacgccauggacgccg

SEQ ID NO: 2430927 - RNA, 20 nt, Bordetella pertussis
gccgcccacgccgccuggcc

SEQ ID NO: 2430928 - RNA, 16 nt, Bordetella pertussis
gccgcccacgccgcug

SEQ ID NO: 2430929 - RNA, 23 nt, Bordetella pertussis
gccgcccacgccgcugucgaccu

SEQ ID NO: 2430930 - RNA, 16 nt, Bordetella pertussis
gccgcccacgggcgcc

SEQ ID NO: 2430931 - RNA, 13 nt, Bordetella pertussis
gccgcccacugcc

SEQ ID NO: 2430932 - RNA, 17 nt, Bordetella pertussis
gccgcccacugccaggc

SEQ ID NO: 2430933 - RNA, 21 nt, Bordetella pertussis
gccgcccacugccaggcgagc

SEQ ID NO: 2430934 - RNA, 22 nt, Bordetella pertussis
gccgcccacugccaggcgagcg

SEQ ID NO: 2430935 - RNA, 14 nt, Bordetella pertussis
gccgcccagcaccu

SEQ ID NO: 2430936 - RNA, 23 nt, Bordetella pertussis
gccgcccagcaccuuggcauuga

SEQ ID NO: 2430937 - RNA, 13 nt, Bordetella pertussis
gccgcccagcaug

SEQ ID NO: 2430938 - RNA, 20 nt, Bordetella pertussis
gccgcccagcaugcgcgcga

SEQ ID NO: 2430939 - RNA, 23 nt, Bordetella pertussis
gccgcccagcauuucgcgugcgu

SEQ ID NO: 2430940 - RNA, 12 nt, Bordetella pertussis
gccgcccagccg

SEQ ID NO: 2430941 - RNA, 14 nt, Bordetella pertussis
gccgcccagccggc

SEQ ID NO: 2430942 - RNA, 16 nt, Bordetella pertussis
gccgcccagccggccg

SEQ ID NO: 2430943 - RNA, 13 nt, Bordetella pertussis
gccgcccagcgcc

SEQ ID NO: 2430944 - RNA, 14 nt, Bordetella pertussis
gccgcccagcgccu

SEQ ID NO: 2430945 - RNA, 14 nt, Bordetella pertussis
gccgcccagcgcgu

SEQ ID NO: 2430946 - RNA, 21 nt, Bordetella pertussis
gccgcccagcgcgugggccag

SEQ ID NO: 2430947 - RNA, 23 nt, Bordetella pertussis
gccgcccagcgcgugggccagca

SEQ ID NO: 2430948 - RNA, 13 nt, Bordetella pertussis
gccgcccaggagc

SEQ ID NO: 2430949 - RNA, 20 nt, Bordetella pertussis
gccgcccaggagcaacuggg

SEQ ID NO: 2430950 - RNA, 13 nt, Bordetella pertussis
gccgcccaggcgc

SEQ ID NO: 2430951 - RNA, 16 nt, Bordetella pertussis
gccgcccaggcgcagc

SEQ ID NO: 2430952 - RNA, 17 nt, Bordetella pertussis
gccgcccaggcgcagcc

SEQ ID NO: 2430953 - RNA, 19 nt, Bordetella pertussis
gccgcccaggcgcagccgc

SEQ ID NO: 2430954 - RNA, 23 nt, Bordetella pertussis
gccgcccaggucggacgcgccgg

SEQ ID NO: 2430955 - RNA, 23 nt, Bordetella pertussis
gccgcccagucguccagcacgcg

SEQ ID NO: 2430956 - RNA, 15 nt, Bordetella pertussis
gccgcccaugccgcc

SEQ ID NO: 2430957 - RNA, 16 nt, Bordetella pertussis
gccgcccaugccgccc

SEQ ID NO: 2430958 - RNA, 20 nt, Bordetella pertussis
gccgcccaugccgccgggca

SEQ ID NO: 2430959 - RNA, 20 nt, Bordetella pertussis
gccgcccaugcgcauggcca

SEQ ID NO: 2430960 - RNA, 23 nt, Bordetella pertussis
gccgcccaugcgcauggccagca

SEQ ID NO: 2430961 - RNA, 15 nt, Bordetella pertussis
gccgccccaacggcc

SEQ ID NO: 2430962 - RNA, 16 nt, Bordetella pertussis
gccgccccaacggccu

SEQ ID NO: 2430963 - RNA, 11 nt, Bordetella pertussis
gccgccccagc

SEQ ID NO: 2430964 - RNA, 14 nt, Bordetella pertussis
gccgccccagcagc

SEQ ID NO: 2430965 - RNA, 16 nt, Bordetella pertussis
gccgccccagcagcag

SEQ ID NO: 2430966 - RNA, 17 nt, Bordetella pertussis
gccgccccagcagcagc

SEQ ID NO: 2430967 - RNA, 18 nt, Bordetella pertussis
gccgccccagcagcagcg

SEQ ID NO: 2430968 - RNA, 12 nt, Bordetella pertussis
gccgccccaggc

SEQ ID NO: 2430969 - RNA, 24 nt, Bordetella pertussis
gccgccccaguugcgcguccaggc

SEQ ID NO: 2430970 - RNA, 16 nt, Bordetella pertussis
gccgcccccagcgcgc

SEQ ID NO: 2430971 - RNA, 15 nt, Bordetella pertussis
gccgcccccgcccag

SEQ ID NO: 2430972 - RNA, 17 nt, Bordetella pertussis
gccgcccccgcccagca

SEQ ID NO: 2430973 - RNA, 20 nt, Bordetella pertussis
gccgccccggcgcggcgcgc

SEQ ID NO: 2430974 - RNA, 21 nt, Bordetella pertussis
gccgcccgaauccagggccac

SEQ ID NO: 2430975 - RNA, 23 nt, Bordetella pertussis
gccgcccgaauccagggccacgc

SEQ ID NO: 2430976 - RNA, 17 nt, Bordetella pertussis
gccgcccgagcuggccg

SEQ ID NO: 2430977 - RNA, 14 nt, Bordetella pertussis
gccgcccgcaagga

SEQ ID NO: 2430978 - RNA, 17 nt, Bordetella pertussis
gccgcccgcacgaagcg

SEQ ID NO: 2430979 - RNA, 18 nt, Bordetella pertussis
gccgcccgcacgaagcgg

SEQ ID NO: 2430980 - RNA, 13 nt, Bordetella pertussis
gccgcccgcaggc

SEQ ID NO: 2430981 - RNA, 20 nt, Bordetella pertussis
gccgcccgcaggcauugcgc

SEQ ID NO: 2430982 - RNA, 14 nt, Bordetella pertussis
gccgcccgcaugca

SEQ ID NO: 2430983 - RNA, 14 nt, Bordetella pertussis
gccgcccgccaggc

SEQ ID NO: 2430984 - RNA, 15 nt, Bordetella pertussis
gccgcccgccaggcc

SEQ ID NO: 2430985 - RNA, 19 nt, Bordetella pertussis
gccgcccgccccggcgcau

SEQ ID NO: 2430986 - RNA, 13 nt, Bordetella pertussis
gccgccgcggccu

SEQ ID NO: 2430987 - RNA, 18 nt, Bordetella pertussis
gccgccgcggccucggcc

SEQ ID NO: 2430988 - RNA, 17 nt, Bordetella pertussis
gccgccgcggccuggcc

SEQ ID NO: 2430989 - RNA, 18 nt, Bordetella pertussis
gccgccgcggccuggccg

SEQ ID NO: 2430990 - RNA, 17 nt, Bordetella pertussis
gccgccgcgggcgccgc

SEQ ID NO: 2430991 - RNA, 23 nt, Bordetella pertussis
gccgccgcguggcggcgcagcgc

SEQ ID NO: 2430992 - RNA, 16 nt, Bordetella pertussis
gccgccgcucgucccc

SEQ ID NO: 2430993 - RNA, 13 nt, Bordetella pertussis
gccgccgcugccg

SEQ ID NO: 2430994 - RNA, 14 nt, Bordetella pertussis
gccgccgcugucgg

SEQ ID NO: 2430995 - RNA, 20 nt, Bordetella pertussis
gccgccgcugucggucagca

SEQ ID NO: 2430996 - RNA, 14 nt, Bordetella pertussis
gccgccggacgcag

SEQ ID NO: 2430997 - RNA, 15 nt, Bordetella pertussis
gccgccggacggcgc

SEQ ID NO: 2430998 - RNA, 16 nt, Bordetella pertussis
gccgccggacggcgcc

SEQ ID NO: 2430999 - RNA, 18 nt, Bordetella pertussis
gccgccggacggcgccuu

SEQ ID NO: 2431000 - RNA, 12 nt, Bordetella pertussis
gccgccggcacg

SEQ ID NO: 2431001 - RNA, 18 nt, Bordetella pertussis
gccgccggcagggccagc

SEQ ID NO: 2431002 - RNA, 19 nt, Bordetella pertussis
gccgccggcagggccagcg

SEQ ID NO: 2431003 - RNA, 11 nt, Bordetella pertussis
gccgccggcca

SEQ ID NO: 2431004 - RNA, 14 nt, Bordetella pertussis
gccgccggccacca

SEQ ID NO: 2431005 - RNA, 17 nt, Bordetella pertussis
gccgccggccaccagcg

SEQ ID NO: 2431006 - RNA, 23 nt, Bordetella pertussis
gccgccggccaccagcggcgccg

SEQ ID NO: 2431007 - RNA, 12 nt, Bordetella pertussis
gccgccggccag

SEQ ID NO: 2431008 - RNA, 15 nt, Bordetella pertussis
gccgccggccagccu

SEQ ID NO: 2431009 - RNA, 16 nt, Bordetella pertussis
gccgccggccagcgcc

SEQ ID NO: 2431010 - RNA, 17 nt, Bordetella pertussis
gccgccggccagcgcca

SEQ ID NO: 2431011 - RNA, 18 nt, Bordetella pertussis
gccgccggccagcgccag

SEQ ID NO: 2431012 - RNA, 17 nt, Bordetella pertussis
gccgccggccagcgcgg

SEQ ID NO: 2431013 - RNA, 19 nt, Bordetella pertussis
gccgccggccagcgcggca

SEQ ID NO: 2431014 - RNA, 14 nt, Bordetella pertussis
gccgccggccagcu

SEQ ID NO: 2431015 - RNA, 14 nt, Bordetella pertussis
gccgccggccauca

SEQ ID NO: 2431016 - RNA, 14 nt, Bordetella pertussis
gccgccggcccgga

SEQ ID NO: 2431017 - RNA, 11 nt, Bordetella pertussis
gccgccggccu

SEQ ID NO: 2431018 - RNA, 22 nt, Bordetella pertussis
gccgccggccucuucgucgccg

SEQ ID NO: 2431019 - RNA, 13 nt, Bordetella pertussis
gccgccggccugc

SEQ ID NO: 2431020 - RNA, 14 nt, Bordetella pertussis
gccgccggccugcu

SEQ ID NO: 2431021 - RNA, 21 nt, Bordetella pertussis
gccgccggccugcucgccggc

SEQ ID NO: 2431022 - RNA, 15 nt, Bordetella pertussis
gccgccggccugcug

SEQ ID NO: 2431023 - RNA, 16 nt, Bordetella pertussis
gccgccggccugcugc

SEQ ID NO: 2431024 - RNA, 20 nt, Bordetella pertussis
gccgccggcgaugaucgccu

SEQ ID NO: 2431025 - RNA, 14 nt, Bordetella pertussis
gccgccggcgcacc

SEQ ID NO: 2431026 - RNA, 15 nt, Bordetella pertussis
gccgccggcgcaccc

SEQ ID NO: 2431027 - RNA, 16 nt, Bordetella pertussis
gccgccggcgcacccg

SEQ ID NO: 2431028 - RNA, 17 nt, Bordetella pertussis
gccgccggcgcacccgg

SEQ ID NO: 2431029 - RNA, 12 nt, Bordetella pertussis
gccgccggcgcg

SEQ ID NO: 2431030 - RNA, 15 nt, Bordetella pertussis
gccgccggcgcgcgg

SEQ ID NO: 2431031 - RNA, 17 nt, Bordetella pertussis
gccgccggcgcgcggau

SEQ ID NO: 2431032 - RNA, 13 nt, Bordetella pertussis
gccgccggcgcgg

SEQ ID NO: 2431033 - RNA, 16 nt, Bordetella pertussis
gccgccggcgcggcug

SEQ ID NO: 2431034 - RNA, 17 nt, Bordetella pertussis
gccgccggcgcgguggc

SEQ ID NO: 2431035 - RNA, 20 nt, Bordetella pertussis
gccgccggcgcguugcggau

SEQ ID NO: 2431036 - RNA, 23 nt, Bordetella pertussis
gccgccggcggauuugcucgcgu

SEQ ID NO: 2431037 - RNA, 14 nt, Bordetella pertussis
gccgccggcggccu

SEQ ID NO: 2431038 - RNA, 15 nt, Bordetella pertussis
gccgccggcggccug

SEQ ID NO: 2431039 - RNA, 17 nt, Bordetella pertussis
gccgccggcggccugga

SEQ ID NO: 2431040 - RNA, 20 nt, Bordetella pertussis
gccgccggcggccuggaccu

SEQ ID NO: 2431041 - RNA, 21 nt, Bordetella pertussis
gccgccggcggccuggaccug

SEQ ID NO: 2431042 - RNA, 13 nt, Bordetella pertussis
gccgccggcggcg

SEQ ID NO: 2431043 - RNA, 15 nt, Bordetella pertussis
gccgccggcggcgcc

SEQ ID NO: 2431044 - RNA, 20 nt, Bordetella pertussis
gccgccggcggcgucggcgc

SEQ ID NO: 2431045 - RNA, 22 nt, Bordetella pertussis
gccgccggcggcgucggcgccc

SEQ ID NO: 2431046 - RNA, 13 nt, Bordetella pertussis
gccgccggcgggc

SEQ ID NO: 2431047 - RNA, 14 nt, Bordetella pertussis
gccgccggcgucgc

SEQ ID NO: 2431048 - RNA, 13 nt, Bordetella pertussis
gccgccggcgugc

SEQ ID NO: 2431049 - RNA, 22 nt, Bordetella pertussis
gccgccgggcauugccggagca

SEQ ID NO: 2431050 - RNA, 23 nt, Bordetella pertussis
gccgccgggcauugccggagcag

SEQ ID NO: 2431051 - RNA, 20 nt, Bordetella pertussis
gccgccgggccgcgaccacg

SEQ ID NO: 2431052 - RNA, 14 nt, Bordetella pertussis
gccgccgggcgcgc

SEQ ID NO: 2431053 - RNA, 17 nt, Bordetella pertussis
gccgccgggcgcgcgcc

SEQ ID NO: 2431054 - RNA, 20 nt, Bordetella pertussis
gccgccgggcgcgcgccggc

SEQ ID NO: 2431055 - RNA, 14 nt, Bordetella pertussis
gccgccgggcugga

SEQ ID NO: 2431056 - RNA, 13 nt, Bordetella pertussis
gccgccgggucgc

SEQ ID NO: 2431057 - RNA, 18 nt, Bordetella pertussis
gccgccgggucgcugugc

SEQ ID NO: 2431058 - RNA, 19 nt, Bordetella pertussis
gccgccgggucgcugugcg

SEQ ID NO: 2431059 - RNA, 17 nt, Bordetella pertussis
gccgccggucaccgccg

SEQ ID NO: 2431060 - RNA, 23 nt, Bordetella pertussis
gccgccggucacugccgaaacgc

SEQ ID NO: 2431061 - RNA, 23 nt, Bordetella pertussis
gccgccggugauaugcgccaggc

SEQ ID NO: 2431062 - RNA, 19 nt, Bordetella pertussis
gccgccggugcaccaggcc

SEQ ID NO: 2431063 - RNA, 20 nt, Bordetella pertussis
gccgccggugcaccaggcca

SEQ ID NO: 2431064 - RNA, 15 nt, Bordetella pertussis
gccgccguaaucggc

SEQ ID NO: 2431065 - RNA, 19 nt, Bordetella pertussis
gccgccguaaucggcgucg

SEQ ID NO: 2431066 - RNA, 18 nt, Bordetella pertussis
gccgccguacgaguggcc

SEQ ID NO: 2431067 - RNA, 20 nt, Bordetella pertussis
gccgccguacgaguggccgu

SEQ ID NO: 2431068 - RNA, 19 nt, Bordetella pertussis
gccgccguagccgcugcgc

SEQ ID NO: 2431069 - RNA, 20 nt, Bordetella pertussis
gccgccguagccgcugcgcg

SEQ ID NO: 2431070 - RNA, 20 nt, Bordetella pertussis
gccgccgucaacgcccaggu

SEQ ID NO: 2431071 - RNA, 22 nt, Bordetella pertussis
gccgccgugacuucggccgcca

SEQ ID NO: 2431072 - RNA, 18 nt, Bordetella pertussis
gccgccgugaugccgccc

SEQ ID NO: 2431073 - RNA, 19 nt, Bordetella pertussis
gccgccgugcgagcacggc

SEQ ID NO: 2431074 - RNA, 24 nt, Bordetella pertussis
gccgccgugcgagcacggcguggc

SEQ ID NO: 2431075 - RNA, 17 nt, Bordetella pertussis
gccgccgugcgcgggcg

SEQ ID NO: 2431076 - RNA, 18 nt, Bordetella pertussis
gccgccgugcgcgggcgc

SEQ ID NO: 2431077 - RNA, 19 nt, Bordetella pertussis
gccgccgugcgcgggcgcg

SEQ ID NO: 2431078 - RNA, 19 nt, Bordetella pertussis
gccgccguuuucgcccgcc

SEQ ID NO: 2431079 - RNA, 22 nt, Bordetella pertussis
gccgccguuuucgcccgcccac

SEQ ID NO: 2431080 - RNA, 17 nt, Bordetella pertussis
gccgccuaccagguggg

SEQ ID NO: 2431081 - RNA, 20 nt, Bordetella pertussis
gccgccuauguaggcgccgc

SEQ ID NO: 2431082 - RNA, 21 nt, Bordetella pertussis
gccgccuauguaggcgccgcg

SEQ ID NO: 2431083 - RNA, 23 nt, Bordetella pertussis
gccgccuauguaggcgccgcgcc

SEQ ID NO: 2431084 - RNA, 15 nt, Bordetella pertussis
gccgccucaccgcgc

SEQ ID NO: 2431085 - RNA, 12 nt, Bordetella pertussis
gccgccucagcc

SEQ ID NO: 2431086 - RNA, 15 nt, Bordetella pertussis
gccgccucaggccgg

SEQ ID NO: 2431087 - RNA, 16 nt, Bordetella pertussis
gccgccucaggccggc

SEQ ID NO: 2431088 - RNA, 13 nt, Bordetella pertussis
gccgccuccaggc

SEQ ID NO: 2431089 - RNA, 19 nt, Bordetella pertussis
gccgccucgauugaccagc

SEQ ID NO: 2431090 - RNA, 20 nt, Bordetella pertussis
gccgccucgauugaccagca

SEQ ID NO: 2431091 - RNA, 23 nt, Bordetella pertussis
gccgccucgauugaccagcacca

SEQ ID NO: 2431092 - RNA, 14 nt, Bordetella pertussis
gccgccucggcggc

SEQ ID NO: 2431093 - RNA, 15 nt, Bordetella pertussis
gccgccucggcggcc

SEQ ID NO: 2431094 - RNA, 16 nt, Bordetella pertussis
gccgccucggcggcca

SEQ ID NO: 2431095 - RNA, 19 nt, Bordetella pertussis
gccgccucggcggccagcg

SEQ ID NO: 2431096 - RNA, 14 nt, Bordetella pertussis
gccgccucgggcac

SEQ ID NO: 2431097 - RNA, 22 nt, Bordetella pertussis
gccgccucgggcacggccagca

SEQ ID NO: 2431098 - RNA, 18 nt, Bordetella pertussis
gccgccugagcacaugcc

SEQ ID NO: 2431099 - RNA, 19 nt, Bordetella pertussis
gccgcgcccagcgcggccu

SEQ ID NO: 2431100 - RNA, 16 nt, Bordetella pertussis
gccgcgcccagguccu

SEQ ID NO: 2431101 - RNA, 15 nt, Bordetella pertussis
gccgcgcccaugcgc

SEQ ID NO: 2431102 - RNA, 22 nt, Bordetella pertussis
gccgcgcccaugcgcuggcgca

SEQ ID NO: 2431103 - RNA, 18 nt, Bordetella pertussis
gccgcgccccuagcgccg

SEQ ID NO: 2431104 - RNA, 20 nt, Bordetella pertussis
gccgcgccccuagcgccgcg

SEQ ID NO: 2431105 - RNA, 21 nt, Bordetella pertussis
gccgcgccccuagcgccgcgc

SEQ ID NO: 2431106 - RNA, 22 nt, Bordetella pertussis
gccgcgccccuagcgccgcgcc

SEQ ID NO: 2431107 - RNA, 15 nt, Bordetella pertussis
gccgcgcccgcaacg

SEQ ID NO: 2431108 - RNA, 14 nt, Bordetella pertussis
gccgcgcccgcccc

SEQ ID NO: 2431109 - RNA, 16 nt, Bordetella pertussis
gccgcgcccgccgcgc

SEQ ID NO: 2431110 - RNA, 21 nt, Bordetella pertussis
gccgcgcccgccgcgccaugc

SEQ ID NO: 2431111 - RNA, 14 nt, Bordetella pertussis
gccgcgcccgccuu

SEQ ID NO: 2431112 - RNA, 15 nt, Bordetella pertussis
gccgcgcccgcuugc

SEQ ID NO: 2431113 - RNA, 16 nt, Bordetella pertussis
gccgcgcccgcuugcg

SEQ ID NO: 2431114 - RNA, 22 nt, Bordetella pertussis
gccgcgcccgcuugcggccggc

SEQ ID NO: 2431115 - RNA, 23 nt, Bordetella pertussis
gccgcgcccgcuugcggccggcg

SEQ ID NO: 2431116 - RNA, 21 nt, Bordetella pertussis
gccgcgcccggaucaguccgg

SEQ ID NO: 2431117 - RNA, 23 nt, Bordetella pertussis
gccgcgcccggaucaguccgggc

SEQ ID NO: 2431118 - RNA, 13 nt, Bordetella pertussis
gccgcgcccggcc

SEQ ID NO: 2431119 - RNA, 16 nt, Bordetella pertussis
gccgcgcccggccggc

SEQ ID NO: 2431120 - RNA, 17 nt, Bordetella pertussis
gccgcgcccggccggcc

SEQ ID NO: 2431121 - RNA, 15 nt, Bordetella pertussis
gccgcgcccggcggc

SEQ ID NO: 2431122 - RNA, 16 nt, Bordetella pertussis
gccgcgcccggcggcc

SEQ ID NO: 2431123 - RNA, 17 nt, Bordetella pertussis
gccgcgcccggcggcca

SEQ ID NO: 2431124 - RNA, 16 nt, Bordetella pertussis
gccgcgcccguccacg

SEQ ID NO: 2431125 - RNA, 12 nt, Bordetella pertussis
gccgcgcccugg

SEQ ID NO: 2431126 - RNA, 15 nt, Bordetella pertussis
gccgcgcccuggcgc

SEQ ID NO: 2431127 - RNA, 16 nt, Bordetella pertussis
gccgcgcccuggcgcg

SEQ ID NO: 2431128 - RNA, 22 nt, Bordetella pertussis
gccgcgcccuggcgcggcggcg

SEQ ID NO: 2431129 - RNA, 17 nt, Bordetella pertussis
gccgcgccgaacgcgca

SEQ ID NO: 2431130 - RNA, 14 nt, Bordetella pertussis
gccgcgccgaaggc

SEQ ID NO: 2431131 - RNA, 16 nt, Bordetella pertussis
gccgcgccgaccggcc

SEQ ID NO: 2431132 - RNA, 10 nt, Bordetella pertussis
gccgcgccgc

SEQ ID NO: 2431133 - RNA, 12 nt, Bordetella pertussis
gccgcgccgccc

SEQ ID NO: 2431134 - RNA, 13 nt, Bordetella pertussis
gccgcgccgcccc

SEQ ID NO: 2431135 - RNA, 19 nt, Bordetella pertussis
gccgcgccgcccccgccca

SEQ ID NO: 2431136 - RNA, 18 nt, Bordetella pertussis
gccgcgccgcccgcggcc

SEQ ID NO: 2431137 - RNA, 14 nt, Bordetella pertussis
gccgcgccgccgcc

SEQ ID NO: 2431138 - RNA, 16 nt, Bordetella pertussis
gccgcgccgccgcccu

SEQ ID NO: 2431139 - RNA, 18 nt, Bordetella pertussis
gccgcgccgccgcccugg

SEQ ID NO: 2431140 - RNA, 21 nt, Bordetella pertussis
gccgcgccgccgcccuggccg

SEQ ID NO: 2431141 - RNA, 18 nt, Bordetella pertussis
gccgcgccgccgccuggc

SEQ ID NO: 2431142 - RNA, 17 nt, Bordetella pertussis
gccgcgccgcgccgguc

SEQ ID NO: 2431143 - RNA, 12 nt, Bordetella pertussis
gccgcgccgcgg

SEQ ID NO: 2431144 - RNA, 13 nt, Bordetella pertussis
gccgcgccgcggc

SEQ ID NO: 2431145 - RNA, 14 nt, Bordetella pertussis
gccgcgccgcggca

SEQ ID NO: 2431146 - RNA, 16 nt, Bordetella pertussis
gccgcgccgcggcacg

SEQ ID NO: 2431147 - RNA, 17 nt, Bordetella pertussis
gccgcgccgcggcacgg

SEQ ID NO: 2431148 - RNA, 22 nt, Bordetella pertussis
gccgcgccgcggcacggggcau

SEQ ID NO: 2431149 - RNA, 13 nt, Bordetella pertussis
gccgcgccgcugg

SEQ ID NO: 2431150 - RNA, 14 nt, Bordetella pertussis
gccgcgccgcuggc

SEQ ID NO: 2431151 - RNA, 15 nt, Bordetella pertussis
gccgcgccgcuggcg

SEQ ID NO: 2431152 - RNA, 16 nt, Bordetella pertussis
gccgcgccgcuggcgg

SEQ ID NO: 2431153 - RNA, 16 nt, Bordetella pertussis
gccgcgccgcuggcgu

SEQ ID NO: 2431154 - RNA, 18 nt, Bordetella pertussis
gccgcgccgcuggcgucc

SEQ ID NO: 2431155 - RNA, 15 nt, Bordetella pertussis
gccgcgccggaucgu

SEQ ID NO: 2431156 - RNA, 13 nt, Bordetella pertussis
gccgcgccggcgc

SEQ ID NO: 2431157 - RNA, 18 nt, Bordetella pertussis
gccgcgccggcgcgcgau

SEQ ID NO: 2431158 - RNA, 21 nt, Bordetella pertussis
gccgcgccgggcgcgccggcg

SEQ ID NO: 2431159 - RNA, 18 nt, Bordetella pertussis
gccgcgccggggcggcgc

SEQ ID NO: 2431160 - RNA, 16 nt, Bordetella pertussis
gccgcgccggucgccg

SEQ ID NO: 2431161 - RNA, 13 nt, Bordetella pertussis
gccgcgccggugg

SEQ ID NO: 2431162 - RNA, 13 nt, Bordetella pertussis
gccgcgccguucg

SEQ ID NO: 2431163 - RNA, 21 nt, Bordetella pertussis
gccgcgccguucucaggccga

SEQ ID NO: 2431164 - RNA, 23 nt, Bordetella pertussis
gccgcgccuauaucgacggcgcc

SEQ ID NO: 2431165 - RNA, 20 nt, Bordetella pertussis
gccgcgccucggacgccugg

SEQ ID NO: 2431166 - RNA, 13 nt, Bordetella pertussis
gccgcgccugcag

SEQ ID NO: 2431167 - RNA, 18 nt, Bordetella pertussis
gccgcgccugcagcagcg

SEQ ID NO: 2431168 - RNA, 22 nt, Bordetella pertussis
gccgcgccugcagcagcggcag

SEQ ID NO: 2431169 - RNA, 16 nt, Bordetella pertussis
gccgcgccuugcccgu

SEQ ID NO: 2431170 - RNA, 14 nt, Bordetella pertussis
gccgcgcgacagcc

SEQ ID NO: 2431171 - RNA, 18 nt, Bordetella pertussis
gccgcgcgacagccgcgc

SEQ ID NO: 2431172 - RNA, 21 nt, Bordetella pertussis
gccgcgcgacagccgcgccag

SEQ ID NO: 2431173 - RNA, 15 nt, Bordetella pertussis
gccgcgcgauccggc

SEQ ID NO: 2431174 - RNA, 18 nt, Bordetella pertussis
gccgcgcgauccuggggc

SEQ ID NO: 2431175 - RNA, 20 nt, Bordetella pertussis
gccgcgcgaucgccgcaugg

SEQ ID NO: 2431176 - RNA, 14 nt, Bordetella pertussis
gccgcgcgaugcgc

SEQ ID NO: 2431177 - RNA, 15 nt, Bordetella pertussis
gccgcgcgaugcgcg

SEQ ID NO: 2431178 - RNA, 18 nt, Bordetella pertussis
gccgcgcgaugcgcggcc

SEQ ID NO: 2431179 - RNA, 19 nt, Bordetella pertussis
gccgcgcgaugcgcggccc

SEQ ID NO: 2431180 - RNA, 14 nt, Bordetella pertussis
gccgcgcgcagcga

SEQ ID NO: 2431181 - RNA, 12 nt, Bordetella pertussis
gccgcgcgcagg

SEQ ID NO: 2431182 - RNA, 14 nt, Bordetella pertussis
gccgcgcgcagggc

SEQ ID NO: 2431183 - RNA, 20 nt, Bordetella pertussis
gccgcgcgcaucacgcuggc

SEQ ID NO: 2431184 - RNA, 14 nt, Bordetella pertussis
gccgcgcgcaucca

SEQ ID NO: 2431185 - RNA, 21 nt, Bordetella pertussis
gccgcgcgcaugcgccuuacu

SEQ ID NO: 2431186 - RNA, 12 nt, Bordetella pertussis
gccgcgcgccau

SEQ ID NO: 2431187 - RNA, 21 nt, Bordetella pertussis
gccgcgcgccauccggcgcau

SEQ ID NO: 2431188 - RNA, 15 nt, Bordetella pertussis
gccgcgcgccgcgcc

SEQ ID NO: 2431189 - RNA, 19 nt, Bordetella pertussis
gccgcgcgccgcgccuucg

SEQ ID NO: 2431190 - RNA, 17 nt, Bordetella pertussis
gccgcgcgccggcgccg

SEQ ID NO: 2431191 - RNA, 16 nt, Bordetella pertussis
gccgcgcgccugcucg

SEQ ID NO: 2431192 - RNA, 15 nt, Bordetella pertussis
gccgcgcgccuuacu

SEQ ID NO: 2431193 - RNA, 19 nt, Bordetella pertussis
gccgcgcgcgcagacgcgc

SEQ ID NO: 2431194 - RNA, 17 nt, Bordetella pertussis
gccgcgcgcgccaggcc

SEQ ID NO: 2431195 - RNA, 15 nt, Bordetella pertussis
gccgcgcgcgccaug

SEQ ID NO: 2431196 - RNA, 13 nt, Bordetella pertussis
gccgcgcgcggca

SEQ ID NO: 2431197 - RNA, 14 nt, Bordetella pertussis
gccgcgcgcggccc

SEQ ID NO: 2431198 - RNA, 16 nt, Bordetella pertussis
gccgcgcgcggccccg

SEQ ID NO: 2431199 - RNA, 18 nt, Bordetella pertussis
gccgcgcgcggccccggc

SEQ ID NO: 2431200 - RNA, 14 nt, Bordetella pertussis
gccgcgcgcggccg

SEQ ID NO: 2431201 - RNA, 17 nt, Bordetella pertussis
gccgcgcgcggccggca

SEQ ID NO: 2431202 - RNA, 18 nt, Bordetella pertussis
gccgcgcgcggccggcac

SEQ ID NO: 2431203 - RNA, 17 nt, Bordetella pertussis
gccgcgcgcggccggcg

SEQ ID NO: 2431204 - RNA, 19 nt, Bordetella pertussis
gccgcgcgcggccggcgcg

SEQ ID NO: 2431205 - RNA, 20 nt, Bordetella pertussis
gccgcgcgcggccggcgcgc

SEQ ID NO: 2431206 - RNA, 22 nt, Bordetella pertussis
gccgcgcgcggccggcgcgccg

SEQ ID NO: 2431207 - RNA, 13 nt, Bordetella pertussis
gccgcgcgcggcg

SEQ ID NO: 2431208 - RNA, 14 nt, Bordetella pertussis
gccgcgcgcggcgg

SEQ ID NO: 2431209 - RNA, 16 nt, Bordetella pertussis
gccgcgcgcgggcgcc

SEQ ID NO: 2431210 - RNA, 17 nt, Bordetella pertussis
gccgcgcgcgggcgccc

SEQ ID NO: 2431211 - RNA, 18 nt, Bordetella pertussis
gccgcgcgcgggcgcccg

SEQ ID NO: 2431212 - RNA, 21 nt, Bordetella pertussis
gccgcgcgcguauggcggcgc

SEQ ID NO: 2431213 - RNA, 20 nt, Bordetella pertussis
gccgcggcgguuucggccgg

SEQ ID NO: 2431214 - RNA, 22 nt, Bordetella pertussis
gccgcggcgguuucggccggga

SEQ ID NO: 2431215 - RNA, 16 nt, Bordetella pertussis
gccgcggcguccgcgc

SEQ ID NO: 2431216 - RNA, 20 nt, Bordetella pertussis
gccgcggcguugcggcagcg

SEQ ID NO: 2431217 - RNA, 14 nt, Bordetella pertussis
gccgcggcuugccg

SEQ ID NO: 2431218 - RNA, 23 nt, Bordetella pertussis
gccgcggcuugccgcggcgcggc

SEQ ID NO: 2431219 - RNA, 20 nt, Bordetella pertussis
gccgcgggauucugcugcau

SEQ ID NO: 2431220 - RNA, 24 nt, Bordetella pertussis
gccgcgggauucugcugcaugccg

SEQ ID NO: 2431221 - RNA, 19 nt, Bordetella pertussis
gccgcgggcaaagcccagc

SEQ ID NO: 2431222 - RNA, 22 nt, Bordetella pertussis
gccgcgggcaaagcccagcaag

SEQ ID NO: 2431223 - RNA, 16 nt, Bordetella pertussis
gccgcgggccgcuggu

SEQ ID NO: 2431224 - RNA, 17 nt, Bordetella pertussis
gccgcgggccgcugguc

SEQ ID NO: 2431225 - RNA, 18 nt, Bordetella pertussis
gccgcgggccugcucggc

SEQ ID NO: 2431226 - RNA, 14 nt, Bordetella pertussis
gccgcgggcgaagc

SEQ ID NO: 2431227 - RNA, 17 nt, Bordetella pertussis
gccgcgggcgaagcagu

SEQ ID NO: 2431228 - RNA, 12 nt, Bordetella pertussis
gccgcgggcgcc

SEQ ID NO: 2431229 - RNA, 15 nt, Bordetella pertussis
gccgcgggcgccgcg

SEQ ID NO: 2431230 - RNA, 20 nt, Bordetella pertussis
gccgcgggcggccacgcgcc

SEQ ID NO: 2431231 - RNA, 14 nt, Bordetella pertussis
gccgcgggcggcgc

SEQ ID NO: 2431232 - RNA, 19 nt, Bordetella pertussis
gccgcgggcggcgccggcc

SEQ ID NO: 2431233 - RNA, 20 nt, Bordetella pertussis
gccgcgggcggcgccggccg

SEQ ID NO: 2431234 - RNA, 15 nt, Bordetella pertussis
gccgcgggcggcgcg

SEQ ID NO: 2431235 - RNA, 16 nt, Bordetella pertussis
gccgcgggcggcgcgc

SEQ ID NO: 2431236 - RNA, 23 nt, Bordetella pertussis
gccgcgggcugcgacaggcgcag

SEQ ID NO: 2431237 - RNA, 14 nt, Bordetella pertussis
gccgcggggcuggc

SEQ ID NO: 2431238 - RNA, 15 nt, Bordetella pertussis
gccgcggggcuggcc

SEQ ID NO: 2431239 - RNA, 16 nt, Bordetella pertussis
gccgcggggcuggcca

SEQ ID NO: 2431240 - RNA, 17 nt, Bordetella pertussis
gccgcggggcuggccag

SEQ ID NO: 2431241 - RNA, 22 nt, Bordetella pertussis
gccgcggggcuggccagcuggc

SEQ ID NO: 2431242 - RNA, 17 nt, Bordetella pertussis
gccgcgggugucgcucc

SEQ ID NO: 2431243 - RNA, 14 nt, Bordetella pertussis
gccgcggucagcca

SEQ ID NO: 2431244 - RNA, 15 nt, Bordetella pertussis
gccgcgguggcgggc

SEQ ID NO: 2431245 - RNA, 22 nt, Bordetella pertussis
gccgcggugguccagauugcgc

SEQ ID NO: 2431246 - RNA, 15 nt, Bordetella pertussis
gccgcguacaacgcc

SEQ ID NO: 2431247 - RNA, 17 nt, Bordetella pertussis
gccgcguacaacgccgc

SEQ ID NO: 2431248 - RNA, 19 nt, Bordetella pertussis
gccgcguacaacgccgcgu

SEQ ID NO: 2431249 - RNA, 21 nt, Bordetella pertussis
gccgcguacaacgccgcgucc

SEQ ID NO: 2431250 - RNA, 18 nt, Bordetella pertussis
gccgcgucauacgacgcg

SEQ ID NO: 2431251 - RNA, 12 nt, Bordetella pertussis
gccgcguccagc

SEQ ID NO: 2431252 - RNA, 17 nt, Bordetella pertussis
gccgcguccagcgcgcg

SEQ ID NO: 2431253 - RNA, 19 nt, Bordetella pertussis
gccgcgucccgugccggcc

SEQ ID NO: 2431254 - RNA, 14 nt, Bordetella pertussis
gccgcguccgcccg

SEQ ID NO: 2431255 - RNA, 22 nt, Bordetella pertussis
gccgcguccgcccgcuccacca

SEQ ID NO: 2431256 - RNA, 12 nt, Bordetella pertussis
gccgcguccggc

SEQ ID NO: 2431257 - RNA, 17 nt, Bordetella pertussis
gccgcguccggcgcccg

SEQ ID NO: 2431258 - RNA, 18 nt, Bordetella pertussis
gccgcguccggcgcccgc

SEQ ID NO: 2431259 - RNA, 19 nt, Bordetella pertussis
gccgcguccggcgcccgcc

SEQ ID NO: 2431260 - RNA, 20 nt, Bordetella pertussis
gccgcguccggcgcccgccg

SEQ ID NO: 2431261 - RNA, 15 nt, Bordetella pertussis
gccgcguccucggcc

SEQ ID NO: 2431262 - RNA, 17 nt, Bordetella pertussis
gccgcguccucggccug

SEQ ID NO: 2431263 - RNA, 18 nt, Bordetella pertussis
gccgcgucgagcgcgacg

SEQ ID NO: 2431264 - RNA, 16 nt, Bordetella pertussis
gccgcgucgaucagcg

SEQ ID NO: 2431265 - RNA, 19 nt, Bordetella pertussis
gccgcgucgaucagcgcgg

SEQ ID NO: 2431266 - RNA, 23 nt, Bordetella pertussis
gccgcgucgaucagcgcgggcca

SEQ ID NO: 2431267 - RNA, 14 nt, Bordetella pertussis
gccgcgucgauccg

SEQ ID NO: 2431268 - RNA, 20 nt, Bordetella pertussis
gccgcgucgauccggcagca

SEQ ID NO: 2431269 - RNA, 21 nt, Bordetella pertussis
gccgcgucgauccggcagcag

SEQ ID NO: 2431270 - RNA, 13 nt, Bordetella pertussis
gccgcgucgcugg

SEQ ID NO: 2431271 - RNA, 16 nt, Bordetella pertussis
gccgcgucggccucau

SEQ ID NO: 2431272 - RNA, 20 nt, Bordetella pertussis
gccgcgucggccucaucgag

SEQ ID NO: 2431273 - RNA, 14 nt, Bordetella pertussis
gccgcgucggcgcc

SEQ ID NO: 2431274 - RNA, 15 nt, Bordetella pertussis
gccgcgucggcgccg

SEQ ID NO: 2431275 - RNA, 16 nt, Bordetella pertussis
gccgcgucggcgccga

SEQ ID NO: 2431276 - RNA, 19 nt, Bordetella pertussis
gccgcgucgguggccagcc

SEQ ID NO: 2431277 - RNA, 21 nt, Bordetella pertussis
gccgcgucgguggccagccag

SEQ ID NO: 2431278 - RNA, 17 nt, Bordetella pertussis
gccgcgucuucggcgcg

SEQ ID NO: 2431279 - RNA, 16 nt, Bordetella pertussis
gccgcgugcccgcguc

SEQ ID NO: 2431280 - RNA, 16 nt, Bordetella pertussis
gccgcgugcgccgggc

SEQ ID NO: 2431281 - RNA, 17 nt, Bordetella pertussis
gccgcgugcgccgggcu

SEQ ID NO: 2431282 - RNA, 15 nt, Bordetella pertussis
gccgcguggccgcgc

SEQ ID NO: 2431283 - RNA, 16 nt, Bordetella pertussis
gccgcguggccgcgcu

SEQ ID NO: 2431284 - RNA, 17 nt, Bordetella pertussis
gccgcguggccgcgcug

SEQ ID NO: 2431285 - RNA, 14 nt, Bordetella pertussis
gccgcguggcggcg

SEQ ID NO: 2431286 - RNA, 15 nt, Bordetella pertussis
gccgcguggcggcgc

SEQ ID NO: 2431287 - RNA, 17 nt, Bordetella pertussis
gccgcguggcggcgcag

SEQ ID NO: 2431288 - RNA, 19 nt, Bordetella pertussis
gccgcguggcggcgcagcg

SEQ ID NO: 2431289 - RNA, 20 nt, Bordetella pertussis
gccgcguggcggcgcagcgc

SEQ ID NO: 2431290 - RNA, 15 nt, Bordetella pertussis
gccgcgugguggcgc

SEQ ID NO: 2431291 - RNA, 16 nt, Bordetella pertussis
gccgcgugguggcgca

SEQ ID NO: 2431292 - RNA, 18 nt, Bordetella pertussis
gccgcgugguggcgcaga

SEQ ID NO: 2431293 - RNA, 22 nt, Bordetella pertussis
gccgcgugguggcgcagauggg

SEQ ID NO: 2431294 - RNA, 16 nt, Bordetella pertussis
gccgcguucacgccgg

SEQ ID NO: 2431295 - RNA, 17 nt, Bordetella pertussis
gccgcguucacgccggc

SEQ ID NO: 2431296 - RNA, 18 nt, Bordetella pertussis
gccgcguucacgccggcg

SEQ ID NO: 2431297 - RNA, 20 nt, Bordetella pertussis
gccgcguucacgccggcgcg

SEQ ID NO: 2431298 - RNA, 22 nt, Bordetella pertussis
gccgcguucacgccggcgcgcc

SEQ ID NO: 2431299 - RNA, 23 nt, Bordetella pertussis
gccgcguucacgccggcgcgccg

SEQ ID NO: 2431300 - RNA, 15 nt, Bordetella pertussis
gccgcguugcagcca

SEQ ID NO: 2431301 - RNA, 20 nt, Bordetella pertussis
gccgcguugcagccacaggc

SEQ ID NO: 2431302 - RNA, 23 nt, Bordetella pertussis
gccgcguugcagccacaggccca

SEQ ID NO: 2431303 - RNA, 14 nt, Bordetella pertussis
gccgcuacgcggcg

SEQ ID NO: 2431304 - RNA, 20 nt, Bordetella pertussis
gccgcuacgcggcgucagga

SEQ ID NO: 2431305 - RNA, 20 nt, Bordetella pertussis
gccgcuaggccuugccgccg

SEQ ID NO: 2431306 - RNA, 21 nt, Bordetella pertussis
gccgcuaggccuugccgccgc

SEQ ID NO: 2431307 - RNA, 18 nt, Bordetella pertussis
gccgcucaauucggccug

SEQ ID NO: 2431308 - RNA, 19 nt, Bordetella pertussis
gccgcucagcgcggcgcgg

SEQ ID NO: 2431309 - RNA, 22 nt, Bordetella pertussis
gccgcucagcgcggcgcggcca

SEQ ID NO: 2431310 - RNA, 15 nt, Bordetella pertussis
gccgcuccagagcgc

SEQ ID NO: 2431311 - RNA, 16 nt, Bordetella pertussis
gccgcuccagagcgcg

SEQ ID NO: 2431312 - RNA, 18 nt, Bordetella pertussis
gccgcuccagagcgcgca

SEQ ID NO: 2431313 - RNA, 20 nt, Bordetella pertussis
gccgcuccagagcgcgcaca

SEQ ID NO: 2431314 - RNA, 13 nt, Bordetella pertussis
gccgcuccagcca

SEQ ID NO: 2431315 - RNA, 18 nt, Bordetella pertussis
gccgcuccagccaccacu

SEQ ID NO: 2431316 - RNA, 23 nt, Bordetella pertussis
gccgcuccgccauggaggcgcag

SEQ ID NO: 2431317 - RNA, 14 nt, Bordetella pertussis
gccgcuccggcaug

SEQ ID NO: 2431318 - RNA, 16 nt, Bordetella pertussis
gccgcucgcgcgacca

SEQ ID NO: 2431319 - RNA, 17 nt, Bordetella pertussis
gccgcucgcgcgaccac

SEQ ID NO: 2431320 - RNA, 14 nt, Bordetella pertussis
gccgcucggccacg

SEQ ID NO: 2431321 - RNA, 15 nt, Bordetella pertussis
gccgcucggccacgc

SEQ ID NO: 2431322 - RNA, 18 nt, Bordetella pertussis
gccgcucggccacgcgcu

SEQ ID NO: 2431323 - RNA, 21 nt, Bordetella pertussis
gccgcucggccacgcgcugcu

SEQ ID NO: 2431324 - RNA, 20 nt, Bordetella pertussis
gccgcucguaguguuccugg

SEQ ID NO: 2431325 - RNA, 24 nt, Bordetella pertussis
gccggaaacgcggucaccgagcug

SEQ ID NO: 2431326 - RNA, 18 nt, Bordetella pertussis
gccggaaagcuguccacg

SEQ ID NO: 2431327 - RNA, 20 nt, Bordetella pertussis
gccggaaagcuguccacgcc

SEQ ID NO: 2431328 - RNA, 19 nt, Bordetella pertussis
gccggaaaucacgaucugg

SEQ ID NO: 2431329 - RNA, 19 nt, Bordetella pertussis
gccggaaaugccgcgcgca

SEQ ID NO: 2431330 - RNA, 21 nt, Bordetella pertussis
gccggaaaugccgcgcgcagg

SEQ ID NO: 2431331 - RNA, 18 nt, Bordetella pertussis
gccggaacagcguccagc

SEQ ID NO: 2431332 - RNA, 19 nt, Bordetella pertussis
gccggaacagcguccagcc

SEQ ID NO: 2431333 - RNA, 21 nt, Bordetella pertussis
gccggaacagcguccagccgc

SEQ ID NO: 2431334 - RNA, 16 nt, Bordetella pertussis
gccggaacaggcgccu

SEQ ID NO: 2431335 - RNA, 15 nt, Bordetella pertussis
gccggaauccuggcg

SEQ ID NO: 2431336 - RNA, 16 nt, Bordetella pertussis
gccggaauccuggcga

SEQ ID NO: 2431337 - RNA, 17 nt, Bordetella pertussis
gccggaauccuggcgac

SEQ ID NO: 2431338 - RNA, 14 nt, Bordetella pertussis
gccggacagcugcg

SEQ ID NO: 2431339 - RNA, 17 nt, Bordetella pertussis
gccggacagggccgcga

SEQ ID NO: 2431340 - RNA, 15 nt, Bordetella pertussis
gccggacaucagcca

SEQ ID NO: 2431341 - RNA, 15 nt, Bordetella pertussis
gccggacccgcgccg

SEQ ID NO: 2431342 - RNA, 16 nt, Bordetella pertussis
gccggacccgcgccgc

SEQ ID NO: 2431343 - RNA, 19 nt, Bordetella pertussis
gccggacccgcgccgcagg

SEQ ID NO: 2431344 - RNA, 21 nt, Bordetella pertussis
gccggacccgcgccgcaggcc

SEQ ID NO: 2431345 - RNA, 17 nt, Bordetella pertussis
gccggaccgcugugcgc

SEQ ID NO: 2431346 - RNA, 12 nt, Bordetella pertussis
gccggaccuggg

SEQ ID NO: 2431347 - RNA, 21 nt, Bordetella pertussis
gccggaccuugcgaggcccgg

SEQ ID NO: 2431348 - RNA, 14 nt, Bordetella pertussis
gccggacgccgacu

SEQ ID NO: 2431349 - RNA, 17 nt, Bordetella pertussis
gccggacgccgacuggg

SEQ ID NO: 2431350 - RNA, 18 nt, Bordetella pertussis
gccggacguagucgcacg

SEQ ID NO: 2431351 - RNA, 16 nt, Bordetella pertussis
gccggacgugggcgcc

SEQ ID NO: 2431352 - RNA, 14 nt, Bordetella pertussis
gccggacucgucca

SEQ ID NO: 2431353 - RNA, 18 nt, Bordetella pertussis
gccggacucguccauggu

SEQ ID NO: 2431354 - RNA, 19 nt, Bordetella pertussis
gccggacuggcgcgcacca

SEQ ID NO: 2431355 - RNA, 19 nt, Bordetella pertussis
gccggacugggcgucgcuc

SEQ ID NO: 2431356 - RNA, 20 nt, Bordetella pertussis
gccggacugggcgucgcucu

SEQ ID NO: 2431357 - RNA, 21 nt, Bordetella pertussis
gccggacuugaaucccgacga

SEQ ID NO: 2431358 - RNA, 15 nt, Bordetella pertussis
gccggagcagcagcg

SEQ ID NO: 2431359 - RNA, 14 nt, Bordetella pertussis
gccggagcagucgc

SEQ ID NO: 2431360 - RNA, 16 nt, Bordetella pertussis
gccggagcagucgcgc

SEQ ID NO: 2431361 - RNA, 17 nt, Bordetella pertussis
gccggagccagguaaua

SEQ ID NO: 2431362 - RNA, 13 nt, Bordetella pertussis
gccggaggcgcgc

SEQ ID NO: 2431363 - RNA, 15 nt, Bordetella pertussis
gccggaggcgcgcag

SEQ ID NO: 2431364 - RNA, 15 nt, Bordetella pertussis
gccggauccagcugc

SEQ ID NO: 2431365 - RNA, 15 nt, Bordetella pertussis
gccggaucggccggc

SEQ ID NO: 2431366 - RNA, 19 nt, Bordetella pertussis
gccggaucggccggcagcg

SEQ ID NO: 2431367 - RNA, 14 nt, Bordetella pertussis
gccggaugcgcagg

SEQ ID NO: 2431368 - RNA, 15 nt, Bordetella pertussis
gccggaugcgcagga

SEQ ID NO: 2431369 - RNA, 23 nt, Bordetella pertussis
gccggaugcgcaggacggcgccg

SEQ ID NO: 2431370 - RNA, 17 nt, Bordetella pertussis
gccggaugcgcguggcg

SEQ ID NO: 2431371 - RNA, 18 nt, Bordetella pertussis
gccggaugcgcguggcgc

SEQ ID NO: 2431372 - RNA, 15 nt, Bordetella pertussis
gccggauggccgggu

SEQ ID NO: 2431373 - RNA, 12 nt, Bordetella pertussis
gccggauggcgu

SEQ ID NO: 2431374 - RNA, 21 nt, Bordetella pertussis
gccggaugguagaugcgcgcg

SEQ ID NO: 2431375 - RNA, 24 nt, Bordetella pertussis
gccggaugguagaugcgcgcgacc

SEQ ID NO: 2431376 - RNA, 22 nt, Bordetella pertussis
gccggauugcuugacgccgccg

SEQ ID NO: 2431377 - RNA, 23 nt, Bordetella pertussis
gccggauugcuugacgccgccga

SEQ ID NO: 2431378 - RNA, 16 nt, Bordetella pertussis
gccggauuggcgcugc

SEQ ID NO: 2431379 - RNA, 14 nt, Bordetella pertussis
gccggcaaacccgg

SEQ ID NO: 2431380 - RNA, 17 nt, Bordetella pertussis
gccggcaagcacgaaca

SEQ ID NO: 2431381 - RNA, 18 nt, Bordetella pertussis
gccggcaagcacgaacag

SEQ ID NO: 2431382 - RNA, 15 nt, Bordetella pertussis
gccggcaaggggcca

SEQ ID NO: 2431383 - RNA, 17 nt, Bordetella pertussis
gccggcaaggggccagc

SEQ ID NO: 2431384 - RNA, 20 nt, Bordetella pertussis
gccggcaaggggccagccug

SEQ ID NO: 2431385 - RNA, 22 nt, Bordetella pertussis
gccggcaaggggccagccuggc

SEQ ID NO: 2431386 - RNA, 13 nt, Bordetella pertussis
gccggcaagguca

SEQ ID NO: 2431387 - RNA, 12 nt, Bordetella pertussis
gccggcaccacg

SEQ ID NO: 2431388 - RNA, 14 nt, Bordetella pertussis
gccggcaccacgac

SEQ ID NO: 2431389 - RNA, 18 nt, Bordetella pertussis
gccggcaccacgaccggc

SEQ ID NO: 2431390 - RNA, 20 nt, Bordetella pertussis
gccggcaccacgaccggcuc

SEQ ID NO: 2431391 - RNA, 22 nt, Bordetella pertussis
gccggcaccacgaccggcucgg

SEQ ID NO: 2431392 - RNA, 20 nt, Bordetella pertussis
gccggcaccagcgccacgcc

SEQ ID NO: 2431393 - RNA, 15 nt, Bordetella pertussis
gccggcaccaggauc

SEQ ID NO: 2431394 - RNA, 21 nt, Bordetella pertussis
gccggcaccaggauccccagc

SEQ ID NO: 2431395 - RNA, 13 nt, Bordetella pertussis
gccggcaccaucu

SEQ ID NO: 2431396 - RNA, 14 nt, Bordetella pertussis
gccggcaccaucug

SEQ ID NO: 2431397 - RNA, 15 nt, Bordetella pertussis
gccggcaccaucugc

SEQ ID NO: 2431398 - RNA, 19 nt, Bordetella pertussis
gccggcaccaucugcgucg

SEQ ID NO: 2431399 - RNA, 14 nt, Bordetella pertussis
gccggcacgcccag

SEQ ID NO: 2431400 - RNA, 18 nt, Bordetella pertussis
gccggcacgcccagccgc

SEQ ID NO: 2431401 - RNA, 22 nt, Bordetella pertussis
gccggcacgcccagccgcagca

SEQ ID NO: 2431402 - RNA, 14 nt, Bordetella pertussis
gccggcacgccugc

SEQ ID NO: 2431403 - RNA, 17 nt, Bordetella pertussis
gccggcacgccugccgc

SEQ ID NO: 2431404 - RNA, 19 nt, Bordetella pertussis
gccggcacgccugccgcgc

SEQ ID NO: 2431405 - RNA, 14 nt, Bordetella pertussis
gccggcacgcugac

SEQ ID NO: 2431406 - RNA, 17 nt, Bordetella pertussis
gccggcacgcugaucgc

SEQ ID NO: 2431407 - RNA, 18 nt, Bordetella pertussis
gccggcacgcugaucgcc

SEQ ID NO: 2431408 - RNA, 20 nt, Bordetella pertussis
gccggcacgcugaucgccgg

SEQ ID NO: 2431409 - RNA, 14 nt, Bordetella pertussis
gccggcacggccgg

SEQ ID NO: 2431410 - RNA, 17 nt, Bordetella pertussis
gccggcacggccggcca

SEQ ID NO: 2431411 - RNA, 18 nt, Bordetella pertussis
gccggcacggccggccag

SEQ ID NO: 2431412 - RNA, 20 nt, Bordetella pertussis
gccggcacggccggccaggc

SEQ ID NO: 2431413 - RNA, 22 nt, Bordetella pertussis
gccggcacggccggccaggcgc

SEQ ID NO: 2431414 - RNA, 17 nt, Bordetella pertussis
gccggcacguaccaggc

SEQ ID NO: 2431415 - RNA, 18 nt, Bordetella pertussis
gccggcacguaccaggcg

SEQ ID NO: 2431416 - RNA, 15 nt, Bordetella pertussis
gccggcacguccggc

SEQ ID NO: 2431417 - RNA, 23 nt, Bordetella pertussis
gccggcacguccggcacggcggc

SEQ ID NO: 2431418 - RNA, 17 nt, Bordetella pertussis
gccggcagaucggcgcu

SEQ ID NO: 2431419 - RNA, 18 nt, Bordetella pertussis
gccggcagaucggcgcug

SEQ ID NO: 2431420 - RNA, 13 nt, Bordetella pertussis
gccggcagcaggg

SEQ ID NO: 2431421 - RNA, 16 nt, Bordetella pertussis
gccggcagccccagcg

SEQ ID NO: 2431422 - RNA, 18 nt, Bordetella pertussis
gccggcagccccagcgcc

SEQ ID NO: 2431423 - RNA, 20 nt, Bordetella pertussis
gccggcagccccagcgccca

SEQ ID NO: 2431424 - RNA, 21 nt, Bordetella pertussis
gccggcagccccagcgcccag

SEQ ID NO: 2431425 - RNA, 22 nt, Bordetella pertussis
gccggcagcgcaaaacgcauga

SEQ ID NO: 2431426 - RNA, 21 nt, Bordetella pertussis
gccggcagcgccuugccuucc

SEQ ID NO: 2431427 - RNA, 20 nt, Bordetella pertussis
gccggcagcgcgaccggcgc

SEQ ID NO: 2431428 - RNA, 13 nt, Bordetella pertussis
gccggcagcggcg

SEQ ID NO: 2431429 - RNA, 19 nt, Bordetella pertussis
gccggcagcggcgccaugc

SEQ ID NO: 2431430 - RNA, 12 nt, Bordetella pertussis
gccggcaggccg

SEQ ID NO: 2431431 - RNA, 17 nt, Bordetella pertussis
gccggcaggcgcgccag

SEQ ID NO: 2431432 - RNA, 18 nt, Bordetella pertussis
gccggcaggcgcgccagc

SEQ ID NO: 2431433 - RNA, 19 nt, Bordetella pertussis
gccggcaggcgcgccagcc

SEQ ID NO: 2431434 - RNA, 22 nt, Bordetella pertussis
gccggcaggcgcgccagcccgc

SEQ ID NO: 2431435 - RNA, 14 nt, Bordetella pertussis
gccggcagggccag

SEQ ID NO: 2431436 - RNA, 17 nt, Bordetella pertussis
gccggcagggccagcgc

SEQ ID NO: 2431437 - RNA, 20 nt, Bordetella pertussis
gccggcagggccagcgccag

SEQ ID NO: 2431438 - RNA, 15 nt, Bordetella pertussis
gccggccgcccaggc

SEQ ID NO: 2431439 - RNA, 17 nt, Bordetella pertussis
gccggccgcccaggcgc

SEQ ID NO: 2431440 - RNA, 22 nt, Bordetella pertussis
gccggccgcccaggcgcagccg

SEQ ID NO: 2431441 - RNA, 14 nt, Bordetella pertussis
gccggccgccgaac

SEQ ID NO: 2431442 - RNA, 15 nt, Bordetella pertussis
gccggccgccgaacg

SEQ ID NO: 2431443 - RNA, 14 nt, Bordetella pertussis
gccggccgccggcg

SEQ ID NO: 2431444 - RNA, 16 nt, Bordetella pertussis
gccggccgccggcggc

SEQ ID NO: 2431445 - RNA, 17 nt, Bordetella pertussis
gccggccgccgggccgc

SEQ ID NO: 2431446 - RNA, 19 nt, Bordetella pertussis
gccggccgccgggccgcga

SEQ ID NO: 2431447 - RNA, 22 nt, Bordetella pertussis
gccggccgccgggccgcgacca

SEQ ID NO: 2431448 - RNA, 13 nt, Bordetella pertussis
gccggccgcgccc

SEQ ID NO: 2431449 - RNA, 17 nt, Bordetella pertussis
gccggccgcgcccaugc

SEQ ID NO: 2431450 - RNA, 22 nt, Bordetella pertussis
gccggccgcgcccaugcgcugg

SEQ ID NO: 2431451 - RNA, 23 nt, Bordetella pertussis
gccggccgcgcccaugcgcuggc

SEQ ID NO: 2431452 - RNA, 14 nt, Bordetella pertussis
gccggccgcgcccg

SEQ ID NO: 2431453 - RNA, 15 nt, Bordetella pertussis
gccggccgcgcccga

SEQ ID NO: 2431454 - RNA, 14 nt, Bordetella pertussis
gccggccgcgccgc

SEQ ID NO: 2431455 - RNA, 13 nt, Bordetella pertussis
gccggccgcgcgc

SEQ ID NO: 2431456 - RNA, 19 nt, Bordetella pertussis
gccggccgcgcgcgccagg

SEQ ID NO: 2431457 - RNA, 16 nt, Bordetella pertussis
gccggccgcgcggccg

SEQ ID NO: 2431458 - RNA, 18 nt, Bordetella pertussis
gccggccgcgcggccguc

SEQ ID NO: 2431459 - RNA, 20 nt, Bordetella pertussis
gccggccgcgcggccgucag

SEQ ID NO: 2431460 - RNA, 15 nt, Bordetella pertussis
gccggccgcguggcc

SEQ ID NO: 2431461 - RNA, 18 nt, Bordetella pertussis
gccggccgcguucagcau

SEQ ID NO: 2431462 - RNA, 14 nt, Bordetella pertussis
gccggccgggccgc

SEQ ID NO: 2431463 - RNA, 16 nt, Bordetella pertussis
gccggccgggccgcgc

SEQ ID NO: 2431464 - RNA, 16 nt, Bordetella pertussis
gccggccgggcgcggc

SEQ ID NO: 2431465 - RNA, 17 nt, Bordetella pertussis
gccggccgggcgcggcg

SEQ ID NO: 2431466 - RNA, 20 nt, Bordetella pertussis
gccggccgggcgcggcgccc

SEQ ID NO: 2431467 - RNA, 17 nt, Bordetella pertussis
gccggccggguugucgc

SEQ ID NO: 2431468 - RNA, 20 nt, Bordetella pertussis
gccggccguauggccguugg

SEQ ID NO: 2431469 - RNA, 16 nt, Bordetella pertussis
gccggccgucauccac

SEQ ID NO: 2431470 - RNA, 19 nt, Bordetella pertussis
gccggccgucuugaggaua

SEQ ID NO: 2431471 - RNA, 18 nt, Bordetella pertussis
gccggccguuucaggccu

SEQ ID NO: 2431472 - RNA, 20 nt, Bordetella pertussis
gccggccguuucaggccugc

SEQ ID NO: 2431473 - RNA, 22 nt, Bordetella pertussis
gccggccguuucaggccugcgg

SEQ ID NO: 2431474 - RNA, 14 nt, Bordetella pertussis
gccggccuccagca

SEQ ID NO: 2431475 - RNA, 23 nt, Bordetella pertussis
gccggccuccagcaucgccgcca

SEQ ID NO: 2431476 - RNA, 24 nt, Bordetella pertussis
gccggccuccagcaucgccgccag

SEQ ID NO: 2431477 - RNA, 17 nt, Bordetella pertussis
gccggccuccggggugc

SEQ ID NO: 2431478 - RNA, 14 nt, Bordetella pertussis
gccggccucggcca

SEQ ID NO: 2431479 - RNA, 19 nt, Bordetella pertussis
gccggccucuucgucgccg

SEQ ID NO: 2431480 - RNA, 20 nt, Bordetella pertussis
gccggccucuucgucgccgg

SEQ ID NO: 2431481 - RNA, 23 nt, Bordetella pertussis
gccggccucuucgucgccggcgc

SEQ ID NO: 2431482 - RNA, 13 nt, Bordetella pertussis
gccggccugacgc

SEQ ID NO: 2431483 - RNA, 17 nt, Bordetella pertussis
gccggccugaggcccga

SEQ ID NO: 2431484 - RNA, 14 nt, Bordetella pertussis
gccggccugcaaug

SEQ ID NO: 2431485 - RNA, 21 nt, Bordetella pertussis
gccggccugcaaugcggccag

SEQ ID NO: 2431486 - RNA, 12 nt, Bordetella pertussis
gccggccugcag

SEQ ID NO: 2431487 - RNA, 16 nt, Bordetella pertussis
gccggccugcaggcuc

SEQ ID NO: 2431488 - RNA, 22 nt, Bordetella pertussis
gccggccugcaggugccgccgg

SEQ ID NO: 2431489 - RNA, 17 nt, Bordetella pertussis
gccggccugccggcgca

SEQ ID NO: 2431490 - RNA, 21 nt, Bordetella pertussis
gccggccugcgauucgcgcuu

SEQ ID NO: 2431491 - RNA, 13 nt, Bordetella pertussis
gccggccugcgcc

SEQ ID NO: 2431492 - RNA, 15 nt, Bordetella pertussis
gccggccugcgccag

SEQ ID NO: 2431493 - RNA, 17 nt, Bordetella pertussis
gccggccugcgccgggc

SEQ ID NO: 2431494 - RNA, 20 nt, Bordetella pertussis
gccggccugcgccgggcgcg

SEQ ID NO: 2431495 - RNA, 14 nt, Bordetella pertussis
gccggccugcgucg

SEQ ID NO: 2431496 - RNA, 20 nt, Bordetella pertussis
gccggccugcgucgccaccu

SEQ ID NO: 2431497 - RNA, 22 nt, Bordetella pertussis
gccggccugcucgccggccagc

SEQ ID NO: 2431498 - RNA, 21 nt, Bordetella pertussis
gccggccugcuuggccgcgua

SEQ ID NO: 2431499 - RNA, 13 nt, Bordetella pertussis
gccggccuggcgc

SEQ ID NO: 2431500 - RNA, 23 nt, Bordetella pertussis
gccggccuggcgcgacgccugcg

SEQ ID NO: 2431501 - RNA, 16 nt, Bordetella pertussis
gccggccuggcgcgca

SEQ ID NO: 2431502 - RNA, 17 nt, Bordetella pertussis
gccggccuggcgcgcau

SEQ ID NO: 2431503 - RNA, 20 nt, Bordetella pertussis
gccggccuggcgcgcaucgg

SEQ ID NO: 2431504 - RNA, 20 nt, Bordetella pertussis
gccggccuggcgcgcggccu

SEQ ID NO: 2431505 - RNA, 14 nt, Bordetella pertussis
gccggccuggcggg

SEQ ID NO: 2431506 - RNA, 15 nt, Bordetella pertussis
gccggccuggcgggc

SEQ ID NO: 2431507 - RNA, 18 nt, Bordetella pertussis
gccggccuggcgggccga

SEQ ID NO: 2431508 - RNA, 12 nt, Bordetella pertussis
gccggccugggc

SEQ ID NO: 2431509 - RNA, 22 nt, Bordetella pertussis
gccggccugggcggcggcgaug

SEQ ID NO: 2431510 - RNA, 13 nt, Bordetella pertussis
gccggccugucug

SEQ ID NO: 2431511 - RNA, 11 nt, Bordetella pertussis
gccggccuguu

SEQ ID NO: 2431512 - RNA, 19 nt, Bordetella pertussis
gccggccuuccggcaucag

SEQ ID NO: 2431513 - RNA, 14 nt, Bordetella pertussis
gccggccuugcuga

SEQ ID NO: 2431514 - RNA, 22 nt, Bordetella pertussis
gccggccuuggccauguccugg

SEQ ID NO: 2431515 - RNA, 18 nt, Bordetella pertussis
gccggcgaauaugcccuc

SEQ ID NO: 2431516 - RNA, 16 nt, Bordetella pertussis
gccggcgaaugccggc

SEQ ID NO: 2431517 - RNA, 20 nt, Bordetella pertussis
gccggcgaaugccggccgau

SEQ ID NO: 2431518 - RNA, 17 nt, Bordetella pertussis
gccggcgacgccgcggu

SEQ ID NO: 2431519 - RNA, 14 nt, Bordetella pertussis
gccggcgacguggc

SEQ ID NO: 2431520 - RNA, 16 nt, Bordetella pertussis
gccggcgacguggcgc

SEQ ID NO: 2431521 - RNA, 18 nt, Bordetella pertussis
gccggcgacguggcgcuc

SEQ ID NO: 2431522 - RNA, 14 nt, Bordetella pertussis
gccggcgacguggu

SEQ ID NO: 2431523 - RNA, 17 nt, Bordetella pertussis
gccggcgauauggccag

SEQ ID NO: 2431524 - RNA, 18 nt, Bordetella pertussis
gccggcgauauggccagg

SEQ ID NO: 2431525 - RNA, 20 nt, Bordetella pertussis
gccggcgaugaagucgcggc

SEQ ID NO: 2431526 - RNA, 23 nt, Bordetella pertussis
gccggcgaugaagucgcggcccg

SEQ ID NO: 2431527 - RNA, 22 nt, Bordetella pertussis
gccggcgaugauggggucgccg

SEQ ID NO: 2431528 - RNA, 14 nt, Bordetella pertussis
gccggcgauggcgu

SEQ ID NO: 2431529 - RNA, 19 nt, Bordetella pertussis
gccggcgauugcgccagcg

SEQ ID NO: 2431530 - RNA, 20 nt, Bordetella pertussis
gccggcgauugcgccagcgc

SEQ ID NO: 2431531 - RNA, 21 nt, Bordetella pertussis
gccggcgauugcgccagcgcu

SEQ ID NO: 2431532 - RNA, 14 nt, Bordetella pertussis
gccggcgcaacggg

SEQ ID NO: 2431533 - RNA, 21 nt, Bordetella pertussis
gccggcgcacaaucugcgucg

SEQ ID NO: 2431534 - RNA, 15 nt, Bordetella pertussis
gccggcgcacccggu

SEQ ID NO: 2431535 - RNA, 17 nt, Bordetella pertussis
gccggcgcacgccggac

SEQ ID NO: 2431536 - RNA, 16 nt, Bordetella pertussis
gccggcgcaugagccg

SEQ ID NO: 2431537 - RNA, 18 nt, Bordetella pertussis
gccggcgcaugagccggc

SEQ ID NO: 2431538 - RNA, 14 nt, Bordetella pertussis
gccggcgccagccg

SEQ ID NO: 2431539 - RNA, 16 nt, Bordetella pertussis
gccggcgccagccgcu

SEQ ID NO: 2431540 - RNA, 19 nt, Bordetella pertussis
gccggcgccagccgcucca

SEQ ID NO: 2431541 - RNA, 13 nt, Bordetella pertussis
gccggcgccccca

SEQ ID NO: 2431542 - RNA, 17 nt, Bordetella pertussis
gccggcgcccccagcag

SEQ ID NO: 2431543 - RNA, 18 nt, Bordetella pertussis
gccggcgcccccagcagc

SEQ ID NO: 2431544 - RNA, 22 nt, Bordetella pertussis
gccggcgcccccagcagcgagg

SEQ ID NO: 2431545 - RNA, 11 nt, Bordetella pertussis
gccggcgcccg

SEQ ID NO: 2431546 - RNA, 14 nt, Bordetella pertussis
gccggcgcccggca

SEQ ID NO: 2431547 - RNA, 18 nt, Bordetella pertussis
gccggcgcccggcagccg

SEQ ID NO: 2431548 - RNA, 20 nt, Bordetella pertussis
gccggcgccgccucaggccg

SEQ ID NO: 2431549 - RNA, 14 nt, Bordetella pertussis
gccggcgccggcaa

SEQ ID NO: 2431550 - RNA, 14 nt, Bordetella pertussis
gccggcgccggcga

SEQ ID NO: 2431551 - RNA, 22 nt, Bordetella pertussis
gccggcgggcgcugccugccgg

SEQ ID NO: 2431552 - RNA, 12 nt, Bordetella pertussis
gccggcgggcgg

SEQ ID NO: 2431553 - RNA, 16 nt, Bordetella pertussis
gccggcgggcggcugc

SEQ ID NO: 2431554 - RNA, 18 nt, Bordetella pertussis
gccggcgggcggcugccc

SEQ ID NO: 2431555 - RNA, 21 nt, Bordetella pertussis
gccggcgggcggcugcccggg

SEQ ID NO: 2431556 - RNA, 19 nt, Bordetella pertussis
gccggcgguaagcguccgc

SEQ ID NO: 2431557 - RNA, 14 nt, Bordetella pertussis
gccggcggucacgc

SEQ ID NO: 2431558 - RNA, 20 nt, Bordetella pertussis
gccggcggucacgccgauga

SEQ ID NO: 2431559 - RNA, 22 nt, Bordetella pertussis
gccggcggucccgagcgcuccc

SEQ ID NO: 2431560 - RNA, 17 nt, Bordetella pertussis
gccggcggucgcgcugg

SEQ ID NO: 2431561 - RNA, 20 nt, Bordetella pertussis
gccggcggucgcgcuggccc

SEQ ID NO: 2431562 - RNA, 21 nt, Bordetella pertussis
gccggcggucgcgcuggcccg

SEQ ID NO: 2431563 - RNA, 22 nt, Bordetella pertussis
gccggcggucgcgcuggcccgc

SEQ ID NO: 2431564 - RNA, 15 nt, Bordetella pertussis
gccggcggugaugac

SEQ ID NO: 2431565 - RNA, 19 nt, Bordetella pertussis
gccggcguagucguugccg

SEQ ID NO: 2431566 - RNA, 23 nt, Bordetella pertussis
gccggcguagucguugccggcca

SEQ ID NO: 2431567 - RNA, 14 nt, Bordetella pertussis
gccggcgucacgcg

SEQ ID NO: 2431568 - RNA, 18 nt, Bordetella pertussis
gccggcgucacgcggccg

SEQ ID NO: 2431569 - RNA, 21 nt, Bordetella pertussis
gccggcgucacgcggccgggc

SEQ ID NO: 2431570 - RNA, 15 nt, Bordetella pertussis
gccggcguccacggc

SEQ ID NO: 2431571 - RNA, 22 nt, Bordetella pertussis
gccggcguccacggcaucggcc

SEQ ID NO: 2431572 - RNA, 20 nt, Bordetella pertussis
gccggcguccugcggcggca

SEQ ID NO: 2431573 - RNA, 22 nt, Bordetella pertussis
gccggcguccugcggcggcagc

SEQ ID NO: 2431574 - RNA, 23 nt, Bordetella pertussis
gccggcguccugcggcggcagcu

SEQ ID NO: 2431575 - RNA, 23 nt, Bordetella pertussis
gccggcgucuggagcggccuggc

SEQ ID NO: 2431576 - RNA, 20 nt, Bordetella pertussis
gccggcguggaacgaccacg

SEQ ID NO: 2431577 - RNA, 22 nt, Bordetella pertussis
gccggcguggccugcccgucgg

SEQ ID NO: 2431578 - RNA, 14 nt, Bordetella pertussis
gccggcguggcgcg

SEQ ID NO: 2431579 - RNA, 15 nt, Bordetella pertussis
gccggcguggcgcgc

SEQ ID NO: 2431580 - RNA, 18 nt, Bordetella pertussis
gccggcguggcgcgcaac

SEQ ID NO: 2431581 - RNA, 21 nt, Bordetella pertussis
gccggcguucaccaggaagcg

SEQ ID NO: 2431582 - RNA, 13 nt, Bordetella pertussis
gccggcguucugg

SEQ ID NO: 2431583 - RNA, 18 nt, Bordetella pertussis
gccggcguucuucagcgc

SEQ ID NO: 2431584 - RNA, 22 nt, Bordetella pertussis
gccggcguucuucagcgcgcuc

SEQ ID NO: 2431585 - RNA, 22 nt, Bordetella pertussis
gccggcguugccguuucagggg

SEQ ID NO: 2431586 - RNA, 18 nt, Bordetella pertussis
gccggcguugcgcccugc

SEQ ID NO: 2431587 - RNA, 15 nt, Bordetella pertussis
gccggcguuggccgg

SEQ ID NO: 2431588 - RNA, 17 nt, Bordetella pertussis
gccggcguuggccgggu

SEQ ID NO: 2431589 - RNA, 22 nt, Bordetella pertussis
gccggcuacagcucgccggcga

SEQ ID NO: 2431590 - RNA, 19 nt, Bordetella pertussis
gccggcuaccgcgccaucu

SEQ ID NO: 2431591 - RNA, 14 nt, Bordetella pertussis
gccggcucagcccc

SEQ ID NO: 2431592 - RNA, 16 nt, Bordetella pertussis
gccggcucaggccagc

SEQ ID NO: 2431593 - RNA, 18 nt, Bordetella pertussis
gccggcucaggccagcga

SEQ ID NO: 2431594 - RNA, 20 nt, Bordetella pertussis
gccggcucaggccagcgacc

SEQ ID NO: 2431595 - RNA, 18 nt, Bordetella pertussis
gccggcucauucggcgcg

SEQ ID NO: 2431596 - RNA, 21 nt, Bordetella pertussis
gccggcucauucggcgcgcuc

SEQ ID NO: 2431597 - RNA, 20 nt, Bordetella pertussis
gccggcuccagucccgcacc

SEQ ID NO: 2431598 - RNA, 21 nt, Bordetella pertussis
gccggcuccagucccgcaccg

SEQ ID NO: 2431599 - RNA, 19 nt, Bordetella pertussis
gccggcucccgcgcugccg

SEQ ID NO: 2431600 - RNA, 15 nt, Bordetella pertussis
gccggcuccgauagc

SEQ ID NO: 2431601 - RNA, 18 nt, Bordetella pertussis
gccggcuccgauagcggc

SEQ ID NO: 2431602 - RNA, 20 nt, Bordetella pertussis
gccggcuccgauagcggcgc

SEQ ID NO: 2431603 - RNA, 21 nt, Bordetella pertussis
gccggcuccgauagcggcgcc

SEQ ID NO: 2431604 - RNA, 12 nt, Bordetella pertussis
gccggcuccgcu

SEQ ID NO: 2431605 - RNA, 17 nt, Bordetella pertussis
gccggcucgaacaggcu

SEQ ID NO: 2431606 - RNA, 12 nt, Bordetella pertussis
gccggcucggcg

SEQ ID NO: 2431607 - RNA, 18 nt, Bordetella pertussis
gccggcucggcggcaucg

SEQ ID NO: 2431608 - RNA, 18 nt, Bordetella pertussis
gccggcugaauuggcgcc

SEQ ID NO: 2431609 - RNA, 24 nt, Bordetella pertussis
gccggcugaauuggcgcccaucgc

SEQ ID NO: 2431610 - RNA, 15 nt, Bordetella pertussis
gccggcugcaccagc

SEQ ID NO: 2431611 - RNA, 22 nt, Bordetella pertussis
gccggcugcaccagcgcgccgc

SEQ ID NO: 2431612 - RNA, 23 nt, Bordetella pertussis
gccggcugcaccagcgcgccgcg

SEQ ID NO: 2431613 - RNA, 13 nt, Bordetella pertussis
gccggcugcgcgc

SEQ ID NO: 2431614 - RNA, 14 nt, Bordetella pertussis
gccggcugcgcgcc

SEQ ID NO: 2431615 - RNA, 17 nt, Bordetella pertussis
gccggcugcgcgccgac

SEQ ID NO: 2431616 - RNA, 19 nt, Bordetella pertussis
gccggcugcgcgccgacca

SEQ ID NO: 2431617 - RNA, 12 nt, Bordetella pertussis
gccggcuggcau

SEQ ID NO: 2431618 - RNA, 17 nt, Bordetella pertussis
gccggcuggcaugcggc

SEQ ID NO: 2431619 - RNA, 15 nt, Bordetella pertussis
gccggcugggcggcc

SEQ ID NO: 2431620 - RNA, 19 nt, Bordetella pertussis
gccggcugggcggccuugg

SEQ ID NO: 2431621 - RNA, 15 nt, Bordetella pertussis
gccggcugggcguuc

SEQ ID NO: 2431622 - RNA, 14 nt, Bordetella pertussis
gccggcuucagccg

SEQ ID NO: 2431623 - RNA, 19 nt, Bordetella pertussis
gccggcuucagccgcaagc

SEQ ID NO: 2431624 - RNA, 21 nt, Bordetella pertussis
gccggcuucagccgcaagcug

SEQ ID NO: 2431625 - RNA, 14 nt, Bordetella pertussis
gccggcuuccagca

SEQ ID NO: 2431626 - RNA, 17 nt, Bordetella pertussis
gccggcuuccagcagca

SEQ ID NO: 2431627 - RNA, 22 nt, Bordetella pertussis
gccggcuuccagcagcaugccg

SEQ ID NO: 2431628 - RNA, 18 nt, Bordetella pertussis
gccggcuucgucaugguc

SEQ ID NO: 2431629 - RNA, 14 nt, Bordetella pertussis
gccggcuugcgcaa

SEQ ID NO: 2431630 - RNA, 15 nt, Bordetella pertussis
gccggcuugcgcaag

SEQ ID NO: 2431631 - RNA, 16 nt, Bordetella pertussis
gccggcuugcgcaagc

SEQ ID NO: 2431632 - RNA, 23 nt, Bordetella pertussis
gccggcuugcgcaagccggccgc

SEQ ID NO: 2431633 - RNA, 15 nt, Bordetella pertussis
gccggcuugcgccag

SEQ ID NO: 2431634 - RNA, 16 nt, Bordetella pertussis
gccggcuugcgccagc

SEQ ID NO: 2431635 - RNA, 20 nt, Bordetella pertussis
gccggcuugcgccagccacg

SEQ ID NO: 2431636 - RNA, 17 nt, Bordetella pertussis
gccggcuuucagcgccg

SEQ ID NO: 2431637 - RNA, 21 nt, Bordetella pertussis
gccggcuuucagcgccgagcg

SEQ ID NO: 2431638 - RNA, 22 nt, Bordetella pertussis
gccggcuuucagcgccgagcgc

SEQ ID NO: 2431639 - RNA, 18 nt, Bordetella pertussis
gccggcuuuggacaggcg

SEQ ID NO: 2431640 - RNA, 21 nt, Bordetella pertussis
gccgggaaaaagagccugucc

SEQ ID NO: 2431641 - RNA, 12 nt, Bordetella pertussis
gccgggaaggcg

SEQ ID NO: 2431642 - RNA, 17 nt, Bordetella pertussis
gccgggacaaucgaaga

SEQ ID NO: 2431643 - RNA, 12 nt, Bordetella pertussis
gccgggacaggc

SEQ ID NO: 2431644 - RNA, 18 nt, Bordetella pertussis
gccgggacaggcacccgc

SEQ ID NO: 2431645 - RNA, 20 nt, Bordetella pertussis
gccgggacaggcacccgcgc

SEQ ID NO: 2431646 - RNA, 21 nt, Bordetella pertussis
gccgggaccuuggcggcuggc

SEQ ID NO: 2431647 - RNA, 22 nt, Bordetella pertussis
gccgggaccuuggcggcuggcg

SEQ ID NO: 2431648 - RNA, 23 nt, Bordetella pertussis
gccgggaccuuggcggcuggcgc

SEQ ID NO: 2431649 - RNA, 14 nt, Bordetella pertussis
gccgggagccuguc

SEQ ID NO: 2431650 - RNA, 23 nt, Bordetella pertussis
gccgggagccuguccccgccggg

SEQ ID NO: 2431651 - RNA, 19 nt, Bordetella pertussis
gccgggagcggccagcaag

SEQ ID NO: 2431652 - RNA, 20 nt, Bordetella pertussis
gccgggagcggccagcaagc

SEQ ID NO: 2431653 - RNA, 15 nt, Bordetella pertussis
gccgggauccacgcc

SEQ ID NO: 2431654 - RNA, 18 nt, Bordetella pertussis
gccgggauccacgccgcc

SEQ ID NO: 2431655 - RNA, 19 nt, Bordetella pertussis
gccgggauccacgccgccg

SEQ ID NO: 2431656 - RNA, 16 nt, Bordetella pertussis
gccgggaugcugcucg

SEQ ID NO: 2431657 - RNA, 22 nt, Bordetella pertussis
gccgggaugcugcucggccaug

SEQ ID NO: 2431658 - RNA, 18 nt, Bordetella pertussis
gccgggcaagcagauggc

SEQ ID NO: 2431659 - RNA, 21 nt, Bordetella pertussis
gccgggcaagcagauggccau

SEQ ID NO: 2431660 - RNA, 22 nt, Bordetella pertussis
gccgggcacaccgucacgcgca

SEQ ID NO: 2431661 - RNA, 20 nt, Bordetella pertussis
gccgggcaccgagccgcagg

SEQ ID NO: 2431662 - RNA, 17 nt, Bordetella pertussis
gccggguccggccgcgc

SEQ ID NO: 2431663 - RNA, 13 nt, Bordetella pertussis
gccgggucgcgca

SEQ ID NO: 2431664 - RNA, 15 nt, Bordetella pertussis
gccgggucgcgcagc

SEQ ID NO: 2431665 - RNA, 16 nt, Bordetella pertussis
gccgggucgcgcagca

SEQ ID NO: 2431666 - RNA, 19 nt, Bordetella pertussis
gccgggucgcgcagcaggg

SEQ ID NO: 2431667 - RNA, 13 nt, Bordetella pertussis
gccgggucggccu

SEQ ID NO: 2431668 - RNA, 22 nt, Bordetella pertussis
gccgggucggccugccaccagc

SEQ ID NO: 2431669 - RNA, 17 nt, Bordetella pertussis
gccgggucuggccggcc

SEQ ID NO: 2431670 - RNA, 20 nt, Bordetella pertussis
gccgggucuggccggccgcg

SEQ ID NO: 2431671 - RNA, 18 nt, Bordetella pertussis
gccggguggguucgggcg

SEQ ID NO: 2431672 - RNA, 17 nt, Bordetella pertussis
gccggguggucgcgccc

SEQ ID NO: 2431673 - RNA, 18 nt, Bordetella pertussis
gccggguggucgcgcccg

SEQ ID NO: 2431674 - RNA, 18 nt, Bordetella pertussis
gccggguguuccggcgcg

SEQ ID NO: 2431675 - RNA, 20 nt, Bordetella pertussis
gccggguguuccggcgcgcg

SEQ ID NO: 2431676 - RNA, 18 nt, Bordetella pertussis
gccggguugcaggaugcg

SEQ ID NO: 2431677 - RNA, 15 nt, Bordetella pertussis
gccggguuucggcau

SEQ ID NO: 2431678 - RNA, 22 nt, Bordetella pertussis
gccggguuuuuacaugccgcgc

SEQ ID NO: 2431679 - RNA, 17 nt, Bordetella pertussis
gccgguaaccgacgcag

SEQ ID NO: 2431680 - RNA, 18 nt, Bordetella pertussis
gccgguaaccgacgcagc

SEQ ID NO: 2431681 - RNA, 20 nt, Bordetella pertussis
gccgguaaccgacgcagcgc

SEQ ID NO: 2431682 - RNA, 21 nt, Bordetella pertussis
gccgguaaccgacgcagcgca

SEQ ID NO: 2431683 - RNA, 23 nt, Bordetella pertussis
gccgguaaccgacgcagcgcacc

SEQ ID NO: 2431684 - RNA, 16 nt, Bordetella pertussis
gccgguacagccaggc

SEQ ID NO: 2431685 - RNA, 19 nt, Bordetella pertussis
gccgguacagccaggccag

SEQ ID NO: 2431686 - RNA, 20 nt, Bordetella pertussis
gccgguacagccaggccagc

SEQ ID NO: 2431687 - RNA, 21 nt, Bordetella pertussis
gccgguacagccaggccagca

SEQ ID NO: 2431688 - RNA, 22 nt, Bordetella pertussis
gccgguacagccaggccagcag

SEQ ID NO: 2431689 - RNA, 16 nt, Bordetella pertussis
gccgguaucgcggcgc

SEQ ID NO: 2431690 - RNA, 19 nt, Bordetella pertussis
gccgguaucgcggcgcagg

SEQ ID NO: 2431691 - RNA, 20 nt, Bordetella pertussis
gccgguaucgcggcgcaggc

SEQ ID NO: 2431692 - RNA, 16 nt, Bordetella pertussis
gccgguaucggccucg

SEQ ID NO: 2431693 - RNA, 23 nt, Bordetella pertussis
gccgguaucgguguggugcugcg

SEQ ID NO: 2431694 - RNA, 20 nt, Bordetella pertussis
gccggucaccgccgccgcca

SEQ ID NO: 2431695 - RNA, 16 nt, Bordetella pertussis
gccggucacgcuggug

SEQ ID NO: 2431696 - RNA, 23 nt, Bordetella pertussis
gccggucacgcugguggccacca

SEQ ID NO: 2431697 - RNA, 15 nt, Bordetella pertussis
gccggucacugccga

SEQ ID NO: 2431698 - RNA, 21 nt, Bordetella pertussis
gccggucacugccgaaacgcu

SEQ ID NO: 2431699 - RNA, 20 nt, Bordetella pertussis
gccggucagcccaggcgggc

SEQ ID NO: 2431700 - RNA, 20 nt, Bordetella pertussis
gccggucaggaaguccuggu

SEQ ID NO: 2431701 - RNA, 16 nt, Bordetella pertussis
gccggucaggaugcgc

SEQ ID NO: 2431702 - RNA, 20 nt, Bordetella pertussis
gccggucaggaugcgcgcca

SEQ ID NO: 2431703 - RNA, 21 nt, Bordetella pertussis
gccggucagggaggcuguccc

SEQ ID NO: 2431704 - RNA, 16 nt, Bordetella pertussis
gccggucaugaagucc

SEQ ID NO: 2431705 - RNA, 15 nt, Bordetella pertussis
gccgguccagcgccc

SEQ ID NO: 2431706 - RNA, 16 nt, Bordetella pertussis
gccgguccagcgcccg

SEQ ID NO: 2431707 - RNA, 13 nt, Bordetella pertussis
gccgguccgacgg

SEQ ID NO: 2431708 - RNA, 15 nt, Bordetella pertussis
gccgguccgccucgc

SEQ ID NO: 2431709 - RNA, 19 nt, Bordetella pertussis
gccgguccgccucgcacag

SEQ ID NO: 2431710 - RNA, 13 nt, Bordetella pertussis
gccggucgagaua

SEQ ID NO: 2431711 - RNA, 16 nt, Bordetella pertussis
gccggucgccagcgau

SEQ ID NO: 2431712 - RNA, 14 nt, Bordetella pertussis
gccggucgccgcgg

SEQ ID NO: 2431713 - RNA, 17 nt, Bordetella pertussis
gccggucgccgcgggca

SEQ ID NO: 2431714 - RNA, 19 nt, Bordetella pertussis
gccggucgccgcgggcaaa

SEQ ID NO: 2431715 - RNA, 16 nt, Bordetella pertussis
gccggucggccgcucc

SEQ ID NO: 2431716 - RNA, 21 nt, Bordetella pertussis
gccggucggccgcuccgccau

SEQ ID NO: 2431717 - RNA, 22 nt, Bordetella pertussis
gccggucggccgcuccgccaug

SEQ ID NO: 2431718 - RNA, 20 nt, Bordetella pertussis
gccggucuaugucgaggacc

SEQ ID NO: 2431719 - RNA, 21 nt, Bordetella pertussis
gccggucuaugucgaggaccu

SEQ ID NO: 2431720 - RNA, 15 nt, Bordetella pertussis
gccggucugggcgcg

SEQ ID NO: 2431721 - RNA, 23 nt, Bordetella pertussis
gccggucugggcgcggaacagcc

SEQ ID NO: 2431722 - RNA, 16 nt, Bordetella pertussis
gccggugaacaccagg

SEQ ID NO: 2431723 - RNA, 20 nt, Bordetella pertussis
gccggugaacaccagggugg

SEQ ID NO: 2431724 - RNA, 23 nt, Bordetella pertussis
gccggugaacaccaggguggcgc

SEQ ID NO: 2431725 - RNA, 12 nt, Bordetella pertussis
gccggugaccgc

SEQ ID NO: 2431726 - RNA, 13 nt, Bordetella pertussis
gccggugaccgca

SEQ ID NO: 2431727 - RNA, 16 nt, Bordetella pertussis
gccggugaccgccagc

SEQ ID NO: 2431728 - RNA, 18 nt, Bordetella pertussis
gccggugaccgccagcag

SEQ ID NO: 2431729 - RNA, 20 nt, Bordetella pertussis
gccggugaccgccagcaggc

SEQ ID NO: 2431730 - RNA, 23 nt, Bordetella pertussis
gccggugauaugcgccaggcccu

SEQ ID NO: 2431731 - RNA, 14 nt, Bordetella pertussis
gccggugaugcccg

SEQ ID NO: 2431732 - RNA, 22 nt, Bordetella pertussis
gccggugaugcccgaggcggcg

SEQ ID NO: 2431733 - RNA, 15 nt, Bordetella pertussis
gccggugaugcggcg

SEQ ID NO: 2431734 - RNA, 16 nt, Bordetella pertussis
gccggugaugcggcgc

SEQ ID NO: 2431735 - RNA, 17 nt, Bordetella pertussis
gccggugaugcggcgcg

SEQ ID NO: 2431736 - RNA, 18 nt, Bordetella pertussis
gccggugaugcggcgcgc

SEQ ID NO: 2431737 - RNA, 20 nt, Bordetella pertussis
gccggugaugcggcgcgccg

SEQ ID NO: 2431738 - RNA, 14 nt, Bordetella pertussis
gccggugcaccagg

SEQ ID NO: 2431739 - RNA, 16 nt, Bordetella pertussis
gccggugcaccaggcc

SEQ ID NO: 2431740 - RNA, 22 nt, Bordetella pertussis
gccggugcaggucaucgcgcug

SEQ ID NO: 2431741 - RNA, 17 nt, Bordetella pertussis
gccggugcaucggccgg

SEQ ID NO: 2431742 - RNA, 21 nt, Bordetella pertussis
gccggugcaucggccggcggu

SEQ ID NO: 2431743 - RNA, 15 nt, Bordetella pertussis
gccggugccaguccc

SEQ ID NO: 2431744 - RNA, 12 nt, Bordetella pertussis
gccggugcgcag

SEQ ID NO: 2431745 - RNA, 15 nt, Bordetella pertussis
gccggugcgcagcac

SEQ ID NO: 2431746 - RNA, 20 nt, Bordetella pertussis
gccggugcgcagcaccagca

SEQ ID NO: 2431747 - RNA, 21 nt, Bordetella pertussis
gccggugcgcagcaccagcau

SEQ ID NO: 2431748 - RNA, 22 nt, Bordetella pertussis
gccggugcgcagcaccagcaug

SEQ ID NO: 2431749 - RNA, 12 nt, Bordetella pertussis
gccggugcgcgg

SEQ ID NO: 2431750 - RNA, 15 nt, Bordetella pertussis
gccggugcgcggcgc

SEQ ID NO: 2431751 - RNA, 18 nt, Bordetella pertussis
gccggugcgcggcgcccc

SEQ ID NO: 2431752 - RNA, 14 nt, Bordetella pertussis
gccggugcgcggcu

SEQ ID NO: 2431753 - RNA, 16 nt, Bordetella pertussis
gccggugcgcggcuug

SEQ ID NO: 2431754 - RNA, 22 nt, Bordetella pertussis
gccggugcguuccaugacgucc

SEQ ID NO: 2431755 - RNA, 16 nt, Bordetella pertussis
gccggugcucggccag

SEQ ID NO: 2431756 - RNA, 18 nt, Bordetella pertussis
gccggugcucggccagcg

SEQ ID NO: 2431757 - RNA, 20 nt, Bordetella pertussis
gccggugcucggccagcgcg

SEQ ID NO: 2431758 - RNA, 21 nt, Bordetella pertussis
gccggugcucggccagcgcgc

SEQ ID NO: 2431759 - RNA, 16 nt, Bordetella pertussis
gccgguggaccagggc

SEQ ID NO: 2431760 - RNA, 14 nt, Bordetella pertussis
gccgguggacggcc

SEQ ID NO: 2431761 - RNA, 16 nt, Bordetella pertussis
gccgguggacggccag

SEQ ID NO: 2431762 - RNA, 17 nt, Bordetella pertussis
gccgguggacggccagc

SEQ ID NO: 2431763 - RNA, 19 nt, Bordetella pertussis
gccgguggacggccagcag

SEQ ID NO: 2431764 - RNA, 14 nt, Bordetella pertussis
gccgguggccagca

SEQ ID NO: 2431765 - RNA, 19 nt, Bordetella pertussis
gccggugggcgcguucuug

SEQ ID NO: 2431766 - RNA, 20 nt, Bordetella pertussis
gccgguggugcccaucgcgc

SEQ ID NO: 2431767 - RNA, 22 nt, Bordetella pertussis
gccgguggugucgaacagcgag

SEQ ID NO: 2431768 - RNA, 19 nt, Bordetella pertussis
gccggugucggggccgggc

SEQ ID NO: 2431769 - RNA, 15 nt, Bordetella pertussis
gccgguucgggcggg

SEQ ID NO: 2431770 - RNA, 21 nt, Bordetella pertussis
gccgguucggucgacgacggc

SEQ ID NO: 2431771 - RNA, 23 nt, Bordetella pertussis
gccgguucggucgacgacggcaa

SEQ ID NO: 2431772 - RNA, 17 nt, Bordetella pertussis
gccgguuucggccugca

SEQ ID NO: 2431773 - RNA, 22 nt, Bordetella pertussis
gccgguuucggccugcaggccc

SEQ ID NO: 2431774 - RNA, 14 nt, Bordetella pertussis
gccguaaccggcca

SEQ ID NO: 2431775 - RNA, 22 nt, Bordetella pertussis
gccguaaccggccagucccagg

SEQ ID NO: 2431776 - RNA, 23 nt, Bordetella pertussis
gccguacacguuggggaaccgca

SEQ ID NO: 2431777 - RNA, 21 nt, Bordetella pertussis
gccguacagcgaaggggcgca

SEQ ID NO: 2431778 - RNA, 22 nt, Bordetella pertussis
gccguacagcgaaggggcgcau

SEQ ID NO: 2431779 - RNA, 16 nt, Bordetella pertussis
gccguacagggccgcg

SEQ ID NO: 2431780 - RNA, 16 nt, Bordetella pertussis
gccguacauggccagg

SEQ ID NO: 2431781 - RNA, 13 nt, Bordetella pertussis
gccguaccagcgc

SEQ ID NO: 2431782 - RNA, 15 nt, Bordetella pertussis
gccguaccagcgcga

SEQ ID NO: 2431783 - RNA, 16 nt, Bordetella pertussis
gccguaccaggugcgc

SEQ ID NO: 2431784 - RNA, 14 nt, Bordetella pertussis
gccguaccccagca

SEQ ID NO: 2431785 - RNA, 17 nt, Bordetella pertussis
gccguaccgggcggucc

SEQ ID NO: 2431786 - RNA, 13 nt, Bordetella pertussis
gccguaccugcag

SEQ ID NO: 2431787 - RNA, 18 nt, Bordetella pertussis
gccguaccugcagcaggc

SEQ ID NO: 2431788 - RNA, 22 nt, Bordetella pertussis
gccguaccugcagcaggcgcac

SEQ ID NO: 2431789 - RNA, 17 nt, Bordetella pertussis
gccguacgagugcaggc

SEQ ID NO: 2431790 - RNA, 20 nt, Bordetella pertussis
gccguacgagugcaggcccg

SEQ ID NO: 2431791 - RNA, 13 nt, Bordetella pertussis
gccguacgccauc

SEQ ID NO: 2431792 - RNA, 18 nt, Bordetella pertussis
gccguacgccaucgacgc

SEQ ID NO: 2431793 - RNA, 22 nt, Bordetella pertussis
gccguacgcggcgcccgcgcau

SEQ ID NO: 2431794 - RNA, 20 nt, Bordetella pertussis
gccguacucgaucgccauga

SEQ ID NO: 2431795 - RNA, 16 nt, Bordetella pertussis
gccguacucgccgguc

SEQ ID NO: 2431796 - RNA, 13 nt, Bordetella pertussis
gccguacugggca

SEQ ID NO: 2431797 - RNA, 17 nt, Bordetella pertussis
gccguacugggcaccac

SEQ ID NO: 2431798 - RNA, 13 nt, Bordetella pertussis
gccguacuuggcg

SEQ ID NO: 2431799 - RNA, 19 nt, Bordetella pertussis
gccguacuuggcgauggcc

SEQ ID NO: 2431800 - RNA, 22 nt, Bordetella pertussis
gccguacuuggcgauggccgcc

SEQ ID NO: 2431801 - RNA, 19 nt, Bordetella pertussis
gccguagagggucuggcgg

SEQ ID NO: 2431802 - RNA, 21 nt, Bordetella pertussis
gccguagagggucuggcggcc

SEQ ID NO: 2431803 - RNA, 13 nt, Bordetella pertussis
gccguagcccagg

SEQ ID NO: 2431804 - RNA, 16 nt, Bordetella pertussis
gccguagccgcugcgc

SEQ ID NO: 2431805 - RNA, 19 nt, Bordetella pertussis
gccguagccgcugcgcgcg

SEQ ID NO: 2431806 - RNA, 14 nt, Bordetella pertussis
gccguagcgcgcca

SEQ ID NO: 2431807 - RNA, 17 nt, Bordetella pertussis
gccguagcgcgccagcc

SEQ ID NO: 2431808 - RNA, 18 nt, Bordetella pertussis
gccguagcgcgccagccg

SEQ ID NO: 2431809 - RNA, 17 nt, Bordetella pertussis
gccguagcgcguggcca

SEQ ID NO: 2431810 - RNA, 17 nt, Bordetella pertussis
gccguagcguuggcggc

SEQ ID NO: 2431811 - RNA, 13 nt, Bordetella pertussis
gccguaggcgccg

SEQ ID NO: 2431812 - RNA, 17 nt, Bordetella pertussis
gccguaggcgccggccu

SEQ ID NO: 2431813 - RNA, 19 nt, Bordetella pertussis
gccguaggguucgccgcug

SEQ ID NO: 2431814 - RNA, 16 nt, Bordetella pertussis
gccguaguaggucaug

SEQ ID NO: 2431815 - RNA, 20 nt, Bordetella pertussis
gccguaucgcguggcgcgcc

SEQ ID NO: 2431816 - RNA, 23 nt, Bordetella pertussis
gccguaucgcguggcgcgccagc

SEQ ID NO: 2431817 - RNA, 20 nt, Bordetella pertussis
gccgucaacagcauggacga

SEQ ID NO: 2431818 - RNA, 13 nt, Bordetella pertussis
gccgucaacgccc

SEQ ID NO: 2431819 - RNA, 21 nt, Bordetella pertussis
gccgucaagcguucauggcgc

SEQ ID NO: 2431820 - RNA, 15 nt, Bordetella pertussis
gccgucaccggcuac

SEQ ID NO: 2431821 - RNA, 22 nt, Bordetella pertussis
gccgucaccggcuacgaccuga

SEQ ID NO: 2431822 - RNA, 15 nt, Bordetella pertussis
gccgucagcagcagg

SEQ ID NO: 2431823 - RNA, 16 nt, Bordetella pertussis
gccgucagcagcaggc

SEQ ID NO: 2431824 - RNA, 17 nt, Bordetella pertussis
gccgucagcagcaggcu

SEQ ID NO: 2431825 - RNA, 19 nt, Bordetella pertussis
gccgucagcagcaggcugg

SEQ ID NO: 2431826 - RNA, 22 nt, Bordetella pertussis
gccgucagcagcaggcuggcca

SEQ ID NO: 2431827 - RNA, 17 nt, Bordetella pertussis
gccgucagcagcgcggc

SEQ ID NO: 2431828 - RNA, 18 nt, Bordetella pertussis
gccgucagcagcgcggcg

SEQ ID NO: 2431829 - RNA, 20 nt, Bordetella pertussis
gccgucagcagcgcggcgcc

SEQ ID NO: 2431830 - RNA, 18 nt, Bordetella pertussis
gccgucagcucgaucagg

SEQ ID NO: 2431831 - RNA, 19 nt, Bordetella pertussis
gccgucagcucgaucaggc

SEQ ID NO: 2431832 - RNA, 20 nt, Bordetella pertussis
gccgucagcucgaucaggcg

SEQ ID NO: 2431833 - RNA, 16 nt, Bordetella pertussis
gccgucaggaucaggc

SEQ ID NO: 2431834 - RNA, 19 nt, Bordetella pertussis
gccgucaggcguugcgccg

SEQ ID NO: 2431835 - RNA, 17 nt, Bordetella pertussis
gccgucaugcgccgucc

SEQ ID NO: 2431836 - RNA, 13 nt, Bordetella pertussis
gccgucauggcgg

SEQ ID NO: 2431837 - RNA, 14 nt, Bordetella pertussis
gccgucauggcggu

SEQ ID NO: 2431838 - RNA, 21 nt, Bordetella pertussis
gccguccaaaacagacaggcc

SEQ ID NO: 2431839 - RNA, 23 nt, Bordetella pertussis
gccguccaaaacagacaggccgg

SEQ ID NO: 2431840 - RNA, 15 nt, Bordetella pertussis
gccguccacgaaggc

SEQ ID NO: 2431841 - RNA, 19 nt, Bordetella pertussis
gccguccacgaaggcagca

SEQ ID NO: 2431842 - RNA, 15 nt, Bordetella pertussis
gccguccacgcccag

SEQ ID NO: 2431843 - RNA, 17 nt, Bordetella pertussis
gccguccacgcccagcg

SEQ ID NO: 2431844 - RNA, 15 nt, Bordetella pertussis
gccguccacgccgcg

SEQ ID NO: 2431845 - RNA, 14 nt, Bordetella pertussis
gccguccagcgcgg

SEQ ID NO: 2431846 - RNA, 16 nt, Bordetella pertussis
gccguccagcgcggcg

SEQ ID NO: 2431847 - RNA, 20 nt, Bordetella pertussis
gccguccaggaagcagccca

SEQ ID NO: 2431848 - RNA, 22 nt, Bordetella pertussis
gccguccaggaagcagcccagc

SEQ ID NO: 2431849 - RNA, 23 nt, Bordetella pertussis
gccguccaggaagcagcccagca

SEQ ID NO: 2431850 - RNA, 21 nt, Bordetella pertussis
gccguccaggcgccgcacgcc

SEQ ID NO: 2431851 - RNA, 19 nt, Bordetella pertussis
gccguccagucccguggcg

SEQ ID NO: 2431852 - RNA, 21 nt, Bordetella pertussis
gccguccgagcccgacgcgag

SEQ ID NO: 2431853 - RNA, 16 nt, Bordetella pertussis
gccguccgcaucgcgc

SEQ ID NO: 2431854 - RNA, 17 nt, Bordetella pertussis
gccguccgcaucgcgca

SEQ ID NO: 2431855 - RNA, 18 nt, Bordetella pertussis
gccguccgcaucgcgcaa

SEQ ID NO: 2431856 - RNA, 19 nt, Bordetella pertussis
gccguccggccgugccgcc

SEQ ID NO: 2431857 - RNA, 13 nt, Bordetella pertussis
gccguccgggccg

SEQ ID NO: 2431858 - RNA, 14 nt, Bordetella pertussis
gccguccgggccgg

SEQ ID NO: 2431859 - RNA, 18 nt, Bordetella pertussis
gccguccgggccgguuuc

SEQ ID NO: 2431860 - RNA, 14 nt, Bordetella pertussis
gccguccucaggcc

SEQ ID NO: 2431861 - RNA, 16 nt, Bordetella pertussis
gccguccucaggcccg

SEQ ID NO: 2431862 - RNA, 17 nt, Bordetella pertussis
gccguccucgcgggccu

SEQ ID NO: 2431863 - RNA, 22 nt, Bordetella pertussis
gccguccucgcgggccuggcgg

SEQ ID NO: 2431864 - RNA, 14 nt, Bordetella pertussis
gccguccugcugcg

SEQ ID NO: 2431865 - RNA, 18 nt, Bordetella pertussis
gccguccugcugcggcac

SEQ ID NO: 2431866 - RNA, 14 nt, Bordetella pertussis
gccguccuggcgac

SEQ ID NO: 2431867 - RNA, 18 nt, Bordetella pertussis
gccguccuugagggcgcg

SEQ ID NO: 2431868 - RNA, 21 nt, Bordetella pertussis
gccguccuugagggcgcgggc

SEQ ID NO: 2431869 - RNA, 24 nt, Bordetella pertussis
gccguccuugagggcgcgggccag

SEQ ID NO: 2431870 - RNA, 14 nt, Bordetella pertussis
gccguccuuggcgc

SEQ ID NO: 2431871 - RNA, 18 nt, Bordetella pertussis
gccguccuuggcgccggc

SEQ ID NO: 2431872 - RNA, 21 nt, Bordetella pertussis
gccguccuuggcgccggcgau

SEQ ID NO: 2431873 - RNA, 16 nt, Bordetella pertussis
gccguccuugugccag

SEQ ID NO: 2431874 - RNA, 19 nt, Bordetella pertussis
gccguccuugugccaggug

SEQ ID NO: 2431875 - RNA, 22 nt, Bordetella pertussis
gccgucgaaacacgaugccucg

SEQ ID NO: 2431876 - RNA, 13 nt, Bordetella pertussis
gccgucgaacucc

SEQ ID NO: 2431877 - RNA, 15 nt, Bordetella pertussis
gccgucgaacuccuc

SEQ ID NO: 2431878 - RNA, 15 nt, Bordetella pertussis
gccgucgaagccggc

SEQ ID NO: 2431879 - RNA, 19 nt, Bordetella pertussis
gccgucgaagccggcgcca

SEQ ID NO: 2431880 - RNA, 20 nt, Bordetella pertussis
gccgucgaagccggcgccau

SEQ ID NO: 2431881 - RNA, 21 nt, Bordetella pertussis
gccgucgaagccggcgccauc

SEQ ID NO: 2431882 - RNA, 22 nt, Bordetella pertussis
gccgucgaagccggcgccaucg

SEQ ID NO: 2431883 - RNA, 16 nt, Bordetella pertussis
gccgucgaaggccgca

SEQ ID NO: 2431884 - RNA, 17 nt, Bordetella pertussis
gccgucgaaggccgcaa

SEQ ID NO: 2431885 - RNA, 19 nt, Bordetella pertussis
gccgucgaaggccgcaacc

SEQ ID NO: 2431886 - RNA, 14 nt, Bordetella pertussis
gccuaugugcaggc

SEQ ID NO: 2431887 - RNA, 19 nt, Bordetella pertussis
gccuauugcgacgccgccg

SEQ ID NO: 2431888 - RNA, 23 nt, Bordetella pertussis
gccuauuggcuguaucuggccug

SEQ ID NO: 2431889 - RNA, 23 nt, Bordetella pertussis
gccucaaccuucucgaugcgcgc

SEQ ID NO: 2431890 - RNA, 16 nt, Bordetella pertussis
gccucaacuggccggc

SEQ ID NO: 2431891 - RNA, 17 nt, Bordetella pertussis
gccucaacuggccggcc

SEQ ID NO: 2431892 - RNA, 18 nt, Bordetella pertussis
gccucaacuggccggccu

SEQ ID NO: 2431893 - RNA, 20 nt, Bordetella pertussis
gccucaacuggccggccugg

SEQ ID NO: 2431894 - RNA, 23 nt, Bordetella pertussis
gccucacaugucacacgaagaac

SEQ ID NO: 2431895 - RNA, 19 nt, Bordetella pertussis
gccucacuccauagcgccg

SEQ ID NO: 2431896 - RNA, 13 nt, Bordetella pertussis
gccucagcccgcg

SEQ ID NO: 2431897 - RNA, 17 nt, Bordetella pertussis
gccucagcccgcguuca

SEQ ID NO: 2431898 - RNA, 20 nt, Bordetella pertussis
gccucagcccgcguucaggc

SEQ ID NO: 2431899 - RNA, 22 nt, Bordetella pertussis
gccucagcguuuccagggcgcg

SEQ ID NO: 2431900 - RNA, 12 nt, Bordetella pertussis
gccucaggccgg

SEQ ID NO: 2431901 - RNA, 16 nt, Bordetella pertussis
gccucaggccggcgcc

SEQ ID NO: 2431902 - RNA, 21 nt, Bordetella pertussis
gccucauccccgcgugccugu

SEQ ID NO: 2431903 - RNA, 23 nt, Bordetella pertussis
gccucaucccgauuucggagcgg

SEQ ID NO: 2431904 - RNA, 23 nt, Bordetella pertussis
gccucaucguucugcgucaaggc

SEQ ID NO: 2431905 - RNA, 12 nt, Bordetella pertussis
gccuccagcagg

SEQ ID NO: 2431906 - RNA, 17 nt, Bordetella pertussis
gccuccagcaucgccgc

SEQ ID NO: 2431907 - RNA, 18 nt, Bordetella pertussis
gccuccagcaucgccgcc

SEQ ID NO: 2431908 - RNA, 22 nt, Bordetella pertussis
gccuccagcaucgccgccagcu

SEQ ID NO: 2431909 - RNA, 15 nt, Bordetella pertussis
gccuccagcgcggcg

SEQ ID NO: 2431910 - RNA, 18 nt, Bordetella pertussis
gccuccagcgcggcgggc

SEQ ID NO: 2431911 - RNA, 22 nt, Bordetella pertussis
gccuccagcgcggcgggcggcg

SEQ ID NO: 2431912 - RNA, 21 nt, Bordetella pertussis
gccuccaggaugagcgccugc

SEQ ID NO: 2431913 - RNA, 16 nt, Bordetella pertussis
gccuccaggcgcaagc

SEQ ID NO: 2431914 - RNA, 12 nt, Bordetella pertussis
gccuccaggcgg

SEQ ID NO: 2431915 - RNA, 15 nt, Bordetella pertussis
gccuccaggcggcgg

SEQ ID NO: 2431916 - RNA, 23 nt, Bordetella pertussis
gccuccaggcggcggugccagcg

SEQ ID NO: 2431917 - RNA, 24 nt, Bordetella pertussis
gccuccaggcggcggugccagcgc

SEQ ID NO: 2431918 - RNA, 18 nt, Bordetella pertussis
gccuccaucagcagcacc

SEQ ID NO: 2431919 - RNA, 20 nt, Bordetella pertussis
gccuccaucagcagcaccuu

SEQ ID NO: 2431920 - RNA, 18 nt, Bordetella pertussis
gccucccauugcgcggcc

SEQ ID NO: 2431921 - RNA, 19 nt, Bordetella pertussis
gccucccauugcgcggcca

SEQ ID NO: 2431922 - RNA, 21 nt, Bordetella pertussis
gccucccauugcgcggccagg

SEQ ID NO: 2431923 - RNA, 15 nt, Bordetella pertussis
gccuccccaggccag

SEQ ID NO: 2431924 - RNA, 21 nt, Bordetella pertussis
gccuccccaggccagcugcgc

SEQ ID NO: 2431925 - RNA, 20 nt, Bordetella pertussis
gccucccgccgcccggccgg

SEQ ID NO: 2431926 - RNA, 22 nt, Bordetella pertussis
gccucccgucgucguccacgcc

SEQ ID NO: 2431927 - RNA, 19 nt, Bordetella pertussis
gccuccgcgcacagcgcgg

SEQ ID NO: 2431928 - RNA, 20 nt, Bordetella pertussis
gccuccgcgcacagcgcggc

SEQ ID NO: 2431929 - RNA, 14 nt, Bordetella pertussis
gccuccgcgccgac

SEQ ID NO: 2431930 - RNA, 16 nt, Bordetella pertussis
gccuccgcgccgacca

SEQ ID NO: 2431931 - RNA, 23 nt, Bordetella pertussis
gccuccgcgccgaccacgcuggg

SEQ ID NO: 2431932 - RNA, 13 nt, Bordetella pertussis
gccuccggguaua

SEQ ID NO: 2431933 - RNA, 12 nt, Bordetella pertussis
gccuccugcagc

SEQ ID NO: 2431934 - RNA, 19 nt, Bordetella pertussis
gccuccugcagcaggucgg

SEQ ID NO: 2431935 - RNA, 19 nt, Bordetella pertussis
gccucgaaccagugcaggg

SEQ ID NO: 2431936 - RNA, 22 nt, Bordetella pertussis
gccucgaacccgaacgcgugca

SEQ ID NO: 2431937 - RNA, 14 nt, Bordetella pertussis
gccucgaacguccg

SEQ ID NO: 2431938 - RNA, 15 nt, Bordetella pertussis
gccucgaacguccgc

SEQ ID NO: 2431939 - RNA, 19 nt, Bordetella pertussis
gccucgaacguccgcccca

SEQ ID NO: 2431940 - RNA, 22 nt, Bordetella pertussis
gccucgaagaccucggcgcuca

SEQ ID NO: 2431941 - RNA, 16 nt, Bordetella pertussis
gccucgaagcccggca

SEQ ID NO: 2431942 - RNA, 20 nt, Bordetella pertussis
gccucgaagcccggcagggu

SEQ ID NO: 2431943 - RNA, 23 nt, Bordetella pertussis
gccucgaagcggcucaggcgcgg

SEQ ID NO: 2431944 - RNA, 12 nt, Bordetella pertussis
gccucgaccggc

SEQ ID NO: 2431945 - RNA, 13 nt, Bordetella pertussis
gccucgaccggcg

SEQ ID NO: 2431946 - RNA, 20 nt, Bordetella pertussis
gccucgaccggcgaagagcc

SEQ ID NO: 2431947 - RNA, 23 nt, Bordetella pertussis
gccucgaccggcgaagagccgua

SEQ ID NO: 2431948 - RNA, 22 nt, Bordetella pertussis
gccucgaccucuccacuggccu

SEQ ID NO: 2431949 - RNA, 12 nt, Bordetella pertussis
gccucgacgaau

SEQ ID NO: 2431950 - RNA, 22 nt, Bordetella pertussis
gccucgacgaugcccugcgcca

SEQ ID NO: 2431951 - RNA, 14 nt, Bordetella pertussis
gccucgacgauggc

SEQ ID NO: 2431952 - RNA, 15 nt, Bordetella pertussis
gccucgacgauggcc

SEQ ID NO: 2431953 - RNA, 21 nt, Bordetella pertussis
gccucgacgcuguagaggcgc

SEQ ID NO: 2431954 - RNA, 17 nt, Bordetella pertussis
gccucgacggccgccgg

SEQ ID NO: 2431955 - RNA, 22 nt, Bordetella pertussis
gccucgagguauucgcgcgauu

SEQ ID NO: 2431956 - RNA, 15 nt, Bordetella pertussis
gccucgagguggcgc

SEQ ID NO: 2431957 - RNA, 16 nt, Bordetella pertussis
gccucgagguggcgca

SEQ ID NO: 2431958 - RNA, 22 nt, Bordetella pertussis
gccucgaguuugcgguccaugu

SEQ ID NO: 2431959 - RNA, 17 nt, Bordetella pertussis
gccucgaucgccagguc

SEQ ID NO: 2431960 - RNA, 18 nt, Bordetella pertussis
gccucgaucgccaggucg

SEQ ID NO: 2431961 - RNA, 19 nt, Bordetella pertussis
gccucgaucgccaggucgg

SEQ ID NO: 2431962 - RNA, 22 nt, Bordetella pertussis
gccucgaucgccaggucggcca

SEQ ID NO: 2431963 - RNA, 21 nt, Bordetella pertussis
gccucgaugaaggugcgcagc

SEQ ID NO: 2431964 - RNA, 16 nt, Bordetella pertussis
gccucgaugcccucgc

SEQ ID NO: 2431965 - RNA, 20 nt, Bordetella pertussis
gccucgaugcccucgcgcac

SEQ ID NO: 2431966 - RNA, 18 nt, Bordetella pertussis
gccucgaugucaucgccc

SEQ ID NO: 2431967 - RNA, 19 nt, Bordetella pertussis
gccucgauugaccagcacc

SEQ ID NO: 2431968 - RNA, 22 nt, Bordetella pertussis
gccucgauugaccagcaccagc

SEQ ID NO: 2431969 - RNA, 14 nt, Bordetella pertussis
gccucgcaucggcc

SEQ ID NO: 2431970 - RNA, 18 nt, Bordetella pertussis
gccucgcaucggccugca

SEQ ID NO: 2431971 - RNA, 12 nt, Bordetella pertussis
gccucgcccugg

SEQ ID NO: 2431972 - RNA, 16 nt, Bordetella pertussis
gccucgcccuggcgca

SEQ ID NO: 2431973 - RNA, 12 nt, Bordetella pertussis
gccucgccggcc

SEQ ID NO: 2431974 - RNA, 13 nt, Bordetella pertussis
gccucgccggccu

SEQ ID NO: 2431975 - RNA, 21 nt, Bordetella pertussis
gccucgcgacggccucccgcc

SEQ ID NO: 2431976 - RNA, 18 nt, Bordetella pertussis
gccucgcgcagggcggcc

SEQ ID NO: 2431977 - RNA, 13 nt, Bordetella pertussis
gccucgcgcucga

SEQ ID NO: 2431978 - RNA, 19 nt, Bordetella pertussis
gccucgcgcucgagcgcgg

SEQ ID NO: 2431979 - RNA, 21 nt, Bordetella pertussis
gccucgcgcucgagcgcggcg

SEQ ID NO: 2431980 - RNA, 22 nt, Bordetella pertussis
gccucgcgcucgagcgcggcgc

SEQ ID NO: 2431981 - RNA, 20 nt, Bordetella pertussis
gccucgcgcucgcgcucggc

SEQ ID NO: 2431982 - RNA, 13 nt, Bordetella pertussis
gccucgcggcgca

SEQ ID NO: 2431983 - RNA, 14 nt, Bordetella pertussis
gccucgcggcgcag

SEQ ID NO: 2431984 - RNA, 15 nt, Bordetella pertussis
gccucgcggcgcagc

SEQ ID NO: 2431985 - RNA, 16 nt, Bordetella pertussis
gccucgcggcgcagca

SEQ ID NO: 2431986 - RNA, 21 nt, Bordetella pertussis
gccucgcggcgcguauccgcc

SEQ ID NO: 2431987 - RNA, 21 nt, Bordetella pertussis
gccucgcgggccuuggccagc

SEQ ID NO: 2431988 - RNA, 22 nt, Bordetella pertussis
gccucgcgggccuuggccagca

SEQ ID NO: 2431989 - RNA, 14 nt, Bordetella pertussis
gccucgcugccagg

SEQ ID NO: 2431990 - RNA, 18 nt, Bordetella pertussis
gccucgcuggagaccggc

SEQ ID NO: 2431991 - RNA, 23 nt, Bordetella pertussis
gccucgcuggagaccggcauggu

SEQ ID NO: 2431992 - RNA, 13 nt, Bordetella pertussis
gccucgcuggcga

SEQ ID NO: 2431993 - RNA, 17 nt, Bordetella pertussis
gccucggcaaacggcug

SEQ ID NO: 2431994 - RNA, 14 nt, Bordetella pertussis
gccucggcauccag

SEQ ID NO: 2431995 - RNA, 20 nt, Bordetella pertussis
gccucggcauccagcucggc

SEQ ID NO: 2431996 - RNA, 16 nt, Bordetella pertussis
gccucggcauggcgcg

SEQ ID NO: 2431997 - RNA, 17 nt, Bordetella pertussis
gccucggcauggcgcgc

SEQ ID NO: 2431998 - RNA, 19 nt, Bordetella pertussis
gccucggcauggcgcgcgc

SEQ ID NO: 2431999 - RNA, 13 nt, Bordetella pertussis
gccucggccaccu

SEQ ID NO: 2432000 - RNA, 18 nt, Bordetella pertussis
gccucggccaccuggcgc

SEQ ID NO: 2432001 - RNA, 13 nt, Bordetella pertussis
gccucggccagcu

SEQ ID NO: 2432002 - RNA, 14 nt, Bordetella pertussis
gccucggccagcug

SEQ ID NO: 2432003 - RNA, 15 nt, Bordetella pertussis
gccucggccagcugg

SEQ ID NO: 2432004 - RNA, 12 nt, Bordetella pertussis
gccucggccagg

SEQ ID NO: 2432005 - RNA, 12 nt, Bordetella pertussis
gccucggccggc

SEQ ID NO: 2432006 - RNA, 14 nt, Bordetella pertussis
gccucggccggcag

SEQ ID NO: 2432007 - RNA, 22 nt, Bordetella pertussis
gccucggcgaagugcccgcugg

SEQ ID NO: 2432008 - RNA, 23 nt, Bordetella pertussis
gccucggcgaagugcccgcuggc

SEQ ID NO: 2432009 - RNA, 13 nt, Bordetella pertussis
gccucggcgcgcg

SEQ ID NO: 2432010 - RNA, 14 nt, Bordetella pertussis
gccucggcgcgcgc

SEQ ID NO: 2432011 - RNA, 13 nt, Bordetella pertussis
gccucggcggcca

SEQ ID NO: 2432012 - RNA, 16 nt, Bordetella pertussis
gccucggcggccagcg

SEQ ID NO: 2432013 - RNA, 20 nt, Bordetella pertussis
gccucggcggccagcgcgcc

SEQ ID NO: 2432014 - RNA, 22 nt, Bordetella pertussis
gccucggcggccagcgcgcccu

SEQ ID NO: 2432015 - RNA, 15 nt, Bordetella pertussis
gccucggcggccucc

SEQ ID NO: 2432016 - RNA, 18 nt, Bordetella pertussis
gccucggcggccuccggc

SEQ ID NO: 2432017 - RNA, 20 nt, Bordetella pertussis
gccucggcggccuccggcag

SEQ ID NO: 2432018 - RNA, 16 nt, Bordetella pertussis
gccucggcgggcggcg

SEQ ID NO: 2432019 - RNA, 17 nt, Bordetella pertussis
gccucggcgggcggcgc

SEQ ID NO: 2432020 - RNA, 18 nt, Bordetella pertussis
gccucggcgggcggcgcc

SEQ ID NO: 2432021 - RNA, 19 nt, Bordetella pertussis
gccucggcgggcggcgcca

SEQ ID NO: 2432022 - RNA, 21 nt, Bordetella pertussis
gccucggcgggcggcgccagc

SEQ ID NO: 2432023 - RNA, 22 nt, Bordetella pertussis
gccucggcgggcggcgccagcg

SEQ ID NO: 2432024 - RNA, 23 nt, Bordetella pertussis
gccucggcgggcggcgccagcgg

SEQ ID NO: 2432025 - RNA, 21 nt, Bordetella pertussis
gccucggcgguugcccgcccc

SEQ ID NO: 2432026 - RNA, 15 nt, Bordetella pertussis
gccucggcuccgcca

SEQ ID NO: 2432027 - RNA, 17 nt, Bordetella pertussis
gccucggcuccgccauu

SEQ ID NO: 2432028 - RNA, 18 nt, Bordetella pertussis
gccucggcuugcgcggcg

SEQ ID NO: 2432029 - RNA, 19 nt, Bordetella pertussis
gccucggcuugcgcggcgc

SEQ ID NO: 2432030 - RNA, 15 nt, Bordetella pertussis
gccucgggcacggcc

SEQ ID NO: 2432031 - RNA, 18 nt, Bordetella pertussis
gccucgggcacggccagc

SEQ ID NO: 2432032 - RNA, 13 nt, Bordetella pertussis
gccucgggcgcaa

SEQ ID NO: 2432033 - RNA, 15 nt, Bordetella pertussis
gccucgggcgcaacg

SEQ ID NO: 2432034 - RNA, 20 nt, Bordetella pertussis
gccucggggcucgugguggg

SEQ ID NO: 2432035 - RNA, 22 nt, Bordetella pertussis
gccucgguacuccuugacgcgc

SEQ ID NO: 2432036 - RNA, 13 nt, Bordetella pertussis
gccucgguccagc

SEQ ID NO: 2432037 - RNA, 19 nt, Bordetella pertussis
gccucgguggucagguagc

SEQ ID NO: 2432038 - RNA, 21 nt, Bordetella pertussis
gccucguaguguucgauggcg

SEQ ID NO: 2432039 - RNA, 13 nt, Bordetella pertussis
gccucguaucgcc

SEQ ID NO: 2432040 - RNA, 17 nt, Bordetella pertussis
gccucguaucgccugac

SEQ ID NO: 2432041 - RNA, 17 nt, Bordetella pertussis
gccucguccucggugcu

SEQ ID NO: 2432042 - RNA, 19 nt, Bordetella pertussis
gccucguccucgucggcga

SEQ ID NO: 2432043 - RNA, 22 nt, Bordetella pertussis
gccucguccucgucggcgaagc

SEQ ID NO: 2432044 - RNA, 15 nt, Bordetella pertussis
gccucguccugcagg

SEQ ID NO: 2432045 - RNA, 18 nt, Bordetella pertussis
gccucguccugcaggcgg

SEQ ID NO: 2432046 - RNA, 19 nt, Bordetella pertussis
gccucgucgaccacgccgg

SEQ ID NO: 2432047 - RNA, 17 nt, Bordetella pertussis
gccucgucgcgcaacgc

SEQ ID NO: 2432048 - RNA, 17 nt, Bordetella pertussis
gccucgugcgaggccac

SEQ ID NO: 2432049 - RNA, 20 nt, Bordetella pertussis
gccucgugcugcugcaggcg

SEQ ID NO: 2432050 - RNA, 21 nt, Bordetella pertussis
gccucgugcugcugcaggcgc

SEQ ID NO: 2432051 - RNA, 22 nt, Bordetella pertussis
gccucgugcugcugcaggcgcg

SEQ ID NO: 2432052 - RNA, 23 nt, Bordetella pertussis
gccucgugcugcugcaggcgcgg

SEQ ID NO: 2432053 - RNA, 17 nt, Bordetella pertussis
gccucguucaugucgcg

SEQ ID NO: 2432054 - RNA, 14 nt, Bordetella pertussis
gccucuagcucaug

SEQ ID NO: 2432055 - RNA, 17 nt, Bordetella pertussis
gccucuucgaugaugag

SEQ ID NO: 2432056 - RNA, 23 nt, Bordetella pertussis
gccucuucgaugaugagcgcgcc

SEQ ID NO: 2432057 - RNA, 17 nt, Bordetella pertussis
gccucuucgucgccggc

SEQ ID NO: 2432058 - RNA, 21 nt, Bordetella pertussis
gccucuucgucgccggcgcug

SEQ ID NO: 2432059 - RNA, 23 nt, Bordetella pertussis
gccucuugcgugacccggggcag

SEQ ID NO: 2432060 - RNA, 16 nt, Bordetella pertussis
gccugaaaccgcaggc

SEQ ID NO: 2432061 - RNA, 17 nt, Bordetella pertussis
gccugaaaccgcaggca

SEQ ID NO: 2432062 - RNA, 23 nt, Bordetella pertussis
gccugacccagucgcaguucggc

SEQ ID NO: 2432063 - RNA, 17 nt, Bordetella pertussis
gccugacgcucauccag

SEQ ID NO: 2432064 - RNA, 22 nt, Bordetella pertussis
gccugacggccccguugucgcc

SEQ ID NO: 2432065 - RNA, 15 nt, Bordetella pertussis
gccugacgggccucg

SEQ ID NO: 2432066 - RNA, 17 nt, Bordetella pertussis
gccugacgugcgccaca

SEQ ID NO: 2432067 - RNA, 20 nt, Bordetella pertussis
gccugacgugcgccacagca

SEQ ID NO: 2432068 - RNA, 20 nt, Bordetella pertussis
gccugacguucggggcgucg

SEQ ID NO: 2432069 - RNA, 21 nt, Bordetella pertussis
gccugacguucggggcgucgc

SEQ ID NO: 2432070 - RNA, 24 nt, Bordetella pertussis
gccugacguucggggcgucgcugc

SEQ ID NO: 2432071 - RNA, 12 nt, Bordetella pertussis
gccugagcacau

SEQ ID NO: 2432072 - RNA, 20 nt, Bordetella pertussis
gccugagcacaugcccggcc

SEQ ID NO: 2432073 - RNA, 12 nt, Bordetella pertussis
gccugagcaccg

SEQ ID NO: 2432074 - RNA, 15 nt, Bordetella pertussis
gccugagcaccgccg

SEQ ID NO: 2432075 - RNA, 21 nt, Bordetella pertussis
gccugagcugccaggcuaucg

SEQ ID NO: 2432076 - RNA, 17 nt, Bordetella pertussis
gccugaggcccgauggc

SEQ ID NO: 2432077 - RNA, 18 nt, Bordetella pertussis
gccugaggcccgauggcg

SEQ ID NO: 2432078 - RNA, 13 nt, Bordetella pertussis
gccugaugcgcag

SEQ ID NO: 2432079 - RNA, 14 nt, Bordetella pertussis
gccugaugcgcaga

SEQ ID NO: 2432080 - RNA, 16 nt, Bordetella pertussis
gccugaugggugucga

SEQ ID NO: 2432081 - RNA, 17 nt, Bordetella pertussis
gccugauucccaggccc

SEQ ID NO: 2432082 - RNA, 19 nt, Bordetella pertussis
gccugauucccaggcccgg

SEQ ID NO: 2432083 - RNA, 20 nt, Bordetella pertussis
gccugauucccaggcccggc

SEQ ID NO: 2432084 - RNA, 21 nt, Bordetella pertussis
gccugauucccaggcccggcc

SEQ ID NO: 2432085 - RNA, 22 nt, Bordetella pertussis
gccugcaaaaaacaagcucgcg

SEQ ID NO: 2432086 - RNA, 14 nt, Bordetella pertussis
gccugcaaccuggu

SEQ ID NO: 2432087 - RNA, 22 nt, Bordetella pertussis
gccugcaaccuggucaagggcg

SEQ ID NO: 2432088 - RNA, 15 nt, Bordetella pertussis
gccugcaaguccagc

SEQ ID NO: 2432089 - RNA, 22 nt, Bordetella pertussis
gccugcaaguccagcgugguga

SEQ ID NO: 2432090 - RNA, 15 nt, Bordetella pertussis
gccugcaaugcggcc

SEQ ID NO: 2432091 - RNA, 17 nt, Bordetella pertussis
gccugcaaugcggccag

SEQ ID NO: 2432092 - RNA, 16 nt, Bordetella pertussis
gccugcaccgccgcgc

SEQ ID NO: 2432093 - RNA, 14 nt, Bordetella pertussis
gccugcaccggcgc

SEQ ID NO: 2432094 - RNA, 22 nt, Bordetella pertussis
gccugcacgaccugcgcaugcg

SEQ ID NO: 2432095 - RNA, 14 nt, Bordetella pertussis
gccugcacgcucuu

SEQ ID NO: 2432096 - RNA, 22 nt, Bordetella pertussis
gccugcacgcucuugagcgcgg

SEQ ID NO: 2432097 - RNA, 21 nt, Bordetella pertussis
gccugcacggugggcagcagc

SEQ ID NO: 2432098 - RNA, 22 nt, Bordetella pertussis
gccugcacggugggcagcagca

SEQ ID NO: 2432099 - RNA, 23 nt, Bordetella pertussis
gccugcacggugggcagcagcac

SEQ ID NO: 2432100 - RNA, 23 nt, Bordetella pertussis
gccugcacgucccagucgccgcg

SEQ ID NO: 2432101 - RNA, 17 nt, Bordetella pertussis
gccugcagaccagcacc

SEQ ID NO: 2432102 - RNA, 24 nt, Bordetella pertussis
gccugcagaccagcaccggcacga

SEQ ID NO: 2432103 - RNA, 14 nt, Bordetella pertussis
gccugcagcacggc

SEQ ID NO: 2432104 - RNA, 19 nt, Bordetella pertussis
gccugcagcacggccacgg

SEQ ID NO: 2432105 - RNA, 21 nt, Bordetella pertussis
gccugcagcacggccacggcc

SEQ ID NO: 2432106 - RNA, 23 nt, Bordetella pertussis
gccugcagcacggccacggccgg

SEQ ID NO: 2432107 - RNA, 12 nt, Bordetella pertussis
gccugcagcagc

SEQ ID NO: 2432108 - RNA, 13 nt, Bordetella pertussis
gccugcagcagcg

SEQ ID NO: 2432109 - RNA, 14 nt, Bordetella pertussis
gccugcagcagcgc

SEQ ID NO: 2432110 - RNA, 22 nt, Bordetella pertussis
gccugcgccacguccagcacgg

SEQ ID NO: 2432111 - RNA, 13 nt, Bordetella pertussis
gccugcgccagcc

SEQ ID NO: 2432112 - RNA, 16 nt, Bordetella pertussis
gccugcgccagccgcg

SEQ ID NO: 2432113 - RNA, 13 nt, Bordetella pertussis
gccugcgccagcu

SEQ ID NO: 2432114 - RNA, 15 nt, Bordetella pertussis
gccugcgccagcucc

SEQ ID NO: 2432115 - RNA, 17 nt, Bordetella pertussis
gccugcgccagcuccag

SEQ ID NO: 2432116 - RNA, 18 nt, Bordetella pertussis
gccugcgccagcuccagc

SEQ ID NO: 2432117 - RNA, 19 nt, Bordetella pertussis
gccugcgccaggugggcca

SEQ ID NO: 2432118 - RNA, 18 nt, Bordetella pertussis
gccugcgccauggcgcgc

SEQ ID NO: 2432119 - RNA, 13 nt, Bordetella pertussis
gccugcgccaugu

SEQ ID NO: 2432120 - RNA, 14 nt, Bordetella pertussis
gccugcgccaugug

SEQ ID NO: 2432121 - RNA, 15 nt, Bordetella pertussis
gccugcgccaugugg

SEQ ID NO: 2432122 - RNA, 16 nt, Bordetella pertussis
gccugcgccauguggc

SEQ ID NO: 2432123 - RNA, 13 nt, Bordetella pertussis
gccugcgccgccg

SEQ ID NO: 2432124 - RNA, 14 nt, Bordetella pertussis
gccugcgccgccgc

SEQ ID NO: 2432125 - RNA, 17 nt, Bordetella pertussis
gccugcgccgccgcgcg

SEQ ID NO: 2432126 - RNA, 19 nt, Bordetella pertussis
gccugcgccgccgcgcgcu

SEQ ID NO: 2432127 - RNA, 12 nt, Bordetella pertussis
gccugcgccggc

SEQ ID NO: 2432128 - RNA, 14 nt, Bordetella pertussis
gccugcgccggcau

SEQ ID NO: 2432129 - RNA, 13 nt, Bordetella pertussis
gccugcgccgggc

SEQ ID NO: 2432130 - RNA, 14 nt, Bordetella pertussis
gccugcgccgggcg

SEQ ID NO: 2432131 - RNA, 22 nt, Bordetella pertussis
gccugcgccggguccggccgcg

SEQ ID NO: 2432132 - RNA, 17 nt, Bordetella pertussis
gccugcgccgucugcgc

SEQ ID NO: 2432133 - RNA, 19 nt, Bordetella pertussis
gccugcgccgucugcgccg

SEQ ID NO: 2432134 - RNA, 20 nt, Bordetella pertussis
gccugcgccgucugcgccgc

SEQ ID NO: 2432135 - RNA, 15 nt, Bordetella pertussis
gccugcgcgaugcgc

SEQ ID NO: 2432136 - RNA, 19 nt, Bordetella pertussis
gccugcgcgaugcgcgcgc

SEQ ID NO: 2432137 - RNA, 14 nt, Bordetella pertussis
gccugcgcgccgac

SEQ ID NO: 2432138 - RNA, 22 nt, Bordetella pertussis
gccugcgcgccgaccaggucgg

SEQ ID NO: 2432139 - RNA, 13 nt, Bordetella pertussis
gccugcgcgccgc

SEQ ID NO: 2432140 - RNA, 14 nt, Bordetella pertussis
gccugcgcgccgcc

SEQ ID NO: 2432141 - RNA, 16 nt, Bordetella pertussis
gccugcgcgccgccuc

SEQ ID NO: 2432142 - RNA, 14 nt, Bordetella pertussis
gccugcgcgcgagc

SEQ ID NO: 2432143 - RNA, 18 nt, Bordetella pertussis
gccugcgcgcgagcaguc

SEQ ID NO: 2432144 - RNA, 23 nt, Bordetella pertussis
gccugcgcgcgagcagucgacca

SEQ ID NO: 2432145 - RNA, 16 nt, Bordetella pertussis
gccugcgcgcgcuggg

SEQ ID NO: 2432146 - RNA, 21 nt, Bordetella pertussis
gccugcgcgcgcuggggcagc

SEQ ID NO: 2432147 - RNA, 22 nt, Bordetella pertussis
gccugcgcgcgcuggggcagca

SEQ ID NO: 2432148 - RNA, 22 nt, Bordetella pertussis
gccugcgcggccucguaggcca

SEQ ID NO: 2432149 - RNA, 18 nt, Bordetella pertussis
gccugcggacggcgggcg

SEQ ID NO: 2432150 - RNA, 22 nt, Bordetella pertussis
gccugcggacggcgggcgcccc

SEQ ID NO: 2432151 - RNA, 14 nt, Bordetella pertussis
gccugcggcaggcc

SEQ ID NO: 2432152 - RNA, 15 nt, Bordetella pertussis
gccugcggcaggccg

SEQ ID NO: 2432153 - RNA, 18 nt, Bordetella pertussis
gccugcggcaggccgcag

SEQ ID NO: 2432154 - RNA, 19 nt, Bordetella pertussis
gccugcggcaggccgcagc

SEQ ID NO: 2432155 - RNA, 18 nt, Bordetella pertussis
gccugcggcgccagcgcc

SEQ ID NO: 2432156 - RNA, 12 nt, Bordetella pertussis
gccugcggcguc

SEQ ID NO: 2432157 - RNA, 15 nt, Bordetella pertussis
gccugcggcucgagg

SEQ ID NO: 2432158 - RNA, 22 nt, Bordetella pertussis
gccugcggcucgaggaaccagc

SEQ ID NO: 2432159 - RNA, 21 nt, Bordetella pertussis
gccugcgggccgggcaggccg

SEQ ID NO: 2432160 - RNA, 19 nt, Bordetella pertussis
gccugcgggcugaugcagg

SEQ ID NO: 2432161 - RNA, 20 nt, Bordetella pertussis
gccugcgggugcgccugcag

SEQ ID NO: 2432162 - RNA, 21 nt, Bordetella pertussis
gccugcgggugcgccugcagc

SEQ ID NO: 2432163 - RNA, 22 nt, Bordetella pertussis
gccugcgggugcgccugcagcg

SEQ ID NO: 2432164 - RNA, 15 nt, Bordetella pertussis
gccugcgucgccacc

SEQ ID NO: 2432165 - RNA, 20 nt, Bordetella pertussis
gccugcguggcgggccgcgc

SEQ ID NO: 2432166 - RNA, 22 nt, Bordetella pertussis
gccugcguggcgggccgcgccg

SEQ ID NO: 2432167 - RNA, 17 nt, Bordetella pertussis
gccugcgugucaggcgg

SEQ ID NO: 2432168 - RNA, 20 nt, Bordetella pertussis
gccugcguugcgaucagcgc

SEQ ID NO: 2432169 - RNA, 23 nt, Bordetella pertussis
gccugcucacgccccgcccucuu

SEQ ID NO: 2432170 - RNA, 23 nt, Bordetella pertussis
gccugcuccggcgugauggacgc

SEQ ID NO: 2432171 - RNA, 16 nt, Bordetella pertussis
gccugcucgaccugcu

SEQ ID NO: 2432172 - RNA, 15 nt, Bordetella pertussis
gccugcucgcaggcc

SEQ ID NO: 2432173 - RNA, 22 nt, Bordetella pertussis
gccugcucgccggccagcgcgg

SEQ ID NO: 2432174 - RNA, 15 nt, Bordetella pertussis
gccugcucgggcgcc

SEQ ID NO: 2432175 - RNA, 16 nt, Bordetella pertussis
gccugcucgggcgccu

SEQ ID NO: 2432176 - RNA, 13 nt, Bordetella pertussis
gccugcugcagcg

SEQ ID NO: 2432177 - RNA, 16 nt, Bordetella pertussis
gccugcugcagcguga

SEQ ID NO: 2432178 - RNA, 17 nt, Bordetella pertussis
gccugcugcgccuggcc

SEQ ID NO: 2432179 - RNA, 18 nt, Bordetella pertussis
gccugcugcgccuggccg

SEQ ID NO: 2432180 - RNA, 20 nt, Bordetella pertussis
gccugcugggccgcgcucga

SEQ ID NO: 2432181 - RNA, 15 nt, Bordetella pertussis
gccugcuggugcugg

SEQ ID NO: 2432182 - RNA, 15 nt, Bordetella pertussis
gccugcuugaagacg

SEQ ID NO: 2432183 - RNA, 20 nt, Bordetella pertussis
gccugcuugaagacgcccag

SEQ ID NO: 2432184 - RNA, 13 nt, Bordetella pertussis
gccugcuugcagg

SEQ ID NO: 2432185 - RNA, 18 nt, Bordetella pertussis
gccugcuugcaggaagcg

SEQ ID NO: 2432186 - RNA, 13 nt, Bordetella pertussis
gccugcuuggcag

SEQ ID NO: 2432187 - RNA, 15 nt, Bordetella pertussis
gccugcuuggcagcc

SEQ ID NO: 2432188 - RNA, 19 nt, Bordetella pertussis
gccugcuuggccgcguaca

SEQ ID NO: 2432189 - RNA, 15 nt, Bordetella pertussis
gccugcuuggcgcgc

SEQ ID NO: 2432190 - RNA, 18 nt, Bordetella pertussis
gccugcuuguacaggcgc

SEQ ID NO: 2432191 - RNA, 22 nt, Bordetella pertussis
gccugcuuguacaggcgcggca

SEQ ID NO: 2432192 - RNA, 24 nt, Bordetella pertussis
gccugcuuguacaggcgcggcacg

SEQ ID NO: 2432193 - RNA, 17 nt, Bordetella pertussis
gccuggaacauggcccg

SEQ ID NO: 2432194 - RNA, 14 nt, Bordetella pertussis
gccuggaagcuggc

SEQ ID NO: 2432195 - RNA, 15 nt, Bordetella pertussis
gccuggaagcuggcc

SEQ ID NO: 2432196 - RNA, 17 nt, Bordetella pertussis
gccuggaagcuggccag

SEQ ID NO: 2432197 - RNA, 19 nt, Bordetella pertussis
gccuggaagcuggccagcg

SEQ ID NO: 2432198 - RNA, 21 nt, Bordetella pertussis
gccuggaagugaugccgccgg

SEQ ID NO: 2432199 - RNA, 22 nt, Bordetella pertussis
gccuggaagugaugccgccggc

SEQ ID NO: 2432200 - RNA, 13 nt, Bordetella pertussis
gccuggaccggcu

SEQ ID NO: 2432201 - RNA, 14 nt, Bordetella pertussis
gccuggaccggcuc

SEQ ID NO: 2432202 - RNA, 19 nt, Bordetella pertussis
gccuggaccugacccccga

SEQ ID NO: 2432203 - RNA, 15 nt, Bordetella pertussis
gccuggaccugagcc

SEQ ID NO: 2432204 - RNA, 15 nt, Bordetella pertussis
gccuggaccuggacg

SEQ ID NO: 2432205 - RNA, 16 nt, Bordetella pertussis
gccuggaccuggacga

SEQ ID NO: 2432206 - RNA, 20 nt, Bordetella pertussis
gccuggaccuggacgagggc

SEQ ID NO: 2432207 - RNA, 13 nt, Bordetella pertussis
gccuggacgcgcu

SEQ ID NO: 2432208 - RNA, 16 nt, Bordetella pertussis
gccuggacgcgcuggc

SEQ ID NO: 2432209 - RNA, 18 nt, Bordetella pertussis
gccuggacgcgcuggccg

SEQ ID NO: 2432210 - RNA, 16 nt, Bordetella pertussis
gccuggacggcgagga

SEQ ID NO: 2432211 - RNA, 21 nt, Bordetella pertussis
gccuggagacuggcaccggcc

SEQ ID NO: 2432212 - RNA, 16 nt, Bordetella pertussis
gccuggaggccgagcg

SEQ ID NO: 2432213 - RNA, 17 nt, Bordetella pertussis
gccuggaggccgagcgc

SEQ ID NO: 2432214 - RNA, 19 nt, Bordetella pertussis
gccuggaggccgagcgcga

SEQ ID NO: 2432215 - RNA, 18 nt, Bordetella pertussis
gccuggaugugcaggccg

SEQ ID NO: 2432216 - RNA, 19 nt, Bordetella pertussis
gccuggcacaucggcccug

SEQ ID NO: 2432217 - RNA, 20 nt, Bordetella pertussis
gccuggcacaucggcccugg

SEQ ID NO: 2432218 - RNA, 22 nt, Bordetella pertussis
gccuggcacaucggcccuggca

SEQ ID NO: 2432219 - RNA, 17 nt, Bordetella pertussis
gccuggcacgacguggc

SEQ ID NO: 2432220 - RNA, 19 nt, Bordetella pertussis
gccuggcagaugcgcgcca

SEQ ID NO: 2432221 - RNA, 20 nt, Bordetella pertussis
gccuggcagaugcgcgccag

SEQ ID NO: 2432222 - RNA, 22 nt, Bordetella pertussis
gccuggcagaugcgcgccaggc

SEQ ID NO: 2432223 - RNA, 23 nt, Bordetella pertussis
gccuggucgaaguagaacgccgg

SEQ ID NO: 2432224 - RNA, 17 nt, Bordetella pertussis
gccuggucgacgccggc

SEQ ID NO: 2432225 - RNA, 19 nt, Bordetella pertussis
gccuggucgacgccggcga

SEQ ID NO: 2432226 - RNA, 17 nt, Bordetella pertussis
gccuggucgagcgggcg

SEQ ID NO: 2432227 - RNA, 14 nt, Bordetella pertussis
gccuggucgcgcgc

SEQ ID NO: 2432228 - RNA, 16 nt, Bordetella pertussis
gccuggucgcgcgccu

SEQ ID NO: 2432229 - RNA, 18 nt, Bordetella pertussis
gccuggucgcgcgccugc

SEQ ID NO: 2432230 - RNA, 17 nt, Bordetella pertussis
gccuggucgcuggcgcc

SEQ ID NO: 2432231 - RNA, 19 nt, Bordetella pertussis
gccuggucggggucggcca

SEQ ID NO: 2432232 - RNA, 22 nt, Bordetella pertussis
gccuggucggggucggccacca

SEQ ID NO: 2432233 - RNA, 14 nt, Bordetella pertussis
gccuggugcccgac

SEQ ID NO: 2432234 - RNA, 16 nt, Bordetella pertussis
gccuggugcccgacgc

SEQ ID NO: 2432235 - RNA, 16 nt, Bordetella pertussis
gccugguuagagcagc

SEQ ID NO: 2432236 - RNA, 18 nt, Bordetella pertussis
gccugguuggccgccugg

SEQ ID NO: 2432237 - RNA, 16 nt, Bordetella pertussis
gccuguaucagcgccu

SEQ ID NO: 2432238 - RNA, 18 nt, Bordetella pertussis
gccuguaucagcgccugc

SEQ ID NO: 2432239 - RNA, 20 nt, Bordetella pertussis
gccugucacaccccaccacg

SEQ ID NO: 2432240 - RNA, 19 nt, Bordetella pertussis
gccugucccaaccgggaca

SEQ ID NO: 2432241 - RNA, 20 nt, Bordetella pertussis
gccugucccaaccgggacag

SEQ ID NO: 2432242 - RNA, 19 nt, Bordetella pertussis
gccugucccagcggggaca

SEQ ID NO: 2432243 - RNA, 18 nt, Bordetella pertussis
gccuguccccacaggggg

SEQ ID NO: 2432244 - RNA, 15 nt, Bordetella pertussis
gccuguccccacaug

SEQ ID NO: 2432245 - RNA, 15 nt, Bordetella pertussis
gccuguccccaccgg

SEQ ID NO: 2432246 - RNA, 19 nt, Bordetella pertussis
gccuguccccaccgggaca

SEQ ID NO: 2432247 - RNA, 20 nt, Bordetella pertussis
gccuguccccaccgggacag

SEQ ID NO: 2432248 - RNA, 24 nt, Bordetella pertussis
gccuguccccaccgggacaggcac

SEQ ID NO: 2432249 - RNA, 20 nt, Bordetella pertussis
gccuguccccacggggacag

SEQ ID NO: 2432250 - RNA, 24 nt, Bordetella pertussis
gccuguccccacguggacaggcac

SEQ ID NO: 2432251 - RNA, 20 nt, Bordetella pertussis
gccuguccccacugggggac

SEQ ID NO: 2432252 - RNA, 19 nt, Bordetella pertussis
gccuguccccccaugggga

SEQ ID NO: 2432253 - RNA, 16 nt, Bordetella pertussis
gccuguccccgcacgg

SEQ ID NO: 2432254 - RNA, 21 nt, Bordetella pertussis
gccuguccccgcacggggaca

SEQ ID NO: 2432255 - RNA, 16 nt, Bordetella pertussis
gccuguccccgcagga

SEQ ID NO: 2432256 - RNA, 19 nt, Bordetella pertussis
gccuguccccgcaggagca

SEQ ID NO: 2432257 - RNA, 24 nt, Bordetella pertussis
gccuguccccgcagggacaggcac

SEQ ID NO: 2432258 - RNA, 15 nt, Bordetella pertussis
gccuguccccgccgg

SEQ ID NO: 2432259 - RNA, 20 nt, Bordetella pertussis
gccuguccccgccgggacag

SEQ ID NO: 2432260 - RNA, 17 nt, Bordetella pertussis
gccuguccccgccgggg

SEQ ID NO: 2432261 - RNA, 18 nt, Bordetella pertussis
gccuguccccgccggggc

SEQ ID NO: 2432262 - RNA, 20 nt, Bordetella pertussis
gccuguccccgccggggcag

SEQ ID NO: 2432263 - RNA, 23 nt, Bordetella pertussis
gccuguccccgccggggcaggcu

SEQ ID NO: 2432264 - RNA, 17 nt, Bordetella pertussis
gccuguccccgcgggga

SEQ ID NO: 2432265 - RNA, 19 nt, Bordetella pertussis
gccuguccccgcggggaca

SEQ ID NO: 2432266 - RNA, 24 nt, Bordetella pertussis
gccuguccccgcggggacaggcac

SEQ ID NO: 2432267 - RNA, 23 nt, Bordetella pertussis
gccuguccccgcggggacuggcu

SEQ ID NO: 2432268 - RNA, 15 nt, Bordetella pertussis
gccuguccccgcugg

SEQ ID NO: 2432269 - RNA, 20 nt, Bordetella pertussis
gccuguccccgcugggacag

SEQ ID NO: 2432270 - RNA, 24 nt, Bordetella pertussis
gccuguccccgcugggacaggcac

SEQ ID NO: 2432271 - RNA, 15 nt, Bordetella pertussis
gccuguccccgucgg

SEQ ID NO: 2432272 - RNA, 17 nt, Bordetella pertussis
gccuguccccgugggga

SEQ ID NO: 2432273 - RNA, 19 nt, Bordetella pertussis
gccuguccccguggggaca

SEQ ID NO: 2432274 - RNA, 20 nt, Bordetella pertussis
gccuguccccguggggacag

SEQ ID NO: 2432275 - RNA, 19 nt, Bordetella pertussis
gccugucccgacggggaca

SEQ ID NO: 2432276 - RNA, 15 nt, Bordetella pertussis
gccugucccgcacgc

SEQ ID NO: 2432277 - RNA, 14 nt, Bordetella pertussis
gccugucccggcug

SEQ ID NO: 2432278 - RNA, 17 nt, Bordetella pertussis
gccugucccggcuggga

SEQ ID NO: 2432279 - RNA, 19 nt, Bordetella pertussis
gccugucccugaacguggc

SEQ ID NO: 2432280 - RNA, 23 nt, Bordetella pertussis
gccugucccugaacguggcgucc

SEQ ID NO: 2432281 - RNA, 15 nt, Bordetella pertussis
gccugucccugccgg

SEQ ID NO: 2432282 - RNA, 18 nt, Bordetella pertussis
gccugucccugccgggac

SEQ ID NO: 2432283 - RNA, 19 nt, Bordetella pertussis
gccugucccugcggggacu

SEQ ID NO: 2432284 - RNA, 20 nt, Bordetella pertussis
gccugucccugcgggggcag

SEQ ID NO: 2432285 - RNA, 22 nt, Bordetella pertussis
gccugucccugcgggggcaggc

SEQ ID NO: 2432286 - RNA, 13 nt, Bordetella pertussis
gccugucguucgg

SEQ ID NO: 2432287 - RNA, 23 nt, Bordetella pertussis
gccugucugguggcgauccaugu

SEQ ID NO: 2432288 - RNA, 24 nt, Bordetella pertussis
gccugucuguuugcgcaguggcga

SEQ ID NO: 2432289 - RNA, 14 nt, Bordetella pertussis
gccugugccagcug

SEQ ID NO: 2432290 - RNA, 17 nt, Bordetella pertussis
gccugugcccgcagagg

SEQ ID NO: 2432291 - RNA, 14 nt, Bordetella pertussis
gccuguucccgccg

SEQ ID NO: 2432292 - RNA, 23 nt, Bordetella pertussis
gccuguucccgccgggccaaggu

SEQ ID NO: 2432293 - RNA, 23 nt, Bordetella pertussis
gccuguucgcggugucgcaccgc

SEQ ID NO: 2432294 - RNA, 20 nt, Bordetella pertussis
gccuguucggacgcaccuuu

SEQ ID NO: 2432295 - RNA, 14 nt, Bordetella pertussis
gccuguucggccgg

SEQ ID NO: 2432296 - RNA, 17 nt, Bordetella pertussis
gccuguuuuggcgcacg

SEQ ID NO: 2432297 - RNA, 18 nt, Bordetella pertussis
gccuguuuuggcgcacgc

SEQ ID NO: 2432298 - RNA, 21 nt, Bordetella pertussis
gccuguuuuggcgcacgccgg

SEQ ID NO: 2432299 - RNA, 21 nt, Bordetella pertussis
gccuuacuucuugcgcaucgg

SEQ ID NO: 2432300 - RNA, 16 nt, Bordetella pertussis
gccuucaccccgccac

SEQ ID NO: 2432301 - RNA, 22 nt, Bordetella pertussis
gccuucaccuugccgcugguga

SEQ ID NO: 2432302 - RNA, 16 nt, Bordetella pertussis
gccuucagcgggccgg

SEQ ID NO: 2432303 - RNA, 22 nt, Bordetella pertussis
gccuucauggcgucguccagcu

SEQ ID NO: 2432304 - RNA, 19 nt, Bordetella pertussis
gccuucauuuccugguuca

SEQ ID NO: 2432305 - RNA, 23 nt, Bordetella pertussis
gccuuccaaguugcucauggcgg

SEQ ID NO: 2432306 - RNA, 16 nt, Bordetella pertussis
gccuuccaccagccgu

SEQ ID NO: 2432307 - RNA, 14 nt, Bordetella pertussis
gccuucccaggcga

SEQ ID NO: 2432308 - RNA, 16 nt, Bordetella pertussis
gccuucccggccgaaa

SEQ ID NO: 2432309 - RNA, 22 nt, Bordetella pertussis
gccuucccggccgaaaccgccg

SEQ ID NO: 2432310 - RNA, 23 nt, Bordetella pertussis
gccuucccggccgaaaccgccgc

SEQ ID NO: 2432311 - RNA, 14 nt, Bordetella pertussis
gccuuccggcagcg

SEQ ID NO: 2432312 - RNA, 18 nt, Bordetella pertussis
gccuuccggcagcggcca

SEQ ID NO: 2432313 - RNA, 19 nt, Bordetella pertussis
gccuuccggcagcggccag

SEQ ID NO: 2432314 - RNA, 18 nt, Bordetella pertussis
gccuuccugggcgccggc

SEQ ID NO: 2432315 - RNA, 17 nt, Bordetella pertussis
gccuucgaccugcccga

SEQ ID NO: 2432316 - RNA, 20 nt, Bordetella pertussis
gccuucgagcaccaugccgg

SEQ ID NO: 2432317 - RNA, 19 nt, Bordetella pertussis
gccuucgagcugcacccac

SEQ ID NO: 2432318 - RNA, 22 nt, Bordetella pertussis
gccuucgaucuucucgccgcgc

SEQ ID NO: 2432319 - RNA, 16 nt, Bordetella pertussis
gccuucgcgauccagc

SEQ ID NO: 2432320 - RNA, 18 nt, Bordetella pertussis
gccuucgcgauccagcag

SEQ ID NO: 2432321 - RNA, 19 nt, Bordetella pertussis
gccuucgcgauccagcagc

SEQ ID NO: 2432322 - RNA, 22 nt, Bordetella pertussis
gccuucgcugacgcguucuuca

SEQ ID NO: 2432323 - RNA, 19 nt, Bordetella pertussis
gccuucggcaggcgccggc

SEQ ID NO: 2432324 - RNA, 20 nt, Bordetella pertussis
gccuucggcaggcgccggcu

SEQ ID NO: 2432325 - RNA, 13 nt, Bordetella pertussis
gccuucggccggc

SEQ ID NO: 2432326 - RNA, 14 nt, Bordetella pertussis
gccuucggccggcu

SEQ ID NO: 2432327 - RNA, 20 nt, Bordetella pertussis
gccuucggccggcugcgcgc

SEQ ID NO: 2432328 - RNA, 16 nt, Bordetella pertussis
gccuucggcgaucugg

SEQ ID NO: 2432329 - RNA, 14 nt, Bordetella pertussis
gccuucggcggcga

SEQ ID NO: 2432330 - RNA, 14 nt, Bordetella pertussis
gccuucggcggcgg

SEQ ID NO: 2432331 - RNA, 15 nt, Bordetella pertussis
gccuucggcggcggg

SEQ ID NO: 2432332 - RNA, 22 nt, Bordetella pertussis
gccuucgggcgguuuuuucuug

SEQ ID NO: 2432333 - RNA, 14 nt, Bordetella pertussis
gccuucggguugca

SEQ ID NO: 2432334 - RNA, 16 nt, Bordetella pertussis
gcgaagccacggcccg

SEQ ID NO: 2432335 - RNA, 21 nt, Bordetella pertussis
gcgaagccacggcccgccagg

SEQ ID NO: 2432336 - RNA, 22 nt, Bordetella pertussis
gcgaagccacggcccgccagga

SEQ ID NO: 2432337 - RNA, 22 nt, Bordetella pertussis
gcgaagccggcacgccugccgc

SEQ ID NO: 2432338 - RNA, 22 nt, Bordetella pertussis
gcgaagccuucuucugcaucgg

SEQ ID NO: 2432339 - RNA, 14 nt, Bordetella pertussis
gcgaagccuugcgc

SEQ ID NO: 2432340 - RNA, 17 nt, Bordetella pertussis
gcgaagcgcccuggcgu

SEQ ID NO: 2432341 - RNA, 12 nt, Bordetella pertussis
gcgaagcgcgcc

SEQ ID NO: 2432342 - RNA, 13 nt, Bordetella pertussis
gcgaagcgcgccu

SEQ ID NO: 2432343 - RNA, 14 nt, Bordetella pertussis
gcgaagcgcgccuc

SEQ ID NO: 2432344 - RNA, 19 nt, Bordetella pertussis
gcgaagcgcgggaagcgcu

SEQ ID NO: 2432345 - RNA, 22 nt, Bordetella pertussis
gcgaagcuguccuucguggcgc

SEQ ID NO: 2432346 - RNA, 15 nt, Bordetella pertussis
gcgaaggccagcgcc

SEQ ID NO: 2432347 - RNA, 19 nt, Bordetella pertussis
gcgaaggccgccgcgccca

SEQ ID NO: 2432348 - RNA, 21 nt, Bordetella pertussis
gcgaaggccgccgcgcccagc

SEQ ID NO: 2432349 - RNA, 13 nt, Bordetella pertussis
gcgaaggcgcggc

SEQ ID NO: 2432350 - RNA, 13 nt, Bordetella pertussis
gcgaaggcgucgg

SEQ ID NO: 2432351 - RNA, 14 nt, Bordetella pertussis
gcgaaggggcgcau

SEQ ID NO: 2432352 - RNA, 18 nt, Bordetella pertussis
gcgaaggugcggaucacg

SEQ ID NO: 2432353 - RNA, 20 nt, Bordetella pertussis
gcgaauaugcccucuucggc

SEQ ID NO: 2432354 - RNA, 19 nt, Bordetella pertussis
gcgaaucaguucgcgcagg

SEQ ID NO: 2432355 - RNA, 20 nt, Bordetella pertussis
gcgaaucaguucgcgcaggc

SEQ ID NO: 2432356 - RNA, 15 nt, Bordetella pertussis
gcgaauccaccggcg

SEQ ID NO: 2432357 - RNA, 20 nt, Bordetella pertussis
gcgaauccaccggcgcgcgc

SEQ ID NO: 2432358 - RNA, 20 nt, Bordetella pertussis
gcgaauccgcaacccagcag

SEQ ID NO: 2432359 - RNA, 15 nt, Bordetella pertussis
gcgaaugccugguag

SEQ ID NO: 2432360 - RNA, 14 nt, Bordetella pertussis
gcgaaugcgacagc

SEQ ID NO: 2432361 - RNA, 16 nt, Bordetella pertussis
gcgaaugcgcguaguc

SEQ ID NO: 2432362 - RNA, 14 nt, Bordetella pertussis
gcgaaugcguguuc

SEQ ID NO: 2432363 - RNA, 15 nt, Bordetella pertussis
gcgaauggccacggc

SEQ ID NO: 2432364 - RNA, 21 nt, Bordetella pertussis
gcgacaaauagccgaccgcgc

SEQ ID NO: 2432365 - RNA, 23 nt, Bordetella pertussis
gcgacaaauagccgaccgcgcgc

SEQ ID NO: 2432366 - RNA, 22 nt, Bordetella pertussis
gcgacaacaggucguggcccag

SEQ ID NO: 2432367 - RNA, 17 nt, Bordetella pertussis
gcgacaaccgcggcgac

SEQ ID NO: 2432368 - RNA, 16 nt, Bordetella pertussis
gcgacacaaggcggcc

SEQ ID NO: 2432369 - RNA, 17 nt, Bordetella pertussis
gcgacacaaggcggccg

SEQ ID NO: 2432370 - RNA, 18 nt, Bordetella pertussis
gcgacacaaggcggccgc

SEQ ID NO: 2432371 - RNA, 20 nt, Bordetella pertussis
gcgacacaaggcggccgcgc

SEQ ID NO: 2432372 - RNA, 16 nt, Bordetella pertussis
gcgacacccccagggc

SEQ ID NO: 2432373 - RNA, 18 nt, Bordetella pertussis
gcgacacccccagggcgc

SEQ ID NO: 2432374 - RNA, 19 nt, Bordetella pertussis
gcgacacccccagggcgcg

SEQ ID NO: 2432375 - RNA, 20 nt, Bordetella pertussis
gcgacacccccagggcgcgc

SEQ ID NO: 2432376 - RNA, 21 nt, Bordetella pertussis
gcgacacccccagggcgcgcc

SEQ ID NO: 2432377 - RNA, 14 nt, Bordetella pertussis
gcgacacccgcggc

SEQ ID NO: 2432378 - RNA, 17 nt, Bordetella pertussis
gcgacacccgcggccag

SEQ ID NO: 2432379 - RNA, 18 nt, Bordetella pertussis
gcgacaccgcggccuugc

SEQ ID NO: 2432380 - RNA, 12 nt, Bordetella pertussis
gcgacagcagca

SEQ ID NO: 2432381 - RNA, 12 nt, Bordetella pertussis
gcgacagcaggc

SEQ ID NO: 2432382 - RNA, 13 nt, Bordetella pertussis
gcgacagcaggcc

SEQ ID NO: 2432383 - RNA, 16 nt, Bordetella pertussis
gcgacagcaggccggu

SEQ ID NO: 2432384 - RNA, 18 nt, Bordetella pertussis
gcgacagcaggccgguca

SEQ ID NO: 2432385 - RNA, 15 nt, Bordetella pertussis
gcgacagcagggcca

SEQ ID NO: 2432386 - RNA, 16 nt, Bordetella pertussis
gcgacagcagggccag

SEQ ID NO: 2432387 - RNA, 18 nt, Bordetella pertussis
gcgacagcagggccaggc

SEQ ID NO: 2432388 - RNA, 19 nt, Bordetella pertussis
gcgacagcagggccaggcc

SEQ ID NO: 2432389 - RNA, 14 nt, Bordetella pertussis
gcgacagccaggcc

SEQ ID NO: 2432390 - RNA, 15 nt, Bordetella pertussis
gcgacagccaggcca

SEQ ID NO: 2432391 - RNA, 19 nt, Bordetella pertussis
gcgacagccaggccagcgc

SEQ ID NO: 2432392 - RNA, 22 nt, Bordetella pertussis
gcgacagccaggccagcgccag

SEQ ID NO: 2432393 - RNA, 13 nt, Bordetella pertussis
gcgacagccgcgc

SEQ ID NO: 2432394 - RNA, 15 nt, Bordetella pertussis
gcgacagccgcgcca

SEQ ID NO: 2432395 - RNA, 15 nt, Bordetella pertussis
gcgacagcgacagcc

SEQ ID NO: 2432396 - RNA, 13 nt, Bordetella pertussis
gcgacagcgcugg

SEQ ID NO: 2432397 - RNA, 21 nt, Bordetella pertussis
gcgacagcgcugguggccaga

SEQ ID NO: 2432398 - RNA, 21 nt, Bordetella pertussis
gcgacagcuugaugggcgagg

SEQ ID NO: 2432399 - RNA, 23 nt, Bordetella pertussis
gcgacagcuugaugggcgaggcg

SEQ ID NO: 2432400 - RNA, 19 nt, Bordetella pertussis
gcgacaggcccgcggccgc

SEQ ID NO: 2432401 - RNA, 18 nt, Bordetella pertussis
gcgacaggcgcagcucga

SEQ ID NO: 2432402 - RNA, 14 nt, Bordetella pertussis
gcgacaggcgcgcc

SEQ ID NO: 2432403 - RNA, 14 nt, Bordetella pertussis
gcgacaggcggugc

SEQ ID NO: 2432404 - RNA, 21 nt, Bordetella pertussis
gcgacaggcggugcgcgcggc

SEQ ID NO: 2432405 - RNA, 22 nt, Bordetella pertussis
gcgacaggcggugcgcgcggcc

SEQ ID NO: 2432406 - RNA, 23 nt, Bordetella pertussis
gcgacaggcggugcgcgcggccg

SEQ ID NO: 2432407 - RNA, 16 nt, Bordetella pertussis
gcgacauagcgcugga

SEQ ID NO: 2432408 - RNA, 16 nt, Bordetella pertussis
gcgacaugacgauggu

SEQ ID NO: 2432409 - RNA, 15 nt, Bordetella pertussis
gcgacaugagcugcg

SEQ ID NO: 2432410 - RNA, 16 nt, Bordetella pertussis
gcgacaugucgccgcg

SEQ ID NO: 2432411 - RNA, 13 nt, Bordetella pertussis
gcgaccaccagca

SEQ ID NO: 2432412 - RNA, 15 nt, Bordetella pertussis
gcgaccaccagcacc

SEQ ID NO: 2432413 - RNA, 16 nt, Bordetella pertussis
gcgaccaccagcacca

SEQ ID NO: 2432414 - RNA, 16 nt, Bordetella pertussis
gcgaccaccaggucgu

SEQ ID NO: 2432415 - RNA, 16 nt, Bordetella pertussis
gcgaccacggucuggc

SEQ ID NO: 2432416 - RNA, 19 nt, Bordetella pertussis
gcgaccacggucuggcgcg

SEQ ID NO: 2432417 - RNA, 21 nt, Bordetella pertussis
gcgaccacggucuggcgcgac

SEQ ID NO: 2432418 - RNA, 19 nt, Bordetella pertussis
gcgaccacuaucagcgcgu

SEQ ID NO: 2432419 - RNA, 15 nt, Bordetella pertussis
gcgaccacuggcaga

SEQ ID NO: 2432420 - RNA, 16 nt, Bordetella pertussis
gcgaccaggcccacga

SEQ ID NO: 2432421 - RNA, 18 nt, Bordetella pertussis
gcgaccaggcccauggcg

SEQ ID NO: 2432422 - RNA, 20 nt, Bordetella pertussis
gcgaccaggcuggagucggg

SEQ ID NO: 2432423 - RNA, 21 nt, Bordetella pertussis
gcgaccaggcuggagucgggc

SEQ ID NO: 2432424 - RNA, 17 nt, Bordetella pertussis
gcgaccaggugcgggcc

SEQ ID NO: 2432425 - RNA, 13 nt, Bordetella pertussis
gcgaccaugcggc

SEQ ID NO: 2432426 - RNA, 17 nt, Bordetella pertussis
gcgaccaugcggccguc

SEQ ID NO: 2432427 - RNA, 16 nt, Bordetella pertussis
gcgacccagaacccgg

SEQ ID NO: 2432428 - RNA, 21 nt, Bordetella pertussis
gcgacccagaacccggccggc

SEQ ID NO: 2432429 - RNA, 22 nt, Bordetella pertussis
gcgacccagaacccggccggcg

SEQ ID NO: 2432430 - RNA, 18 nt, Bordetella pertussis
gcgacccgauagccgcgc

SEQ ID NO: 2432431 - RNA, 20 nt, Bordetella pertussis
gcgacccgauagccgcgcgc

SEQ ID NO: 2432432 - RNA, 21 nt, Bordetella pertussis
gcgacccgauagccgcgcgcc

SEQ ID NO: 2432433 - RNA, 23 nt, Bordetella pertussis
gcgacccgauagccgcgcgccug

SEQ ID NO: 2432434 - RNA, 23 nt, Bordetella pertussis
gcgacccgcaaaaccgggcccgg

SEQ ID NO: 2432435 - RNA, 14 nt, Bordetella pertussis
gcgacccguggccc

SEQ ID NO: 2432436 - RNA, 17 nt, Bordetella pertussis
gcgacccguggcccggg

SEQ ID NO: 2432437 - RNA, 23 nt, Bordetella pertussis
gcgacccuuucauuucggcgccg

SEQ ID NO: 2432438 - RNA, 12 nt, Bordetella pertussis
gcgaccgacggc

SEQ ID NO: 2432439 - RNA, 14 nt, Bordetella pertussis
gcgaccgccgcggg

SEQ ID NO: 2432440 - RNA, 15 nt, Bordetella pertussis
gcgaccgccggccgg

SEQ ID NO: 2432441 - RNA, 18 nt, Bordetella pertussis
gcgaccgccggccggugc

SEQ ID NO: 2432442 - RNA, 14 nt, Bordetella pertussis
gcgaccgccuccag

SEQ ID NO: 2432443 - RNA, 22 nt, Bordetella pertussis
gcgaccgccuccagcgcggcgg

SEQ ID NO: 2432444 - RNA, 14 nt, Bordetella pertussis
gcgaccgcgaaccg

SEQ ID NO: 2432445 - RNA, 13 nt, Bordetella pertussis
gcgaccgcgcggc

SEQ ID NO: 2432446 - RNA, 16 nt, Bordetella pertussis
gcgaccgcgcggcgcu

SEQ ID NO: 2432447 - RNA, 13 nt, Bordetella pertussis
gcgagaucagcac

SEQ ID NO: 2432448 - RNA, 16 nt, Bordetella pertussis
gcgagaucagcaccgc

SEQ ID NO: 2432449 - RNA, 20 nt, Bordetella pertussis
gcgagaucaucgaggcaauc

SEQ ID NO: 2432450 - RNA, 20 nt, Bordetella pertussis
gcgagcaaaggacacgcgcg

SEQ ID NO: 2432451 - RNA, 15 nt, Bordetella pertussis
gcgagcacccgcagg

SEQ ID NO: 2432452 - RNA, 16 nt, Bordetella pertussis
gcgagcacggcguggc

SEQ ID NO: 2432453 - RNA, 22 nt, Bordetella pertussis
gcgagcacggcguggcgcgcac

SEQ ID NO: 2432454 - RNA, 17 nt, Bordetella pertussis
gcgagcagaugcaccgg

SEQ ID NO: 2432455 - RNA, 18 nt, Bordetella pertussis
gcgagcagaugcaccggc

SEQ ID NO: 2432456 - RNA, 14 nt, Bordetella pertussis
gcgagcaggcccgu

SEQ ID NO: 2432457 - RNA, 15 nt, Bordetella pertussis
gcgagcaugcgcagc

SEQ ID NO: 2432458 - RNA, 16 nt, Bordetella pertussis
gcgagcaugcgcagcg

SEQ ID NO: 2432459 - RNA, 17 nt, Bordetella pertussis
gcgagcaugcgcagcgc

SEQ ID NO: 2432460 - RNA, 19 nt, Bordetella pertussis
gcgagcaugcgcagcgcgu

SEQ ID NO: 2432461 - RNA, 14 nt, Bordetella pertussis
gcgagcauggcggu

SEQ ID NO: 2432462 - RNA, 22 nt, Bordetella pertussis
gcgagcauggcgguggccagcg

SEQ ID NO: 2432463 - RNA, 17 nt, Bordetella pertussis
gcgagcccaucaggugg

SEQ ID NO: 2432464 - RNA, 19 nt, Bordetella pertussis
gcgagcccaucaggugggc

SEQ ID NO: 2432465 - RNA, 22 nt, Bordetella pertussis
gcgagcccgcgucagacgcgcu

SEQ ID NO: 2432466 - RNA, 20 nt, Bordetella pertussis
gcgagccgauggcauggggc

SEQ ID NO: 2432467 - RNA, 14 nt, Bordetella pertussis
gcgagccgcccacg

SEQ ID NO: 2432468 - RNA, 15 nt, Bordetella pertussis
gcgagccgcccacgg

SEQ ID NO: 2432469 - RNA, 15 nt, Bordetella pertussis
gcgagccgggcaccg

SEQ ID NO: 2432470 - RNA, 22 nt, Bordetella pertussis
gcgagccgggcaccgagccgca

SEQ ID NO: 2432471 - RNA, 13 nt, Bordetella pertussis
gcgagccuucggc

SEQ ID NO: 2432472 - RNA, 16 nt, Bordetella pertussis
gcgagccuucggccgg

SEQ ID NO: 2432473 - RNA, 17 nt, Bordetella pertussis
gcgagccuucggccggc

SEQ ID NO: 2432474 - RNA, 21 nt, Bordetella pertussis
gcgagcgaaagccgucggcca

SEQ ID NO: 2432475 - RNA, 22 nt, Bordetella pertussis
gcgagcgaaagccgucggccac

SEQ ID NO: 2432476 - RNA, 14 nt, Bordetella pertussis
gcgagcgaugcccu

SEQ ID NO: 2432477 - RNA, 16 nt, Bordetella pertussis
gcgagcgaugcccugg

SEQ ID NO: 2432478 - RNA, 22 nt, Bordetella pertussis
gcgagcgcaagcaccgccugcu

SEQ ID NO: 2432479 - RNA, 22 nt, Bordetella pertussis
gcgagcgcacaggcggcgccgg

SEQ ID NO: 2432480 - RNA, 13 nt, Bordetella pertussis
gcgagcgccgcca

SEQ ID NO: 2432481 - RNA, 18 nt, Bordetella pertussis
gcgagcgccgccaggccg

SEQ ID NO: 2432482 - RNA, 19 nt, Bordetella pertussis
gcgagcgccgccaggccgu

SEQ ID NO: 2432483 - RNA, 12 nt, Bordetella pertussis
gcgagcgccgcg

SEQ ID NO: 2432484 - RNA, 13 nt, Bordetella pertussis
gcgagcgccgggc

SEQ ID NO: 2432485 - RNA, 22 nt, Bordetella pertussis
gcgagcgccgggcgccgcgccc

SEQ ID NO: 2432486 - RNA, 13 nt, Bordetella pertussis
gcgagcgccucgc

SEQ ID NO: 2432487 - RNA, 20 nt, Bordetella pertussis
gcgagcgcggcgauacgcgc

SEQ ID NO: 2432488 - RNA, 15 nt, Bordetella pertussis
gcgagcgcggcgcgc

SEQ ID NO: 2432489 - RNA, 18 nt, Bordetella pertussis
gcgagcgcggcgcgcgcc

SEQ ID NO: 2432490 - RNA, 13 nt, Bordetella pertussis
gcgagcggccagc

SEQ ID NO: 2432491 - RNA, 17 nt, Bordetella pertussis
gcgagcggcggccgcgu

SEQ ID NO: 2432492 - RNA, 11 nt, Bordetella pertussis
gcgagcggcgu

SEQ ID NO: 2432493 - RNA, 20 nt, Bordetella pertussis
gcgagcggcgugcgcgugca

SEQ ID NO: 2432494 - RNA, 16 nt, Bordetella pertussis
gcgagcgggccggucg

SEQ ID NO: 2432495 - RNA, 15 nt, Bordetella pertussis
gcgagcggggcuggu

SEQ ID NO: 2432496 - RNA, 16 nt, Bordetella pertussis
gcgagcugcgcgaccu

SEQ ID NO: 2432497 - RNA, 15 nt, Bordetella pertussis
gcgagcugcgcugcu

SEQ ID NO: 2432498 - RNA, 13 nt, Bordetella pertussis
gcgagcuggcccu

SEQ ID NO: 2432499 - RNA, 15 nt, Bordetella pertussis
gcgagcuggcccugg

SEQ ID NO: 2432500 - RNA, 13 nt, Bordetella pertussis
gcgagcuggugau

SEQ ID NO: 2432501 - RNA, 21 nt, Bordetella pertussis
gcgagcuggugauggugucga

SEQ ID NO: 2432502 - RNA, 17 nt, Bordetella pertussis
gcgaggacacgcagcug

SEQ ID NO: 2432503 - RNA, 18 nt, Bordetella pertussis
gcgaggacaggggccuca

SEQ ID NO: 2432504 - RNA, 12 nt, Bordetella pertussis
gcgaggaccuga

SEQ ID NO: 2432505 - RNA, 18 nt, Bordetella pertussis
gcgaggaggugcgccgcu

SEQ ID NO: 2432506 - RNA, 19 nt, Bordetella pertussis
gcgaggaggugcgccgcuc

SEQ ID NO: 2432507 - RNA, 20 nt, Bordetella pertussis
gcgaggaggugcgccgcucg

SEQ ID NO: 2432508 - RNA, 16 nt, Bordetella pertussis
gcgaggcaucgaaggc

SEQ ID NO: 2432509 - RNA, 13 nt, Bordetella pertussis
gcgaggcccggcc

SEQ ID NO: 2432510 - RNA, 12 nt, Bordetella pertussis
gcgaggccgccc

SEQ ID NO: 2432511 - RNA, 13 nt, Bordetella pertussis
gcgaggccgcccg

SEQ ID NO: 2432512 - RNA, 14 nt, Bordetella pertussis
gcgaggccgcccgc

SEQ ID NO: 2432513 - RNA, 22 nt, Bordetella pertussis
gcgaggccgcccgccccggcgc

SEQ ID NO: 2432514 - RNA, 18 nt, Bordetella pertussis
gcgaggccucgugcugcu

SEQ ID NO: 2432515 - RNA, 22 nt, Bordetella pertussis
gcgaggccucgugcugcugcag

SEQ ID NO: 2432516 - RNA, 20 nt, Bordetella pertussis
gcgaggcgaacaggcacagg

SEQ ID NO: 2432517 - RNA, 24 nt, Bordetella pertussis
gcgaggcgaugccccgguagucgc

SEQ ID NO: 2432518 - RNA, 16 nt, Bordetella pertussis
gcgaggcgcaggccga

SEQ ID NO: 2432519 - RNA, 17 nt, Bordetella pertussis
gcgaggcgcaggccgac

SEQ ID NO: 2432520 - RNA, 23 nt, Bordetella pertussis
gcgaggcgcuggccggcgugccc

SEQ ID NO: 2432521 - RNA, 12 nt, Bordetella pertussis
gcgaggcggccu

SEQ ID NO: 2432522 - RNA, 13 nt, Bordetella pertussis
gcgaggcggccuu

SEQ ID NO: 2432523 - RNA, 12 nt, Bordetella pertussis
gcgaggcggcga

SEQ ID NO: 2432524 - RNA, 12 nt, Bordetella pertussis
gcgaggcggcgg

SEQ ID NO: 2432525 - RNA, 13 nt, Bordetella pertussis
gcgaggcggggcu

SEQ ID NO: 2432526 - RNA, 13 nt, Bordetella pertussis
gcgaggcuggcgc

SEQ ID NO: 2432527 - RNA, 14 nt, Bordetella pertussis
gcgaggcuggcgcc

SEQ ID NO: 2432528 - RNA, 15 nt, Bordetella pertussis
gcgaggcuggcgccc

SEQ ID NO: 2432529 - RNA, 16 nt, Bordetella pertussis
gcgaggcuggcgccca

SEQ ID NO: 2432530 - RNA, 17 nt, Bordetella pertussis
gcgaggcuggcgcccac

SEQ ID NO: 2432531 - RNA, 15 nt, Bordetella pertussis
gcgagggcucgaccg

SEQ ID NO: 2432532 - RNA, 21 nt, Bordetella pertussis
gcgagggcucgaccgccgcca

SEQ ID NO: 2432533 - RNA, 13 nt, Bordetella pertussis
gcgagggucaggc

SEQ ID NO: 2432534 - RNA, 16 nt, Bordetella pertussis
gcgagggucaggcgcg

SEQ ID NO: 2432535 - RNA, 19 nt, Bordetella pertussis
gcgagggucaggcgcgcuu

SEQ ID NO: 2432536 - RNA, 16 nt, Bordetella pertussis
gcgagggugccugucc

SEQ ID NO: 2432537 - RNA, 15 nt, Bordetella pertussis
gcgagguagggcgcg

SEQ ID NO: 2432538 - RNA, 18 nt, Bordetella pertussis
gcgagguagggcgcggcc

SEQ ID NO: 2432539 - RNA, 19 nt, Bordetella pertussis
gcgagguagggcgcggcca

SEQ ID NO: 2432540 - RNA, 17 nt, Bordetella pertussis
gcgaggucagcccggcg

SEQ ID NO: 2432541 - RNA, 20 nt, Bordetella pertussis
gcgaggucagcccggcggcc

SEQ ID NO: 2432542 - RNA, 23 nt, Bordetella pertussis
gcgaggucagcccggcggccauc

SEQ ID NO: 2432543 - RNA, 14 nt, Bordetella pertussis
gcgaggugccggac

SEQ ID NO: 2432544 - RNA, 13 nt, Bordetella pertussis
gcgagguggcgcu

SEQ ID NO: 2432545 - RNA, 14 nt, Bordetella pertussis
gcgagguggcgcuc

SEQ ID NO: 2432546 - RNA, 18 nt, Bordetella pertussis
gcgagguggcgcucgcgc

SEQ ID NO: 2432547 - RNA, 21 nt, Bordetella pertussis
gcgagguggcgcucgcgccca

SEQ ID NO: 2432548 - RNA, 20 nt, Bordetella pertussis
gcgagguugcaggccaggcu

SEQ ID NO: 2432549 - RNA, 18 nt, Bordetella pertussis
gcgaguauucacgccgcg

SEQ ID NO: 2432550 - RNA, 19 nt, Bordetella pertussis
gcgaguauucacgccgcga

SEQ ID NO: 2432551 - RNA, 21 nt, Bordetella pertussis
gcgaguauucacgccgcgaca

SEQ ID NO: 2432552 - RNA, 15 nt, Bordetella pertussis
gcgagugcgccccgc

SEQ ID NO: 2432553 - RNA, 18 nt, Bordetella pertussis
gcgaguuguccuggccgg

SEQ ID NO: 2432554 - RNA, 20 nt, Bordetella pertussis
gcgaguuguccuggccggga

SEQ ID NO: 2432555 - RNA, 15 nt, Bordetella pertussis
gcgauacgcgccgcc

SEQ ID NO: 2432556 - RNA, 22 nt, Bordetella pertussis
gcgauacgggacugagucguca

SEQ ID NO: 2432557 - RNA, 17 nt, Bordetella pertussis
gcgauacugcgcauggg

SEQ ID NO: 2432558 - RNA, 14 nt, Bordetella pertussis
gcgauagcgccgcg

SEQ ID NO: 2432559 - RNA, 15 nt, Bordetella pertussis
gcgauaggugcgcag

SEQ ID NO: 2432560 - RNA, 17 nt, Bordetella pertussis
gcgauaggugcgcagcc

SEQ ID NO: 2432561 - RNA, 22 nt, Bordetella pertussis
gcgaugcgggccacgccggccg

SEQ ID NO: 2432562 - RNA, 13 nt, Bordetella pertussis
gcgaugcgggcgg

SEQ ID NO: 2432563 - RNA, 23 nt, Bordetella pertussis
gcgaugcgucaggggcaugccgg

SEQ ID NO: 2432564 - RNA, 22 nt, Bordetella pertussis
gcgaugcucacgcccaguccca

SEQ ID NO: 2432565 - RNA, 18 nt, Bordetella pertussis
gcgaugcucgauaugcag

SEQ ID NO: 2432566 - RNA, 17 nt, Bordetella pertussis
gcgaugcugaccaccgg

SEQ ID NO: 2432567 - RNA, 20 nt, Bordetella pertussis
gcgauggacucauaggcauc

SEQ ID NO: 2432568 - RNA, 14 nt, Bordetella pertussis
gcgauggcacggca

SEQ ID NO: 2432569 - RNA, 18 nt, Bordetella pertussis
gcgauggcacggcacgcc

SEQ ID NO: 2432570 - RNA, 22 nt, Bordetella pertussis
gcgauggcacggcacgccucgc

SEQ ID NO: 2432571 - RNA, 14 nt, Bordetella pertussis
gcgauggccacgcg

SEQ ID NO: 2432572 - RNA, 15 nt, Bordetella pertussis
gcgauggccacgcgc

SEQ ID NO: 2432573 - RNA, 20 nt, Bordetella pertussis
gcgauggcccgguaggccac

SEQ ID NO: 2432574 - RNA, 15 nt, Bordetella pertussis
gcgauggccgacaug

SEQ ID NO: 2432575 - RNA, 16 nt, Bordetella pertussis
gcgauggccgccagcg

SEQ ID NO: 2432576 - RNA, 15 nt, Bordetella pertussis
gcgauggcgccggcc

SEQ ID NO: 2432577 - RNA, 16 nt, Bordetella pertussis
gcgauggcgccggcca

SEQ ID NO: 2432578 - RNA, 18 nt, Bordetella pertussis
gcgauggcgccggccagc

SEQ ID NO: 2432579 - RNA, 16 nt, Bordetella pertussis
gcgauggcgcgcgcca

SEQ ID NO: 2432580 - RNA, 14 nt, Bordetella pertussis
gcgauggcgcggcc

SEQ ID NO: 2432581 - RNA, 15 nt, Bordetella pertussis
gcgauggcgcggccg

SEQ ID NO: 2432582 - RNA, 12 nt, Bordetella pertussis
gcgauggcgcgu

SEQ ID NO: 2432583 - RNA, 20 nt, Bordetella pertussis
gcgauggcgcgucgccgcgc

SEQ ID NO: 2432584 - RNA, 16 nt, Bordetella pertussis
gcgaugggcaccugcu

SEQ ID NO: 2432585 - RNA, 22 nt, Bordetella pertussis
gcgauggucaccacccgcacgc

SEQ ID NO: 2432586 - RNA, 23 nt, Bordetella pertussis
gcgauggucaccacccgcacgcc

SEQ ID NO: 2432587 - RNA, 15 nt, Bordetella pertussis
gcgauggucggccgg

SEQ ID NO: 2432588 - RNA, 13 nt, Bordetella pertussis
gcgauggucuggg

SEQ ID NO: 2432589 - RNA, 21 nt, Bordetella pertussis
gcgaugguggauccgccggug

SEQ ID NO: 2432590 - RNA, 14 nt, Bordetella pertussis
gcgauguaggccag

SEQ ID NO: 2432591 - RNA, 17 nt, Bordetella pertussis
gcgauguaggccagguu

SEQ ID NO: 2432592 - RNA, 17 nt, Bordetella pertussis
gcgauguagggcagcuc

SEQ ID NO: 2432593 - RNA, 16 nt, Bordetella pertussis
gcgauguccagcgagc

SEQ ID NO: 2432594 - RNA, 18 nt, Bordetella pertussis
gcgauguccagcgagcga

SEQ ID NO: 2432595 - RNA, 17 nt, Bordetella pertussis
gcgauguccagcuccag

SEQ ID NO: 2432596 - RNA, 19 nt, Bordetella pertussis
gcgaugucgcgcgcgcuca

SEQ ID NO: 2432597 - RNA, 21 nt, Bordetella pertussis
gcgaugugacggcucgaugca

SEQ ID NO: 2432598 - RNA, 16 nt, Bordetella pertussis
gcgauguugaagccgu

SEQ ID NO: 2432599 - RNA, 18 nt, Bordetella pertussis
gcgauucccuggcgcgcc

SEQ ID NO: 2432600 - RNA, 16 nt, Bordetella pertussis
gcgauuccuuccauga

SEQ ID NO: 2432601 - RNA, 14 nt, Bordetella pertussis
gcgauucgcgcuug

SEQ ID NO: 2432602 - RNA, 18 nt, Bordetella pertussis
gcgauucguacaugucga

SEQ ID NO: 2432603 - RNA, 20 nt, Bordetella pertussis
gcgauugaguucgcgcgccg

SEQ ID NO: 2432604 - RNA, 21 nt, Bordetella pertussis
gcgauugaguucgcgcgccgg

SEQ ID NO: 2432605 - RNA, 22 nt, Bordetella pertussis
gcgauugaguucgcgcgccggc

SEQ ID NO: 2432606 - RNA, 20 nt, Bordetella pertussis
gcgauugcagguggccagcc

SEQ ID NO: 2432607 - RNA, 17 nt, Bordetella pertussis
gcgauugcggcccgcgg

SEQ ID NO: 2432608 - RNA, 20 nt, Bordetella pertussis
gcgauuuccuugcgccgccc

SEQ ID NO: 2432609 - RNA, 21 nt, Bordetella pertussis
gcgauuuccuugcgccgcccg

SEQ ID NO: 2432610 - RNA, 17 nt, Bordetella pertussis
gcgauuugccgcagccc

SEQ ID NO: 2432611 - RNA, 21 nt, Bordetella pertussis
gcgauuugccgcagcccgcgc

SEQ ID NO: 2432612 - RNA, 20 nt, Bordetella pertussis
gcgcaaaccgacgcggccag

SEQ ID NO: 2432613 - RNA, 15 nt, Bordetella pertussis
gcgcaaacgggggca

SEQ ID NO: 2432614 - RNA, 20 nt, Bordetella pertussis
gcgcaaacgggggcaggccg

SEQ ID NO: 2432615 - RNA, 20 nt, Bordetella pertussis
gcgcaacacgcgcgacgccg

SEQ ID NO: 2432616 - RNA, 14 nt, Bordetella pertussis
gcgcaacaggucgu

SEQ ID NO: 2432617 - RNA, 23 nt, Bordetella pertussis
gcgcaacauggugaccggggcgu

SEQ ID NO: 2432618 - RNA, 15 nt, Bordetella pertussis
gcgcaaccaggggcg

SEQ ID NO: 2432619 - RNA, 23 nt, Bordetella pertussis
gcgcaaccaggggcggcgcggcg

SEQ ID NO: 2432620 - RNA, 16 nt, Bordetella pertussis
gcgcaacccacggcgu

SEQ ID NO: 2432621 - RNA, 16 nt, Bordetella pertussis
gcgcaacccggccucg

SEQ ID NO: 2432622 - RNA, 22 nt, Bordetella pertussis
gcgcaacccggccucgcugcgg

SEQ ID NO: 2432623 - RNA, 14 nt, Bordetella pertussis
gcgcaaccggcccg

SEQ ID NO: 2432624 - RNA, 13 nt, Bordetella pertussis
gcgcaacgcaugc

SEQ ID NO: 2432625 - RNA, 14 nt, Bordetella pertussis
gcgcaacgccgcca

SEQ ID NO: 2432626 - RNA, 23 nt, Bordetella pertussis
gcgcaacgccggccgccauggcc

SEQ ID NO: 2432627 - RNA, 15 nt, Bordetella pertussis
gcgcaacgcgcgcgc

SEQ ID NO: 2432628 - RNA, 16 nt, Bordetella pertussis
gcgcaacuccagcaua

SEQ ID NO: 2432629 - RNA, 17 nt, Bordetella pertussis
gcgcaagcaccgccugc

SEQ ID NO: 2432630 - RNA, 20 nt, Bordetella pertussis
gcgcaagcaggucacgacgg

SEQ ID NO: 2432631 - RNA, 14 nt, Bordetella pertussis
gcgcaagccagcac

SEQ ID NO: 2432632 - RNA, 17 nt, Bordetella pertussis
gcgcaagcccaggcggc

SEQ ID NO: 2432633 - RNA, 12 nt, Bordetella pertussis
gcgcaagccgcc

SEQ ID NO: 2432634 - RNA, 17 nt, Bordetella pertussis
gcgcaagccgccgcccu

SEQ ID NO: 2432635 - RNA, 20 nt, Bordetella pertussis
gcgcaagccgccgcccucgc

SEQ ID NO: 2432636 - RNA, 13 nt, Bordetella pertussis
gcgcaagccgcug

SEQ ID NO: 2432637 - RNA, 21 nt, Bordetella pertussis
gcgcaagccgcuggauuucgc

SEQ ID NO: 2432638 - RNA, 19 nt, Bordetella pertussis
gcgcaagccggccgcgcgg

SEQ ID NO: 2432639 - RNA, 20 nt, Bordetella pertussis
gcgcaagccggccgcgcggc

SEQ ID NO: 2432640 - RNA, 21 nt, Bordetella pertussis
gcgcaagccggccgcgcggcc

SEQ ID NO: 2432641 - RNA, 22 nt, Bordetella pertussis
gcgcaagccggccgcgcggccg

SEQ ID NO: 2432642 - RNA, 13 nt, Bordetella pertussis
gcgcaagcgcgcc

SEQ ID NO: 2432643 - RNA, 14 nt, Bordetella pertussis
gcgcaagcgcgccg

SEQ ID NO: 2432644 - RNA, 20 nt, Bordetella pertussis
gcgcaagcgcgccgacagga

SEQ ID NO: 2432645 - RNA, 13 nt, Bordetella pertussis
gcgcaagcggccc

SEQ ID NO: 2432646 - RNA, 14 nt, Bordetella pertussis
gcgcaagcggcccc

SEQ ID NO: 2432647 - RNA, 20 nt, Bordetella pertussis
gcgcaaggacgcguccucgg

SEQ ID NO: 2432648 - RNA, 23 nt, Bordetella pertussis
gcgcaaggacgcguccucggcca

SEQ ID NO: 2432649 - RNA, 20 nt, Bordetella pertussis
gcgcaaggcaugcgccagcg

SEQ ID NO: 2432650 - RNA, 16 nt, Bordetella pertussis
gcgcaaggcggcccgg

SEQ ID NO: 2432651 - RNA, 18 nt, Bordetella pertussis
gcgcaaggcgggcugguc

SEQ ID NO: 2432652 - RNA, 17 nt, Bordetella pertussis
gcgcaaggcgucgggca

SEQ ID NO: 2432653 - RNA, 18 nt, Bordetella pertussis
gcgcaaggcgucgggcac

SEQ ID NO: 2432654 - RNA, 16 nt, Bordetella pertussis
gcgcaagggccagucg

SEQ ID NO: 2432655 - RNA, 15 nt, Bordetella pertussis
gcgcaagguggcggu

SEQ ID NO: 2432656 - RNA, 20 nt, Bordetella pertussis
gcgcaaguguggcgcaccgc

SEQ ID NO: 2432657 - RNA, 23 nt, Bordetella pertussis
gcgcaaguguggcgcaccgcgcu

SEQ ID NO: 2432658 - RNA, 20 nt, Bordetella pertussis
gcgcaaguucaucaucgccg

SEQ ID NO: 2432659 - RNA, 21 nt, Bordetella pertussis
gcgcaaguucaucaucgccga

SEQ ID NO: 2432660 - RNA, 22 nt, Bordetella pertussis
gcgcaaguucaucaucgccgac

SEQ ID NO: 2432661 - RNA, 23 nt, Bordetella pertussis
gcgcaaguucaucaucgccgacg

SEQ ID NO: 2432662 - RNA, 15 nt, Bordetella pertussis
gcgcaauacgccgcc

SEQ ID NO: 2432663 - RNA, 17 nt, Bordetella pertussis
gcgcaauacgccgccgg

SEQ ID NO: 2432664 - RNA, 19 nt, Bordetella pertussis
gcgcaauacgccgccggcg

SEQ ID NO: 2432665 - RNA, 21 nt, Bordetella pertussis
gcgcaauacgccgccggcgca

SEQ ID NO: 2432666 - RNA, 15 nt, Bordetella pertussis
gcgcaauaggccgcg

SEQ ID NO: 2432667 - RNA, 21 nt, Bordetella pertussis
gcgcaauccccgcuuccugcu

SEQ ID NO: 2432668 - RNA, 13 nt, Bordetella pertussis
gcgcaaugcgcgg

SEQ ID NO: 2432669 - RNA, 15 nt, Bordetella pertussis
gcgcaaugcgcggcg

SEQ ID NO: 2432670 - RNA, 21 nt, Bordetella pertussis
gcgcaauggacacagcggcgc

SEQ ID NO: 2432671 - RNA, 23 nt, Bordetella pertussis
gcgcaauggacacagcggcgcga

SEQ ID NO: 2432672 - RNA, 18 nt, Bordetella pertussis
gcgcacaaucugcgucgc

SEQ ID NO: 2432673 - RNA, 24 nt, Bordetella pertussis
gcgcacgcugggcgaggcgcuggc

SEQ ID NO: 2432674 - RNA, 14 nt, Bordetella pertussis
gcgcacggacagcc

SEQ ID NO: 2432675 - RNA, 18 nt, Bordetella pertussis
gcgcacggacagcccgcg

SEQ ID NO: 2432676 - RNA, 19 nt, Bordetella pertussis
gcgcacggacagcccgcgc

SEQ ID NO: 2432677 - RNA, 22 nt, Bordetella pertussis
gcgcacggacagcccgcgcugg

SEQ ID NO: 2432678 - RNA, 12 nt, Bordetella pertussis
gcgcacggcgcc

SEQ ID NO: 2432679 - RNA, 12 nt, Bordetella pertussis
gcgcacggcggc

SEQ ID NO: 2432680 - RNA, 14 nt, Bordetella pertussis
gcgcacgggcgagg

SEQ ID NO: 2432681 - RNA, 16 nt, Bordetella pertussis
gcgcacgggcgagggc

SEQ ID NO: 2432682 - RNA, 14 nt, Bordetella pertussis
gcgcacgggcgccu

SEQ ID NO: 2432683 - RNA, 20 nt, Bordetella pertussis
gcgcacgguccaggcggccg

SEQ ID NO: 2432684 - RNA, 17 nt, Bordetella pertussis
gcgcacggugcgcacga

SEQ ID NO: 2432685 - RNA, 14 nt, Bordetella pertussis
gcgcacguggacca

SEQ ID NO: 2432686 - RNA, 17 nt, Bordetella pertussis
gcgcacguggaccaggg

SEQ ID NO: 2432687 - RNA, 15 nt, Bordetella pertussis
gcgcacucgaccgcc

SEQ ID NO: 2432688 - RNA, 16 nt, Bordetella pertussis
gcgcacucgaccgccg

SEQ ID NO: 2432689 - RNA, 23 nt, Bordetella pertussis
gcgcacucgaccgccgggacagg

SEQ ID NO: 2432690 - RNA, 21 nt, Bordetella pertussis
gcgcacugagaaaggccgcca

SEQ ID NO: 2432691 - RNA, 23 nt, Bordetella pertussis
gcgcacugagaaaggccgccacg

SEQ ID NO: 2432692 - RNA, 15 nt, Bordetella pertussis
gcgcacugaucgccg

SEQ ID NO: 2432693 - RNA, 15 nt, Bordetella pertussis
gcgcagaaaccgcca

SEQ ID NO: 2432694 - RNA, 22 nt, Bordetella pertussis
gcgcagaaaccgccacagcgcc

SEQ ID NO: 2432695 - RNA, 20 nt, Bordetella pertussis
gcgcagacgacgcagcgugc

SEQ ID NO: 2432696 - RNA, 14 nt, Bordetella pertussis
gcgcagacgcgcuc

SEQ ID NO: 2432697 - RNA, 17 nt, Bordetella pertussis
gcgcagacgcgcucagg

SEQ ID NO: 2432698 - RNA, 23 nt, Bordetella pertussis
gcgcagacgcgcucaggcgguga

SEQ ID NO: 2432699 - RNA, 17 nt, Bordetella pertussis
gcgcagacgggcccguu

SEQ ID NO: 2432700 - RNA, 17 nt, Bordetella pertussis
gcgcagaucccaggcgc

SEQ ID NO: 2432701 - RNA, 19 nt, Bordetella pertussis
gcgcagaucccaggcgcuc

SEQ ID NO: 2432702 - RNA, 22 nt, Bordetella pertussis
gcgcagauccucgaacaggcca

SEQ ID NO: 2432703 - RNA, 13 nt, Bordetella pertussis
gcgcagauggcgg

SEQ ID NO: 2432704 - RNA, 15 nt, Bordetella pertussis
gcgcagauggcggcg

SEQ ID NO: 2432705 - RNA, 16 nt, Bordetella pertussis
gcgcagauggcggcga

SEQ ID NO: 2432706 - RNA, 19 nt, Bordetella pertussis
gcgcagaugggcggcgacg

SEQ ID NO: 2432707 - RNA, 21 nt, Bordetella pertussis
gcgcagauugcgcucggucau

SEQ ID NO: 2432708 - RNA, 15 nt, Bordetella pertussis
gcgcagcaacccgcc

SEQ ID NO: 2432709 - RNA, 18 nt, Bordetella pertussis
gcgcagcaacccgcccgg

SEQ ID NO: 2432710 - RNA, 20 nt, Bordetella pertussis
gcgcagcaagcugcugcugg

SEQ ID NO: 2432711 - RNA, 17 nt, Bordetella pertussis
gcgcagcaaggcgcgcc

SEQ ID NO: 2432712 - RNA, 18 nt, Bordetella pertussis
gcgcagcaaggcgcgcca

SEQ ID NO: 2432713 - RNA, 21 nt, Bordetella pertussis
gcgcagcaaggcgcgccaccg

SEQ ID NO: 2432714 - RNA, 22 nt, Bordetella pertussis
gcgcagcaauucaagccgcacc

SEQ ID NO: 2432715 - RNA, 23 nt, Bordetella pertussis
gcgcagcaauucaagccgcacca

SEQ ID NO: 2432716 - RNA, 13 nt, Bordetella pertussis
gcgcagcaccgcc

SEQ ID NO: 2432717 - RNA, 15 nt, Bordetella pertussis
gcgcagcaccgccag

SEQ ID NO: 2432718 - RNA, 17 nt, Bordetella pertussis
gcgcagcaccgccagcg

SEQ ID NO: 2432719 - RNA, 18 nt, Bordetella pertussis
gcgcagcaccgcgcgcac

SEQ ID NO: 2432720 - RNA, 15 nt, Bordetella pertussis
gcgcagcaccggcgu

SEQ ID NO: 2432721 - RNA, 16 nt, Bordetella pertussis
gcgcagcaccggcgug

SEQ ID NO: 2432722 - RNA, 21 nt, Bordetella pertussis
gcgcagcaccggcgugagcgc

SEQ ID NO: 2432723 - RNA, 22 nt, Bordetella pertussis
gcgcagcaccggcgugagcgcc

SEQ ID NO: 2432724 - RNA, 23 nt, Bordetella pertussis
gcgcagcaccggcgugagcgcca

SEQ ID NO: 2432725 - RNA, 19 nt, Bordetella pertussis
gcgcagcaccucggggcgc

SEQ ID NO: 2432726 - RNA, 15 nt, Bordetella pertussis
gcgcagcacgauggg

SEQ ID NO: 2432727 - RNA, 19 nt, Bordetella pertussis
gcgcagcacgauggggcca

SEQ ID NO: 2432728 - RNA, 20 nt, Bordetella pertussis
gcgcagcacgauggggccau

SEQ ID NO: 2432729 - RNA, 23 nt, Bordetella pertussis
gcgcagcacgauggggccauggc

SEQ ID NO: 2432730 - RNA, 13 nt, Bordetella pertussis
gcgcagcacgccc

SEQ ID NO: 2432731 - RNA, 23 nt, Bordetella pertussis
gcgcagcacgcccgcgcgcgagc

SEQ ID NO: 2432732 - RNA, 18 nt, Bordetella pertussis
gcgcagcacgccgcgcca

SEQ ID NO: 2432733 - RNA, 21 nt, Bordetella pertussis
gcgcagcacgccgcgccaggc

SEQ ID NO: 2432734 - RNA, 14 nt, Bordetella pertussis
gcgcagcagacgcu

SEQ ID NO: 2432735 - RNA, 23 nt, Bordetella pertussis
gcgcagcagauugccgcgcggcg

SEQ ID NO: 2432736 - RNA, 20 nt, Bordetella pertussis
gcgcagcagcagcgcaucga

SEQ ID NO: 2432737 - RNA, 20 nt, Bordetella pertussis
gcgcagcagcgacaggacgu

SEQ ID NO: 2432738 - RNA, 12 nt, Bordetella pertussis
gcgcagcagcgc

SEQ ID NO: 2432739 - RNA, 16 nt, Bordetella pertussis
gcgcagcagcgccggc

SEQ ID NO: 2432740 - RNA, 17 nt, Bordetella pertussis
gcgcagcagcgccggca

SEQ ID NO: 2432741 - RNA, 21 nt, Bordetella pertussis
gcgcagcagcgccggcaggcg

SEQ ID NO: 2432742 - RNA, 18 nt, Bordetella pertussis
gcgcagcagcgcgguggc

SEQ ID NO: 2432743 - RNA, 19 nt, Bordetella pertussis
gcgcagcagcgcgguggcc

SEQ ID NO: 2432744 - RNA, 22 nt, Bordetella pertussis
gcgcagcagcgcgguggccagc

SEQ ID NO: 2432745 - RNA, 18 nt, Bordetella pertussis
gcgcagcagcuugccgac

SEQ ID NO: 2432746 - RNA, 20 nt, Bordetella pertussis
gcgcagcagcuugccgaccg

SEQ ID NO: 2432747 - RNA, 13 nt, Bordetella pertussis
gcgcagcaggccc

SEQ ID NO: 2432748 - RNA, 14 nt, Bordetella pertussis
gcgcagcaggccgc

SEQ ID NO: 2432749 - RNA, 15 nt, Bordetella pertussis
gcgcagcaggccgcg

SEQ ID NO: 2432750 - RNA, 14 nt, Bordetella pertussis
gcgcagcaggccgu

SEQ ID NO: 2432751 - RNA, 18 nt, Bordetella pertussis
gcgcagcaggccguugcc

SEQ ID NO: 2432752 - RNA, 12 nt, Bordetella pertussis
gcgcagcaggcg

SEQ ID NO: 2432753 - RNA, 14 nt, Bordetella pertussis
gcgcagcaggcgcg

SEQ ID NO: 2432754 - RNA, 17 nt, Bordetella pertussis
gcgcagcaggcgcgcgg

SEQ ID NO: 2432755 - RNA, 18 nt, Bordetella pertussis
gcgcagcaggcgcgcggc

SEQ ID NO: 2432756 - RNA, 19 nt, Bordetella pertussis
gcgcagcaggcgcgcggcc

SEQ ID NO: 2432757 - RNA, 22 nt, Bordetella pertussis
gcgcagcaggcgcgcggccucg

SEQ ID NO: 2432758 - RNA, 15 nt, Bordetella pertussis
gcgcagcaggcgcgu

SEQ ID NO: 2432759 - RNA, 11 nt, Bordetella pertussis
gcgcagcaggg

SEQ ID NO: 2432760 - RNA, 17 nt, Bordetella pertussis
gcgcagcagggcggcgg

SEQ ID NO: 2432761 - RNA, 14 nt, Bordetella pertussis
gcgcagcagggugg

SEQ ID NO: 2432762 - RNA, 17 nt, Bordetella pertussis
gcgcagcaggguggcca

SEQ ID NO: 2432763 - RNA, 13 nt, Bordetella pertussis
gcgcagcaggugg

SEQ ID NO: 2432764 - RNA, 21 nt, Bordetella pertussis
gcgcagcaucuugcgccgcug

SEQ ID NO: 2432765 - RNA, 19 nt, Bordetella pertussis
gcgcagcauuucggcgccg

SEQ ID NO: 2432766 - RNA, 22 nt, Bordetella pertussis
gcgcagcauuucggcgccgccg

SEQ ID NO: 2432767 - RNA, 23 nt, Bordetella pertussis
gcgcagcauuucggcgccgccgg

SEQ ID NO: 2432768 - RNA, 13 nt, Bordetella pertussis
gcgcagccacagc

SEQ ID NO: 2432769 - RNA, 15 nt, Bordetella pertussis
gcgcagccacagcgc

SEQ ID NO: 2432770 - RNA, 17 nt, Bordetella pertussis
gcgcagccacagcgcgu

SEQ ID NO: 2432771 - RNA, 20 nt, Bordetella pertussis
gcgcagcccacucagggcgg

SEQ ID NO: 2432772 - RNA, 23 nt, Bordetella pertussis
gcgcagcccacucagggcggggu

SEQ ID NO: 2432773 - RNA, 13 nt, Bordetella pertussis
gcgcagcccggcg

SEQ ID NO: 2432774 - RNA, 18 nt, Bordetella pertussis
gcgcagccgacaggcgcg

SEQ ID NO: 2432775 - RNA, 23 nt, Bordetella pertussis
gcgcagccgacaggcgcgcaggc

SEQ ID NO: 2432776 - RNA, 15 nt, Bordetella pertussis
gcgcagccgcgccaa

SEQ ID NO: 2432777 - RNA, 16 nt, Bordetella pertussis
gcgcagccgcgcgccu

SEQ ID NO: 2432778 - RNA, 16 nt, Bordetella pertussis
gcgcagccgcuccagc

SEQ ID NO: 2432779 - RNA, 17 nt, Bordetella pertussis
gcgcagccgcuccagcc

SEQ ID NO: 2432780 - RNA, 14 nt, Bordetella pertussis
gcgcagccgggcug

SEQ ID NO: 2432781 - RNA, 20 nt, Bordetella pertussis
gcgcagccgggcugccggca

SEQ ID NO: 2432782 - RNA, 17 nt, Bordetella pertussis
gcgcagcgaacggccca

SEQ ID NO: 2432783 - RNA, 19 nt, Bordetella pertussis
gcgcagcgaacggcccacg

SEQ ID NO: 2432784 - RNA, 20 nt, Bordetella pertussis
gcgcagcgaacggcccacgc

SEQ ID NO: 2432785 - RNA, 22 nt, Bordetella pertussis
gcgcaucacgcuggccgcgccc

SEQ ID NO: 2432786 - RNA, 14 nt, Bordetella pertussis
gcgcaucagcgcgc

SEQ ID NO: 2432787 - RNA, 15 nt, Bordetella pertussis
gcgcaucagcgcgcc

SEQ ID NO: 2432788 - RNA, 16 nt, Bordetella pertussis
gcgcaucagcgcgccc

SEQ ID NO: 2432789 - RNA, 14 nt, Bordetella pertussis
gcgcaucagcuugg

SEQ ID NO: 2432790 - RNA, 16 nt, Bordetella pertussis
gcgcaucccagacagc

SEQ ID NO: 2432791 - RNA, 17 nt, Bordetella pertussis
gcgcaucccagacagcc

SEQ ID NO: 2432792 - RNA, 21 nt, Bordetella pertussis
gcgcaucccagacagccacgc

SEQ ID NO: 2432793 - RNA, 22 nt, Bordetella pertussis
gcgcaucccagacagccacgcg

SEQ ID NO: 2432794 - RNA, 19 nt, Bordetella pertussis
gcgcauccgguggugcugg

SEQ ID NO: 2432795 - RNA, 20 nt, Bordetella pertussis
gcgcauccgguggugcuggg

SEQ ID NO: 2432796 - RNA, 17 nt, Bordetella pertussis
gcgcaucgacagcgcgc

SEQ ID NO: 2432797 - RNA, 18 nt, Bordetella pertussis
gcgcaucgacagcgcgcc

SEQ ID NO: 2432798 - RNA, 19 nt, Bordetella pertussis
gcgcaucgacagcgcgccc

SEQ ID NO: 2432799 - RNA, 13 nt, Bordetella pertussis
gcgcaucgaucag

SEQ ID NO: 2432800 - RNA, 19 nt, Bordetella pertussis
gcgcaucgaucagcgcgcc

SEQ ID NO: 2432801 - RNA, 20 nt, Bordetella pertussis
gcgcaucgaucagcgcgccg

SEQ ID NO: 2432802 - RNA, 19 nt, Bordetella pertussis
gcgcaucgaucucggccuc

SEQ ID NO: 2432803 - RNA, 21 nt, Bordetella pertussis
gcgcaucgaucucggccucgg

SEQ ID NO: 2432804 - RNA, 16 nt, Bordetella pertussis
gcgcaucgaugcggcc

SEQ ID NO: 2432805 - RNA, 16 nt, Bordetella pertussis
gcgcaucgccgcaggc

SEQ ID NO: 2432806 - RNA, 18 nt, Bordetella pertussis
gcgcaucgccgcaggcgu

SEQ ID NO: 2432807 - RNA, 14 nt, Bordetella pertussis
gcgcaucgcgaugc

SEQ ID NO: 2432808 - RNA, 17 nt, Bordetella pertussis
gcgcaucgcgaugcgca

SEQ ID NO: 2432809 - RNA, 23 nt, Bordetella pertussis
gcgcaucgcgaugcgcagcagca

SEQ ID NO: 2432810 - RNA, 13 nt, Bordetella pertussis
gcgcaucgcgcac

SEQ ID NO: 2432811 - RNA, 15 nt, Bordetella pertussis
gcgcaucgcgcaccc

SEQ ID NO: 2432812 - RNA, 15 nt, Bordetella pertussis
gcgcaucgcgcgcgc

SEQ ID NO: 2432813 - RNA, 17 nt, Bordetella pertussis
gcgcaucgcgcgcgccg

SEQ ID NO: 2432814 - RNA, 18 nt, Bordetella pertussis
gcgcaucgcgcgcgccgg

SEQ ID NO: 2432815 - RNA, 19 nt, Bordetella pertussis
gcgcaucgcgcgcgccggc

SEQ ID NO: 2432816 - RNA, 15 nt, Bordetella pertussis
gcgcaucgcgcggca

SEQ ID NO: 2432817 - RNA, 13 nt, Bordetella pertussis
gcgcaucggccgg

SEQ ID NO: 2432818 - RNA, 15 nt, Bordetella pertussis
gcgcaucggcgccag

SEQ ID NO: 2432819 - RNA, 13 nt, Bordetella pertussis
gcgcaucggcggc

SEQ ID NO: 2432820 - RNA, 14 nt, Bordetella pertussis
gcgcaucggcggca

SEQ ID NO: 2432821 - RNA, 20 nt, Bordetella pertussis
gcgcaucggcggcaggucgg

SEQ ID NO: 2432822 - RNA, 15 nt, Bordetella pertussis
gcgcaucgggauccg

SEQ ID NO: 2432823 - RNA, 17 nt, Bordetella pertussis
gcgcaucgucaggcagg

SEQ ID NO: 2432824 - RNA, 21 nt, Bordetella pertussis
gcgcaucgucaggcaggcgcg

SEQ ID NO: 2432825 - RNA, 23 nt, Bordetella pertussis
gcgcaugacgaggugccuguccc

SEQ ID NO: 2432826 - RNA, 22 nt, Bordetella pertussis
gcgcaugacggcgucgagcacg

SEQ ID NO: 2432827 - RNA, 13 nt, Bordetella pertussis
gcgcaugacgggg

SEQ ID NO: 2432828 - RNA, 22 nt, Bordetella pertussis
gcgcaugacggggugccugucc

SEQ ID NO: 2432829 - RNA, 17 nt, Bordetella pertussis
gcgcaugagccggcaga

SEQ ID NO: 2432830 - RNA, 17 nt, Bordetella pertussis
gcgcaugaugcugccgg

SEQ ID NO: 2432831 - RNA, 16 nt, Bordetella pertussis
gcgcaugauggccggc

SEQ ID NO: 2432832 - RNA, 17 nt, Bordetella pertussis
gcgcaugauggccggcc

SEQ ID NO: 2432833 - RNA, 21 nt, Bordetella pertussis
gcgcaugauuccugucgcgcu

SEQ ID NO: 2432834 - RNA, 15 nt, Bordetella pertussis
gcgcaugcagccgca

SEQ ID NO: 2432835 - RNA, 13 nt, Bordetella pertussis
gcgcaugccagcu

SEQ ID NO: 2432836 - RNA, 21 nt, Bordetella pertussis
gcgcaugccauggccgcgcgg

SEQ ID NO: 2432837 - RNA, 22 nt, Bordetella pertussis
gcgcaugccauggccgcgcggc

SEQ ID NO: 2432838 - RNA, 17 nt, Bordetella pertussis
gcgcaugccgucgagcg

SEQ ID NO: 2432839 - RNA, 20 nt, Bordetella pertussis
gcgcaugccgucgagcgcga

SEQ ID NO: 2432840 - RNA, 21 nt, Bordetella pertussis
gcgcaugcgccugucccaggc

SEQ ID NO: 2432841 - RNA, 22 nt, Bordetella pertussis
gcgcaugcgccugucccaggcg

SEQ ID NO: 2432842 - RNA, 15 nt, Bordetella pertussis
gcgcauggacgccgc

SEQ ID NO: 2432843 - RNA, 16 nt, Bordetella pertussis
gcgcauggacgccgcc

SEQ ID NO: 2432844 - RNA, 17 nt, Bordetella pertussis
gcgcauggacgccgccg

SEQ ID NO: 2432845 - RNA, 18 nt, Bordetella pertussis
gcgcauggacgccgccgc

SEQ ID NO: 2432846 - RNA, 17 nt, Bordetella pertussis
gcgcauggacugcaggc

SEQ ID NO: 2432847 - RNA, 18 nt, Bordetella pertussis
gcgcauggacugcaggcg

SEQ ID NO: 2432848 - RNA, 20 nt, Bordetella pertussis
gcgcauggacugcaggcgcu

SEQ ID NO: 2432849 - RNA, 11 nt, Bordetella pertussis
gcgcauggcca

SEQ ID NO: 2432850 - RNA, 14 nt, Bordetella pertussis
gcgcauggccagca

SEQ ID NO: 2432851 - RNA, 15 nt, Bordetella pertussis
gcgcauggccagcac

SEQ ID NO: 2432852 - RNA, 16 nt, Bordetella pertussis
gcgcauggccagcaca

SEQ ID NO: 2432853 - RNA, 24 nt, Bordetella pertussis
gcgcauggccagcacauacgccgc

SEQ ID NO: 2432854 - RNA, 17 nt, Bordetella pertussis
gcgcauggccagcgcgc

SEQ ID NO: 2432855 - RNA, 11 nt, Bordetella pertussis
gcgcauggccg

SEQ ID NO: 2432856 - RNA, 15 nt, Bordetella pertussis
gcgcauggccggcgu

SEQ ID NO: 2432857 - RNA, 14 nt, Bordetella pertussis
gcgcauggcgauga

SEQ ID NO: 2432858 - RNA, 17 nt, Bordetella pertussis
gcgcauggcgaugaccu

SEQ ID NO: 2432859 - RNA, 14 nt, Bordetella pertussis
gcgcauggcugguc

SEQ ID NO: 2432860 - RNA, 19 nt, Bordetella pertussis
gcgcaugggaaauccgccg

SEQ ID NO: 2432861 - RNA, 20 nt, Bordetella pertussis
gcgcaugggaaauccgccgg

SEQ ID NO: 2432862 - RNA, 16 nt, Bordetella pertussis
gcgcaugggcgcaggc

SEQ ID NO: 2432863 - RNA, 17 nt, Bordetella pertussis
gcgcaugggcgcaggcc

SEQ ID NO: 2432864 - RNA, 18 nt, Bordetella pertussis
gcgcaugggcgcaggccg

SEQ ID NO: 2432865 - RNA, 19 nt, Bordetella pertussis
gcgcaugggcgcaggccgc

SEQ ID NO: 2432866 - RNA, 22 nt, Bordetella pertussis
gcgcauggugagggccacgcgc

SEQ ID NO: 2432867 - RNA, 22 nt, Bordetella pertussis
gcgcauguagucgucgcuggcc

SEQ ID NO: 2432868 - RNA, 17 nt, Bordetella pertussis
gcgcauguccgccacgc

SEQ ID NO: 2432869 - RNA, 18 nt, Bordetella pertussis
gcgcauguccgccacgcc

SEQ ID NO: 2432870 - RNA, 20 nt, Bordetella pertussis
gcgcauguccgccacgccgg

SEQ ID NO: 2432871 - RNA, 17 nt, Bordetella pertussis
gcgcauuaucgcuagga

SEQ ID NO: 2432872 - RNA, 15 nt, Bordetella pertussis
gcgcauucgcgccug

SEQ ID NO: 2432873 - RNA, 19 nt, Bordetella pertussis
gcgcauucgcgccugagcu

SEQ ID NO: 2432874 - RNA, 18 nt, Bordetella pertussis
gcgcauucgucgcugccg

SEQ ID NO: 2432875 - RNA, 14 nt, Bordetella pertussis
gcgcauugccgcca

SEQ ID NO: 2432876 - RNA, 21 nt, Bordetella pertussis
gcgcauugccgccaacgcggc

SEQ ID NO: 2432877 - RNA, 21 nt, Bordetella pertussis
gcgcauugccgucggccgcgc

SEQ ID NO: 2432878 - RNA, 17 nt, Bordetella pertussis
gcgcauuggugagcacg

SEQ ID NO: 2432879 - RNA, 19 nt, Bordetella pertussis
gcgcauuggugagcacgcg

SEQ ID NO: 2432880 - RNA, 22 nt, Bordetella pertussis
gcgcauuucgaccugcgcaccg

SEQ ID NO: 2432881 - RNA, 14 nt, Bordetella pertussis
gcgcauuugccgcg

SEQ ID NO: 2432882 - RNA, 16 nt, Bordetella pertussis
gcgcauuugccgcggc

SEQ ID NO: 2432883 - RNA, 15 nt, Bordetella pertussis
gcgccaaaaggcagc

SEQ ID NO: 2432884 - RNA, 20 nt, Bordetella pertussis
gcgccaaagcacaggauggc

SEQ ID NO: 2432885 - RNA, 22 nt, Bordetella pertussis
gcgccaaagcacaggauggcga

SEQ ID NO: 2432886 - RNA, 15 nt, Bordetella pertussis
gcgccaacccgccau

SEQ ID NO: 2432887 - RNA, 23 nt, Bordetella pertussis
gcgccaacccgccauccuggccg

SEQ ID NO: 2432888 - RNA, 21 nt, Bordetella pertussis
gcgccaacccggccucagcgg

SEQ ID NO: 2432889 - RNA, 13 nt, Bordetella pertussis
gcgccaagcggca

SEQ ID NO: 2432890 - RNA, 16 nt, Bordetella pertussis
gcgccaagcggcaggc

SEQ ID NO: 2432891 - RNA, 19 nt, Bordetella pertussis
gcgccaagcggcaggcggc

SEQ ID NO: 2432892 - RNA, 22 nt, Bordetella pertussis
gcgccaagggcgugcgcuugcg

SEQ ID NO: 2432893 - RNA, 20 nt, Bordetella pertussis
gcgccaaucagauggcgcag

SEQ ID NO: 2432894 - RNA, 23 nt, Bordetella pertussis
gcgccaaucagauggcgcagcgg

SEQ ID NO: 2432895 - RNA, 20 nt, Bordetella pertussis
gcgccacaauugccagccuu

SEQ ID NO: 2432896 - RNA, 18 nt, Bordetella pertussis
gcgccacacgggcgccug

SEQ ID NO: 2432897 - RNA, 14 nt, Bordetella pertussis
gcgccagcgccgcg

SEQ ID NO: 2432898 - RNA, 16 nt, Bordetella pertussis
gcgccagcgccgcgcg

SEQ ID NO: 2432899 - RNA, 16 nt, Bordetella pertussis
gcgccagcgccgcguc

SEQ ID NO: 2432900 - RNA, 13 nt, Bordetella pertussis
gcgccagcgccgg

SEQ ID NO: 2432901 - RNA, 15 nt, Bordetella pertussis
gcgccagcgccggcg

SEQ ID NO: 2432902 - RNA, 17 nt, Bordetella pertussis
gcgccagcgccggcgcg

SEQ ID NO: 2432903 - RNA, 12 nt, Bordetella pertussis
gcgccagcgcgc

SEQ ID NO: 2432904 - RNA, 13 nt, Bordetella pertussis
gcgccagcgcggc

SEQ ID NO: 2432905 - RNA, 15 nt, Bordetella pertussis
gcgccagcgcggcca

SEQ ID NO: 2432906 - RNA, 18 nt, Bordetella pertussis
gcgccagcgcggccagcg

SEQ ID NO: 2432907 - RNA, 14 nt, Bordetella pertussis
gcgccagcgcggcg

SEQ ID NO: 2432908 - RNA, 19 nt, Bordetella pertussis
gcgccagcgcuguccaggc

SEQ ID NO: 2432909 - RNA, 20 nt, Bordetella pertussis
gcgccagcgcuucgggcagc

SEQ ID NO: 2432910 - RNA, 12 nt, Bordetella pertussis
gcgccagcggca

SEQ ID NO: 2432911 - RNA, 14 nt, Bordetella pertussis
gcgccagcggccgu

SEQ ID NO: 2432912 - RNA, 16 nt, Bordetella pertussis
gcgccagcggcugcuu

SEQ ID NO: 2432913 - RNA, 13 nt, Bordetella pertussis
gcgccagcguggc

SEQ ID NO: 2432914 - RNA, 18 nt, Bordetella pertussis
gcgccagcguggccgagg

SEQ ID NO: 2432915 - RNA, 22 nt, Bordetella pertussis
gcgccagcguggccgaggugcc

SEQ ID NO: 2432916 - RNA, 20 nt, Bordetella pertussis
gcgccagcguucggccaccc

SEQ ID NO: 2432917 - RNA, 16 nt, Bordetella pertussis
gcgccagcuccagccg

SEQ ID NO: 2432918 - RNA, 18 nt, Bordetella pertussis
gcgccagcucgcgcagca

SEQ ID NO: 2432919 - RNA, 19 nt, Bordetella pertussis
gcgccagcucgcgcagcag

SEQ ID NO: 2432920 - RNA, 15 nt, Bordetella pertussis
gcgccagcucggcca

SEQ ID NO: 2432921 - RNA, 19 nt, Bordetella pertussis
gcgccagcucggccaaggc

SEQ ID NO: 2432922 - RNA, 22 nt, Bordetella pertussis
gcgccagcucuucgagcgcggc

SEQ ID NO: 2432923 - RNA, 14 nt, Bordetella pertussis
gcgccagcugcgca

SEQ ID NO: 2432924 - RNA, 15 nt, Bordetella pertussis
gcgccagcugcgcag

SEQ ID NO: 2432925 - RNA, 16 nt, Bordetella pertussis
gcgccagcugcgcagc

SEQ ID NO: 2432926 - RNA, 17 nt, Bordetella pertussis
gcgccagcugcgcagcg

SEQ ID NO: 2432927 - RNA, 19 nt, Bordetella pertussis
gcgccagcugcgcagcgac

SEQ ID NO: 2432928 - RNA, 20 nt, Bordetella pertussis
gcgccagcugcgcagcgacu

SEQ ID NO: 2432929 - RNA, 18 nt, Bordetella pertussis
gcgccagcuggaccgccu

SEQ ID NO: 2432930 - RNA, 23 nt, Bordetella pertussis
gcgccagcuggaccgccuggccu

SEQ ID NO: 2432931 - RNA, 13 nt, Bordetella pertussis
gcgccagcugggc

SEQ ID NO: 2432932 - RNA, 14 nt, Bordetella pertussis
gcgccagcugggcg

SEQ ID NO: 2432933 - RNA, 18 nt, Bordetella pertussis
gcgccagcugggcguugu

SEQ ID NO: 2432934 - RNA, 15 nt, Bordetella pertussis
gcgccagcuugcgcg

SEQ ID NO: 2432935 - RNA, 17 nt, Bordetella pertussis
gcgccagcuugcgcgcc

SEQ ID NO: 2432936 - RNA, 18 nt, Bordetella pertussis
gcgccagcuuggccaggc

SEQ ID NO: 2432937 - RNA, 19 nt, Bordetella pertussis
gcgccagcuuggccaggcu

SEQ ID NO: 2432938 - RNA, 19 nt, Bordetella pertussis
gcgccaggaacagcgccgg

SEQ ID NO: 2432939 - RNA, 22 nt, Bordetella pertussis
gcgccaggaacagcgccggcag

SEQ ID NO: 2432940 - RNA, 23 nt, Bordetella pertussis
gcgccaggaacagcgccggcagc

SEQ ID NO: 2432941 - RNA, 16 nt, Bordetella pertussis
gcgccaggaagcgcgc

SEQ ID NO: 2432942 - RNA, 22 nt, Bordetella pertussis
gcgccaggaagcgcgccgcgcg

SEQ ID NO: 2432943 - RNA, 18 nt, Bordetella pertussis
gcgccaggcaaaggccca

SEQ ID NO: 2432944 - RNA, 22 nt, Bordetella pertussis
gcgccaggcaaaggcccaggca

SEQ ID NO: 2432945 - RNA, 10 nt, Bordetella pertussis
gcgccaggcc

SEQ ID NO: 2432946 - RNA, 13 nt, Bordetella pertussis
gcgccaggcccag

SEQ ID NO: 2432947 - RNA, 13 nt, Bordetella pertussis
gcgccaggccgcg

SEQ ID NO: 2432948 - RNA, 14 nt, Bordetella pertussis
gcgccaggccgcgc

SEQ ID NO: 2432949 - RNA, 15 nt, Bordetella pertussis
gcgccaggccgcgca

SEQ ID NO: 2432950 - RNA, 16 nt, Bordetella pertussis
gcgccaggccgcgcag

SEQ ID NO: 2432951 - RNA, 13 nt, Bordetella pertussis
gcgccaggccggc

SEQ ID NO: 2432952 - RNA, 18 nt, Bordetella pertussis
gcgccaggccggcggcga

SEQ ID NO: 2432953 - RNA, 12 nt, Bordetella pertussis
gcgccaggccuc

SEQ ID NO: 2432954 - RNA, 13 nt, Bordetella pertussis
gcgccaggccucg

SEQ ID NO: 2432955 - RNA, 13 nt, Bordetella pertussis
gcgccaggcgcau

SEQ ID NO: 2432956 - RNA, 14 nt, Bordetella pertussis
gcgccaggcgccgg

SEQ ID NO: 2432957 - RNA, 18 nt, Bordetella pertussis
gcgccaggcgccgggccg

SEQ ID NO: 2432958 - RNA, 13 nt, Bordetella pertussis
gcgccaggcgcgc

SEQ ID NO: 2432959 - RNA, 20 nt, Bordetella pertussis
gcgccaggcgcgcaucgcgc

SEQ ID NO: 2432960 - RNA, 23 nt, Bordetella pertussis
gcgccaggcgcgcaucgcgcggc

SEQ ID NO: 2432961 - RNA, 14 nt, Bordetella pertussis
gcgccaggcgcucg

SEQ ID NO: 2432962 - RNA, 15 nt, Bordetella pertussis
gcgccaggcgcucgg

SEQ ID NO: 2432963 - RNA, 17 nt, Bordetella pertussis
gcgccaggcgcucggcg

SEQ ID NO: 2432964 - RNA, 14 nt, Bordetella pertussis
gcgccaggcgguac

SEQ ID NO: 2432965 - RNA, 16 nt, Bordetella pertussis
gcgccaggcgguacag

SEQ ID NO: 2432966 - RNA, 18 nt, Bordetella pertussis
gcgccaggcgguacaggc

SEQ ID NO: 2432967 - RNA, 23 nt, Bordetella pertussis
gcgccaggcgguacaggccggcg

SEQ ID NO: 2432968 - RNA, 13 nt, Bordetella pertussis
gcgccaggcguug

SEQ ID NO: 2432969 - RNA, 23 nt, Bordetella pertussis
gcgccaggcguugaccuggucga

SEQ ID NO: 2432970 - RNA, 14 nt, Bordetella pertussis
gcgccaggcuccau

SEQ ID NO: 2432971 - RNA, 21 nt, Bordetella pertussis
gcgccaggcugaaugccgccg

SEQ ID NO: 2432972 - RNA, 22 nt, Bordetella pertussis
gcgccaggcugaaugccgccgu

SEQ ID NO: 2432973 - RNA, 18 nt, Bordetella pertussis
gcgccaggcugucgucgu

SEQ ID NO: 2432974 - RNA, 18 nt, Bordetella pertussis
gcgccaggcuuugggcaa

SEQ ID NO: 2432975 - RNA, 13 nt, Bordetella pertussis
gcgccagggccag

SEQ ID NO: 2432976 - RNA, 15 nt, Bordetella pertussis
gcgccagggccaggc

SEQ ID NO: 2432977 - RNA, 16 nt, Bordetella pertussis
gcgccagggccaggcc

SEQ ID NO: 2432978 - RNA, 17 nt, Bordetella pertussis
gcgccagggccaggccg

SEQ ID NO: 2432979 - RNA, 18 nt, Bordetella pertussis
gcgccagggccaggccgc

SEQ ID NO: 2432980 - RNA, 19 nt, Bordetella pertussis
gcgccagggccaggccgcc

SEQ ID NO: 2432981 - RNA, 21 nt, Bordetella pertussis
gcgccagggccaggccgccgc

SEQ ID NO: 2432982 - RNA, 12 nt, Bordetella pertussis
gcgccagggccc

SEQ ID NO: 2432983 - RNA, 21 nt, Bordetella pertussis
gcgccagggccccuccggcgc

SEQ ID NO: 2432984 - RNA, 15 nt, Bordetella pertussis
gcgccagggccgccg

SEQ ID NO: 2432985 - RNA, 17 nt, Bordetella pertussis
gcgccagggccuccucg

SEQ ID NO: 2432986 - RNA, 12 nt, Bordetella pertussis
gcgccagggcgc

SEQ ID NO: 2432987 - RNA, 14 nt, Bordetella pertussis
gcgccagggcgccg

SEQ ID NO: 2432988 - RNA, 16 nt, Bordetella pertussis
gcgccagggcgccgcg

SEQ ID NO: 2432989 - RNA, 13 nt, Bordetella pertussis
gcgccagggcgcg

SEQ ID NO: 2432990 - RNA, 19 nt, Bordetella pertussis
gcgccagggcgcggaucau

SEQ ID NO: 2432991 - RNA, 12 nt, Bordetella pertussis
gcgccagggugc

SEQ ID NO: 2432992 - RNA, 20 nt, Bordetella pertussis
gcgccagggugccgaaaccc

SEQ ID NO: 2432993 - RNA, 22 nt, Bordetella pertussis
gcgccagguaggccggcgcgac

SEQ ID NO: 2432994 - RNA, 18 nt, Bordetella pertussis
gcgccaggucgcgcacca

SEQ ID NO: 2432995 - RNA, 19 nt, Bordetella pertussis
gcgccaggucgcgcaccag

SEQ ID NO: 2432996 - RNA, 21 nt, Bordetella pertussis
gcgccaguagcgccggcuugc

SEQ ID NO: 2432997 - RNA, 13 nt, Bordetella pertussis
gcgccaguccagc

SEQ ID NO: 2432998 - RNA, 17 nt, Bordetella pertussis
gcgccaguccagcgcgc

SEQ ID NO: 2432999 - RNA, 18 nt, Bordetella pertussis
gcgccaguccccaugcgg

SEQ ID NO: 2433000 - RNA, 13 nt, Bordetella pertussis
gcgccaguccgcg

SEQ ID NO: 2433001 - RNA, 16 nt, Bordetella pertussis
gcgccaguccgcgcuc

SEQ ID NO: 2433002 - RNA, 13 nt, Bordetella pertussis
gcgccagucgcgc

SEQ ID NO: 2433003 - RNA, 14 nt, Bordetella pertussis
gcgccagucgcgca

SEQ ID NO: 2433004 - RNA, 16 nt, Bordetella pertussis
gcgccagucgcgcagc

SEQ ID NO: 2433005 - RNA, 17 nt, Bordetella pertussis
gcgccagucgcgcagca

SEQ ID NO: 2433006 - RNA, 23 nt, Bordetella pertussis
gcgccagucgcgcagcaccucgg

SEQ ID NO: 2433007 - RNA, 23 nt, Bordetella pertussis
gcgccaguucgaguuccgcgacg

SEQ ID NO: 2433008 - RNA, 14 nt, Bordetella pertussis
gcgccaguugcgca

SEQ ID NO: 2433009 - RNA, 16 nt, Bordetella pertussis
gcgccaguugcgcacc

SEQ ID NO: 2433010 - RNA, 16 nt, Bordetella pertussis
gcgccaguugcggggc

SEQ ID NO: 2433011 - RNA, 14 nt, Bordetella pertussis
gcgcccccagcgcc

SEQ ID NO: 2433012 - RNA, 18 nt, Bordetella pertussis
gcgcccccagcgccguca

SEQ ID NO: 2433013 - RNA, 13 nt, Bordetella pertussis
gcgcccccgcggc

SEQ ID NO: 2433014 - RNA, 16 nt, Bordetella pertussis
gcgcccccgcggcgcc

SEQ ID NO: 2433015 - RNA, 17 nt, Bordetella pertussis
gcgcccccgcggcgccc

SEQ ID NO: 2433016 - RNA, 19 nt, Bordetella pertussis
gcgcccccucuucucgucc

SEQ ID NO: 2433017 - RNA, 20 nt, Bordetella pertussis
gcgccccgaucagcaagggc

SEQ ID NO: 2433018 - RNA, 17 nt, Bordetella pertussis
gcgccccgaucggcgcc

SEQ ID NO: 2433019 - RNA, 18 nt, Bordetella pertussis
gcgccccgaucggcgccg

SEQ ID NO: 2433020 - RNA, 23 nt, Bordetella pertussis
gcgccccgaucggcgccgcgcgc

SEQ ID NO: 2433021 - RNA, 21 nt, Bordetella pertussis
gcgccccgccacgucgccggc

SEQ ID NO: 2433022 - RNA, 14 nt, Bordetella pertussis
gcgccccgccaugc

SEQ ID NO: 2433023 - RNA, 13 nt, Bordetella pertussis
gcgccccgcuggc

SEQ ID NO: 2433024 - RNA, 15 nt, Bordetella pertussis
gcgccccgcuggccg

SEQ ID NO: 2433025 - RNA, 16 nt, Bordetella pertussis
gcgccccgcuggccgu

SEQ ID NO: 2433026 - RNA, 20 nt, Bordetella pertussis
gcgccccuagcgccgcgcca

SEQ ID NO: 2433027 - RNA, 23 nt, Bordetella pertussis
gcgccccuagcgccgcgccaggu

SEQ ID NO: 2433028 - RNA, 16 nt, Bordetella pertussis
gcgccccuugcggggc

SEQ ID NO: 2433029 - RNA, 17 nt, Bordetella pertussis
gcgccccuugcggggcg

SEQ ID NO: 2433030 - RNA, 21 nt, Bordetella pertussis
gcgccccuugcggggcgcguu

SEQ ID NO: 2433031 - RNA, 12 nt, Bordetella pertussis
gcgcccgacggc

SEQ ID NO: 2433032 - RNA, 17 nt, Bordetella pertussis
gcgcccgacggcgcgcc

SEQ ID NO: 2433033 - RNA, 18 nt, Bordetella pertussis
gcgcccgagcgccacaua

SEQ ID NO: 2433034 - RNA, 17 nt, Bordetella pertussis
gcgcccgaggcgcgcag

SEQ ID NO: 2433035 - RNA, 21 nt, Bordetella pertussis
gcgcccgaggcgcgcagcacg

SEQ ID NO: 2433036 - RNA, 13 nt, Bordetella pertussis
gcgcccgaugccc

SEQ ID NO: 2433037 - RNA, 13 nt, Bordetella pertussis
gcgcccgaugccu

SEQ ID NO: 2433038 - RNA, 21 nt, Bordetella pertussis
gcgcccgaugcucgccggcgc

SEQ ID NO: 2433039 - RNA, 23 nt, Bordetella pertussis
gcgcccgaugcucgccggcgccg

SEQ ID NO: 2433040 - RNA, 12 nt, Bordetella pertussis
gcgcccgcaggc

SEQ ID NO: 2433041 - RNA, 15 nt, Bordetella pertussis
gcgcccgcaggcggc

SEQ ID NO: 2433042 - RNA, 18 nt, Bordetella pertussis
gcgcccgcaggcggcggc

SEQ ID NO: 2433043 - RNA, 20 nt, Bordetella pertussis
gcgcccgcaggcggcggccu

SEQ ID NO: 2433044 - RNA, 21 nt, Bordetella pertussis
gcgcccgcaggcggcggccuc

SEQ ID NO: 2433045 - RNA, 18 nt, Bordetella pertussis
gcgcccgcaucggcuggc

SEQ ID NO: 2433046 - RNA, 20 nt, Bordetella pertussis
gcgcccgcaucggcuggcgc

SEQ ID NO: 2433047 - RNA, 13 nt, Bordetella pertussis
gcgcccgccacca

SEQ ID NO: 2433048 - RNA, 14 nt, Bordetella pertussis
gcgcccgccacguc

SEQ ID NO: 2433049 - RNA, 16 nt, Bordetella pertussis
gcgcccgccgccgggc

SEQ ID NO: 2433050 - RNA, 17 nt, Bordetella pertussis
gcgcccgccgccgggcg

SEQ ID NO: 2433051 - RNA, 14 nt, Bordetella pertussis
gcgcccgccgcgcc

SEQ ID NO: 2433052 - RNA, 15 nt, Bordetella pertussis
gcgcccgccgcgcca

SEQ ID NO: 2433053 - RNA, 16 nt, Bordetella pertussis
gcgcccgccguggcca

SEQ ID NO: 2433054 - RNA, 19 nt, Bordetella pertussis
gcgcccgccugcgccagcc

SEQ ID NO: 2433055 - RNA, 21 nt, Bordetella pertussis
gcgcccgccugcgccagccgc

SEQ ID NO: 2433056 - RNA, 23 nt, Bordetella pertussis
gcgcccgccugcgccagccgcgc

SEQ ID NO: 2433057 - RNA, 15 nt, Bordetella pertussis
gcgcccgccuucagc

SEQ ID NO: 2433058 - RNA, 19 nt, Bordetella pertussis
gcgcccgccuucagcgggc

SEQ ID NO: 2433059 - RNA, 20 nt, Bordetella pertussis
gcgcccgccuucggcggcgg

SEQ ID NO: 2433060 - RNA, 13 nt, Bordetella pertussis
gcgcccgcggccu

SEQ ID NO: 2433061 - RNA, 21 nt, Bordetella pertussis
gcgcccgcggccugcgcgucc

SEQ ID NO: 2433062 - RNA, 17 nt, Bordetella pertussis
gcgcccgcuacgcgggc

SEQ ID NO: 2433063 - RNA, 23 nt, Bordetella pertussis
gcgcccgcuacgcgggcuugcug

SEQ ID NO: 2433064 - RNA, 23 nt, Bordetella pertussis
gcgcccgcuaugcgggcuugcug

SEQ ID NO: 2433065 - RNA, 14 nt, Bordetella pertussis
gcgcccgcugcguc

SEQ ID NO: 2433066 - RNA, 19 nt, Bordetella pertussis
gcgcccgcuugcggccggc

SEQ ID NO: 2433067 - RNA, 16 nt, Bordetella pertussis
gcgcccgcuugggccg

SEQ ID NO: 2433068 - RNA, 19 nt, Bordetella pertussis
gcgcccgcuugggccgcgc

SEQ ID NO: 2433069 - RNA, 15 nt, Bordetella pertussis
gcgcccggccggccc

SEQ ID NO: 2433070 - RNA, 21 nt, Bordetella pertussis
gcgcccggccggccuuccggc

SEQ ID NO: 2433071 - RNA, 22 nt, Bordetella pertussis
gcgcccggccugcgggcgccgc

SEQ ID NO: 2433072 - RNA, 15 nt, Bordetella pertussis
gcgcccggcgccgcg

SEQ ID NO: 2433073 - RNA, 16 nt, Bordetella pertussis
gcgcccggcgccgcgc

SEQ ID NO: 2433074 - RNA, 18 nt, Bordetella pertussis
gcgcccggcgccgcgcgc

SEQ ID NO: 2433075 - RNA, 12 nt, Bordetella pertussis
gcgcccggcggc

SEQ ID NO: 2433076 - RNA, 16 nt, Bordetella pertussis
gcgcccggcggccagg

SEQ ID NO: 2433077 - RNA, 13 nt, Bordetella pertussis
gcgcccggcguga

SEQ ID NO: 2433078 - RNA, 15 nt, Bordetella pertussis
gcgcccgggcugccg

SEQ ID NO: 2433079 - RNA, 16 nt, Bordetella pertussis
gcgcccggucugccac

SEQ ID NO: 2433080 - RNA, 15 nt, Bordetella pertussis
gcgcccguccacggc

SEQ ID NO: 2433081 - RNA, 16 nt, Bordetella pertussis
gcgcccguccacggcc

SEQ ID NO: 2433082 - RNA, 17 nt, Bordetella pertussis
gcgcccguccacggccu

SEQ ID NO: 2433083 - RNA, 18 nt, Bordetella pertussis
gcgcccguccacggccug

SEQ ID NO: 2433084 - RNA, 22 nt, Bordetella pertussis
gcgcccguccacggccugcgcg

SEQ ID NO: 2433085 - RNA, 23 nt, Bordetella pertussis
gcgcccguccacggccugcgcgc

SEQ ID NO: 2433086 - RNA, 13 nt, Bordetella pertussis
gcgcccucagucc

SEQ ID NO: 2433087 - RNA, 19 nt, Bordetella pertussis
gcgcccucaguccagcugg

SEQ ID NO: 2433088 - RNA, 20 nt, Bordetella pertussis
gcgcccucaguccagcuggc

SEQ ID NO: 2433089 - RNA, 20 nt, Bordetella pertussis
gcgcccucguugacgccgac

SEQ ID NO: 2433090 - RNA, 22 nt, Bordetella pertussis
gcgcccucguugacgccgacga

SEQ ID NO: 2433091 - RNA, 18 nt, Bordetella pertussis
gcgcccucuuucgccgcg

SEQ ID NO: 2433092 - RNA, 15 nt, Bordetella pertussis
gcgcccugcacgcgc

SEQ ID NO: 2433093 - RNA, 22 nt, Bordetella pertussis
gcgcccugcacgcgcgcgugca

SEQ ID NO: 2433094 - RNA, 19 nt, Bordetella pertussis
gcgcccugcagggcauggg

SEQ ID NO: 2433095 - RNA, 23 nt, Bordetella pertussis
gcgcccugcagggcaugggcccg

SEQ ID NO: 2433096 - RNA, 22 nt, Bordetella pertussis
gcgcccugcgaacccgccgcga

SEQ ID NO: 2433097 - RNA, 14 nt, Bordetella pertussis
gcgcccugcgcgua

SEQ ID NO: 2433098 - RNA, 18 nt, Bordetella pertussis
gcgcccuggcgccgcggc

SEQ ID NO: 2433099 - RNA, 19 nt, Bordetella pertussis
gcgcccuggcgccgcggcc

SEQ ID NO: 2433100 - RNA, 13 nt, Bordetella pertussis
gcgcccuggcgcg

SEQ ID NO: 2433101 - RNA, 14 nt, Bordetella pertussis
gcgcccuggcgcgg

SEQ ID NO: 2433102 - RNA, 16 nt, Bordetella pertussis
gcgcccuggcgcggcg

SEQ ID NO: 2433103 - RNA, 21 nt, Bordetella pertussis
gcgcccuggcgcggcggcguc

SEQ ID NO: 2433104 - RNA, 13 nt, Bordetella pertussis
gcgcccuggcgug

SEQ ID NO: 2433105 - RNA, 13 nt, Bordetella pertussis
gcgcccuggggcg

SEQ ID NO: 2433106 - RNA, 21 nt, Bordetella pertussis
gcgcccuggggcgcgguccgg

SEQ ID NO: 2433107 - RNA, 14 nt, Bordetella pertussis
gcgcccuugaugcc

SEQ ID NO: 2433108 - RNA, 21 nt, Bordetella pertussis
gcgcccuugaugccgucggcg

SEQ ID NO: 2433109 - RNA, 19 nt, Bordetella pertussis
gcgcccuuugcauugcggc

SEQ ID NO: 2433110 - RNA, 21 nt, Bordetella pertussis
gcgccgaaacauaagucugcg

SEQ ID NO: 2433111 - RNA, 21 nt, Bordetella pertussis
gcgccgaaauauggaccagcc

SEQ ID NO: 2433112 - RNA, 13 nt, Bordetella pertussis
gcgccgaacacca

SEQ ID NO: 2433113 - RNA, 16 nt, Bordetella pertussis
gcgccgaacaccagcu

SEQ ID NO: 2433114 - RNA, 18 nt, Bordetella pertussis
gcgccgaacaccagcucg

SEQ ID NO: 2433115 - RNA, 21 nt, Bordetella pertussis
gcgccgaacaccagcucggcg

SEQ ID NO: 2433116 - RNA, 23 nt, Bordetella pertussis
gcgccgaacaccagcucggcggc

SEQ ID NO: 2433117 - RNA, 13 nt, Bordetella pertussis
gcgccgaacgcgc

SEQ ID NO: 2433118 - RNA, 14 nt, Bordetella pertussis
gcgccgaacgcgca

SEQ ID NO: 2433119 - RNA, 15 nt, Bordetella pertussis
gcgccgaagcgcagg

SEQ ID NO: 2433120 - RNA, 17 nt, Bordetella pertussis
gcgccgaagcgcaggcc

SEQ ID NO: 2433121 - RNA, 15 nt, Bordetella pertussis
gcgccgaaggcggcg

SEQ ID NO: 2433122 - RNA, 16 nt, Bordetella pertussis
gcgccgaaggcggcgc

SEQ ID NO: 2433123 - RNA, 18 nt, Bordetella pertussis
gcgccgaaggcggcgccg

SEQ ID NO: 2433124 - RNA, 20 nt, Bordetella pertussis
gcgccgcccgcggccagcca

SEQ ID NO: 2433125 - RNA, 12 nt, Bordetella pertussis
gcgccgccgcca

SEQ ID NO: 2433126 - RNA, 12 nt, Bordetella pertussis
gcgccgccgccc

SEQ ID NO: 2433127 - RNA, 15 nt, Bordetella pertussis
gcgccgccgcccggc

SEQ ID NO: 2433128 - RNA, 13 nt, Bordetella pertussis
gcgccgccgcccu

SEQ ID NO: 2433129 - RNA, 16 nt, Bordetella pertussis
gcgccgccgcccuggc

SEQ ID NO: 2433130 - RNA, 16 nt, Bordetella pertussis
gcgccgccgccgcggc

SEQ ID NO: 2433131 - RNA, 22 nt, Bordetella pertussis
gcgccgccgccgcggccuggcc

SEQ ID NO: 2433132 - RNA, 20 nt, Bordetella pertussis
gcgccgccgccggcccgcca

SEQ ID NO: 2433133 - RNA, 21 nt, Bordetella pertussis
gcgccgccgccggcccgccac

SEQ ID NO: 2433134 - RNA, 15 nt, Bordetella pertussis
gcgccgccgccuggc

SEQ ID NO: 2433135 - RNA, 13 nt, Bordetella pertussis
gcgccgccgcgcg

SEQ ID NO: 2433136 - RNA, 14 nt, Bordetella pertussis
gcgccgccgcgcgc

SEQ ID NO: 2433137 - RNA, 17 nt, Bordetella pertussis
gcgccgccgcgcgcugg

SEQ ID NO: 2433138 - RNA, 20 nt, Bordetella pertussis
gcgccgccgcgcgcuggcug

SEQ ID NO: 2433139 - RNA, 10 nt, Bordetella pertussis
gcgccgccgg

SEQ ID NO: 2433140 - RNA, 13 nt, Bordetella pertussis
gcgccgccggcca

SEQ ID NO: 2433141 - RNA, 17 nt, Bordetella pertussis
gcgccgccggccagccu

SEQ ID NO: 2433142 - RNA, 14 nt, Bordetella pertussis
gcgccgccggccau

SEQ ID NO: 2433143 - RNA, 14 nt, Bordetella pertussis
gcgccgccggccug

SEQ ID NO: 2433144 - RNA, 18 nt, Bordetella pertussis
gcgccgccggcggccugg

SEQ ID NO: 2433145 - RNA, 20 nt, Bordetella pertussis
gcgccgccggcggccuggac

SEQ ID NO: 2433146 - RNA, 16 nt, Bordetella pertussis
gcgccgccgggccugc

SEQ ID NO: 2433147 - RNA, 19 nt, Bordetella pertussis
gcgccgccgggccugcccg

SEQ ID NO: 2433148 - RNA, 12 nt, Bordetella pertussis
gcgccgccgggu

SEQ ID NO: 2433149 - RNA, 12 nt, Bordetella pertussis
gcgccgccggug

SEQ ID NO: 2433150 - RNA, 14 nt, Bordetella pertussis
gcgccgccggugca

SEQ ID NO: 2433151 - RNA, 20 nt, Bordetella pertussis
gcgccgccggugcaccaggc

SEQ ID NO: 2433152 - RNA, 20 nt, Bordetella pertussis
gcgccgccguaggacagccc

SEQ ID NO: 2433153 - RNA, 17 nt, Bordetella pertussis
gcgccgccuaccaggug

SEQ ID NO: 2433154 - RNA, 21 nt, Bordetella pertussis
gcgccgccuaccaggugggcg

SEQ ID NO: 2433155 - RNA, 16 nt, Bordetella pertussis
gcgccgccucagcccg

SEQ ID NO: 2433156 - RNA, 19 nt, Bordetella pertussis
gcgccgccucaggccggcg

SEQ ID NO: 2433157 - RNA, 14 nt, Bordetella pertussis
gcgccgccucgacc

SEQ ID NO: 2433158 - RNA, 16 nt, Bordetella pertussis
gcgccgccucgaccgg

SEQ ID NO: 2433159 - RNA, 22 nt, Bordetella pertussis
gcgccgccucgauugaccagca

SEQ ID NO: 2433160 - RNA, 14 nt, Bordetella pertussis
gcgccgccucgcgc

SEQ ID NO: 2433161 - RNA, 16 nt, Bordetella pertussis
gcgccgccucgcgcuc

SEQ ID NO: 2433162 - RNA, 15 nt, Bordetella pertussis
gcgccgccucgggca

SEQ ID NO: 2433163 - RNA, 21 nt, Bordetella pertussis
gcgccgccucgggcacggcca

SEQ ID NO: 2433164 - RNA, 23 nt, Bordetella pertussis
gcgccgccugguaguaaucgcgc

SEQ ID NO: 2433165 - RNA, 22 nt, Bordetella pertussis
gcgccgccuucaccggccccau

SEQ ID NO: 2433166 - RNA, 18 nt, Bordetella pertussis
gcgccgcgaacuggcggu

SEQ ID NO: 2433167 - RNA, 12 nt, Bordetella pertussis
gcgccgcgagcg

SEQ ID NO: 2433168 - RNA, 13 nt, Bordetella pertussis
gcgccgcgagcgc

SEQ ID NO: 2433169 - RNA, 14 nt, Bordetella pertussis
gcgccgcgagcgcc

SEQ ID NO: 2433170 - RNA, 19 nt, Bordetella pertussis
gcgccgcgauggcgccggc

SEQ ID NO: 2433171 - RNA, 21 nt, Bordetella pertussis
gcgccgcgauggcgccggcca

SEQ ID NO: 2433172 - RNA, 22 nt, Bordetella pertussis
gcgccgcgauggcgccggccag

SEQ ID NO: 2433173 - RNA, 13 nt, Bordetella pertussis
gcgccgcgcacgc

SEQ ID NO: 2433174 - RNA, 14 nt, Bordetella pertussis
gcgccgcgcagcag

SEQ ID NO: 2433175 - RNA, 17 nt, Bordetella pertussis
gcgccgcgcaucgauca

SEQ ID NO: 2433176 - RNA, 14 nt, Bordetella pertussis
gcgccgcgccaggu

SEQ ID NO: 2433177 - RNA, 19 nt, Bordetella pertussis
gcgccgcgccccaucacca

SEQ ID NO: 2433178 - RNA, 15 nt, Bordetella pertussis
gcgccgcgcccggcc

SEQ ID NO: 2433179 - RNA, 17 nt, Bordetella pertussis
gcgccgcgcccggccgg

SEQ ID NO: 2433180 - RNA, 20 nt, Bordetella pertussis
gcgccgcgcccggccggccc

SEQ ID NO: 2433181 - RNA, 21 nt, Bordetella pertussis
gcgccgcgccgaaggcgugcu

SEQ ID NO: 2433182 - RNA, 14 nt, Bordetella pertussis
gcgccgcgccgccc

SEQ ID NO: 2433183 - RNA, 15 nt, Bordetella pertussis
gcgccgcgccgcccc

SEQ ID NO: 2433184 - RNA, 18 nt, Bordetella pertussis
gcgccgcgccgcccccgc

SEQ ID NO: 2433185 - RNA, 13 nt, Bordetella pertussis
gcgccgcgccggg

SEQ ID NO: 2433186 - RNA, 16 nt, Bordetella pertussis
gcgccgcgccggggcg

SEQ ID NO: 2433187 - RNA, 15 nt, Bordetella pertussis
gcgccgcgccgguca

SEQ ID NO: 2433188 - RNA, 16 nt, Bordetella pertussis
gcgccgcgccggucag

SEQ ID NO: 2433189 - RNA, 15 nt, Bordetella pertussis
gcgccgcgccuugcc

SEQ ID NO: 2433190 - RNA, 16 nt, Bordetella pertussis
gcgccgcgccuugccc

SEQ ID NO: 2433191 - RNA, 17 nt, Bordetella pertussis
gcgccgcgccuugcccg

SEQ ID NO: 2433192 - RNA, 15 nt, Bordetella pertussis
gcgccgcgcgcacgg

SEQ ID NO: 2433193 - RNA, 14 nt, Bordetella pertussis
gcgccgcgcgccau

SEQ ID NO: 2433194 - RNA, 13 nt, Bordetella pertussis
gcgccgcgcgccg

SEQ ID NO: 2433195 - RNA, 13 nt, Bordetella pertussis
gcgccgcgcgcgg

SEQ ID NO: 2433196 - RNA, 15 nt, Bordetella pertussis
gcgccgcgcgcggcc

SEQ ID NO: 2433197 - RNA, 19 nt, Bordetella pertussis
gcgccgcgcgcggccccgg

SEQ ID NO: 2433198 - RNA, 19 nt, Bordetella pertussis
gcgccgcgcgcggcggccu

SEQ ID NO: 2433199 - RNA, 20 nt, Bordetella pertussis
gcgccgcgcgcggcggccuu

SEQ ID NO: 2433200 - RNA, 22 nt, Bordetella pertussis
gcgccgcgcgcgugccgcaggc

SEQ ID NO: 2433201 - RNA, 12 nt, Bordetella pertussis
gcgccgcgcgcu

SEQ ID NO: 2433202 - RNA, 14 nt, Bordetella pertussis
gcgccgcgcgcugg

SEQ ID NO: 2433203 - RNA, 19 nt, Bordetella pertussis
gcgccgcgcuccagggcgu

SEQ ID NO: 2433204 - RNA, 16 nt, Bordetella pertussis
gcgccgcgcucgcgcc

SEQ ID NO: 2433205 - RNA, 20 nt, Bordetella pertussis
gcgccgcgcucgcgccaggc

SEQ ID NO: 2433206 - RNA, 15 nt, Bordetella pertussis
gcgccgcgcugaucc

SEQ ID NO: 2433207 - RNA, 16 nt, Bordetella pertussis
gcgccgcgcuucgucg

SEQ ID NO: 2433208 - RNA, 15 nt, Bordetella pertussis
gcgccgcggccacgc

SEQ ID NO: 2433209 - RNA, 14 nt, Bordetella pertussis
gcgccgcggccggc

SEQ ID NO: 2433210 - RNA, 15 nt, Bordetella pertussis
gcgccgcggccggcg

SEQ ID NO: 2433211 - RNA, 21 nt, Bordetella pertussis
gcgccgcggccggcggcgccg

SEQ ID NO: 2433212 - RNA, 15 nt, Bordetella pertussis
gcgccgcggccuguc

SEQ ID NO: 2433213 - RNA, 13 nt, Bordetella pertussis
gcgccgcggcgcu

SEQ ID NO: 2433214 - RNA, 15 nt, Bordetella pertussis
gcgccgcggcgcuuc

SEQ ID NO: 2433215 - RNA, 15 nt, Bordetella pertussis
gcgccgcggcggcga

SEQ ID NO: 2433216 - RNA, 23 nt, Bordetella pertussis
gcgccgcggcggcgagggcgucg

SEQ ID NO: 2433217 - RNA, 13 nt, Bordetella pertussis
gcgccgcggcggg

SEQ ID NO: 2433218 - RNA, 14 nt, Bordetella pertussis
gcgccgcggcgggc

SEQ ID NO: 2433219 - RNA, 19 nt, Bordetella pertussis
gcgccgcggcgggcuuggc

SEQ ID NO: 2433220 - RNA, 15 nt, Bordetella pertussis
gcgccgcgggcugcg

SEQ ID NO: 2433221 - RNA, 22 nt, Bordetella pertussis
gcgccgcgggcugcgacaggcg

SEQ ID NO: 2433222 - RNA, 12 nt, Bordetella pertussis
gcgccgcggggc

SEQ ID NO: 2433223 - RNA, 15 nt, Bordetella pertussis
gcgccgcggugaugc

SEQ ID NO: 2433224 - RNA, 19 nt, Bordetella pertussis
gcgccgcgucauggcgugc

SEQ ID NO: 2433225 - RNA, 15 nt, Bordetella pertussis
gcgccgcguccggcg

SEQ ID NO: 2433226 - RNA, 22 nt, Bordetella pertussis
gcgccgcguccggcgcccgccg

SEQ ID NO: 2433227 - RNA, 15 nt, Bordetella pertussis
gcgccgcgucgagcg

SEQ ID NO: 2433228 - RNA, 19 nt, Bordetella pertussis
gcgccgcgucuucggcgcg

SEQ ID NO: 2433229 - RNA, 23 nt, Bordetella pertussis
gcgccgcgugguggcgcagaugg

SEQ ID NO: 2433230 - RNA, 18 nt, Bordetella pertussis
gcgccgcguucacgccgg

SEQ ID NO: 2433231 - RNA, 19 nt, Bordetella pertussis
gcgccgcguucacgccggc

SEQ ID NO: 2433232 - RNA, 22 nt, Bordetella pertussis
gcgccgcguugcagccacaggc

SEQ ID NO: 2433233 - RNA, 16 nt, Bordetella pertussis
gcgccgcuacagcguc

SEQ ID NO: 2433234 - RNA, 16 nt, Bordetella pertussis
gcgccgcuacgcggcg

SEQ ID NO: 2433235 - RNA, 16 nt, Bordetella pertussis
gcgccgcucuuggcgu

SEQ ID NO: 2433236 - RNA, 17 nt, Bordetella pertussis
gcgccgcugcagcgcug

SEQ ID NO: 2433237 - RNA, 18 nt, Bordetella pertussis
gcgccgcugcagcgcugg

SEQ ID NO: 2433238 - RNA, 12 nt, Bordetella pertussis
gcgccggcuggg

SEQ ID NO: 2433239 - RNA, 15 nt, Bordetella pertussis
gcgccggcugggcgu

SEQ ID NO: 2433240 - RNA, 14 nt, Bordetella pertussis
gcgccggcuugcgc

SEQ ID NO: 2433241 - RNA, 20 nt, Bordetella pertussis
gcgccgggaaaaagagccug

SEQ ID NO: 2433242 - RNA, 21 nt, Bordetella pertussis
gcgccgggaaaaagagccugu

SEQ ID NO: 2433243 - RNA, 16 nt, Bordetella pertussis
gcgccgggcagcccgc

SEQ ID NO: 2433244 - RNA, 13 nt, Bordetella pertussis
gcgccgggccaga

SEQ ID NO: 2433245 - RNA, 20 nt, Bordetella pertussis
gcgccgggcccggccacggc

SEQ ID NO: 2433246 - RNA, 22 nt, Bordetella pertussis
gcgccgggcccggccacggccg

SEQ ID NO: 2433247 - RNA, 14 nt, Bordetella pertussis
gcgccgggccgcua

SEQ ID NO: 2433248 - RNA, 13 nt, Bordetella pertussis
gcgccgggccggc

SEQ ID NO: 2433249 - RNA, 14 nt, Bordetella pertussis
gcgccgggccggcg

SEQ ID NO: 2433250 - RNA, 20 nt, Bordetella pertussis
gcgccgggccuagcccggcg

SEQ ID NO: 2433251 - RNA, 23 nt, Bordetella pertussis
gcgccgggccuagcccggcgcca

SEQ ID NO: 2433252 - RNA, 15 nt, Bordetella pertussis
gcgccgggcgaaccg

SEQ ID NO: 2433253 - RNA, 18 nt, Bordetella pertussis
gcgccgggcgaaccggug

SEQ ID NO: 2433254 - RNA, 14 nt, Bordetella pertussis
gcgccgggcgacgg

SEQ ID NO: 2433255 - RNA, 15 nt, Bordetella pertussis
gcgccgggcgccgcg

SEQ ID NO: 2433256 - RNA, 16 nt, Bordetella pertussis
gcgccgggcgccgcgc

SEQ ID NO: 2433257 - RNA, 17 nt, Bordetella pertussis
gcgccgggcgccgcgcc

SEQ ID NO: 2433258 - RNA, 14 nt, Bordetella pertussis
gcgccgggcgcgcc

SEQ ID NO: 2433259 - RNA, 14 nt, Bordetella pertussis
gcgccgggcgcggc

SEQ ID NO: 2433260 - RNA, 19 nt, Bordetella pertussis
gcgccgggcgcggccaggc

SEQ ID NO: 2433261 - RNA, 20 nt, Bordetella pertussis
gcgccgggcgcggccaggcg

SEQ ID NO: 2433262 - RNA, 21 nt, Bordetella pertussis
gcgccgggcgcggccaggcgc

SEQ ID NO: 2433263 - RNA, 16 nt, Bordetella pertussis
gcgccgggcgggucgg

SEQ ID NO: 2433264 - RNA, 21 nt, Bordetella pertussis
gcgccgggcgggucggcgaac

SEQ ID NO: 2433265 - RNA, 22 nt, Bordetella pertussis
gcgccgggcgggucggcgaaca

SEQ ID NO: 2433266 - RNA, 21 nt, Bordetella pertussis
gcgccgggcguuuuugcgucc

SEQ ID NO: 2433267 - RNA, 23 nt, Bordetella pertussis
gcgccgggcuggugcgccgugcc

SEQ ID NO: 2433268 - RNA, 16 nt, Bordetella pertussis
gcgccggggcgccggu

SEQ ID NO: 2433269 - RNA, 13 nt, Bordetella pertussis
gcgccggggcggc

SEQ ID NO: 2433270 - RNA, 19 nt, Bordetella pertussis
gcgccggggcggcgcagca

SEQ ID NO: 2433271 - RNA, 14 nt, Bordetella pertussis
gcgccggggcggcu

SEQ ID NO: 2433272 - RNA, 19 nt, Bordetella pertussis
gcgccggggcggcucggcc

SEQ ID NO: 2433273 - RNA, 14 nt, Bordetella pertussis
gcgccggggcgugg

SEQ ID NO: 2433274 - RNA, 14 nt, Bordetella pertussis
gcgccggggggcgc

SEQ ID NO: 2433275 - RNA, 17 nt, Bordetella pertussis
gcgccggggggcgcacg

SEQ ID NO: 2433276 - RNA, 18 nt, Bordetella pertussis
gcgccggggggcgcacgc

SEQ ID NO: 2433277 - RNA, 15 nt, Bordetella pertussis
gcgccggggucagcg

SEQ ID NO: 2433278 - RNA, 20 nt, Bordetella pertussis
gcgccggggucagcgccggc

SEQ ID NO: 2433279 - RNA, 21 nt, Bordetella pertussis
gcgccggggucagcgccggca

SEQ ID NO: 2433280 - RNA, 23 nt, Bordetella pertussis
gcgccggggucagcgccggcacg

SEQ ID NO: 2433281 - RNA, 16 nt, Bordetella pertussis
gcgccggguccggccg

SEQ ID NO: 2433282 - RNA, 17 nt, Bordetella pertussis
gcgccggguccggccgc

SEQ ID NO: 2433283 - RNA, 21 nt, Bordetella pertussis
gcgccggguccggccgcgcaa

SEQ ID NO: 2433284 - RNA, 19 nt, Bordetella pertussis
gcgccggguggguucgggc

SEQ ID NO: 2433285 - RNA, 21 nt, Bordetella pertussis
gcgccggguguuccggcgcgc

SEQ ID NO: 2433286 - RNA, 13 nt, Bordetella pertussis
gcgccggucaggc

SEQ ID NO: 2433287 - RNA, 15 nt, Bordetella pertussis
gcgccggucaggcgu

SEQ ID NO: 2433288 - RNA, 13 nt, Bordetella pertussis
gcgccgguccagc

SEQ ID NO: 2433289 - RNA, 14 nt, Bordetella pertussis
gcgccgguccagcg

SEQ ID NO: 2433290 - RNA, 16 nt, Bordetella pertussis
gcgccgguccagcgcc

SEQ ID NO: 2433291 - RNA, 15 nt, Bordetella pertussis
gcgccggucgccgcg

SEQ ID NO: 2433292 - RNA, 15 nt, Bordetella pertussis
gcgccggugaccgcc

SEQ ID NO: 2433293 - RNA, 19 nt, Bordetella pertussis
gcgccggugaccgccagca

SEQ ID NO: 2433294 - RNA, 21 nt, Bordetella pertussis
gcgccggugaccgccagcagg

SEQ ID NO: 2433295 - RNA, 22 nt, Bordetella pertussis
gcgccggugcaggucaucgcgc

SEQ ID NO: 2433296 - RNA, 15 nt, Bordetella pertussis
gcgccggugcgcggc

SEQ ID NO: 2433297 - RNA, 16 nt, Bordetella pertussis
gcgccggugcgcggcg

SEQ ID NO: 2433298 - RNA, 22 nt, Bordetella pertussis
gcgccggugcgcggcgcccccg

SEQ ID NO: 2433299 - RNA, 23 nt, Bordetella pertussis
gcgccggugcgcggcgcccccgc

SEQ ID NO: 2433300 - RNA, 13 nt, Bordetella pertussis
gcgccgguggcca

SEQ ID NO: 2433301 - RNA, 16 nt, Bordetella pertussis
gcgccgguggccagca

SEQ ID NO: 2433302 - RNA, 18 nt, Bordetella pertussis
gcgccgguggccagcagc

SEQ ID NO: 2433303 - RNA, 19 nt, Bordetella pertussis
gcgccgguggccagcagcu

SEQ ID NO: 2433304 - RNA, 20 nt, Bordetella pertussis
gcgccgguggccagcagcug

SEQ ID NO: 2433305 - RNA, 12 nt, Bordetella pertussis
gcgccggugggc

SEQ ID NO: 2433306 - RNA, 15 nt, Bordetella pertussis
gcgccggugucggcc

SEQ ID NO: 2433307 - RNA, 16 nt, Bordetella pertussis
gcgccguacagccgcg

SEQ ID NO: 2433308 - RNA, 14 nt, Bordetella pertussis
gcgccguaccagcg

SEQ ID NO: 2433309 - RNA, 16 nt, Bordetella pertussis
gcgccguaccagcgcg

SEQ ID NO: 2433310 - RNA, 17 nt, Bordetella pertussis
gcgccguaccagcgcga

SEQ ID NO: 2433311 - RNA, 14 nt, Bordetella pertussis
gcgccguaccccag

SEQ ID NO: 2433312 - RNA, 13 nt, Bordetella pertussis
gcgccguaccugc

SEQ ID NO: 2433313 - RNA, 16 nt, Bordetella pertussis
gcgccguaccugcagc

SEQ ID NO: 2433314 - RNA, 18 nt, Bordetella pertussis
gcgccguaccugcagcag

SEQ ID NO: 2433315 - RNA, 21 nt, Bordetella pertussis
gcgccguaccugcagcaggcg

SEQ ID NO: 2433316 - RNA, 14 nt, Bordetella pertussis
gcgccgucagcagc

SEQ ID NO: 2433317 - RNA, 16 nt, Bordetella pertussis
gcgccgucagcagcgc

SEQ ID NO: 2433318 - RNA, 20 nt, Bordetella pertussis
gcgccgucagcagcgcggcg

SEQ ID NO: 2433319 - RNA, 12 nt, Bordetella pertussis
gcgccguccagc

SEQ ID NO: 2433320 - RNA, 13 nt, Bordetella pertussis
gcgccguccagcg

SEQ ID NO: 2433321 - RNA, 16 nt, Bordetella pertussis
gcgccguccagcgcgg

SEQ ID NO: 2433322 - RNA, 18 nt, Bordetella pertussis
gcgccguccagcgcggca

SEQ ID NO: 2433323 - RNA, 20 nt, Bordetella pertussis
gcgccguccagcgcggcaug

SEQ ID NO: 2433324 - RNA, 12 nt, Bordetella pertussis
gcgccguccagu

SEQ ID NO: 2433325 - RNA, 18 nt, Bordetella pertussis
gcgccguccgagcccgac

SEQ ID NO: 2433326 - RNA, 20 nt, Bordetella pertussis
gcgccguccgagcccgacgc

SEQ ID NO: 2433327 - RNA, 15 nt, Bordetella pertussis
gcgccguccgggccg

SEQ ID NO: 2433328 - RNA, 20 nt, Bordetella pertussis
gcgccguccgugagugcagc

SEQ ID NO: 2433329 - RNA, 23 nt, Bordetella pertussis
gcgccguccgugagugcagcgcu

SEQ ID NO: 2433330 - RNA, 21 nt, Bordetella pertussis
gcgccguccucaggcccgcgg

SEQ ID NO: 2433331 - RNA, 23 nt, Bordetella pertussis
gcgccguccucaggcccgcggcg

SEQ ID NO: 2433332 - RNA, 19 nt, Bordetella pertussis
gcgccgucgaacuccugca

SEQ ID NO: 2433333 - RNA, 20 nt, Bordetella pertussis
gcgccgucgaacuccugcag

SEQ ID NO: 2433334 - RNA, 14 nt, Bordetella pertussis
gcgccgucgaagcc

SEQ ID NO: 2433335 - RNA, 18 nt, Bordetella pertussis
gcgccgucgaagccggcg

SEQ ID NO: 2433336 - RNA, 21 nt, Bordetella pertussis
gcgccgucgaagccggcgcca

SEQ ID NO: 2433337 - RNA, 18 nt, Bordetella pertussis
gcgccgucgggggccggc

SEQ ID NO: 2433338 - RNA, 14 nt, Bordetella pertussis
gcgccgucugcgcc

SEQ ID NO: 2433339 - RNA, 18 nt, Bordetella pertussis
gcgccgucugcgccgccg

SEQ ID NO: 2433340 - RNA, 19 nt, Bordetella pertussis
gcgccgucugcgccgccgc

SEQ ID NO: 2433341 - RNA, 15 nt, Bordetella pertussis
gcgccgucugugcgc

SEQ ID NO: 2433342 - RNA, 17 nt, Bordetella pertussis
gcgccgucugugcgccc

SEQ ID NO: 2433343 - RNA, 19 nt, Bordetella pertussis
gcgccgucugugcgccccg

SEQ ID NO: 2433344 - RNA, 22 nt, Bordetella pertussis
gcgccgucugugcgccccgcug

SEQ ID NO: 2433345 - RNA, 23 nt, Bordetella pertussis
gcgccgucugugcgccccgcugg

SEQ ID NO: 2433346 - RNA, 20 nt, Bordetella pertussis
gcgccgucuucgguggcccg

SEQ ID NO: 2433347 - RNA, 23 nt, Bordetella pertussis
gcgccgucuucgguggcccgcca

SEQ ID NO: 2433348 - RNA, 15 nt, Bordetella pertussis
gcgccgugaaugcgc

SEQ ID NO: 2433349 - RNA, 21 nt, Bordetella pertussis
gcgccgugaaugcgccuggcg

SEQ ID NO: 2433350 - RNA, 22 nt, Bordetella pertussis
gcgccgugaaugcgccuggcgu

SEQ ID NO: 2433351 - RNA, 23 nt, Bordetella pertussis
gcgcgaccuccggcaacagcagg

SEQ ID NO: 2433352 - RNA, 13 nt, Bordetella pertussis
gcgcgaccugcgc

SEQ ID NO: 2433353 - RNA, 20 nt, Bordetella pertussis
gcgcgaccugcgcgaccgcc

SEQ ID NO: 2433354 - RNA, 19 nt, Bordetella pertussis
gcgcgaccuugucuucgau

SEQ ID NO: 2433355 - RNA, 16 nt, Bordetella pertussis
gcgcgacgacagcggc

SEQ ID NO: 2433356 - RNA, 18 nt, Bordetella pertussis
gcgcgacgacagcggcga

SEQ ID NO: 2433357 - RNA, 22 nt, Bordetella pertussis
gcgcgacgacagcggcgagcgc

SEQ ID NO: 2433358 - RNA, 13 nt, Bordetella pertussis
gcgcgacgccagc

SEQ ID NO: 2433359 - RNA, 21 nt, Bordetella pertussis
gcgcgacgccagcgcgccaug

SEQ ID NO: 2433360 - RNA, 12 nt, Bordetella pertussis
gcgcgacgccgu

SEQ ID NO: 2433361 - RNA, 17 nt, Bordetella pertussis
gcgcgacgcgcucgucg

SEQ ID NO: 2433362 - RNA, 12 nt, Bordetella pertussis
gcgcgacggcga

SEQ ID NO: 2433363 - RNA, 14 nt, Bordetella pertussis
gcgcgacggcgccg

SEQ ID NO: 2433364 - RNA, 15 nt, Bordetella pertussis
gcgcgacggcgccgg

SEQ ID NO: 2433365 - RNA, 16 nt, Bordetella pertussis
gcgcgacggcgccggc

SEQ ID NO: 2433366 - RNA, 14 nt, Bordetella pertussis
gcgcgacggcggcc

SEQ ID NO: 2433367 - RNA, 15 nt, Bordetella pertussis
gcgcgacggcggccu

SEQ ID NO: 2433368 - RNA, 18 nt, Bordetella pertussis
gcgcgacuccaccggcgu

SEQ ID NO: 2433369 - RNA, 13 nt, Bordetella pertussis
gcgcgacuggccc

SEQ ID NO: 2433370 - RNA, 22 nt, Bordetella pertussis
gcgcgacuggcccaggcgggcc

SEQ ID NO: 2433371 - RNA, 23 nt, Bordetella pertussis
gcgcgacuggcccaggcgggcca

SEQ ID NO: 2433372 - RNA, 21 nt, Bordetella pertussis
gcgcgacuuccucgacccgcg

SEQ ID NO: 2433373 - RNA, 23 nt, Bordetella pertussis
gcgcgacuuccucgacccgcgcc

SEQ ID NO: 2433374 - RNA, 16 nt, Bordetella pertussis
gcgcgagaaccaggcc

SEQ ID NO: 2433375 - RNA, 20 nt, Bordetella pertussis
gcgcgagaaccaggccacga

SEQ ID NO: 2433376 - RNA, 17 nt, Bordetella pertussis
gcgcgagaauggcgcga

SEQ ID NO: 2433377 - RNA, 23 nt, Bordetella pertussis
gcgcgagaccacgauggccggcg

SEQ ID NO: 2433378 - RNA, 14 nt, Bordetella pertussis
gcgcgagaccagcg

SEQ ID NO: 2433379 - RNA, 17 nt, Bordetella pertussis
gcgcgagaccagcggau

SEQ ID NO: 2433380 - RNA, 23 nt, Bordetella pertussis
gcgcgagaccagcggaucgccgg

SEQ ID NO: 2433381 - RNA, 15 nt, Bordetella pertussis
gcgcgagcagggcau

SEQ ID NO: 2433382 - RNA, 17 nt, Bordetella pertussis
gcgcgagcagggcauca

SEQ ID NO: 2433383 - RNA, 20 nt, Bordetella pertussis
gcgcgagcagggcaucacca

SEQ ID NO: 2433384 - RNA, 14 nt, Bordetella pertussis
gcgcgagccgccca

SEQ ID NO: 2433385 - RNA, 21 nt, Bordetella pertussis
gcgcgagccgcccacgggcgc

SEQ ID NO: 2433386 - RNA, 14 nt, Bordetella pertussis
gcgcgagcgcaagc

SEQ ID NO: 2433387 - RNA, 22 nt, Bordetella pertussis
gcgcgagcgcaagcaccgccug

SEQ ID NO: 2433388 - RNA, 16 nt, Bordetella pertussis
gcgcgagcgccgggcg

SEQ ID NO: 2433389 - RNA, 14 nt, Bordetella pertussis
gcgcgagcgcgugg

SEQ ID NO: 2433390 - RNA, 16 nt, Bordetella pertussis
gcgcgagcggcggccg

SEQ ID NO: 2433391 - RNA, 14 nt, Bordetella pertussis
gcgcgaggcggcga

SEQ ID NO: 2433392 - RNA, 16 nt, Bordetella pertussis
gcgcgaggcggcgacg

SEQ ID NO: 2433393 - RNA, 21 nt, Bordetella pertussis
gcgcgaggcggcgacgcagca

SEQ ID NO: 2433394 - RNA, 14 nt, Bordetella pertussis
gcgcgaggcggcgg

SEQ ID NO: 2433395 - RNA, 15 nt, Bordetella pertussis
gcgcgaggcggcggc

SEQ ID NO: 2433396 - RNA, 17 nt, Bordetella pertussis
gcgcgaggcggcggccg

SEQ ID NO: 2433397 - RNA, 18 nt, Bordetella pertussis
gcgcgaggcggcggccgg

SEQ ID NO: 2433398 - RNA, 14 nt, Bordetella pertussis
gcgcgagggcauca

SEQ ID NO: 2433399 - RNA, 16 nt, Bordetella pertussis
gcgcgagggcaucagc

SEQ ID NO: 2433400 - RNA, 17 nt, Bordetella pertussis
gcgcgagggcaucagcg

SEQ ID NO: 2433401 - RNA, 13 nt, Bordetella pertussis
gcgcgagggugcc

SEQ ID NO: 2433402 - RNA, 14 nt, Bordetella pertussis
gcgcgaggugccgg

SEQ ID NO: 2433403 - RNA, 19 nt, Bordetella pertussis
gcgcgagguggcgcucgcg

SEQ ID NO: 2433404 - RNA, 16 nt, Bordetella pertussis
gcgcgaggugggcggc

SEQ ID NO: 2433405 - RNA, 17 nt, Bordetella pertussis
gcgcgaggugggcggca

SEQ ID NO: 2433406 - RNA, 21 nt, Bordetella pertussis
gcgcgaguaucccuaccgccu

SEQ ID NO: 2433407 - RNA, 20 nt, Bordetella pertussis
gcgcgaguauucacgccgcg

SEQ ID NO: 2433408 - RNA, 20 nt, Bordetella pertussis
gcgcgauagauggccaggug

SEQ ID NO: 2433409 - RNA, 19 nt, Bordetella pertussis
gcgcgauagcgcuugccug

SEQ ID NO: 2433410 - RNA, 13 nt, Bordetella pertussis
gcgcgauccgcgc

SEQ ID NO: 2433411 - RNA, 16 nt, Bordetella pertussis
gcgcgauccgcgccag

SEQ ID NO: 2433412 - RNA, 18 nt, Bordetella pertussis
gcgcgauccgcgccaggc

SEQ ID NO: 2433413 - RNA, 19 nt, Bordetella pertussis
gcgcgauccgcgccaggcg

SEQ ID NO: 2433414 - RNA, 17 nt, Bordetella pertussis
gcgcgauccggcguggu

SEQ ID NO: 2433415 - RNA, 15 nt, Bordetella pertussis
gcgcgauccuggggc

SEQ ID NO: 2433416 - RNA, 20 nt, Bordetella pertussis
gcgcgauccuucgcggccgu

SEQ ID NO: 2433417 - RNA, 17 nt, Bordetella pertussis
gcgcgaucgccagcagg

SEQ ID NO: 2433418 - RNA, 18 nt, Bordetella pertussis
gcgcgaucgccagcaggc

SEQ ID NO: 2433419 - RNA, 19 nt, Bordetella pertussis
gcgcgaucgccagcaggcg

SEQ ID NO: 2433420 - RNA, 17 nt, Bordetella pertussis
gcgcgaucucgcgcagg

SEQ ID NO: 2433421 - RNA, 21 nt, Bordetella pertussis
gcgcgaucucgcgcagggugg

SEQ ID NO: 2433422 - RNA, 22 nt, Bordetella pertussis
gcgcgaucucgcgcaggguggc

SEQ ID NO: 2433423 - RNA, 17 nt, Bordetella pertussis
gcgcgaucucgggcagg

SEQ ID NO: 2433424 - RNA, 18 nt, Bordetella pertussis
gcgcgaucucgggcaggu

SEQ ID NO: 2433425 - RNA, 22 nt, Bordetella pertussis
gcgcgaucucguggcccagcac

SEQ ID NO: 2433426 - RNA, 18 nt, Bordetella pertussis
gcgcgaugagcuggcgca

SEQ ID NO: 2433427 - RNA, 19 nt, Bordetella pertussis
gcgcgaugagcuggcgcag

SEQ ID NO: 2433428 - RNA, 20 nt, Bordetella pertussis
gcgcgaugagcuggcgcagg

SEQ ID NO: 2433429 - RNA, 14 nt, Bordetella pertussis
gcgcgaugcgcagg

SEQ ID NO: 2433430 - RNA, 16 nt, Bordetella pertussis
gcgcgaugcgcaggcu

SEQ ID NO: 2433431 - RNA, 17 nt, Bordetella pertussis
gcgcgaugcgcgcgugc

SEQ ID NO: 2433432 - RNA, 18 nt, Bordetella pertussis
gcgcgaugcgcggcccgg

SEQ ID NO: 2433433 - RNA, 13 nt, Bordetella pertussis
gcgcgaugggccu

SEQ ID NO: 2433434 - RNA, 15 nt, Bordetella pertussis
gcgcgaugggccugc

SEQ ID NO: 2433435 - RNA, 20 nt, Bordetella pertussis
gcgcgaugggccugcccaug

SEQ ID NO: 2433436 - RNA, 21 nt, Bordetella pertussis
gcgcgauggucaccacccgca

SEQ ID NO: 2433437 - RNA, 23 nt, Bordetella pertussis
gcgcgaugucgaauuccgggacg

SEQ ID NO: 2433438 - RNA, 17 nt, Bordetella pertussis
gcgcgaugucgcccaug

SEQ ID NO: 2433439 - RNA, 18 nt, Bordetella pertussis
gcgcgauguucaggccgg

SEQ ID NO: 2433440 - RNA, 21 nt, Bordetella pertussis
gcgcgauguucaggccggccc

SEQ ID NO: 2433441 - RNA, 16 nt, Bordetella pertussis
gcgcgauucccuggcg

SEQ ID NO: 2433442 - RNA, 21 nt, Bordetella pertussis
gcgcgauucccuggcgcgcca

SEQ ID NO: 2433443 - RNA, 19 nt, Bordetella pertussis
gcgcgcaaaccgacgcggc

SEQ ID NO: 2433444 - RNA, 21 nt, Bordetella pertussis
gcgcgcaaaccgacgcggcca

SEQ ID NO: 2433445 - RNA, 23 nt, Bordetella pertussis
gcgcgcaaaccgacgcggccagc

SEQ ID NO: 2433446 - RNA, 19 nt, Bordetella pertussis
gcgcgcaaccaggggcggc

SEQ ID NO: 2433447 - RNA, 20 nt, Bordetella pertussis
gcgcgcaaccaggggcggcg

SEQ ID NO: 2433448 - RNA, 21 nt, Bordetella pertussis
gcgcgcaaccaggggcggcgc

SEQ ID NO: 2433449 - RNA, 23 nt, Bordetella pertussis
gcgcgcaacccacggcguggcgc

SEQ ID NO: 2433450 - RNA, 16 nt, Bordetella pertussis
gcgcgcaagagcgugu

SEQ ID NO: 2433451 - RNA, 20 nt, Bordetella pertussis
gcgcgcaagccgccgcccuc

SEQ ID NO: 2433452 - RNA, 20 nt, Bordetella pertussis
gcgcgcaagguggcgguggu

SEQ ID NO: 2433453 - RNA, 15 nt, Bordetella pertussis
gcgcgcaaugcgcgg

SEQ ID NO: 2433454 - RNA, 18 nt, Bordetella pertussis
gcgcgcacaaacgcacga

SEQ ID NO: 2433455 - RNA, 14 nt, Bordetella pertussis
gcgcgcacaagcgc

SEQ ID NO: 2433456 - RNA, 15 nt, Bordetella pertussis
gcgcgcacacuggcc

SEQ ID NO: 2433457 - RNA, 13 nt, Bordetella pertussis
gcgcgcaccagcc

SEQ ID NO: 2433458 - RNA, 15 nt, Bordetella pertussis
gcgcgcaccaucgcc

SEQ ID NO: 2433459 - RNA, 17 nt, Bordetella pertussis
gcgcgcaccaucgccga

SEQ ID NO: 2433460 - RNA, 19 nt, Bordetella pertussis
gcgcgcaccaucgccgagc

SEQ ID NO: 2433461 - RNA, 22 nt, Bordetella pertussis
gcgcgcaccauucucgcccugc

SEQ ID NO: 2433462 - RNA, 23 nt, Bordetella pertussis
gcgcgcaccauucucgcccugcu

SEQ ID NO: 2433463 - RNA, 18 nt, Bordetella pertussis
gcgcgccauggccggccg

SEQ ID NO: 2433464 - RNA, 23 nt, Bordetella pertussis
gcgcgccauggugaacggccccg

SEQ ID NO: 2433465 - RNA, 17 nt, Bordetella pertussis
gcgcgcccaccagggug

SEQ ID NO: 2433466 - RNA, 18 nt, Bordetella pertussis
gcgcgcccaccagggugc

SEQ ID NO: 2433467 - RNA, 21 nt, Bordetella pertussis
gcgcgcccaccagggugccgc

SEQ ID NO: 2433468 - RNA, 12 nt, Bordetella pertussis
gcgcgcccagcc

SEQ ID NO: 2433469 - RNA, 14 nt, Bordetella pertussis
gcgcgcccagcccc

SEQ ID NO: 2433470 - RNA, 20 nt, Bordetella pertussis
gcgcgcccagccccgcggcc

SEQ ID NO: 2433471 - RNA, 15 nt, Bordetella pertussis
gcgcgcccagcgcgc

SEQ ID NO: 2433472 - RNA, 17 nt, Bordetella pertussis
gcgcgcccagcgcgccg

SEQ ID NO: 2433473 - RNA, 14 nt, Bordetella pertussis
gcgcgcccagcggc

SEQ ID NO: 2433474 - RNA, 16 nt, Bordetella pertussis
gcgcgcccagcggcag

SEQ ID NO: 2433475 - RNA, 17 nt, Bordetella pertussis
gcgcgcccagcggcagg

SEQ ID NO: 2433476 - RNA, 11 nt, Bordetella pertussis
gcgcgcccagg

SEQ ID NO: 2433477 - RNA, 15 nt, Bordetella pertussis
gcgcgcccccacgcc

SEQ ID NO: 2433478 - RNA, 18 nt, Bordetella pertussis
gcgcgcccccacgccgcu

SEQ ID NO: 2433479 - RNA, 14 nt, Bordetella pertussis
gcgcgcccccagcg

SEQ ID NO: 2433480 - RNA, 14 nt, Bordetella pertussis
gcgcgccccgucgg

SEQ ID NO: 2433481 - RNA, 19 nt, Bordetella pertussis
gcgcgcccgaggcgcgcag

SEQ ID NO: 2433482 - RNA, 17 nt, Bordetella pertussis
gcgcgcccgaugccccg

SEQ ID NO: 2433483 - RNA, 14 nt, Bordetella pertussis
gcgcgcccgcacga

SEQ ID NO: 2433484 - RNA, 14 nt, Bordetella pertussis
gcgcgcccgcaggc

SEQ ID NO: 2433485 - RNA, 15 nt, Bordetella pertussis
gcgcgcccgcaggcg

SEQ ID NO: 2433486 - RNA, 16 nt, Bordetella pertussis
gcgcgcccgcaggcgg

SEQ ID NO: 2433487 - RNA, 18 nt, Bordetella pertussis
gcgcgcccgcaggcggcg

SEQ ID NO: 2433488 - RNA, 22 nt, Bordetella pertussis
gcgcgcccgcaggcggcggccu

SEQ ID NO: 2433489 - RNA, 23 nt, Bordetella pertussis
gcgcgcccgcaggcggcggccuc

SEQ ID NO: 2433490 - RNA, 14 nt, Bordetella pertussis
gcgcgcccgccacg

SEQ ID NO: 2433491 - RNA, 14 nt, Bordetella pertussis
gcgcgcccgcuucc

SEQ ID NO: 2433492 - RNA, 15 nt, Bordetella pertussis
gcgcgcccgcuugcg

SEQ ID NO: 2433493 - RNA, 12 nt, Bordetella pertussis
gcgcgcccggcg

SEQ ID NO: 2433494 - RNA, 15 nt, Bordetella pertussis
gcgcgcccggcgcgc

SEQ ID NO: 2433495 - RNA, 18 nt, Bordetella pertussis
gcgcgcccggcgcgccuu

SEQ ID NO: 2433496 - RNA, 23 nt, Bordetella pertussis
gcgcgcccucguugacgccgacg

SEQ ID NO: 2433497 - RNA, 14 nt, Bordetella pertussis
gcgcgcccugcacg

SEQ ID NO: 2433498 - RNA, 18 nt, Bordetella pertussis
gcgcgcccugcacgcgcg

SEQ ID NO: 2433499 - RNA, 16 nt, Bordetella pertussis
gcgcgccgaagcgcag

SEQ ID NO: 2433500 - RNA, 18 nt, Bordetella pertussis
gcgcgccgaagcgcaggc

SEQ ID NO: 2433501 - RNA, 22 nt, Bordetella pertussis
gcgcgccgaagcgcaggccuuc

SEQ ID NO: 2433502 - RNA, 14 nt, Bordetella pertussis
gcgcgccgaccacc

SEQ ID NO: 2433503 - RNA, 20 nt, Bordetella pertussis
gcgcgccgaccaggucgggc

SEQ ID NO: 2433504 - RNA, 22 nt, Bordetella pertussis
gcgcgccgaggaucuggccggc

SEQ ID NO: 2433505 - RNA, 22 nt, Bordetella pertussis
gcgcgccgaggugaucuggucc

SEQ ID NO: 2433506 - RNA, 14 nt, Bordetella pertussis
gcgcgccgaugcgc

SEQ ID NO: 2433507 - RNA, 19 nt, Bordetella pertussis
gcgcgccgaugcgccaggc

SEQ ID NO: 2433508 - RNA, 12 nt, Bordetella pertussis
gcgcgccgcagc

SEQ ID NO: 2433509 - RNA, 10 nt, Bordetella pertussis
gcgcgccgcc

SEQ ID NO: 2433510 - RNA, 13 nt, Bordetella pertussis
gcgcgccgccagc

SEQ ID NO: 2433511 - RNA, 14 nt, Bordetella pertussis
gcgcgccgccagcg

SEQ ID NO: 2433512 - RNA, 15 nt, Bordetella pertussis
gcgcgccgccagcgc

SEQ ID NO: 2433513 - RNA, 13 nt, Bordetella pertussis
gcgcgccgcccac

SEQ ID NO: 2433514 - RNA, 14 nt, Bordetella pertussis
gcgcgccgcccacc

SEQ ID NO: 2433515 - RNA, 15 nt, Bordetella pertussis
gcgcgccgcccacca

SEQ ID NO: 2433516 - RNA, 20 nt, Bordetella pertussis
gcgcgccgccgcgcugugcg

SEQ ID NO: 2433517 - RNA, 15 nt, Bordetella pertussis
gcgcgccgccggcca

SEQ ID NO: 2433518 - RNA, 14 nt, Bordetella pertussis
gcgcgccgccgggc

SEQ ID NO: 2433519 - RNA, 18 nt, Bordetella pertussis
gcgcgccgccgggccugc

SEQ ID NO: 2433520 - RNA, 24 nt, Bordetella pertussis
gcgcgccgccgggccugcccgcau

SEQ ID NO: 2433521 - RNA, 14 nt, Bordetella pertussis
gcgcgccgccggug

SEQ ID NO: 2433522 - RNA, 22 nt, Bordetella pertussis
gcgcgccgccggugcaccaggc

SEQ ID NO: 2433523 - RNA, 21 nt, Bordetella pertussis
gcgcgccgccguaggacagcc

SEQ ID NO: 2433524 - RNA, 23 nt, Bordetella pertussis
gcgcgccgccucgcgcuccagca

SEQ ID NO: 2433525 - RNA, 15 nt, Bordetella pertussis
gcgcgccgcgauggc

SEQ ID NO: 2433526 - RNA, 14 nt, Bordetella pertussis
gcgcgccgcgccgg

SEQ ID NO: 2433527 - RNA, 15 nt, Bordetella pertussis
gcgcgccgcgccggg

SEQ ID NO: 2433528 - RNA, 16 nt, Bordetella pertussis
gcgcgccgcgccgggc

SEQ ID NO: 2433529 - RNA, 13 nt, Bordetella pertussis
gcgcgccgcggcc

SEQ ID NO: 2433530 - RNA, 14 nt, Bordetella pertussis
gcgcgccgcggccu

SEQ ID NO: 2433531 - RNA, 17 nt, Bordetella pertussis
gcgcgccgcggccuguc

SEQ ID NO: 2433532 - RNA, 16 nt, Bordetella pertussis
gcgcgccgcggcgggc

SEQ ID NO: 2433533 - RNA, 21 nt, Bordetella pertussis
gcgcgccgcggcgggcuuggc

SEQ ID NO: 2433534 - RNA, 13 nt, Bordetella pertussis
gcgcgccgcgggc

SEQ ID NO: 2433535 - RNA, 15 nt, Bordetella pertussis
gcgcgccgcgggcug

SEQ ID NO: 2433536 - RNA, 18 nt, Bordetella pertussis
gcgcgccgcgggcugcga

SEQ ID NO: 2433537 - RNA, 22 nt, Bordetella pertussis
gcgcgccgcgggcugcgacagg

SEQ ID NO: 2433538 - RNA, 23 nt, Bordetella pertussis
gcgcgccgcgggcugcgacaggc

SEQ ID NO: 2433539 - RNA, 20 nt, Bordetella pertussis
gcgcgccgcgucgguggcca

SEQ ID NO: 2433540 - RNA, 23 nt, Bordetella pertussis
gcgcgccgcgucgguggccagcc

SEQ ID NO: 2433541 - RNA, 13 nt, Bordetella pertussis
gcgcgccgcugca

SEQ ID NO: 2433542 - RNA, 15 nt, Bordetella pertussis
gcgcgccgcugcagc

SEQ ID NO: 2433543 - RNA, 13 nt, Bordetella pertussis
gcgcgccggaaca

SEQ ID NO: 2433544 - RNA, 17 nt, Bordetella pertussis
gcgcgccggaacauggc

SEQ ID NO: 2433545 - RNA, 16 nt, Bordetella pertussis
gcgcgccggacgcaaa

SEQ ID NO: 2433546 - RNA, 11 nt, Bordetella pertussis
gcgcgccggca

SEQ ID NO: 2433547 - RNA, 19 nt, Bordetella pertussis
gcgcgccggcagggcggcc

SEQ ID NO: 2433548 - RNA, 20 nt, Bordetella pertussis
gcgcgccggcagggcggcca

SEQ ID NO: 2433549 - RNA, 22 nt, Bordetella pertussis
gcgcgccggcagggcggccagg

SEQ ID NO: 2433550 - RNA, 22 nt, Bordetella pertussis
gcgcgccggcauuucgcugggc

SEQ ID NO: 2433551 - RNA, 11 nt, Bordetella pertussis
gcgcgccggcc

SEQ ID NO: 2433552 - RNA, 16 nt, Bordetella pertussis
gcgcgccggccagcgg

SEQ ID NO: 2433553 - RNA, 17 nt, Bordetella pertussis
gcgcgccggccagcggc

SEQ ID NO: 2433554 - RNA, 17 nt, Bordetella pertussis
gcgcgccggccagggcc

SEQ ID NO: 2433555 - RNA, 13 nt, Bordetella pertussis
gcgcgccggccca

SEQ ID NO: 2433556 - RNA, 22 nt, Bordetella pertussis
gcgcgccggcccaaggccccgc

SEQ ID NO: 2433557 - RNA, 20 nt, Bordetella pertussis
gcgcgccggccgacaggugg

SEQ ID NO: 2433558 - RNA, 13 nt, Bordetella pertussis
gcgcgccggccgc

SEQ ID NO: 2433559 - RNA, 17 nt, Bordetella pertussis
gcgcgccggccgccagc

SEQ ID NO: 2433560 - RNA, 14 nt, Bordetella pertussis
gcgcgccggccgcg

SEQ ID NO: 2433561 - RNA, 15 nt, Bordetella pertussis
gcgcgccggccgcgg

SEQ ID NO: 2433562 - RNA, 22 nt, Bordetella pertussis
gcgcgccggccgcggggcuggc

SEQ ID NO: 2433563 - RNA, 24 nt, Bordetella pertussis
gcgcgccggccgcggggcuggcca

SEQ ID NO: 2433564 - RNA, 14 nt, Bordetella pertussis
gcgcgccggccggu

SEQ ID NO: 2433565 - RNA, 13 nt, Bordetella pertussis
gcgcgccggccug

SEQ ID NO: 2433566 - RNA, 12 nt, Bordetella pertussis
gcgcgccggcgc

SEQ ID NO: 2433567 - RNA, 13 nt, Bordetella pertussis
gcgcgccggcgcu

SEQ ID NO: 2433568 - RNA, 15 nt, Bordetella pertussis
gcgcgccggcggccu

SEQ ID NO: 2433569 - RNA, 23 nt, Bordetella pertussis
gcgcgccggcuaccgcgccaucu

SEQ ID NO: 2433570 - RNA, 13 nt, Bordetella pertussis
gcgcgccgggccg

SEQ ID NO: 2433571 - RNA, 14 nt, Bordetella pertussis
gcgcgccgggccgg

SEQ ID NO: 2433572 - RNA, 20 nt, Bordetella pertussis
gcgcgccgggccggcgggca

SEQ ID NO: 2433573 - RNA, 14 nt, Bordetella pertussis
gcgcgccgggggcg

SEQ ID NO: 2433574 - RNA, 12 nt, Bordetella pertussis
gcgcgccguaca

SEQ ID NO: 2433575 - RNA, 13 nt, Bordetella pertussis
gcgcgccguacag

SEQ ID NO: 2433576 - RNA, 17 nt, Bordetella pertussis
gcgcgccguacagccgc

SEQ ID NO: 2433577 - RNA, 14 nt, Bordetella pertussis
gcgcgcggccagcg

SEQ ID NO: 2433578 - RNA, 18 nt, Bordetella pertussis
gcgcgcggccagcgcggu

SEQ ID NO: 2433579 - RNA, 16 nt, Bordetella pertussis
gcgcgcggccaguucg

SEQ ID NO: 2433580 - RNA, 13 nt, Bordetella pertussis
gcgcgcggccgag

SEQ ID NO: 2433581 - RNA, 13 nt, Bordetella pertussis
gcgcgcggccggc

SEQ ID NO: 2433582 - RNA, 14 nt, Bordetella pertussis
gcgcgcggccggcc

SEQ ID NO: 2433583 - RNA, 15 nt, Bordetella pertussis
gcgcgcggccggccg

SEQ ID NO: 2433584 - RNA, 19 nt, Bordetella pertussis
gcgcgcggccggcgcgccg

SEQ ID NO: 2433585 - RNA, 13 nt, Bordetella pertussis
gcgcgcggccugg

SEQ ID NO: 2433586 - RNA, 16 nt, Bordetella pertussis
gcgcgcggccugggcg

SEQ ID NO: 2433587 - RNA, 14 nt, Bordetella pertussis
gcgcgcggcgcagc

SEQ ID NO: 2433588 - RNA, 16 nt, Bordetella pertussis
gcgcgcggcgcagcgc

SEQ ID NO: 2433589 - RNA, 13 nt, Bordetella pertussis
gcgcgcggcgccg

SEQ ID NO: 2433590 - RNA, 16 nt, Bordetella pertussis
gcgcgcggcgccgcgc

SEQ ID NO: 2433591 - RNA, 12 nt, Bordetella pertussis
gcgcgcggcggc

SEQ ID NO: 2433592 - RNA, 13 nt, Bordetella pertussis
gcgcgcggcggcc

SEQ ID NO: 2433593 - RNA, 22 nt, Bordetella pertussis
gcgcgcggcguugcggcgccau

SEQ ID NO: 2433594 - RNA, 15 nt, Bordetella pertussis
gcgcgcggcuggcug

SEQ ID NO: 2433595 - RNA, 13 nt, Bordetella pertussis
gcgcgcggcuggg

SEQ ID NO: 2433596 - RNA, 15 nt, Bordetella pertussis
gcgcgcggcuggggc

SEQ ID NO: 2433597 - RNA, 19 nt, Bordetella pertussis
gcgcgcggcuggggcugcu

SEQ ID NO: 2433598 - RNA, 14 nt, Bordetella pertussis
gcgcgcggcugggu

SEQ ID NO: 2433599 - RNA, 19 nt, Bordetella pertussis
gcgcgcggcugggucggcg

SEQ ID NO: 2433600 - RNA, 12 nt, Bordetella pertussis
gcgcgcgggcca

SEQ ID NO: 2433601 - RNA, 13 nt, Bordetella pertussis
gcgcgcgggcccu

SEQ ID NO: 2433602 - RNA, 16 nt, Bordetella pertussis
gcgcgcgggcccuggc

SEQ ID NO: 2433603 - RNA, 20 nt, Bordetella pertussis
gcgcgcgggcgauggccacg

SEQ ID NO: 2433604 - RNA, 14 nt, Bordetella pertussis
gcgcgcgggcgccc

SEQ ID NO: 2433605 - RNA, 17 nt, Bordetella pertussis
gcgcgcgggcgcccgcg

SEQ ID NO: 2433606 - RNA, 13 nt, Bordetella pertussis
gcgcgcgggcgcg

SEQ ID NO: 2433607 - RNA, 16 nt, Bordetella pertussis
gcgcgcgggcgcgccg

SEQ ID NO: 2433608 - RNA, 18 nt, Bordetella pertussis
gcgcgcgggcgcgccguc

SEQ ID NO: 2433609 - RNA, 17 nt, Bordetella pertussis
gcgcgcggggcaggccg

SEQ ID NO: 2433610 - RNA, 18 nt, Bordetella pertussis
gcgcgcggggcaggccga

SEQ ID NO: 2433611 - RNA, 16 nt, Bordetella pertussis
gcgcgcgguccauggu

SEQ ID NO: 2433612 - RNA, 15 nt, Bordetella pertussis
gcgcgcggucggugc

SEQ ID NO: 2433613 - RNA, 13 nt, Bordetella pertussis
gcgcgcggugacg

SEQ ID NO: 2433614 - RNA, 14 nt, Bordetella pertussis
gcgcgcggugucgc

SEQ ID NO: 2433615 - RNA, 21 nt, Bordetella pertussis
gcgcgcggugucgccgccgcg

SEQ ID NO: 2433616 - RNA, 16 nt, Bordetella pertussis
gcgcgcgguguucgag

SEQ ID NO: 2433617 - RNA, 21 nt, Bordetella pertussis
gcgcgcgguugagcgccaggg

SEQ ID NO: 2433618 - RNA, 14 nt, Bordetella pertussis
gcgcgcguacagcc

SEQ ID NO: 2433619 - RNA, 17 nt, Bordetella pertussis
gcgcgcguacagccggg

SEQ ID NO: 2433620 - RNA, 19 nt, Bordetella pertussis
gcgcgcguacagccgggug

SEQ ID NO: 2433621 - RNA, 21 nt, Bordetella pertussis
gcgcgcguauggcggcgccga

SEQ ID NO: 2433622 - RNA, 14 nt, Bordetella pertussis
gcgcgcguccugcg

SEQ ID NO: 2433623 - RNA, 17 nt, Bordetella pertussis
gcgcgcguccugcgcca

SEQ ID NO: 2433624 - RNA, 13 nt, Bordetella pertussis
gcgcgcgucgccg

SEQ ID NO: 2433625 - RNA, 18 nt, Bordetella pertussis
gcgcgcgucgccgcuggc

SEQ ID NO: 2433626 - RNA, 19 nt, Bordetella pertussis
gcgcgcgugcagcgccgcg

SEQ ID NO: 2433627 - RNA, 16 nt, Bordetella pertussis
gcgcgcgugcagguag

SEQ ID NO: 2433628 - RNA, 17 nt, Bordetella pertussis
gcgcgcgugccgcaggc

SEQ ID NO: 2433629 - RNA, 19 nt, Bordetella pertussis
gcgcgcgugccgcaggcca

SEQ ID NO: 2433630 - RNA, 15 nt, Bordetella pertussis
gcgcgcgugccgcgc

SEQ ID NO: 2433631 - RNA, 23 nt, Bordetella pertussis
gcgcgcgugcugggccaugcgua

SEQ ID NO: 2433632 - RNA, 23 nt, Bordetella pertussis
gcgcgcguucaggucgccguucu

SEQ ID NO: 2433633 - RNA, 20 nt, Bordetella pertussis
gcgcgcguucguggaugggc

SEQ ID NO: 2433634 - RNA, 16 nt, Bordetella pertussis
gcgcgcguugaccgcc

SEQ ID NO: 2433635 - RNA, 20 nt, Bordetella pertussis
gcgcgcguugaucaucggcc

SEQ ID NO: 2433636 - RNA, 22 nt, Bordetella pertussis
gcgcgcguugaucaucggcccg

SEQ ID NO: 2433637 - RNA, 17 nt, Bordetella pertussis
gcgcgcuaagcacaagc

SEQ ID NO: 2433638 - RNA, 21 nt, Bordetella pertussis
gcgcgcuaagcacaagcgcgu

SEQ ID NO: 2433639 - RNA, 13 nt, Bordetella pertussis
gcgcgcucagcgc

SEQ ID NO: 2433640 - RNA, 15 nt, Bordetella pertussis
gcgcgcucagcgcca

SEQ ID NO: 2433641 - RNA, 17 nt, Bordetella pertussis
gcgcgcucagcgccauc

SEQ ID NO: 2433642 - RNA, 18 nt, Bordetella pertussis
gcgcgcucagcgccauca

SEQ ID NO: 2433643 - RNA, 17 nt, Bordetella pertussis
gcgcgcucauggcgcau

SEQ ID NO: 2433644 - RNA, 19 nt, Bordetella pertussis
gcgcgcucauggcgcauga

SEQ ID NO: 2433645 - RNA, 23 nt, Bordetella pertussis
gcgcgcucauggcgcaugacgag

SEQ ID NO: 2433646 - RNA, 22 nt, Bordetella pertussis
gcgcgcuccagcauguacagcg

SEQ ID NO: 2433647 - RNA, 21 nt, Bordetella pertussis
gcgcgcuccuucgugguggcg

SEQ ID NO: 2433648 - RNA, 16 nt, Bordetella pertussis
gcgcgcucgcugccgg

SEQ ID NO: 2433649 - RNA, 18 nt, Bordetella pertussis
gcgcgcucgcugccggcg

SEQ ID NO: 2433650 - RNA, 20 nt, Bordetella pertussis
gcgcgcucgcugccggcguc

SEQ ID NO: 2433651 - RNA, 15 nt, Bordetella pertussis
gcgcgcucggcgccg

SEQ ID NO: 2433652 - RNA, 14 nt, Bordetella pertussis
gcgcgcugcacggc

SEQ ID NO: 2433653 - RNA, 14 nt, Bordetella pertussis
gcgcgcugcccagc

SEQ ID NO: 2433654 - RNA, 16 nt, Bordetella pertussis
gcgcgcugcccagcca

SEQ ID NO: 2433655 - RNA, 13 nt, Bordetella pertussis
gcgcgcuggcgcc

SEQ ID NO: 2433656 - RNA, 16 nt, Bordetella pertussis
gcgcgcuggcgcccgg

SEQ ID NO: 2433657 - RNA, 17 nt, Bordetella pertussis
gcgcgcuggcgcccggc

SEQ ID NO: 2433658 - RNA, 13 nt, Bordetella pertussis
gcgcgcuggcgcu

SEQ ID NO: 2433659 - RNA, 19 nt, Bordetella pertussis
gcgcgcuggcgcucgggcg

SEQ ID NO: 2433660 - RNA, 12 nt, Bordetella pertussis
gcgcgcuggcug

SEQ ID NO: 2433661 - RNA, 13 nt, Bordetella pertussis
gcgcgcuggcugu

SEQ ID NO: 2433662 - RNA, 15 nt, Bordetella pertussis
gcgcgcuggcugugc

SEQ ID NO: 2433663 - RNA, 18 nt, Bordetella pertussis
gcgcgcuggggcugucgc

SEQ ID NO: 2433664 - RNA, 22 nt, Bordetella pertussis
gcgcgcuguucaucaacauguc

SEQ ID NO: 2433665 - RNA, 17 nt, Bordetella pertussis
gcgcgcuucacccugga

SEQ ID NO: 2433666 - RNA, 16 nt, Bordetella pertussis
gcgcgcuucaggcgcc

SEQ ID NO: 2433667 - RNA, 21 nt, Bordetella pertussis
gcgcgcuucaggcgccgcaga

SEQ ID NO: 2433668 - RNA, 19 nt, Bordetella pertussis
gcgcgcuucagugcucggg

SEQ ID NO: 2433669 - RNA, 20 nt, Bordetella pertussis
gcgcgcuucagugcucgggc

SEQ ID NO: 2433670 - RNA, 17 nt, Bordetella pertussis
gcgcgcuuccucgacca

SEQ ID NO: 2433671 - RNA, 20 nt, Bordetella pertussis
gcgcgcuuccucgaccaggu

SEQ ID NO: 2433672 - RNA, 20 nt, Bordetella pertussis
gcgcgcuucgagccgguaca

SEQ ID NO: 2433673 - RNA, 23 nt, Bordetella pertussis
gcgcgcuucuuggcgaccaggcc

SEQ ID NO: 2433674 - RNA, 18 nt, Bordetella pertussis
gcgcgcuugaacuccgcg

SEQ ID NO: 2433675 - RNA, 16 nt, Bordetella pertussis
gcgcgcuugagcggcu

SEQ ID NO: 2433676 - RNA, 19 nt, Bordetella pertussis
gcgcgcuuggucagcauca

SEQ ID NO: 2433677 - RNA, 23 nt, Bordetella pertussis
gcgcgcuuggucagcaucagcag

SEQ ID NO: 2433678 - RNA, 23 nt, Bordetella pertussis
gcgcggaaauccguaguccagca

SEQ ID NO: 2433679 - RNA, 16 nt, Bordetella pertussis
gcgcggacugccagau

SEQ ID NO: 2433680 - RNA, 23 nt, Bordetella pertussis
gcgcggauauucgucggccgccg

SEQ ID NO: 2433681 - RNA, 13 nt, Bordetella pertussis
gcgcggauccagc

SEQ ID NO: 2433682 - RNA, 15 nt, Bordetella pertussis
gcgcggauccagcca

SEQ ID NO: 2433683 - RNA, 17 nt, Bordetella pertussis
gcgcggauccagccaug

SEQ ID NO: 2433684 - RNA, 23 nt, Bordetella pertussis
gcgcggaucgaaguugaacgagc

SEQ ID NO: 2433685 - RNA, 15 nt, Bordetella pertussis
gcgcggaucgacgcg

SEQ ID NO: 2433686 - RNA, 16 nt, Bordetella pertussis
gcgcggaucgacgcga

SEQ ID NO: 2433687 - RNA, 14 nt, Bordetella pertussis
gcgcggaucggcca

SEQ ID NO: 2433688 - RNA, 17 nt, Bordetella pertussis
gcgcggaucggccacga

SEQ ID NO: 2433689 - RNA, 17 nt, Bordetella pertussis
gcgcggaucgugcgcca

SEQ ID NO: 2433690 - RNA, 20 nt, Bordetella pertussis
gcgcggaucgugcgccacuu

SEQ ID NO: 2433691 - RNA, 17 nt, Bordetella pertussis
gcgcggcgccgcuggcc

SEQ ID NO: 2433692 - RNA, 13 nt, Bordetella pertussis
gcgcggcgccggc

SEQ ID NO: 2433693 - RNA, 14 nt, Bordetella pertussis
gcgcggcgccggcc

SEQ ID NO: 2433694 - RNA, 17 nt, Bordetella pertussis
gcgcggcgccggccucc

SEQ ID NO: 2433695 - RNA, 15 nt, Bordetella pertussis
gcgcggcgccugcgc

SEQ ID NO: 2433696 - RNA, 16 nt, Bordetella pertussis
gcgcggcgccuggggc

SEQ ID NO: 2433697 - RNA, 12 nt, Bordetella pertussis
gcgcggcgcgcg

SEQ ID NO: 2433698 - RNA, 13 nt, Bordetella pertussis
gcgcggcgcgcgc

SEQ ID NO: 2433699 - RNA, 15 nt, Bordetella pertussis
gcgcggcgcgcgcca

SEQ ID NO: 2433700 - RNA, 20 nt, Bordetella pertussis
gcgcggcgcgcgccgaggug

SEQ ID NO: 2433701 - RNA, 14 nt, Bordetella pertussis
gcgcggcgcggcug

SEQ ID NO: 2433702 - RNA, 17 nt, Bordetella pertussis
gcgcggcgcggcuggcg

SEQ ID NO: 2433703 - RNA, 20 nt, Bordetella pertussis
gcgcggcgcgugccagcagg

SEQ ID NO: 2433704 - RNA, 21 nt, Bordetella pertussis
gcgcggcgcguucagcagcag

SEQ ID NO: 2433705 - RNA, 13 nt, Bordetella pertussis
gcgcggcgcugca

SEQ ID NO: 2433706 - RNA, 13 nt, Bordetella pertussis
gcgcggcgcuggc

SEQ ID NO: 2433707 - RNA, 14 nt, Bordetella pertussis
gcgcggcgcuggcg

SEQ ID NO: 2433708 - RNA, 15 nt, Bordetella pertussis
gcgcggcgcuggcgc

SEQ ID NO: 2433709 - RNA, 16 nt, Bordetella pertussis
gcgcggcgcuggcgcc

SEQ ID NO: 2433710 - RNA, 18 nt, Bordetella pertussis
gcgcggcgcuggcgccgc

SEQ ID NO: 2433711 - RNA, 19 nt, Bordetella pertussis
gcgcggcgcuggcgccgcg

SEQ ID NO: 2433712 - RNA, 20 nt, Bordetella pertussis
gcgcggcggaucggcguggu

SEQ ID NO: 2433713 - RNA, 17 nt, Bordetella pertussis
gcgcggcggcaccagca

SEQ ID NO: 2433714 - RNA, 14 nt, Bordetella pertussis
gcgcggcggcagcg

SEQ ID NO: 2433715 - RNA, 17 nt, Bordetella pertussis
gcgcggcggcagcgcgu

SEQ ID NO: 2433716 - RNA, 13 nt, Bordetella pertussis
gcgcggcggccag

SEQ ID NO: 2433717 - RNA, 14 nt, Bordetella pertussis
gcgcggcggccagg

SEQ ID NO: 2433718 - RNA, 15 nt, Bordetella pertussis
gcgcggcggccaggc

SEQ ID NO: 2433719 - RNA, 17 nt, Bordetella pertussis
gcgcggcggccaggcgu

SEQ ID NO: 2433720 - RNA, 13 nt, Bordetella pertussis
gcgcggcggccug

SEQ ID NO: 2433721 - RNA, 16 nt, Bordetella pertussis
gcgcggcggccugggc

SEQ ID NO: 2433722 - RNA, 13 nt, Bordetella pertussis
gcgcggcggcgac

SEQ ID NO: 2433723 - RNA, 14 nt, Bordetella pertussis
gcgcggcggcgacc

SEQ ID NO: 2433724 - RNA, 17 nt, Bordetella pertussis
gcgcggcggcgaccggc

SEQ ID NO: 2433725 - RNA, 18 nt, Bordetella pertussis
gcgcggcggcgaccggcg

SEQ ID NO: 2433726 - RNA, 15 nt, Bordetella pertussis
gcgcggcggcggcca

SEQ ID NO: 2433727 - RNA, 12 nt, Bordetella pertussis
gcgcggcggcgu

SEQ ID NO: 2433728 - RNA, 14 nt, Bordetella pertussis
gcgcggcggcguca

SEQ ID NO: 2433729 - RNA, 20 nt, Bordetella pertussis
gcgcggcggcgugaacgcgc

SEQ ID NO: 2433730 - RNA, 20 nt, Bordetella pertussis
gcgcggcggcguuccugggc

SEQ ID NO: 2433731 - RNA, 16 nt, Bordetella pertussis
gcgcggcggcuugccg

SEQ ID NO: 2433732 - RNA, 17 nt, Bordetella pertussis
gcgcggcgggacggcca

SEQ ID NO: 2433733 - RNA, 16 nt, Bordetella pertussis
gcgcggcgggccccgc

SEQ ID NO: 2433734 - RNA, 17 nt, Bordetella pertussis
gcgcggcgggcgcuggc

SEQ ID NO: 2433735 - RNA, 20 nt, Bordetella pertussis
gcgcggcgggcgcuggcgcg

SEQ ID NO: 2433736 - RNA, 20 nt, Bordetella pertussis
gcgcggcgggcggcgcggcc

SEQ ID NO: 2433737 - RNA, 22 nt, Bordetella pertussis
gcgcggcgggcucagcccgccu

SEQ ID NO: 2433738 - RNA, 19 nt, Bordetella pertussis
gcgcggcgguccucgccgg

SEQ ID NO: 2433739 - RNA, 15 nt, Bordetella pertussis
gcgcggcggugccgc

SEQ ID NO: 2433740 - RNA, 17 nt, Bordetella pertussis
gcgcggcggugccgccc

SEQ ID NO: 2433741 - RNA, 16 nt, Bordetella pertussis
gcgcggcgguggcggu

SEQ ID NO: 2433742 - RNA, 20 nt, Bordetella pertussis
gcgcggcgucgaaggccgcc

SEQ ID NO: 2433743 - RNA, 19 nt, Bordetella pertussis
gcgcggcguugcggcgcca

SEQ ID NO: 2433744 - RNA, 15 nt, Bordetella pertussis
gcgcggcucgccgcg

SEQ ID NO: 2433745 - RNA, 16 nt, Bordetella pertussis
gcgcggcucgccgcgc

SEQ ID NO: 2433746 - RNA, 20 nt, Bordetella pertussis
gcgcggcucgccgcgcacgg

SEQ ID NO: 2433747 - RNA, 14 nt, Bordetella pertussis
gcgcggcucgccgg

SEQ ID NO: 2433748 - RNA, 15 nt, Bordetella pertussis
gcgcggcucgccggc

SEQ ID NO: 2433749 - RNA, 16 nt, Bordetella pertussis
gcgcggcucgccggcc

SEQ ID NO: 2433750 - RNA, 19 nt, Bordetella pertussis
gcgcggcucgccggccgcg

SEQ ID NO: 2433751 - RNA, 22 nt, Bordetella pertussis
gcgcggcucgccggccgcgccc

SEQ ID NO: 2433752 - RNA, 16 nt, Bordetella pertussis
gcgcggcugcccucgg

SEQ ID NO: 2433753 - RNA, 15 nt, Bordetella pertussis
gcgcggcugcgggcc

SEQ ID NO: 2433754 - RNA, 16 nt, Bordetella pertussis
gcgcggcugcgggccg

SEQ ID NO: 2433755 - RNA, 19 nt, Bordetella pertussis
gcgcggcugcgggccggcg

SEQ ID NO: 2433756 - RNA, 20 nt, Bordetella pertussis
gcgcggcugcgggccggcgc

SEQ ID NO: 2433757 - RNA, 15 nt, Bordetella pertussis
gcgcggcugcugggc

SEQ ID NO: 2433758 - RNA, 14 nt, Bordetella pertussis
gcgcggcuggcugu

SEQ ID NO: 2433759 - RNA, 22 nt, Bordetella pertussis
gcgcggcuggcuguucgccaug

SEQ ID NO: 2433760 - RNA, 15 nt, Bordetella pertussis
gcgcggcuggggcug

SEQ ID NO: 2433761 - RNA, 16 nt, Bordetella pertussis
gcgcggcugggucggc

SEQ ID NO: 2433762 - RNA, 20 nt, Bordetella pertussis
gcgcggcugggucggcguga

SEQ ID NO: 2433763 - RNA, 22 nt, Bordetella pertussis
gcgcggcuuucgccggaggcgc

SEQ ID NO: 2433764 - RNA, 23 nt, Bordetella pertussis
gcgcggcuuuuucucggccucgc

SEQ ID NO: 2433765 - RNA, 20 nt, Bordetella pertussis
gcgcgggaagcgcucgcgca

SEQ ID NO: 2433766 - RNA, 21 nt, Bordetella pertussis
gcgcgggaagcugucggcgcu

SEQ ID NO: 2433767 - RNA, 22 nt, Bordetella pertussis
gcgcgggcacucggccauggug

SEQ ID NO: 2433768 - RNA, 14 nt, Bordetella pertussis
gcgcgggccacugc

SEQ ID NO: 2433769 - RNA, 19 nt, Bordetella pertussis
gcgcgggccacugcgccug

SEQ ID NO: 2433770 - RNA, 15 nt, Bordetella pertussis
gcgcgggccagcaga

SEQ ID NO: 2433771 - RNA, 13 nt, Bordetella pertussis
gcgcgggccagcu

SEQ ID NO: 2433772 - RNA, 14 nt, Bordetella pertussis
gcgcgggccgccgc

SEQ ID NO: 2433773 - RNA, 15 nt, Bordetella pertussis
gcgcgggccgccgca

SEQ ID NO: 2433774 - RNA, 23 nt, Bordetella pertussis
gcgcgggcgauggccacgcgcug

SEQ ID NO: 2433775 - RNA, 13 nt, Bordetella pertussis
gcgcgggcgaugu

SEQ ID NO: 2433776 - RNA, 12 nt, Bordetella pertussis
gcgcgggcgcac

SEQ ID NO: 2433777 - RNA, 15 nt, Bordetella pertussis
gcgcgggcgcgcagc

SEQ ID NO: 2433778 - RNA, 16 nt, Bordetella pertussis
gcgcgggcgcgcagcg

SEQ ID NO: 2433779 - RNA, 21 nt, Bordetella pertussis
gcgcgggcgcgccgucgcugg

SEQ ID NO: 2433780 - RNA, 18 nt, Bordetella pertussis
gcgcgggcgcggcaggcg

SEQ ID NO: 2433781 - RNA, 15 nt, Bordetella pertussis
gcgcgggcgcgggcu

SEQ ID NO: 2433782 - RNA, 16 nt, Bordetella pertussis
gcgcgggcgcgggcug

SEQ ID NO: 2433783 - RNA, 14 nt, Bordetella pertussis
gcgcgggcggcccg

SEQ ID NO: 2433784 - RNA, 13 nt, Bordetella pertussis
gcgcgggcggcua

SEQ ID NO: 2433785 - RNA, 21 nt, Bordetella pertussis
gcgcgggcggcuaggcgcagc

SEQ ID NO: 2433786 - RNA, 22 nt, Bordetella pertussis
gcgcgggcggcuaggcgcagca

SEQ ID NO: 2433787 - RNA, 14 nt, Bordetella pertussis
gcgcgggcugucgc

SEQ ID NO: 2433788 - RNA, 13 nt, Bordetella pertussis
gcgcggggcaccg

SEQ ID NO: 2433789 - RNA, 16 nt, Bordetella pertussis
gcgcggggccaggcgc

SEQ ID NO: 2433790 - RNA, 17 nt, Bordetella pertussis
gcgcggggccaggcgca

SEQ ID NO: 2433791 - RNA, 18 nt, Bordetella pertussis
gcgcggggccaggcgcag

SEQ ID NO: 2433792 - RNA, 19 nt, Bordetella pertussis
gcgcggggccaggcgcagu

SEQ ID NO: 2433793 - RNA, 15 nt, Bordetella pertussis
gcgcggggccggucc

SEQ ID NO: 2433794 - RNA, 13 nt, Bordetella pertussis
gcgcggggggcug

SEQ ID NO: 2433795 - RNA, 17 nt, Bordetella pertussis
gcgcgggguaggccucg

SEQ ID NO: 2433796 - RNA, 22 nt, Bordetella pertussis
gcgcggguaggcaaagcgcagc

SEQ ID NO: 2433797 - RNA, 13 nt, Bordetella pertussis
gcgcggguccagg

SEQ ID NO: 2433798 - RNA, 21 nt, Bordetella pertussis
gcgcggguccggcgugccaug

SEQ ID NO: 2433799 - RNA, 22 nt, Bordetella pertussis
gcgcggguccuugccgggcucg

SEQ ID NO: 2433800 - RNA, 18 nt, Bordetella pertussis
gcgcgggucuugagcggc

SEQ ID NO: 2433801 - RNA, 22 nt, Bordetella pertussis
gcgcgggucuugagcggcccgg

SEQ ID NO: 2433802 - RNA, 15 nt, Bordetella pertussis
gcgcgguagcgcccc

SEQ ID NO: 2433803 - RNA, 16 nt, Bordetella pertussis
gcgcgguagcgccccu

SEQ ID NO: 2433804 - RNA, 15 nt, Bordetella pertussis
gcgcgguauccaggu

SEQ ID NO: 2433805 - RNA, 17 nt, Bordetella pertussis
gcgcgucuuuacgccga

SEQ ID NO: 2433806 - RNA, 18 nt, Bordetella pertussis
gcgcgucuuuacgccgag

SEQ ID NO: 2433807 - RNA, 19 nt, Bordetella pertussis
gcgcgucuuuacgccgaga

SEQ ID NO: 2433808 - RNA, 23 nt, Bordetella pertussis
gcgcgugacgauauccaggcgcg

SEQ ID NO: 2433809 - RNA, 23 nt, Bordetella pertussis
gcgcgugagaaaagugaucaccg

SEQ ID NO: 2433810 - RNA, 15 nt, Bordetella pertussis
gcgcgugaggucgcg

SEQ ID NO: 2433811 - RNA, 22 nt, Bordetella pertussis
gcgcgugcacgaccugccacug

SEQ ID NO: 2433812 - RNA, 22 nt, Bordetella pertussis
gcgcgugcagcgccgcgcgcuc

SEQ ID NO: 2433813 - RNA, 12 nt, Bordetella pertussis
gcgcgugcaggg

SEQ ID NO: 2433814 - RNA, 20 nt, Bordetella pertussis
gcgcgugcagggucagggug

SEQ ID NO: 2433815 - RNA, 14 nt, Bordetella pertussis
gcgcgugccgcagg

SEQ ID NO: 2433816 - RNA, 17 nt, Bordetella pertussis
gcgcgugccgcaggcca

SEQ ID NO: 2433817 - RNA, 12 nt, Bordetella pertussis
gcgcgugcgcag

SEQ ID NO: 2433818 - RNA, 14 nt, Bordetella pertussis
gcgcgugcgcgcgc

SEQ ID NO: 2433819 - RNA, 15 nt, Bordetella pertussis
gcgcgugcgcgcgcc

SEQ ID NO: 2433820 - RNA, 14 nt, Bordetella pertussis
gcgcgugcggggcg

SEQ ID NO: 2433821 - RNA, 21 nt, Bordetella pertussis
gcgcgugcguauucgguggcg

SEQ ID NO: 2433822 - RNA, 17 nt, Bordetella pertussis
gcgcgugcucaucggca

SEQ ID NO: 2433823 - RNA, 17 nt, Bordetella pertussis
gcgcgugcucgcgcaac

SEQ ID NO: 2433824 - RNA, 15 nt, Bordetella pertussis
gcgcgugcuggcgca

SEQ ID NO: 2433825 - RNA, 16 nt, Bordetella pertussis
gcgcgugcuggcgcag

SEQ ID NO: 2433826 - RNA, 20 nt, Bordetella pertussis
gcgcgugcuggcgcagcagc

SEQ ID NO: 2433827 - RNA, 19 nt, Bordetella pertussis
gcgcgugcugggccaugcg

SEQ ID NO: 2433828 - RNA, 16 nt, Bordetella pertussis
gcgcguggaaccgccg

SEQ ID NO: 2433829 - RNA, 17 nt, Bordetella pertussis
gcgcguggaaccgccgc

SEQ ID NO: 2433830 - RNA, 12 nt, Bordetella pertussis
gcgcguggccac

SEQ ID NO: 2433831 - RNA, 16 nt, Bordetella pertussis
gcgcguggccacggcg

SEQ ID NO: 2433832 - RNA, 19 nt, Bordetella pertussis
gcgcguggccacggcgucg

SEQ ID NO: 2433833 - RNA, 15 nt, Bordetella pertussis
gcgcguggccagcac

SEQ ID NO: 2433834 - RNA, 21 nt, Bordetella pertussis
gcgcguggccagcacggcgca

SEQ ID NO: 2433835 - RNA, 13 nt, Bordetella pertussis
gcgcguggccauc

SEQ ID NO: 2433836 - RNA, 14 nt, Bordetella pertussis
gcgcguggccauca

SEQ ID NO: 2433837 - RNA, 17 nt, Bordetella pertussis
gcgcguggcccgcgccg

SEQ ID NO: 2433838 - RNA, 23 nt, Bordetella pertussis
gcgcguggcccgcgccgcgucau

SEQ ID NO: 2433839 - RNA, 14 nt, Bordetella pertussis
gcgcguggccgcca

SEQ ID NO: 2433840 - RNA, 13 nt, Bordetella pertussis
gcgcguggccggc

SEQ ID NO: 2433841 - RNA, 15 nt, Bordetella pertussis
gcgcguggccggcga

SEQ ID NO: 2433842 - RNA, 19 nt, Bordetella pertussis
gcgcguggccggcgacggc

SEQ ID NO: 2433843 - RNA, 14 nt, Bordetella pertussis
gcgcguggccgggg

SEQ ID NO: 2433844 - RNA, 13 nt, Bordetella pertussis
gcgcguggcgcga

SEQ ID NO: 2433845 - RNA, 18 nt, Bordetella pertussis
gcgcgugggcacccggcc

SEQ ID NO: 2433846 - RNA, 19 nt, Bordetella pertussis
gcgcgugggcacccggccg

SEQ ID NO: 2433847 - RNA, 15 nt, Bordetella pertussis
gcgcgugggcaggug

SEQ ID NO: 2433848 - RNA, 17 nt, Bordetella pertussis
gcgcgugggccagcaac

SEQ ID NO: 2433849 - RNA, 19 nt, Bordetella pertussis
gcgcgugggccagcaacug

SEQ ID NO: 2433850 - RNA, 24 nt, Bordetella pertussis
gcgcgugggccagcaacuggugcc

SEQ ID NO: 2433851 - RNA, 22 nt, Bordetella pertussis
gcgcgugggccaguccgcagcg

SEQ ID NO: 2433852 - RNA, 22 nt, Bordetella pertussis
gcgcgugucccagccggcggca

SEQ ID NO: 2433853 - RNA, 16 nt, Bordetella pertussis
gcgcgugugguuggcg

SEQ ID NO: 2433854 - RNA, 17 nt, Bordetella pertussis
gcgcgugugguuggcgc

SEQ ID NO: 2433855 - RNA, 19 nt, Bordetella pertussis
gcgcgugugguuggcgcug

SEQ ID NO: 2433856 - RNA, 20 nt, Bordetella pertussis
gcgcgugugguuggcgcugc

SEQ ID NO: 2433857 - RNA, 17 nt, Bordetella pertussis
gcgcguuaaccucccga

SEQ ID NO: 2433858 - RNA, 14 nt, Bordetella pertussis
gcgcguucagcagc

SEQ ID NO: 2433859 - RNA, 15 nt, Bordetella pertussis
gcgcguucagcagca

SEQ ID NO: 2433860 - RNA, 20 nt, Bordetella pertussis
gcgcguucagcagcaggccc

SEQ ID NO: 2433861 - RNA, 21 nt, Bordetella pertussis
gcgcguucagcagcaggcccu

SEQ ID NO: 2433862 - RNA, 19 nt, Bordetella pertussis
gcgcguucagggcgccgcg

SEQ ID NO: 2433863 - RNA, 21 nt, Bordetella pertussis
gcgcguucagggcgccgcggc

SEQ ID NO: 2433864 - RNA, 14 nt, Bordetella pertussis
gcgcguuccggccg

SEQ ID NO: 2433865 - RNA, 16 nt, Bordetella pertussis
gcgcguuccggccgcg

SEQ ID NO: 2433866 - RNA, 15 nt, Bordetella pertussis
gcgcguucgccgcag

SEQ ID NO: 2433867 - RNA, 17 nt, Bordetella pertussis
gcgcguucgccgcagcc

SEQ ID NO: 2433868 - RNA, 15 nt, Bordetella pertussis
gcgcguucgggucgu

SEQ ID NO: 2433869 - RNA, 19 nt, Bordetella pertussis
gcgcguucgggucguuggu

SEQ ID NO: 2433870 - RNA, 21 nt, Bordetella pertussis
gcgcguucucagccgcccgcc

SEQ ID NO: 2433871 - RNA, 22 nt, Bordetella pertussis
gcgcguugagcagcaugugcuc

SEQ ID NO: 2433872 - RNA, 14 nt, Bordetella pertussis
gcgcguugccggug

SEQ ID NO: 2433873 - RNA, 18 nt, Bordetella pertussis
gcgcguugcgcaucgcgc

SEQ ID NO: 2433874 - RNA, 20 nt, Bordetella pertussis
gcgcguugcgcaucgcgcac

SEQ ID NO: 2433875 - RNA, 17 nt, Bordetella pertussis
gcgcguugcgcuugcgc

SEQ ID NO: 2433876 - RNA, 14 nt, Bordetella pertussis
gcgcguuggcguug

SEQ ID NO: 2433877 - RNA, 20 nt, Bordetella pertussis
gcgcguuucggucagggcga

SEQ ID NO: 2433878 - RNA, 16 nt, Bordetella pertussis
gcgcguuuucgcuggc

SEQ ID NO: 2433879 - RNA, 17 nt, Bordetella pertussis
gcgcguuuucgcuggcg

SEQ ID NO: 2433880 - RNA, 20 nt, Bordetella pertussis
gcgcguuuucgcuggcggac

SEQ ID NO: 2433881 - RNA, 13 nt, Bordetella pertussis
gcgcuacagggug

SEQ ID NO: 2433882 - RNA, 19 nt, Bordetella pertussis
gcgcuacagggugccgcgc

SEQ ID NO: 2433883 - RNA, 24 nt, Bordetella pertussis
gcgcuacgacgagaucgcgccuac

SEQ ID NO: 2433884 - RNA, 12 nt, Bordetella pertussis
gcgcuacgccgc

SEQ ID NO: 2433885 - RNA, 13 nt, Bordetella pertussis
gcgcuacgccgcc

SEQ ID NO: 2433886 - RNA, 22 nt, Bordetella pertussis
gcgcuacgccgccgauggcgcg

SEQ ID NO: 2433887 - RNA, 21 nt, Bordetella pertussis
gcgcuaugggggcgagcgggc

SEQ ID NO: 2433888 - RNA, 17 nt, Bordetella pertussis
gcgcucaagggccuguc

SEQ ID NO: 2433889 - RNA, 20 nt, Bordetella pertussis
gcgcucaccgagggccggac

SEQ ID NO: 2433890 - RNA, 16 nt, Bordetella pertussis
gcgcucagcaccaggc

SEQ ID NO: 2433891 - RNA, 17 nt, Bordetella pertussis
gcgcucagcaccaggcc

SEQ ID NO: 2433892 - RNA, 21 nt, Bordetella pertussis
gcgcucagcaccaggccgccg

SEQ ID NO: 2433893 - RNA, 23 nt, Bordetella pertussis
gcgcucagcaccaggccgccggc

SEQ ID NO: 2433894 - RNA, 14 nt, Bordetella pertussis
gcgcucagccgugc

SEQ ID NO: 2433895 - RNA, 17 nt, Bordetella pertussis
gcgcucagccgugccgc

SEQ ID NO: 2433896 - RNA, 19 nt, Bordetella pertussis
gcgcucagcgacgcgcgcc

SEQ ID NO: 2433897 - RNA, 21 nt, Bordetella pertussis
gcgcucagcgacgcgcgccgg

SEQ ID NO: 2433898 - RNA, 17 nt, Bordetella pertussis
gcgcucagcgccaucau

SEQ ID NO: 2433899 - RNA, 21 nt, Bordetella pertussis
gcgcucagcgccaucaucgcg

SEQ ID NO: 2433900 - RNA, 13 nt, Bordetella pertussis
gcgcucagcgcgc

SEQ ID NO: 2433901 - RNA, 15 nt, Bordetella pertussis
gcgcucagcgcgccg

SEQ ID NO: 2433902 - RNA, 16 nt, Bordetella pertussis
gcgcucagcgcgccga

SEQ ID NO: 2433903 - RNA, 17 nt, Bordetella pertussis
gcgcucaggaaccagcg

SEQ ID NO: 2433904 - RNA, 20 nt, Bordetella pertussis
gcgcucaggaaccagcggcu

SEQ ID NO: 2433905 - RNA, 13 nt, Bordetella pertussis
gcgcucaggccgc

SEQ ID NO: 2433906 - RNA, 17 nt, Bordetella pertussis
gcgcucaggccgccggc

SEQ ID NO: 2433907 - RNA, 19 nt, Bordetella pertussis
gcgcucaggccgccggcgc

SEQ ID NO: 2433908 - RNA, 18 nt, Bordetella pertussis
gcgcucaggccgcugggc

SEQ ID NO: 2433909 - RNA, 16 nt, Bordetella pertussis
gcgcucagggggcgcc

SEQ ID NO: 2433910 - RNA, 22 nt, Bordetella pertussis
gcgcucaguagcucgaccauca

SEQ ID NO: 2433911 - RNA, 19 nt, Bordetella pertussis
gcgcucaucaucgcgcugg

SEQ ID NO: 2433912 - RNA, 18 nt, Bordetella pertussis
gcgcucauguucgggcgc

SEQ ID NO: 2433913 - RNA, 19 nt, Bordetella pertussis
gcgcucauguucgggcgcg

SEQ ID NO: 2433914 - RNA, 13 nt, Bordetella pertussis
gcgcuccagcaug

SEQ ID NO: 2433915 - RNA, 17 nt, Bordetella pertussis
gcgcuccagcccuucgc

SEQ ID NO: 2433916 - RNA, 19 nt, Bordetella pertussis
gcgcuccagcgucauggcc

SEQ ID NO: 2433917 - RNA, 20 nt, Bordetella pertussis
gcgcuccagcgucauggccu

SEQ ID NO: 2433918 - RNA, 13 nt, Bordetella pertussis
gcgcugcccagcc

SEQ ID NO: 2433919 - RNA, 16 nt, Bordetella pertussis
gcgcugcccaggaugg

SEQ ID NO: 2433920 - RNA, 19 nt, Bordetella pertussis
gcgcugcccgucgcuggcg

SEQ ID NO: 2433921 - RNA, 16 nt, Bordetella pertussis
gcgcugccgcugcagg

SEQ ID NO: 2433922 - RNA, 21 nt, Bordetella pertussis
gcgcugccugaaaccgcaggc

SEQ ID NO: 2433923 - RNA, 22 nt, Bordetella pertussis
gcgcugccugaaaccgcaggca

SEQ ID NO: 2433924 - RNA, 15 nt, Bordetella pertussis
gcgcugccugccggc

SEQ ID NO: 2433925 - RNA, 15 nt, Bordetella pertussis
gcgcugcgacagcag

SEQ ID NO: 2433926 - RNA, 16 nt, Bordetella pertussis
gcgcugcgacagcagc

SEQ ID NO: 2433927 - RNA, 14 nt, Bordetella pertussis
gcgcugcgagccgc

SEQ ID NO: 2433928 - RNA, 15 nt, Bordetella pertussis
gcgcugcgcagcagg

SEQ ID NO: 2433929 - RNA, 21 nt, Bordetella pertussis
gcgcugcgcagcagggcggcg

SEQ ID NO: 2433930 - RNA, 14 nt, Bordetella pertussis
gcgcugcgccgcgg

SEQ ID NO: 2433931 - RNA, 16 nt, Bordetella pertussis
gcgcugcgccgcggcg

SEQ ID NO: 2433932 - RNA, 14 nt, Bordetella pertussis
gcgcugcgccggcg

SEQ ID NO: 2433933 - RNA, 16 nt, Bordetella pertussis
gcgcugcgccggcggc

SEQ ID NO: 2433934 - RNA, 18 nt, Bordetella pertussis
gcgcugcgccggcggcac

SEQ ID NO: 2433935 - RNA, 21 nt, Bordetella pertussis
gcgcugcgccuuggcgcgcag

SEQ ID NO: 2433936 - RNA, 22 nt, Bordetella pertussis
gcgcugcgccuuggcgcgcaga

SEQ ID NO: 2433937 - RNA, 23 nt, Bordetella pertussis
gcgcugcgccuuggcgcgcagac

SEQ ID NO: 2433938 - RNA, 21 nt, Bordetella pertussis
gcgcugcgcgaaacggccggg

SEQ ID NO: 2433939 - RNA, 14 nt, Bordetella pertussis
gcgcugcgcgccgc

SEQ ID NO: 2433940 - RNA, 15 nt, Bordetella pertussis
gcgcugcggucagcu

SEQ ID NO: 2433941 - RNA, 17 nt, Bordetella pertussis
gcgcugcggucagcugu

SEQ ID NO: 2433942 - RNA, 21 nt, Bordetella pertussis
gcgcugcugcaggccggcgcg

SEQ ID NO: 2433943 - RNA, 17 nt, Bordetella pertussis
gcgcugcugcuggcugc

SEQ ID NO: 2433944 - RNA, 18 nt, Bordetella pertussis
gcgcugcugcuggcugcc

SEQ ID NO: 2433945 - RNA, 14 nt, Bordetella pertussis
gcgcugcuggaggc

SEQ ID NO: 2433946 - RNA, 17 nt, Bordetella pertussis
gcgcugcuggaggccgg

SEQ ID NO: 2433947 - RNA, 18 nt, Bordetella pertussis
gcgcugcuggaggccggc

SEQ ID NO: 2433948 - RNA, 21 nt, Bordetella pertussis
gcgcugcuggccaagcgcgcc

SEQ ID NO: 2433949 - RNA, 16 nt, Bordetella pertussis
gcgcugcuggccggcc

SEQ ID NO: 2433950 - RNA, 17 nt, Bordetella pertussis
gcgcugcuggccggcca

SEQ ID NO: 2433951 - RNA, 13 nt, Bordetella pertussis
gcgcugcugucgc

SEQ ID NO: 2433952 - RNA, 16 nt, Bordetella pertussis
gcgcugcugucgcgcg

SEQ ID NO: 2433953 - RNA, 21 nt, Bordetella pertussis
gcgcugcugucgcgcgacugg

SEQ ID NO: 2433954 - RNA, 20 nt, Bordetella pertussis
gcgcugcugucgcgcugccc

SEQ ID NO: 2433955 - RNA, 22 nt, Bordetella pertussis
gcgcugcugucgcgcugcccgu

SEQ ID NO: 2433956 - RNA, 15 nt, Bordetella pertussis
gcgcuggaagacgug

SEQ ID NO: 2433957 - RNA, 17 nt, Bordetella pertussis
gcgcuggaagacguggc

SEQ ID NO: 2433958 - RNA, 20 nt, Bordetella pertussis
gcgcuggaagacguggcccg

SEQ ID NO: 2433959 - RNA, 19 nt, Bordetella pertussis
gcgcuggaauauggcgucc

SEQ ID NO: 2433960 - RNA, 17 nt, Bordetella pertussis
gcgcuggacgcccuggc

SEQ ID NO: 2433961 - RNA, 19 nt, Bordetella pertussis
gcgcuggacgcccuggcgc

SEQ ID NO: 2433962 - RNA, 20 nt, Bordetella pertussis
gcgcuggacgcccuggcgca

SEQ ID NO: 2433963 - RNA, 21 nt, Bordetella pertussis
gcgcuggacgcccuggcgcag

SEQ ID NO: 2433964 - RNA, 23 nt, Bordetella pertussis
gcgcuggacgcccuggcgcaggc

SEQ ID NO: 2433965 - RNA, 22 nt, Bordetella pertussis
gcgcuggaggccuuccaccagc

SEQ ID NO: 2433966 - RNA, 20 nt, Bordetella pertussis
gcgcuggaucccggcgauca

SEQ ID NO: 2433967 - RNA, 22 nt, Bordetella pertussis
gcgcuggaucccggcgaucaug

SEQ ID NO: 2433968 - RNA, 23 nt, Bordetella pertussis
gcgcuggauggucacgcccaggc

SEQ ID NO: 2433969 - RNA, 17 nt, Bordetella pertussis
gcgcuggcaggcgccuu

SEQ ID NO: 2433970 - RNA, 18 nt, Bordetella pertussis
gcgcuggccaucaccgcc

SEQ ID NO: 2433971 - RNA, 22 nt, Bordetella pertussis
gcgcuggcccaguucgcgcagc

SEQ ID NO: 2433972 - RNA, 22 nt, Bordetella pertussis
gcgcuggcccgucaugggcggg

SEQ ID NO: 2433973 - RNA, 13 nt, Bordetella pertussis
gcgcuggccgcca

SEQ ID NO: 2433974 - RNA, 13 nt, Bordetella pertussis
gcgcuggccgccc

SEQ ID NO: 2433975 - RNA, 20 nt, Bordetella pertussis
gcgcuggccgcccgcggccu

SEQ ID NO: 2433976 - RNA, 12 nt, Bordetella pertussis
gcgcuggccggc

SEQ ID NO: 2433977 - RNA, 14 nt, Bordetella pertussis
gcgcuggccggccg

SEQ ID NO: 2433978 - RNA, 17 nt, Bordetella pertussis
gcgcuggccugccgcgc

SEQ ID NO: 2433979 - RNA, 18 nt, Bordetella pertussis
gcgcuggccugccgcgcc

SEQ ID NO: 2433980 - RNA, 20 nt, Bordetella pertussis
gcgcuggccugccgcgccga

SEQ ID NO: 2433981 - RNA, 13 nt, Bordetella pertussis
gcgcuggccuggc

SEQ ID NO: 2433982 - RNA, 17 nt, Bordetella pertussis
gcgcuggccuggccgcc

SEQ ID NO: 2433983 - RNA, 19 nt, Bordetella pertussis
gcgcuggccuggccgccgg

SEQ ID NO: 2433984 - RNA, 22 nt, Bordetella pertussis
gcgcuggcgaagaacaccgccg

SEQ ID NO: 2433985 - RNA, 18 nt, Bordetella pertussis
gcgcuggcgaugcgggcc

SEQ ID NO: 2433986 - RNA, 19 nt, Bordetella pertussis
gcgcuggcgaugcgggcca

SEQ ID NO: 2433987 - RNA, 11 nt, Bordetella pertussis
gcgcuggcgca

SEQ ID NO: 2433988 - RNA, 13 nt, Bordetella pertussis
gcgcuggcgcagc

SEQ ID NO: 2433989 - RNA, 18 nt, Bordetella pertussis
gcgcuggcgcagcaggcg

SEQ ID NO: 2433990 - RNA, 21 nt, Bordetella pertussis
gcgcuggcgcagcaggcgcgc

SEQ ID NO: 2433991 - RNA, 14 nt, Bordetella pertussis
gcgcuggcgcccgg

SEQ ID NO: 2433992 - RNA, 14 nt, Bordetella pertussis
gcgcuggcgccgcg

SEQ ID NO: 2433993 - RNA, 15 nt, Bordetella pertussis
gcgcuggcgccgcgc

SEQ ID NO: 2433994 - RNA, 17 nt, Bordetella pertussis
gcgcuggcgccgcgcgc

SEQ ID NO: 2433995 - RNA, 18 nt, Bordetella pertussis
gcgcuggcgccgcgcgcc

SEQ ID NO: 2433996 - RNA, 11 nt, Bordetella pertussis
gcgcuggcgcg

SEQ ID NO: 2433997 - RNA, 12 nt, Bordetella pertussis
gcgcuggcgcgc

SEQ ID NO: 2433998 - RNA, 15 nt, Bordetella pertussis
gcgcuggcgcgcgac

SEQ ID NO: 2433999 - RNA, 21 nt, Bordetella pertussis
gcgcuggcgcgcgacggcgcc

SEQ ID NO: 2434000 - RNA, 19 nt, Bordetella pertussis
gcgcuggcgcgcggccgcg

SEQ ID NO: 2434001 - RNA, 17 nt, Bordetella pertussis
gcgcuggcgcgcggcug

SEQ ID NO: 2434002 - RNA, 20 nt, Bordetella pertussis
gcgcuggcgcgcggcuggcu

SEQ ID NO: 2434003 - RNA, 13 nt, Bordetella pertussis
gcgcuggcgcgcu

SEQ ID NO: 2434004 - RNA, 14 nt, Bordetella pertussis
gcgcuggcgcuggc

SEQ ID NO: 2434005 - RNA, 14 nt, Bordetella pertussis
gcgcuggcggcgca

SEQ ID NO: 2434006 - RNA, 14 nt, Bordetella pertussis
gcgcuggcggcugc

SEQ ID NO: 2434007 - RNA, 15 nt, Bordetella pertussis
gcgcuggcggcugcg

SEQ ID NO: 2434008 - RNA, 21 nt, Bordetella pertussis
gcgcuggcggcugcgcgacga

SEQ ID NO: 2434009 - RNA, 18 nt, Bordetella pertussis
gcgcuggcgguggccgcg

SEQ ID NO: 2434010 - RNA, 14 nt, Bordetella pertussis
gcgcuggcguucag

SEQ ID NO: 2434011 - RNA, 17 nt, Bordetella pertussis
gcgcuggcuggacgcgc

SEQ ID NO: 2434012 - RNA, 23 nt, Bordetella pertussis
gcgcuggcuggacgcgcgcggcg

SEQ ID NO: 2434013 - RNA, 15 nt, Bordetella pertussis
gcgcuggcugggccu

SEQ ID NO: 2434014 - RNA, 16 nt, Bordetella pertussis
gcgcuggcugggccug

SEQ ID NO: 2434015 - RNA, 17 nt, Bordetella pertussis
gcgcuggcugggccugc

SEQ ID NO: 2434016 - RNA, 15 nt, Bordetella pertussis
gcgcuggcugugccc

SEQ ID NO: 2434017 - RNA, 19 nt, Bordetella pertussis
gcgcuggcuucggcguacu

SEQ ID NO: 2434018 - RNA, 17 nt, Bordetella pertussis
gcgcugggcaggcuggc

SEQ ID NO: 2434019 - RNA, 18 nt, Bordetella pertussis
gcgcugggcaggcuggcg

SEQ ID NO: 2434020 - RNA, 19 nt, Bordetella pertussis
gcgcugggcaugggcggcc

SEQ ID NO: 2434021 - RNA, 20 nt, Bordetella pertussis
gcgcugggcaugggcggccc

SEQ ID NO: 2434022 - RNA, 21 nt, Bordetella pertussis
gcgcugggcaugggcggcccg

SEQ ID NO: 2434023 - RNA, 14 nt, Bordetella pertussis
gcgcugggccaggc

SEQ ID NO: 2434024 - RNA, 15 nt, Bordetella pertussis
gcgcugggccaggcc

SEQ ID NO: 2434025 - RNA, 17 nt, Bordetella pertussis
gcgcugggccaggccgg

SEQ ID NO: 2434026 - RNA, 19 nt, Bordetella pertussis
gcgcugggccaggccggcc

SEQ ID NO: 2434027 - RNA, 20 nt, Bordetella pertussis
gcgcugggccaggccggccu

SEQ ID NO: 2434028 - RNA, 21 nt, Bordetella pertussis
gcgcugggccaggccggccuu

SEQ ID NO: 2434029 - RNA, 15 nt, Bordetella pertussis
gcgcugggcgccagc

SEQ ID NO: 2434030 - RNA, 16 nt, Bordetella pertussis
gcgcugggcgccagca

SEQ ID NO: 2434031 - RNA, 17 nt, Bordetella pertussis
gcggaccgaacggccgg

SEQ ID NO: 2434032 - RNA, 15 nt, Bordetella pertussis
gcggaccuccugguc

SEQ ID NO: 2434033 - RNA, 17 nt, Bordetella pertussis
gcggaccugcucgagcg

SEQ ID NO: 2434034 - RNA, 19 nt, Bordetella pertussis
gcggaccugcucgagcggc

SEQ ID NO: 2434035 - RNA, 21 nt, Bordetella pertussis
gcggaccugcucgagcggcgg

SEQ ID NO: 2434036 - RNA, 14 nt, Bordetella pertussis
gcggacgaagccua

SEQ ID NO: 2434037 - RNA, 21 nt, Bordetella pertussis
gcggacgaagccuaggcugca

SEQ ID NO: 2434038 - RNA, 22 nt, Bordetella pertussis
gcggacgaagccuaggcugcag

SEQ ID NO: 2434039 - RNA, 18 nt, Bordetella pertussis
gcggacgauguagaucug

SEQ ID NO: 2434040 - RNA, 20 nt, Bordetella pertussis
gcggacgauguagaucuggc

SEQ ID NO: 2434041 - RNA, 21 nt, Bordetella pertussis
gcggacgauguagaucuggcg

SEQ ID NO: 2434042 - RNA, 15 nt, Bordetella pertussis
gcggacgccauggcg

SEQ ID NO: 2434043 - RNA, 20 nt, Bordetella pertussis
gcggacgccauggcggcggc

SEQ ID NO: 2434044 - RNA, 13 nt, Bordetella pertussis
gcggacggcgggc

SEQ ID NO: 2434045 - RNA, 16 nt, Bordetella pertussis
gcggacggcgggcgcc

SEQ ID NO: 2434046 - RNA, 17 nt, Bordetella pertussis
gcggacggcgggcgccc

SEQ ID NO: 2434047 - RNA, 13 nt, Bordetella pertussis
gcggacgggccag

SEQ ID NO: 2434048 - RNA, 15 nt, Bordetella pertussis
gcggacgggccaggc

SEQ ID NO: 2434049 - RNA, 16 nt, Bordetella pertussis
gcggacgggccaggcc

SEQ ID NO: 2434050 - RNA, 18 nt, Bordetella pertussis
gcggacgggccaggccga

SEQ ID NO: 2434051 - RNA, 20 nt, Bordetella pertussis
gcggacgggccaggccgaug

SEQ ID NO: 2434052 - RNA, 18 nt, Bordetella pertussis
gcggacgguagcgcacgc

SEQ ID NO: 2434053 - RNA, 16 nt, Bordetella pertussis
gcggacguuggccgau

SEQ ID NO: 2434054 - RNA, 21 nt, Bordetella pertussis
gcggacucuaugcgguguugc

SEQ ID NO: 2434055 - RNA, 15 nt, Bordetella pertussis
gcggacugcgccgca

SEQ ID NO: 2434056 - RNA, 22 nt, Bordetella pertussis
gcggacuucgcuuucgguggcg

SEQ ID NO: 2434057 - RNA, 15 nt, Bordetella pertussis
gcggagccgcgcaca

SEQ ID NO: 2434058 - RNA, 23 nt, Bordetella pertussis
gcggagccgcgcacacauggcgc

SEQ ID NO: 2434059 - RNA, 13 nt, Bordetella pertussis
gcggaggcggccg

SEQ ID NO: 2434060 - RNA, 15 nt, Bordetella pertussis
gcggaggcggccgcg

SEQ ID NO: 2434061 - RNA, 22 nt, Bordetella pertussis
gcggaggcggccgcgggcggcg

SEQ ID NO: 2434062 - RNA, 19 nt, Bordetella pertussis
gcggaggcuuugucguuga

SEQ ID NO: 2434063 - RNA, 20 nt, Bordetella pertussis
gcggagggugagugcccaug

SEQ ID NO: 2434064 - RNA, 17 nt, Bordetella pertussis
gcggaggugucgccgcc

SEQ ID NO: 2434065 - RNA, 18 nt, Bordetella pertussis
gcggaggugucgccgccc

SEQ ID NO: 2434066 - RNA, 22 nt, Bordetella pertussis
gcggaggugucgccgcccaugc

SEQ ID NO: 2434067 - RNA, 14 nt, Bordetella pertussis
gcggagucgauaug

SEQ ID NO: 2434068 - RNA, 21 nt, Bordetella pertussis
gcggagucgauaugccgauug

SEQ ID NO: 2434069 - RNA, 14 nt, Bordetella pertussis
gcggagucgccccg

SEQ ID NO: 2434070 - RNA, 20 nt, Bordetella pertussis
gcggagucgccccgacgcgc

SEQ ID NO: 2434071 - RNA, 18 nt, Bordetella pertussis
gcggauaacaucaugggc

SEQ ID NO: 2434072 - RNA, 20 nt, Bordetella pertussis
gcggauacgaaaccaggccg

SEQ ID NO: 2434073 - RNA, 23 nt, Bordetella pertussis
gcggauacgaaaccaggccgggg

SEQ ID NO: 2434074 - RNA, 17 nt, Bordetella pertussis
gcggauauucgucggcc

SEQ ID NO: 2434075 - RNA, 20 nt, Bordetella pertussis
gcggaucaagcggcccgcgc

SEQ ID NO: 2434076 - RNA, 22 nt, Bordetella pertussis
gcggaucaagcggcccgcgccc

SEQ ID NO: 2434077 - RNA, 21 nt, Bordetella pertussis
gcggaucacgcuaaauacgcu

SEQ ID NO: 2434078 - RNA, 19 nt, Bordetella pertussis
gcggaucaugggccugccc

SEQ ID NO: 2434079 - RNA, 14 nt, Bordetella pertussis
gcggauccagccau

SEQ ID NO: 2434080 - RNA, 18 nt, Bordetella pertussis
gcggauccagcgaggcau

SEQ ID NO: 2434081 - RNA, 15 nt, Bordetella pertussis
gcggauccuugacga

SEQ ID NO: 2434082 - RNA, 17 nt, Bordetella pertussis
gcggaucgaaaccggcg

SEQ ID NO: 2434083 - RNA, 18 nt, Bordetella pertussis
gcggaucgaacgccucgg

SEQ ID NO: 2434084 - RNA, 23 nt, Bordetella pertussis
gcggaucgaacgccucgggcgca

SEQ ID NO: 2434085 - RNA, 12 nt, Bordetella pertussis
gcggaucgccga

SEQ ID NO: 2434086 - RNA, 12 nt, Bordetella pertussis
gcggaucgccgg

SEQ ID NO: 2434087 - RNA, 14 nt, Bordetella pertussis
gcggaucgccgggc

SEQ ID NO: 2434088 - RNA, 14 nt, Bordetella pertussis
gcggaucgcggcgc

SEQ ID NO: 2434089 - RNA, 15 nt, Bordetella pertussis
gcggaucgugcgcca

SEQ ID NO: 2434090 - RNA, 20 nt, Bordetella pertussis
gcggaucucggccagcagcg

SEQ ID NO: 2434091 - RNA, 15 nt, Bordetella pertussis
gcggaucugacgggu

SEQ ID NO: 2434092 - RNA, 18 nt, Bordetella pertussis
gcggaugaacgaccagca

SEQ ID NO: 2434093 - RNA, 16 nt, Bordetella pertussis
gcggaugaagggcugg

SEQ ID NO: 2434094 - RNA, 17 nt, Bordetella pertussis
gcggaugaagggcuggc

SEQ ID NO: 2434095 - RNA, 20 nt, Bordetella pertussis
gcggaugaagggcuggccgg

SEQ ID NO: 2434096 - RNA, 21 nt, Bordetella pertussis
gcggaugaccugcgccaggug

SEQ ID NO: 2434097 - RNA, 20 nt, Bordetella pertussis
gcggaugaccuggugcacca

SEQ ID NO: 2434098 - RNA, 17 nt, Bordetella pertussis
gcggaugagcaggccgg

SEQ ID NO: 2434099 - RNA, 15 nt, Bordetella pertussis
gcggaugaucgcgca

SEQ ID NO: 2434100 - RNA, 17 nt, Bordetella pertussis
gcggaugaucgcgcagc

SEQ ID NO: 2434101 - RNA, 22 nt, Bordetella pertussis
gcggaugaucgcgcagcaccgc

SEQ ID NO: 2434102 - RNA, 21 nt, Bordetella pertussis
gcggaugaugcggcgccacgc

SEQ ID NO: 2434103 - RNA, 15 nt, Bordetella pertussis
gcggaugcagcagcg

SEQ ID NO: 2434104 - RNA, 14 nt, Bordetella pertussis
gcggaugcgccgcc

SEQ ID NO: 2434105 - RNA, 15 nt, Bordetella pertussis
gcggaugcgccgccc

SEQ ID NO: 2434106 - RNA, 19 nt, Bordetella pertussis
gcggaugcgccgccccagu

SEQ ID NO: 2434107 - RNA, 22 nt, Bordetella pertussis
gcggaugcgguacugcggcgcc

SEQ ID NO: 2434108 - RNA, 22 nt, Bordetella pertussis
gcggaugguaguacucgcugcg

SEQ ID NO: 2434109 - RNA, 23 nt, Bordetella pertussis
gcggaugguaguacucgcugcgc

SEQ ID NO: 2434110 - RNA, 19 nt, Bordetella pertussis
gcggauggucgagcgccug

SEQ ID NO: 2434111 - RNA, 13 nt, Bordetella pertussis
gcggauggugcuc

SEQ ID NO: 2434112 - RNA, 14 nt, Bordetella pertussis
gcggauguccggcg

SEQ ID NO: 2434113 - RNA, 21 nt, Bordetella pertussis
gcggauguccggcgcgaacgg

SEQ ID NO: 2434114 - RNA, 15 nt, Bordetella pertussis
gcggauucaggcgau

SEQ ID NO: 2434115 - RNA, 22 nt, Bordetella pertussis
gcggauucaggcgauccugccc

SEQ ID NO: 2434116 - RNA, 23 nt, Bordetella pertussis
gcggauugaugucgcgcaccgcc

SEQ ID NO: 2434117 - RNA, 14 nt, Bordetella pertussis
gcggauugccgucc

SEQ ID NO: 2434118 - RNA, 20 nt, Bordetella pertussis
gcggauugccguccuggcga

SEQ ID NO: 2434119 - RNA, 21 nt, Bordetella pertussis
gcggauugccguccuggcgac

SEQ ID NO: 2434120 - RNA, 16 nt, Bordetella pertussis
gcggauuggacagcag

SEQ ID NO: 2434121 - RNA, 22 nt, Bordetella pertussis
gcggcaaaaaaaaccgcgcgcc

SEQ ID NO: 2434122 - RNA, 23 nt, Bordetella pertussis
gcggcaaaaaaaaccgcgcgccg

SEQ ID NO: 2434123 - RNA, 17 nt, Bordetella pertussis
gcggcaaacccggcgaa

SEQ ID NO: 2434124 - RNA, 21 nt, Bordetella pertussis
gcggcaaacccggcgaagccg

SEQ ID NO: 2434125 - RNA, 15 nt, Bordetella pertussis
gcggcaaagccgcug

SEQ ID NO: 2434126 - RNA, 17 nt, Bordetella pertussis
gcggcaaagccgcugcg

SEQ ID NO: 2434127 - RNA, 19 nt, Bordetella pertussis
gcggcaaagccgcugcgcu

SEQ ID NO: 2434128 - RNA, 22 nt, Bordetella pertussis
gcggcaaagccgcugcgcuggc

SEQ ID NO: 2434129 - RNA, 23 nt, Bordetella pertussis
gcggcaaaguagugcccccacgc

SEQ ID NO: 2434130 - RNA, 19 nt, Bordetella pertussis
gcggcaaagucggggcgcc

SEQ ID NO: 2434131 - RNA, 16 nt, Bordetella pertussis
gcggcaaauggggcgg

SEQ ID NO: 2434132 - RNA, 17 nt, Bordetella pertussis
gcggcaaauggggcggc

SEQ ID NO: 2434133 - RNA, 22 nt, Bordetella pertussis
gcggcaaauggggcggccggga

SEQ ID NO: 2434134 - RNA, 14 nt, Bordetella pertussis
gcggcaacgugcag

SEQ ID NO: 2434135 - RNA, 16 nt, Bordetella pertussis
gcggcaagcagccgga

SEQ ID NO: 2434136 - RNA, 13 nt, Bordetella pertussis
gcggcaagccgcg

SEQ ID NO: 2434137 - RNA, 14 nt, Bordetella pertussis
gcggcaagccgcgg

SEQ ID NO: 2434138 - RNA, 16 nt, Bordetella pertussis
gcggcaagccgcggcg

SEQ ID NO: 2434139 - RNA, 14 nt, Bordetella pertussis
gcggcaagggugcc

SEQ ID NO: 2434140 - RNA, 19 nt, Bordetella pertussis
gcggcaagguagccgauga

SEQ ID NO: 2434141 - RNA, 20 nt, Bordetella pertussis
gcggcaauaccuucugcaag

SEQ ID NO: 2434142 - RNA, 14 nt, Bordetella pertussis
gcggcaaugcgcgc

SEQ ID NO: 2434143 - RNA, 16 nt, Bordetella pertussis
gcggcaucucgcggcg

SEQ ID NO: 2434144 - RNA, 13 nt, Bordetella pertussis
gcggcaugccgcu

SEQ ID NO: 2434145 - RNA, 14 nt, Bordetella pertussis
gcggcaugccgcug

SEQ ID NO: 2434146 - RNA, 16 nt, Bordetella pertussis
gcggcaugccgcugca

SEQ ID NO: 2434147 - RNA, 18 nt, Bordetella pertussis
gcggcaugccgcugcagg

SEQ ID NO: 2434148 - RNA, 15 nt, Bordetella pertussis
gcggcaugcgcaugc

SEQ ID NO: 2434149 - RNA, 16 nt, Bordetella pertussis
gcggcaugcgcaugcu

SEQ ID NO: 2434150 - RNA, 18 nt, Bordetella pertussis
gcggcaugcgcaugcugg

SEQ ID NO: 2434151 - RNA, 20 nt, Bordetella pertussis
gcggcaugcgccagccagcg

SEQ ID NO: 2434152 - RNA, 14 nt, Bordetella pertussis
gcggcaugcugguc

SEQ ID NO: 2434153 - RNA, 16 nt, Bordetella pertussis
gcggcaugcuggucau

SEQ ID NO: 2434154 - RNA, 20 nt, Bordetella pertussis
gcggcauggcgccgcgccgc

SEQ ID NO: 2434155 - RNA, 23 nt, Bordetella pertussis
gcggcaugggcacauacagcgga

SEQ ID NO: 2434156 - RNA, 21 nt, Bordetella pertussis
gcggcauggugugccuguccc

SEQ ID NO: 2434157 - RNA, 16 nt, Bordetella pertussis
gcggcauugcccaggu

SEQ ID NO: 2434158 - RNA, 18 nt, Bordetella pertussis
gcggcauugcccagguug

SEQ ID NO: 2434159 - RNA, 14 nt, Bordetella pertussis
gcggccaaccccga

SEQ ID NO: 2434160 - RNA, 20 nt, Bordetella pertussis
gcggccaaccccgagggcgc

SEQ ID NO: 2434161 - RNA, 12 nt, Bordetella pertussis
gcggccaccacc

SEQ ID NO: 2434162 - RNA, 14 nt, Bordetella pertussis
gcggccaccaccag

SEQ ID NO: 2434163 - RNA, 12 nt, Bordetella pertussis
gcggccaccagg

SEQ ID NO: 2434164 - RNA, 15 nt, Bordetella pertussis
gcggccacccugccg

SEQ ID NO: 2434165 - RNA, 16 nt, Bordetella pertussis
gcggccacccugccgu

SEQ ID NO: 2434166 - RNA, 19 nt, Bordetella pertussis
gcggccacccugccgugca

SEQ ID NO: 2434167 - RNA, 17 nt, Bordetella pertussis
gcggccacgaccggcuc

SEQ ID NO: 2434168 - RNA, 12 nt, Bordetella pertussis
gcggccacgccc

SEQ ID NO: 2434169 - RNA, 14 nt, Bordetella pertussis
gcggccacgcgccg

SEQ ID NO: 2434170 - RNA, 21 nt, Bordetella pertussis
gcggccacgcgccgcccgggc

SEQ ID NO: 2434171 - RNA, 15 nt, Bordetella pertussis
gcggccacggccugc

SEQ ID NO: 2434172 - RNA, 19 nt, Bordetella pertussis
gcggccacggccugcccgg

SEQ ID NO: 2434173 - RNA, 23 nt, Bordetella pertussis
gcggccacggccugcccgggcgg

SEQ ID NO: 2434174 - RNA, 22 nt, Bordetella pertussis
gcggccacggcggugaccacca

SEQ ID NO: 2434175 - RNA, 22 nt, Bordetella pertussis
gcggccagaccuugcgcgacgg

SEQ ID NO: 2434176 - RNA, 23 nt, Bordetella pertussis
gcggccagaccuugcgcgacggc

SEQ ID NO: 2434177 - RNA, 14 nt, Bordetella pertussis
gcggccagaucgga

SEQ ID NO: 2434178 - RNA, 17 nt, Bordetella pertussis
gcggccagaucggacgg

SEQ ID NO: 2434179 - RNA, 15 nt, Bordetella pertussis
gcggccagcaagcgc

SEQ ID NO: 2434180 - RNA, 17 nt, Bordetella pertussis
gcggccagcaagcgcgc

SEQ ID NO: 2434181 - RNA, 19 nt, Bordetella pertussis
gcggccagcaagcgcgcca

SEQ ID NO: 2434182 - RNA, 20 nt, Bordetella pertussis
gcggccagcaagcgcgccau

SEQ ID NO: 2434183 - RNA, 12 nt, Bordetella pertussis
gcggccagcacc

SEQ ID NO: 2434184 - RNA, 15 nt, Bordetella pertussis
gcggccagcaccggc

SEQ ID NO: 2434185 - RNA, 22 nt, Bordetella pertussis
gcggccagcaccggccgccgca

SEQ ID NO: 2434186 - RNA, 13 nt, Bordetella pertussis
gcggccagcacga

SEQ ID NO: 2434187 - RNA, 15 nt, Bordetella pertussis
gcggccagcagcgcg

SEQ ID NO: 2434188 - RNA, 19 nt, Bordetella pertussis
gcggccagcagcgcgugca

SEQ ID NO: 2434189 - RNA, 15 nt, Bordetella pertussis
gcggccagcagcggc

SEQ ID NO: 2434190 - RNA, 16 nt, Bordetella pertussis
gcggccagcagcggca

SEQ ID NO: 2434191 - RNA, 12 nt, Bordetella pertussis
gcggccagcaug

SEQ ID NO: 2434192 - RNA, 18 nt, Bordetella pertussis
gcggccagccacgccggc

SEQ ID NO: 2434193 - RNA, 22 nt, Bordetella pertussis
gcggccagccacgccggcgcgc

SEQ ID NO: 2434194 - RNA, 14 nt, Bordetella pertussis
gcggccagccggcg

SEQ ID NO: 2434195 - RNA, 17 nt, Bordetella pertussis
gcggccagccggcgcgc

SEQ ID NO: 2434196 - RNA, 20 nt, Bordetella pertussis
gcggccagccggcgcgccau

SEQ ID NO: 2434197 - RNA, 13 nt, Bordetella pertussis
gcggccagccggg

SEQ ID NO: 2434198 - RNA, 15 nt, Bordetella pertussis
gcggccagccgggug

SEQ ID NO: 2434199 - RNA, 20 nt, Bordetella pertussis
gcggccagccugccgcggcc

SEQ ID NO: 2434200 - RNA, 22 nt, Bordetella pertussis
gcggccagccugccgcggccgc

SEQ ID NO: 2434201 - RNA, 20 nt, Bordetella pertussis
gcggccagcgccgcgccgga

SEQ ID NO: 2434202 - RNA, 15 nt, Bordetella pertussis
gcggccagcgccggc

SEQ ID NO: 2434203 - RNA, 16 nt, Bordetella pertussis
gcggccagcgccggcg

SEQ ID NO: 2434204 - RNA, 19 nt, Bordetella pertussis
gcggccagcgccggcgcgc

SEQ ID NO: 2434205 - RNA, 14 nt, Bordetella pertussis
gcggccagcgcgca

SEQ ID NO: 2434206 - RNA, 14 nt, Bordetella pertussis
gcggccagcgcgcc

SEQ ID NO: 2434207 - RNA, 15 nt, Bordetella pertussis
gcggccagcgcgccg

SEQ ID NO: 2434208 - RNA, 13 nt, Bordetella pertussis
gcggccagcgcgg

SEQ ID NO: 2434209 - RNA, 16 nt, Bordetella pertussis
gcggccagcgcggcgg

SEQ ID NO: 2434210 - RNA, 14 nt, Bordetella pertussis
gcggccagcgcggu

SEQ ID NO: 2434211 - RNA, 24 nt, Bordetella pertussis
gcggccagcgcgucgagcagcgca

SEQ ID NO: 2434212 - RNA, 21 nt, Bordetella pertussis
gcggccagcggaugaugcggc

SEQ ID NO: 2434213 - RNA, 14 nt, Bordetella pertussis
gcggccagcggcgc

SEQ ID NO: 2434214 - RNA, 15 nt, Bordetella pertussis
gcggccagcggcgcu

SEQ ID NO: 2434215 - RNA, 21 nt, Bordetella pertussis
gcggccagcuugaccgccagc

SEQ ID NO: 2434216 - RNA, 22 nt, Bordetella pertussis
gcggccagcuugaccgccagca

SEQ ID NO: 2434217 - RNA, 18 nt, Bordetella pertussis
gcggccaggaucgcggcc

SEQ ID NO: 2434218 - RNA, 19 nt, Bordetella pertussis
gcggccaggaucgcggcca

SEQ ID NO: 2434219 - RNA, 21 nt, Bordetella pertussis
gcggccaggaucgcggccagc

SEQ ID NO: 2434220 - RNA, 22 nt, Bordetella pertussis
gcggccaggaucgcggccagcc

SEQ ID NO: 2434221 - RNA, 12 nt, Bordetella pertussis
gcggccaggccc

SEQ ID NO: 2434222 - RNA, 20 nt, Bordetella pertussis
gcggccaggcccaugccgcc

SEQ ID NO: 2434223 - RNA, 13 nt, Bordetella pertussis
gcggccaggcccu

SEQ ID NO: 2434224 - RNA, 13 nt, Bordetella pertussis
gcggccaggccga

SEQ ID NO: 2434225 - RNA, 17 nt, Bordetella pertussis
gcggccaggccgaacgc

SEQ ID NO: 2434226 - RNA, 20 nt, Bordetella pertussis
gcggccaggccggcgcgccg

SEQ ID NO: 2434227 - RNA, 22 nt, Bordetella pertussis
gcggccaggccggcgcgccggc

SEQ ID NO: 2434228 - RNA, 16 nt, Bordetella pertussis
gcggccaggccggggc

SEQ ID NO: 2434229 - RNA, 21 nt, Bordetella pertussis
gcggccaggccggggccgugg

SEQ ID NO: 2434230 - RNA, 16 nt, Bordetella pertussis
gcggccaggcgcgugc

SEQ ID NO: 2434231 - RNA, 15 nt, Bordetella pertussis
gcggccaggcggggu

SEQ ID NO: 2434232 - RNA, 12 nt, Bordetella pertussis
gcggccaggcuc

SEQ ID NO: 2434233 - RNA, 14 nt, Bordetella pertussis
gcggccaggcucug

SEQ ID NO: 2434234 - RNA, 17 nt, Bordetella pertussis
gcggccaggcucugggc

SEQ ID NO: 2434235 - RNA, 19 nt, Bordetella pertussis
gcggccaggcucugggcgg

SEQ ID NO: 2434236 - RNA, 20 nt, Bordetella pertussis
gcggccagggaaggggcggc

SEQ ID NO: 2434237 - RNA, 15 nt, Bordetella pertussis
gcggccagggcaagc

SEQ ID NO: 2434238 - RNA, 18 nt, Bordetella pertussis
gcggccagggccugcggg

SEQ ID NO: 2434239 - RNA, 20 nt, Bordetella pertussis
gcggccagggccugcgggcc

SEQ ID NO: 2434240 - RNA, 22 nt, Bordetella pertussis
gcggccagggccugcgggccgg

SEQ ID NO: 2434241 - RNA, 17 nt, Bordetella pertussis
gcggccagggcugcggc

SEQ ID NO: 2434242 - RNA, 14 nt, Bordetella pertussis
gcggccagggugcc

SEQ ID NO: 2434243 - RNA, 16 nt, Bordetella pertussis
gcggccagggugcccc

SEQ ID NO: 2434244 - RNA, 19 nt, Bordetella pertussis
gcggccagggugccccgcc

SEQ ID NO: 2434245 - RNA, 20 nt, Bordetella pertussis
gcggccagggugccccgccg

SEQ ID NO: 2434246 - RNA, 18 nt, Bordetella pertussis
gcggccaggucggcgucg

SEQ ID NO: 2434247 - RNA, 22 nt, Bordetella pertussis
gcggccaguucgacgcccaugc

SEQ ID NO: 2434248 - RNA, 17 nt, Bordetella pertussis
gcggccaguucguccgc

SEQ ID NO: 2434249 - RNA, 17 nt, Bordetella pertussis
gcggccaucgccauggc

SEQ ID NO: 2434250 - RNA, 20 nt, Bordetella pertussis
gcggccaucgccauggccac

SEQ ID NO: 2434251 - RNA, 23 nt, Bordetella pertussis
gcggccaucgccauggccacgac

SEQ ID NO: 2434252 - RNA, 13 nt, Bordetella pertussis
gcggccaucgccg

SEQ ID NO: 2434253 - RNA, 14 nt, Bordetella pertussis
gcggccaucgccgc

SEQ ID NO: 2434254 - RNA, 15 nt, Bordetella pertussis
gcggccaucgccgcc

SEQ ID NO: 2434255 - RNA, 18 nt, Bordetella pertussis
gcggccaucgccgccacg

SEQ ID NO: 2434256 - RNA, 16 nt, Bordetella pertussis
gcggccgcgggcagca

SEQ ID NO: 2434257 - RNA, 17 nt, Bordetella pertussis
gcggccgcgggcagcaa

SEQ ID NO: 2434258 - RNA, 13 nt, Bordetella pertussis
gcggccgcgucca

SEQ ID NO: 2434259 - RNA, 16 nt, Bordetella pertussis
gcggccgcguccagcg

SEQ ID NO: 2434260 - RNA, 19 nt, Bordetella pertussis
gcggccgcguccagcgcgc

SEQ ID NO: 2434261 - RNA, 17 nt, Bordetella pertussis
gcggccgcugccgcgcg

SEQ ID NO: 2434262 - RNA, 22 nt, Bordetella pertussis
gcggccgcugccgcgcgccggc

SEQ ID NO: 2434263 - RNA, 18 nt, Bordetella pertussis
gcggccggacagggccgc

SEQ ID NO: 2434264 - RNA, 20 nt, Bordetella pertussis
gcggccggacagggccgcga

SEQ ID NO: 2434265 - RNA, 23 nt, Bordetella pertussis
gcggccggacagggccgcgagca

SEQ ID NO: 2434266 - RNA, 17 nt, Bordetella pertussis
gcggccggaggccgccc

SEQ ID NO: 2434267 - RNA, 16 nt, Bordetella pertussis
gcggccggcaccagga

SEQ ID NO: 2434268 - RNA, 16 nt, Bordetella pertussis
gcggccggcaccaucu

SEQ ID NO: 2434269 - RNA, 21 nt, Bordetella pertussis
gcggccggcacgcccagccgc

SEQ ID NO: 2434270 - RNA, 13 nt, Bordetella pertussis
gcggccggcaggc

SEQ ID NO: 2434271 - RNA, 15 nt, Bordetella pertussis
gcggccggcaggccg

SEQ ID NO: 2434272 - RNA, 16 nt, Bordetella pertussis
gcggccggcaggccgg

SEQ ID NO: 2434273 - RNA, 19 nt, Bordetella pertussis
gcggccggcaggccggcca

SEQ ID NO: 2434274 - RNA, 22 nt, Bordetella pertussis
gcggccggcaggccggccagca

SEQ ID NO: 2434275 - RNA, 23 nt, Bordetella pertussis
gcggccggcaggccggccagcaa

SEQ ID NO: 2434276 - RNA, 13 nt, Bordetella pertussis
gcggccggccagc

SEQ ID NO: 2434277 - RNA, 14 nt, Bordetella pertussis
gcggccggccgcgc

SEQ ID NO: 2434278 - RNA, 16 nt, Bordetella pertussis
gcggccggccgcgccc

SEQ ID NO: 2434279 - RNA, 16 nt, Bordetella pertussis
gcggccggccggguug

SEQ ID NO: 2434280 - RNA, 17 nt, Bordetella pertussis
gcggccggcgcgccggc

SEQ ID NO: 2434281 - RNA, 18 nt, Bordetella pertussis
gcggccggcgcgccggcc

SEQ ID NO: 2434282 - RNA, 19 nt, Bordetella pertussis
gcggccggcgcgccggccu

SEQ ID NO: 2434283 - RNA, 15 nt, Bordetella pertussis
gcggccggcgcgcgc

SEQ ID NO: 2434284 - RNA, 21 nt, Bordetella pertussis
gcggccggcgcgcgcgaccac

SEQ ID NO: 2434285 - RNA, 22 nt, Bordetella pertussis
gcggccggcgcgucgccggcga

SEQ ID NO: 2434286 - RNA, 12 nt, Bordetella pertussis
gcggccggcgcu

SEQ ID NO: 2434287 - RNA, 13 nt, Bordetella pertussis
gcggccggcgcug

SEQ ID NO: 2434288 - RNA, 14 nt, Bordetella pertussis
gcggccggcggcgc

SEQ ID NO: 2434289 - RNA, 20 nt, Bordetella pertussis
gcggccggcguugcgcccug

SEQ ID NO: 2434290 - RNA, 17 nt, Bordetella pertussis
gcggccggcuugcgcaa

SEQ ID NO: 2434291 - RNA, 14 nt, Bordetella pertussis
gcggccgggcuauc

SEQ ID NO: 2434292 - RNA, 18 nt, Bordetella pertussis
gcggccgggcuaucccaa

SEQ ID NO: 2434293 - RNA, 20 nt, Bordetella pertussis
gcggccgggcucaggcugcg

SEQ ID NO: 2434294 - RNA, 13 nt, Bordetella pertussis
gcggccggggccg

SEQ ID NO: 2434295 - RNA, 14 nt, Bordetella pertussis
gcggccggggccgc

SEQ ID NO: 2434296 - RNA, 19 nt, Bordetella pertussis
gcggccggggccgcccugg

SEQ ID NO: 2434297 - RNA, 16 nt, Bordetella pertussis
gcggccgggucggccu

SEQ ID NO: 2434298 - RNA, 18 nt, Bordetella pertussis
gcggccgggucggccugc

SEQ ID NO: 2434299 - RNA, 20 nt, Bordetella pertussis
gcggccgggucggccugcca

SEQ ID NO: 2434300 - RNA, 13 nt, Bordetella pertussis
gcggccgguggcg

SEQ ID NO: 2434301 - RNA, 18 nt, Bordetella pertussis
gcggccgguggcgaucag

SEQ ID NO: 2434302 - RNA, 22 nt, Bordetella pertussis
gcggccgucgaccgacagcaca

SEQ ID NO: 2434303 - RNA, 13 nt, Bordetella pertussis
gcggccgucgccg

SEQ ID NO: 2434304 - RNA, 16 nt, Bordetella pertussis
gcggccgucgccgccc

SEQ ID NO: 2434305 - RNA, 20 nt, Bordetella pertussis
gcggccgucgccgcccaugc

SEQ ID NO: 2434306 - RNA, 17 nt, Bordetella pertussis
gcggccgucggcgcugg

SEQ ID NO: 2434307 - RNA, 13 nt, Bordetella pertussis
gcggccgucgggg

SEQ ID NO: 2434308 - RNA, 16 nt, Bordetella pertussis
gcggccgucgguggug

SEQ ID NO: 2434309 - RNA, 14 nt, Bordetella pertussis
gcggccgucgugca

SEQ ID NO: 2434310 - RNA, 17 nt, Bordetella pertussis
gcggccgucgugcagcg

SEQ ID NO: 2434311 - RNA, 17 nt, Bordetella pertussis
gcggccgugcgccagcg

SEQ ID NO: 2434312 - RNA, 19 nt, Bordetella pertussis
gcggccguggaggcggcgg

SEQ ID NO: 2434313 - RNA, 20 nt, Bordetella pertussis
gcggccguggaggcggcggc

SEQ ID NO: 2434314 - RNA, 14 nt, Bordetella pertussis
gcggccguggcggc

SEQ ID NO: 2434315 - RNA, 15 nt, Bordetella pertussis
gcggccguggcggcc

SEQ ID NO: 2434316 - RNA, 16 nt, Bordetella pertussis
gcggccguggcggccu

SEQ ID NO: 2434317 - RNA, 17 nt, Bordetella pertussis
gcggccguggcggccug

SEQ ID NO: 2434318 - RNA, 18 nt, Bordetella pertussis
gcggccguugcuccagcc

SEQ ID NO: 2434319 - RNA, 19 nt, Bordetella pertussis
gcggccguugcuccagcca

SEQ ID NO: 2434320 - RNA, 21 nt, Bordetella pertussis
gcggccguuggcgauggcgcg

SEQ ID NO: 2434321 - RNA, 17 nt, Bordetella pertussis
gcggccguuggcgugca

SEQ ID NO: 2434322 - RNA, 22 nt, Bordetella pertussis
gcggccuaugugcaggccaccg

SEQ ID NO: 2434323 - RNA, 22 nt, Bordetella pertussis
gcggccuauuuggcggccuggc

SEQ ID NO: 2434324 - RNA, 13 nt, Bordetella pertussis
gcggccuccagca

SEQ ID NO: 2434325 - RNA, 16 nt, Bordetella pertussis
gcggccuccagcaggg

SEQ ID NO: 2434326 - RNA, 23 nt, Bordetella pertussis
gcggccuccgcgcacagcgcggc

SEQ ID NO: 2434327 - RNA, 18 nt, Bordetella pertussis
gcggccuccggcaggauc

SEQ ID NO: 2434328 - RNA, 17 nt, Bordetella pertussis
gcggccucgacgauggc

SEQ ID NO: 2434329 - RNA, 18 nt, Bordetella pertussis
gcggccucgacgauggcc

SEQ ID NO: 2434330 - RNA, 22 nt, Bordetella pertussis
gcggccucgacgauggccgggg

SEQ ID NO: 2434331 - RNA, 17 nt, Bordetella pertussis
gcggccucgacggccgc

SEQ ID NO: 2434332 - RNA, 19 nt, Bordetella pertussis
gcggccucgacggccgccg

SEQ ID NO: 2434333 - RNA, 15 nt, Bordetella pertussis
gcggccucgccggcc

SEQ ID NO: 2434334 - RNA, 16 nt, Bordetella pertussis
gcggccucgccggccu

SEQ ID NO: 2434335 - RNA, 17 nt, Bordetella pertussis
gcggccucgccggccug

SEQ ID NO: 2434336 - RNA, 18 nt, Bordetella pertussis
gcggccucgccggccugg

SEQ ID NO: 2434337 - RNA, 22 nt, Bordetella pertussis
gcggccucgccggccuggcgcg

SEQ ID NO: 2434338 - RNA, 16 nt, Bordetella pertussis
gcggccucggccagcu

SEQ ID NO: 2434339 - RNA, 17 nt, Bordetella pertussis
gcggccucggccagcug

SEQ ID NO: 2434340 - RNA, 13 nt, Bordetella pertussis
gcggccucggccg

SEQ ID NO: 2434341 - RNA, 15 nt, Bordetella pertussis
gcggccucggcgggc

SEQ ID NO: 2434342 - RNA, 18 nt, Bordetella pertussis
gcggccucggcgggcggc

SEQ ID NO: 2434343 - RNA, 19 nt, Bordetella pertussis
gcggccugcagaccagcac

SEQ ID NO: 2434344 - RNA, 22 nt, Bordetella pertussis
gcggccugcagaccagcaccgg

SEQ ID NO: 2434345 - RNA, 19 nt, Bordetella pertussis
gcggccugcaggccguucc

SEQ ID NO: 2434346 - RNA, 14 nt, Bordetella pertussis
gcggccugcgccgg

SEQ ID NO: 2434347 - RNA, 16 nt, Bordetella pertussis
gcggccugcgcguccc

SEQ ID NO: 2434348 - RNA, 19 nt, Bordetella pertussis
gcggccugcuuggcagccu

SEQ ID NO: 2434349 - RNA, 16 nt, Bordetella pertussis
gcggccuggaccugag

SEQ ID NO: 2434350 - RNA, 15 nt, Bordetella pertussis
gcggccuggccccgc

SEQ ID NO: 2434351 - RNA, 20 nt, Bordetella pertussis
gcggccuggccccgcgcgag

SEQ ID NO: 2434352 - RNA, 21 nt, Bordetella pertussis
gcggccuggccccgcgcgagc

SEQ ID NO: 2434353 - RNA, 13 nt, Bordetella pertussis
gcggccuggccgc

SEQ ID NO: 2434354 - RNA, 16 nt, Bordetella pertussis
gcggccuggccgcgcg

SEQ ID NO: 2434355 - RNA, 18 nt, Bordetella pertussis
gcggccuggccgcgcgcc

SEQ ID NO: 2434356 - RNA, 20 nt, Bordetella pertussis
gcggccuggccgcgcgccug

SEQ ID NO: 2434357 - RNA, 22 nt, Bordetella pertussis
gcggccuggccgcgcgccugcu

SEQ ID NO: 2434358 - RNA, 14 nt, Bordetella pertussis
gcggccugggcggc

SEQ ID NO: 2434359 - RNA, 15 nt, Bordetella pertussis
gcggccugggcggcg

SEQ ID NO: 2434360 - RNA, 18 nt, Bordetella pertussis
gcggccugggcggcgcgc

SEQ ID NO: 2434361 - RNA, 14 nt, Bordetella pertussis
gcggccuucacccc

SEQ ID NO: 2434362 - RNA, 17 nt, Bordetella pertussis
gcggccuucaccccgcc

SEQ ID NO: 2434363 - RNA, 22 nt, Bordetella pertussis
gcggccuucaugaucuggccga

SEQ ID NO: 2434364 - RNA, 23 nt, Bordetella pertussis
gcggccuucaugaucuggccgac

SEQ ID NO: 2434365 - RNA, 16 nt, Bordetella pertussis
gcggccuucgccggug

SEQ ID NO: 2434366 - RNA, 21 nt, Bordetella pertussis
gcggccuugagcaucugcggc

SEQ ID NO: 2434367 - RNA, 22 nt, Bordetella pertussis
gcggccuugagcaucugcggca

SEQ ID NO: 2434368 - RNA, 15 nt, Bordetella pertussis
gcggccuugccggcc

SEQ ID NO: 2434369 - RNA, 12 nt, Bordetella pertussis
gcggcgccagcu

SEQ ID NO: 2434370 - RNA, 14 nt, Bordetella pertussis
gcggcgccagcugg

SEQ ID NO: 2434371 - RNA, 20 nt, Bordetella pertussis
gcggcgccaugccgcgcccg

SEQ ID NO: 2434372 - RNA, 14 nt, Bordetella pertussis
gcggcgccaugcgc

SEQ ID NO: 2434373 - RNA, 22 nt, Bordetella pertussis
gcggcgccaugcgcaccaccgc

SEQ ID NO: 2434374 - RNA, 12 nt, Bordetella pertussis
gcggcgcccagc

SEQ ID NO: 2434375 - RNA, 15 nt, Bordetella pertussis
gcggcgcccagcugg

SEQ ID NO: 2434376 - RNA, 16 nt, Bordetella pertussis
gcggcgcccagcuggc

SEQ ID NO: 2434377 - RNA, 19 nt, Bordetella pertussis
gcggcgcccagcuggcgcc

SEQ ID NO: 2434378 - RNA, 22 nt, Bordetella pertussis
gcggcgcccagcuggcgccccu

SEQ ID NO: 2434379 - RNA, 19 nt, Bordetella pertussis
gcggcgcccaggcccagcg

SEQ ID NO: 2434380 - RNA, 21 nt, Bordetella pertussis
gcggcgcccaggcccagcgcg

SEQ ID NO: 2434381 - RNA, 13 nt, Bordetella pertussis
gcggcgcccauca

SEQ ID NO: 2434382 - RNA, 17 nt, Bordetella pertussis
gcggcgcccccgcggcg

SEQ ID NO: 2434383 - RNA, 22 nt, Bordetella pertussis
gcggcgcccccgcggcgccccg

SEQ ID NO: 2434384 - RNA, 12 nt, Bordetella pertussis
gcggcgcccgca

SEQ ID NO: 2434385 - RNA, 16 nt, Bordetella pertussis
gcggcgcccgcaugga

SEQ ID NO: 2434386 - RNA, 18 nt, Bordetella pertussis
gcggcgcccgcgcaugca

SEQ ID NO: 2434387 - RNA, 20 nt, Bordetella pertussis
gcggcgcccggugcgcgcag

SEQ ID NO: 2434388 - RNA, 22 nt, Bordetella pertussis
gcggcgcccggugcgcgcaggg

SEQ ID NO: 2434389 - RNA, 16 nt, Bordetella pertussis
gcggcgccgaccaggu

SEQ ID NO: 2434390 - RNA, 12 nt, Bordetella pertussis
gcggcgccgccg

SEQ ID NO: 2434391 - RNA, 14 nt, Bordetella pertussis
gcggcgccgccggc

SEQ ID NO: 2434392 - RNA, 15 nt, Bordetella pertussis
gcggcgccgccggcg

SEQ ID NO: 2434393 - RNA, 22 nt, Bordetella pertussis
gcggcgccgccggcggccugga

SEQ ID NO: 2434394 - RNA, 14 nt, Bordetella pertussis
gcggcgccgcuggc

SEQ ID NO: 2434395 - RNA, 20 nt, Bordetella pertussis
gcggcgccggaucggccggc

SEQ ID NO: 2434396 - RNA, 22 nt, Bordetella pertussis
gcggcgccggaucggccggcag

SEQ ID NO: 2434397 - RNA, 12 nt, Bordetella pertussis
gcggcgccggca

SEQ ID NO: 2434398 - RNA, 12 nt, Bordetella pertussis
gcggcgccggcc

SEQ ID NO: 2434399 - RNA, 21 nt, Bordetella pertussis
gcggcgccggccgucauccac

SEQ ID NO: 2434400 - RNA, 13 nt, Bordetella pertussis
gcggcgccggccu

SEQ ID NO: 2434401 - RNA, 18 nt, Bordetella pertussis
gcggcgccggccuccagc

SEQ ID NO: 2434402 - RNA, 19 nt, Bordetella pertussis
gcggcgccggugaccgcca

SEQ ID NO: 2434403 - RNA, 17 nt, Bordetella pertussis
gcggcgccguccagcgc

SEQ ID NO: 2434404 - RNA, 18 nt, Bordetella pertussis
gcggcgccguccagcgcg

SEQ ID NO: 2434405 - RNA, 22 nt, Bordetella pertussis
gcggcgccguccagcgcggcau

SEQ ID NO: 2434406 - RNA, 13 nt, Bordetella pertussis
gcggcgccgucga

SEQ ID NO: 2434407 - RNA, 14 nt, Bordetella pertussis
gcggcgccucgguc

SEQ ID NO: 2434408 - RNA, 19 nt, Bordetella pertussis
gcggcgccucgguccagcg

SEQ ID NO: 2434409 - RNA, 21 nt, Bordetella pertussis
gcggcgccucgguccagcgga

SEQ ID NO: 2434410 - RNA, 13 nt, Bordetella pertussis
gcggcgccugccu

SEQ ID NO: 2434411 - RNA, 12 nt, Bordetella pertussis
gcggcgccugcg

SEQ ID NO: 2434412 - RNA, 17 nt, Bordetella pertussis
gcggcgccugcgcgcgc

SEQ ID NO: 2434413 - RNA, 21 nt, Bordetella pertussis
gcggcgccugcgcgcgcuggg

SEQ ID NO: 2434414 - RNA, 18 nt, Bordetella pertussis
gcggcgccugggccuucu

SEQ ID NO: 2434415 - RNA, 17 nt, Bordetella pertussis
gcggcgccuggggcgug

SEQ ID NO: 2434416 - RNA, 13 nt, Bordetella pertussis
gcggcgccugguc

SEQ ID NO: 2434417 - RNA, 20 nt, Bordetella pertussis
gcggcgccuggucgcgcgcc

SEQ ID NO: 2434418 - RNA, 22 nt, Bordetella pertussis
gcggcgccuggucgcgcgccug

SEQ ID NO: 2434419 - RNA, 18 nt, Bordetella pertussis
gcggcgccugucccgcug

SEQ ID NO: 2434420 - RNA, 14 nt, Bordetella pertussis
gcggcgcgaacggc

SEQ ID NO: 2434421 - RNA, 16 nt, Bordetella pertussis
gcggcgcgaacggcag

SEQ ID NO: 2434422 - RNA, 15 nt, Bordetella pertussis
gcggcgcgaccugcg

SEQ ID NO: 2434423 - RNA, 14 nt, Bordetella pertussis
gcggcgcgacgcgc

SEQ ID NO: 2434424 - RNA, 14 nt, Bordetella pertussis
gcggcgcgagcgca

SEQ ID NO: 2434425 - RNA, 15 nt, Bordetella pertussis
gcggcgcgagcgcac

SEQ ID NO: 2434426 - RNA, 12 nt, Bordetella pertussis
gcggcgcgcacg

SEQ ID NO: 2434427 - RNA, 14 nt, Bordetella pertussis
gcggcgcgccagcg

SEQ ID NO: 2434428 - RNA, 16 nt, Bordetella pertussis
gcggcgcgccagcgcg

SEQ ID NO: 2434429 - RNA, 21 nt, Bordetella pertussis
gcggcgcgccagcgcggccag

SEQ ID NO: 2434430 - RNA, 14 nt, Bordetella pertussis
gcggcgcgcccagc

SEQ ID NO: 2434431 - RNA, 15 nt, Bordetella pertussis
gcggcgcgcccagcg

SEQ ID NO: 2434432 - RNA, 14 nt, Bordetella pertussis
gcggcgcgcccgcc

SEQ ID NO: 2434433 - RNA, 14 nt, Bordetella pertussis
gcggcgcgccgccg

SEQ ID NO: 2434434 - RNA, 19 nt, Bordetella pertussis
gcggcgcgccgccgggccu

SEQ ID NO: 2434435 - RNA, 15 nt, Bordetella pertussis
gcggcgcgccgcguc

SEQ ID NO: 2434436 - RNA, 14 nt, Bordetella pertussis
gcggcgcgccgucc

SEQ ID NO: 2434437 - RNA, 15 nt, Bordetella pertussis
gcggcgcgccguccg

SEQ ID NO: 2434438 - RNA, 11 nt, Bordetella pertussis
gcggcgcgcgc

SEQ ID NO: 2434439 - RNA, 15 nt, Bordetella pertussis
gcggcgcgcgcaggu

SEQ ID NO: 2434440 - RNA, 16 nt, Bordetella pertussis
gcggcgcgcgcagguc

SEQ ID NO: 2434441 - RNA, 13 nt, Bordetella pertussis
gcggcgcgcgcca

SEQ ID NO: 2434442 - RNA, 14 nt, Bordetella pertussis
gcggcgcgcgccag

SEQ ID NO: 2434443 - RNA, 13 nt, Bordetella pertussis
gcggcgcgcgccg

SEQ ID NO: 2434444 - RNA, 14 nt, Bordetella pertussis
gcggcgcgcgccug

SEQ ID NO: 2434445 - RNA, 16 nt, Bordetella pertussis
gcggcgcgcgccugca

SEQ ID NO: 2434446 - RNA, 14 nt, Bordetella pertussis
gcggcgcgcgcgcc

SEQ ID NO: 2434447 - RNA, 15 nt, Bordetella pertussis
gcggcgcgcgcgccg

SEQ ID NO: 2434448 - RNA, 18 nt, Bordetella pertussis
gcggcgcgcgcgccgccu

SEQ ID NO: 2434449 - RNA, 21 nt, Bordetella pertussis
gcggcgcgcgcgccgccuacc

SEQ ID NO: 2434450 - RNA, 17 nt, Bordetella pertussis
gcggcgcgcgcgcgcag

SEQ ID NO: 2434451 - RNA, 19 nt, Bordetella pertussis
gcggcgcgcgcgcgcagca

SEQ ID NO: 2434452 - RNA, 14 nt, Bordetella pertussis
gcggcgcgcgcggc

SEQ ID NO: 2434453 - RNA, 18 nt, Bordetella pertussis
gcggcgcgcgcggcgccu

SEQ ID NO: 2434454 - RNA, 13 nt, Bordetella pertussis
gcggcgcgcggcu

SEQ ID NO: 2434455 - RNA, 14 nt, Bordetella pertussis
gcggcgcgcggcug

SEQ ID NO: 2434456 - RNA, 15 nt, Bordetella pertussis
gcggcgcgcggcugg

SEQ ID NO: 2434457 - RNA, 16 nt, Bordetella pertussis
gcggcgcgcggcuggg

SEQ ID NO: 2434458 - RNA, 15 nt, Bordetella pertussis
gcggcgcgcuggacg

SEQ ID NO: 2434459 - RNA, 20 nt, Bordetella pertussis
gcggcgcggccaaccccgag

SEQ ID NO: 2434460 - RNA, 14 nt, Bordetella pertussis
gcggcgcggccagc

SEQ ID NO: 2434461 - RNA, 17 nt, Bordetella pertussis
gcggcgcggccagcacg

SEQ ID NO: 2434462 - RNA, 14 nt, Bordetella pertussis
gcggcgcggcccgc

SEQ ID NO: 2434463 - RNA, 20 nt, Bordetella pertussis
gcggcgcggcccgccacgca

SEQ ID NO: 2434464 - RNA, 14 nt, Bordetella pertussis
gcggcgcggccgac

SEQ ID NO: 2434465 - RNA, 16 nt, Bordetella pertussis
gcggcgcggccggcuu

SEQ ID NO: 2434466 - RNA, 12 nt, Bordetella pertussis
gcggcgcggccu

SEQ ID NO: 2434467 - RNA, 17 nt, Bordetella pertussis
gcggcgcggcgagcacg

SEQ ID NO: 2434468 - RNA, 13 nt, Bordetella pertussis
gcggcgcggcgca

SEQ ID NO: 2434469 - RNA, 14 nt, Bordetella pertussis
gcggcgcggcgcca

SEQ ID NO: 2434470 - RNA, 13 nt, Bordetella pertussis
gcggcgcggcgcg

SEQ ID NO: 2434471 - RNA, 17 nt, Bordetella pertussis
gcggcgcggcgcuggcg

SEQ ID NO: 2434472 - RNA, 16 nt, Bordetella pertussis
gcggcgcggcggugcc

SEQ ID NO: 2434473 - RNA, 16 nt, Bordetella pertussis
gcggcgcggcuggcga

SEQ ID NO: 2434474 - RNA, 13 nt, Bordetella pertussis
gcggcgcgggcgg

SEQ ID NO: 2434475 - RNA, 18 nt, Bordetella pertussis
gcggcgcgggcggcuagg

SEQ ID NO: 2434476 - RNA, 19 nt, Bordetella pertussis
gcggcgcgggcggcuaggc

SEQ ID NO: 2434477 - RNA, 20 nt, Bordetella pertussis
gcggcgcguauccgccguug

SEQ ID NO: 2434478 - RNA, 18 nt, Bordetella pertussis
gcggcgcgucgcgcgcca

SEQ ID NO: 2434479 - RNA, 16 nt, Bordetella pertussis
gcggcgcgugccagca

SEQ ID NO: 2434480 - RNA, 18 nt, Bordetella pertussis
gcggcgcgugccagcagg

SEQ ID NO: 2434481 - RNA, 19 nt, Bordetella pertussis
gcggcgcgugccagcaggu

SEQ ID NO: 2434482 - RNA, 21 nt, Bordetella pertussis
gcggcgcguucagcagcaggc

SEQ ID NO: 2434483 - RNA, 22 nt, Bordetella pertussis
gcggcgcguucagcagcaggcc

SEQ ID NO: 2434484 - RNA, 16 nt, Bordetella pertussis
gcggcgucgccgcgca

SEQ ID NO: 2434485 - RNA, 18 nt, Bordetella pertussis
gcggcgucgcgcuguucg

SEQ ID NO: 2434486 - RNA, 13 nt, Bordetella pertussis
gcggcgucgcguc

SEQ ID NO: 2434487 - RNA, 14 nt, Bordetella pertussis
gcggcgucgcuggc

SEQ ID NO: 2434488 - RNA, 15 nt, Bordetella pertussis
gcggcgucgcuggca

SEQ ID NO: 2434489 - RNA, 16 nt, Bordetella pertussis
gcggcgucgcuggcag

SEQ ID NO: 2434490 - RNA, 18 nt, Bordetella pertussis
gcggcgucgcuggcagcc

SEQ ID NO: 2434491 - RNA, 14 nt, Bordetella pertussis
gcggcgucggcgcc

SEQ ID NO: 2434492 - RNA, 16 nt, Bordetella pertussis
gcggcgucggcgcccg

SEQ ID NO: 2434493 - RNA, 17 nt, Bordetella pertussis
gcggcgucggcgcccgg

SEQ ID NO: 2434494 - RNA, 19 nt, Bordetella pertussis
gcggcgucggcgcccggcg

SEQ ID NO: 2434495 - RNA, 14 nt, Bordetella pertussis
gcggcgucugguac

SEQ ID NO: 2434496 - RNA, 21 nt, Bordetella pertussis
gcggcgugaacgcgcauucgu

SEQ ID NO: 2434497 - RNA, 20 nt, Bordetella pertussis
gcggcgugaugcccaggccc

SEQ ID NO: 2434498 - RNA, 21 nt, Bordetella pertussis
gcggcgugaugcccaggcccu

SEQ ID NO: 2434499 - RNA, 15 nt, Bordetella pertussis
gcggcgugcccugcg

SEQ ID NO: 2434500 - RNA, 19 nt, Bordetella pertussis
gcggcgugcccugcggcgc

SEQ ID NO: 2434501 - RNA, 22 nt, Bordetella pertussis
gcggcgugcccugcggcgcggc

SEQ ID NO: 2434502 - RNA, 23 nt, Bordetella pertussis
gcggcgugcccugcggcgcggcc

SEQ ID NO: 2434503 - RNA, 14 nt, Bordetella pertussis
gcggcgugcggccc

SEQ ID NO: 2434504 - RNA, 17 nt, Bordetella pertussis
gcggcgugcggcccagc

SEQ ID NO: 2434505 - RNA, 18 nt, Bordetella pertussis
gcggcgugcggcccagcc

SEQ ID NO: 2434506 - RNA, 17 nt, Bordetella pertussis
gcggcguggacuucgug

SEQ ID NO: 2434507 - RNA, 15 nt, Bordetella pertussis
gcggcguggccgugc

SEQ ID NO: 2434508 - RNA, 20 nt, Bordetella pertussis
gcggcguggccgugcugguc

SEQ ID NO: 2434509 - RNA, 15 nt, Bordetella pertussis
gcggcguggcgccga

SEQ ID NO: 2434510 - RNA, 15 nt, Bordetella pertussis
gcggcguggcggcca

SEQ ID NO: 2434511 - RNA, 16 nt, Bordetella pertussis
gcggcguggcggcggg

SEQ ID NO: 2434512 - RNA, 19 nt, Bordetella pertussis
gcggcguggcggggcguuc

SEQ ID NO: 2434513 - RNA, 16 nt, Bordetella pertussis
gcggcguggggccggc

SEQ ID NO: 2434514 - RNA, 17 nt, Bordetella pertussis
gcggcguggggccggcc

SEQ ID NO: 2434515 - RNA, 18 nt, Bordetella pertussis
gcggcguggggccggccg

SEQ ID NO: 2434516 - RNA, 19 nt, Bordetella pertussis
gcggcguggggccggccgc

SEQ ID NO: 2434517 - RNA, 16 nt, Bordetella pertussis
gcggcguguagagcug

SEQ ID NO: 2434518 - RNA, 16 nt, Bordetella pertussis
gcggcgugugcccagc

SEQ ID NO: 2434519 - RNA, 18 nt, Bordetella pertussis
gcggcgugugcccagcac

SEQ ID NO: 2434520 - RNA, 20 nt, Bordetella pertussis
gcggcgugugcccagcacca

SEQ ID NO: 2434521 - RNA, 15 nt, Bordetella pertussis
gcggcguuccugggc

SEQ ID NO: 2434522 - RNA, 16 nt, Bordetella pertussis
gcggcguuccugggca

SEQ ID NO: 2434523 - RNA, 17 nt, Bordetella pertussis
gcggcguuccugggcac

SEQ ID NO: 2434524 - RNA, 19 nt, Bordetella pertussis
gcggcguucugcagcgcgg

SEQ ID NO: 2434525 - RNA, 20 nt, Bordetella pertussis
gcggcguucugcagcgcggu

SEQ ID NO: 2434526 - RNA, 18 nt, Bordetella pertussis
gcggcguugaccuggucg

SEQ ID NO: 2434527 - RNA, 22 nt, Bordetella pertussis
gcggcguugaccuggucgggcg

SEQ ID NO: 2434528 - RNA, 17 nt, Bordetella pertussis
gcggcguugcggcgcca

SEQ ID NO: 2434529 - RNA, 16 nt, Bordetella pertussis
gcggcuaggcgcagca

SEQ ID NO: 2434530 - RNA, 21 nt, Bordetella pertussis
gcggcuaggcgcagcaggcca

SEQ ID NO: 2434531 - RNA, 22 nt, Bordetella pertussis
gcggcuaggcgcagcaggccag

SEQ ID NO: 2434532 - RNA, 17 nt, Bordetella pertussis
gcggcuauugccagggg

SEQ ID NO: 2434533 - RNA, 20 nt, Bordetella pertussis
gcggcuauugccaggggucg

SEQ ID NO: 2434534 - RNA, 22 nt, Bordetella pertussis
gcggcucagagcuugccguacg

SEQ ID NO: 2434535 - RNA, 17 nt, Bordetella pertussis
gcggcucaggcgcggau

SEQ ID NO: 2434536 - RNA, 20 nt, Bordetella pertussis
gcggcuccccuggucagggc

SEQ ID NO: 2434537 - RNA, 19 nt, Bordetella pertussis
gcggcucgacgccguacug

SEQ ID NO: 2434538 - RNA, 21 nt, Bordetella pertussis
gcggcucgagcggcagcagcg

SEQ ID NO: 2434539 - RNA, 13 nt, Bordetella pertussis
gcggcucgaggaa

SEQ ID NO: 2434540 - RNA, 21 nt, Bordetella pertussis
gcggcucgaggaaccagccgu

SEQ ID NO: 2434541 - RNA, 15 nt, Bordetella pertussis
gcggcucgccgcgca

SEQ ID NO: 2434542 - RNA, 16 nt, Bordetella pertussis
gcggcucgccgcgcac

SEQ ID NO: 2434543 - RNA, 13 nt, Bordetella pertussis
gcggcucgccggc

SEQ ID NO: 2434544 - RNA, 15 nt, Bordetella pertussis
gcggcucgccggccg

SEQ ID NO: 2434545 - RNA, 18 nt, Bordetella pertussis
gcggcucgccggccgcgc

SEQ ID NO: 2434546 - RNA, 16 nt, Bordetella pertussis
gcggcugaucaccgcc

SEQ ID NO: 2434547 - RNA, 18 nt, Bordetella pertussis
gcggcugaucaccgccgg

SEQ ID NO: 2434548 - RNA, 15 nt, Bordetella pertussis
gcggcugcccaccuu

SEQ ID NO: 2434549 - RNA, 14 nt, Bordetella pertussis
gcggcugcccgggc

SEQ ID NO: 2434550 - RNA, 15 nt, Bordetella pertussis
gcggcugccgauacg

SEQ ID NO: 2434551 - RNA, 14 nt, Bordetella pertussis
gcggcugcgggccg

SEQ ID NO: 2434552 - RNA, 18 nt, Bordetella pertussis
gcggcugcgggccggcgc

SEQ ID NO: 2434553 - RNA, 20 nt, Bordetella pertussis
gcggcugcgggccggcgccg

SEQ ID NO: 2434554 - RNA, 13 nt, Bordetella pertussis
gcggcugcgggcg

SEQ ID NO: 2434555 - RNA, 16 nt, Bordetella pertussis
gcggcugcgggcgcaa

SEQ ID NO: 2434556 - RNA, 20 nt, Bordetella pertussis
gcggcugcgggcgcaagcca

SEQ ID NO: 2434557 - RNA, 15 nt, Bordetella pertussis
gcggcuggccacugg

SEQ ID NO: 2434558 - RNA, 19 nt, Bordetella pertussis
gcggcuggccacuggccgc

SEQ ID NO: 2434559 - RNA, 13 nt, Bordetella pertussis
gcggcuggccgau

SEQ ID NO: 2434560 - RNA, 16 nt, Bordetella pertussis
gcggcuggcgaucacc

SEQ ID NO: 2434561 - RNA, 23 nt, Bordetella pertussis
gcggcuggcgaucaccgacagcg

SEQ ID NO: 2434562 - RNA, 12 nt, Bordetella pertussis
gcggcuggcgca

SEQ ID NO: 2434563 - RNA, 14 nt, Bordetella pertussis
gcggcuggcgcacg

SEQ ID NO: 2434564 - RNA, 16 nt, Bordetella pertussis
gcggcuggcgccguuc

SEQ ID NO: 2434565 - RNA, 16 nt, Bordetella pertussis
gcggcuggcgcggccg

SEQ ID NO: 2434566 - RNA, 12 nt, Bordetella pertussis
gcggcuggcugu

SEQ ID NO: 2434567 - RNA, 16 nt, Bordetella pertussis
gcggcuggggcugcug

SEQ ID NO: 2434568 - RNA, 23 nt, Bordetella pertussis
gcggcuggggcugcugggccggc

SEQ ID NO: 2434569 - RNA, 13 nt, Bordetella pertussis
gcggcugggugcg

SEQ ID NO: 2434570 - RNA, 22 nt, Bordetella pertussis
gcggcugggugcggucagucgg

SEQ ID NO: 2434571 - RNA, 12 nt, Bordetella pertussis
gcggcuggucaa

SEQ ID NO: 2434572 - RNA, 15 nt, Bordetella pertussis
gcggcuggucaacuc

SEQ ID NO: 2434573 - RNA, 17 nt, Bordetella pertussis
gcggcuggucgccguca

SEQ ID NO: 2434574 - RNA, 17 nt, Bordetella pertussis
gcggcuggugccgacgg

SEQ ID NO: 2434575 - RNA, 18 nt, Bordetella pertussis
gcggcuggugccgacggc

SEQ ID NO: 2434576 - RNA, 21 nt, Bordetella pertussis
gcggcuggugccgacggcgcg

SEQ ID NO: 2434577 - RNA, 22 nt, Bordetella pertussis
gcggcuggugccgacggcgcgg

SEQ ID NO: 2434578 - RNA, 18 nt, Bordetella pertussis
gcggcugguggugccgcg

SEQ ID NO: 2434579 - RNA, 22 nt, Bordetella pertussis
gcggcugguggugccgcgcacg

SEQ ID NO: 2434580 - RNA, 16 nt, Bordetella pertussis
gcggcuguagucgccg

SEQ ID NO: 2434581 - RNA, 22 nt, Bordetella pertussis
gcggcuguagucgccgcugccg

SEQ ID NO: 2434582 - RNA, 23 nt, Bordetella pertussis
gcggcuguagucgccgcugccgg

SEQ ID NO: 2434583 - RNA, 15 nt, Bordetella pertussis
gcggcuguccaccug

SEQ ID NO: 2434584 - RNA, 19 nt, Bordetella pertussis
gcggcuguccaccugcacc

SEQ ID NO: 2434585 - RNA, 14 nt, Bordetella pertussis
gcggcuguccuggc

SEQ ID NO: 2434586 - RNA, 13 nt, Bordetella pertussis
gcggcugucgggc

SEQ ID NO: 2434587 - RNA, 16 nt, Bordetella pertussis
gcggcugucgggcggc

SEQ ID NO: 2434588 - RNA, 18 nt, Bordetella pertussis
gcggcugucgggcggcgc

SEQ ID NO: 2434589 - RNA, 19 nt, Bordetella pertussis
gcggcugugggccucgcug

SEQ ID NO: 2434590 - RNA, 21 nt, Bordetella pertussis
gcggcugugggccucgcugga

SEQ ID NO: 2434591 - RNA, 18 nt, Bordetella pertussis
gcggcuguugggcaaggu

SEQ ID NO: 2434592 - RNA, 13 nt, Bordetella pertussis
gcggcuucaggcg

SEQ ID NO: 2434593 - RNA, 16 nt, Bordetella pertussis
gcggcuucaggcgcgc

SEQ ID NO: 2434594 - RNA, 15 nt, Bordetella pertussis
gcggcuucaugccgg

SEQ ID NO: 2434595 - RNA, 23 nt, Bordetella pertussis
gcggcuuccuggucacccggcgc

SEQ ID NO: 2434596 - RNA, 14 nt, Bordetella pertussis
gcggcuucgcgcag

SEQ ID NO: 2434597 - RNA, 20 nt, Bordetella pertussis
gcgggccuacuugccggcgc

SEQ ID NO: 2434598 - RNA, 22 nt, Bordetella pertussis
gcgggccuacuugccggcgcuc

SEQ ID NO: 2434599 - RNA, 21 nt, Bordetella pertussis
gcgggccucgaagcccggcag

SEQ ID NO: 2434600 - RNA, 16 nt, Bordetella pertussis
gcgggccugcaguucg

SEQ ID NO: 2434601 - RNA, 23 nt, Bordetella pertussis
gcgggccugcaguucggccgcca

SEQ ID NO: 2434602 - RNA, 12 nt, Bordetella pertussis
gcgggccugccg

SEQ ID NO: 2434603 - RNA, 14 nt, Bordetella pertussis
gcgggccugccgcg

SEQ ID NO: 2434604 - RNA, 16 nt, Bordetella pertussis
gcgggccugccgcgcg

SEQ ID NO: 2434605 - RNA, 13 nt, Bordetella pertussis
gcgggccuggcgg

SEQ ID NO: 2434606 - RNA, 15 nt, Bordetella pertussis
gcgggccuggcggau

SEQ ID NO: 2434607 - RNA, 21 nt, Bordetella pertussis
gcgggccuggcggaucucggc

SEQ ID NO: 2434608 - RNA, 23 nt, Bordetella pertussis
gcgggccuggcggaucucggcca

SEQ ID NO: 2434609 - RNA, 16 nt, Bordetella pertussis
gcgggccuuggccagc

SEQ ID NO: 2434610 - RNA, 18 nt, Bordetella pertussis
gcgggccuuggccagcag

SEQ ID NO: 2434611 - RNA, 20 nt, Bordetella pertussis
gcgggccuuggccagcagcg

SEQ ID NO: 2434612 - RNA, 21 nt, Bordetella pertussis
gcgggccuuggccagcagcgc

SEQ ID NO: 2434613 - RNA, 22 nt, Bordetella pertussis
gcgggccuuggccagcagcgca

SEQ ID NO: 2434614 - RNA, 19 nt, Bordetella pertussis
gcgggcgagaucagccacc

SEQ ID NO: 2434615 - RNA, 20 nt, Bordetella pertussis
gcgggcgagaucagccaccg

SEQ ID NO: 2434616 - RNA, 13 nt, Bordetella pertussis
gcgggcgaggacu

SEQ ID NO: 2434617 - RNA, 15 nt, Bordetella pertussis
gcgggcgauggccac

SEQ ID NO: 2434618 - RNA, 19 nt, Bordetella pertussis
gcgggcgauguagggcagc

SEQ ID NO: 2434619 - RNA, 20 nt, Bordetella pertussis
gcgggcgauuugccgcagcc

SEQ ID NO: 2434620 - RNA, 23 nt, Bordetella pertussis
gcgggcgauuugccgcagcccgc

SEQ ID NO: 2434621 - RNA, 19 nt, Bordetella pertussis
gcgggcgcaagccagcacg

SEQ ID NO: 2434622 - RNA, 24 nt, Bordetella pertussis
gcgggcgcaaguguggcgcaccgc

SEQ ID NO: 2434623 - RNA, 23 nt, Bordetella pertussis
gcgggcgcaccugguccauggcg

SEQ ID NO: 2434624 - RNA, 12 nt, Bordetella pertussis
gcgggcgcagcg

SEQ ID NO: 2434625 - RNA, 13 nt, Bordetella pertussis
gcgggcgcagcgc

SEQ ID NO: 2434626 - RNA, 15 nt, Bordetella pertussis
gcgggcgcagcgccg

SEQ ID NO: 2434627 - RNA, 16 nt, Bordetella pertussis
gcgggcgcagcgccgc

SEQ ID NO: 2434628 - RNA, 14 nt, Bordetella pertussis
gcgggcgccaucgc

SEQ ID NO: 2434629 - RNA, 12 nt, Bordetella pertussis
gcgggcgcccgc

SEQ ID NO: 2434630 - RNA, 14 nt, Bordetella pertussis
gcgggcgcccggcc

SEQ ID NO: 2434631 - RNA, 13 nt, Bordetella pertussis
gcgggcgccgcgc

SEQ ID NO: 2434632 - RNA, 14 nt, Bordetella pertussis
gcgggcgccgcgca

SEQ ID NO: 2434633 - RNA, 15 nt, Bordetella pertussis
gcgggcgccgcgcac

SEQ ID NO: 2434634 - RNA, 14 nt, Bordetella pertussis
gcgggcgccgcgcc

SEQ ID NO: 2434635 - RNA, 16 nt, Bordetella pertussis
gcgggcgccgcgcccg

SEQ ID NO: 2434636 - RNA, 17 nt, Bordetella pertussis
gcgggcgccgcgcccgg

SEQ ID NO: 2434637 - RNA, 19 nt, Bordetella pertussis
gcgggcgccgcgcccggcc

SEQ ID NO: 2434638 - RNA, 20 nt, Bordetella pertussis
gcgggcgccggcgcccggca

SEQ ID NO: 2434639 - RNA, 23 nt, Bordetella pertussis
gcgggcgccggcgucacgcggcc

SEQ ID NO: 2434640 - RNA, 14 nt, Bordetella pertussis
gcgggcgcgcagcg

SEQ ID NO: 2434641 - RNA, 15 nt, Bordetella pertussis
gcgggcgcgcaggcc

SEQ ID NO: 2434642 - RNA, 17 nt, Bordetella pertussis
gcgggcgcgcaggccuc

SEQ ID NO: 2434643 - RNA, 15 nt, Bordetella pertussis
gcgggcgcgcccggc

SEQ ID NO: 2434644 - RNA, 17 nt, Bordetella pertussis
gcgggcgcgcccggcgc

SEQ ID NO: 2434645 - RNA, 19 nt, Bordetella pertussis
gcgggcgcgcccggcgcgc

SEQ ID NO: 2434646 - RNA, 21 nt, Bordetella pertussis
gcgggcgcgcccggcgcgccu

SEQ ID NO: 2434647 - RNA, 12 nt, Bordetella pertussis
gcgggcgcgccg

SEQ ID NO: 2434648 - RNA, 14 nt, Bordetella pertussis
gcgggcgcgccguc

SEQ ID NO: 2434649 - RNA, 15 nt, Bordetella pertussis
gcgggcgcgccgucg

SEQ ID NO: 2434650 - RNA, 20 nt, Bordetella pertussis
gcgggcgcgccgucgcuggg

SEQ ID NO: 2434651 - RNA, 12 nt, Bordetella pertussis
gcgggcgcgcgc

SEQ ID NO: 2434652 - RNA, 13 nt, Bordetella pertussis
gcgggcgcgcgcc

SEQ ID NO: 2434653 - RNA, 14 nt, Bordetella pertussis
gcgggcgcgcgccc

SEQ ID NO: 2434654 - RNA, 16 nt, Bordetella pertussis
gcgggcgcgcgccccg

SEQ ID NO: 2434655 - RNA, 20 nt, Bordetella pertussis
gcgggcgcgguauucgcugc

SEQ ID NO: 2434656 - RNA, 17 nt, Bordetella pertussis
gcgggcgcugacgccga

SEQ ID NO: 2434657 - RNA, 21 nt, Bordetella pertussis
gcgggcgcugccugccggccg

SEQ ID NO: 2434658 - RNA, 13 nt, Bordetella pertussis
gcgggcgcugcgc

SEQ ID NO: 2434659 - RNA, 20 nt, Bordetella pertussis
gcgggcgcugcgcgaacgcg

SEQ ID NO: 2434660 - RNA, 12 nt, Bordetella pertussis
gcgggcgcuggc

SEQ ID NO: 2434661 - RNA, 16 nt, Bordetella pertussis
gcgggcgcuggcgcgc

SEQ ID NO: 2434662 - RNA, 14 nt, Bordetella pertussis
gcgggcggccacgc

SEQ ID NO: 2434663 - RNA, 14 nt, Bordetella pertussis
gcgggcggccgacg

SEQ ID NO: 2434664 - RNA, 15 nt, Bordetella pertussis
gcgggcggccggcgc

SEQ ID NO: 2434665 - RNA, 18 nt, Bordetella pertussis
gcgggcggccggcgcguc

SEQ ID NO: 2434666 - RNA, 23 nt, Bordetella pertussis
gcgggcggccuaucaccugggca

SEQ ID NO: 2434667 - RNA, 11 nt, Bordetella pertussis
gcgggcggcgc

SEQ ID NO: 2434668 - RNA, 13 nt, Bordetella pertussis
gcgggcggcgcca

SEQ ID NO: 2434669 - RNA, 15 nt, Bordetella pertussis
gcgggcggcgccggc

SEQ ID NO: 2434670 - RNA, 16 nt, Bordetella pertussis
gcgggcggcgccggcc

SEQ ID NO: 2434671 - RNA, 19 nt, Bordetella pertussis
gcgggcggcgccggccgcc

SEQ ID NO: 2434672 - RNA, 20 nt, Bordetella pertussis
gcgggcggcgcgcccagcgg

SEQ ID NO: 2434673 - RNA, 13 nt, Bordetella pertussis
gcgggcggcgcgg

SEQ ID NO: 2434674 - RNA, 15 nt, Bordetella pertussis
gcgggcggcgcggcc

SEQ ID NO: 2434675 - RNA, 16 nt, Bordetella pertussis
gcgggcggcggcgcgu

SEQ ID NO: 2434676 - RNA, 15 nt, Bordetella pertussis
gcgggcgggccgcgg

SEQ ID NO: 2434677 - RNA, 14 nt, Bordetella pertussis
gcgggcgggcgcaa

SEQ ID NO: 2434678 - RNA, 13 nt, Bordetella pertussis
gcgggcggucggc

SEQ ID NO: 2434679 - RNA, 16 nt, Bordetella pertussis
gcgggcggucggcgcg

SEQ ID NO: 2434680 - RNA, 17 nt, Bordetella pertussis
gcgggcguacccgucga

SEQ ID NO: 2434681 - RNA, 23 nt, Bordetella pertussis
gcgggcguagaaagccagugccu

SEQ ID NO: 2434682 - RNA, 22 nt, Bordetella pertussis
gcgggcgugaugccgaccaggc

SEQ ID NO: 2434683 - RNA, 21 nt, Bordetella pertussis
gcgggcucagcccgccuggcg

SEQ ID NO: 2434684 - RNA, 22 nt, Bordetella pertussis
gcgggcucagcccgccuggcgc

SEQ ID NO: 2434685 - RNA, 21 nt, Bordetella pertussis
gcgggcucgagcuggcuggcc

SEQ ID NO: 2434686 - RNA, 21 nt, Bordetella pertussis
gcgggcugaugcaggccugca

SEQ ID NO: 2434687 - RNA, 14 nt, Bordetella pertussis
gcgggcugcgcggg

SEQ ID NO: 2434688 - RNA, 14 nt, Bordetella pertussis
gcgggcuggggcag

SEQ ID NO: 2434689 - RNA, 15 nt, Bordetella pertussis
gcgggcuggucgcgc

SEQ ID NO: 2434690 - RNA, 13 nt, Bordetella pertussis
gcgggcugguggu

SEQ ID NO: 2434691 - RNA, 22 nt, Bordetella pertussis
gcgggcugucgcagucggggcc

SEQ ID NO: 2434692 - RNA, 19 nt, Bordetella pertussis
gcgggcuugcugccccccg

SEQ ID NO: 2434693 - RNA, 20 nt, Bordetella pertussis
gcgggcuugcugccccccga

SEQ ID NO: 2434694 - RNA, 18 nt, Bordetella pertussis
gcgggcuugucgcugcgc

SEQ ID NO: 2434695 - RNA, 21 nt, Bordetella pertussis
gcgggcuuguuuuccaucagc

SEQ ID NO: 2434696 - RNA, 17 nt, Bordetella pertussis
gcggggaauucgaccgg

SEQ ID NO: 2434697 - RNA, 16 nt, Bordetella pertussis
gcggggacaggcacac

SEQ ID NO: 2434698 - RNA, 23 nt, Bordetella pertussis
gcggggacaggcacacucugucg

SEQ ID NO: 2434699 - RNA, 20 nt, Bordetella pertussis
gcggggacaggcacccccga

SEQ ID NO: 2434700 - RNA, 17 nt, Bordetella pertussis
gcggggacaggcacccg

SEQ ID NO: 2434701 - RNA, 16 nt, Bordetella pertussis
gcggggacaggcaccg

SEQ ID NO: 2434702 - RNA, 17 nt, Bordetella pertussis
gcggggacaggcaccuu

SEQ ID NO: 2434703 - RNA, 15 nt, Bordetella pertussis
gcggggacaggcgcc

SEQ ID NO: 2434704 - RNA, 17 nt, Bordetella pertussis
gcggggacaggcgccuc

SEQ ID NO: 2434705 - RNA, 19 nt, Bordetella pertussis
gcggggacaggcgccucgc

SEQ ID NO: 2434706 - RNA, 14 nt, Bordetella pertussis
gcggggacaggcuc

SEQ ID NO: 2434707 - RNA, 18 nt, Bordetella pertussis
gcggggaccggcacccgc

SEQ ID NO: 2434708 - RNA, 17 nt, Bordetella pertussis
gcggggacuggcaccag

SEQ ID NO: 2434709 - RNA, 18 nt, Bordetella pertussis
gcggggacuggcaccagg

SEQ ID NO: 2434710 - RNA, 23 nt, Bordetella pertussis
gcggucagcuggaacgcgccgcu

SEQ ID NO: 2434711 - RNA, 17 nt, Bordetella pertussis
gcggucagcugugguag

SEQ ID NO: 2434712 - RNA, 17 nt, Bordetella pertussis
gcggucagucgggacgg

SEQ ID NO: 2434713 - RNA, 15 nt, Bordetella pertussis
gcggucaucggcgac

SEQ ID NO: 2434714 - RNA, 18 nt, Bordetella pertussis
gcggucaugccgaacagc

SEQ ID NO: 2434715 - RNA, 17 nt, Bordetella pertussis
gcgguccacagcccggc

SEQ ID NO: 2434716 - RNA, 22 nt, Bordetella pertussis
gcgguccacagcccggccccca

SEQ ID NO: 2434717 - RNA, 22 nt, Bordetella pertussis
gcgguccaccucgucguccagc

SEQ ID NO: 2434718 - RNA, 23 nt, Bordetella pertussis
gcgguccaccucgucguccagcg

SEQ ID NO: 2434719 - RNA, 12 nt, Bordetella pertussis
gcgguccacgcc

SEQ ID NO: 2434720 - RNA, 19 nt, Bordetella pertussis
gcgguccacgcccuggcug

SEQ ID NO: 2434721 - RNA, 22 nt, Bordetella pertussis
gcgguccacgccggguugcggc

SEQ ID NO: 2434722 - RNA, 17 nt, Bordetella pertussis
gcgguccagcaaggcgu

SEQ ID NO: 2434723 - RNA, 21 nt, Bordetella pertussis
gcgguccagcaccagggcgcg

SEQ ID NO: 2434724 - RNA, 12 nt, Bordetella pertussis
gcgguccagccc

SEQ ID NO: 2434725 - RNA, 14 nt, Bordetella pertussis
gcgguccagccccu

SEQ ID NO: 2434726 - RNA, 14 nt, Bordetella pertussis
gcgguccaugguga

SEQ ID NO: 2434727 - RNA, 21 nt, Bordetella pertussis
gcgguccccagauccgcaagu

SEQ ID NO: 2434728 - RNA, 14 nt, Bordetella pertussis
gcggucccgagcgc

SEQ ID NO: 2434729 - RNA, 16 nt, Bordetella pertussis
gcgguccgcagcgcuc

SEQ ID NO: 2434730 - RNA, 17 nt, Bordetella pertussis
gcgguccggggcgggcg

SEQ ID NO: 2434731 - RNA, 18 nt, Bordetella pertussis
gcgguccgguucgcccac

SEQ ID NO: 2434732 - RNA, 20 nt, Bordetella pertussis
gcgguccgguucgcccacca

SEQ ID NO: 2434733 - RNA, 18 nt, Bordetella pertussis
gcgguccugaccggcggc

SEQ ID NO: 2434734 - RNA, 18 nt, Bordetella pertussis
gcggucgagacgauggcc

SEQ ID NO: 2434735 - RNA, 15 nt, Bordetella pertussis
gcggucgaggcgcag

SEQ ID NO: 2434736 - RNA, 23 nt, Bordetella pertussis
gcggucgaggcgcaguccagcgu

SEQ ID NO: 2434737 - RNA, 14 nt, Bordetella pertussis
gcggucgaugcgca

SEQ ID NO: 2434738 - RNA, 16 nt, Bordetella pertussis
gcggucgaugcgcacg

SEQ ID NO: 2434739 - RNA, 17 nt, Bordetella pertussis
gcggucgaugcgcacgc

SEQ ID NO: 2434740 - RNA, 19 nt, Bordetella pertussis
gcggucgauguccagcgcc

SEQ ID NO: 2434741 - RNA, 21 nt, Bordetella pertussis
gcggucgauguccagcgccag

SEQ ID NO: 2434742 - RNA, 22 nt, Bordetella pertussis
gcggucgauguccagcgccagc

SEQ ID NO: 2434743 - RNA, 23 nt, Bordetella pertussis
gcggucgauguccagcgccagca

SEQ ID NO: 2434744 - RNA, 20 nt, Bordetella pertussis
gcggucgcauuggccgccgc

SEQ ID NO: 2434745 - RNA, 19 nt, Bordetella pertussis
gcggucgccaucggccggc

SEQ ID NO: 2434746 - RNA, 20 nt, Bordetella pertussis
gcggucgccaucggccggcc

SEQ ID NO: 2434747 - RNA, 18 nt, Bordetella pertussis
gcggucgcccaacccggc

SEQ ID NO: 2434748 - RNA, 15 nt, Bordetella pertussis
gcggucgcgcuggcc

SEQ ID NO: 2434749 - RNA, 22 nt, Bordetella pertussis
gcggucgcgcuggcccgcgcga

SEQ ID NO: 2434750 - RNA, 14 nt, Bordetella pertussis
gcggucggccgcgc

SEQ ID NO: 2434751 - RNA, 18 nt, Bordetella pertussis
gcggucggccgcgccgcc

SEQ ID NO: 2434752 - RNA, 23 nt, Bordetella pertussis
gcggucggccgcgccgccgcccu

SEQ ID NO: 2434753 - RNA, 15 nt, Bordetella pertussis
gcggucggcgcggcg

SEQ ID NO: 2434754 - RNA, 22 nt, Bordetella pertussis
gcggucggcgcggcgccgucca

SEQ ID NO: 2434755 - RNA, 17 nt, Bordetella pertussis
gcggucgggaucauccu

SEQ ID NO: 2434756 - RNA, 12 nt, Bordetella pertussis
gcggucggugca

SEQ ID NO: 2434757 - RNA, 16 nt, Bordetella pertussis
gcggucguagcguucg

SEQ ID NO: 2434758 - RNA, 12 nt, Bordetella pertussis
gcggucguccuc

SEQ ID NO: 2434759 - RNA, 21 nt, Bordetella pertussis
gcggucuccgguucggcgcgg

SEQ ID NO: 2434760 - RNA, 20 nt, Bordetella pertussis
gcggucugggcgucccaggc

SEQ ID NO: 2434761 - RNA, 22 nt, Bordetella pertussis
gcggucuguuuuuuugggggcc

SEQ ID NO: 2434762 - RNA, 20 nt, Bordetella pertussis
gcggucuucacauagcccgg

SEQ ID NO: 2434763 - RNA, 21 nt, Bordetella pertussis
gcggucuucgaugcuggcgcg

SEQ ID NO: 2434764 - RNA, 18 nt, Bordetella pertussis
gcggucuugaccgaggug

SEQ ID NO: 2434765 - RNA, 18 nt, Bordetella pertussis
gcggucuuucaccgacag

SEQ ID NO: 2434766 - RNA, 16 nt, Bordetella pertussis
gcggugaaggcgcccg

SEQ ID NO: 2434767 - RNA, 15 nt, Bordetella pertussis
gcggugaccaccagg

SEQ ID NO: 2434768 - RNA, 18 nt, Bordetella pertussis
gcggugaccaugcgcacc

SEQ ID NO: 2434769 - RNA, 23 nt, Bordetella pertussis
gcggugaccaugcgcaccgacug

SEQ ID NO: 2434770 - RNA, 14 nt, Bordetella pertussis
gcggugaggcggcc

SEQ ID NO: 2434771 - RNA, 16 nt, Bordetella pertussis
gcggugaggcggccgg

SEQ ID NO: 2434772 - RNA, 16 nt, Bordetella pertussis
gcggugaucugcucgc

SEQ ID NO: 2434773 - RNA, 24 nt, Bordetella pertussis
gcggugaucugcucgccgcgcgac

SEQ ID NO: 2434774 - RNA, 18 nt, Bordetella pertussis
gcggugaugacgucgucg

SEQ ID NO: 2434775 - RNA, 16 nt, Bordetella pertussis
gcggugcaagcggccg

SEQ ID NO: 2434776 - RNA, 17 nt, Bordetella pertussis
gcggugcaagcggccgg

SEQ ID NO: 2434777 - RNA, 19 nt, Bordetella pertussis
gcggugcaagcggccggcc

SEQ ID NO: 2434778 - RNA, 16 nt, Bordetella pertussis
gcggugcaucucggca

SEQ ID NO: 2434779 - RNA, 14 nt, Bordetella pertussis
gcggugccccggcc

SEQ ID NO: 2434780 - RNA, 15 nt, Bordetella pertussis
gcggugcccuugcuc

SEQ ID NO: 2434781 - RNA, 16 nt, Bordetella pertussis
gcggugccgcccaccg

SEQ ID NO: 2434782 - RNA, 16 nt, Bordetella pertussis
gcggugccgccuggcc

SEQ ID NO: 2434783 - RNA, 13 nt, Bordetella pertussis
gcggugccgcgca

SEQ ID NO: 2434784 - RNA, 14 nt, Bordetella pertussis
gcggugccgcgcac

SEQ ID NO: 2434785 - RNA, 22 nt, Bordetella pertussis
gcggugccgcgcacccaggccc

SEQ ID NO: 2434786 - RNA, 18 nt, Bordetella pertussis
gcggugccgcgcgcggcc

SEQ ID NO: 2434787 - RNA, 14 nt, Bordetella pertussis
gcggugccuguccc

SEQ ID NO: 2434788 - RNA, 13 nt, Bordetella pertussis
gcggugccugugc

SEQ ID NO: 2434789 - RNA, 14 nt, Bordetella pertussis
gcggugcgacugca

SEQ ID NO: 2434790 - RNA, 20 nt, Bordetella pertussis
gcggugcgacugcaggauga

SEQ ID NO: 2434791 - RNA, 14 nt, Bordetella pertussis
gcggugcgcgcggc

SEQ ID NO: 2434792 - RNA, 14 nt, Bordetella pertussis
gcggugcgcggcgc

SEQ ID NO: 2434793 - RNA, 16 nt, Bordetella pertussis
gcggugcgcggcgcag

SEQ ID NO: 2434794 - RNA, 13 nt, Bordetella pertussis
gcggugcggccuc

SEQ ID NO: 2434795 - RNA, 15 nt, Bordetella pertussis
gcggugcggccucgg

SEQ ID NO: 2434796 - RNA, 16 nt, Bordetella pertussis
gcggugcggccucggc

SEQ ID NO: 2434797 - RNA, 17 nt, Bordetella pertussis
gcggugcggccucggcg

SEQ ID NO: 2434798 - RNA, 15 nt, Bordetella pertussis
gcggugcgggugggc

SEQ ID NO: 2434799 - RNA, 20 nt, Bordetella pertussis
gcggugcgggugggcgcgcc

SEQ ID NO: 2434800 - RNA, 23 nt, Bordetella pertussis
gcggugcgggugggcgcgccgcg

SEQ ID NO: 2434801 - RNA, 14 nt, Bordetella pertussis
gcggugcguccagg

SEQ ID NO: 2434802 - RNA, 22 nt, Bordetella pertussis
gcggugcguccaggacgcgaag

SEQ ID NO: 2434803 - RNA, 21 nt, Bordetella pertussis
gcggugcgugcgcccauggcg

SEQ ID NO: 2434804 - RNA, 14 nt, Bordetella pertussis
gcggugcugaacgc

SEQ ID NO: 2434805 - RNA, 17 nt, Bordetella pertussis
gcgguggccagcgccug

SEQ ID NO: 2434806 - RNA, 22 nt, Bordetella pertussis
gcgguggccaugcugggcgggc

SEQ ID NO: 2434807 - RNA, 17 nt, Bordetella pertussis
gcgguggccgccgcgcg

SEQ ID NO: 2434808 - RNA, 13 nt, Bordetella pertussis
gcgguggccgcgc

SEQ ID NO: 2434809 - RNA, 18 nt, Bordetella pertussis
gcgguggccgcgcaugcc

SEQ ID NO: 2434810 - RNA, 23 nt, Bordetella pertussis
gcgguggccgcgcaugccagcuu

SEQ ID NO: 2434811 - RNA, 21 nt, Bordetella pertussis
gcgguggccgcuucggcggcc

SEQ ID NO: 2434812 - RNA, 18 nt, Bordetella pertussis
gcgguggccucguccacg

SEQ ID NO: 2434813 - RNA, 12 nt, Bordetella pertussis
gcgguggcggcc

SEQ ID NO: 2434814 - RNA, 18 nt, Bordetella pertussis
gcgguggcuuggcgcagg

SEQ ID NO: 2434815 - RNA, 19 nt, Bordetella pertussis
gcgguggcuuggcgcagga

SEQ ID NO: 2434816 - RNA, 15 nt, Bordetella pertussis
gcggugggcagcgcg

SEQ ID NO: 2434817 - RNA, 15 nt, Bordetella pertussis
gcggugggcagggcg

SEQ ID NO: 2434818 - RNA, 16 nt, Bordetella pertussis
gcggugggcagggcgg

SEQ ID NO: 2434819 - RNA, 22 nt, Bordetella pertussis
gcgguggggcaguugaccauga

SEQ ID NO: 2434820 - RNA, 15 nt, Bordetella pertussis
gcgguggugcgccuc

SEQ ID NO: 2434821 - RNA, 14 nt, Bordetella pertussis
gcgguggugggcag

SEQ ID NO: 2434822 - RNA, 19 nt, Bordetella pertussis
gcgguguagaccaccagca

SEQ ID NO: 2434823 - RNA, 15 nt, Bordetella pertussis
gcgucaugcgcaccu

SEQ ID NO: 2434824 - RNA, 18 nt, Bordetella pertussis
gcgucauggccuggccca

SEQ ID NO: 2434825 - RNA, 14 nt, Bordetella pertussis
gcgucauguccgag

SEQ ID NO: 2434826 - RNA, 18 nt, Bordetella pertussis
gcgucaugugcugcggca

SEQ ID NO: 2434827 - RNA, 19 nt, Bordetella pertussis
gcguccaagcagacccgcg

SEQ ID NO: 2434828 - RNA, 21 nt, Bordetella pertussis
gcguccaagcagacccgcgcc

SEQ ID NO: 2434829 - RNA, 16 nt, Bordetella pertussis
gcguccaccaccaggc

SEQ ID NO: 2434830 - RNA, 19 nt, Bordetella pertussis
gcguccaccaccaggccgg

SEQ ID NO: 2434831 - RNA, 21 nt, Bordetella pertussis
gcguccaccaccaggccggcc

SEQ ID NO: 2434832 - RNA, 22 nt, Bordetella pertussis
gcguccaccaccaggccggcca

SEQ ID NO: 2434833 - RNA, 23 nt, Bordetella pertussis
gcguccaccaccaggccggccag

SEQ ID NO: 2434834 - RNA, 22 nt, Bordetella pertussis
gcguccaccgccgaugccgcca

SEQ ID NO: 2434835 - RNA, 22 nt, Bordetella pertussis
gcguccaccuugacgcgcaggc

SEQ ID NO: 2434836 - RNA, 12 nt, Bordetella pertussis
gcguccacggca

SEQ ID NO: 2434837 - RNA, 12 nt, Bordetella pertussis
gcguccagcagc

SEQ ID NO: 2434838 - RNA, 22 nt, Bordetella pertussis
gcguccagccccugcgggccgc

SEQ ID NO: 2434839 - RNA, 23 nt, Bordetella pertussis
gcguccagccccugcgggccgcu

SEQ ID NO: 2434840 - RNA, 15 nt, Bordetella pertussis
gcguccagccgcccg

SEQ ID NO: 2434841 - RNA, 21 nt, Bordetella pertussis
gcguccagccugcccgggcag

SEQ ID NO: 2434842 - RNA, 22 nt, Bordetella pertussis
gcguccagccugcccgggcagc

SEQ ID NO: 2434843 - RNA, 14 nt, Bordetella pertussis
gcguccagcgcgcg

SEQ ID NO: 2434844 - RNA, 16 nt, Bordetella pertussis
gcguccaggcccagcg

SEQ ID NO: 2434845 - RNA, 16 nt, Bordetella pertussis
gcguccaggcccuggc

SEQ ID NO: 2434846 - RNA, 21 nt, Bordetella pertussis
gcguccaggcccuggcggcgc

SEQ ID NO: 2434847 - RNA, 14 nt, Bordetella pertussis
gcguccaggcgcgc

SEQ ID NO: 2434848 - RNA, 20 nt, Bordetella pertussis
gcguccaggcgcgccagccg

SEQ ID NO: 2434849 - RNA, 21 nt, Bordetella pertussis
gcguccaggcgcgccagccgc

SEQ ID NO: 2434850 - RNA, 13 nt, Bordetella pertussis
gcguccaggcggc

SEQ ID NO: 2434851 - RNA, 15 nt, Bordetella pertussis
gcguccaggcggcca

SEQ ID NO: 2434852 - RNA, 16 nt, Bordetella pertussis
gcguccaggcggccau

SEQ ID NO: 2434853 - RNA, 12 nt, Bordetella pertussis
gcguccaggcug

SEQ ID NO: 2434854 - RNA, 18 nt, Bordetella pertussis
gcguccaggcugccggcg

SEQ ID NO: 2434855 - RNA, 19 nt, Bordetella pertussis
gcguccaggcugccggcgu

SEQ ID NO: 2434856 - RNA, 16 nt, Bordetella pertussis
gcguccaggugcggcg

SEQ ID NO: 2434857 - RNA, 18 nt, Bordetella pertussis
gcguccaggugcggcggc

SEQ ID NO: 2434858 - RNA, 19 nt, Bordetella pertussis
gcguccaggugcggcggcg

SEQ ID NO: 2434859 - RNA, 19 nt, Bordetella pertussis
gcguccaucuggaccgcgc

SEQ ID NO: 2434860 - RNA, 22 nt, Bordetella pertussis
gcguccaucuggaccgcgcgcg

SEQ ID NO: 2434861 - RNA, 23 nt, Bordetella pertussis
gcguccaucuggaccgcgcgcga

SEQ ID NO: 2434862 - RNA, 13 nt, Bordetella pertussis
gcguccaugcagg

SEQ ID NO: 2434863 - RNA, 18 nt, Bordetella pertussis
gcguccauuagggcccag

SEQ ID NO: 2434864 - RNA, 14 nt, Bordetella pertussis
gcgucccggaugcg

SEQ ID NO: 2434865 - RNA, 19 nt, Bordetella pertussis
gcgucccgguaggccuggu

SEQ ID NO: 2434866 - RNA, 16 nt, Bordetella pertussis
gcgucccgugccggcc

SEQ ID NO: 2434867 - RNA, 17 nt, Bordetella pertussis
gcgucccgugccggccg

SEQ ID NO: 2434868 - RNA, 20 nt, Bordetella pertussis
gcguccgaauacgccacguu

SEQ ID NO: 2434869 - RNA, 22 nt, Bordetella pertussis
gcguccgcccgcuccaccagca

SEQ ID NO: 2434870 - RNA, 13 nt, Bordetella pertussis
gcguccgccgugc

SEQ ID NO: 2434871 - RNA, 17 nt, Bordetella pertussis
gcguccgcgucgccgcc

SEQ ID NO: 2434872 - RNA, 19 nt, Bordetella pertussis
gcguccgcucaugccggca

SEQ ID NO: 2434873 - RNA, 23 nt, Bordetella pertussis
gcguccgcucaugccggcaagca

SEQ ID NO: 2434874 - RNA, 20 nt, Bordetella pertussis
gcguccggccccaggaugcg

SEQ ID NO: 2434875 - RNA, 13 nt, Bordetella pertussis
gcguccggcgccc

SEQ ID NO: 2434876 - RNA, 18 nt, Bordetella pertussis
gcguccggcgcccgccgc

SEQ ID NO: 2434877 - RNA, 14 nt, Bordetella pertussis
gcguccggcgcgcg

SEQ ID NO: 2434878 - RNA, 15 nt, Bordetella pertussis
gcguccggcgcgcgc

SEQ ID NO: 2434879 - RNA, 23 nt, Bordetella pertussis
gcguccggugcgauagcgccgcg

SEQ ID NO: 2434880 - RNA, 19 nt, Bordetella pertussis
gcguccgucggguugccgc

SEQ ID NO: 2434881 - RNA, 22 nt, Bordetella pertussis
gcguccgucggguugccgcugc

SEQ ID NO: 2434882 - RNA, 15 nt, Bordetella pertussis
gcguccucgcggucc

SEQ ID NO: 2434883 - RNA, 15 nt, Bordetella pertussis
gcguccucggccugg

SEQ ID NO: 2434884 - RNA, 13 nt, Bordetella pertussis
gcguccugcgcca

SEQ ID NO: 2434885 - RNA, 17 nt, Bordetella pertussis
gcguccugcgccaguug

SEQ ID NO: 2434886 - RNA, 15 nt, Bordetella pertussis
gcguccugcggcggc

SEQ ID NO: 2434887 - RNA, 13 nt, Bordetella pertussis
gcguccuggcgcg

SEQ ID NO: 2434888 - RNA, 16 nt, Bordetella pertussis
gcguccuuggcggccu

SEQ ID NO: 2434889 - RNA, 18 nt, Bordetella pertussis
gcgucgaaacgcugcgcg

SEQ ID NO: 2434890 - RNA, 20 nt, Bordetella pertussis
gcgucgaaacgcugcgcgau

SEQ ID NO: 2434891 - RNA, 23 nt, Bordetella pertussis
gcgucgaaauaggaucccggcgc

SEQ ID NO: 2434892 - RNA, 17 nt, Bordetella pertussis
gcgucgaacggccgggc

SEQ ID NO: 2434893 - RNA, 22 nt, Bordetella pertussis
gcgucgaacggccgggcgccca

SEQ ID NO: 2434894 - RNA, 15 nt, Bordetella pertussis
gcgucgaaggcggcc

SEQ ID NO: 2434895 - RNA, 17 nt, Bordetella pertussis
gcgucgaaggcggccgg

SEQ ID NO: 2434896 - RNA, 21 nt, Bordetella pertussis
gcgucgaaugcacgggcgcug

SEQ ID NO: 2434897 - RNA, 16 nt, Bordetella pertussis
gcgucgaccgccaugc

SEQ ID NO: 2434898 - RNA, 17 nt, Bordetella pertussis
gcgucgaccgccaugcg

SEQ ID NO: 2434899 - RNA, 19 nt, Bordetella pertussis
gcgucgaccgcgggcgcgc

SEQ ID NO: 2434900 - RNA, 20 nt, Bordetella pertussis
gcgucgaccgcgggcgcgcg

SEQ ID NO: 2434901 - RNA, 15 nt, Bordetella pertussis
gcgucgacgaagcgc

SEQ ID NO: 2434902 - RNA, 13 nt, Bordetella pertussis
gcgucgacgcccg

SEQ ID NO: 2434903 - RNA, 19 nt, Bordetella pertussis
gcgucgacgcccgcgccca

SEQ ID NO: 2434904 - RNA, 13 nt, Bordetella pertussis
gcgucgacggugc

SEQ ID NO: 2434905 - RNA, 14 nt, Bordetella pertussis
gcgucgacggugcg

SEQ ID NO: 2434906 - RNA, 17 nt, Bordetella pertussis
gcgucgacggugcgcgc

SEQ ID NO: 2434907 - RNA, 18 nt, Bordetella pertussis
gcgucgacggugcgcgcc

SEQ ID NO: 2434908 - RNA, 19 nt, Bordetella pertussis
gcgucgacggugcgcgcca

SEQ ID NO: 2434909 - RNA, 24 nt, Bordetella pertussis
gcgucgacggugcgcgccacggcg

SEQ ID NO: 2434910 - RNA, 13 nt, Bordetella pertussis
gcgucgagcacgc

SEQ ID NO: 2434911 - RNA, 18 nt, Bordetella pertussis
gcgucgagcacgcggcgc

SEQ ID NO: 2434912 - RNA, 22 nt, Bordetella pertussis
gcgucgagcacgcggcgcggca

SEQ ID NO: 2434913 - RNA, 15 nt, Bordetella pertussis
gcgucgagcagcgca

SEQ ID NO: 2434914 - RNA, 19 nt, Bordetella pertussis
gcgucgagcagcgcaucga

SEQ ID NO: 2434915 - RNA, 17 nt, Bordetella pertussis
gcgucgagcaggccggc

SEQ ID NO: 2434916 - RNA, 16 nt, Bordetella pertussis
gcgucgagcggcgugu

SEQ ID NO: 2434917 - RNA, 14 nt, Bordetella pertussis
gcgucgagcugacg

SEQ ID NO: 2434918 - RNA, 15 nt, Bordetella pertussis
gcgucgagcugacga

SEQ ID NO: 2434919 - RNA, 15 nt, Bordetella pertussis
gcgucgaucagcgcg

SEQ ID NO: 2434920 - RNA, 13 nt, Bordetella pertussis
gcgucgauccggc

SEQ ID NO: 2434921 - RNA, 18 nt, Bordetella pertussis
gcgucgauccggcagcag

SEQ ID NO: 2434922 - RNA, 23 nt, Bordetella pertussis
gcgucgauccggcagcagcagcg

SEQ ID NO: 2434923 - RNA, 16 nt, Bordetella pertussis
gcgucgaucggcgcgc

SEQ ID NO: 2434924 - RNA, 22 nt, Bordetella pertussis
gcgucgaucggcgcgcccgcca

SEQ ID NO: 2434925 - RNA, 19 nt, Bordetella pertussis
gcgucgaucuucgccugca

SEQ ID NO: 2434926 - RNA, 22 nt, Bordetella pertussis
gcgucgaucuucgccugcaugg

SEQ ID NO: 2434927 - RNA, 23 nt, Bordetella pertussis
gcgucgaucuucgccugcauggu

SEQ ID NO: 2434928 - RNA, 20 nt, Bordetella pertussis
gcgucgaugaaauauugggc

SEQ ID NO: 2434929 - RNA, 14 nt, Bordetella pertussis
gcgucgaugcgcgc

SEQ ID NO: 2434930 - RNA, 15 nt, Bordetella pertussis
gcgucgaugcgcgcg

SEQ ID NO: 2434931 - RNA, 16 nt, Bordetella pertussis
gcgucgaugcgcgcgc

SEQ ID NO: 2434932 - RNA, 19 nt, Bordetella pertussis
gcgucgauuucgucgagcu

SEQ ID NO: 2434933 - RNA, 22 nt, Bordetella pertussis
gcgucgcacuggguggccagcg

SEQ ID NO: 2434934 - RNA, 21 nt, Bordetella pertussis
gcgucgcccuugauggccucg

SEQ ID NO: 2434935 - RNA, 20 nt, Bordetella pertussis
gcgugacgcugacccuggcc

SEQ ID NO: 2434936 - RNA, 23 nt, Bordetella pertussis
gcgugacgcugacccuggccgaa

SEQ ID NO: 2434937 - RNA, 20 nt, Bordetella pertussis
gcgugacgcuggagauggcg

SEQ ID NO: 2434938 - RNA, 13 nt, Bordetella pertussis
gcgugacggcggc

SEQ ID NO: 2434939 - RNA, 15 nt, Bordetella pertussis
gcgugacggcggcgc

SEQ ID NO: 2434940 - RNA, 20 nt, Bordetella pertussis
gcgugacguagcgguagggc

SEQ ID NO: 2434941 - RNA, 17 nt, Bordetella pertussis
gcgugagcaggcgccug

SEQ ID NO: 2434942 - RNA, 16 nt, Bordetella pertussis
gcgugagcgccaccgu

SEQ ID NO: 2434943 - RNA, 23 nt, Bordetella pertussis
gcgugagcgccaccgugauggcg

SEQ ID NO: 2434944 - RNA, 17 nt, Bordetella pertussis
gcgugagcgccucgagu

SEQ ID NO: 2434945 - RNA, 15 nt, Bordetella pertussis
gcgugaugcccaggc

SEQ ID NO: 2434946 - RNA, 21 nt, Bordetella pertussis
gcgugaugcccaggcccuggc

SEQ ID NO: 2434947 - RNA, 13 nt, Bordetella pertussis
gcgugaugccgac

SEQ ID NO: 2434948 - RNA, 15 nt, Bordetella pertussis
gcgugaugccgacca

SEQ ID NO: 2434949 - RNA, 17 nt, Bordetella pertussis
gcgugaugccgucgagc

SEQ ID NO: 2434950 - RNA, 18 nt, Bordetella pertussis
gcgugaugccgucgagcg

SEQ ID NO: 2434951 - RNA, 22 nt, Bordetella pertussis
gcgugaugccgucgagcgcggc

SEQ ID NO: 2434952 - RNA, 20 nt, Bordetella pertussis
gcgugaugcggucggccaca

SEQ ID NO: 2434953 - RNA, 15 nt, Bordetella pertussis
gcgugauggcguagc

SEQ ID NO: 2434954 - RNA, 20 nt, Bordetella pertussis
gcgugauggggccgggcgcc

SEQ ID NO: 2434955 - RNA, 13 nt, Bordetella pertussis
gcgugcaccagcc

SEQ ID NO: 2434956 - RNA, 23 nt, Bordetella pertussis
gcgugcaccagccauucgauggc

SEQ ID NO: 2434957 - RNA, 15 nt, Bordetella pertussis
gcgugcagaucugca

SEQ ID NO: 2434958 - RNA, 17 nt, Bordetella pertussis
gcgugcagaucugcacg

SEQ ID NO: 2434959 - RNA, 19 nt, Bordetella pertussis
gcgugcagaucugcacgcu

SEQ ID NO: 2434960 - RNA, 19 nt, Bordetella pertussis
gcgugcagcaagcccaccg

SEQ ID NO: 2434961 - RNA, 20 nt, Bordetella pertussis
gcgugcagcaagcccaccgg

SEQ ID NO: 2434962 - RNA, 22 nt, Bordetella pertussis
gcgugcagcaagcccaccgggc

SEQ ID NO: 2434963 - RNA, 14 nt, Bordetella pertussis
gcgugcagccagcg

SEQ ID NO: 2434964 - RNA, 16 nt, Bordetella pertussis
gcgugcagccagcggc

SEQ ID NO: 2434965 - RNA, 17 nt, Bordetella pertussis
gcgugcagccagcggcc

SEQ ID NO: 2434966 - RNA, 15 nt, Bordetella pertussis
gcgugcagccauucg

SEQ ID NO: 2434967 - RNA, 14 nt, Bordetella pertussis
gcgugcagcgacuu

SEQ ID NO: 2434968 - RNA, 19 nt, Bordetella pertussis
gcgugcagcgccgcgcgcu

SEQ ID NO: 2434969 - RNA, 13 nt, Bordetella pertussis
gcgugcaggccgc

SEQ ID NO: 2434970 - RNA, 14 nt, Bordetella pertussis
gcgugcaggccggc

SEQ ID NO: 2434971 - RNA, 19 nt, Bordetella pertussis
gcgugcagguaggacggcg

SEQ ID NO: 2434972 - RNA, 21 nt, Bordetella pertussis
gcgugcauugcuugccggacu

SEQ ID NO: 2434973 - RNA, 12 nt, Bordetella pertussis
gcgugccagcag

SEQ ID NO: 2434974 - RNA, 13 nt, Bordetella pertussis
gcgugccagcagg

SEQ ID NO: 2434975 - RNA, 18 nt, Bordetella pertussis
gcgugcccagcgagauca

SEQ ID NO: 2434976 - RNA, 18 nt, Bordetella pertussis
gcgugcccagggccacga

SEQ ID NO: 2434977 - RNA, 15 nt, Bordetella pertussis
gcgugcccgcgucca

SEQ ID NO: 2434978 - RNA, 19 nt, Bordetella pertussis
gcgugcccguugccgcgcg

SEQ ID NO: 2434979 - RNA, 21 nt, Bordetella pertussis
gcgugcccguugccgcgcgcg

SEQ ID NO: 2434980 - RNA, 22 nt, Bordetella pertussis
gcgugcccguugccgcgcgcga

SEQ ID NO: 2434981 - RNA, 20 nt, Bordetella pertussis
gcgugcccugcggcgcggcc

SEQ ID NO: 2434982 - RNA, 21 nt, Bordetella pertussis
gcgugcccugcggcgcggcca

SEQ ID NO: 2434983 - RNA, 23 nt, Bordetella pertussis
gcgugcccugcggcgcggccagc

SEQ ID NO: 2434984 - RNA, 17 nt, Bordetella pertussis
gcgugcccuugaccgac

SEQ ID NO: 2434985 - RNA, 15 nt, Bordetella pertussis
gcgugccgacgaugc

SEQ ID NO: 2434986 - RNA, 22 nt, Bordetella pertussis
gcgugccgacgaugccgccgcc

SEQ ID NO: 2434987 - RNA, 17 nt, Bordetella pertussis
gcgugccgcaggccagc

SEQ ID NO: 2434988 - RNA, 12 nt, Bordetella pertussis
gcgugccgccca

SEQ ID NO: 2434989 - RNA, 14 nt, Bordetella pertussis
gcgugccgcccagg

SEQ ID NO: 2434990 - RNA, 12 nt, Bordetella pertussis
gcgugccgccgg

SEQ ID NO: 2434991 - RNA, 14 nt, Bordetella pertussis
gcgugccgccggcg

SEQ ID NO: 2434992 - RNA, 11 nt, Bordetella pertussis
gcgugccgcgc

SEQ ID NO: 2434993 - RNA, 13 nt, Bordetella pertussis
gcgugccgcgcag

SEQ ID NO: 2434994 - RNA, 14 nt, Bordetella pertussis
gcgugccgcgcagg

SEQ ID NO: 2434995 - RNA, 19 nt, Bordetella pertussis
gcgugccgcgcaggucggc

SEQ ID NO: 2434996 - RNA, 17 nt, Bordetella pertussis
gcgugccgcgcaguucg

SEQ ID NO: 2434997 - RNA, 17 nt, Bordetella pertussis
gcgugccgcgcugggcg

SEQ ID NO: 2434998 - RNA, 22 nt, Bordetella pertussis
gcgugccgggaugcugcucggc

SEQ ID NO: 2434999 - RNA, 14 nt, Bordetella pertussis
gcgugccggugacg

SEQ ID NO: 2435000 - RNA, 12 nt, Bordetella pertussis
gcgugccugucc

SEQ ID NO: 2435001 - RNA, 15 nt, Bordetella pertussis
gcgugccuguccccg

SEQ ID NO: 2435002 - RNA, 12 nt, Bordetella pertussis
gcgugcgcagcu

SEQ ID NO: 2435003 - RNA, 14 nt, Bordetella pertussis
gcgugcgcaucagc

SEQ ID NO: 2435004 - RNA, 18 nt, Bordetella pertussis
gcgugcgcccauggcgcg

SEQ ID NO: 2435005 - RNA, 19 nt, Bordetella pertussis
gcgugcgcccauggcgcgc

SEQ ID NO: 2435006 - RNA, 22 nt, Bordetella pertussis
gcgugcgcccauggcgcgcagc

SEQ ID NO: 2435007 - RNA, 17 nt, Bordetella pertussis
gcgugcgcgaccuccgg

SEQ ID NO: 2435008 - RNA, 18 nt, Bordetella pertussis
gcgugcgcgaccuccggc

SEQ ID NO: 2435009 - RNA, 12 nt, Bordetella pertussis
gcgugcgcggcg

SEQ ID NO: 2435010 - RNA, 23 nt, Bordetella pertussis
gcgugcgcgggcgccaucgcggu

SEQ ID NO: 2435011 - RNA, 16 nt, Bordetella pertussis
gcgugcgcgugcaugu

SEQ ID NO: 2435012 - RNA, 16 nt, Bordetella pertussis
gcgugcggaccagcgg

SEQ ID NO: 2435013 - RNA, 12 nt, Bordetella pertussis
gcgugcggaugg

SEQ ID NO: 2435014 - RNA, 24 nt, Bordetella pertussis
gcgugcggauggucgagcgccugc

SEQ ID NO: 2435015 - RNA, 14 nt, Bordetella pertussis
gcgugcggcccagc

SEQ ID NO: 2435016 - RNA, 17 nt, Bordetella pertussis
gcgugcggcccagccgc

SEQ ID NO: 2435017 - RNA, 15 nt, Bordetella pertussis
gcgugcgggacaggc

SEQ ID NO: 2435018 - RNA, 18 nt, Bordetella pertussis
gcgugcgggacggccagg

SEQ ID NO: 2435019 - RNA, 22 nt, Bordetella pertussis
gcgugcguauucgguggcgcgc

SEQ ID NO: 2435020 - RNA, 18 nt, Bordetella pertussis
gcgugcucaucggcaggc

SEQ ID NO: 2435021 - RNA, 16 nt, Bordetella pertussis
gcgugcucgcgcaacg

SEQ ID NO: 2435022 - RNA, 17 nt, Bordetella pertussis
gcgugcucgcgcaacgc

SEQ ID NO: 2435023 - RNA, 15 nt, Bordetella pertussis
gcgugcugaacgcgc

SEQ ID NO: 2435024 - RNA, 17 nt, Bordetella pertussis
gcgugcugaacgcgcgu

SEQ ID NO: 2435025 - RNA, 13 nt, Bordetella pertussis
gcgugcugcggcu

SEQ ID NO: 2435026 - RNA, 22 nt, Bordetella pertussis
gcgugcuggcacugucggcguu

SEQ ID NO: 2435027 - RNA, 12 nt, Bordetella pertussis
gcgugcuggcgc

SEQ ID NO: 2435028 - RNA, 16 nt, Bordetella pertussis
gcgugcuggcgcagca

SEQ ID NO: 2435029 - RNA, 16 nt, Bordetella pertussis
gcgugcuugccgccgg

SEQ ID NO: 2435030 - RNA, 17 nt, Bordetella pertussis
gcguggaaccgccgcuu

SEQ ID NO: 2435031 - RNA, 20 nt, Bordetella pertussis
gcguggaacgaccacggaau

SEQ ID NO: 2435032 - RNA, 18 nt, Bordetella pertussis
gcguggcaggugcggccg

SEQ ID NO: 2435033 - RNA, 19 nt, Bordetella pertussis
gcguggcaggugcggccgc

SEQ ID NO: 2435034 - RNA, 14 nt, Bordetella pertussis
gcguggccaccagg

SEQ ID NO: 2435035 - RNA, 15 nt, Bordetella pertussis
gcguggccaccaggc

SEQ ID NO: 2435036 - RNA, 14 nt, Bordetella pertussis
gcguggccagcacg

SEQ ID NO: 2435037 - RNA, 19 nt, Bordetella pertussis
gcguggccaucaacguggc

SEQ ID NO: 2435038 - RNA, 18 nt, Bordetella pertussis
gcguggccgaggugccca

SEQ ID NO: 2435039 - RNA, 12 nt, Bordetella pertussis
gcguggccgcca

SEQ ID NO: 2435040 - RNA, 15 nt, Bordetella pertussis
gcguggccgccacca

SEQ ID NO: 2435041 - RNA, 20 nt, Bordetella pertussis
gcguggccgccaccagcgcg

SEQ ID NO: 2435042 - RNA, 16 nt, Bordetella pertussis
gcguggccgccacgcc

SEQ ID NO: 2435043 - RNA, 15 nt, Bordetella pertussis
gcguggccgcgcugc

SEQ ID NO: 2435044 - RNA, 16 nt, Bordetella pertussis
gcguggccgcgcugcu

SEQ ID NO: 2435045 - RNA, 13 nt, Bordetella pertussis
gcguggccguucg

SEQ ID NO: 2435046 - RNA, 20 nt, Bordetella pertussis
gcguggccugcccgucgggc

SEQ ID NO: 2435047 - RNA, 14 nt, Bordetella pertussis
gcguggcgacgcgc

SEQ ID NO: 2435048 - RNA, 16 nt, Bordetella pertussis
gcguggcgacgcgcug

SEQ ID NO: 2435049 - RNA, 17 nt, Bordetella pertussis
gcguugaccggcuggcg

SEQ ID NO: 2435050 - RNA, 21 nt, Bordetella pertussis
gcguugaccggcuggcgcacg

SEQ ID NO: 2435051 - RNA, 15 nt, Bordetella pertussis
gcguugagcagcaug

SEQ ID NO: 2435052 - RNA, 23 nt, Bordetella pertussis
gcguugagcagcaugugcucggg

SEQ ID NO: 2435053 - RNA, 15 nt, Bordetella pertussis
gcguugagcgccgac

SEQ ID NO: 2435054 - RNA, 20 nt, Bordetella pertussis
gcguugcaccgcgucggccu

SEQ ID NO: 2435055 - RNA, 21 nt, Bordetella pertussis
gcguugcaccgcgucggccug

SEQ ID NO: 2435056 - RNA, 19 nt, Bordetella pertussis
gcguugcagccacaggccc

SEQ ID NO: 2435057 - RNA, 14 nt, Bordetella pertussis
gcguugccagccca

SEQ ID NO: 2435058 - RNA, 14 nt, Bordetella pertussis
gcguugccggccug

SEQ ID NO: 2435059 - RNA, 19 nt, Bordetella pertussis
gcguugcgcaucgcgcacc

SEQ ID NO: 2435060 - RNA, 14 nt, Bordetella pertussis
gcguugcgcccugc

SEQ ID NO: 2435061 - RNA, 14 nt, Bordetella pertussis
gcguugcgcugccc

SEQ ID NO: 2435062 - RNA, 15 nt, Bordetella pertussis
gcguugcggcagcgg

SEQ ID NO: 2435063 - RNA, 20 nt, Bordetella pertussis
gcguugcuggcaaagcgcgc

SEQ ID NO: 2435064 - RNA, 21 nt, Bordetella pertussis
gcguugcuggcaaagcgcgcg

SEQ ID NO: 2435065 - RNA, 13 nt, Bordetella pertussis
gcguuggcauggc

SEQ ID NO: 2435066 - RNA, 15 nt, Bordetella pertussis
gcguuggcauggcgc

SEQ ID NO: 2435067 - RNA, 21 nt, Bordetella pertussis
gcguuggccgggucgcgcagc

SEQ ID NO: 2435068 - RNA, 14 nt, Bordetella pertussis
gcguuggcgcggcg

SEQ ID NO: 2435069 - RNA, 12 nt, Bordetella pertussis
gcguuggcggcc

SEQ ID NO: 2435070 - RNA, 17 nt, Bordetella pertussis
gcguuggcggccggcca

SEQ ID NO: 2435071 - RNA, 21 nt, Bordetella pertussis
gcguuggcggccggccagcca

SEQ ID NO: 2435072 - RNA, 19 nt, Bordetella pertussis
gcguuguucgggccggcug

SEQ ID NO: 2435073 - RNA, 17 nt, Bordetella pertussis
gcguuucccucggugcu

SEQ ID NO: 2435074 - RNA, 17 nt, Bordetella pertussis
gcguuucggucagggcg

SEQ ID NO: 2435075 - RNA, 15 nt, Bordetella pertussis
gcguuuucuggccuu

SEQ ID NO: 2435076 - RNA, 16 nt, Bordetella pertussis
gcguuuuggcgagcag

SEQ ID NO: 2435077 - RNA, 16 nt, Bordetella pertussis
gcuaaauacgcuggcu

SEQ ID NO: 2435078 - RNA, 15 nt, Bordetella pertussis
gcuaagcacaagcgc

SEQ ID NO: 2435079 - RNA, 16 nt, Bordetella pertussis
gcuacaccgugcuggc

SEQ ID NO: 2435080 - RNA, 16 nt, Bordetella pertussis
gcuacagcucgccggc

SEQ ID NO: 2435081 - RNA, 19 nt, Bordetella pertussis
gcuaccacguggucuggaa

SEQ ID NO: 2435082 - RNA, 21 nt, Bordetella pertussis
gcuaccacguggucuggaaug

SEQ ID NO: 2435083 - RNA, 12 nt, Bordetella pertussis
gcuaccaggcgc

SEQ ID NO: 2435084 - RNA, 13 nt, Bordetella pertussis
gcuaccccggcag

SEQ ID NO: 2435085 - RNA, 18 nt, Bordetella pertussis
gcuaccccggcagcguca

SEQ ID NO: 2435086 - RNA, 12 nt, Bordetella pertussis
gcuaccgcgcca

SEQ ID NO: 2435087 - RNA, 14 nt, Bordetella pertussis
gcuaccgcgccauc

SEQ ID NO: 2435088 - RNA, 18 nt, Bordetella pertussis
gcuacgacgagaucgcgc

SEQ ID NO: 2435089 - RNA, 14 nt, Bordetella pertussis
gcuacgcggcguca

SEQ ID NO: 2435090 - RNA, 19 nt, Bordetella pertussis
gcuacgcgggcuugcugcc

SEQ ID NO: 2435091 - RNA, 21 nt, Bordetella pertussis
gcuacggcaagguccaggcgc

SEQ ID NO: 2435092 - RNA, 16 nt, Bordetella pertussis
gcuacguguccugccg

SEQ ID NO: 2435093 - RNA, 19 nt, Bordetella pertussis
gcuacguguccugccgggg

SEQ ID NO: 2435094 - RNA, 13 nt, Bordetella pertussis
gcuaggaucgcga

SEQ ID NO: 2435095 - RNA, 18 nt, Bordetella pertussis
gcuaggcgcagcaggcca

SEQ ID NO: 2435096 - RNA, 21 nt, Bordetella pertussis
gcuaggcgcagcaggccagga

SEQ ID NO: 2435097 - RNA, 18 nt, Bordetella pertussis
gcuaguacaccgucgcgc

SEQ ID NO: 2435098 - RNA, 22 nt, Bordetella pertussis
gcuaguacaccgucgcgcgcac

SEQ ID NO: 2435099 - RNA, 17 nt, Bordetella pertussis
gcuaucauccgcgcaug

SEQ ID NO: 2435100 - RNA, 18 nt, Bordetella pertussis
gcuaucguggcuggcgag

SEQ ID NO: 2435101 - RNA, 16 nt, Bordetella pertussis
gcuaugcagcugcgcc

SEQ ID NO: 2435102 - RNA, 20 nt, Bordetella pertussis
gcuaugcagcugcgccagcc

SEQ ID NO: 2435103 - RNA, 18 nt, Bordetella pertussis
gcuaugggggcgagcggg

SEQ ID NO: 2435104 - RNA, 19 nt, Bordetella pertussis
gcucaaccucgacgcgcau

SEQ ID NO: 2435105 - RNA, 20 nt, Bordetella pertussis
gcucaaccucgacgcgcauu

SEQ ID NO: 2435106 - RNA, 14 nt, Bordetella pertussis
gcucaacggccacc

SEQ ID NO: 2435107 - RNA, 15 nt, Bordetella pertussis
gcucaacggccacca

SEQ ID NO: 2435108 - RNA, 20 nt, Bordetella pertussis
gcucaagaagaagccgggcu

SEQ ID NO: 2435109 - RNA, 17 nt, Bordetella pertussis
gcucaaggauuucaccu

SEQ ID NO: 2435110 - RNA, 23 nt, Bordetella pertussis
gcucacagggucaaggcgcggcc

SEQ ID NO: 2435111 - RNA, 23 nt, Bordetella pertussis
gcucaccgacuucaccgaggcgc

SEQ ID NO: 2435112 - RNA, 22 nt, Bordetella pertussis
gcucaccgagggccggacuggc

SEQ ID NO: 2435113 - RNA, 17 nt, Bordetella pertussis
gcucaccucgaucgcgu

SEQ ID NO: 2435114 - RNA, 16 nt, Bordetella pertussis
gcucaccucgcgcuug

SEQ ID NO: 2435115 - RNA, 13 nt, Bordetella pertussis
gcucacgcccagu

SEQ ID NO: 2435116 - RNA, 18 nt, Bordetella pertussis
gcucacgcccagucccag

SEQ ID NO: 2435117 - RNA, 17 nt, Bordetella pertussis
gcucacgcccgugucgc

SEQ ID NO: 2435118 - RNA, 16 nt, Bordetella pertussis
gcucacggggcugucg

SEQ ID NO: 2435119 - RNA, 20 nt, Bordetella pertussis
gcucacggggcugucgcgcg

SEQ ID NO: 2435120 - RNA, 21 nt, Bordetella pertussis
gcucacggggcugucgcgcgc

SEQ ID NO: 2435121 - RNA, 23 nt, Bordetella pertussis
gcucacggggcugucgcgcgcau

SEQ ID NO: 2435122 - RNA, 16 nt, Bordetella pertussis
gcucagagccccagga

SEQ ID NO: 2435123 - RNA, 17 nt, Bordetella pertussis
gcucagagccccaggaa

SEQ ID NO: 2435124 - RNA, 20 nt, Bordetella pertussis
gcucagagcuugccguacga

SEQ ID NO: 2435125 - RNA, 15 nt, Bordetella pertussis
gcucagcaccaggcc

SEQ ID NO: 2435126 - RNA, 16 nt, Bordetella pertussis
gcucagcaccaggccg

SEQ ID NO: 2435127 - RNA, 19 nt, Bordetella pertussis
gcucagcaccaggccgccg

SEQ ID NO: 2435128 - RNA, 20 nt, Bordetella pertussis
gcucagcaccaggccgccgg

SEQ ID NO: 2435129 - RNA, 11 nt, Bordetella pertussis
gcucagcagcg

SEQ ID NO: 2435130 - RNA, 17 nt, Bordetella pertussis
gcucagcagcgccaggg

SEQ ID NO: 2435131 - RNA, 18 nt, Bordetella pertussis
gcucagcagcgccagggc

SEQ ID NO: 2435132 - RNA, 23 nt, Bordetella pertussis
gcucagcagcgccagggccaggc

SEQ ID NO: 2435133 - RNA, 23 nt, Bordetella pertussis
gcucagcagggucgagaccagca

SEQ ID NO: 2435134 - RNA, 16 nt, Bordetella pertussis
gcucagcaugcgcugg

SEQ ID NO: 2435135 - RNA, 20 nt, Bordetella pertussis
gcucagcccgccuggcgccg

SEQ ID NO: 2435136 - RNA, 22 nt, Bordetella pertussis
gcucagcccgccuggcgccgcg

SEQ ID NO: 2435137 - RNA, 17 nt, Bordetella pertussis
gcucagcccggcgaggu

SEQ ID NO: 2435138 - RNA, 22 nt, Bordetella pertussis
gcucagcccuugacgcguacga

SEQ ID NO: 2435139 - RNA, 14 nt, Bordetella pertussis
gcucagccgugccg

SEQ ID NO: 2435140 - RNA, 21 nt, Bordetella pertussis
gcucagccucgagguggcgca

SEQ ID NO: 2435141 - RNA, 14 nt, Bordetella pertussis
gcucagccuugucg

SEQ ID NO: 2435142 - RNA, 20 nt, Bordetella pertussis
gcucagccuugucgcgggca

SEQ ID NO: 2435143 - RNA, 17 nt, Bordetella pertussis
gcucagcgcgccgagga

SEQ ID NO: 2435144 - RNA, 22 nt, Bordetella pertussis
gcucagcgcggcgcggccagca

SEQ ID NO: 2435145 - RNA, 23 nt, Bordetella pertussis
gcucagcgcggcgcggccagcag

SEQ ID NO: 2435146 - RNA, 23 nt, Bordetella pertussis
gcucagcuuggcguacggcugca

SEQ ID NO: 2435147 - RNA, 17 nt, Bordetella pertussis
gcucagcuuguagcccu

SEQ ID NO: 2435148 - RNA, 19 nt, Bordetella pertussis
gcucagcuuguagcccucg

SEQ ID NO: 2435149 - RNA, 20 nt, Bordetella pertussis
gcucagcuuguagcccucgg

SEQ ID NO: 2435150 - RNA, 15 nt, Bordetella pertussis
gcucaggaaccagcg

SEQ ID NO: 2435151 - RNA, 21 nt, Bordetella pertussis
gcucaggaaccagcggcuggc

SEQ ID NO: 2435152 - RNA, 14 nt, Bordetella pertussis
gcucaggauacgug

SEQ ID NO: 2435153 - RNA, 12 nt, Bordetella pertussis
gcucaggccagc

SEQ ID NO: 2435154 - RNA, 13 nt, Bordetella pertussis
gcucaggccagcg

SEQ ID NO: 2435155 - RNA, 14 nt, Bordetella pertussis
gcucaggccagcga

SEQ ID NO: 2435156 - RNA, 15 nt, Bordetella pertussis
gcucaggccagcgac

SEQ ID NO: 2435157 - RNA, 16 nt, Bordetella pertussis
gcucaggccgccggcg

SEQ ID NO: 2435158 - RNA, 23 nt, Bordetella pertussis
gcucaggcgcggauugaugucgc

SEQ ID NO: 2435159 - RNA, 14 nt, Bordetella pertussis
gcucaggcggccag

SEQ ID NO: 2435160 - RNA, 15 nt, Bordetella pertussis
gcucaggcggccagg

SEQ ID NO: 2435161 - RNA, 19 nt, Bordetella pertussis
gcucaggcggccagggccu

SEQ ID NO: 2435162 - RNA, 22 nt, Bordetella pertussis
gcuccucggccugccggcgcgc

SEQ ID NO: 2435163 - RNA, 19 nt, Bordetella pertussis
gcuccugccaggcgccgcg

SEQ ID NO: 2435164 - RNA, 22 nt, Bordetella pertussis
gcuccugccaggcgccgcgucc

SEQ ID NO: 2435165 - RNA, 17 nt, Bordetella pertussis
gcuccugcucgauccgg

SEQ ID NO: 2435166 - RNA, 13 nt, Bordetella pertussis
gcuccugcucggc

SEQ ID NO: 2435167 - RNA, 11 nt, Bordetella pertussis
gcuccugcugg

SEQ ID NO: 2435168 - RNA, 21 nt, Bordetella pertussis
gcuccugugggggcgcggcgg

SEQ ID NO: 2435169 - RNA, 16 nt, Bordetella pertussis
gcucgaaaaagcccug

SEQ ID NO: 2435170 - RNA, 17 nt, Bordetella pertussis
gcucgaaaaagcccugc

SEQ ID NO: 2435171 - RNA, 22 nt, Bordetella pertussis
gcucgaacaggcuggcauggaa

SEQ ID NO: 2435172 - RNA, 21 nt, Bordetella pertussis
gcucgaagcgcaugucgaagc

SEQ ID NO: 2435173 - RNA, 15 nt, Bordetella pertussis
gcucgaaggcgccga

SEQ ID NO: 2435174 - RNA, 19 nt, Bordetella pertussis
gcucgaaggcgccgacggc

SEQ ID NO: 2435175 - RNA, 16 nt, Bordetella pertussis
gcucgaaguacagcuu

SEQ ID NO: 2435176 - RNA, 21 nt, Bordetella pertussis
gcucgaauggcugcgcgccgu

SEQ ID NO: 2435177 - RNA, 17 nt, Bordetella pertussis
gcucgaccacggcggcu

SEQ ID NO: 2435178 - RNA, 16 nt, Bordetella pertussis
gcucgaccaucauggc

SEQ ID NO: 2435179 - RNA, 21 nt, Bordetella pertussis
gcucgaccaucauggccaggg

SEQ ID NO: 2435180 - RNA, 12 nt, Bordetella pertussis
gcucgaccgccg

SEQ ID NO: 2435181 - RNA, 20 nt, Bordetella pertussis
gcucgaccgccgccacgcgc

SEQ ID NO: 2435182 - RNA, 22 nt, Bordetella pertussis
gcucgaccgccgccacgcgcac

SEQ ID NO: 2435183 - RNA, 23 nt, Bordetella pertussis
gcucgaccgccgccacgcgcacg

SEQ ID NO: 2435184 - RNA, 21 nt, Bordetella pertussis
gcucgacgccaucucgcgcgc

SEQ ID NO: 2435185 - RNA, 13 nt, Bordetella pertussis
gcucgacgccgua

SEQ ID NO: 2435186 - RNA, 22 nt, Bordetella pertussis
gcucgacuucgucgggcucggg

SEQ ID NO: 2435187 - RNA, 18 nt, Bordetella pertussis
gcucgagcaagggccaga

SEQ ID NO: 2435188 - RNA, 20 nt, Bordetella pertussis
gcucgagcaucuggcgcaug

SEQ ID NO: 2435189 - RNA, 22 nt, Bordetella pertussis
gcucgagcaucuggcgcauggc

SEQ ID NO: 2435190 - RNA, 21 nt, Bordetella pertussis
gcucgagcaugcgggccaugu

SEQ ID NO: 2435191 - RNA, 19 nt, Bordetella pertussis
gcucgagcgccugcagcgu

SEQ ID NO: 2435192 - RNA, 14 nt, Bordetella pertussis
gcucgagcgcggcg

SEQ ID NO: 2435193 - RNA, 17 nt, Bordetella pertussis
gcucgagcgcggcgcgc

SEQ ID NO: 2435194 - RNA, 19 nt, Bordetella pertussis
gcucgagcgcggcgcgcgc

SEQ ID NO: 2435195 - RNA, 17 nt, Bordetella pertussis
gcucgagcggcagcagc

SEQ ID NO: 2435196 - RNA, 18 nt, Bordetella pertussis
gcucgagcggcagcagcg

SEQ ID NO: 2435197 - RNA, 13 nt, Bordetella pertussis
gcucgagcggcgg

SEQ ID NO: 2435198 - RNA, 16 nt, Bordetella pertussis
gcucgagcuggcuggc

SEQ ID NO: 2435199 - RNA, 18 nt, Bordetella pertussis
gcucgagcuggcuggcca

SEQ ID NO: 2435200 - RNA, 16 nt, Bordetella pertussis
gcucgaggaaccagcc

SEQ ID NO: 2435201 - RNA, 18 nt, Bordetella pertussis
gcucgaggaaccagccgu

SEQ ID NO: 2435202 - RNA, 13 nt, Bordetella pertussis
gcucgaggccagg

SEQ ID NO: 2435203 - RNA, 15 nt, Bordetella pertussis
gcucgaggccaggcu

SEQ ID NO: 2435204 - RNA, 16 nt, Bordetella pertussis
gcucgaggccaggcug

SEQ ID NO: 2435205 - RNA, 17 nt, Bordetella pertussis
gcucgaggccaggcuga

SEQ ID NO: 2435206 - RNA, 16 nt, Bordetella pertussis
gcucgaggcgcuggcg

SEQ ID NO: 2435207 - RNA, 15 nt, Bordetella pertussis
gcucgagguaggcgg

SEQ ID NO: 2435208 - RNA, 23 nt, Bordetella pertussis
gcucgagguaggcgggacuggcg

SEQ ID NO: 2435209 - RNA, 20 nt, Bordetella pertussis
gcucgaggugcacgugggca

SEQ ID NO: 2435210 - RNA, 18 nt, Bordetella pertussis
gcucgauaugcagcaccg

SEQ ID NO: 2435211 - RNA, 21 nt, Bordetella pertussis
gcucgauaugcagcaccggau

SEQ ID NO: 2435212 - RNA, 15 nt, Bordetella pertussis
gcucgaucgccgccg

SEQ ID NO: 2435213 - RNA, 16 nt, Bordetella pertussis
gcucgaucgccgccgg

SEQ ID NO: 2435214 - RNA, 17 nt, Bordetella pertussis
gcucgaucgccgccggc

SEQ ID NO: 2435215 - RNA, 20 nt, Bordetella pertussis
gcucgaucgccgccggcacg

SEQ ID NO: 2435216 - RNA, 19 nt, Bordetella pertussis
gcucgaucugguuggccac

SEQ ID NO: 2435217 - RNA, 15 nt, Bordetella pertussis
gcucgaugaccagca

SEQ ID NO: 2435218 - RNA, 16 nt, Bordetella pertussis
gcucgaugaccagcag

SEQ ID NO: 2435219 - RNA, 19 nt, Bordetella pertussis
gcucgaugaccagcagcga

SEQ ID NO: 2435220 - RNA, 21 nt, Bordetella pertussis
gcucgaugaccagcagcgaau

SEQ ID NO: 2435221 - RNA, 17 nt, Bordetella pertussis
gcucgaugccggccucg

SEQ ID NO: 2435222 - RNA, 19 nt, Bordetella pertussis
gcucgauggcuucgcgcac

SEQ ID NO: 2435223 - RNA, 22 nt, Bordetella pertussis
gcucgauggcuucgcgcacauc

SEQ ID NO: 2435224 - RNA, 18 nt, Bordetella pertussis
gcucgcacggcaaugucc

SEQ ID NO: 2435225 - RNA, 12 nt, Bordetella pertussis
gcucgcaggccu

SEQ ID NO: 2435226 - RNA, 13 nt, Bordetella pertussis
gcucgcaggccug

SEQ ID NO: 2435227 - RNA, 14 nt, Bordetella pertussis
gcucgcaggccugc

SEQ ID NO: 2435228 - RNA, 15 nt, Bordetella pertussis
gcucgcaggccugcu

SEQ ID NO: 2435229 - RNA, 21 nt, Bordetella pertussis
gcucgcaggccugcugcagcg

SEQ ID NO: 2435230 - RNA, 21 nt, Bordetella pertussis
gcucgcagucuugcuugaggu

SEQ ID NO: 2435231 - RNA, 14 nt, Bordetella pertussis
gcucgcccagccgc

SEQ ID NO: 2435232 - RNA, 14 nt, Bordetella pertussis
gcucgcccauggca

SEQ ID NO: 2435233 - RNA, 20 nt, Bordetella pertussis
gcucgcccccgcgccgcgca

SEQ ID NO: 2435234 - RNA, 21 nt, Bordetella pertussis
gcucgcccccgcgccgcgcag

SEQ ID NO: 2435235 - RNA, 13 nt, Bordetella pertussis
gcucgccccggcg

SEQ ID NO: 2435236 - RNA, 14 nt, Bordetella pertussis
gcucgccccggcgc

SEQ ID NO: 2435237 - RNA, 16 nt, Bordetella pertussis
gcucgccccggcgcgc

SEQ ID NO: 2435238 - RNA, 17 nt, Bordetella pertussis
gcucgccccggcgcgca

SEQ ID NO: 2435239 - RNA, 18 nt, Bordetella pertussis
gcucgccccggcgcgcag

SEQ ID NO: 2435240 - RNA, 14 nt, Bordetella pertussis
gcucgcccggccac

SEQ ID NO: 2435241 - RNA, 15 nt, Bordetella pertussis
gcucgcccggccacg

SEQ ID NO: 2435242 - RNA, 14 nt, Bordetella pertussis
gcucgcccucgcgc

SEQ ID NO: 2435243 - RNA, 16 nt, Bordetella pertussis
gcucgcccucgcgcca

SEQ ID NO: 2435244 - RNA, 19 nt, Bordetella pertussis
gcucgcccucgcgccacca

SEQ ID NO: 2435245 - RNA, 17 nt, Bordetella pertussis
gcucgcccuugagcacg

SEQ ID NO: 2435246 - RNA, 19 nt, Bordetella pertussis
gcucgcccuugagcacggc

SEQ ID NO: 2435247 - RNA, 22 nt, Bordetella pertussis
gcucgcccuugagcacggcgcg

SEQ ID NO: 2435248 - RNA, 23 nt, Bordetella pertussis
gcucgcccuugagcacggcgcgg

SEQ ID NO: 2435249 - RNA, 16 nt, Bordetella pertussis
gcucgccgagccgggc

SEQ ID NO: 2435250 - RNA, 18 nt, Bordetella pertussis
gcucgccgagccgggcca

SEQ ID NO: 2435251 - RNA, 19 nt, Bordetella pertussis
gcucgccgagccgggccau

SEQ ID NO: 2435252 - RNA, 23 nt, Bordetella pertussis
gcucgccgagccgggccaugcgg

SEQ ID NO: 2435253 - RNA, 14 nt, Bordetella pertussis
gcucgccgcgcacg

SEQ ID NO: 2435254 - RNA, 18 nt, Bordetella pertussis
gcucgccgcgcacgggcg

SEQ ID NO: 2435255 - RNA, 19 nt, Bordetella pertussis
gcucgccgcgcacgggcgc

SEQ ID NO: 2435256 - RNA, 18 nt, Bordetella pertussis
gcucgccgcgcgacagcc

SEQ ID NO: 2435257 - RNA, 16 nt, Bordetella pertussis
gcucgccgcuccggca

SEQ ID NO: 2435258 - RNA, 12 nt, Bordetella pertussis
gcucgccggcca

SEQ ID NO: 2435259 - RNA, 16 nt, Bordetella pertussis
gcucgccggccagcgc

SEQ ID NO: 2435260 - RNA, 18 nt, Bordetella pertussis
gcucgccggccagcgcgg

SEQ ID NO: 2435261 - RNA, 15 nt, Bordetella pertussis
gcucgccggccgcgc

SEQ ID NO: 2435262 - RNA, 22 nt, Bordetella pertussis
gcucgccggccgcgcccagcgu

SEQ ID NO: 2435263 - RNA, 14 nt, Bordetella pertussis
gcucgccggcgccg

SEQ ID NO: 2435264 - RNA, 17 nt, Bordetella pertussis
gcucgccggcgccgccc

SEQ ID NO: 2435265 - RNA, 18 nt, Bordetella pertussis
gcucgccggcgcgcaggc

SEQ ID NO: 2435266 - RNA, 18 nt, Bordetella pertussis
gcucgccgucgacgccga

SEQ ID NO: 2435267 - RNA, 16 nt, Bordetella pertussis
gcucgccuccccaggc

SEQ ID NO: 2435268 - RNA, 18 nt, Bordetella pertussis
gcucgccuccccaggcca

SEQ ID NO: 2435269 - RNA, 19 nt, Bordetella pertussis
gcucgccuccccaggccag

SEQ ID NO: 2435270 - RNA, 18 nt, Bordetella pertussis
gcucgcgcacagcgcgca

SEQ ID NO: 2435271 - RNA, 16 nt, Bordetella pertussis
gcucgcgcagcaggcc

SEQ ID NO: 2435272 - RNA, 17 nt, Bordetella pertussis
gcucgcgcagcaggccg

SEQ ID NO: 2435273 - RNA, 23 nt, Bordetella pertussis
gcucgcgcagcguggcggcgacg

SEQ ID NO: 2435274 - RNA, 14 nt, Bordetella pertussis
gcucgcgcaggcgu

SEQ ID NO: 2435275 - RNA, 18 nt, Bordetella pertussis
gcucgucgccaugcggcu

SEQ ID NO: 2435276 - RNA, 22 nt, Bordetella pertussis
gcucgucgccaugcggcuggcc

SEQ ID NO: 2435277 - RNA, 19 nt, Bordetella pertussis
gcucgucgccgcuggacag

SEQ ID NO: 2435278 - RNA, 20 nt, Bordetella pertussis
gcucgucgggggggaugucg

SEQ ID NO: 2435279 - RNA, 15 nt, Bordetella pertussis
gcucgugcagcaggg

SEQ ID NO: 2435280 - RNA, 15 nt, Bordetella pertussis
gcucgugcaucaucu

SEQ ID NO: 2435281 - RNA, 15 nt, Bordetella pertussis
gcucguucugcgcgc

SEQ ID NO: 2435282 - RNA, 17 nt, Bordetella pertussis
gcucguucugcgcgccc

SEQ ID NO: 2435283 - RNA, 22 nt, Bordetella pertussis
gcucguugaccugcuggggguu

SEQ ID NO: 2435284 - RNA, 21 nt, Bordetella pertussis
gcucguugcgcaagccgcccg

SEQ ID NO: 2435285 - RNA, 22 nt, Bordetella pertussis
gcucguugcgcaagccgcccgc

SEQ ID NO: 2435286 - RNA, 14 nt, Bordetella pertussis
gcucuacaccauca

SEQ ID NO: 2435287 - RNA, 15 nt, Bordetella pertussis
gcucuccaugcugaa

SEQ ID NO: 2435288 - RNA, 20 nt, Bordetella pertussis
gcucucgaagaagcagccgc

SEQ ID NO: 2435289 - RNA, 21 nt, Bordetella pertussis
gcucucgaagaagcagccgcg

SEQ ID NO: 2435290 - RNA, 17 nt, Bordetella pertussis
gcucugaucgcgcugga

SEQ ID NO: 2435291 - RNA, 21 nt, Bordetella pertussis
gcucugcaccuugggcgccug

SEQ ID NO: 2435292 - RNA, 15 nt, Bordetella pertussis
gcucuggcacaccag

SEQ ID NO: 2435293 - RNA, 16 nt, Bordetella pertussis
gcucuggcacaccagc

SEQ ID NO: 2435294 - RNA, 19 nt, Bordetella pertussis
gcucuggcacaccagcgcc

SEQ ID NO: 2435295 - RNA, 20 nt, Bordetella pertussis
gcucuggcacaccagcgcca

SEQ ID NO: 2435296 - RNA, 22 nt, Bordetella pertussis
gcucuggcacaccagcgccagg

SEQ ID NO: 2435297 - RNA, 23 nt, Bordetella pertussis
gcucuggcacaccagcgccagga

SEQ ID NO: 2435298 - RNA, 23 nt, Bordetella pertussis
gcucuggcccgccucaaccuucu

SEQ ID NO: 2435299 - RNA, 19 nt, Bordetella pertussis
gcucuuccgagauggccuu

SEQ ID NO: 2435300 - RNA, 17 nt, Bordetella pertussis
gcucuucgacagcgcgc

SEQ ID NO: 2435301 - RNA, 18 nt, Bordetella pertussis
gcucuucgacagcgcgca

SEQ ID NO: 2435302 - RNA, 14 nt, Bordetella pertussis
gcucuugagcgcgg

SEQ ID NO: 2435303 - RNA, 16 nt, Bordetella pertussis
gcucuugagcgcggcc

SEQ ID NO: 2435304 - RNA, 17 nt, Bordetella pertussis
gcucuugagcgcggccu

SEQ ID NO: 2435305 - RNA, 19 nt, Bordetella pertussis
gcucuugcucaucaccagc

SEQ ID NO: 2435306 - RNA, 22 nt, Bordetella pertussis
gcucuuggcaaccucgccgcgc

SEQ ID NO: 2435307 - RNA, 23 nt, Bordetella pertussis
gcucuuggcgugcuugccgccgg

SEQ ID NO: 2435308 - RNA, 22 nt, Bordetella pertussis
gcucuuuuucccggcgcggaca

SEQ ID NO: 2435309 - RNA, 23 nt, Bordetella pertussis
gcugaaaaccaacggggccgcca

SEQ ID NO: 2435310 - RNA, 17 nt, Bordetella pertussis
gcugaagaagcccggcu

SEQ ID NO: 2435311 - RNA, 15 nt, Bordetella pertussis
gcugaagcgccgcca

SEQ ID NO: 2435312 - RNA, 23 nt, Bordetella pertussis
gcugaaggaccucgcgccgguca

SEQ ID NO: 2435313 - RNA, 12 nt, Bordetella pertussis
gcugaaggucgc

SEQ ID NO: 2435314 - RNA, 19 nt, Bordetella pertussis
gcugaaguaguacucgccg

SEQ ID NO: 2435315 - RNA, 13 nt, Bordetella pertussis
gcugaaugccgcc

SEQ ID NO: 2435316 - RNA, 23 nt, Bordetella pertussis
gcugacaccguuuuggcaggcug

SEQ ID NO: 2435317 - RNA, 22 nt, Bordetella pertussis
gcugaccaccgucuugcccgcc

SEQ ID NO: 2435318 - RNA, 18 nt, Bordetella pertussis
gcugaccagcacgauggu

SEQ ID NO: 2435319 - RNA, 14 nt, Bordetella pertussis
gcugaccagcgcgu

SEQ ID NO: 2435320 - RNA, 15 nt, Bordetella pertussis
gcugaccagcgcguc

SEQ ID NO: 2435321 - RNA, 18 nt, Bordetella pertussis
gcugaccagcgcgucgca

SEQ ID NO: 2435322 - RNA, 14 nt, Bordetella pertussis
gcugaccgaagcgg

SEQ ID NO: 2435323 - RNA, 16 nt, Bordetella pertussis
gcugaccgacggccug

SEQ ID NO: 2435324 - RNA, 18 nt, Bordetella pertussis
gcugaccgacgugcgccg

SEQ ID NO: 2435325 - RNA, 15 nt, Bordetella pertussis
gcugaccgagggcgc

SEQ ID NO: 2435326 - RNA, 16 nt, Bordetella pertussis
gcugaccgagggcgcg

SEQ ID NO: 2435327 - RNA, 23 nt, Bordetella pertussis
gcugaccgagggcgcguccaagc

SEQ ID NO: 2435328 - RNA, 22 nt, Bordetella pertussis
gcugaccggccuggucaugacg

SEQ ID NO: 2435329 - RNA, 14 nt, Bordetella pertussis
gcugaccggcggca

SEQ ID NO: 2435330 - RNA, 23 nt, Bordetella pertussis
gcugaccggcggcacggccggcc

SEQ ID NO: 2435331 - RNA, 23 nt, Bordetella pertussis
gcugaccggcguauggcccgcca

SEQ ID NO: 2435332 - RNA, 18 nt, Bordetella pertussis
gcugaccucgcccaggcc

SEQ ID NO: 2435333 - RNA, 19 nt, Bordetella pertussis
gcugaccucgcccaggccg

SEQ ID NO: 2435334 - RNA, 20 nt, Bordetella pertussis
gcugaccugcacgauggcgc

SEQ ID NO: 2435335 - RNA, 21 nt, Bordetella pertussis
gcugaccugcacgauggcgcc

SEQ ID NO: 2435336 - RNA, 18 nt, Bordetella pertussis
gcugacgaaacgcgcguc

SEQ ID NO: 2435337 - RNA, 21 nt, Bordetella pertussis
gcugacgaagggauagcgccg

SEQ ID NO: 2435338 - RNA, 14 nt, Bordetella pertussis
gcugacgcccggcu

SEQ ID NO: 2435339 - RNA, 18 nt, Bordetella pertussis
gcugacgcccggcucgcu

SEQ ID NO: 2435340 - RNA, 20 nt, Bordetella pertussis
gcugacgcccggcucgcugu

SEQ ID NO: 2435341 - RNA, 20 nt, Bordetella pertussis
gcugacgcgauacugcgcau

SEQ ID NO: 2435342 - RNA, 22 nt, Bordetella pertussis
gcugacgguaagcaccagguug

SEQ ID NO: 2435343 - RNA, 14 nt, Bordetella pertussis
gcugacggugccgg

SEQ ID NO: 2435344 - RNA, 17 nt, Bordetella pertussis
gcugacggugccggcca

SEQ ID NO: 2435345 - RNA, 18 nt, Bordetella pertussis
gcugacggugccggccag

SEQ ID NO: 2435346 - RNA, 20 nt, Bordetella pertussis
gcugacggugccggccagcc

SEQ ID NO: 2435347 - RNA, 21 nt, Bordetella pertussis
gcugagaucguccagcgacuc

SEQ ID NO: 2435348 - RNA, 13 nt, Bordetella pertussis
gcugagcaccagc

SEQ ID NO: 2435349 - RNA, 14 nt, Bordetella pertussis
gcugagcaccagca

SEQ ID NO: 2435350 - RNA, 16 nt, Bordetella pertussis
gcugagcaccagcagc

SEQ ID NO: 2435351 - RNA, 19 nt, Bordetella pertussis
gcugagcaccagcagcccc

SEQ ID NO: 2435352 - RNA, 12 nt, Bordetella pertussis
gcugagcaggcc

SEQ ID NO: 2435353 - RNA, 17 nt, Bordetella pertussis
gcugagccauuccggcu

SEQ ID NO: 2435354 - RNA, 23 nt, Bordetella pertussis
gcugagcucguguagggccuggc

SEQ ID NO: 2435355 - RNA, 18 nt, Bordetella pertussis
gcugaucacccacagcag

SEQ ID NO: 2435356 - RNA, 19 nt, Bordetella pertussis
gcugaucacccacagcagc

SEQ ID NO: 2435357 - RNA, 14 nt, Bordetella pertussis
gcugaucaggucca

SEQ ID NO: 2435358 - RNA, 13 nt, Bordetella pertussis
gcugauccgcacc

SEQ ID NO: 2435359 - RNA, 15 nt, Bordetella pertussis
gcugauccucgccag

SEQ ID NO: 2435360 - RNA, 18 nt, Bordetella pertussis
gcugauccucgccagcgg

SEQ ID NO: 2435361 - RNA, 19 nt, Bordetella pertussis
gcugauccucgccagcggc

SEQ ID NO: 2435362 - RNA, 19 nt, Bordetella pertussis
gcugaucgacaugcuggcc

SEQ ID NO: 2435363 - RNA, 24 nt, Bordetella pertussis
gcugaucgacaugcuggcccagcu

SEQ ID NO: 2435364 - RNA, 20 nt, Bordetella pertussis
gcugaucgccggcgccccca

SEQ ID NO: 2435365 - RNA, 20 nt, Bordetella pertussis
gcugaucggccgacugcugu

SEQ ID NO: 2435366 - RNA, 15 nt, Bordetella pertussis
gcugaucucggccug

SEQ ID NO: 2435367 - RNA, 16 nt, Bordetella pertussis
gcugaucuuccugggc

SEQ ID NO: 2435368 - RNA, 19 nt, Bordetella pertussis
gcugaucuugaugcggccg

SEQ ID NO: 2435369 - RNA, 18 nt, Bordetella pertussis
gcugaugagaucgcccgc

SEQ ID NO: 2435370 - RNA, 14 nt, Bordetella pertussis
gcugaugcaggccu

SEQ ID NO: 2435371 - RNA, 15 nt, Bordetella pertussis
gcugaugcaggccug

SEQ ID NO: 2435372 - RNA, 19 nt, Bordetella pertussis
gcugaugcccagcccggcu

SEQ ID NO: 2435373 - RNA, 17 nt, Bordetella pertussis
gcugaugcgcggcgggc

SEQ ID NO: 2435374 - RNA, 12 nt, Bordetella pertussis
gcugaugcgcgu

SEQ ID NO: 2435375 - RNA, 21 nt, Bordetella pertussis
gcugaugcgcgucaggcgagc

SEQ ID NO: 2435376 - RNA, 14 nt, Bordetella pertussis
gcugaugcuggcau

SEQ ID NO: 2435377 - RNA, 12 nt, Bordetella pertussis
gcugauggccgc

SEQ ID NO: 2435378 - RNA, 21 nt, Bordetella pertussis
gcugauggccgccagcggcug

SEQ ID NO: 2435379 - RNA, 14 nt, Bordetella pertussis
gcugauggccuugg

SEQ ID NO: 2435380 - RNA, 16 nt, Bordetella pertussis
gcugauggccuuggag

SEQ ID NO: 2435381 - RNA, 17 nt, Bordetella pertussis
gcugauggcggucacca

SEQ ID NO: 2435382 - RNA, 12 nt, Bordetella pertussis
gcugauuucgau

SEQ ID NO: 2435383 - RNA, 17 nt, Bordetella pertussis
gcugcaagacgcccagg

SEQ ID NO: 2435384 - RNA, 18 nt, Bordetella pertussis
gcugcaagacgcccaggc

SEQ ID NO: 2435385 - RNA, 20 nt, Bordetella pertussis
gcugcaagacgcccaggccc

SEQ ID NO: 2435386 - RNA, 22 nt, Bordetella pertussis
gcugcaaggacaccaugauggc

SEQ ID NO: 2435387 - RNA, 14 nt, Bordetella pertussis
gcugccggauuggc

SEQ ID NO: 2435388 - RNA, 15 nt, Bordetella pertussis
gcugccggcagcagg

SEQ ID NO: 2435389 - RNA, 11 nt, Bordetella pertussis
gcugccggcau

SEQ ID NO: 2435390 - RNA, 13 nt, Bordetella pertussis
gcugccggcauug

SEQ ID NO: 2435391 - RNA, 20 nt, Bordetella pertussis
gcugccggcauugcccacca

SEQ ID NO: 2435392 - RNA, 21 nt, Bordetella pertussis
gcugccggcauugcccaccac

SEQ ID NO: 2435393 - RNA, 13 nt, Bordetella pertussis
gcugccggccgac

SEQ ID NO: 2435394 - RNA, 13 nt, Bordetella pertussis
gcugccggcgccc

SEQ ID NO: 2435395 - RNA, 15 nt, Bordetella pertussis
gcugccggcgcccuu

SEQ ID NO: 2435396 - RNA, 15 nt, Bordetella pertussis
gcugccggcguccug

SEQ ID NO: 2435397 - RNA, 21 nt, Bordetella pertussis
gcugccggcguuggccggguc

SEQ ID NO: 2435398 - RNA, 17 nt, Bordetella pertussis
gcugccgggcucggcca

SEQ ID NO: 2435399 - RNA, 18 nt, Bordetella pertussis
gcugccgggcucggccac

SEQ ID NO: 2435400 - RNA, 20 nt, Bordetella pertussis
gcugccguagcccaggucca

SEQ ID NO: 2435401 - RNA, 23 nt, Bordetella pertussis
gcugccguagcccagguccagcg

SEQ ID NO: 2435402 - RNA, 18 nt, Bordetella pertussis
gcugccgucgccaaagcg

SEQ ID NO: 2435403 - RNA, 14 nt, Bordetella pertussis
gcugccgucggcca

SEQ ID NO: 2435404 - RNA, 17 nt, Bordetella pertussis
gcugccgucggccagcu

SEQ ID NO: 2435405 - RNA, 13 nt, Bordetella pertussis
gcugccgucggcg

SEQ ID NO: 2435406 - RNA, 13 nt, Bordetella pertussis
gcugccgucguau

SEQ ID NO: 2435407 - RNA, 17 nt, Bordetella pertussis
gcugccgucgucgucca

SEQ ID NO: 2435408 - RNA, 17 nt, Bordetella pertussis
gcugccgugaggcagcc

SEQ ID NO: 2435409 - RNA, 12 nt, Bordetella pertussis
gcugccguggua

SEQ ID NO: 2435410 - RNA, 20 nt, Bordetella pertussis
gcugccgugguacguggacu

SEQ ID NO: 2435411 - RNA, 23 nt, Bordetella pertussis
gcugccguuucucaacccgccgg

SEQ ID NO: 2435412 - RNA, 19 nt, Bordetella pertussis
gcugccguuuucgaucagg

SEQ ID NO: 2435413 - RNA, 19 nt, Bordetella pertussis
gcugccugaaaccgcaggc

SEQ ID NO: 2435414 - RNA, 23 nt, Bordetella pertussis
gcugccugaaaccgcaggcaagc

SEQ ID NO: 2435415 - RNA, 15 nt, Bordetella pertussis
gcugccugagcaccg

SEQ ID NO: 2435416 - RNA, 20 nt, Bordetella pertussis
gcugccugagcaccgccgcg

SEQ ID NO: 2435417 - RNA, 18 nt, Bordetella pertussis
gcugcgaaaaagcccgcg

SEQ ID NO: 2435418 - RNA, 15 nt, Bordetella pertussis
gcugcgaaagcgcgu

SEQ ID NO: 2435419 - RNA, 17 nt, Bordetella pertussis
gcugcgaaagcgcgucg

SEQ ID NO: 2435420 - RNA, 23 nt, Bordetella pertussis
gcugcgaaaggccgagccauugu

SEQ ID NO: 2435421 - RNA, 12 nt, Bordetella pertussis
gcugcgacagca

SEQ ID NO: 2435422 - RNA, 14 nt, Bordetella pertussis
gcugcgacagcagc

SEQ ID NO: 2435423 - RNA, 17 nt, Bordetella pertussis
gcugcgacagcagcaug

SEQ ID NO: 2435424 - RNA, 18 nt, Bordetella pertussis
gcugcgacagcagggcca

SEQ ID NO: 2435425 - RNA, 19 nt, Bordetella pertussis
gcugcgacagcagggccag

SEQ ID NO: 2435426 - RNA, 16 nt, Bordetella pertussis
gcugcgacaggcgcag

SEQ ID NO: 2435427 - RNA, 19 nt, Bordetella pertussis
gcugcgacaggcgcagcuc

SEQ ID NO: 2435428 - RNA, 16 nt, Bordetella pertussis
gcugcgagacgcgcuc

SEQ ID NO: 2435429 - RNA, 21 nt, Bordetella pertussis
gcugcgagacgcgcucgcgcg

SEQ ID NO: 2435430 - RNA, 22 nt, Bordetella pertussis
gcugcgagacgcgcucgcgcgc

SEQ ID NO: 2435431 - RNA, 22 nt, Bordetella pertussis
gcugcgcaagggagaccggguu

SEQ ID NO: 2435432 - RNA, 15 nt, Bordetella pertussis
gcugcgcacgcuggc

SEQ ID NO: 2435433 - RNA, 16 nt, Bordetella pertussis
gcugcgcacgcuggcg

SEQ ID NO: 2435434 - RNA, 17 nt, Bordetella pertussis
gcugcgcacgcuggcgc

SEQ ID NO: 2435435 - RNA, 13 nt, Bordetella pertussis
gcugcgcagcagc

SEQ ID NO: 2435436 - RNA, 14 nt, Bordetella pertussis
gcugcgcagcagcg

SEQ ID NO: 2435437 - RNA, 16 nt, Bordetella pertussis
gcugcgcagcagcgcg

SEQ ID NO: 2435438 - RNA, 18 nt, Bordetella pertussis
gcugcgcagcagcgcggu

SEQ ID NO: 2435439 - RNA, 22 nt, Bordetella pertussis
gcugcgcagcagcgcgguggcc

SEQ ID NO: 2435440 - RNA, 18 nt, Bordetella pertussis
gcugcgcagcagggcggc

SEQ ID NO: 2435441 - RNA, 19 nt, Bordetella pertussis
gcugcgcagcagggcggcg

SEQ ID NO: 2435442 - RNA, 14 nt, Bordetella pertussis
gcugcgcagcgacu

SEQ ID NO: 2435443 - RNA, 15 nt, Bordetella pertussis
gcugcgcagcgacuc

SEQ ID NO: 2435444 - RNA, 23 nt, Bordetella pertussis
gcugcgcagcgacucgaacaccg

SEQ ID NO: 2435445 - RNA, 15 nt, Bordetella pertussis
gcugcgcaggcgccg

SEQ ID NO: 2435446 - RNA, 15 nt, Bordetella pertussis
gcugcgcaggcgcgc

SEQ ID NO: 2435447 - RNA, 15 nt, Bordetella pertussis
gcugcgcaggucggc

SEQ ID NO: 2435448 - RNA, 19 nt, Bordetella pertussis
gcugcgcaggucggccagg

SEQ ID NO: 2435449 - RNA, 23 nt, Bordetella pertussis
gcugcgccaacggugccaguccc

SEQ ID NO: 2435450 - RNA, 15 nt, Bordetella pertussis
gcugcgccgaggccu

SEQ ID NO: 2435451 - RNA, 17 nt, Bordetella pertussis
gcugcgccgaggccugc

SEQ ID NO: 2435452 - RNA, 13 nt, Bordetella pertussis
gcugcgccgcauu

SEQ ID NO: 2435453 - RNA, 15 nt, Bordetella pertussis
gcugcgccggcggca

SEQ ID NO: 2435454 - RNA, 22 nt, Bordetella pertussis
gcugcgccuggccgcgcugauc

SEQ ID NO: 2435455 - RNA, 13 nt, Bordetella pertussis
gcugcgccuggcg

SEQ ID NO: 2435456 - RNA, 15 nt, Bordetella pertussis
gcugcgccuggcgga

SEQ ID NO: 2435457 - RNA, 17 nt, Bordetella pertussis
gcugcgccuuggcgcgc

SEQ ID NO: 2435458 - RNA, 18 nt, Bordetella pertussis
gcugcgcgaaacggccgg

SEQ ID NO: 2435459 - RNA, 16 nt, Bordetella pertussis
gcugcgcgaacgcggc

SEQ ID NO: 2435460 - RNA, 17 nt, Bordetella pertussis
gcugcgcgaacgcggcc

SEQ ID NO: 2435461 - RNA, 18 nt, Bordetella pertussis
gcugcgcgaacgcggcca

SEQ ID NO: 2435462 - RNA, 13 nt, Bordetella pertussis
gcugcgcgaccuc

SEQ ID NO: 2435463 - RNA, 15 nt, Bordetella pertussis
gcugcgcgaggacca

SEQ ID NO: 2435464 - RNA, 21 nt, Bordetella pertussis
gcugcgcgccgccgcgcugug

SEQ ID NO: 2435465 - RNA, 14 nt, Bordetella pertussis
gcugcgcgccggcg

SEQ ID NO: 2435466 - RNA, 23 nt, Bordetella pertussis
gcugcgcgccggcgccuuggccu

SEQ ID NO: 2435467 - RNA, 16 nt, Bordetella pertussis
gcugcgcgccguggug

SEQ ID NO: 2435468 - RNA, 21 nt, Bordetella pertussis
gcugcgcgccguggugcugac

SEQ ID NO: 2435469 - RNA, 13 nt, Bordetella pertussis
gcugcgcgcgagc

SEQ ID NO: 2435470 - RNA, 19 nt, Bordetella pertussis
gcugcgcgcgcagccaggu

SEQ ID NO: 2435471 - RNA, 13 nt, Bordetella pertussis
gcugcgcgcggcc

SEQ ID NO: 2435472 - RNA, 14 nt, Bordetella pertussis
gcugcgcgcggccu

SEQ ID NO: 2435473 - RNA, 17 nt, Bordetella pertussis
gcugcgcgcggccuggc

SEQ ID NO: 2435474 - RNA, 17 nt, Bordetella pertussis
gcugcgcggcgggaccg

SEQ ID NO: 2435475 - RNA, 22 nt, Bordetella pertussis
gcugcgcggguccggcgugcca

SEQ ID NO: 2435476 - RNA, 12 nt, Bordetella pertussis
gcugcgcgguca

SEQ ID NO: 2435477 - RNA, 14 nt, Bordetella pertussis
gcugcgcgucggca

SEQ ID NO: 2435478 - RNA, 22 nt, Bordetella pertussis
gcugcgcgugcacgaccugcca

SEQ ID NO: 2435479 - RNA, 18 nt, Bordetella pertussis
gcugcggccccggcacca

SEQ ID NO: 2435480 - RNA, 12 nt, Bordetella pertussis
gcugcggcggga

SEQ ID NO: 2435481 - RNA, 15 nt, Bordetella pertussis
gcugcggcguggcgc

SEQ ID NO: 2435482 - RNA, 17 nt, Bordetella pertussis
gcugcggcguggcgccg

SEQ ID NO: 2435483 - RNA, 19 nt, Bordetella pertussis
gcugcggcuccugcuggcg

SEQ ID NO: 2435484 - RNA, 20 nt, Bordetella pertussis
gcugcggcuccugcuggcgc

SEQ ID NO: 2435485 - RNA, 14 nt, Bordetella pertussis
gcugcgggccggcg

SEQ ID NO: 2435486 - RNA, 17 nt, Bordetella pertussis
gcugcgggccggcgccg

SEQ ID NO: 2435487 - RNA, 15 nt, Bordetella pertussis
gcugcgggcggccug

SEQ ID NO: 2435488 - RNA, 16 nt, Bordetella pertussis
gcugcgggucgaguug

SEQ ID NO: 2435489 - RNA, 22 nt, Bordetella pertussis
gcugcgggucgaguugcgcgcc

SEQ ID NO: 2435490 - RNA, 15 nt, Bordetella pertussis
gcugcguccaccacc

SEQ ID NO: 2435491 - RNA, 17 nt, Bordetella pertussis
gcugcgucuugagcagg

SEQ ID NO: 2435492 - RNA, 15 nt, Bordetella pertussis
gcugcgugcgaucgg

SEQ ID NO: 2435493 - RNA, 14 nt, Bordetella pertussis
gcugcuaugccgug

SEQ ID NO: 2435494 - RNA, 16 nt, Bordetella pertussis
gcugcucaacggccac

SEQ ID NO: 2435495 - RNA, 18 nt, Bordetella pertussis
gcugcucgaaacgcugga

SEQ ID NO: 2435496 - RNA, 12 nt, Bordetella pertussis
gcugcucgacag

SEQ ID NO: 2435497 - RNA, 18 nt, Bordetella pertussis
gcugcucgacagcagccc

SEQ ID NO: 2435498 - RNA, 23 nt, Bordetella pertussis
gcugcucgacagcagcccgcugg

SEQ ID NO: 2435499 - RNA, 14 nt, Bordetella pertussis
gcugcucgagcaug

SEQ ID NO: 2435500 - RNA, 17 nt, Bordetella pertussis
gcugcucgagcaugcgg

SEQ ID NO: 2435501 - RNA, 22 nt, Bordetella pertussis
gcuggcccacucggugcgcgcg

SEQ ID NO: 2435502 - RNA, 17 nt, Bordetella pertussis
gcuggcccagaccaagc

SEQ ID NO: 2435503 - RNA, 19 nt, Bordetella pertussis
gcuggcccagaccaagcgc

SEQ ID NO: 2435504 - RNA, 15 nt, Bordetella pertussis
gcuggcccagcuggg

SEQ ID NO: 2435505 - RNA, 16 nt, Bordetella pertussis
gcuggcccagcugggc

SEQ ID NO: 2435506 - RNA, 19 nt, Bordetella pertussis
gcuggcccaggaaaccggc

SEQ ID NO: 2435507 - RNA, 19 nt, Bordetella pertussis
gcuggcccaguucgcgcag

SEQ ID NO: 2435508 - RNA, 21 nt, Bordetella pertussis
gcuggcccaguucgcgcagca

SEQ ID NO: 2435509 - RNA, 16 nt, Bordetella pertussis
gcuggccccagaugcc

SEQ ID NO: 2435510 - RNA, 14 nt, Bordetella pertussis
gcuggcccgccagc

SEQ ID NO: 2435511 - RNA, 15 nt, Bordetella pertussis
gcuggcccgccagca

SEQ ID NO: 2435512 - RNA, 16 nt, Bordetella pertussis
gcuggcccgccagcaa

SEQ ID NO: 2435513 - RNA, 17 nt, Bordetella pertussis
gcuggcccgccagcaag

SEQ ID NO: 2435514 - RNA, 20 nt, Bordetella pertussis
gcuggcccgccagcaaggcg

SEQ ID NO: 2435515 - RNA, 11 nt, Bordetella pertussis
gcuggcccggg

SEQ ID NO: 2435516 - RNA, 19 nt, Bordetella pertussis
gcuggcccuggcagacgua

SEQ ID NO: 2435517 - RNA, 14 nt, Bordetella pertussis
gcuggcccugggcu

SEQ ID NO: 2435518 - RNA, 18 nt, Bordetella pertussis
gcuggccgacgcgcuggu

SEQ ID NO: 2435519 - RNA, 20 nt, Bordetella pertussis
gcuggccgccgcgcucaccg

SEQ ID NO: 2435520 - RNA, 14 nt, Bordetella pertussis
gcuggccgccgcgg

SEQ ID NO: 2435521 - RNA, 15 nt, Bordetella pertussis
gcuggccgccgcggc

SEQ ID NO: 2435522 - RNA, 18 nt, Bordetella pertussis
gcuggccgccgcggccuc

SEQ ID NO: 2435523 - RNA, 14 nt, Bordetella pertussis
gcuggccgccggcg

SEQ ID NO: 2435524 - RNA, 14 nt, Bordetella pertussis
gcuggccgccugcu

SEQ ID NO: 2435525 - RNA, 16 nt, Bordetella pertussis
gcuggccgccugcugc

SEQ ID NO: 2435526 - RNA, 18 nt, Bordetella pertussis
gcuggccgcgcccgccgc

SEQ ID NO: 2435527 - RNA, 19 nt, Bordetella pertussis
gcuggccggauauuucgcc

SEQ ID NO: 2435528 - RNA, 14 nt, Bordetella pertussis
gcuggccggccagc

SEQ ID NO: 2435529 - RNA, 16 nt, Bordetella pertussis
gcuggccggccccauc

SEQ ID NO: 2435530 - RNA, 19 nt, Bordetella pertussis
gcuggccggccccauccuc

SEQ ID NO: 2435531 - RNA, 16 nt, Bordetella pertussis
gcuggccggcgacuuc

SEQ ID NO: 2435532 - RNA, 21 nt, Bordetella pertussis
gcuggccgucgccgcccugcu

SEQ ID NO: 2435533 - RNA, 23 nt, Bordetella pertussis
gcuggccgucgccgcccugcugc

SEQ ID NO: 2435534 - RNA, 20 nt, Bordetella pertussis
gcuggccugccgcgccgacc

SEQ ID NO: 2435535 - RNA, 18 nt, Bordetella pertussis
gcuggccuggccgccggc

SEQ ID NO: 2435536 - RNA, 17 nt, Bordetella pertussis
gcuggcgaagaacaccg

SEQ ID NO: 2435537 - RNA, 19 nt, Bordetella pertussis
gcuggcgaagaacaccgcc

SEQ ID NO: 2435538 - RNA, 20 nt, Bordetella pertussis
gcuggcgaagaacaccgccg

SEQ ID NO: 2435539 - RNA, 17 nt, Bordetella pertussis
gcuggcgaagaccguga

SEQ ID NO: 2435540 - RNA, 17 nt, Bordetella pertussis
gcuggcgagcauggcau

SEQ ID NO: 2435541 - RNA, 19 nt, Bordetella pertussis
gcuggcgaucaggccgccc

SEQ ID NO: 2435542 - RNA, 15 nt, Bordetella pertussis
gcuggcgaugcccac

SEQ ID NO: 2435543 - RNA, 20 nt, Bordetella pertussis
gcuggcgaugcccaccagcc

SEQ ID NO: 2435544 - RNA, 15 nt, Bordetella pertussis
gcuggcgaugcgggc

SEQ ID NO: 2435545 - RNA, 17 nt, Bordetella pertussis
gcuggcgaugcgggcca

SEQ ID NO: 2435546 - RNA, 18 nt, Bordetella pertussis
gcuggcgaugcgggccac

SEQ ID NO: 2435547 - RNA, 22 nt, Bordetella pertussis
gcuggcgaugguggauccgccg

SEQ ID NO: 2435548 - RNA, 16 nt, Bordetella pertussis
gcuggcgcacgaugag

SEQ ID NO: 2435549 - RNA, 15 nt, Bordetella pertussis
gcuggcgcagcacgc

SEQ ID NO: 2435550 - RNA, 15 nt, Bordetella pertussis
gcuggcgcagcagcg

SEQ ID NO: 2435551 - RNA, 21 nt, Bordetella pertussis
gcuggcgcagcagcgccggca

SEQ ID NO: 2435552 - RNA, 23 nt, Bordetella pertussis
gcuggcgcagcaggcgcgcggcc

SEQ ID NO: 2435553 - RNA, 15 nt, Bordetella pertussis
gcuggcgcagguccu

SEQ ID NO: 2435554 - RNA, 20 nt, Bordetella pertussis
gcuggcgcaguaucccggcc

SEQ ID NO: 2435555 - RNA, 16 nt, Bordetella pertussis
gcuggcgcauggcugg

SEQ ID NO: 2435556 - RNA, 14 nt, Bordetella pertussis
gcuggcgcccgccu

SEQ ID NO: 2435557 - RNA, 14 nt, Bordetella pertussis
gcuggcgcccggcc

SEQ ID NO: 2435558 - RNA, 15 nt, Bordetella pertussis
gcuggcgcccggccu

SEQ ID NO: 2435559 - RNA, 21 nt, Bordetella pertussis
gcuggcgcccggccugcgggc

SEQ ID NO: 2435560 - RNA, 12 nt, Bordetella pertussis
gcuggcgccgcg

SEQ ID NO: 2435561 - RNA, 17 nt, Bordetella pertussis
gcuggcgccgcgcgcca

SEQ ID NO: 2435562 - RNA, 19 nt, Bordetella pertussis
gcuggcgccgcgcgccauc

SEQ ID NO: 2435563 - RNA, 20 nt, Bordetella pertussis
gcuggcgcgagaaccaggcc

SEQ ID NO: 2435564 - RNA, 13 nt, Bordetella pertussis
gcuggcgcgcacc

SEQ ID NO: 2435565 - RNA, 16 nt, Bordetella pertussis
gcuggcgcgcaccauc

SEQ ID NO: 2435566 - RNA, 18 nt, Bordetella pertussis
gcuggcgcgcaccaucgc

SEQ ID NO: 2435567 - RNA, 14 nt, Bordetella pertussis
gcuggcgcgcggcc

SEQ ID NO: 2435568 - RNA, 16 nt, Bordetella pertussis
gcuggcgcgcuguucg

SEQ ID NO: 2435569 - RNA, 17 nt, Bordetella pertussis
gcuggcgcggaccugcu

SEQ ID NO: 2435570 - RNA, 14 nt, Bordetella pertussis
gcuggcgcggccgu

SEQ ID NO: 2435571 - RNA, 16 nt, Bordetella pertussis
gcuggcgcgggcggcc

SEQ ID NO: 2435572 - RNA, 14 nt, Bordetella pertussis
gcuggcgcggucca

SEQ ID NO: 2435573 - RNA, 18 nt, Bordetella pertussis
gcuggcgcgucggcgcgc

SEQ ID NO: 2435574 - RNA, 18 nt, Bordetella pertussis
gcuggcgcguggccgcca

SEQ ID NO: 2435575 - RNA, 17 nt, Bordetella pertussis
gcuggcgcucgggcgcg

SEQ ID NO: 2435576 - RNA, 12 nt, Bordetella pertussis
gcuggcgcugcu

SEQ ID NO: 2435577 - RNA, 17 nt, Bordetella pertussis
gcuggcgcuggccgccc

SEQ ID NO: 2435578 - RNA, 19 nt, Bordetella pertussis
gcuggcgcuggccgcccgc

SEQ ID NO: 2435579 - RNA, 17 nt, Bordetella pertussis
gcuggcgcuuggccagc

SEQ ID NO: 2435580 - RNA, 18 nt, Bordetella pertussis
gcuggcgcuuggccagcu

SEQ ID NO: 2435581 - RNA, 14 nt, Bordetella pertussis
gcuggcggccgugc

SEQ ID NO: 2435582 - RNA, 18 nt, Bordetella pertussis
gcuggcggcgcagcacca

SEQ ID NO: 2435583 - RNA, 16 nt, Bordetella pertussis
gcuggcggcgcaggcc

SEQ ID NO: 2435584 - RNA, 14 nt, Bordetella pertussis
gcuggcggcgcgcg

SEQ ID NO: 2435585 - RNA, 20 nt, Bordetella pertussis
gcuggcggcgcgcggcuggg

SEQ ID NO: 2435586 - RNA, 16 nt, Bordetella pertussis
gcuggcggcgcugguc

SEQ ID NO: 2435587 - RNA, 17 nt, Bordetella pertussis
gcuggcgguggccgcgc

SEQ ID NO: 2435588 - RNA, 18 nt, Bordetella pertussis
gcuggcgguggccgcgca

SEQ ID NO: 2435589 - RNA, 13 nt, Bordetella pertussis
gcuggcguccagg

SEQ ID NO: 2435590 - RNA, 19 nt, Bordetella pertussis
gcuggcguugacguggcug

SEQ ID NO: 2435591 - RNA, 17 nt, Bordetella pertussis
gcuggcguuugcgcgcg

SEQ ID NO: 2435592 - RNA, 16 nt, Bordetella pertussis
gcuggcugagcaggcc

SEQ ID NO: 2435593 - RNA, 16 nt, Bordetella pertussis
gcuggcugcccuggcg

SEQ ID NO: 2435594 - RNA, 16 nt, Bordetella pertussis
gcuggcuggacgcgcg

SEQ ID NO: 2435595 - RNA, 17 nt, Bordetella pertussis
gcuggcuggacgcgcgc

SEQ ID NO: 2435596 - RNA, 13 nt, Bordetella pertussis
gcuggcugggccu

SEQ ID NO: 2435597 - RNA, 14 nt, Bordetella pertussis
gcuggcugggccug

SEQ ID NO: 2435598 - RNA, 17 nt, Bordetella pertussis
gcuggcugggcgcgccg

SEQ ID NO: 2435599 - RNA, 20 nt, Bordetella pertussis
gcuggcugggcgcgccgcug

SEQ ID NO: 2435600 - RNA, 19 nt, Bordetella pertussis
gcuggcugugcccgcccca

SEQ ID NO: 2435601 - RNA, 14 nt, Bordetella pertussis
gcuggcuucggcgc

SEQ ID NO: 2435602 - RNA, 16 nt, Bordetella pertussis
gcuggcuucggcgcug

SEQ ID NO: 2435603 - RNA, 17 nt, Bordetella pertussis
gcuggcuucggcgcugg

SEQ ID NO: 2435604 - RNA, 18 nt, Bordetella pertussis
gcuggcuucggcgcuggg

SEQ ID NO: 2435605 - RNA, 20 nt, Bordetella pertussis
gcuggcuucggcgcugggcg

SEQ ID NO: 2435606 - RNA, 18 nt, Bordetella pertussis
gcuggcuucgucgccggc

SEQ ID NO: 2435607 - RNA, 21 nt, Bordetella pertussis
gcuggcuucgucgccggcguu

SEQ ID NO: 2435608 - RNA, 12 nt, Bordetella pertussis
gcugggacaggc

SEQ ID NO: 2435609 - RNA, 14 nt, Bordetella pertussis
gcugggacaggcac

SEQ ID NO: 2435610 - RNA, 18 nt, Bordetella pertussis
gcugggacaggcacucug

SEQ ID NO: 2435611 - RNA, 16 nt, Bordetella pertussis
gcugggagagccggcc

SEQ ID NO: 2435612 - RNA, 22 nt, Bordetella pertussis
gcugggaggcgugcugcaccug

SEQ ID NO: 2435613 - RNA, 21 nt, Bordetella pertussis
gcugggauggguacgccggcc

SEQ ID NO: 2435614 - RNA, 16 nt, Bordetella pertussis
gcugggcacauccagc

SEQ ID NO: 2435615 - RNA, 17 nt, Bordetella pertussis
gcuguccggcgcucgcc

SEQ ID NO: 2435616 - RNA, 20 nt, Bordetella pertussis
gcuguccuggcguggccguu

SEQ ID NO: 2435617 - RNA, 18 nt, Bordetella pertussis
gcuguccuucguggcgcc

SEQ ID NO: 2435618 - RNA, 18 nt, Bordetella pertussis
gcugucgcaggcgcugca

SEQ ID NO: 2435619 - RNA, 21 nt, Bordetella pertussis
gcugucgcagucggggccgca

SEQ ID NO: 2435620 - RNA, 17 nt, Bordetella pertussis
gcugucgcgcgacuggc

SEQ ID NO: 2435621 - RNA, 14 nt, Bordetella pertussis
gcugucgcgcgggu

SEQ ID NO: 2435622 - RNA, 22 nt, Bordetella pertussis
gcugucgcgcuacagcguggug

SEQ ID NO: 2435623 - RNA, 14 nt, Bordetella pertussis
gcugucgcgcugcc

SEQ ID NO: 2435624 - RNA, 20 nt, Bordetella pertussis
gcugucgcucaugaccagcg

SEQ ID NO: 2435625 - RNA, 22 nt, Bordetella pertussis
gcugucgcucaugaccagcggc

SEQ ID NO: 2435626 - RNA, 23 nt, Bordetella pertussis
gcugucgcucaugaccagcggcg

SEQ ID NO: 2435627 - RNA, 23 nt, Bordetella pertussis
gcugucggcgaugaacagguacc

SEQ ID NO: 2435628 - RNA, 15 nt, Bordetella pertussis
gcugucggcgcuggc

SEQ ID NO: 2435629 - RNA, 16 nt, Bordetella pertussis
gcugucggcgcuggcc

SEQ ID NO: 2435630 - RNA, 17 nt, Bordetella pertussis
gcugucgggcggcgccu

SEQ ID NO: 2435631 - RNA, 14 nt, Bordetella pertussis
gcugucggucagca

SEQ ID NO: 2435632 - RNA, 15 nt, Bordetella pertussis
gcugucggucagcac

SEQ ID NO: 2435633 - RNA, 16 nt, Bordetella pertussis
gcugucgucgucggca

SEQ ID NO: 2435634 - RNA, 18 nt, Bordetella pertussis
gcugucgucgucggcacc

SEQ ID NO: 2435635 - RNA, 16 nt, Bordetella pertussis
gcugucgugccgcacg

SEQ ID NO: 2435636 - RNA, 21 nt, Bordetella pertussis
gcugugccccacacgcgcgca

SEQ ID NO: 2435637 - RNA, 16 nt, Bordetella pertussis
gcugugccugccaagc

SEQ ID NO: 2435638 - RNA, 14 nt, Bordetella pertussis
gcugugcgauggca

SEQ ID NO: 2435639 - RNA, 15 nt, Bordetella pertussis
gcugugcgauggcac

SEQ ID NO: 2435640 - RNA, 19 nt, Bordetella pertussis
gcugugcgccggggcgccg

SEQ ID NO: 2435641 - RNA, 13 nt, Bordetella pertussis
gcugugcgcggcg

SEQ ID NO: 2435642 - RNA, 18 nt, Bordetella pertussis
gcugugcgcguuccggcc

SEQ ID NO: 2435643 - RNA, 20 nt, Bordetella pertussis
gcugugcgcguuccggccgc

SEQ ID NO: 2435644 - RNA, 19 nt, Bordetella pertussis
gcuguggacgccgccggcc

SEQ ID NO: 2435645 - RNA, 13 nt, Bordetella pertussis
gcuguggccgcgg

SEQ ID NO: 2435646 - RNA, 16 nt, Bordetella pertussis
gcuguggccgcggccc

SEQ ID NO: 2435647 - RNA, 14 nt, Bordetella pertussis
gcuguggcgcgcca

SEQ ID NO: 2435648 - RNA, 12 nt, Bordetella pertussis
gcuguuccagcc

SEQ ID NO: 2435649 - RNA, 17 nt, Bordetella pertussis
gcuguuccagccaguac

SEQ ID NO: 2435650 - RNA, 16 nt, Bordetella pertussis
gcuguucggcgaccgc

SEQ ID NO: 2435651 - RNA, 21 nt, Bordetella pertussis
gcuguucggcgaccgccggcc

SEQ ID NO: 2435652 - RNA, 19 nt, Bordetella pertussis
gcuguucggcgagccgggc

SEQ ID NO: 2435653 - RNA, 14 nt, Bordetella pertussis
gcuguucgggcgcg

SEQ ID NO: 2435654 - RNA, 16 nt, Bordetella pertussis
gcuguucgggcgcggu

SEQ ID NO: 2435655 - RNA, 14 nt, Bordetella pertussis
gcuguucggggcag

SEQ ID NO: 2435656 - RNA, 19 nt, Bordetella pertussis
gcuguucggggcagggcgc

SEQ ID NO: 2435657 - RNA, 22 nt, Bordetella pertussis
gcuguucggggcagggcgccug

SEQ ID NO: 2435658 - RNA, 21 nt, Bordetella pertussis
gcuguucuucggcaaccgcgc

SEQ ID NO: 2435659 - RNA, 23 nt, Bordetella pertussis
gcuguucuucggcaaccgcgccu

SEQ ID NO: 2435660 - RNA, 16 nt, Bordetella pertussis
gcuguugaggaugugc

SEQ ID NO: 2435661 - RNA, 16 nt, Bordetella pertussis
gcuguugcccaccagc

SEQ ID NO: 2435662 - RNA, 17 nt, Bordetella pertussis
gcuguugcccaccagcc

SEQ ID NO: 2435663 - RNA, 19 nt, Bordetella pertussis
gcuguugcuccaggccggc

SEQ ID NO: 2435664 - RNA, 22 nt, Bordetella pertussis
gcuguugcuccaggccggcaug

SEQ ID NO: 2435665 - RNA, 13 nt, Bordetella pertussis
gcuguugcuggcc

SEQ ID NO: 2435666 - RNA, 18 nt, Bordetella pertussis
gcuguuggcguggcuggc

SEQ ID NO: 2435667 - RNA, 22 nt, Bordetella pertussis
gcuguuuuucauuugccgccug

SEQ ID NO: 2435668 - RNA, 13 nt, Bordetella pertussis
gcuuaccaggcgu

SEQ ID NO: 2435669 - RNA, 19 nt, Bordetella pertussis
gcuuacuggaucuuggccu

SEQ ID NO: 2435670 - RNA, 15 nt, Bordetella pertussis
gcuuagcgcagcagc

SEQ ID NO: 2435671 - RNA, 18 nt, Bordetella pertussis
gcuuaucgcggcgcggcg

SEQ ID NO: 2435672 - RNA, 21 nt, Bordetella pertussis
gcuucacccuggaugccaugc

SEQ ID NO: 2435673 - RNA, 13 nt, Bordetella pertussis
gcuucaggcgcgc

SEQ ID NO: 2435674 - RNA, 14 nt, Bordetella pertussis
gcuucaggcgcgcg

SEQ ID NO: 2435675 - RNA, 20 nt, Bordetella pertussis
gcuucaggcuggccugcagg

SEQ ID NO: 2435676 - RNA, 23 nt, Bordetella pertussis
gcuucagugcucgggcugcggcu

SEQ ID NO: 2435677 - RNA, 15 nt, Bordetella pertussis
gcuucaguuccaggc

SEQ ID NO: 2435678 - RNA, 14 nt, Bordetella pertussis
gcuucaucaccuuc

SEQ ID NO: 2435679 - RNA, 14 nt, Bordetella pertussis
gcuucaugccggcg

SEQ ID NO: 2435680 - RNA, 15 nt, Bordetella pertussis
gcuucaugccggcgu

SEQ ID NO: 2435681 - RNA, 13 nt, Bordetella pertussis
gcuucaugcgcuc

SEQ ID NO: 2435682 - RNA, 16 nt, Bordetella pertussis
gcuuccaccgucuggc

SEQ ID NO: 2435683 - RNA, 20 nt, Bordetella pertussis
gcuuccagaucgaccaggac

SEQ ID NO: 2435684 - RNA, 16 nt, Bordetella pertussis
gcuucccgguccaggc

SEQ ID NO: 2435685 - RNA, 18 nt, Bordetella pertussis
gcuucccgguccaggccg

SEQ ID NO: 2435686 - RNA, 15 nt, Bordetella pertussis
gcuucccguggcuga

SEQ ID NO: 2435687 - RNA, 15 nt, Bordetella pertussis
gcuuccggccgggcc

SEQ ID NO: 2435688 - RNA, 16 nt, Bordetella pertussis
gcuuccggccgggcca

SEQ ID NO: 2435689 - RNA, 16 nt, Bordetella pertussis
gcuuccucgaccaggu

SEQ ID NO: 2435690 - RNA, 19 nt, Bordetella pertussis
gcuuccucgaccaggucca

SEQ ID NO: 2435691 - RNA, 13 nt, Bordetella pertussis
gcuuccugcaccu

SEQ ID NO: 2435692 - RNA, 12 nt, Bordetella pertussis
gcuuccugcggc

SEQ ID NO: 2435693 - RNA, 12 nt, Bordetella pertussis
gcuuccugcugc

SEQ ID NO: 2435694 - RNA, 19 nt, Bordetella pertussis
gcuuccugcugcgccuggc

SEQ ID NO: 2435695 - RNA, 15 nt, Bordetella pertussis
gcuuccugggccugc

SEQ ID NO: 2435696 - RNA, 13 nt, Bordetella pertussis
gcuuccuggucac

SEQ ID NO: 2435697 - RNA, 17 nt, Bordetella pertussis
gcuuccuugcgguugaa

SEQ ID NO: 2435698 - RNA, 18 nt, Bordetella pertussis
gcuucgaacgacuugggc

SEQ ID NO: 2435699 - RNA, 17 nt, Bordetella pertussis
gcuucgaccacgcggcg

SEQ ID NO: 2435700 - RNA, 15 nt, Bordetella pertussis
gcuucgacggcuugc

SEQ ID NO: 2435701 - RNA, 19 nt, Bordetella pertussis
gcuucgagauccgccggcg

SEQ ID NO: 2435702 - RNA, 20 nt, Bordetella pertussis
gcuucgagauccgccggcga

SEQ ID NO: 2435703 - RNA, 17 nt, Bordetella pertussis
gcuucgaucaugcccgc

SEQ ID NO: 2435704 - RNA, 20 nt, Bordetella pertussis
gcuucgaugcuggcggcauc

SEQ ID NO: 2435705 - RNA, 15 nt, Bordetella pertussis
gcuucgcccagcgcu

SEQ ID NO: 2435706 - RNA, 18 nt, Bordetella pertussis
gcuucgcccagcgcuugc

SEQ ID NO: 2435707 - RNA, 13 nt, Bordetella pertussis
gcuucgcccgcca

SEQ ID NO: 2435708 - RNA, 18 nt, Bordetella pertussis
gcuucgcccgccaccacg

SEQ ID NO: 2435709 - RNA, 16 nt, Bordetella pertussis
gcuucgcgcacaucca

SEQ ID NO: 2435710 - RNA, 16 nt, Bordetella pertussis
gcuucgcgcagcaagu

SEQ ID NO: 2435711 - RNA, 17 nt, Bordetella pertussis
gcuucggacagcaguuu

SEQ ID NO: 2435712 - RNA, 16 nt, Bordetella pertussis
gcuucggccugcgcca

SEQ ID NO: 2435713 - RNA, 15 nt, Bordetella pertussis
gcuucggcgcugggc

SEQ ID NO: 2435714 - RNA, 15 nt, Bordetella pertussis
gcuucggcggccaug

SEQ ID NO: 2435715 - RNA, 17 nt, Bordetella pertussis
gcuucggcggccauggc

SEQ ID NO: 2435716 - RNA, 16 nt, Bordetella pertussis
gcuucggcggccgcgu

SEQ ID NO: 2435717 - RNA, 18 nt, Bordetella pertussis
gcuucggcguacugcugc

SEQ ID NO: 2435718 - RNA, 19 nt, Bordetella pertussis
gcuucggcguacugcugca

SEQ ID NO: 2435719 - RNA, 21 nt, Bordetella pertussis
gcuucggcguacugcugcaag

SEQ ID NO: 2435720 - RNA, 13 nt, Bordetella pertussis
gcuucgggcagcu

SEQ ID NO: 2435721 - RNA, 21 nt, Bordetella pertussis
gcuucgggcagcucgcgcgcu

SEQ ID NO: 2435722 - RNA, 15 nt, Bordetella pertussis
gcuucggucagcugc

SEQ ID NO: 2435723 - RNA, 16 nt, Bordetella pertussis
gcuucggucagcugcu

SEQ ID NO: 2435724 - RNA, 17 nt, Bordetella pertussis
gcuucggucagcugcug

SEQ ID NO: 2435725 - RNA, 17 nt, Bordetella pertussis
gcuucgguggcgcgcaa

SEQ ID NO: 2435726 - RNA, 21 nt, Bordetella pertussis
gcuucgguggcgcgcaacacg

SEQ ID NO: 2435727 - RNA, 22 nt, Bordetella pertussis
gcuucgguggcgcgcaacacgc

SEQ ID NO: 2435728 - RNA, 16 nt, Bordetella pertussis
gcuucgucauggucga

SEQ ID NO: 2435729 - RNA, 18 nt, Bordetella pertussis
gcuuggcgcgcagcagcg

SEQ ID NO: 2435730 - RNA, 20 nt, Bordetella pertussis
gcuuggcgcgcagcagcgca

SEQ ID NO: 2435731 - RNA, 13 nt, Bordetella pertussis
gcuuggcggccag

SEQ ID NO: 2435732 - RNA, 14 nt, Bordetella pertussis
gcuuggcggccagg

SEQ ID NO: 2435733 - RNA, 15 nt, Bordetella pertussis
gcuuggcggccagga

SEQ ID NO: 2435734 - RNA, 20 nt, Bordetella pertussis
gcuuggcggccaggaucgcg

SEQ ID NO: 2435735 - RNA, 13 nt, Bordetella pertussis
gcuuggcggucug

SEQ ID NO: 2435736 - RNA, 17 nt, Bordetella pertussis
gcuuggcggucugggcg

SEQ ID NO: 2435737 - RNA, 21 nt, Bordetella pertussis
gcuuggcggucugggcguccc

SEQ ID NO: 2435738 - RNA, 18 nt, Bordetella pertussis
gcuuggcguacggcugca

SEQ ID NO: 2435739 - RNA, 15 nt, Bordetella pertussis
gcuuggcguagccgg

SEQ ID NO: 2435740 - RNA, 15 nt, Bordetella pertussis
gcuuggcgugcgcga

SEQ ID NO: 2435741 - RNA, 23 nt, Bordetella pertussis
gcuugggacgcuucgagaugccg

SEQ ID NO: 2435742 - RNA, 14 nt, Bordetella pertussis
gcuugggcccggcg

SEQ ID NO: 2435743 - RNA, 15 nt, Bordetella pertussis
gcuugggcccggcgu

SEQ ID NO: 2435744 - RNA, 21 nt, Bordetella pertussis
gcuugggcccggcguagcugc

SEQ ID NO: 2435745 - RNA, 13 nt, Bordetella pertussis
gcuugggccgcgc

SEQ ID NO: 2435746 - RNA, 14 nt, Bordetella pertussis
gcuuggggcgcgcc

SEQ ID NO: 2435747 - RNA, 14 nt, Bordetella pertussis
gcuugggggcgugg

SEQ ID NO: 2435748 - RNA, 17 nt, Bordetella pertussis
gcuuggucagcaucagc

SEQ ID NO: 2435749 - RNA, 17 nt, Bordetella pertussis
gcuugguugucgcgcac

SEQ ID NO: 2435750 - RNA, 19 nt, Bordetella pertussis
gcuuguaccccauaguccu

SEQ ID NO: 2435751 - RNA, 17 nt, Bordetella pertussis
gcuuguagcccucgguc

SEQ ID NO: 2435752 - RNA, 18 nt, Bordetella pertussis
gcuuguagcccucggucg

SEQ ID NO: 2435753 - RNA, 16 nt, Bordetella pertussis
gcuuguagcggccauc

SEQ ID NO: 2435754 - RNA, 14 nt, Bordetella pertussis
gcuugucgaugacg

SEQ ID NO: 2435755 - RNA, 18 nt, Bordetella pertussis
gcuugucgauuaugccgc

SEQ ID NO: 2435756 - RNA, 17 nt, Bordetella pertussis
gcuuucagauccuuggu

SEQ ID NO: 2435757 - RNA, 17 nt, Bordetella pertussis
gcuuucaugggccuggg

SEQ ID NO: 2435758 - RNA, 17 nt, Bordetella pertussis
gcuuuccaggguggcca

SEQ ID NO: 2435759 - RNA, 14 nt, Bordetella pertussis
gcuuuccgccgaga

SEQ ID NO: 2435760 - RNA, 17 nt, Bordetella pertussis
gcuuucgaagccgcccc

SEQ ID NO: 2435761 - RNA, 19 nt, Bordetella pertussis
gcuuucgaagccgccccac

SEQ ID NO: 2435762 - RNA, 17 nt, Bordetella pertussis
gcuuucgaagcgcucga

SEQ ID NO: 2435763 - RNA, 21 nt, Bordetella pertussis
gcuuucggucucgcgcggccg

SEQ ID NO: 2435764 - RNA, 18 nt, Bordetella pertussis
gcuuucugcuugccggcc

SEQ ID NO: 2435765 - RNA, 15 nt, Bordetella pertussis
gcuuugacgccggcu

SEQ ID NO: 2435766 - RNA, 17 nt, Bordetella pertussis
gcuuuggcuuggcgaau

SEQ ID NO: 2435767 - RNA, 18 nt, Bordetella pertussis
gcuuuggucuauuuccga

SEQ ID NO: 2435768 - RNA, 21 nt, Bordetella pertussis
gcuuuggucuauuuccgacga

SEQ ID NO: 2435769 - RNA, 15 nt, Bordetella pertussis
gcuuuuccacgcccg

SEQ ID NO: 2435770 - RNA, 14 nt, Bordetella pertussis
gcuuuuuccugcug

SEQ ID NO: 2435771 - RNA, 12 nt, Bordetella pertussis
gcuuuuuccugu

SEQ ID NO: 2435772 - RNA, 17 nt, Bordetella pertussis
gcuuuuuccuguucggc

SEQ ID NO: 2435773 - RNA, 13 nt, Bordetella pertussis
gcuuuuugccuug

SEQ ID NO: 2435774 - RNA, 17 nt, Bordetella pertussis
gcuuuuugccuugggca

SEQ ID NO: 2435775 - RNA, 18 nt, Bordetella pertussis
gcuuuuuguugcgcgccg

SEQ ID NO: 2435776 - RNA, 12 nt, Bordetella pertussis
gcuuuuuugccu

SEQ ID NO: 2435777 - RNA, 14 nt, Bordetella pertussis
gcuuuuuugccuug

SEQ ID NO: 2435778 - RNA, 14 nt, Bordetella pertussis
ggaaaacagcgcgg

SEQ ID NO: 2435779 - RNA, 20 nt, Bordetella pertussis
ggaaaaucgauacgccgggc

SEQ ID NO: 2435780 - RNA, 20 nt, Bordetella pertussis
ggaaacagauugaacugcug

SEQ ID NO: 2435781 - RNA, 21 nt, Bordetella pertussis
ggaaacgcccagcccugcccg

SEQ ID NO: 2435782 - RNA, 22 nt, Bordetella pertussis
ggaaacgcccagcccugcccgc

SEQ ID NO: 2435783 - RNA, 14 nt, Bordetella pertussis
ggaaacggccaagc

SEQ ID NO: 2435784 - RNA, 16 nt, Bordetella pertussis
ggaaacucgcgcagcg

SEQ ID NO: 2435785 - RNA, 18 nt, Bordetella pertussis
ggaaagaggccaggcccu

SEQ ID NO: 2435786 - RNA, 12 nt, Bordetella pertussis
ggaaagcccggc

SEQ ID NO: 2435787 - RNA, 22 nt, Bordetella pertussis
ggaaagcccggccccaggccgg

SEQ ID NO: 2435788 - RNA, 13 nt, Bordetella pertussis
ggaaagcgccgcc

SEQ ID NO: 2435789 - RNA, 18 nt, Bordetella pertussis
ggaaauccgccgggugug

SEQ ID NO: 2435790 - RNA, 23 nt, Bordetella pertussis
ggaaauccgggcgcugcgccggc

SEQ ID NO: 2435791 - RNA, 19 nt, Bordetella pertussis
ggaaauccguaguccagca

SEQ ID NO: 2435792 - RNA, 20 nt, Bordetella pertussis
ggaaaucgugccgucgauga

SEQ ID NO: 2435793 - RNA, 15 nt, Bordetella pertussis
ggaaaugccgcgcgc

SEQ ID NO: 2435794 - RNA, 15 nt, Bordetella pertussis
ggaaaugccggcggc

SEQ ID NO: 2435795 - RNA, 21 nt, Bordetella pertussis
ggaacaccaccuccaccgcca

SEQ ID NO: 2435796 - RNA, 23 nt, Bordetella pertussis
ggaacaccaccuccaccgccagc

SEQ ID NO: 2435797 - RNA, 14 nt, Bordetella pertussis
ggaacaccagcaag

SEQ ID NO: 2435798 - RNA, 20 nt, Bordetella pertussis
ggaacaccagcaagccggcg

SEQ ID NO: 2435799 - RNA, 16 nt, Bordetella pertussis
ggaacagccugcccuc

SEQ ID NO: 2435800 - RNA, 17 nt, Bordetella pertussis
ggaacaggcgcgccagc

SEQ ID NO: 2435801 - RNA, 15 nt, Bordetella pertussis
ggaacauggcgguga

SEQ ID NO: 2435802 - RNA, 22 nt, Bordetella pertussis
ggaacauggcggugaaggcgcc

SEQ ID NO: 2435803 - RNA, 13 nt, Bordetella pertussis
ggaaccagccguc

SEQ ID NO: 2435804 - RNA, 16 nt, Bordetella pertussis
ggaaccagcggcuggc

SEQ ID NO: 2435805 - RNA, 19 nt, Bordetella pertussis
ggaaccgcaccggaggcgc

SEQ ID NO: 2435806 - RNA, 14 nt, Bordetella pertussis
ggaacgccagcagc

SEQ ID NO: 2435807 - RNA, 19 nt, Bordetella pertussis
ggaacgcgccgcuggcguc

SEQ ID NO: 2435808 - RNA, 20 nt, Bordetella pertussis
ggaacggcaccagccgggcu

SEQ ID NO: 2435809 - RNA, 13 nt, Bordetella pertussis
ggaacgugccguc

SEQ ID NO: 2435810 - RNA, 18 nt, Bordetella pertussis
ggaacgugccgucgggcg

SEQ ID NO: 2435811 - RNA, 20 nt, Bordetella pertussis
ggaacgugccgucgggcgcc

SEQ ID NO: 2435812 - RNA, 22 nt, Bordetella pertussis
ggaacguuugcggacgggccag

SEQ ID NO: 2435813 - RNA, 20 nt, Bordetella pertussis
ggaacucguuggccagcgcg

SEQ ID NO: 2435814 - RNA, 13 nt, Bordetella pertussis
ggaacugggcgcc

SEQ ID NO: 2435815 - RNA, 11 nt, Bordetella pertussis
ggaacuuggga

SEQ ID NO: 2435816 - RNA, 21 nt, Bordetella pertussis
ggaagaacaccguuuccaagc

SEQ ID NO: 2435817 - RNA, 20 nt, Bordetella pertussis
ggaagacauggcgcgcgcca

SEQ ID NO: 2435818 - RNA, 14 nt, Bordetella pertussis
ggaagagggcgggg

SEQ ID NO: 2435819 - RNA, 18 nt, Bordetella pertussis
ggaagauguggucggcgc

SEQ ID NO: 2435820 - RNA, 20 nt, Bordetella pertussis
ggaagauguggucggcgccg

SEQ ID NO: 2435821 - RNA, 14 nt, Bordetella pertussis
ggaagcagcccagc

SEQ ID NO: 2435822 - RNA, 22 nt, Bordetella pertussis
ggaagccgccggcgugcccagu

SEQ ID NO: 2435823 - RNA, 14 nt, Bordetella pertussis
ggaagccgugcgca

SEQ ID NO: 2435824 - RNA, 15 nt, Bordetella pertussis
ggaagcgcagguuca

SEQ ID NO: 2435825 - RNA, 19 nt, Bordetella pertussis
ggaagcgcucgucggggug

SEQ ID NO: 2435826 - RNA, 14 nt, Bordetella pertussis
ggaagcgcuggccc

SEQ ID NO: 2435827 - RNA, 15 nt, Bordetella pertussis
ggaagcgcuggcccg

SEQ ID NO: 2435828 - RNA, 13 nt, Bordetella pertussis
ggaagcgggccug

SEQ ID NO: 2435829 - RNA, 14 nt, Bordetella pertussis
ggaagcgggccugc

SEQ ID NO: 2435830 - RNA, 19 nt, Bordetella pertussis
ggaagcugacgaaacgcgc

SEQ ID NO: 2435831 - RNA, 17 nt, Bordetella pertussis
ggaagcugucggcgcug

SEQ ID NO: 2435832 - RNA, 21 nt, Bordetella pertussis
ggaagcugucggcgcuggcca

SEQ ID NO: 2435833 - RNA, 13 nt, Bordetella pertussis
ggaaggccgccgc

SEQ ID NO: 2435834 - RNA, 23 nt, Bordetella pertussis
ggaaggccgccgcgugcgccggg

SEQ ID NO: 2435835 - RNA, 17 nt, Bordetella pertussis
ggaaggcgagcgcggca

SEQ ID NO: 2435836 - RNA, 20 nt, Bordetella pertussis
ggaaggcgagcgcggcauag

SEQ ID NO: 2435837 - RNA, 22 nt, Bordetella pertussis
ggaaggggcggcuucaggcgcg

SEQ ID NO: 2435838 - RNA, 20 nt, Bordetella pertussis
ggaagguccacggcauggcc

SEQ ID NO: 2435839 - RNA, 18 nt, Bordetella pertussis
ggaagugaugccgccggc

SEQ ID NO: 2435840 - RNA, 19 nt, Bordetella pertussis
ggaaguggccgagcgcacc

SEQ ID NO: 2435841 - RNA, 15 nt, Bordetella pertussis
ggaaguucagggcga

SEQ ID NO: 2435842 - RNA, 17 nt, Bordetella pertussis
ggacgauggccugugcg

SEQ ID NO: 2435843 - RNA, 17 nt, Bordetella pertussis
ggacgcaaaaacgcccg

SEQ ID NO: 2435844 - RNA, 23 nt, Bordetella pertussis
ggacgcaaaaacgcccggcgcgg

SEQ ID NO: 2435845 - RNA, 21 nt, Bordetella pertussis
ggacgcaaccggucggccggc

SEQ ID NO: 2435846 - RNA, 13 nt, Bordetella pertussis
ggacgcaggccca

SEQ ID NO: 2435847 - RNA, 18 nt, Bordetella pertussis
ggacgcaggcccagccag

SEQ ID NO: 2435848 - RNA, 22 nt, Bordetella pertussis
ggacgccaccagugcgccggcg

SEQ ID NO: 2435849 - RNA, 13 nt, Bordetella pertussis
ggacgccagcccg

SEQ ID NO: 2435850 - RNA, 16 nt, Bordetella pertussis
ggacgccauggcggcg

SEQ ID NO: 2435851 - RNA, 18 nt, Bordetella pertussis
ggacgccauggcggcggc

SEQ ID NO: 2435852 - RNA, 21 nt, Bordetella pertussis
ggacgccauggcggcggccac

SEQ ID NO: 2435853 - RNA, 19 nt, Bordetella pertussis
ggacgcccgcccgcugacc

SEQ ID NO: 2435854 - RNA, 18 nt, Bordetella pertussis
ggacgcccuggcgcaggc

SEQ ID NO: 2435855 - RNA, 21 nt, Bordetella pertussis
ggacgcccuggcgcaggccgg

SEQ ID NO: 2435856 - RNA, 19 nt, Bordetella pertussis
ggacgccgaccucggcacc

SEQ ID NO: 2435857 - RNA, 20 nt, Bordetella pertussis
ggacgccgaccucggcaccg

SEQ ID NO: 2435858 - RNA, 18 nt, Bordetella pertussis
ggacgccgccggcccagg

SEQ ID NO: 2435859 - RNA, 14 nt, Bordetella pertussis
ggacgccggcgccg

SEQ ID NO: 2435860 - RNA, 16 nt, Bordetella pertussis
ggacgccggcgggcag

SEQ ID NO: 2435861 - RNA, 19 nt, Bordetella pertussis
ggacgccggcgggcaggcg

SEQ ID NO: 2435862 - RNA, 14 nt, Bordetella pertussis
ggacgccucgccgg

SEQ ID NO: 2435863 - RNA, 20 nt, Bordetella pertussis
ggacgccuggcgcggcccca

SEQ ID NO: 2435864 - RNA, 13 nt, Bordetella pertussis
ggacgcgccgggc

SEQ ID NO: 2435865 - RNA, 20 nt, Bordetella pertussis
ggacgcgccgggcgaaccgg

SEQ ID NO: 2435866 - RNA, 12 nt, Bordetella pertussis
ggacgcgcgccg

SEQ ID NO: 2435867 - RNA, 17 nt, Bordetella pertussis
ggacgcgcgccgcauca

SEQ ID NO: 2435868 - RNA, 14 nt, Bordetella pertussis
ggacgcgcuggccg

SEQ ID NO: 2435869 - RNA, 19 nt, Bordetella pertussis
ggacgcgcuguaggcgccg

SEQ ID NO: 2435870 - RNA, 22 nt, Bordetella pertussis
ggacgcgcuguaggcgccggcg

SEQ ID NO: 2435871 - RNA, 16 nt, Bordetella pertussis
ggacgcgggccacgcg

SEQ ID NO: 2435872 - RNA, 20 nt, Bordetella pertussis
ggacgcguccucggccagcc

SEQ ID NO: 2435873 - RNA, 15 nt, Bordetella pertussis
ggacggcagcaccgc

SEQ ID NO: 2435874 - RNA, 12 nt, Bordetella pertussis
ggacggccagca

SEQ ID NO: 2435875 - RNA, 15 nt, Bordetella pertussis
ggacggccagcagga

SEQ ID NO: 2435876 - RNA, 17 nt, Bordetella pertussis
ggacggccagcaggagc

SEQ ID NO: 2435877 - RNA, 12 nt, Bordetella pertussis
ggacggccaggg

SEQ ID NO: 2435878 - RNA, 18 nt, Bordetella pertussis
ggacggccaggggcagcu

SEQ ID NO: 2435879 - RNA, 21 nt, Bordetella pertussis
ggacggccaggggcagcucgg

SEQ ID NO: 2435880 - RNA, 19 nt, Bordetella pertussis
ggacggcgcacccgcggcg

SEQ ID NO: 2435881 - RNA, 13 nt, Bordetella pertussis
ggacggcgccguc

SEQ ID NO: 2435882 - RNA, 12 nt, Bordetella pertussis
ggacggcgcugg

SEQ ID NO: 2435883 - RNA, 14 nt, Bordetella pertussis
ggacggcgggcgcc

SEQ ID NO: 2435884 - RNA, 15 nt, Bordetella pertussis
ggacgggaaagcggc

SEQ ID NO: 2435885 - RNA, 17 nt, Bordetella pertussis
ggacgggccaggccgau

SEQ ID NO: 2435886 - RNA, 19 nt, Bordetella pertussis
ggacgggccaggccgaugc

SEQ ID NO: 2435887 - RNA, 14 nt, Bordetella pertussis
ggacgggcgcacag

SEQ ID NO: 2435888 - RNA, 17 nt, Bordetella pertussis
ggacggggaacaggcgc

SEQ ID NO: 2435889 - RNA, 21 nt, Bordetella pertussis
ggacggggaacaggcgcgcca

SEQ ID NO: 2435890 - RNA, 20 nt, Bordetella pertussis
ggacgguagcgcacgcaccg

SEQ ID NO: 2435891 - RNA, 22 nt, Bordetella pertussis
ggacgguagcgcacgcaccgcg

SEQ ID NO: 2435892 - RNA, 19 nt, Bordetella pertussis
ggacguagucgcacgcggc

SEQ ID NO: 2435893 - RNA, 14 nt, Bordetella pertussis
ggacguccaggccu

SEQ ID NO: 2435894 - RNA, 16 nt, Bordetella pertussis
ggacgucugagcgccg

SEQ ID NO: 2435895 - RNA, 14 nt, Bordetella pertussis
ggacgugggcgccu

SEQ ID NO: 2435896 - RNA, 22 nt, Bordetella pertussis
ggacgugggcgccuacggcggc

SEQ ID NO: 2435897 - RNA, 13 nt, Bordetella pertussis
ggacucgauggcg

SEQ ID NO: 2435898 - RNA, 16 nt, Bordetella pertussis
ggacucgauggcgcag

SEQ ID NO: 2435899 - RNA, 22 nt, Bordetella pertussis
ggacucgauggcgcaggcgcgc

SEQ ID NO: 2435900 - RNA, 21 nt, Bordetella pertussis
ggacugaacgcguccaggccc

SEQ ID NO: 2435901 - RNA, 16 nt, Bordetella pertussis
ggacugcaggcgcugc

SEQ ID NO: 2435902 - RNA, 12 nt, Bordetella pertussis
ggacugccagau

SEQ ID NO: 2435903 - RNA, 19 nt, Bordetella pertussis
ggacuggauauggcgccgc

SEQ ID NO: 2435904 - RNA, 14 nt, Bordetella pertussis
ggacuggcaccggc

SEQ ID NO: 2435905 - RNA, 12 nt, Bordetella pertussis
ggacuggcgcgc

SEQ ID NO: 2435906 - RNA, 13 nt, Bordetella pertussis
ggacugggcgucg

SEQ ID NO: 2435907 - RNA, 22 nt, Bordetella pertussis
ggacuuagaaguccaugccgcc

SEQ ID NO: 2435908 - RNA, 20 nt, Bordetella pertussis
ggacuucgucgaucauggcg

SEQ ID NO: 2435909 - RNA, 21 nt, Bordetella pertussis
ggacuucguguucgcggccgg

SEQ ID NO: 2435910 - RNA, 16 nt, Bordetella pertussis
ggagaaaucgccgccg

SEQ ID NO: 2435911 - RNA, 18 nt, Bordetella pertussis
ggagaaaucgccgccggc

SEQ ID NO: 2435912 - RNA, 14 nt, Bordetella pertussis
ggagaacaggcggc

SEQ ID NO: 2435913 - RNA, 17 nt, Bordetella pertussis
ggagaacaggcggcuga

SEQ ID NO: 2435914 - RNA, 14 nt, Bordetella pertussis
ggagaacugcucga

SEQ ID NO: 2435915 - RNA, 13 nt, Bordetella pertussis
ggagaagcgccgc

SEQ ID NO: 2435916 - RNA, 17 nt, Bordetella pertussis
ggagaaggagcgagcga

SEQ ID NO: 2435917 - RNA, 16 nt, Bordetella pertussis
ggagaauccgcaggcg

SEQ ID NO: 2435918 - RNA, 16 nt, Bordetella pertussis
ggagacacgcuagggc

SEQ ID NO: 2435919 - RNA, 20 nt, Bordetella pertussis
ggagacacgcuagggcgugg

SEQ ID NO: 2435920 - RNA, 16 nt, Bordetella pertussis
ggagacaucaugcaga

SEQ ID NO: 2435921 - RNA, 14 nt, Bordetella pertussis
ggagaccggcgccu

SEQ ID NO: 2435922 - RNA, 19 nt, Bordetella pertussis
ggagaccggcgccugcggc

SEQ ID NO: 2435923 - RNA, 19 nt, Bordetella pertussis
ggagaccggguugcccggc

SEQ ID NO: 2435924 - RNA, 20 nt, Bordetella pertussis
ggagacguagccgcugccgu

SEQ ID NO: 2435925 - RNA, 13 nt, Bordetella pertussis
ggagagggccugg

SEQ ID NO: 2435926 - RNA, 14 nt, Bordetella pertussis
ggagagggccuggu

SEQ ID NO: 2435927 - RNA, 18 nt, Bordetella pertussis
ggagaguucauccacagc

SEQ ID NO: 2435928 - RNA, 20 nt, Bordetella pertussis
ggagaguucggugucggcgu

SEQ ID NO: 2435929 - RNA, 13 nt, Bordetella pertussis
ggagauacuggcc

SEQ ID NO: 2435930 - RNA, 18 nt, Bordetella pertussis
ggagaucgccgagcggca

SEQ ID NO: 2435931 - RNA, 18 nt, Bordetella pertussis
ggagauggguacagcgcg

SEQ ID NO: 2435932 - RNA, 19 nt, Bordetella pertussis
ggagauggguacagcgcgc

SEQ ID NO: 2435933 - RNA, 18 nt, Bordetella pertussis
ggagcaugcccuuugcag

SEQ ID NO: 2435934 - RNA, 23 nt, Bordetella pertussis
ggagcauggcaugagcgccucgu

SEQ ID NO: 2435935 - RNA, 14 nt, Bordetella pertussis
ggagccaggcggcg

SEQ ID NO: 2435936 - RNA, 15 nt, Bordetella pertussis
ggagccaguccccgc

SEQ ID NO: 2435937 - RNA, 20 nt, Bordetella pertussis
ggagccaguccccgcgggga

SEQ ID NO: 2435938 - RNA, 14 nt, Bordetella pertussis
ggagcccagugucu

SEQ ID NO: 2435939 - RNA, 21 nt, Bordetella pertussis
ggagccgcgcacacauggcgc

SEQ ID NO: 2435940 - RNA, 13 nt, Bordetella pertussis
ggagccggcgggc

SEQ ID NO: 2435941 - RNA, 17 nt, Bordetella pertussis
ggagccggcgggcggcu

SEQ ID NO: 2435942 - RNA, 22 nt, Bordetella pertussis
ggagccggcgggcggcugcccg

SEQ ID NO: 2435943 - RNA, 20 nt, Bordetella pertussis
ggagccugucccugcgggga

SEQ ID NO: 2435944 - RNA, 17 nt, Bordetella pertussis
ggagcgacacccgcggc

SEQ ID NO: 2435945 - RNA, 23 nt, Bordetella pertussis
ggagcgacacccgcggccagggu

SEQ ID NO: 2435946 - RNA, 14 nt, Bordetella pertussis
ggagcgccacgccg

SEQ ID NO: 2435947 - RNA, 15 nt, Bordetella pertussis
ggagcgccacgccgu

SEQ ID NO: 2435948 - RNA, 20 nt, Bordetella pertussis
ggagcgccacgccgucagcg

SEQ ID NO: 2435949 - RNA, 11 nt, Bordetella pertussis
ggagcgcggcc

SEQ ID NO: 2435950 - RNA, 13 nt, Bordetella pertussis
ggagcgcggcggc

SEQ ID NO: 2435951 - RNA, 14 nt, Bordetella pertussis
ggagcgcggcggcg

SEQ ID NO: 2435952 - RNA, 18 nt, Bordetella pertussis
ggagcgguugaaauccuu

SEQ ID NO: 2435953 - RNA, 15 nt, Bordetella pertussis
ggagcucguccccac

SEQ ID NO: 2435954 - RNA, 22 nt, Bordetella pertussis
ggagcucuaugucgccggccag

SEQ ID NO: 2435955 - RNA, 18 nt, Bordetella pertussis
ggaugcgcuggccggccg

SEQ ID NO: 2435956 - RNA, 15 nt, Bordetella pertussis
ggaugcgcuugccgc

SEQ ID NO: 2435957 - RNA, 18 nt, Bordetella pertussis
ggaugcgcuugccgccca

SEQ ID NO: 2435958 - RNA, 13 nt, Bordetella pertussis
ggaugcuccagcu

SEQ ID NO: 2435959 - RNA, 18 nt, Bordetella pertussis
ggauggacuggccgcgac

SEQ ID NO: 2435960 - RNA, 19 nt, Bordetella pertussis
ggauggacuggccgcgaca

SEQ ID NO: 2435961 - RNA, 18 nt, Bordetella pertussis
ggauggaguucagcagcu

SEQ ID NO: 2435962 - RNA, 14 nt, Bordetella pertussis
ggauggcgccagcc

SEQ ID NO: 2435963 - RNA, 17 nt, Bordetella pertussis
ggauggcgccagcccgc

SEQ ID NO: 2435964 - RNA, 23 nt, Bordetella pertussis
ggauggcgccagcccgcccgcga

SEQ ID NO: 2435965 - RNA, 14 nt, Bordetella pertussis
ggauggcggccgcc

SEQ ID NO: 2435966 - RNA, 16 nt, Bordetella pertussis
ggauggcuggccgagu

SEQ ID NO: 2435967 - RNA, 17 nt, Bordetella pertussis
ggauggcuuuggcgaau

SEQ ID NO: 2435968 - RNA, 14 nt, Bordetella pertussis
ggaugggccaccca

SEQ ID NO: 2435969 - RNA, 14 nt, Bordetella pertussis
ggaugggcgcggcg

SEQ ID NO: 2435970 - RNA, 20 nt, Bordetella pertussis
ggaugggcgcggcgcgcgcc

SEQ ID NO: 2435971 - RNA, 13 nt, Bordetella pertussis
ggaugggcggccu

SEQ ID NO: 2435972 - RNA, 21 nt, Bordetella pertussis
ggauggucgagcgccugcgcc

SEQ ID NO: 2435973 - RNA, 13 nt, Bordetella pertussis
ggauggucgugcg

SEQ ID NO: 2435974 - RNA, 17 nt, Bordetella pertussis
ggauguacgucagcaug

SEQ ID NO: 2435975 - RNA, 21 nt, Bordetella pertussis
ggauguacgucagcaugcacg

SEQ ID NO: 2435976 - RNA, 21 nt, Bordetella pertussis
ggauguccacggucgccggca

SEQ ID NO: 2435977 - RNA, 23 nt, Bordetella pertussis
ggauguccacggucgccggcaug

SEQ ID NO: 2435978 - RNA, 12 nt, Bordetella pertussis
ggaugugcagcg

SEQ ID NO: 2435979 - RNA, 13 nt, Bordetella pertussis
ggaugugcagcgc

SEQ ID NO: 2435980 - RNA, 12 nt, Bordetella pertussis
ggaugugcaggc

SEQ ID NO: 2435981 - RNA, 17 nt, Bordetella pertussis
ggaugugcgcgggcgcg

SEQ ID NO: 2435982 - RNA, 20 nt, Bordetella pertussis
ggauucaggcgauccugccc

SEQ ID NO: 2435983 - RNA, 17 nt, Bordetella pertussis
ggauuccugcgaggaca

SEQ ID NO: 2435984 - RNA, 20 nt, Bordetella pertussis
ggauuccugggugcugccgc

SEQ ID NO: 2435985 - RNA, 20 nt, Bordetella pertussis
ggauucgccggucggccgcu

SEQ ID NO: 2435986 - RNA, 16 nt, Bordetella pertussis
ggauucugcugcaugc

SEQ ID NO: 2435987 - RNA, 15 nt, Bordetella pertussis
ggauugaccagcgcg

SEQ ID NO: 2435988 - RNA, 23 nt, Bordetella pertussis
ggauugaugucgcgcaccgccug

SEQ ID NO: 2435989 - RNA, 18 nt, Bordetella pertussis
ggauugcuugacgccgcc

SEQ ID NO: 2435990 - RNA, 23 nt, Bordetella pertussis
ggauuguugcgaaacccgcuggg

SEQ ID NO: 2435991 - RNA, 17 nt, Bordetella pertussis
ggauuucaccuaccuca

SEQ ID NO: 2435992 - RNA, 13 nt, Bordetella pertussis
ggauuucauggca

SEQ ID NO: 2435993 - RNA, 13 nt, Bordetella pertussis
ggauuuccagcuc

SEQ ID NO: 2435994 - RNA, 19 nt, Bordetella pertussis
ggcaaaaaaaaccgcgcgc

SEQ ID NO: 2435995 - RNA, 14 nt, Bordetella pertussis
ggcaaacccggcga

SEQ ID NO: 2435996 - RNA, 22 nt, Bordetella pertussis
ggcaaacccggcgaagccggca

SEQ ID NO: 2435997 - RNA, 22 nt, Bordetella pertussis
ggcaaacggcggcaggccgcgc

SEQ ID NO: 2435998 - RNA, 14 nt, Bordetella pertussis
ggcaaacggcugga

SEQ ID NO: 2435999 - RNA, 19 nt, Bordetella pertussis
ggcaaacuuccccgcgugc

SEQ ID NO: 2436000 - RNA, 23 nt, Bordetella pertussis
ggcaaagaucaccugggccaucg

SEQ ID NO: 2436001 - RNA, 13 nt, Bordetella pertussis
ggcaaagcccagc

SEQ ID NO: 2436002 - RNA, 14 nt, Bordetella pertussis
ggcaaagcccagca

SEQ ID NO: 2436003 - RNA, 15 nt, Bordetella pertussis
ggcaaagccugacgg

SEQ ID NO: 2436004 - RNA, 13 nt, Bordetella pertussis
ggcaaagcgcggc

SEQ ID NO: 2436005 - RNA, 14 nt, Bordetella pertussis
ggcaaauggggcgg

SEQ ID NO: 2436006 - RNA, 11 nt, Bordetella pertussis
ggcaacaucuc

SEQ ID NO: 2436007 - RNA, 17 nt, Bordetella pertussis
ggcaacaucuccaccag

SEQ ID NO: 2436008 - RNA, 20 nt, Bordetella pertussis
ggcaaccgucgccagcgcgu

SEQ ID NO: 2436009 - RNA, 17 nt, Bordetella pertussis
ggcaaccucgccgcgcc

SEQ ID NO: 2436010 - RNA, 19 nt, Bordetella pertussis
ggcaaccucgccgcgccag

SEQ ID NO: 2436011 - RNA, 20 nt, Bordetella pertussis
ggcaaccucgccgcgccagc

SEQ ID NO: 2436012 - RNA, 21 nt, Bordetella pertussis
ggcaaccucgccgcgccagcu

SEQ ID NO: 2436013 - RNA, 21 nt, Bordetella pertussis
ggcaaccugcacgcgggcgcu

SEQ ID NO: 2436014 - RNA, 16 nt, Bordetella pertussis
ggcaacgggucgcgca

SEQ ID NO: 2436015 - RNA, 14 nt, Bordetella pertussis
ggcaacgugcaggc

SEQ ID NO: 2436016 - RNA, 16 nt, Bordetella pertussis
ggcaacuucaccgucg

SEQ ID NO: 2436017 - RNA, 15 nt, Bordetella pertussis
ggcaagaagauccgc

SEQ ID NO: 2436018 - RNA, 16 nt, Bordetella pertussis
ggcaagacggcgcucg

SEQ ID NO: 2436019 - RNA, 13 nt, Bordetella pertussis
ggcaagagccugg

SEQ ID NO: 2436020 - RNA, 16 nt, Bordetella pertussis
ggcaagaucgccggcu

SEQ ID NO: 2436021 - RNA, 19 nt, Bordetella pertussis
ggcaagcagauggccaucg

SEQ ID NO: 2436022 - RNA, 17 nt, Bordetella pertussis
ggcaagccagggcagga

SEQ ID NO: 2436023 - RNA, 13 nt, Bordetella pertussis
ggcaagccuugcg

SEQ ID NO: 2436024 - RNA, 18 nt, Bordetella pertussis
ggcaagccuugcggcccu

SEQ ID NO: 2436025 - RNA, 17 nt, Bordetella pertussis
ggcaagccuugcggcuu

SEQ ID NO: 2436026 - RNA, 19 nt, Bordetella pertussis
ggcaagccuugcggcuugc

SEQ ID NO: 2436027 - RNA, 21 nt, Bordetella pertussis
ggcaagccuugcggcuugccg

SEQ ID NO: 2436028 - RNA, 13 nt, Bordetella pertussis
ggcaagcgcucgc

SEQ ID NO: 2436029 - RNA, 15 nt, Bordetella pertussis
ggcaagcgcucgccg

SEQ ID NO: 2436030 - RNA, 16 nt, Bordetella pertussis
ggcaagcgcucgccgg

SEQ ID NO: 2436031 - RNA, 18 nt, Bordetella pertussis
ggcaagcgcucgccggcg

SEQ ID NO: 2436032 - RNA, 12 nt, Bordetella pertussis
ggcaagcggcgu

SEQ ID NO: 2436033 - RNA, 13 nt, Bordetella pertussis
ggcaagcggcgug

SEQ ID NO: 2436034 - RNA, 20 nt, Bordetella pertussis
ggcaagcugcuggcgcgcca

SEQ ID NO: 2436035 - RNA, 14 nt, Bordetella pertussis
ggcaaggcccgccg

SEQ ID NO: 2436036 - RNA, 18 nt, Bordetella pertussis
ggcaaggcccgccgcggc

SEQ ID NO: 2436037 - RNA, 22 nt, Bordetella pertussis
ggcaaggccgcgaacgcgccgg

SEQ ID NO: 2436038 - RNA, 13 nt, Bordetella pertussis
ggcaaggggccag

SEQ ID NO: 2436039 - RNA, 18 nt, Bordetella pertussis
ggcaaggggccagccugg

SEQ ID NO: 2436040 - RNA, 22 nt, Bordetella pertussis
ggcaaggggccagccuggcgcc

SEQ ID NO: 2436041 - RNA, 18 nt, Bordetella pertussis
ggcaagggugccuguccc

SEQ ID NO: 2436042 - RNA, 13 nt, Bordetella pertussis
ggcaagucgacgc

SEQ ID NO: 2436043 - RNA, 20 nt, Bordetella pertussis
ggcaagucgacgcugaucgg

SEQ ID NO: 2436044 - RNA, 16 nt, Bordetella pertussis
ggcaaguucgcugccg

SEQ ID NO: 2436045 - RNA, 17 nt, Bordetella pertussis
ggcaaguucgcugccgg

SEQ ID NO: 2436046 - RNA, 14 nt, Bordetella pertussis
ggcaaucagcccca

SEQ ID NO: 2436047 - RNA, 19 nt, Bordetella pertussis
ggcaaucagccccaggcgc

SEQ ID NO: 2436048 - RNA, 21 nt, Bordetella pertussis
ggcaaucccggcgacaccgcg

SEQ ID NO: 2436049 - RNA, 19 nt, Bordetella pertussis
ggcaaucgaugaucacgcg

SEQ ID NO: 2436050 - RNA, 20 nt, Bordetella pertussis
ggcaaucggagguaugcacg

SEQ ID NO: 2436051 - RNA, 13 nt, Bordetella pertussis
ggcaaucggcgug

SEQ ID NO: 2436052 - RNA, 19 nt, Bordetella pertussis
ggcaaucuugccgccgggc

SEQ ID NO: 2436053 - RNA, 18 nt, Bordetella pertussis
ggcaaugcgcaggcccga

SEQ ID NO: 2436054 - RNA, 13 nt, Bordetella pertussis
ggcaaugcgcgcg

SEQ ID NO: 2436055 - RNA, 15 nt, Bordetella pertussis
ggcaaugguccagca

SEQ ID NO: 2436056 - RNA, 17 nt, Bordetella pertussis
ggcaaugguccagcagg

SEQ ID NO: 2436057 - RNA, 18 nt, Bordetella pertussis
ggcaaugguccagcaggg

SEQ ID NO: 2436058 - RNA, 16 nt, Bordetella pertussis
ggcacaacccgcccgg

SEQ ID NO: 2436059 - RNA, 20 nt, Bordetella pertussis
ggcacaacccgcccggggcc

SEQ ID NO: 2436060 - RNA, 19 nt, Bordetella pertussis
ggcacaaccuggcgcgcgg

SEQ ID NO: 2436061 - RNA, 15 nt, Bordetella pertussis
ggcacaccacgcgau

SEQ ID NO: 2436062 - RNA, 17 nt, Bordetella pertussis
ggcacaccacgcgaugc

SEQ ID NO: 2436063 - RNA, 12 nt, Bordetella pertussis
ggcacaccagcg

SEQ ID NO: 2436064 - RNA, 14 nt, Bordetella pertussis
ggcacaccagcgcc

SEQ ID NO: 2436065 - RNA, 16 nt, Bordetella pertussis
ggcacaccagcgccag

SEQ ID NO: 2436066 - RNA, 17 nt, Bordetella pertussis
ggcacaccagcgccagg

SEQ ID NO: 2436067 - RNA, 22 nt, Bordetella pertussis
ggcacaccggucuacgccauga

SEQ ID NO: 2436068 - RNA, 16 nt, Bordetella pertussis
ggcacaccgucacgcg

SEQ ID NO: 2436069 - RNA, 16 nt, Bordetella pertussis
ggcacgggucaggcug

SEQ ID NO: 2436070 - RNA, 21 nt, Bordetella pertussis
ggcacgggucaggcugcggcg

SEQ ID NO: 2436071 - RNA, 21 nt, Bordetella pertussis
ggcacgguggcgaaggccgcc

SEQ ID NO: 2436072 - RNA, 20 nt, Bordetella pertussis
ggcacgguucagaacgcgua

SEQ ID NO: 2436073 - RNA, 16 nt, Bordetella pertussis
ggcacguaccaggcgc

SEQ ID NO: 2436074 - RNA, 19 nt, Bordetella pertussis
ggcacguaccaggcgcuga

SEQ ID NO: 2436075 - RNA, 15 nt, Bordetella pertussis
ggcacguaguacagc

SEQ ID NO: 2436076 - RNA, 16 nt, Bordetella pertussis
ggcacguaguacagca

SEQ ID NO: 2436077 - RNA, 17 nt, Bordetella pertussis
ggcacguaguacagcag

SEQ ID NO: 2436078 - RNA, 21 nt, Bordetella pertussis
ggcacguaguacagcagcagc

SEQ ID NO: 2436079 - RNA, 20 nt, Bordetella pertussis
ggcacgucauugcaucgcag

SEQ ID NO: 2436080 - RNA, 23 nt, Bordetella pertussis
ggcacgucauugcaucgcagcag

SEQ ID NO: 2436081 - RNA, 20 nt, Bordetella pertussis
ggcacguccggcacggcggc

SEQ ID NO: 2436082 - RNA, 15 nt, Bordetella pertussis
ggcacgucgggcagg

SEQ ID NO: 2436083 - RNA, 22 nt, Bordetella pertussis
ggcacgugauaguccacccccg

SEQ ID NO: 2436084 - RNA, 13 nt, Bordetella pertussis
ggcacguugucga

SEQ ID NO: 2436085 - RNA, 16 nt, Bordetella pertussis
ggcacucggccauggu

SEQ ID NO: 2436086 - RNA, 17 nt, Bordetella pertussis
ggcacucggccauggug

SEQ ID NO: 2436087 - RNA, 23 nt, Bordetella pertussis
ggcacucugccgugggacaggca

SEQ ID NO: 2436088 - RNA, 15 nt, Bordetella pertussis
ggcacucuugccgcu

SEQ ID NO: 2436089 - RNA, 20 nt, Bordetella pertussis
ggcacucuugccgcugcgcg

SEQ ID NO: 2436090 - RNA, 22 nt, Bordetella pertussis
ggcacucuugccgcugcgcggu

SEQ ID NO: 2436091 - RNA, 16 nt, Bordetella pertussis
ggcacuggcgcggcgc

SEQ ID NO: 2436092 - RNA, 20 nt, Bordetella pertussis
ggcacugucggcguuccugg

SEQ ID NO: 2436093 - RNA, 20 nt, Bordetella pertussis
ggcagaacagcggaucgccg

SEQ ID NO: 2436094 - RNA, 21 nt, Bordetella pertussis
ggcagaacagcggaucgccgg

SEQ ID NO: 2436095 - RNA, 21 nt, Bordetella pertussis
ggcagaacggaaacgcccagc

SEQ ID NO: 2436096 - RNA, 17 nt, Bordetella pertussis
ggcagaaguggucgcgc

SEQ ID NO: 2436097 - RNA, 17 nt, Bordetella pertussis
ggcagaguggcaggagg

SEQ ID NO: 2436098 - RNA, 16 nt, Bordetella pertussis
ggcagaucggcgcugg

SEQ ID NO: 2436099 - RNA, 19 nt, Bordetella pertussis
ggcagaucggcgcuggccu

SEQ ID NO: 2436100 - RNA, 21 nt, Bordetella pertussis
ggcagaucggcgcuggccugg

SEQ ID NO: 2436101 - RNA, 23 nt, Bordetella pertussis
ggcagaucuccggauccagccgc

SEQ ID NO: 2436102 - RNA, 20 nt, Bordetella pertussis
ggcagaugaucuacgcgcgc

SEQ ID NO: 2436103 - RNA, 14 nt, Bordetella pertussis
ggcagaugcgcgcc

SEQ ID NO: 2436104 - RNA, 15 nt, Bordetella pertussis
ggcagaugcgcgcca

SEQ ID NO: 2436105 - RNA, 17 nt, Bordetella pertussis
ggcagaugcgcgccagg

SEQ ID NO: 2436106 - RNA, 19 nt, Bordetella pertussis
ggcagaugcgcgccaggcg

SEQ ID NO: 2436107 - RNA, 24 nt, Bordetella pertussis
ggcagauugaugcccaugcgcugc

SEQ ID NO: 2436108 - RNA, 16 nt, Bordetella pertussis
ggcagcaauucgaccg

SEQ ID NO: 2436109 - RNA, 15 nt, Bordetella pertussis
ggcagcacccagcgu

SEQ ID NO: 2436110 - RNA, 18 nt, Bordetella pertussis
ggcagcacccagcguucg

SEQ ID NO: 2436111 - RNA, 15 nt, Bordetella pertussis
ggcagcaccgccacc

SEQ ID NO: 2436112 - RNA, 20 nt, Bordetella pertussis
ggcagcaccgccaugugcgc

SEQ ID NO: 2436113 - RNA, 17 nt, Bordetella pertussis
ggcagcaccggggcagg

SEQ ID NO: 2436114 - RNA, 13 nt, Bordetella pertussis
ggcagcaccucgg

SEQ ID NO: 2436115 - RNA, 24 nt, Bordetella pertussis
ggcagcaccucggacgagacaggc

SEQ ID NO: 2436116 - RNA, 17 nt, Bordetella pertussis
ggcagcacgauggcgcc

SEQ ID NO: 2436117 - RNA, 12 nt, Bordetella pertussis
ggcagcacgcgc

SEQ ID NO: 2436118 - RNA, 23 nt, Bordetella pertussis
ggcagcacgcgcaccaggccugc

SEQ ID NO: 2436119 - RNA, 17 nt, Bordetella pertussis
ggcagcagaucggcggc

SEQ ID NO: 2436120 - RNA, 22 nt, Bordetella pertussis
ggcagcagaucggcggccuggg

SEQ ID NO: 2436121 - RNA, 17 nt, Bordetella pertussis
ggcagcagcacgcccau

SEQ ID NO: 2436122 - RNA, 16 nt, Bordetella pertussis
ggcagcagcagcgcgg

SEQ ID NO: 2436123 - RNA, 17 nt, Bordetella pertussis
ggcagcagcagcgcggu

SEQ ID NO: 2436124 - RNA, 14 nt, Bordetella pertussis
ggcagcagcagcgu

SEQ ID NO: 2436125 - RNA, 22 nt, Bordetella pertussis
ggcagcagcagcgugcggucgu

SEQ ID NO: 2436126 - RNA, 13 nt, Bordetella pertussis
ggcagcagcaggg

SEQ ID NO: 2436127 - RNA, 14 nt, Bordetella pertussis
ggcagcagcagggc

SEQ ID NO: 2436128 - RNA, 23 nt, Bordetella pertussis
ggcagcagcgagaacagccacac

SEQ ID NO: 2436129 - RNA, 13 nt, Bordetella pertussis
ggcagcagcgcgc

SEQ ID NO: 2436130 - RNA, 15 nt, Bordetella pertussis
ggcagcagcgcgccg

SEQ ID NO: 2436131 - RNA, 15 nt, Bordetella pertussis
ggcagcaggccggcg

SEQ ID NO: 2436132 - RNA, 18 nt, Bordetella pertussis
ggcagcaggccggcggcg

SEQ ID NO: 2436133 - RNA, 13 nt, Bordetella pertussis
ggcagcaggcgcg

SEQ ID NO: 2436134 - RNA, 14 nt, Bordetella pertussis
ggcagcaggcgcgu

SEQ ID NO: 2436135 - RNA, 16 nt, Bordetella pertussis
ggcagcaggcgcguga

SEQ ID NO: 2436136 - RNA, 13 nt, Bordetella pertussis
ggcagcaggcugc

SEQ ID NO: 2436137 - RNA, 19 nt, Bordetella pertussis
ggcagcaggcugccgccgg

SEQ ID NO: 2436138 - RNA, 20 nt, Bordetella pertussis
ggcagcaggcugccgccggc

SEQ ID NO: 2436139 - RNA, 21 nt, Bordetella pertussis
ggcagcaggcugccgccggcg

SEQ ID NO: 2436140 - RNA, 18 nt, Bordetella pertussis
ggcagcauggcgccaugc

SEQ ID NO: 2436141 - RNA, 23 nt, Bordetella pertussis
ggcagccagaacaugagccaugc

SEQ ID NO: 2436142 - RNA, 19 nt, Bordetella pertussis
ggcagccccgggugcaggu

SEQ ID NO: 2436143 - RNA, 13 nt, Bordetella pertussis
ggcagcccgcgca

SEQ ID NO: 2436144 - RNA, 14 nt, Bordetella pertussis
ggcagcccgcgcac

SEQ ID NO: 2436145 - RNA, 20 nt, Bordetella pertussis
ggcagcccgcgcacgcccgc

SEQ ID NO: 2436146 - RNA, 12 nt, Bordetella pertussis
ggcagcccggca

SEQ ID NO: 2436147 - RNA, 16 nt, Bordetella pertussis
ggcagccggccauggc

SEQ ID NO: 2436148 - RNA, 21 nt, Bordetella pertussis
ggcagccggccauggccgcca

SEQ ID NO: 2436149 - RNA, 13 nt, Bordetella pertussis
ggcagccggcccc

SEQ ID NO: 2436150 - RNA, 14 nt, Bordetella pertussis
ggcagccggccccg

SEQ ID NO: 2436151 - RNA, 15 nt, Bordetella pertussis
ggcagccggccccgc

SEQ ID NO: 2436152 - RNA, 16 nt, Bordetella pertussis
ggcagccggccccgca

SEQ ID NO: 2436153 - RNA, 18 nt, Bordetella pertussis
ggcagccggccccgcaag

SEQ ID NO: 2436154 - RNA, 17 nt, Bordetella pertussis
ggcagccuggggcgagg

SEQ ID NO: 2436155 - RNA, 18 nt, Bordetella pertussis
ggcagccuugaaagaggc

SEQ ID NO: 2436156 - RNA, 20 nt, Bordetella pertussis
ggcagcgaauacggcaagca

SEQ ID NO: 2436157 - RNA, 16 nt, Bordetella pertussis
ggcagcgaccgcggcg

SEQ ID NO: 2436158 - RNA, 15 nt, Bordetella pertussis
ggcagcgacucgccg

SEQ ID NO: 2436159 - RNA, 22 nt, Bordetella pertussis
ggcagcgacucgccgugcuggg

SEQ ID NO: 2436160 - RNA, 14 nt, Bordetella pertussis
ggcagcgaggcgca

SEQ ID NO: 2436161 - RNA, 16 nt, Bordetella pertussis
ggcagcgaggcgcagc

SEQ ID NO: 2436162 - RNA, 22 nt, Bordetella pertussis
ggcagcgaggcgcagcgcagcu

SEQ ID NO: 2436163 - RNA, 14 nt, Bordetella pertussis
ggcagcgaggcgcg

SEQ ID NO: 2436164 - RNA, 15 nt, Bordetella pertussis
ggcagcgaggcgcgg

SEQ ID NO: 2436165 - RNA, 21 nt, Bordetella pertussis
ggcagcgaggcgcgggcgaug

SEQ ID NO: 2436166 - RNA, 14 nt, Bordetella pertussis
ggcagcgcccgcgc

SEQ ID NO: 2436167 - RNA, 19 nt, Bordetella pertussis
ggcagcgcccgcgccaucg

SEQ ID NO: 2436168 - RNA, 18 nt, Bordetella pertussis
ggcagcgccgcaacccgc

SEQ ID NO: 2436169 - RNA, 19 nt, Bordetella pertussis
ggcagcgcgaccggcgcga

SEQ ID NO: 2436170 - RNA, 14 nt, Bordetella pertussis
ggcagcgcgcagga

SEQ ID NO: 2436171 - RNA, 22 nt, Bordetella pertussis
ggcagcgcgcaggacaaggcgc

SEQ ID NO: 2436172 - RNA, 12 nt, Bordetella pertussis
ggcagcgcggcc

SEQ ID NO: 2436173 - RNA, 14 nt, Bordetella pertussis
ggcagcgcggccgg

SEQ ID NO: 2436174 - RNA, 14 nt, Bordetella pertussis
ggcagcgcggcggc

SEQ ID NO: 2436175 - RNA, 15 nt, Bordetella pertussis
ggcagcgcggcggcg

SEQ ID NO: 2436176 - RNA, 16 nt, Bordetella pertussis
ggcagcgcggcggcga

SEQ ID NO: 2436177 - RNA, 19 nt, Bordetella pertussis
ggcagcgcggcggcgaccg

SEQ ID NO: 2436178 - RNA, 20 nt, Bordetella pertussis
ggcagcgcggcggcgaccgg

SEQ ID NO: 2436179 - RNA, 22 nt, Bordetella pertussis
ggcagcggacgguagcgcacgc

SEQ ID NO: 2436180 - RNA, 20 nt, Bordetella pertussis
ggcagcggcaucacgccggu

SEQ ID NO: 2436181 - RNA, 14 nt, Bordetella pertussis
ggcagcggccagau

SEQ ID NO: 2436182 - RNA, 15 nt, Bordetella pertussis
ggcaggugcgccagc

SEQ ID NO: 2436183 - RNA, 18 nt, Bordetella pertussis
ggcaggugcggccgcagc

SEQ ID NO: 2436184 - RNA, 19 nt, Bordetella pertussis
ggcaggugcgucacgcaca

SEQ ID NO: 2436185 - RNA, 12 nt, Bordetella pertussis
ggcaggugcuug

SEQ ID NO: 2436186 - RNA, 15 nt, Bordetella pertussis
ggcaggugcuuggcg

SEQ ID NO: 2436187 - RNA, 24 nt, Bordetella pertussis
ggcaggugcuuggcggucugggcg

SEQ ID NO: 2436188 - RNA, 20 nt, Bordetella pertussis
ggcagguguuguugcacgac

SEQ ID NO: 2436189 - RNA, 20 nt, Bordetella pertussis
ggcagguugaaguugcucgg

SEQ ID NO: 2436190 - RNA, 14 nt, Bordetella pertussis
ggcaguacgagcgg

SEQ ID NO: 2436191 - RNA, 15 nt, Bordetella pertussis
ggcaguacgagcggc

SEQ ID NO: 2436192 - RNA, 18 nt, Bordetella pertussis
ggcaguacgagcggcggc

SEQ ID NO: 2436193 - RNA, 22 nt, Bordetella pertussis
ggcaguacguacgcccggccgc

SEQ ID NO: 2436194 - RNA, 23 nt, Bordetella pertussis
ggcaguacguacgcccggccgcc

SEQ ID NO: 2436195 - RNA, 22 nt, Bordetella pertussis
ggcagucaaccguucauggcgu

SEQ ID NO: 2436196 - RNA, 16 nt, Bordetella pertussis
ggcaguccuggcuggg

SEQ ID NO: 2436197 - RNA, 15 nt, Bordetella pertussis
ggcagugguggugca

SEQ ID NO: 2436198 - RNA, 19 nt, Bordetella pertussis
ggcagugguggugcagcgg

SEQ ID NO: 2436199 - RNA, 21 nt, Bordetella pertussis
ggcagugguggugcagcggca

SEQ ID NO: 2436200 - RNA, 23 nt, Bordetella pertussis
ggcagugguggugcagcggcagc

SEQ ID NO: 2436201 - RNA, 18 nt, Bordetella pertussis
ggcagugucaggaugccc

SEQ ID NO: 2436202 - RNA, 22 nt, Bordetella pertussis
ggcagugucaggaugcccuggg

SEQ ID NO: 2436203 - RNA, 16 nt, Bordetella pertussis
ggcaguucgcccggcu

SEQ ID NO: 2436204 - RNA, 23 nt, Bordetella pertussis
ggcaguugaccaugaccaugccg

SEQ ID NO: 2436205 - RNA, 17 nt, Bordetella pertussis
ggcaguugcuggcggcc

SEQ ID NO: 2436206 - RNA, 22 nt, Bordetella pertussis
ggcaguugcuggcggccgugcc

SEQ ID NO: 2436207 - RNA, 20 nt, Bordetella pertussis
ggcaguuggcggcgcagccg

SEQ ID NO: 2436208 - RNA, 20 nt, Bordetella pertussis
ggcauacgccgauggcgcgg

SEQ ID NO: 2436209 - RNA, 17 nt, Bordetella pertussis
ggcauagaugccgaaca

SEQ ID NO: 2436210 - RNA, 20 nt, Bordetella pertussis
ggcauagaugccgaacagcc

SEQ ID NO: 2436211 - RNA, 22 nt, Bordetella pertussis
ggcauagcccaggccgccggcg

SEQ ID NO: 2436212 - RNA, 17 nt, Bordetella pertussis
ggcauaggcggcgcagg

SEQ ID NO: 2436213 - RNA, 18 nt, Bordetella pertussis
ggcauaggcggcgcaggc

SEQ ID NO: 2436214 - RNA, 21 nt, Bordetella pertussis
ggcaucaauagcccgugcggg

SEQ ID NO: 2436215 - RNA, 15 nt, Bordetella pertussis
ggcaucaccaucgau

SEQ ID NO: 2436216 - RNA, 13 nt, Bordetella pertussis
ggcaucacgccgg

SEQ ID NO: 2436217 - RNA, 15 nt, Bordetella pertussis
ggcaucagggcgaug

SEQ ID NO: 2436218 - RNA, 23 nt, Bordetella pertussis
ggcaucagggcgaugccgcagau

SEQ ID NO: 2436219 - RNA, 19 nt, Bordetella pertussis
ggcaucaggggcucggcca

SEQ ID NO: 2436220 - RNA, 15 nt, Bordetella pertussis
ggcaucagguuugcg

SEQ ID NO: 2436221 - RNA, 18 nt, Bordetella pertussis
ggcaucaguucaggcugg

SEQ ID NO: 2436222 - RNA, 20 nt, Bordetella pertussis
ggcaucccgacaugccgccc

SEQ ID NO: 2436223 - RNA, 18 nt, Bordetella pertussis
ggcaucccugcuugcgcg

SEQ ID NO: 2436224 - RNA, 12 nt, Bordetella pertussis
ggcaucgaaggc

SEQ ID NO: 2436225 - RNA, 17 nt, Bordetella pertussis
ggcaucgaaggcgaccg

SEQ ID NO: 2436226 - RNA, 14 nt, Bordetella pertussis
ggcaucgaccagcg

SEQ ID NO: 2436227 - RNA, 20 nt, Bordetella pertussis
ggcaucgagaaaccagccgc

SEQ ID NO: 2436228 - RNA, 23 nt, Bordetella pertussis
ggcaucgagauugagcacgcaug

SEQ ID NO: 2436229 - RNA, 22 nt, Bordetella pertussis
ggcaucgauuucucgcugcuga

SEQ ID NO: 2436230 - RNA, 23 nt, Bordetella pertussis
ggcaucgauuucucgcugcugac

SEQ ID NO: 2436231 - RNA, 14 nt, Bordetella pertussis
ggcaucgcccacca

SEQ ID NO: 2436232 - RNA, 12 nt, Bordetella pertussis
ggcaucgcccug

SEQ ID NO: 2436233 - RNA, 16 nt, Bordetella pertussis
ggcaucgcccugcucg

SEQ ID NO: 2436234 - RNA, 14 nt, Bordetella pertussis
ggcaucgccgcggg

SEQ ID NO: 2436235 - RNA, 21 nt, Bordetella pertussis
ggcaucgcgcugacagcgcuc

SEQ ID NO: 2436236 - RNA, 14 nt, Bordetella pertussis
ggcaucgcuuccuu

SEQ ID NO: 2436237 - RNA, 15 nt, Bordetella pertussis
ggcaucggccacgcu

SEQ ID NO: 2436238 - RNA, 18 nt, Bordetella pertussis
ggcaucggccacgcugcc

SEQ ID NO: 2436239 - RNA, 13 nt, Bordetella pertussis
ggcaucggccagc

SEQ ID NO: 2436240 - RNA, 14 nt, Bordetella pertussis
ggcaucggccagca

SEQ ID NO: 2436241 - RNA, 16 nt, Bordetella pertussis
ggcaucggccagcaua

SEQ ID NO: 2436242 - RNA, 13 nt, Bordetella pertussis
ggcaucggcgccg

SEQ ID NO: 2436243 - RNA, 15 nt, Bordetella pertussis
ggcaucggcgccgcg

SEQ ID NO: 2436244 - RNA, 19 nt, Bordetella pertussis
ggcaucggcgccgcgcgcu

SEQ ID NO: 2436245 - RNA, 19 nt, Bordetella pertussis
ggcaucgggcagggcuucc

SEQ ID NO: 2436246 - RNA, 23 nt, Bordetella pertussis
ggcaucguaguugggcgccuugc

SEQ ID NO: 2436247 - RNA, 24 nt, Bordetella pertussis
ggcaucguuacacuggcccuggca

SEQ ID NO: 2436248 - RNA, 18 nt, Bordetella pertussis
ggcaucuguccgcgccgg

SEQ ID NO: 2436249 - RNA, 19 nt, Bordetella pertussis
ggcaucuguccgcgccggg

SEQ ID NO: 2436250 - RNA, 20 nt, Bordetella pertussis
ggcaucuugccuuggcgaau

SEQ ID NO: 2436251 - RNA, 12 nt, Bordetella pertussis
ggcaugaaaaag

SEQ ID NO: 2436252 - RNA, 20 nt, Bordetella pertussis
ggcaugaaaaagggcgcacc

SEQ ID NO: 2436253 - RNA, 22 nt, Bordetella pertussis
ggcaugaaacggcaagagccug

SEQ ID NO: 2436254 - RNA, 16 nt, Bordetella pertussis
ggcaugaccgcggacg

SEQ ID NO: 2436255 - RNA, 14 nt, Bordetella pertussis
ggcaugacgaccgc

SEQ ID NO: 2436256 - RNA, 17 nt, Bordetella pertussis
ggcaugcaccgcguggc

SEQ ID NO: 2436257 - RNA, 22 nt, Bordetella pertussis
ggcaugcaccgcguggcgcugc

SEQ ID NO: 2436258 - RNA, 12 nt, Bordetella pertussis
ggcaugccggca

SEQ ID NO: 2436259 - RNA, 22 nt, Bordetella pertussis
ggcaugccggcauaggcggcgc

SEQ ID NO: 2436260 - RNA, 18 nt, Bordetella pertussis
ggcaugccguccacgccc

SEQ ID NO: 2436261 - RNA, 24 nt, Bordetella pertussis
ggcaugcgaagaauuggccgucca

SEQ ID NO: 2436262 - RNA, 16 nt, Bordetella pertussis
ggcaugcgccagccag

SEQ ID NO: 2436263 - RNA, 16 nt, Bordetella pertussis
ggcaugcgccagcgcc

SEQ ID NO: 2436264 - RNA, 16 nt, Bordetella pertussis
ggcaugcgccugcgcc

SEQ ID NO: 2436265 - RNA, 12 nt, Bordetella pertussis
ggcaugcugcgu

SEQ ID NO: 2436266 - RNA, 13 nt, Bordetella pertussis
ggcauggcagcag

SEQ ID NO: 2436267 - RNA, 14 nt, Bordetella pertussis
ggcauggccagcuu

SEQ ID NO: 2436268 - RNA, 17 nt, Bordetella pertussis
ggcauggccaucgcggu

SEQ ID NO: 2436269 - RNA, 17 nt, Bordetella pertussis
ggcauggcccggcucgc

SEQ ID NO: 2436270 - RNA, 18 nt, Bordetella pertussis
ggcauggcccggcucgcc

SEQ ID NO: 2436271 - RNA, 13 nt, Bordetella pertussis
ggcauggcgaucg

SEQ ID NO: 2436272 - RNA, 18 nt, Bordetella pertussis
ggcauggcgccgcgccgc

SEQ ID NO: 2436273 - RNA, 19 nt, Bordetella pertussis
ggcauggcgccgcgccgcc

SEQ ID NO: 2436274 - RNA, 16 nt, Bordetella pertussis
ggcauggcgccgcgcg

SEQ ID NO: 2436275 - RNA, 17 nt, Bordetella pertussis
ggcauggcgcgcgcggu

SEQ ID NO: 2436276 - RNA, 15 nt, Bordetella pertussis
ggcauggcggccagc

SEQ ID NO: 2436277 - RNA, 16 nt, Bordetella pertussis
ggcauggcggccagcu

SEQ ID NO: 2436278 - RNA, 18 nt, Bordetella pertussis
ggcaugggcccgggcgcg

SEQ ID NO: 2436279 - RNA, 19 nt, Bordetella pertussis
ggcaugggcgugccgcgcu

SEQ ID NO: 2436280 - RNA, 18 nt, Bordetella pertussis
ggcaugguagcgguccag

SEQ ID NO: 2436281 - RNA, 19 nt, Bordetella pertussis
ggcaugguagcgguccagc

SEQ ID NO: 2436282 - RNA, 20 nt, Bordetella pertussis
ggcauggucggcauggccau

SEQ ID NO: 2436283 - RNA, 20 nt, Bordetella pertussis
ggcaugucgcggcccacggc

SEQ ID NO: 2436284 - RNA, 18 nt, Bordetella pertussis
ggcaugugccaccgccca

SEQ ID NO: 2436285 - RNA, 20 nt, Bordetella pertussis
ggcauucgaacaacagcgcc

SEQ ID NO: 2436286 - RNA, 19 nt, Bordetella pertussis
ggcauucucggacaggucg

SEQ ID NO: 2436287 - RNA, 12 nt, Bordetella pertussis
ggcauugagggc

SEQ ID NO: 2436288 - RNA, 18 nt, Bordetella pertussis
ggcauugccggagcagca

SEQ ID NO: 2436289 - RNA, 15 nt, Bordetella pertussis
ggcauugcgccagcc

SEQ ID NO: 2436290 - RNA, 15 nt, Bordetella pertussis
ggcauuggcggcggc

SEQ ID NO: 2436291 - RNA, 18 nt, Bordetella pertussis
ggcauuggcggcggcguu

SEQ ID NO: 2436292 - RNA, 14 nt, Bordetella pertussis
ggcauugggcagcg

SEQ ID NO: 2436293 - RNA, 21 nt, Bordetella pertussis
ggcauugggcagcggacggua

SEQ ID NO: 2436294 - RNA, 22 nt, Bordetella pertussis
ggccacguccggguuggcgaug

SEQ ID NO: 2436295 - RNA, 13 nt, Bordetella pertussis
ggccacgucggcg

SEQ ID NO: 2436296 - RNA, 15 nt, Bordetella pertussis
ggccacgucggcggc

SEQ ID NO: 2436297 - RNA, 17 nt, Bordetella pertussis
ggccacgucggcggccg

SEQ ID NO: 2436298 - RNA, 19 nt, Bordetella pertussis
ggccacgucggcggccgcc

SEQ ID NO: 2436299 - RNA, 20 nt, Bordetella pertussis
ggccacgucggcggccgccu

SEQ ID NO: 2436300 - RNA, 14 nt, Bordetella pertussis
ggccacgucggucg

SEQ ID NO: 2436301 - RNA, 17 nt, Bordetella pertussis
ggccacguguggcaggc

SEQ ID NO: 2436302 - RNA, 21 nt, Bordetella pertussis
ggccacguguggcaggccagc

SEQ ID NO: 2436303 - RNA, 17 nt, Bordetella pertussis
ggccacguugauccagc

SEQ ID NO: 2436304 - RNA, 18 nt, Bordetella pertussis
ggccacguugauccagcg

SEQ ID NO: 2436305 - RNA, 19 nt, Bordetella pertussis
ggccacguugauccagcgc

SEQ ID NO: 2436306 - RNA, 23 nt, Bordetella pertussis
ggccacguugauccagcgcucgg

SEQ ID NO: 2436307 - RNA, 17 nt, Bordetella pertussis
ggccacucgaugggcgc

SEQ ID NO: 2436308 - RNA, 15 nt, Bordetella pertussis
ggccacuggccgcgc

SEQ ID NO: 2436309 - RNA, 15 nt, Bordetella pertussis
ggccacuuccagcgc

SEQ ID NO: 2436310 - RNA, 17 nt, Bordetella pertussis
ggccacuuccagcgccu

SEQ ID NO: 2436311 - RNA, 19 nt, Bordetella pertussis
ggccacuuccagcgccugc

SEQ ID NO: 2436312 - RNA, 16 nt, Bordetella pertussis
ggccacuucgcggccg

SEQ ID NO: 2436313 - RNA, 22 nt, Bordetella pertussis
ggccacuuucgcgcgcgccugc

SEQ ID NO: 2436314 - RNA, 19 nt, Bordetella pertussis
ggccagacauugucaagca

SEQ ID NO: 2436315 - RNA, 23 nt, Bordetella pertussis
ggccagacauugucaagcagcgc

SEQ ID NO: 2436316 - RNA, 15 nt, Bordetella pertussis
ggccagaccgcgcgc

SEQ ID NO: 2436317 - RNA, 19 nt, Bordetella pertussis
ggccagaccuugcgcgacg

SEQ ID NO: 2436318 - RNA, 21 nt, Bordetella pertussis
ggccagaccuugcgcgacggc

SEQ ID NO: 2436319 - RNA, 22 nt, Bordetella pertussis
ggccagaccuugcgcgacggcg

SEQ ID NO: 2436320 - RNA, 17 nt, Bordetella pertussis
ggccagauagcccaggc

SEQ ID NO: 2436321 - RNA, 17 nt, Bordetella pertussis
ggccagauagucgcgga

SEQ ID NO: 2436322 - RNA, 15 nt, Bordetella pertussis
ggccagcaagcgcgc

SEQ ID NO: 2436323 - RNA, 18 nt, Bordetella pertussis
ggccagcaagcgcgccau

SEQ ID NO: 2436324 - RNA, 18 nt, Bordetella pertussis
ggccagcaagcgcucggc

SEQ ID NO: 2436325 - RNA, 21 nt, Bordetella pertussis
ggccagcaagcgcucggccac

SEQ ID NO: 2436326 - RNA, 20 nt, Bordetella pertussis
ggccagcaagggguccgugg

SEQ ID NO: 2436327 - RNA, 19 nt, Bordetella pertussis
ggccagcacauacgccgcc

SEQ ID NO: 2436328 - RNA, 21 nt, Bordetella pertussis
ggccagcacauacgccgccga

SEQ ID NO: 2436329 - RNA, 17 nt, Bordetella pertussis
ggccagcaccggcccga

SEQ ID NO: 2436330 - RNA, 15 nt, Bordetella pertussis
ggccagcacgccggc

SEQ ID NO: 2436331 - RNA, 17 nt, Bordetella pertussis
ggccagcacgccggcca

SEQ ID NO: 2436332 - RNA, 18 nt, Bordetella pertussis
ggccagcacgccggccag

SEQ ID NO: 2436333 - RNA, 19 nt, Bordetella pertussis
ggccagcacgccggcgggc

SEQ ID NO: 2436334 - RNA, 18 nt, Bordetella pertussis
ggccagcacgggcgaagu

SEQ ID NO: 2436335 - RNA, 20 nt, Bordetella pertussis
ggccagcacgucauccuggg

SEQ ID NO: 2436336 - RNA, 18 nt, Bordetella pertussis
ggccagcagaaugccgcc

SEQ ID NO: 2436337 - RNA, 22 nt, Bordetella pertussis
ggccagcagaaugccgcccacg

SEQ ID NO: 2436338 - RNA, 22 nt, Bordetella pertussis
ggccagcagcacgaucgcggcg

SEQ ID NO: 2436339 - RNA, 14 nt, Bordetella pertussis
ggccagcagcgacg

SEQ ID NO: 2436340 - RNA, 17 nt, Bordetella pertussis
ggccagcagcgacggcc

SEQ ID NO: 2436341 - RNA, 21 nt, Bordetella pertussis
ggccagcagcgacggccccag

SEQ ID NO: 2436342 - RNA, 22 nt, Bordetella pertussis
ggccagcagcgacggccccagc

SEQ ID NO: 2436343 - RNA, 19 nt, Bordetella pertussis
ggccagcagcgcaucgcgc

SEQ ID NO: 2436344 - RNA, 20 nt, Bordetella pertussis
ggccagcagcgcaucgcgcg

SEQ ID NO: 2436345 - RNA, 13 nt, Bordetella pertussis
ggccagcagcgcc

SEQ ID NO: 2436346 - RNA, 16 nt, Bordetella pertussis
ggccagcagcgccgcc

SEQ ID NO: 2436347 - RNA, 22 nt, Bordetella pertussis
ggccagcagcgccgccagcaug

SEQ ID NO: 2436348 - RNA, 15 nt, Bordetella pertussis
ggccagcagcgccug

SEQ ID NO: 2436349 - RNA, 14 nt, Bordetella pertussis
ggccagcagcgcgu

SEQ ID NO: 2436350 - RNA, 16 nt, Bordetella pertussis
ggccagcagcgcgugc

SEQ ID NO: 2436351 - RNA, 20 nt, Bordetella pertussis
ggccagcagcuggcgcagca

SEQ ID NO: 2436352 - RNA, 19 nt, Bordetella pertussis
ggccagcaggagcccgcug

SEQ ID NO: 2436353 - RNA, 20 nt, Bordetella pertussis
ggccagcaggagcccgcugc

SEQ ID NO: 2436354 - RNA, 22 nt, Bordetella pertussis
ggccagcaggagcccgcugccg

SEQ ID NO: 2436355 - RNA, 21 nt, Bordetella pertussis
ggccagcaggcucagcgggcu

SEQ ID NO: 2436356 - RNA, 19 nt, Bordetella pertussis
ggccagcaggucguuggcc

SEQ ID NO: 2436357 - RNA, 21 nt, Bordetella pertussis
ggccagcaguguuucggccug

SEQ ID NO: 2436358 - RNA, 22 nt, Bordetella pertussis
ggccagcaguguuucggccugc

SEQ ID NO: 2436359 - RNA, 20 nt, Bordetella pertussis
ggccagcauacccugcgcgc

SEQ ID NO: 2436360 - RNA, 22 nt, Bordetella pertussis
ggccagcauacccugcgcgccg

SEQ ID NO: 2436361 - RNA, 22 nt, Bordetella pertussis
ggccagcaucggcacccagccg

SEQ ID NO: 2436362 - RNA, 23 nt, Bordetella pertussis
ggccagcaucggcacccagccgg

SEQ ID NO: 2436363 - RNA, 20 nt, Bordetella pertussis
ggccagcaucguaucgggcg

SEQ ID NO: 2436364 - RNA, 22 nt, Bordetella pertussis
ggccagcaucguaucgggcguc

SEQ ID NO: 2436365 - RNA, 13 nt, Bordetella pertussis
ggccagcauggcc

SEQ ID NO: 2436366 - RNA, 21 nt, Bordetella pertussis
ggccagcauggccguggcgug

SEQ ID NO: 2436367 - RNA, 19 nt, Bordetella pertussis
ggccagcauuaccagcaac

SEQ ID NO: 2436368 - RNA, 14 nt, Bordetella pertussis
ggccagccacgccg

SEQ ID NO: 2436369 - RNA, 17 nt, Bordetella pertussis
ggccagccacgccggcg

SEQ ID NO: 2436370 - RNA, 19 nt, Bordetella pertussis
ggccagccacgccggcgcg

SEQ ID NO: 2436371 - RNA, 21 nt, Bordetella pertussis
ggccagccacgccggcgcgcc

SEQ ID NO: 2436372 - RNA, 12 nt, Bordetella pertussis
ggccagccagcg

SEQ ID NO: 2436373 - RNA, 16 nt, Bordetella pertussis
ggccagccagcgccgc

SEQ ID NO: 2436374 - RNA, 18 nt, Bordetella pertussis
ggccagccagcgccgcag

SEQ ID NO: 2436375 - RNA, 19 nt, Bordetella pertussis
ggccagccaggcgguggcc

SEQ ID NO: 2436376 - RNA, 17 nt, Bordetella pertussis
ggccagccauugccgca

SEQ ID NO: 2436377 - RNA, 20 nt, Bordetella pertussis
ggccagccauugccgcacga

SEQ ID NO: 2436378 - RNA, 20 nt, Bordetella pertussis
ggccagccccaccuugccca

SEQ ID NO: 2436379 - RNA, 22 nt, Bordetella pertussis
ggccagccccaccuugcccagc

SEQ ID NO: 2436380 - RNA, 23 nt, Bordetella pertussis
ggccagccccaccuugcccagca

SEQ ID NO: 2436381 - RNA, 16 nt, Bordetella pertussis
ggccagccccggcgcg

SEQ ID NO: 2436382 - RNA, 19 nt, Bordetella pertussis
ggccagccccggcgcgccg

SEQ ID NO: 2436383 - RNA, 14 nt, Bordetella pertussis
ggccagcccgcgcg

SEQ ID NO: 2436384 - RNA, 15 nt, Bordetella pertussis
ggccagcccgcgcgc

SEQ ID NO: 2436385 - RNA, 17 nt, Bordetella pertussis
ggccagcccgcgcgcgu

SEQ ID NO: 2436386 - RNA, 17 nt, Bordetella pertussis
ggccagccgcucgcgcg

SEQ ID NO: 2436387 - RNA, 20 nt, Bordetella pertussis
ggccagccgcucgcgcgacc

SEQ ID NO: 2436388 - RNA, 16 nt, Bordetella pertussis
ggccagccggcccagc

SEQ ID NO: 2436389 - RNA, 21 nt, Bordetella pertussis
ggccagccggcccagcaugcc

SEQ ID NO: 2436390 - RNA, 23 nt, Bordetella pertussis
ggccagccggccgauggcaucgc

SEQ ID NO: 2436391 - RNA, 14 nt, Bordetella pertussis
ggccagccggcgcg

SEQ ID NO: 2436392 - RNA, 20 nt, Bordetella pertussis
ggccagccggcgcgccaugg

SEQ ID NO: 2436393 - RNA, 13 nt, Bordetella pertussis
ggccagccugccc

SEQ ID NO: 2436394 - RNA, 19 nt, Bordetella pertussis
ggccagccugcccgucgac

SEQ ID NO: 2436395 - RNA, 17 nt, Bordetella pertussis
ggccagccugccgcggc

SEQ ID NO: 2436396 - RNA, 18 nt, Bordetella pertussis
ggccagccugccgcggcc

SEQ ID NO: 2436397 - RNA, 19 nt, Bordetella pertussis
ggccagccugccgcggccg

SEQ ID NO: 2436398 - RNA, 14 nt, Bordetella pertussis
ggccagccuggccu

SEQ ID NO: 2436399 - RNA, 13 nt, Bordetella pertussis
ggccagccuggcg

SEQ ID NO: 2436400 - RNA, 22 nt, Bordetella pertussis
ggccagcgaaccgaaaugccgc

SEQ ID NO: 2436401 - RNA, 14 nt, Bordetella pertussis
ggccagcgacccgc

SEQ ID NO: 2436402 - RNA, 16 nt, Bordetella pertussis
ggccagcgaggccgcu

SEQ ID NO: 2436403 - RNA, 17 nt, Bordetella pertussis
ggccagcgccaccaccg

SEQ ID NO: 2436404 - RNA, 12 nt, Bordetella pertussis
ggccagcgccag

SEQ ID NO: 2436405 - RNA, 14 nt, Bordetella pertussis
ggccagcgccagca

SEQ ID NO: 2436406 - RNA, 15 nt, Bordetella pertussis
ggccaggcgcgccgc

SEQ ID NO: 2436407 - RNA, 18 nt, Bordetella pertussis
ggccaggcgcgugcgcag

SEQ ID NO: 2436408 - RNA, 16 nt, Bordetella pertussis
ggccaggcgcuccagc

SEQ ID NO: 2436409 - RNA, 17 nt, Bordetella pertussis
ggccaggcgcuccagca

SEQ ID NO: 2436410 - RNA, 18 nt, Bordetella pertussis
ggccaggcgcuccagcac

SEQ ID NO: 2436411 - RNA, 15 nt, Bordetella pertussis
ggccaggcucagcag

SEQ ID NO: 2436412 - RNA, 16 nt, Bordetella pertussis
ggccaggcucagcagg

SEQ ID NO: 2436413 - RNA, 14 nt, Bordetella pertussis
ggccaggcucuggg

SEQ ID NO: 2436414 - RNA, 17 nt, Bordetella pertussis
ggccaggcugaccagcg

SEQ ID NO: 2436415 - RNA, 16 nt, Bordetella pertussis
ggccagggaggcgaug

SEQ ID NO: 2436416 - RNA, 19 nt, Bordetella pertussis
ggccagggagugcgaggac

SEQ ID NO: 2436417 - RNA, 17 nt, Bordetella pertussis
ggccagggcaagcgcgu

SEQ ID NO: 2436418 - RNA, 23 nt, Bordetella pertussis
ggccagggcaagcgcgucgaugg

SEQ ID NO: 2436419 - RNA, 14 nt, Bordetella pertussis
ggccagggccacca

SEQ ID NO: 2436420 - RNA, 19 nt, Bordetella pertussis
ggccagggccacgccggcc

SEQ ID NO: 2436421 - RNA, 20 nt, Bordetella pertussis
ggccagggccacgccggccg

SEQ ID NO: 2436422 - RNA, 17 nt, Bordetella pertussis
ggccagggccucgcggg

SEQ ID NO: 2436423 - RNA, 13 nt, Bordetella pertussis
ggccagggccugc

SEQ ID NO: 2436424 - RNA, 20 nt, Bordetella pertussis
ggccagggccugcgggccgg

SEQ ID NO: 2436425 - RNA, 17 nt, Bordetella pertussis
ggccagggcgaugcggc

SEQ ID NO: 2436426 - RNA, 21 nt, Bordetella pertussis
ggccagggcgaugcggcggcc

SEQ ID NO: 2436427 - RNA, 22 nt, Bordetella pertussis
ggccagggcgaugcggcggccg

SEQ ID NO: 2436428 - RNA, 12 nt, Bordetella pertussis
ggccagggcggc

SEQ ID NO: 2436429 - RNA, 14 nt, Bordetella pertussis
ggccagggcugcgg

SEQ ID NO: 2436430 - RNA, 15 nt, Bordetella pertussis
ggccagggcugcggc

SEQ ID NO: 2436431 - RNA, 15 nt, Bordetella pertussis
ggccaggggcgcugg

SEQ ID NO: 2436432 - RNA, 18 nt, Bordetella pertussis
ggccagggugccccgccg

SEQ ID NO: 2436433 - RNA, 19 nt, Bordetella pertussis
ggccagguacaggccgccg

SEQ ID NO: 2436434 - RNA, 21 nt, Bordetella pertussis
ggccagguagucgucgaaggc

SEQ ID NO: 2436435 - RNA, 20 nt, Bordetella pertussis
ggccagguauucggcgguga

SEQ ID NO: 2436436 - RNA, 19 nt, Bordetella pertussis
ggccagguauugcucggcg

SEQ ID NO: 2436437 - RNA, 22 nt, Bordetella pertussis
ggccagguauugcucggcgguc

SEQ ID NO: 2436438 - RNA, 17 nt, Bordetella pertussis
ggccaggucgcgcauca

SEQ ID NO: 2436439 - RNA, 13 nt, Bordetella pertussis
ggccaggucggcg

SEQ ID NO: 2436440 - RNA, 20 nt, Bordetella pertussis
ggccaggucggcggccagcg

SEQ ID NO: 2436441 - RNA, 17 nt, Bordetella pertussis
ggccaggugcacagcgu

SEQ ID NO: 2436442 - RNA, 14 nt, Bordetella pertussis
ggccagguggcggc

SEQ ID NO: 2436443 - RNA, 15 nt, Bordetella pertussis
ggccagguggcggcg

SEQ ID NO: 2436444 - RNA, 18 nt, Bordetella pertussis
ggccagguggcggcggca

SEQ ID NO: 2436445 - RNA, 20 nt, Bordetella pertussis
ggccagguugggugcgccgc

SEQ ID NO: 2436446 - RNA, 22 nt, Bordetella pertussis
ggccagguugggugcgccgccg

SEQ ID NO: 2436447 - RNA, 14 nt, Bordetella pertussis
ggccagucccagga

SEQ ID NO: 2436448 - RNA, 23 nt, Bordetella pertussis
ggccagucccaggaucaccgccg

SEQ ID NO: 2436449 - RNA, 14 nt, Bordetella pertussis
ggccaguccgcagc

SEQ ID NO: 2436450 - RNA, 20 nt, Bordetella pertussis
ggccagucuggcuucguugg

SEQ ID NO: 2436451 - RNA, 23 nt, Bordetella pertussis
ggccagugauggccugcuuggcg

SEQ ID NO: 2436452 - RNA, 20 nt, Bordetella pertussis
ggccagugccuggacgcgcu

SEQ ID NO: 2436453 - RNA, 22 nt, Bordetella pertussis
ggccagugccuggacgcgcugg

SEQ ID NO: 2436454 - RNA, 18 nt, Bordetella pertussis
ggccaguuccgugcgcgc

SEQ ID NO: 2436455 - RNA, 18 nt, Bordetella pertussis
ggccaguucgacgcccau

SEQ ID NO: 2436456 - RNA, 16 nt, Bordetella pertussis
ggccaguucgcggcgc

SEQ ID NO: 2436457 - RNA, 15 nt, Bordetella pertussis
ggccaguucggcuug

SEQ ID NO: 2436458 - RNA, 16 nt, Bordetella pertussis
ggccaguucggcuugc

SEQ ID NO: 2436459 - RNA, 22 nt, Bordetella pertussis
ggccaguucguccgcuucgucg

SEQ ID NO: 2436460 - RNA, 15 nt, Bordetella pertussis
ggccaucaccgccuc

SEQ ID NO: 2436461 - RNA, 17 nt, Bordetella pertussis
ggccaucaccgccuccg

SEQ ID NO: 2436462 - RNA, 22 nt, Bordetella pertussis
ggccaucacgccgaucuucugg

SEQ ID NO: 2436463 - RNA, 18 nt, Bordetella pertussis
ggccaucaggugcagggu

SEQ ID NO: 2436464 - RNA, 20 nt, Bordetella pertussis
ggccaucagguuguccagcg

SEQ ID NO: 2436465 - RNA, 22 nt, Bordetella pertussis
ggccaucagguuguccagcgcg

SEQ ID NO: 2436466 - RNA, 17 nt, Bordetella pertussis
ggccauccggccacgca

SEQ ID NO: 2436467 - RNA, 19 nt, Bordetella pertussis
ggccauccguccgccagga

SEQ ID NO: 2436468 - RNA, 16 nt, Bordetella pertussis
ggccaucgaagccaga

SEQ ID NO: 2436469 - RNA, 13 nt, Bordetella pertussis
ggccaucgacgcc

SEQ ID NO: 2436470 - RNA, 14 nt, Bordetella pertussis
ggccaucgccgcca

SEQ ID NO: 2436471 - RNA, 14 nt, Bordetella pertussis
ggccaucgccgccg

SEQ ID NO: 2436472 - RNA, 21 nt, Bordetella pertussis
ggccaucgccgccgccgggcu

SEQ ID NO: 2436473 - RNA, 12 nt, Bordetella pertussis
ggccaucgcggu

SEQ ID NO: 2436474 - RNA, 13 nt, Bordetella pertussis
ggccaucggcgcc

SEQ ID NO: 2436475 - RNA, 22 nt, Bordetella pertussis
ggccaucgggauaccgcuggcc

SEQ ID NO: 2436476 - RNA, 16 nt, Bordetella pertussis
ggccaucgggcugcgg

SEQ ID NO: 2436477 - RNA, 12 nt, Bordetella pertussis
ggccaucguacg

SEQ ID NO: 2436478 - RNA, 12 nt, Bordetella pertussis
ggccaugacggc

SEQ ID NO: 2436479 - RNA, 14 nt, Bordetella pertussis
ggccaugacggcca

SEQ ID NO: 2436480 - RNA, 22 nt, Bordetella pertussis
ggccaugacgggaauccgcugc

SEQ ID NO: 2436481 - RNA, 14 nt, Bordetella pertussis
ggccaugcaccagc

SEQ ID NO: 2436482 - RNA, 15 nt, Bordetella pertussis
ggccaugcaccagca

SEQ ID NO: 2436483 - RNA, 18 nt, Bordetella pertussis
ggccaugcaccagcacau

SEQ ID NO: 2436484 - RNA, 19 nt, Bordetella pertussis
ggccaugcccaggcccagu

SEQ ID NO: 2436485 - RNA, 22 nt, Bordetella pertussis
ggccaugcccaggcccaguucg

SEQ ID NO: 2436486 - RNA, 23 nt, Bordetella pertussis
ggccaugccgacggauucgccca

SEQ ID NO: 2436487 - RNA, 17 nt, Bordetella pertussis
ggccaugccguccugcu

SEQ ID NO: 2436488 - RNA, 21 nt, Bordetella pertussis
ggccaugccguccugcugcgg

SEQ ID NO: 2436489 - RNA, 22 nt, Bordetella pertussis
ggccaugcgauaggcgaagcgc

SEQ ID NO: 2436490 - RNA, 13 nt, Bordetella pertussis
ggccaugcgccgc

SEQ ID NO: 2436491 - RNA, 16 nt, Bordetella pertussis
ggccaugcgcgccagc

SEQ ID NO: 2436492 - RNA, 17 nt, Bordetella pertussis
ggccaugcgcgccagca

SEQ ID NO: 2436493 - RNA, 19 nt, Bordetella pertussis
ggccaugcgcgccagcaug

SEQ ID NO: 2436494 - RNA, 21 nt, Bordetella pertussis
ggccaugcgcuuggaccccgu

SEQ ID NO: 2436495 - RNA, 21 nt, Bordetella pertussis
ggccaugcgggucaggccgcc

SEQ ID NO: 2436496 - RNA, 22 nt, Bordetella pertussis
ggccaugcgggucaggccgccg

SEQ ID NO: 2436497 - RNA, 14 nt, Bordetella pertussis
ggccaugcucagca

SEQ ID NO: 2436498 - RNA, 17 nt, Bordetella pertussis
ggccaugcucagcagca

SEQ ID NO: 2436499 - RNA, 18 nt, Bordetella pertussis
ggccaugcucagcagcac

SEQ ID NO: 2436500 - RNA, 19 nt, Bordetella pertussis
ggccaugcucguccaucgc

SEQ ID NO: 2436501 - RNA, 19 nt, Bordetella pertussis
ggccaugcugggcgggcug

SEQ ID NO: 2436502 - RNA, 17 nt, Bordetella pertussis
ggccauggacagcaccg

SEQ ID NO: 2436503 - RNA, 16 nt, Bordetella pertussis
ggccauggaugcgcgc

SEQ ID NO: 2436504 - RNA, 14 nt, Bordetella pertussis
ggccauggcacagg

SEQ ID NO: 2436505 - RNA, 18 nt, Bordetella pertussis
ggccauggcacaggccau

SEQ ID NO: 2436506 - RNA, 18 nt, Bordetella pertussis
ggccauggcagggcgccg

SEQ ID NO: 2436507 - RNA, 12 nt, Bordetella pertussis
ggccauggccag

SEQ ID NO: 2436508 - RNA, 14 nt, Bordetella pertussis
ggccauggccagcu

SEQ ID NO: 2436509 - RNA, 18 nt, Bordetella pertussis
ggccauggcccuugccgc

SEQ ID NO: 2436510 - RNA, 12 nt, Bordetella pertussis
ggccauggccgc

SEQ ID NO: 2436511 - RNA, 13 nt, Bordetella pertussis
ggccauggccgcc

SEQ ID NO: 2436512 - RNA, 21 nt, Bordetella pertussis
ggccauggccgccacacgagg

SEQ ID NO: 2436513 - RNA, 16 nt, Bordetella pertussis
ggccauggcggccggc

SEQ ID NO: 2436514 - RNA, 14 nt, Bordetella pertussis
ggccauggcgguga

SEQ ID NO: 2436515 - RNA, 20 nt, Bordetella pertussis
ggccaugucagucguccucc

SEQ ID NO: 2436516 - RNA, 22 nt, Bordetella pertussis
ggccaugucagucguccuccgc

SEQ ID NO: 2436517 - RNA, 14 nt, Bordetella pertussis
ggccauguccagca

SEQ ID NO: 2436518 - RNA, 15 nt, Bordetella pertussis
ggccauguccuggca

SEQ ID NO: 2436519 - RNA, 12 nt, Bordetella pertussis
ggccccagcgcc

SEQ ID NO: 2436520 - RNA, 13 nt, Bordetella pertussis
ggccccagcgccg

SEQ ID NO: 2436521 - RNA, 15 nt, Bordetella pertussis
ggccccagcgccgcg

SEQ ID NO: 2436522 - RNA, 15 nt, Bordetella pertussis
ggccccaggccgggu

SEQ ID NO: 2436523 - RNA, 14 nt, Bordetella pertussis
ggccccaggcgccc

SEQ ID NO: 2436524 - RNA, 17 nt, Bordetella pertussis
ggccccaugcgcggcac

SEQ ID NO: 2436525 - RNA, 12 nt, Bordetella pertussis
ggcccccagccc

SEQ ID NO: 2436526 - RNA, 13 nt, Bordetella pertussis
ggcccccagccca

SEQ ID NO: 2436527 - RNA, 15 nt, Bordetella pertussis
ggccccccggcgcgg

SEQ ID NO: 2436528 - RNA, 22 nt, Bordetella pertussis
ggccccgcaaggggccggcgcc

SEQ ID NO: 2436529 - RNA, 13 nt, Bordetella pertussis
ggccccgcagggc

SEQ ID NO: 2436530 - RNA, 18 nt, Bordetella pertussis
ggccccgcagggcccgca

SEQ ID NO: 2436531 - RNA, 16 nt, Bordetella pertussis
ggccccgccgggccgc

SEQ ID NO: 2436532 - RNA, 15 nt, Bordetella pertussis
ggccccgcgaggggc

SEQ ID NO: 2436533 - RNA, 15 nt, Bordetella pertussis
ggccccggccgcccc

SEQ ID NO: 2436534 - RNA, 22 nt, Bordetella pertussis
ggccccggccgguuccugcaag

SEQ ID NO: 2436535 - RNA, 14 nt, Bordetella pertussis
ggccccggcucccg

SEQ ID NO: 2436536 - RNA, 18 nt, Bordetella pertussis
ggccccggcucccgcgcc

SEQ ID NO: 2436537 - RNA, 16 nt, Bordetella pertussis
ggccccguugucgccg

SEQ ID NO: 2436538 - RNA, 21 nt, Bordetella pertussis
ggccccguugucgccgcggcc

SEQ ID NO: 2436539 - RNA, 15 nt, Bordetella pertussis
ggccccuccggcgcc

SEQ ID NO: 2436540 - RNA, 12 nt, Bordetella pertussis
ggccccucgcgg

SEQ ID NO: 2436541 - RNA, 23 nt, Bordetella pertussis
ggcccgaaacgcgcagcaccggc

SEQ ID NO: 2436542 - RNA, 18 nt, Bordetella pertussis
ggcccgaauuccagcucu

SEQ ID NO: 2436543 - RNA, 14 nt, Bordetella pertussis
ggcccgacagcgcc

SEQ ID NO: 2436544 - RNA, 13 nt, Bordetella pertussis
ggcccgauacaug

SEQ ID NO: 2436545 - RNA, 16 nt, Bordetella pertussis
ggcccgaucgccggug

SEQ ID NO: 2436546 - RNA, 21 nt, Bordetella pertussis
ggcccgauggcggggauggag

SEQ ID NO: 2436547 - RNA, 12 nt, Bordetella pertussis
ggcccgcaccgg

SEQ ID NO: 2436548 - RNA, 18 nt, Bordetella pertussis
ggcccgcaccgggcggcc

SEQ ID NO: 2436549 - RNA, 20 nt, Bordetella pertussis
ggcccgcaccgggcggcccg

SEQ ID NO: 2436550 - RNA, 22 nt, Bordetella pertussis
ggcccgcaccgggcggcccggc

SEQ ID NO: 2436551 - RNA, 22 nt, Bordetella pertussis
ggcccgcaccugaacaccggcg

SEQ ID NO: 2436552 - RNA, 17 nt, Bordetella pertussis
ggcccgcaccuugccug

SEQ ID NO: 2436553 - RNA, 16 nt, Bordetella pertussis
ggcccgcauguccgag

SEQ ID NO: 2436554 - RNA, 19 nt, Bordetella pertussis
ggcccgccaccacggcgcg

SEQ ID NO: 2436555 - RNA, 21 nt, Bordetella pertussis
ggcccgccaccacggcgcgga

SEQ ID NO: 2436556 - RNA, 23 nt, Bordetella pertussis
ggcccgccacgcaggcgggcgcc

SEQ ID NO: 2436557 - RNA, 16 nt, Bordetella pertussis
ggcccgccacggcgcc

SEQ ID NO: 2436558 - RNA, 17 nt, Bordetella pertussis
ggcccgccacggcgccc

SEQ ID NO: 2436559 - RNA, 18 nt, Bordetella pertussis
ggcccgccagcaaggcgg

SEQ ID NO: 2436560 - RNA, 14 nt, Bordetella pertussis
ggcccgccagggcc

SEQ ID NO: 2436561 - RNA, 15 nt, Bordetella pertussis
ggcccgccagggcca

SEQ ID NO: 2436562 - RNA, 20 nt, Bordetella pertussis
ggcccgccauugcacgcgca

SEQ ID NO: 2436563 - RNA, 23 nt, Bordetella pertussis
ggcccgccauugcacgcgcagga

SEQ ID NO: 2436564 - RNA, 20 nt, Bordetella pertussis
ggcccgccgacugggcuugc

SEQ ID NO: 2436565 - RNA, 13 nt, Bordetella pertussis
ggcccgccgcggc

SEQ ID NO: 2436566 - RNA, 19 nt, Bordetella pertussis
ggcccgccgcggcaggccc

SEQ ID NO: 2436567 - RNA, 21 nt, Bordetella pertussis
ggcccgccgcggcaggccccg

SEQ ID NO: 2436568 - RNA, 23 nt, Bordetella pertussis
ggcccgccgcggcaggccccggc

SEQ ID NO: 2436569 - RNA, 14 nt, Bordetella pertussis
ggcccgcgccagcg

SEQ ID NO: 2436570 - RNA, 20 nt, Bordetella pertussis
ggcccgcgccgacggcggcg

SEQ ID NO: 2436571 - RNA, 13 nt, Bordetella pertussis
ggcccgcgccgcg

SEQ ID NO: 2436572 - RNA, 13 nt, Bordetella pertussis
ggcccgcgcgagc

SEQ ID NO: 2436573 - RNA, 20 nt, Bordetella pertussis
ggcccgcgcgagcggcgugc

SEQ ID NO: 2436574 - RNA, 13 nt, Bordetella pertussis
ggcccgcgcgccu

SEQ ID NO: 2436575 - RNA, 14 nt, Bordetella pertussis
ggcccgcgcgccuu

SEQ ID NO: 2436576 - RNA, 14 nt, Bordetella pertussis
ggcccgcgcggcca

SEQ ID NO: 2436577 - RNA, 15 nt, Bordetella pertussis
ggcccgcgcggccag

SEQ ID NO: 2436578 - RNA, 16 nt, Bordetella pertussis
ggcccgcgcggccagc

SEQ ID NO: 2436579 - RNA, 19 nt, Bordetella pertussis
ggcccgcgcggccagcgcc

SEQ ID NO: 2436580 - RNA, 20 nt, Bordetella pertussis
ggcccgcgcggccagcgccg

SEQ ID NO: 2436581 - RNA, 15 nt, Bordetella pertussis
ggcccgcgcuguugc

SEQ ID NO: 2436582 - RNA, 22 nt, Bordetella pertussis
ggcccgcgcuguugcuccaggc

SEQ ID NO: 2436583 - RNA, 14 nt, Bordetella pertussis
ggcccgcggccgcg

SEQ ID NO: 2436584 - RNA, 12 nt, Bordetella pertussis
ggcccgcggccu

SEQ ID NO: 2436585 - RNA, 14 nt, Bordetella pertussis
ggcccgcggccuug

SEQ ID NO: 2436586 - RNA, 14 nt, Bordetella pertussis
ggcccgcggcgcca

SEQ ID NO: 2436587 - RNA, 14 nt, Bordetella pertussis
ggcccgcgggcgcc

SEQ ID NO: 2436588 - RNA, 15 nt, Bordetella pertussis
ggcccgcgggcgccc

SEQ ID NO: 2436589 - RNA, 23 nt, Bordetella pertussis
ggcccgcgggcgcccggccggcc

SEQ ID NO: 2436590 - RNA, 16 nt, Bordetella pertussis
ggcccgcgucuuggcg

SEQ ID NO: 2436591 - RNA, 21 nt, Bordetella pertussis
ggcccgcgucuuggcgggcac

SEQ ID NO: 2436592 - RNA, 15 nt, Bordetella pertussis
ggcccgcuccaggcg

SEQ ID NO: 2436593 - RNA, 16 nt, Bordetella pertussis
ggcccgcuccaggcgg

SEQ ID NO: 2436594 - RNA, 18 nt, Bordetella pertussis
ggcccgcuccaggcggcc

SEQ ID NO: 2436595 - RNA, 19 nt, Bordetella pertussis
ggcccgcuccaggcggcca

SEQ ID NO: 2436596 - RNA, 21 nt, Bordetella pertussis
ggcccgcuccaggcggccagu

SEQ ID NO: 2436597 - RNA, 14 nt, Bordetella pertussis
ggcccgcucggcca

SEQ ID NO: 2436598 - RNA, 16 nt, Bordetella pertussis
ggcccgcucggccagc

SEQ ID NO: 2436599 - RNA, 19 nt, Bordetella pertussis
ggcccgcucggccagcagu

SEQ ID NO: 2436600 - RNA, 18 nt, Bordetella pertussis
ggcccggaauaccgccag

SEQ ID NO: 2436601 - RNA, 23 nt, Bordetella pertussis
ggcccggaauaccgccagcucgg

SEQ ID NO: 2436602 - RNA, 19 nt, Bordetella pertussis
ggcccggacgcggccggca

SEQ ID NO: 2436603 - RNA, 18 nt, Bordetella pertussis
ggcccggauauggccggc

SEQ ID NO: 2436604 - RNA, 21 nt, Bordetella pertussis
ggcccggauauggccggcgcg

SEQ ID NO: 2436605 - RNA, 16 nt, Bordetella pertussis
ggcccggccaagcugg

SEQ ID NO: 2436606 - RNA, 19 nt, Bordetella pertussis
ggcccggccacggccgggc

SEQ ID NO: 2436607 - RNA, 16 nt, Bordetella pertussis
ggcccggccgcagggc

SEQ ID NO: 2436608 - RNA, 17 nt, Bordetella pertussis
ggcccggccgccgccgg

SEQ ID NO: 2436609 - RNA, 20 nt, Bordetella pertussis
ggcccggcgccggugggcag

SEQ ID NO: 2436610 - RNA, 13 nt, Bordetella pertussis
ggcccggcgcgac

SEQ ID NO: 2436611 - RNA, 15 nt, Bordetella pertussis
ggcccggcgcgcauc

SEQ ID NO: 2436612 - RNA, 14 nt, Bordetella pertussis
ggcccggcgcgccu

SEQ ID NO: 2436613 - RNA, 15 nt, Bordetella pertussis
ggcccggcgcgccuu

SEQ ID NO: 2436614 - RNA, 22 nt, Bordetella pertussis
ggcccggcggaucacccagcgg

SEQ ID NO: 2436615 - RNA, 17 nt, Bordetella pertussis
ggcccggcggcaaaaaa

SEQ ID NO: 2436616 - RNA, 15 nt, Bordetella pertussis
ggcccggcguagcug

SEQ ID NO: 2436617 - RNA, 22 nt, Bordetella pertussis
ggcccggcguagcugcgccgca

SEQ ID NO: 2436618 - RNA, 17 nt, Bordetella pertussis
ggcccggcucgccgagc

SEQ ID NO: 2436619 - RNA, 24 nt, Bordetella pertussis
ggcccggcucgccgagccgggcca

SEQ ID NO: 2436620 - RNA, 21 nt, Bordetella pertussis
ggcccggcugccgcggauugc

SEQ ID NO: 2436621 - RNA, 14 nt, Bordetella pertussis
ggcccgggcaggcu

SEQ ID NO: 2436622 - RNA, 16 nt, Bordetella pertussis
ggcccgggcaggcuca

SEQ ID NO: 2436623 - RNA, 16 nt, Bordetella pertussis
ggcccgggcgagaugg

SEQ ID NO: 2436624 - RNA, 12 nt, Bordetella pertussis
ggcccgggcgcc

SEQ ID NO: 2436625 - RNA, 18 nt, Bordetella pertussis
ggcccgggcgccugcgcc

SEQ ID NO: 2436626 - RNA, 13 nt, Bordetella pertussis
ggcccgggcgcgc

SEQ ID NO: 2436627 - RNA, 14 nt, Bordetella pertussis
ggcccgggcgcgcu

SEQ ID NO: 2436628 - RNA, 16 nt, Bordetella pertussis
ggcccgggcgcgcugu

SEQ ID NO: 2436629 - RNA, 18 nt, Bordetella pertussis
ggcccgggcguggcgucg

SEQ ID NO: 2436630 - RNA, 16 nt, Bordetella pertussis
ggcccgggugggcggc

SEQ ID NO: 2436631 - RNA, 18 nt, Bordetella pertussis
ggcccgggugggcggcau

SEQ ID NO: 2436632 - RNA, 20 nt, Bordetella pertussis
ggcccgguaggccacgcgcg

SEQ ID NO: 2436633 - RNA, 20 nt, Bordetella pertussis
ggccgagcgggccagcgcgg

SEQ ID NO: 2436634 - RNA, 17 nt, Bordetella pertussis
ggccgagcgugccggga

SEQ ID NO: 2436635 - RNA, 15 nt, Bordetella pertussis
ggccgagcuccucga

SEQ ID NO: 2436636 - RNA, 21 nt, Bordetella pertussis
ggccgagcuccucgagcgugg

SEQ ID NO: 2436637 - RNA, 16 nt, Bordetella pertussis
ggccgaggaccugcug

SEQ ID NO: 2436638 - RNA, 15 nt, Bordetella pertussis
ggccgaggccagcgu

SEQ ID NO: 2436639 - RNA, 13 nt, Bordetella pertussis
ggccgaggccagg

SEQ ID NO: 2436640 - RNA, 14 nt, Bordetella pertussis
ggccgaggccaggu

SEQ ID NO: 2436641 - RNA, 17 nt, Bordetella pertussis
ggccgaggccagguugg

SEQ ID NO: 2436642 - RNA, 18 nt, Bordetella pertussis
ggccgaggccagguuggg

SEQ ID NO: 2436643 - RNA, 17 nt, Bordetella pertussis
ggccgaggucggcgguc

SEQ ID NO: 2436644 - RNA, 18 nt, Bordetella pertussis
ggccgaggugcccaucag

SEQ ID NO: 2436645 - RNA, 20 nt, Bordetella pertussis
ggccgagguggacaagaaag

SEQ ID NO: 2436646 - RNA, 16 nt, Bordetella pertussis
ggccgaguagcggcgc

SEQ ID NO: 2436647 - RNA, 17 nt, Bordetella pertussis
ggccgaguggccgcugu

SEQ ID NO: 2436648 - RNA, 18 nt, Bordetella pertussis
ggccgauacgcgugcgcg

SEQ ID NO: 2436649 - RNA, 21 nt, Bordetella pertussis
ggccgauacgcgugcgcggcc

SEQ ID NO: 2436650 - RNA, 22 nt, Bordetella pertussis
ggccgauacgcgugcgcggccg

SEQ ID NO: 2436651 - RNA, 14 nt, Bordetella pertussis
ggccgauagccgcg

SEQ ID NO: 2436652 - RNA, 16 nt, Bordetella pertussis
ggccgauagccgcggc

SEQ ID NO: 2436653 - RNA, 17 nt, Bordetella pertussis
ggccgauagccgcggcg

SEQ ID NO: 2436654 - RNA, 19 nt, Bordetella pertussis
ggccgauagccgcggcgcc

SEQ ID NO: 2436655 - RNA, 19 nt, Bordetella pertussis
ggccgaucaccugcaggcc

SEQ ID NO: 2436656 - RNA, 17 nt, Bordetella pertussis
ggccgaucagcaccacg

SEQ ID NO: 2436657 - RNA, 18 nt, Bordetella pertussis
ggccgaucagcaccacgg

SEQ ID NO: 2436658 - RNA, 22 nt, Bordetella pertussis
ggccgaucagcaccacggcggc

SEQ ID NO: 2436659 - RNA, 23 nt, Bordetella pertussis
ggccgaucagcaccacggcggcc

SEQ ID NO: 2436660 - RNA, 15 nt, Bordetella pertussis
ggccgaucagcgaca

SEQ ID NO: 2436661 - RNA, 17 nt, Bordetella pertussis
ggccgaucagcgacagc

SEQ ID NO: 2436662 - RNA, 16 nt, Bordetella pertussis
ggccgaucccuugugc

SEQ ID NO: 2436663 - RNA, 22 nt, Bordetella pertussis
ggccgaucccuugugcgcgcca

SEQ ID NO: 2436664 - RNA, 14 nt, Bordetella pertussis
ggccgaucgcgccg

SEQ ID NO: 2436665 - RNA, 17 nt, Bordetella pertussis
ggccgaucucacgggcg

SEQ ID NO: 2436666 - RNA, 22 nt, Bordetella pertussis
ggccgaucugcugggccgggug

SEQ ID NO: 2436667 - RNA, 18 nt, Bordetella pertussis
ggccgaugaagacgccgu

SEQ ID NO: 2436668 - RNA, 20 nt, Bordetella pertussis
ggccgaugaagacgccgucg

SEQ ID NO: 2436669 - RNA, 23 nt, Bordetella pertussis
ggccgaugaagacgccgucgacc

SEQ ID NO: 2436670 - RNA, 17 nt, Bordetella pertussis
ggccgaugaauugcgcc

SEQ ID NO: 2436671 - RNA, 19 nt, Bordetella pertussis
ggccgaugaauugcgccac

SEQ ID NO: 2436672 - RNA, 16 nt, Bordetella pertussis
ggccgaugacaucgcc

SEQ ID NO: 2436673 - RNA, 17 nt, Bordetella pertussis
ggccgaugacaucgccg

SEQ ID NO: 2436674 - RNA, 17 nt, Bordetella pertussis
ggccgaugcguccgccg

SEQ ID NO: 2436675 - RNA, 20 nt, Bordetella pertussis
ggccgaugcguccgccgugc

SEQ ID NO: 2436676 - RNA, 15 nt, Bordetella pertussis
ggccgaugcuggucg

SEQ ID NO: 2436677 - RNA, 18 nt, Bordetella pertussis
ggccgaugcuggucgcca

SEQ ID NO: 2436678 - RNA, 22 nt, Bordetella pertussis
ggccgauggccucgcugccagg

SEQ ID NO: 2436679 - RNA, 17 nt, Bordetella pertussis
ggccgauggcguccagc

SEQ ID NO: 2436680 - RNA, 19 nt, Bordetella pertussis
ggccgauggcguccagcag

SEQ ID NO: 2436681 - RNA, 20 nt, Bordetella pertussis
ggccgauggcguccagcagc

SEQ ID NO: 2436682 - RNA, 21 nt, Bordetella pertussis
ggccgauggcguccagcagca

SEQ ID NO: 2436683 - RNA, 15 nt, Bordetella pertussis
ggccgauggucagca

SEQ ID NO: 2436684 - RNA, 18 nt, Bordetella pertussis
ggccgauggucagcgugu

SEQ ID NO: 2436685 - RNA, 19 nt, Bordetella pertussis
ggccgauguagcccauggc

SEQ ID NO: 2436686 - RNA, 20 nt, Bordetella pertussis
ggccgauguagcccauggcc

SEQ ID NO: 2436687 - RNA, 22 nt, Bordetella pertussis
ggccgauguagcccauggccag

SEQ ID NO: 2436688 - RNA, 23 nt, Bordetella pertussis
ggccgauguagcccauggccagg

SEQ ID NO: 2436689 - RNA, 18 nt, Bordetella pertussis
ggccgaugucgccgccug

SEQ ID NO: 2436690 - RNA, 16 nt, Bordetella pertussis
ggccgauuccagcgcc

SEQ ID NO: 2436691 - RNA, 15 nt, Bordetella pertussis
ggccgauucgaccug

SEQ ID NO: 2436692 - RNA, 17 nt, Bordetella pertussis
ggccgauucgccguggc

SEQ ID NO: 2436693 - RNA, 16 nt, Bordetella pertussis
ggccgauuucgcgcgc

SEQ ID NO: 2436694 - RNA, 17 nt, Bordetella pertussis
ggccgauuucgcgcgcc

SEQ ID NO: 2436695 - RNA, 18 nt, Bordetella pertussis
ggccgauuucgcgcgcca

SEQ ID NO: 2436696 - RNA, 20 nt, Bordetella pertussis
ggccgauuucgcgcgccagc

SEQ ID NO: 2436697 - RNA, 22 nt, Bordetella pertussis
ggccgauuucgcgcgccagcgc

SEQ ID NO: 2436698 - RNA, 23 nt, Bordetella pertussis
ggccgauuucgcgcgccagcgcg

SEQ ID NO: 2436699 - RNA, 24 nt, Bordetella pertussis
ggccgauuucgcgcgccagcgcgg

SEQ ID NO: 2436700 - RNA, 19 nt, Bordetella pertussis
ggccgauuucggccgccgg

SEQ ID NO: 2436701 - RNA, 20 nt, Bordetella pertussis
ggccgauuucggccgccggc

SEQ ID NO: 2436702 - RNA, 22 nt, Bordetella pertussis
ggccgauuucggccgccggcga

SEQ ID NO: 2436703 - RNA, 15 nt, Bordetella pertussis
ggccgcaaccaggga

SEQ ID NO: 2436704 - RNA, 22 nt, Bordetella pertussis
ggccgcaacccacccccagcag

SEQ ID NO: 2436705 - RNA, 23 nt, Bordetella pertussis
ggccgcaacccacccccagcagc

SEQ ID NO: 2436706 - RNA, 19 nt, Bordetella pertussis
ggccgcaagcaagccccag

SEQ ID NO: 2436707 - RNA, 22 nt, Bordetella pertussis
ggccgcaagcaagccccaggca

SEQ ID NO: 2436708 - RNA, 13 nt, Bordetella pertussis
ggccgcacgcgcg

SEQ ID NO: 2436709 - RNA, 16 nt, Bordetella pertussis
ggccgcacgcgcggca

SEQ ID NO: 2436710 - RNA, 19 nt, Bordetella pertussis
ggccgcacgcgcggcagcg

SEQ ID NO: 2436711 - RNA, 22 nt, Bordetella pertussis
ggccgcacgcgcggcagcgccg

SEQ ID NO: 2436712 - RNA, 15 nt, Bordetella pertussis
ggccgcacgcggccg

SEQ ID NO: 2436713 - RNA, 19 nt, Bordetella pertussis
ggccgcacugggugacgcu

SEQ ID NO: 2436714 - RNA, 21 nt, Bordetella pertussis
ggccgcacugggugacgcugg

SEQ ID NO: 2436715 - RNA, 13 nt, Bordetella pertussis
ggccgcagcaauu

SEQ ID NO: 2436716 - RNA, 18 nt, Bordetella pertussis
ggccgcagcaauugcccc

SEQ ID NO: 2436717 - RNA, 17 nt, Bordetella pertussis
ggccgcagcauggcgcc

SEQ ID NO: 2436718 - RNA, 21 nt, Bordetella pertussis
ggccgcagcauggcgccagcu

SEQ ID NO: 2436719 - RNA, 15 nt, Bordetella pertussis
ggccgcagcgggccc

SEQ ID NO: 2436720 - RNA, 21 nt, Bordetella pertussis
ggccgcagcuggacuauggcc

SEQ ID NO: 2436721 - RNA, 13 nt, Bordetella pertussis
ggccgcagggcgu

SEQ ID NO: 2436722 - RNA, 13 nt, Bordetella pertussis
ggccgcaugcgug

SEQ ID NO: 2436723 - RNA, 24 nt, Bordetella pertussis
ggccgcaugcgugaagcccauggc

SEQ ID NO: 2436724 - RNA, 16 nt, Bordetella pertussis
ggccgcauggcggccc

SEQ ID NO: 2436725 - RNA, 17 nt, Bordetella pertussis
ggccgcauggcggcccu

SEQ ID NO: 2436726 - RNA, 20 nt, Bordetella pertussis
ggccgcauugggacgcggcc

SEQ ID NO: 2436727 - RNA, 21 nt, Bordetella pertussis
ggccgcauugggacgcggccu

SEQ ID NO: 2436728 - RNA, 22 nt, Bordetella pertussis
ggccgcauugggacgcggccuu

SEQ ID NO: 2436729 - RNA, 20 nt, Bordetella pertussis
ggccgccacacgaggaccgc

SEQ ID NO: 2436730 - RNA, 14 nt, Bordetella pertussis
ggccgccaccagcg

SEQ ID NO: 2436731 - RNA, 16 nt, Bordetella pertussis
ggccgccaccagcgcg

SEQ ID NO: 2436732 - RNA, 17 nt, Bordetella pertussis
ggccgccaccagcgcgu

SEQ ID NO: 2436733 - RNA, 20 nt, Bordetella pertussis
ggccgccaccagcgcgucgc

SEQ ID NO: 2436734 - RNA, 22 nt, Bordetella pertussis
ggccgccaccagcgcgucgccg

SEQ ID NO: 2436735 - RNA, 22 nt, Bordetella pertussis
ggccgccacccaggcggcaggc

SEQ ID NO: 2436736 - RNA, 19 nt, Bordetella pertussis
ggccgccaccugggccgcc

SEQ ID NO: 2436737 - RNA, 22 nt, Bordetella pertussis
ggccgccaccugggccgccugc

SEQ ID NO: 2436738 - RNA, 21 nt, Bordetella pertussis
ggccgccacgaaacccacggc

SEQ ID NO: 2436739 - RNA, 16 nt, Bordetella pertussis
ggccgccacgcccugg

SEQ ID NO: 2436740 - RNA, 18 nt, Bordetella pertussis
ggccgccacgcccuggca

SEQ ID NO: 2436741 - RNA, 23 nt, Bordetella pertussis
ggccgccacgcccuggcagcugg

SEQ ID NO: 2436742 - RNA, 22 nt, Bordetella pertussis
ggccgccacuugcggcaggugc

SEQ ID NO: 2436743 - RNA, 23 nt, Bordetella pertussis
ggccgccagcaaggcgucggcca

SEQ ID NO: 2436744 - RNA, 23 nt, Bordetella pertussis
ggccgcgaacagauccacgcccg

SEQ ID NO: 2436745 - RNA, 13 nt, Bordetella pertussis
ggccgcgacauag

SEQ ID NO: 2436746 - RNA, 20 nt, Bordetella pertussis
ggccgcgacauagcgcugga

SEQ ID NO: 2436747 - RNA, 14 nt, Bordetella pertussis
ggccgcgagcaugc

SEQ ID NO: 2436748 - RNA, 20 nt, Bordetella pertussis
ggccgcgagcaugcgcagcg

SEQ ID NO: 2436749 - RNA, 19 nt, Bordetella pertussis
ggccgcgauauccuugcgc

SEQ ID NO: 2436750 - RNA, 19 nt, Bordetella pertussis
ggccgcgauauugaaggcc

SEQ ID NO: 2436751 - RNA, 22 nt, Bordetella pertussis
ggccgcgaucgaguggugcgcg

SEQ ID NO: 2436752 - RNA, 12 nt, Bordetella pertussis
ggccgcgaugca

SEQ ID NO: 2436753 - RNA, 13 nt, Bordetella pertussis
ggccgcgcaaggc

SEQ ID NO: 2436754 - RNA, 15 nt, Bordetella pertussis
ggccgcgcaaggccu

SEQ ID NO: 2436755 - RNA, 18 nt, Bordetella pertussis
ggccgcgcaaggccugcu

SEQ ID NO: 2436756 - RNA, 20 nt, Bordetella pertussis
ggccgcgcaaggccugcucg

SEQ ID NO: 2436757 - RNA, 20 nt, Bordetella pertussis
ggccgcgcaaggcggcccgg

SEQ ID NO: 2436758 - RNA, 22 nt, Bordetella pertussis
ggccgcgcaaggcggcccggcc

SEQ ID NO: 2436759 - RNA, 13 nt, Bordetella pertussis
ggccgcgcagcac

SEQ ID NO: 2436760 - RNA, 15 nt, Bordetella pertussis
ggccgcgcagcacgc

SEQ ID NO: 2436761 - RNA, 17 nt, Bordetella pertussis
ggccgcgcagcacgccc

SEQ ID NO: 2436762 - RNA, 18 nt, Bordetella pertussis
ggccgcgcagcacgcccg

SEQ ID NO: 2436763 - RNA, 12 nt, Bordetella pertussis
ggccgcgcccac

SEQ ID NO: 2436764 - RNA, 13 nt, Bordetella pertussis
ggccgcgcccaca

SEQ ID NO: 2436765 - RNA, 16 nt, Bordetella pertussis
ggccgcgcccacagga

SEQ ID NO: 2436766 - RNA, 13 nt, Bordetella pertussis
ggccgcgcccagc

SEQ ID NO: 2436767 - RNA, 14 nt, Bordetella pertussis
ggccgcgcccagcg

SEQ ID NO: 2436768 - RNA, 16 nt, Bordetella pertussis
ggccgcgcccagcgcg

SEQ ID NO: 2436769 - RNA, 16 nt, Bordetella pertussis
ggccgcgcccagcgug

SEQ ID NO: 2436770 - RNA, 14 nt, Bordetella pertussis
ggccgcgcccaggu

SEQ ID NO: 2436771 - RNA, 16 nt, Bordetella pertussis
ggccgcgcccaugcgc

SEQ ID NO: 2436772 - RNA, 20 nt, Bordetella pertussis
ggccgcgcccaugcgcuggc

SEQ ID NO: 2436773 - RNA, 23 nt, Bordetella pertussis
ggccgcgcccaugcgcuggcgca

SEQ ID NO: 2436774 - RNA, 21 nt, Bordetella pertussis
ggccgcgccccuagcgccgcg

SEQ ID NO: 2436775 - RNA, 13 nt, Bordetella pertussis
ggccgcgcccgca

SEQ ID NO: 2436776 - RNA, 20 nt, Bordetella pertussis
ggccgcgcccgccgcgccau

SEQ ID NO: 2436777 - RNA, 13 nt, Bordetella pertussis
ggccgcgccgccg

SEQ ID NO: 2436778 - RNA, 14 nt, Bordetella pertussis
ggccgcgccgccgc

SEQ ID NO: 2436779 - RNA, 17 nt, Bordetella pertussis
ggccgcgccgccgcccu

SEQ ID NO: 2436780 - RNA, 12 nt, Bordetella pertussis
ggccgcgccgcg

SEQ ID NO: 2436781 - RNA, 15 nt, Bordetella pertussis
ggccgcgccgcgccg

SEQ ID NO: 2436782 - RNA, 13 nt, Bordetella pertussis
ggccgcgccgcug

SEQ ID NO: 2436783 - RNA, 18 nt, Bordetella pertussis
ggccgcgccgcuggcggc

SEQ ID NO: 2436784 - RNA, 19 nt, Bordetella pertussis
ggccgcgccgcuggcggcc

SEQ ID NO: 2436785 - RNA, 23 nt, Bordetella pertussis
ggccgcgccggcucccgcgcugc

SEQ ID NO: 2436786 - RNA, 22 nt, Bordetella pertussis
ggccgcgccguucucaggccga

SEQ ID NO: 2436787 - RNA, 19 nt, Bordetella pertussis
ggccgcgcgauccuggggc

SEQ ID NO: 2436788 - RNA, 19 nt, Bordetella pertussis
ggccgcgcgaugcgcggcc

SEQ ID NO: 2436789 - RNA, 20 nt, Bordetella pertussis
ggccgcgcgaugcgcggccc

SEQ ID NO: 2436790 - RNA, 13 nt, Bordetella pertussis
ggccgcgcgcagc

SEQ ID NO: 2436791 - RNA, 14 nt, Bordetella pertussis
ggccgcgcgcagcg

SEQ ID NO: 2436792 - RNA, 21 nt, Bordetella pertussis
ggccgcgcgcauccaggugcc

SEQ ID NO: 2436793 - RNA, 17 nt, Bordetella pertussis
ggccgcgcgccggcgcc

SEQ ID NO: 2436794 - RNA, 18 nt, Bordetella pertussis
ggccgcgcgccggcgccg

SEQ ID NO: 2436795 - RNA, 20 nt, Bordetella pertussis
ggccgcgcgccggcgccguu

SEQ ID NO: 2436796 - RNA, 12 nt, Bordetella pertussis
ggccgcgcgccu

SEQ ID NO: 2436797 - RNA, 14 nt, Bordetella pertussis
ggccgcgcgccugc

SEQ ID NO: 2436798 - RNA, 18 nt, Bordetella pertussis
ggccgcgcgccugcucgu

SEQ ID NO: 2436799 - RNA, 14 nt, Bordetella pertussis
ggccgcgcgcgcca

SEQ ID NO: 2436800 - RNA, 15 nt, Bordetella pertussis
ggccgcgcgcgccag

SEQ ID NO: 2436801 - RNA, 15 nt, Bordetella pertussis
ggccgcgcgcgggcg

SEQ ID NO: 2436802 - RNA, 17 nt, Bordetella pertussis
ggccgcgcgcgggcgcc

SEQ ID NO: 2436803 - RNA, 18 nt, Bordetella pertussis
ggccgcgcgcgggcgccc

SEQ ID NO: 2436804 - RNA, 20 nt, Bordetella pertussis
ggccgcgcgcgggcgcccgc

SEQ ID NO: 2436805 - RNA, 21 nt, Bordetella pertussis
ggccgcgcgcuucaggcgccg

SEQ ID NO: 2436806 - RNA, 15 nt, Bordetella pertussis
ggccgcgcggcgccu

SEQ ID NO: 2436807 - RNA, 17 nt, Bordetella pertussis
ggccgcgcggcgccugc

SEQ ID NO: 2436808 - RNA, 18 nt, Bordetella pertussis
ggccgcgcggcgccugcc

SEQ ID NO: 2436809 - RNA, 17 nt, Bordetella pertussis
ggccgcgcgggccuggc

SEQ ID NO: 2436810 - RNA, 22 nt, Bordetella pertussis
ggccgcgcgggccuggcucagg

SEQ ID NO: 2436811 - RNA, 21 nt, Bordetella pertussis
ggccgcgcgguacgcaccgcc

SEQ ID NO: 2436812 - RNA, 18 nt, Bordetella pertussis
ggccgcgcucaggccgcu

SEQ ID NO: 2436813 - RNA, 21 nt, Bordetella pertussis
ggccgcgcucaggccgcuggg

SEQ ID NO: 2436814 - RNA, 22 nt, Bordetella pertussis
ggccgcgcucgaauggcugcgc

SEQ ID NO: 2436815 - RNA, 15 nt, Bordetella pertussis
ggccgcgcugccagc

SEQ ID NO: 2436816 - RNA, 17 nt, Bordetella pertussis
ggccgcgcugccagcca

SEQ ID NO: 2436817 - RNA, 22 nt, Bordetella pertussis
ggccgcgcugcugcaggccggc

SEQ ID NO: 2436818 - RNA, 15 nt, Bordetella pertussis
ggccgcgcuggcggc

SEQ ID NO: 2436819 - RNA, 19 nt, Bordetella pertussis
ggccgcgcuggcggcgcag

SEQ ID NO: 2436820 - RNA, 23 nt, Bordetella pertussis
ggccgcgcuggcggcgcaggccg

SEQ ID NO: 2436821 - RNA, 20 nt, Bordetella pertussis
ggccgcggaagucgggcacc

SEQ ID NO: 2436822 - RNA, 23 nt, Bordetella pertussis
ggccgcggaagucgggcaccagc

SEQ ID NO: 2436823 - RNA, 16 nt, Bordetella pertussis
ggccgcggccaggccc

SEQ ID NO: 2436824 - RNA, 13 nt, Bordetella pertussis
ggccgcggcccag

SEQ ID NO: 2436825 - RNA, 17 nt, Bordetella pertussis
ggccgcggcccagcgcg

SEQ ID NO: 2436826 - RNA, 14 nt, Bordetella pertussis
ggccgcggccggca

SEQ ID NO: 2436827 - RNA, 16 nt, Bordetella pertussis
ggccgcggccggcacg

SEQ ID NO: 2436828 - RNA, 22 nt, Bordetella pertussis
ggccgcggccggcacgcccagc

SEQ ID NO: 2436829 - RNA, 14 nt, Bordetella pertussis
ggccgcggcgagcu

SEQ ID NO: 2436830 - RNA, 19 nt, Bordetella pertussis
ggccgcggcgagcucggca

SEQ ID NO: 2436831 - RNA, 16 nt, Bordetella pertussis
ggccgcggcgcgcgcg

SEQ ID NO: 2436832 - RNA, 14 nt, Bordetella pertussis
ggccgcggcguccg

SEQ ID NO: 2436833 - RNA, 22 nt, Bordetella pertussis
ggccgcggcguccgcgccgaac

SEQ ID NO: 2436834 - RNA, 14 nt, Bordetella pertussis
ggccgcggcgugcu

SEQ ID NO: 2436835 - RNA, 14 nt, Bordetella pertussis
ggccgcggcguugc

SEQ ID NO: 2436836 - RNA, 20 nt, Bordetella pertussis
ggccgcggcguugcggcagc

SEQ ID NO: 2436837 - RNA, 12 nt, Bordetella pertussis
ggccgcgggcag

SEQ ID NO: 2436838 - RNA, 14 nt, Bordetella pertussis
ggccgcgggccgcu

SEQ ID NO: 2436839 - RNA, 16 nt, Bordetella pertussis
ggccgcgggccgcugg

SEQ ID NO: 2436840 - RNA, 12 nt, Bordetella pertussis
ggccgcgggcgg

SEQ ID NO: 2436841 - RNA, 13 nt, Bordetella pertussis
ggccgcgggcgug

SEQ ID NO: 2436842 - RNA, 17 nt, Bordetella pertussis
ggccgcggggcuggcca

SEQ ID NO: 2436843 - RNA, 13 nt, Bordetella pertussis
ggccgcggguggc

SEQ ID NO: 2436844 - RNA, 17 nt, Bordetella pertussis
ggccgcggguggccgcu

SEQ ID NO: 2436845 - RNA, 16 nt, Bordetella pertussis
ggccgcggucagccag

SEQ ID NO: 2436846 - RNA, 17 nt, Bordetella pertussis
ggccgcggugguccaga

SEQ ID NO: 2436847 - RNA, 15 nt, Bordetella pertussis
ggccgcguacaacgc

SEQ ID NO: 2436848 - RNA, 21 nt, Bordetella pertussis
ggccgcguacuuccucgacca

SEQ ID NO: 2436849 - RNA, 15 nt, Bordetella pertussis
ggccgcguagcccau

SEQ ID NO: 2436850 - RNA, 22 nt, Bordetella pertussis
ggccgcguaggcggucagcugg

SEQ ID NO: 2436851 - RNA, 15 nt, Bordetella pertussis
ggccgcguccagcgc

SEQ ID NO: 2436852 - RNA, 16 nt, Bordetella pertussis
ggccgcguccagcgcg

SEQ ID NO: 2436853 - RNA, 22 nt, Bordetella pertussis
ggccgcguccagcgcgcggccu

SEQ ID NO: 2436854 - RNA, 20 nt, Bordetella pertussis
ggccgcgucgaucagcgcgg

SEQ ID NO: 2436855 - RNA, 13 nt, Bordetella pertussis
ggccgcgucggcc

SEQ ID NO: 2436856 - RNA, 16 nt, Bordetella pertussis
ggccgcuacggcgguc

SEQ ID NO: 2436857 - RNA, 17 nt, Bordetella pertussis
ggccgcuacggcggucu

SEQ ID NO: 2436858 - RNA, 15 nt, Bordetella pertussis
ggccggcgcgcucgc

SEQ ID NO: 2436859 - RNA, 21 nt, Bordetella pertussis
ggccggcgcgcucgcugccgg

SEQ ID NO: 2436860 - RNA, 20 nt, Bordetella pertussis
ggccggcgcgcucggccucg

SEQ ID NO: 2436861 - RNA, 16 nt, Bordetella pertussis
ggccggcgcggcagcc

SEQ ID NO: 2436862 - RNA, 14 nt, Bordetella pertussis
ggccggcgcgucgc

SEQ ID NO: 2436863 - RNA, 16 nt, Bordetella pertussis
ggccggcgcgucgccg

SEQ ID NO: 2436864 - RNA, 17 nt, Bordetella pertussis
ggccggcgcgugcuggc

SEQ ID NO: 2436865 - RNA, 18 nt, Bordetella pertussis
ggccggcgcugggcaggc

SEQ ID NO: 2436866 - RNA, 15 nt, Bordetella pertussis
ggccggcggcagccg

SEQ ID NO: 2436867 - RNA, 16 nt, Bordetella pertussis
ggccggcggcagccgg

SEQ ID NO: 2436868 - RNA, 23 nt, Bordetella pertussis
ggccggcggcagccggccauggc

SEQ ID NO: 2436869 - RNA, 15 nt, Bordetella pertussis
ggccggcggccagcg

SEQ ID NO: 2436870 - RNA, 18 nt, Bordetella pertussis
ggccggcggccagcgcgc

SEQ ID NO: 2436871 - RNA, 16 nt, Bordetella pertussis
ggccggcggcgagcgc

SEQ ID NO: 2436872 - RNA, 15 nt, Bordetella pertussis
ggccggcggcgauca

SEQ ID NO: 2436873 - RNA, 13 nt, Bordetella pertussis
ggccggcggcgcc

SEQ ID NO: 2436874 - RNA, 14 nt, Bordetella pertussis
ggccggcggcgccg

SEQ ID NO: 2436875 - RNA, 12 nt, Bordetella pertussis
ggccggcggcgu

SEQ ID NO: 2436876 - RNA, 13 nt, Bordetella pertussis
ggccggcgggcau

SEQ ID NO: 2436877 - RNA, 14 nt, Bordetella pertussis
ggccggcgggcaug

SEQ ID NO: 2436878 - RNA, 13 nt, Bordetella pertussis
ggccggcgggcgu

SEQ ID NO: 2436879 - RNA, 19 nt, Bordetella pertussis
ggccggcgucuggagcggc

SEQ ID NO: 2436880 - RNA, 14 nt, Bordetella pertussis
ggccggcguggccu

SEQ ID NO: 2436881 - RNA, 14 nt, Bordetella pertussis
ggccggcguugcgc

SEQ ID NO: 2436882 - RNA, 16 nt, Bordetella pertussis
ggccggcguugcgccc

SEQ ID NO: 2436883 - RNA, 19 nt, Bordetella pertussis
ggccggcguugcgcccugc

SEQ ID NO: 2436884 - RNA, 21 nt, Bordetella pertussis
ggccggcuacagcucgccggc

SEQ ID NO: 2436885 - RNA, 22 nt, Bordetella pertussis
ggccggcuacagcucgccggcg

SEQ ID NO: 2436886 - RNA, 13 nt, Bordetella pertussis
ggccggcucgccc

SEQ ID NO: 2436887 - RNA, 16 nt, Bordetella pertussis
ggccggcucggcggca

SEQ ID NO: 2436888 - RNA, 16 nt, Bordetella pertussis
ggccggcugcaccagc

SEQ ID NO: 2436889 - RNA, 17 nt, Bordetella pertussis
ggccggcugcaccagcg

SEQ ID NO: 2436890 - RNA, 20 nt, Bordetella pertussis
ggccggcugcaccagcgcgc

SEQ ID NO: 2436891 - RNA, 12 nt, Bordetella pertussis
ggccggcugccg

SEQ ID NO: 2436892 - RNA, 12 nt, Bordetella pertussis
ggccggcugcgc

SEQ ID NO: 2436893 - RNA, 15 nt, Bordetella pertussis
ggccggcugcgcgcc

SEQ ID NO: 2436894 - RNA, 20 nt, Bordetella pertussis
ggccggcugcgcgccgacca

SEQ ID NO: 2436895 - RNA, 13 nt, Bordetella pertussis
ggccggcugggcg

SEQ ID NO: 2436896 - RNA, 16 nt, Bordetella pertussis
ggccggcugggcggcc

SEQ ID NO: 2436897 - RNA, 21 nt, Bordetella pertussis
ggccggcugggcggccuuggc

SEQ ID NO: 2436898 - RNA, 13 nt, Bordetella pertussis
ggccggcuugcgc

SEQ ID NO: 2436899 - RNA, 17 nt, Bordetella pertussis
ggccggcuugcgcaagc

SEQ ID NO: 2436900 - RNA, 20 nt, Bordetella pertussis
ggccggcuugcgcaagccgg

SEQ ID NO: 2436901 - RNA, 18 nt, Bordetella pertussis
ggccggcuuuggacaggc

SEQ ID NO: 2436902 - RNA, 16 nt, Bordetella pertussis
ggccgggaccuuggcg

SEQ ID NO: 2436903 - RNA, 23 nt, Bordetella pertussis
ggccgggaccuuggcggcuggcg

SEQ ID NO: 2436904 - RNA, 13 nt, Bordetella pertussis
ggccgggagccug

SEQ ID NO: 2436905 - RNA, 13 nt, Bordetella pertussis
ggccgggagcggc

SEQ ID NO: 2436906 - RNA, 17 nt, Bordetella pertussis
ggccgggagcggccagc

SEQ ID NO: 2436907 - RNA, 20 nt, Bordetella pertussis
ggccgggagcggccagcaag

SEQ ID NO: 2436908 - RNA, 22 nt, Bordetella pertussis
ggccgggcacgaugcguugcgc

SEQ ID NO: 2436909 - RNA, 14 nt, Bordetella pertussis
ggccgggcaggccg

SEQ ID NO: 2436910 - RNA, 19 nt, Bordetella pertussis
ggccgggcaggccgcgcug

SEQ ID NO: 2436911 - RNA, 16 nt, Bordetella pertussis
ggccgggcaguccugg

SEQ ID NO: 2436912 - RNA, 12 nt, Bordetella pertussis
ggccgggccagc

SEQ ID NO: 2436913 - RNA, 14 nt, Bordetella pertussis
ggccgggccagcgc

SEQ ID NO: 2436914 - RNA, 15 nt, Bordetella pertussis
ggccgggccagcgcg

SEQ ID NO: 2436915 - RNA, 16 nt, Bordetella pertussis
ggccgggccagcgcga

SEQ ID NO: 2436916 - RNA, 16 nt, Bordetella pertussis
ggccgggcccggcgcg

SEQ ID NO: 2436917 - RNA, 13 nt, Bordetella pertussis
ggccgggccggcg

SEQ ID NO: 2436918 - RNA, 15 nt, Bordetella pertussis
ggccgggccggcggg

SEQ ID NO: 2436919 - RNA, 13 nt, Bordetella pertussis
ggccgggccgggc

SEQ ID NO: 2436920 - RNA, 14 nt, Bordetella pertussis
ggccgggccgggca

SEQ ID NO: 2436921 - RNA, 12 nt, Bordetella pertussis
ggccgggcgcca

SEQ ID NO: 2436922 - RNA, 13 nt, Bordetella pertussis
ggccgggcgccag

SEQ ID NO: 2436923 - RNA, 15 nt, Bordetella pertussis
ggccgggcgccaggc

SEQ ID NO: 2436924 - RNA, 16 nt, Bordetella pertussis
ggccgggcgccaggcu

SEQ ID NO: 2436925 - RNA, 14 nt, Bordetella pertussis
ggccgggcgcccag

SEQ ID NO: 2436926 - RNA, 16 nt, Bordetella pertussis
ggccgggcgcccagcg

SEQ ID NO: 2436927 - RNA, 16 nt, Bordetella pertussis
ggccgggcgcggcgcc

SEQ ID NO: 2436928 - RNA, 14 nt, Bordetella pertussis
ggccgggcucaggc

SEQ ID NO: 2436929 - RNA, 17 nt, Bordetella pertussis
ggccggggaagccgccg

SEQ ID NO: 2436930 - RNA, 19 nt, Bordetella pertussis
ggccggggaagccgccggc

SEQ ID NO: 2436931 - RNA, 15 nt, Bordetella pertussis
ggccggggccgccca

SEQ ID NO: 2436932 - RNA, 17 nt, Bordetella pertussis
ggccggggccgcccugc

SEQ ID NO: 2436933 - RNA, 18 nt, Bordetella pertussis
ggccggggccgcccuggu

SEQ ID NO: 2436934 - RNA, 13 nt, Bordetella pertussis
ggccggggcgucg

SEQ ID NO: 2436935 - RNA, 19 nt, Bordetella pertussis
ggccggggguuccugccca

SEQ ID NO: 2436936 - RNA, 19 nt, Bordetella pertussis
ggccgggguccugaggcca

SEQ ID NO: 2436937 - RNA, 23 nt, Bordetella pertussis
ggccgggguccugaggccaggcc

SEQ ID NO: 2436938 - RNA, 17 nt, Bordetella pertussis
ggccgggucccuggccc

SEQ ID NO: 2436939 - RNA, 17 nt, Bordetella pertussis
ggccgggucgcgcagca

SEQ ID NO: 2436940 - RNA, 23 nt, Bordetella pertussis
ggccgggucgcgcagcagggccu

SEQ ID NO: 2436941 - RNA, 15 nt, Bordetella pertussis
ggccgggucggccug

SEQ ID NO: 2436942 - RNA, 16 nt, Bordetella pertussis
ggccgggucggccugc

SEQ ID NO: 2436943 - RNA, 20 nt, Bordetella pertussis
ggccgggucguucgaacugg

SEQ ID NO: 2436944 - RNA, 17 nt, Bordetella pertussis
ggccggguggccgcggu

SEQ ID NO: 2436945 - RNA, 15 nt, Bordetella pertussis
ggccgguaaggcgcu

SEQ ID NO: 2436946 - RNA, 16 nt, Bordetella pertussis
ggccgguaccagacgg

SEQ ID NO: 2436947 - RNA, 18 nt, Bordetella pertussis
ggccgguaccagacggua

SEQ ID NO: 2436948 - RNA, 17 nt, Bordetella pertussis
ggccgguaucggccucg

SEQ ID NO: 2436949 - RNA, 15 nt, Bordetella pertussis
ggccggucagcccag

SEQ ID NO: 2436950 - RNA, 17 nt, Bordetella pertussis
ggccggucagcccaggc

SEQ ID NO: 2436951 - RNA, 21 nt, Bordetella pertussis
ggccggucagcccaggcgggc

SEQ ID NO: 2436952 - RNA, 17 nt, Bordetella pertussis
ggccggugaugcggcgc

SEQ ID NO: 2436953 - RNA, 18 nt, Bordetella pertussis
ggccggugaugcggcgcg

SEQ ID NO: 2436954 - RNA, 21 nt, Bordetella pertussis
ggccggugaugcggcgcgccg

SEQ ID NO: 2436955 - RNA, 22 nt, Bordetella pertussis
ggccggugaugcggcgcgccgc

SEQ ID NO: 2436956 - RNA, 18 nt, Bordetella pertussis
ggccggugcaucggccgg

SEQ ID NO: 2436957 - RNA, 20 nt, Bordetella pertussis
ggccggugcaucggccggcg

SEQ ID NO: 2436958 - RNA, 22 nt, Bordetella pertussis
ggccggugccagucuccaggcu

SEQ ID NO: 2436959 - RNA, 15 nt, Bordetella pertussis
ggccgguggaccagg

SEQ ID NO: 2436960 - RNA, 19 nt, Bordetella pertussis
ggccgguggaccagggcac

SEQ ID NO: 2436961 - RNA, 23 nt, Bordetella pertussis
ggccguaacccgaguccuugacg

SEQ ID NO: 2436962 - RNA, 15 nt, Bordetella pertussis
ggccguaaccggcca

SEQ ID NO: 2436963 - RNA, 16 nt, Bordetella pertussis
ggccguaaccggccag

SEQ ID NO: 2436964 - RNA, 17 nt, Bordetella pertussis
ggccguaaccggccagu

SEQ ID NO: 2436965 - RNA, 15 nt, Bordetella pertussis
ggccguacauggcca

SEQ ID NO: 2436966 - RNA, 19 nt, Bordetella pertussis
ggccguagcguuggcggcc

SEQ ID NO: 2436967 - RNA, 21 nt, Bordetella pertussis
ggccguagcguuggcggccgg

SEQ ID NO: 2436968 - RNA, 22 nt, Bordetella pertussis
ggccguagcguuggcggccggc

SEQ ID NO: 2436969 - RNA, 14 nt, Bordetella pertussis
ggccgucaacggcu

SEQ ID NO: 2436970 - RNA, 17 nt, Bordetella pertussis
ggccgucaagcguucau

SEQ ID NO: 2436971 - RNA, 21 nt, Bordetella pertussis
ggccgucaagcguucauggcg

SEQ ID NO: 2436972 - RNA, 15 nt, Bordetella pertussis
ggccucgcggcgcag

SEQ ID NO: 2436973 - RNA, 19 nt, Bordetella pertussis
ggccucgcggcgcagcaug

SEQ ID NO: 2436974 - RNA, 14 nt, Bordetella pertussis
ggccucgcggcgcg

SEQ ID NO: 2436975 - RNA, 14 nt, Bordetella pertussis
ggccucgcgggccu

SEQ ID NO: 2436976 - RNA, 18 nt, Bordetella pertussis
ggccucgcgggccuuggc

SEQ ID NO: 2436977 - RNA, 19 nt, Bordetella pertussis
ggccucgcgggccuuggcc

SEQ ID NO: 2436978 - RNA, 22 nt, Bordetella pertussis
ggccucgcgggccuuggccagc

SEQ ID NO: 2436979 - RNA, 17 nt, Bordetella pertussis
ggccucgcugccagggu

SEQ ID NO: 2436980 - RNA, 17 nt, Bordetella pertussis
ggccucgcugcgggcgg

SEQ ID NO: 2436981 - RNA, 19 nt, Bordetella pertussis
ggccucgcugcgggcggcc

SEQ ID NO: 2436982 - RNA, 20 nt, Bordetella pertussis
ggccucgcugcgggcggccu

SEQ ID NO: 2436983 - RNA, 23 nt, Bordetella pertussis
ggccucgcugcgggcggccuggg

SEQ ID NO: 2436984 - RNA, 13 nt, Bordetella pertussis
ggccucgcuggag

SEQ ID NO: 2436985 - RNA, 19 nt, Bordetella pertussis
ggccucgcuggagaccggc

SEQ ID NO: 2436986 - RNA, 20 nt, Bordetella pertussis
ggccucgcuggagaccggca

SEQ ID NO: 2436987 - RNA, 22 nt, Bordetella pertussis
ggccucgcuggagaccggcaug

SEQ ID NO: 2436988 - RNA, 16 nt, Bordetella pertussis
ggccucggccagcugg

SEQ ID NO: 2436989 - RNA, 23 nt, Bordetella pertussis
ggccucggccagcugggaggcgu

SEQ ID NO: 2436990 - RNA, 14 nt, Bordetella pertussis
ggccucggccggca

SEQ ID NO: 2436991 - RNA, 15 nt, Bordetella pertussis
ggccucggccggcag

SEQ ID NO: 2436992 - RNA, 16 nt, Bordetella pertussis
ggccucggcgaagugc

SEQ ID NO: 2436993 - RNA, 14 nt, Bordetella pertussis
ggccucggcggccu

SEQ ID NO: 2436994 - RNA, 16 nt, Bordetella pertussis
ggccucggcggccucc

SEQ ID NO: 2436995 - RNA, 17 nt, Bordetella pertussis
ggccucggcgggcggcg

SEQ ID NO: 2436996 - RNA, 17 nt, Bordetella pertussis
ggccucggucagggugg

SEQ ID NO: 2436997 - RNA, 17 nt, Bordetella pertussis
ggccucggucucgugcg

SEQ ID NO: 2436998 - RNA, 23 nt, Bordetella pertussis
ggccucguaggccaucacaucgc

SEQ ID NO: 2436999 - RNA, 19 nt, Bordetella pertussis
ggccucguaguguucgaug

SEQ ID NO: 2437000 - RNA, 19 nt, Bordetella pertussis
ggccucguaucgccugacg

SEQ ID NO: 2437001 - RNA, 17 nt, Bordetella pertussis
ggccucuucgucgccgg

SEQ ID NO: 2437002 - RNA, 14 nt, Bordetella pertussis
ggccugacgcgcaa

SEQ ID NO: 2437003 - RNA, 19 nt, Bordetella pertussis
ggccugacgcucauccagg

SEQ ID NO: 2437004 - RNA, 14 nt, Bordetella pertussis
ggccugaucggggc

SEQ ID NO: 2437005 - RNA, 17 nt, Bordetella pertussis
ggccugcaaugcggcca

SEQ ID NO: 2437006 - RNA, 18 nt, Bordetella pertussis
ggccugcaaugcggccag

SEQ ID NO: 2437007 - RNA, 19 nt, Bordetella pertussis
ggccugcaaugcggccagg

SEQ ID NO: 2437008 - RNA, 16 nt, Bordetella pertussis
ggccugcaccggcgcg

SEQ ID NO: 2437009 - RNA, 14 nt, Bordetella pertussis
ggccugcacgacgg

SEQ ID NO: 2437010 - RNA, 23 nt, Bordetella pertussis
ggccugcacggugggcagcagca

SEQ ID NO: 2437011 - RNA, 13 nt, Bordetella pertussis
ggccugcagcaug

SEQ ID NO: 2437012 - RNA, 20 nt, Bordetella pertussis
ggccugcagcaugaccgaca

SEQ ID NO: 2437013 - RNA, 13 nt, Bordetella pertussis
ggccugcaggaag

SEQ ID NO: 2437014 - RNA, 21 nt, Bordetella pertussis
ggccugcaggaagccugcgcg

SEQ ID NO: 2437015 - RNA, 18 nt, Bordetella pertussis
ggccugcaggaugggccg

SEQ ID NO: 2437016 - RNA, 17 nt, Bordetella pertussis
ggccugcaggcccagca

SEQ ID NO: 2437017 - RNA, 19 nt, Bordetella pertussis
ggccugcaggcccagcacg

SEQ ID NO: 2437018 - RNA, 13 nt, Bordetella pertussis
ggccugcaggccg

SEQ ID NO: 2437019 - RNA, 19 nt, Bordetella pertussis
ggccugcaggccguuccag

SEQ ID NO: 2437020 - RNA, 23 nt, Bordetella pertussis
ggccugcaggccguuccagucca

SEQ ID NO: 2437021 - RNA, 13 nt, Bordetella pertussis
ggccugcaggcuc

SEQ ID NO: 2437022 - RNA, 23 nt, Bordetella pertussis
ggccugcaggcucuugaccagcu

SEQ ID NO: 2437023 - RNA, 18 nt, Bordetella pertussis
ggccugcaggugccgccg

SEQ ID NO: 2437024 - RNA, 19 nt, Bordetella pertussis
ggccugcaggugccgccgg

SEQ ID NO: 2437025 - RNA, 21 nt, Bordetella pertussis
ggccugcaggugccgccggcg

SEQ ID NO: 2437026 - RNA, 23 nt, Bordetella pertussis
ggccugcaggugccgccggcgcg

SEQ ID NO: 2437027 - RNA, 17 nt, Bordetella pertussis
ggccugcaguucggccg

SEQ ID NO: 2437028 - RNA, 18 nt, Bordetella pertussis
ggccugcaguucggccgc

SEQ ID NO: 2437029 - RNA, 21 nt, Bordetella pertussis
ggccugcaguucggccgccag

SEQ ID NO: 2437030 - RNA, 18 nt, Bordetella pertussis
ggccugccaccagcgcgc

SEQ ID NO: 2437031 - RNA, 21 nt, Bordetella pertussis
ggccugccaccagcgcgccag

SEQ ID NO: 2437032 - RNA, 23 nt, Bordetella pertussis
ggccugccaccagcgcgccagca

SEQ ID NO: 2437033 - RNA, 21 nt, Bordetella pertussis
ggccugccaccgacaagccgg

SEQ ID NO: 2437034 - RNA, 14 nt, Bordetella pertussis
ggccugccagccug

SEQ ID NO: 2437035 - RNA, 15 nt, Bordetella pertussis
ggccugccagccugc

SEQ ID NO: 2437036 - RNA, 20 nt, Bordetella pertussis
ggccugccauccggccgcac

SEQ ID NO: 2437037 - RNA, 19 nt, Bordetella pertussis
ggccugcccauggccugca

SEQ ID NO: 2437038 - RNA, 17 nt, Bordetella pertussis
ggccugcccgcauccga

SEQ ID NO: 2437039 - RNA, 13 nt, Bordetella pertussis
ggccugcccgggc

SEQ ID NO: 2437040 - RNA, 14 nt, Bordetella pertussis
ggccugccgcgccg

SEQ ID NO: 2437041 - RNA, 16 nt, Bordetella pertussis
ggccugccgcgccgac

SEQ ID NO: 2437042 - RNA, 20 nt, Bordetella pertussis
ggccugccgcgccgaccggc

SEQ ID NO: 2437043 - RNA, 21 nt, Bordetella pertussis
ggccugccgcgccgaccggcc

SEQ ID NO: 2437044 - RNA, 14 nt, Bordetella pertussis
ggccugccgcgcgu

SEQ ID NO: 2437045 - RNA, 14 nt, Bordetella pertussis
ggccugccggcgca

SEQ ID NO: 2437046 - RNA, 14 nt, Bordetella pertussis
ggccugccggcgcg

SEQ ID NO: 2437047 - RNA, 13 nt, Bordetella pertussis
ggccugcgccacc

SEQ ID NO: 2437048 - RNA, 17 nt, Bordetella pertussis
ggccugcgccaccagcu

SEQ ID NO: 2437049 - RNA, 18 nt, Bordetella pertussis
ggccugcgccaccgcaug

SEQ ID NO: 2437050 - RNA, 21 nt, Bordetella pertussis
ggccugcgccagcuccagccg

SEQ ID NO: 2437051 - RNA, 13 nt, Bordetella pertussis
ggccugcgccgcc

SEQ ID NO: 2437052 - RNA, 17 nt, Bordetella pertussis
ggccugcgccgccgcgc

SEQ ID NO: 2437053 - RNA, 12 nt, Bordetella pertussis
ggccugcgccgg

SEQ ID NO: 2437054 - RNA, 22 nt, Bordetella pertussis
ggccugcgccggcauggccaau

SEQ ID NO: 2437055 - RNA, 17 nt, Bordetella pertussis
ggccugcgccgggcgcg

SEQ ID NO: 2437056 - RNA, 20 nt, Bordetella pertussis
ggccugcgccgggcgcggcc

SEQ ID NO: 2437057 - RNA, 16 nt, Bordetella pertussis
ggccugcgcgccgacc

SEQ ID NO: 2437058 - RNA, 18 nt, Bordetella pertussis
ggccugcgcgccgaccag

SEQ ID NO: 2437059 - RNA, 14 nt, Bordetella pertussis
ggccugcgcgccgg

SEQ ID NO: 2437060 - RNA, 15 nt, Bordetella pertussis
ggccugcggcgccag

SEQ ID NO: 2437061 - RNA, 16 nt, Bordetella pertussis
ggccugcggcgccagc

SEQ ID NO: 2437062 - RNA, 17 nt, Bordetella pertussis
ggccugcggcgccagcg

SEQ ID NO: 2437063 - RNA, 19 nt, Bordetella pertussis
ggccugcggcgccagcgcc

SEQ ID NO: 2437064 - RNA, 20 nt, Bordetella pertussis
ggccugcggcgccagcgccg

SEQ ID NO: 2437065 - RNA, 15 nt, Bordetella pertussis
ggccugcgggcgccg

SEQ ID NO: 2437066 - RNA, 16 nt, Bordetella pertussis
ggccugcgggcgccgc

SEQ ID NO: 2437067 - RNA, 13 nt, Bordetella pertussis
ggccugcgggcug

SEQ ID NO: 2437068 - RNA, 19 nt, Bordetella pertussis
ggccugcgggugcgccugc

SEQ ID NO: 2437069 - RNA, 21 nt, Bordetella pertussis
ggccugcgggugcgccugcag

SEQ ID NO: 2437070 - RNA, 15 nt, Bordetella pertussis
ggccugcgucgccac

SEQ ID NO: 2437071 - RNA, 15 nt, Bordetella pertussis
ggccugcucgcaggc

SEQ ID NO: 2437072 - RNA, 15 nt, Bordetella pertussis
ggccugcucgcccac

SEQ ID NO: 2437073 - RNA, 21 nt, Bordetella pertussis
ggccugcucgcccacauagcg

SEQ ID NO: 2437074 - RNA, 18 nt, Bordetella pertussis
ggccugcucgccggccag

SEQ ID NO: 2437075 - RNA, 19 nt, Bordetella pertussis
ggccugcucgccggccagc

SEQ ID NO: 2437076 - RNA, 22 nt, Bordetella pertussis
ggccugcucgccggccagcgcg

SEQ ID NO: 2437077 - RNA, 17 nt, Bordetella pertussis
ggccugcucgggcgccu

SEQ ID NO: 2437078 - RNA, 20 nt, Bordetella pertussis
ggccugcugcaauucgccga

SEQ ID NO: 2437079 - RNA, 14 nt, Bordetella pertussis
ggccugcugcagca

SEQ ID NO: 2437080 - RNA, 14 nt, Bordetella pertussis
ggccugcugcagcg

SEQ ID NO: 2437081 - RNA, 16 nt, Bordetella pertussis
ggccugcugucgcugg

SEQ ID NO: 2437082 - RNA, 23 nt, Bordetella pertussis
ggccugcugugcgauggcacggc

SEQ ID NO: 2437083 - RNA, 15 nt, Bordetella pertussis
ggccugcuugaagac

SEQ ID NO: 2437084 - RNA, 17 nt, Bordetella pertussis
ggccugcuuggccgcgu

SEQ ID NO: 2437085 - RNA, 14 nt, Bordetella pertussis
ggcgaagccggcac

SEQ ID NO: 2437086 - RNA, 15 nt, Bordetella pertussis
ggcgaagccggcacg

SEQ ID NO: 2437087 - RNA, 21 nt, Bordetella pertussis
ggcgaagccggcacgccugcc

SEQ ID NO: 2437088 - RNA, 18 nt, Bordetella pertussis
ggcgaagccuugcgcggc

SEQ ID NO: 2437089 - RNA, 20 nt, Bordetella pertussis
ggcgaagccuugcgcggcca

SEQ ID NO: 2437090 - RNA, 22 nt, Bordetella pertussis
ggcgaagccuugcgcggccagc

SEQ ID NO: 2437091 - RNA, 23 nt, Bordetella pertussis
ggcgaagccuugcgcggccagca

SEQ ID NO: 2437092 - RNA, 21 nt, Bordetella pertussis
ggcgaagcuguccuucguggc

SEQ ID NO: 2437093 - RNA, 22 nt, Bordetella pertussis
ggcgaagcuguccuucguggcg

SEQ ID NO: 2437094 - RNA, 14 nt, Bordetella pertussis
ggcgaaggccagcg

SEQ ID NO: 2437095 - RNA, 17 nt, Bordetella pertussis
ggcgaaggccagcgccu

SEQ ID NO: 2437096 - RNA, 14 nt, Bordetella pertussis
ggcgaaggcgucgg

SEQ ID NO: 2437097 - RNA, 22 nt, Bordetella pertussis
ggcgaaggcgucggccauggcg

SEQ ID NO: 2437098 - RNA, 18 nt, Bordetella pertussis
ggcgaagguggcacauca

SEQ ID NO: 2437099 - RNA, 23 nt, Bordetella pertussis
ggcgaagugcccgcuggccaugc

SEQ ID NO: 2437100 - RNA, 20 nt, Bordetella pertussis
ggcgaaucaguucgcgcagg

SEQ ID NO: 2437101 - RNA, 14 nt, Bordetella pertussis
ggcgaauccaccgg

SEQ ID NO: 2437102 - RNA, 23 nt, Bordetella pertussis
ggcgaauccgcaacccagcagcg

SEQ ID NO: 2437103 - RNA, 19 nt, Bordetella pertussis
ggcgaaugccugguaggcg

SEQ ID NO: 2437104 - RNA, 19 nt, Bordetella pertussis
ggcgacacccccagggcgc

SEQ ID NO: 2437105 - RNA, 22 nt, Bordetella pertussis
ggcgacacccccagggcgcgcc

SEQ ID NO: 2437106 - RNA, 14 nt, Bordetella pertussis
ggcgacaccgcggc

SEQ ID NO: 2437107 - RNA, 15 nt, Bordetella pertussis
ggcgacaccgcggcc

SEQ ID NO: 2437108 - RNA, 20 nt, Bordetella pertussis
ggcgacaccgcggccuugcc

SEQ ID NO: 2437109 - RNA, 16 nt, Bordetella pertussis
ggcgacaggcgcgccc

SEQ ID NO: 2437110 - RNA, 14 nt, Bordetella pertussis
ggcgacagggcguc

SEQ ID NO: 2437111 - RNA, 17 nt, Bordetella pertussis
ggcgacagggcgucguc

SEQ ID NO: 2437112 - RNA, 21 nt, Bordetella pertussis
ggcgacauagaucuccggcgc

SEQ ID NO: 2437113 - RNA, 23 nt, Bordetella pertussis
ggcgacauagaucuccggcgccu

SEQ ID NO: 2437114 - RNA, 14 nt, Bordetella pertussis
ggcgacauugcgcc

SEQ ID NO: 2437115 - RNA, 19 nt, Bordetella pertussis
ggcgaccaggcccacgacg

SEQ ID NO: 2437116 - RNA, 13 nt, Bordetella pertussis
ggcgaccgccggc

SEQ ID NO: 2437117 - RNA, 15 nt, Bordetella pertussis
ggcgaccgccggccg

SEQ ID NO: 2437118 - RNA, 16 nt, Bordetella pertussis
ggcgaccgccggccgg

SEQ ID NO: 2437119 - RNA, 23 nt, Bordetella pertussis
ggcgaccgcgaaccggugcuggu

SEQ ID NO: 2437120 - RNA, 13 nt, Bordetella pertussis
ggcgaccggcacc

SEQ ID NO: 2437121 - RNA, 17 nt, Bordetella pertussis
ggcgaccggcaccuggg

SEQ ID NO: 2437122 - RNA, 19 nt, Bordetella pertussis
ggcgaccggcaccugggcc

SEQ ID NO: 2437123 - RNA, 14 nt, Bordetella pertussis
ggcgaccggcggca

SEQ ID NO: 2437124 - RNA, 21 nt, Bordetella pertussis
ggcgaccgugcgccaacgcgu

SEQ ID NO: 2437125 - RNA, 18 nt, Bordetella pertussis
ggcgacgaacccgggcgu

SEQ ID NO: 2437126 - RNA, 19 nt, Bordetella pertussis
ggcgacgaacccgggcgug

SEQ ID NO: 2437127 - RNA, 20 nt, Bordetella pertussis
ggcgacgacuacgcgcuggc

SEQ ID NO: 2437128 - RNA, 22 nt, Bordetella pertussis
ggcgacgacuacgcgcuggcgc

SEQ ID NO: 2437129 - RNA, 16 nt, Bordetella pertussis
ggcgacgaucccgacg

SEQ ID NO: 2437130 - RNA, 17 nt, Bordetella pertussis
ggcgacgaucuccaccc

SEQ ID NO: 2437131 - RNA, 20 nt, Bordetella pertussis
ggcgacgcaacagacccggg

SEQ ID NO: 2437132 - RNA, 16 nt, Bordetella pertussis
ggcgacgcccagccug

SEQ ID NO: 2437133 - RNA, 17 nt, Bordetella pertussis
ggcgacgcccagccugc

SEQ ID NO: 2437134 - RNA, 22 nt, Bordetella pertussis
ggcgacgcccagccugccggcg

SEQ ID NO: 2437135 - RNA, 14 nt, Bordetella pertussis
ggcgacgccgcggu

SEQ ID NO: 2437136 - RNA, 18 nt, Bordetella pertussis
ggcgacgccgcggugcug

SEQ ID NO: 2437137 - RNA, 14 nt, Bordetella pertussis
ggcgacgcgcugcc

SEQ ID NO: 2437138 - RNA, 15 nt, Bordetella pertussis
ggcgacgcgcugccg

SEQ ID NO: 2437139 - RNA, 12 nt, Bordetella pertussis
ggcgacgcggcg

SEQ ID NO: 2437140 - RNA, 13 nt, Bordetella pertussis
ggcgacggccugc

SEQ ID NO: 2437141 - RNA, 22 nt, Bordetella pertussis
ggcgacggcgccuggcgcauga

SEQ ID NO: 2437142 - RNA, 14 nt, Bordetella pertussis
ggcgacggcgucgg

SEQ ID NO: 2437143 - RNA, 22 nt, Bordetella pertussis
ggcgacggcgucggccuggucc

SEQ ID NO: 2437144 - RNA, 19 nt, Bordetella pertussis
ggcgacggcgugcugcgcg

SEQ ID NO: 2437145 - RNA, 13 nt, Bordetella pertussis
ggcgacggucagg

SEQ ID NO: 2437146 - RNA, 16 nt, Bordetella pertussis
ggcgacggucaggggc

SEQ ID NO: 2437147 - RNA, 16 nt, Bordetella pertussis
ggcgacgguggcuggg

SEQ ID NO: 2437148 - RNA, 15 nt, Bordetella pertussis
ggcgacgucccaggc

SEQ ID NO: 2437149 - RNA, 14 nt, Bordetella pertussis
ggcgacgucgggca

SEQ ID NO: 2437150 - RNA, 20 nt, Bordetella pertussis
ggcgacgucgggcagggcga

SEQ ID NO: 2437151 - RNA, 19 nt, Bordetella pertussis
ggcgacguggugugcgagg

SEQ ID NO: 2437152 - RNA, 16 nt, Bordetella pertussis
ggcgacguuggcgaau

SEQ ID NO: 2437153 - RNA, 13 nt, Bordetella pertussis
ggcgacuccagcc

SEQ ID NO: 2437154 - RNA, 22 nt, Bordetella pertussis
ggcgacugcagcaggcugggcg

SEQ ID NO: 2437155 - RNA, 19 nt, Bordetella pertussis
ggcgacugccccagcggcu

SEQ ID NO: 2437156 - RNA, 22 nt, Bordetella pertussis
ggcgacuuccgcuuccggccgg

SEQ ID NO: 2437157 - RNA, 21 nt, Bordetella pertussis
ggcgacuucggcggccaugcc

SEQ ID NO: 2437158 - RNA, 17 nt, Bordetella pertussis
ggcgacuucggcggccu

SEQ ID NO: 2437159 - RNA, 19 nt, Bordetella pertussis
ggcgacuucggcggccugc

SEQ ID NO: 2437160 - RNA, 20 nt, Bordetella pertussis
ggcgacuucggcggccugcu

SEQ ID NO: 2437161 - RNA, 19 nt, Bordetella pertussis
ggcgagaacgcggccgcga

SEQ ID NO: 2437162 - RNA, 20 nt, Bordetella pertussis
ggcgagaugccgucgaaggc

SEQ ID NO: 2437163 - RNA, 19 nt, Bordetella pertussis
ggcgagcacccgcaggcgg

SEQ ID NO: 2437164 - RNA, 16 nt, Bordetella pertussis
ggcgagcacggccugc

SEQ ID NO: 2437165 - RNA, 22 nt, Bordetella pertussis
ggcgagcagguccauggccagu

SEQ ID NO: 2437166 - RNA, 16 nt, Bordetella pertussis
ggcgagcauggcaucg

SEQ ID NO: 2437167 - RNA, 17 nt, Bordetella pertussis
ggcgagcauggcaucgg

SEQ ID NO: 2437168 - RNA, 22 nt, Bordetella pertussis
ggcgagcauggcgguggccagc

SEQ ID NO: 2437169 - RNA, 23 nt, Bordetella pertussis
ggcgagcauggcgguggccagcg

SEQ ID NO: 2437170 - RNA, 22 nt, Bordetella pertussis
ggcgagcccagguugcucgccu

SEQ ID NO: 2437171 - RNA, 18 nt, Bordetella pertussis
ggcgagccgcgcgcaugc

SEQ ID NO: 2437172 - RNA, 12 nt, Bordetella pertussis
ggcgagccgggc

SEQ ID NO: 2437173 - RNA, 17 nt, Bordetella pertussis
ggcgagcgcagccgcuc

SEQ ID NO: 2437174 - RNA, 12 nt, Bordetella pertussis
ggcgagcgccgc

SEQ ID NO: 2437175 - RNA, 13 nt, Bordetella pertussis
ggcgagcgccgcc

SEQ ID NO: 2437176 - RNA, 14 nt, Bordetella pertussis
ggcgagcgccgcgc

SEQ ID NO: 2437177 - RNA, 17 nt, Bordetella pertussis
ggcgagcgccgcgcucc

SEQ ID NO: 2437178 - RNA, 19 nt, Bordetella pertussis
ggcgagcgccucgcgcucc

SEQ ID NO: 2437179 - RNA, 12 nt, Bordetella pertussis
ggcgagcgcggc

SEQ ID NO: 2437180 - RNA, 18 nt, Bordetella pertussis
ggcgagcgcggcgauacg

SEQ ID NO: 2437181 - RNA, 19 nt, Bordetella pertussis
ggcgagcgcggcgcgcgcc

SEQ ID NO: 2437182 - RNA, 21 nt, Bordetella pertussis
ggcgagcgcggcgcgcgccag

SEQ ID NO: 2437183 - RNA, 23 nt, Bordetella pertussis
ggcgagcgcggcgggugccgcga

SEQ ID NO: 2437184 - RNA, 12 nt, Bordetella pertussis
ggcgagcggcgu

SEQ ID NO: 2437185 - RNA, 14 nt, Bordetella pertussis
ggcgagcgggccgg

SEQ ID NO: 2437186 - RNA, 20 nt, Bordetella pertussis
ggcgagcguuuuggcgagca

SEQ ID NO: 2437187 - RNA, 16 nt, Bordetella pertussis
ggcgagcucggcaugg

SEQ ID NO: 2437188 - RNA, 17 nt, Bordetella pertussis
ggcgagcuggcccuggg

SEQ ID NO: 2437189 - RNA, 13 nt, Bordetella pertussis
ggcgaggacaggc

SEQ ID NO: 2437190 - RNA, 15 nt, Bordetella pertussis
ggcgaggacaggcca

SEQ ID NO: 2437191 - RNA, 18 nt, Bordetella pertussis
ggcgaggaggugcgccgc

SEQ ID NO: 2437192 - RNA, 16 nt, Bordetella pertussis
ggcgaggaugccgcgc

SEQ ID NO: 2437193 - RNA, 14 nt, Bordetella pertussis
ggcgaggcgcuggc

SEQ ID NO: 2437194 - RNA, 19 nt, Bordetella pertussis
ggcgaggcgcuggccggcg

SEQ ID NO: 2437195 - RNA, 18 nt, Bordetella pertussis
ggcgaggcggggcuggcg

SEQ ID NO: 2437196 - RNA, 18 nt, Bordetella pertussis
ggcgaggcguccagcccc

SEQ ID NO: 2437197 - RNA, 13 nt, Bordetella pertussis
ggcgagggcgucg

SEQ ID NO: 2437198 - RNA, 16 nt, Bordetella pertussis
ggcgcaagcgcgccga

SEQ ID NO: 2437199 - RNA, 17 nt, Bordetella pertussis
ggcgcaagcgcgccgac

SEQ ID NO: 2437200 - RNA, 20 nt, Bordetella pertussis
ggcgcaaggacgcguccucg

SEQ ID NO: 2437201 - RNA, 20 nt, Bordetella pertussis
ggcgcaaggcaugcgccagc

SEQ ID NO: 2437202 - RNA, 15 nt, Bordetella pertussis
ggcgcaaggcgucgg

SEQ ID NO: 2437203 - RNA, 19 nt, Bordetella pertussis
ggcgcaaggcgucgggcac

SEQ ID NO: 2437204 - RNA, 20 nt, Bordetella pertussis
ggcgcacaaccugguacggc

SEQ ID NO: 2437205 - RNA, 14 nt, Bordetella pertussis
ggcgcacaccauca

SEQ ID NO: 2437206 - RNA, 22 nt, Bordetella pertussis
ggcgcaccaaucuugccaggcc

SEQ ID NO: 2437207 - RNA, 17 nt, Bordetella pertussis
ggcgcaccagcgcgccg

SEQ ID NO: 2437208 - RNA, 18 nt, Bordetella pertussis
ggcgcaccagcgcgccga

SEQ ID NO: 2437209 - RNA, 14 nt, Bordetella pertussis
ggcgcaccaggcug

SEQ ID NO: 2437210 - RNA, 16 nt, Bordetella pertussis
ggcgcaccaggcuggg

SEQ ID NO: 2437211 - RNA, 17 nt, Bordetella pertussis
ggcgcaccagguuggcg

SEQ ID NO: 2437212 - RNA, 21 nt, Bordetella pertussis
ggcgcaccaugcggugcgccc

SEQ ID NO: 2437213 - RNA, 22 nt, Bordetella pertussis
ggcgcaccaugcggugcgcccu

SEQ ID NO: 2437214 - RNA, 14 nt, Bordetella pertussis
ggcgcacccgcggc

SEQ ID NO: 2437215 - RNA, 15 nt, Bordetella pertussis
ggcgcacccgcggcg

SEQ ID NO: 2437216 - RNA, 23 nt, Bordetella pertussis
ggcgcacccgcggcgcaugcagc

SEQ ID NO: 2437217 - RNA, 18 nt, Bordetella pertussis
ggcgcacccugcaggccg

SEQ ID NO: 2437218 - RNA, 19 nt, Bordetella pertussis
ggcgcacccugcaggccgg

SEQ ID NO: 2437219 - RNA, 23 nt, Bordetella pertussis
ggcgcacccugcaggccgggcag

SEQ ID NO: 2437220 - RNA, 20 nt, Bordetella pertussis
ggcgcaccgacagcaagggc

SEQ ID NO: 2437221 - RNA, 15 nt, Bordetella pertussis
ggcgcaccgcgcugg

SEQ ID NO: 2437222 - RNA, 16 nt, Bordetella pertussis
ggcgcaccgcgcuggg

SEQ ID NO: 2437223 - RNA, 20 nt, Bordetella pertussis
ggcgcaccggcacgcgccag

SEQ ID NO: 2437224 - RNA, 21 nt, Bordetella pertussis
ggcgcaccggcacgcgccagc

SEQ ID NO: 2437225 - RNA, 18 nt, Bordetella pertussis
ggcgcaccgucacgcgcu

SEQ ID NO: 2437226 - RNA, 23 nt, Bordetella pertussis
ggcgcaccucguaaguggcggcg

SEQ ID NO: 2437227 - RNA, 13 nt, Bordetella pertussis
ggcgcacgccccg

SEQ ID NO: 2437228 - RNA, 13 nt, Bordetella pertussis
ggcgcacgccgcc

SEQ ID NO: 2437229 - RNA, 18 nt, Bordetella pertussis
ggcgcacgccgcgccggc

SEQ ID NO: 2437230 - RNA, 19 nt, Bordetella pertussis
ggcgcacgccgcgccggcg

SEQ ID NO: 2437231 - RNA, 17 nt, Bordetella pertussis
ggcgcacgccggaccag

SEQ ID NO: 2437232 - RNA, 14 nt, Bordetella pertussis
ggcgcacgccgggc

SEQ ID NO: 2437233 - RNA, 17 nt, Bordetella pertussis
ggcgcacgccgggcgcg

SEQ ID NO: 2437234 - RNA, 23 nt, Bordetella pertussis
ggcgcacgccgggcgcggccgcc

SEQ ID NO: 2437235 - RNA, 13 nt, Bordetella pertussis
ggcgcacgccugu

SEQ ID NO: 2437236 - RNA, 21 nt, Bordetella pertussis
ggcgcagauccucgaacaggc

SEQ ID NO: 2437237 - RNA, 19 nt, Bordetella pertussis
ggcgcagauggcggcgaug

SEQ ID NO: 2437238 - RNA, 16 nt, Bordetella pertussis
ggcgcagaugggcggc

SEQ ID NO: 2437239 - RNA, 17 nt, Bordetella pertussis
ggcgcagaugggcggcg

SEQ ID NO: 2437240 - RNA, 18 nt, Bordetella pertussis
ggcgcagaugggcggcga

SEQ ID NO: 2437241 - RNA, 20 nt, Bordetella pertussis
ggcgcagaugggcggcgacg

SEQ ID NO: 2437242 - RNA, 21 nt, Bordetella pertussis
ggcgcagaugggcggcgacga

SEQ ID NO: 2437243 - RNA, 16 nt, Bordetella pertussis
ggcgcagcacgccgcg

SEQ ID NO: 2437244 - RNA, 17 nt, Bordetella pertussis
ggcgcagcacgccgcgc

SEQ ID NO: 2437245 - RNA, 13 nt, Bordetella pertussis
ggcgcagcagcgc

SEQ ID NO: 2437246 - RNA, 16 nt, Bordetella pertussis
ggcgcagcagcgccgg

SEQ ID NO: 2437247 - RNA, 18 nt, Bordetella pertussis
ggcgcagcagcgccggca

SEQ ID NO: 2437248 - RNA, 12 nt, Bordetella pertussis
ggcgcagcaggc

SEQ ID NO: 2437249 - RNA, 14 nt, Bordetella pertussis
ggcgcagcaggcca

SEQ ID NO: 2437250 - RNA, 16 nt, Bordetella pertussis
ggcgcagcaggcgcgc

SEQ ID NO: 2437251 - RNA, 18 nt, Bordetella pertussis
ggcgcagcaggcgcgcgg

SEQ ID NO: 2437252 - RNA, 23 nt, Bordetella pertussis
ggcgcagcaucuugcgccgcugc

SEQ ID NO: 2437253 - RNA, 19 nt, Bordetella pertussis
ggcgcagcauuucggcgcc

SEQ ID NO: 2437254 - RNA, 22 nt, Bordetella pertussis
ggcgcagcccacucagggcggg

SEQ ID NO: 2437255 - RNA, 13 nt, Bordetella pertussis
ggcgcagcccagc

SEQ ID NO: 2437256 - RNA, 22 nt, Bordetella pertussis
ggcgcagccgccauaggcgcgc

SEQ ID NO: 2437257 - RNA, 13 nt, Bordetella pertussis
ggcgcagccgcgc

SEQ ID NO: 2437258 - RNA, 14 nt, Bordetella pertussis
ggcgcagccggccg

SEQ ID NO: 2437259 - RNA, 16 nt, Bordetella pertussis
ggcgcagcgcccaggc

SEQ ID NO: 2437260 - RNA, 13 nt, Bordetella pertussis
ggcgcagcgcggc

SEQ ID NO: 2437261 - RNA, 15 nt, Bordetella pertussis
ggcgcagcgcguccu

SEQ ID NO: 2437262 - RNA, 12 nt, Bordetella pertussis
ggcgcagcggcg

SEQ ID NO: 2437263 - RNA, 18 nt, Bordetella pertussis
ggcgcagcggcggcgcgg

SEQ ID NO: 2437264 - RNA, 14 nt, Bordetella pertussis
ggcgcagcuccggg

SEQ ID NO: 2437265 - RNA, 21 nt, Bordetella pertussis
ggcgcagcuccgggucgagcg

SEQ ID NO: 2437266 - RNA, 24 nt, Bordetella pertussis
ggcgcagcuccgggucgagcgccg

SEQ ID NO: 2437267 - RNA, 19 nt, Bordetella pertussis
ggcgcaggaugcgcuggcc

SEQ ID NO: 2437268 - RNA, 20 nt, Bordetella pertussis
ggcgcaggaugcgcuggccg

SEQ ID NO: 2437269 - RNA, 22 nt, Bordetella pertussis
ggcgcaggaugcgcuggccggc

SEQ ID NO: 2437270 - RNA, 23 nt, Bordetella pertussis
ggcgcaggaugcgcuggccggcc

SEQ ID NO: 2437271 - RNA, 14 nt, Bordetella pertussis
ggcgcaggccagcg

SEQ ID NO: 2437272 - RNA, 16 nt, Bordetella pertussis
ggcgcaggccagcgcc

SEQ ID NO: 2437273 - RNA, 18 nt, Bordetella pertussis
ggcgcaggccagcgccgc

SEQ ID NO: 2437274 - RNA, 21 nt, Bordetella pertussis
ggcgcaggccagcgccgcggu

SEQ ID NO: 2437275 - RNA, 11 nt, Bordetella pertussis
ggcgcaggccg

SEQ ID NO: 2437276 - RNA, 12 nt, Bordetella pertussis
ggcgcaggccga

SEQ ID NO: 2437277 - RNA, 15 nt, Bordetella pertussis
ggcgcaggccgacgc

SEQ ID NO: 2437278 - RNA, 13 nt, Bordetella pertussis
ggcgcaggccgcc

SEQ ID NO: 2437279 - RNA, 14 nt, Bordetella pertussis
ggcgcaggccgcgc

SEQ ID NO: 2437280 - RNA, 16 nt, Bordetella pertussis
ggcgcaggccgcgccg

SEQ ID NO: 2437281 - RNA, 16 nt, Bordetella pertussis
ggcgcaggccgcgcgc

SEQ ID NO: 2437282 - RNA, 19 nt, Bordetella pertussis
ggcgcaggccgcgcgcauc

SEQ ID NO: 2437283 - RNA, 16 nt, Bordetella pertussis
ggcgcaggccggcggc

SEQ ID NO: 2437284 - RNA, 19 nt, Bordetella pertussis
ggcgcaggccggcggccag

SEQ ID NO: 2437285 - RNA, 14 nt, Bordetella pertussis
ggcgcaggccugcg

SEQ ID NO: 2437286 - RNA, 16 nt, Bordetella pertussis
ggcgcaggccugcggc

SEQ ID NO: 2437287 - RNA, 13 nt, Bordetella pertussis
ggcgcaggcgcga

SEQ ID NO: 2437288 - RNA, 15 nt, Bordetella pertussis
ggcgcaggcgcgcgc

SEQ ID NO: 2437289 - RNA, 16 nt, Bordetella pertussis
ggcgcaggcgcgcgcc

SEQ ID NO: 2437290 - RNA, 20 nt, Bordetella pertussis
ggcgcaggcguuucgccagg

SEQ ID NO: 2437291 - RNA, 19 nt, Bordetella pertussis
ggcgcagguccaccgccac

SEQ ID NO: 2437292 - RNA, 18 nt, Bordetella pertussis
ggcgcaguaucccggcca

SEQ ID NO: 2437293 - RNA, 19 nt, Bordetella pertussis
ggcgcaguaucccggccag

SEQ ID NO: 2437294 - RNA, 20 nt, Bordetella pertussis
ggcgcaguaucccggccagg

SEQ ID NO: 2437295 - RNA, 23 nt, Bordetella pertussis
ggcgcaguaucccggccaggcgc

SEQ ID NO: 2437296 - RNA, 20 nt, Bordetella pertussis
ggcgcaguaucuggugcgcg

SEQ ID NO: 2437297 - RNA, 14 nt, Bordetella pertussis
ggcgcagucgagca

SEQ ID NO: 2437298 - RNA, 15 nt, Bordetella pertussis
ggcgcagucgagcac

SEQ ID NO: 2437299 - RNA, 16 nt, Bordetella pertussis
ggcgcagucgagcacc

SEQ ID NO: 2437300 - RNA, 21 nt, Bordetella pertussis
ggcgcagucgagcaccgcgcg

SEQ ID NO: 2437301 - RNA, 15 nt, Bordetella pertussis
ggcgcagucgcgcac

SEQ ID NO: 2437302 - RNA, 18 nt, Bordetella pertussis
ggcgcaguuccggcgggc

SEQ ID NO: 2437303 - RNA, 19 nt, Bordetella pertussis
ggcgcaguuccggcgggcc

SEQ ID NO: 2437304 - RNA, 22 nt, Bordetella pertussis
ggcgcaguuccggcgggccgca

SEQ ID NO: 2437305 - RNA, 17 nt, Bordetella pertussis
ggcgcauagcgaaagcc

SEQ ID NO: 2437306 - RNA, 18 nt, Bordetella pertussis
ggcgcauauggagccagg

SEQ ID NO: 2437307 - RNA, 19 nt, Bordetella pertussis
ggcgcauauggagccaggc

SEQ ID NO: 2437308 - RNA, 23 nt, Bordetella pertussis
ggcgcauauggagccaggcggcg

SEQ ID NO: 2437309 - RNA, 15 nt, Bordetella pertussis
ggcgcaucagcgcgc

SEQ ID NO: 2437310 - RNA, 21 nt, Bordetella pertussis
ggcgcaucagcuuggccacca

SEQ ID NO: 2437311 - RNA, 18 nt, Bordetella pertussis
ggcgccgacgaugccgcc

SEQ ID NO: 2437312 - RNA, 14 nt, Bordetella pertussis
ggcgccgacgcgcu

SEQ ID NO: 2437313 - RNA, 15 nt, Bordetella pertussis
ggcgccgacgcgcug

SEQ ID NO: 2437314 - RNA, 17 nt, Bordetella pertussis
ggcgccgacgcgcuggc

SEQ ID NO: 2437315 - RNA, 13 nt, Bordetella pertussis
ggcgccgacggcg

SEQ ID NO: 2437316 - RNA, 22 nt, Bordetella pertussis
ggcgccgacggcgcccugcagg

SEQ ID NO: 2437317 - RNA, 16 nt, Bordetella pertussis
ggcgccgacuuccugg

SEQ ID NO: 2437318 - RNA, 13 nt, Bordetella pertussis
ggcgccgagaugg

SEQ ID NO: 2437319 - RNA, 15 nt, Bordetella pertussis
ggcgccgagggccgc

SEQ ID NO: 2437320 - RNA, 16 nt, Bordetella pertussis
ggcgccgagggccgcg

SEQ ID NO: 2437321 - RNA, 15 nt, Bordetella pertussis
ggcgccgaucagcag

SEQ ID NO: 2437322 - RNA, 18 nt, Bordetella pertussis
ggcgccgauccagcccac

SEQ ID NO: 2437323 - RNA, 19 nt, Bordetella pertussis
ggcgccgauccagcccacc

SEQ ID NO: 2437324 - RNA, 16 nt, Bordetella pertussis
ggcgccgauccagggc

SEQ ID NO: 2437325 - RNA, 20 nt, Bordetella pertussis
ggcgccgauccagggccgca

SEQ ID NO: 2437326 - RNA, 13 nt, Bordetella pertussis
ggcgccgauccgg

SEQ ID NO: 2437327 - RNA, 19 nt, Bordetella pertussis
ggcgccgauccggcgcaga

SEQ ID NO: 2437328 - RNA, 18 nt, Bordetella pertussis
ggcgccgauggcgccgcu

SEQ ID NO: 2437329 - RNA, 19 nt, Bordetella pertussis
ggcgccgcaacaggcagcu

SEQ ID NO: 2437330 - RNA, 18 nt, Bordetella pertussis
ggcgccgcaacgccgggc

SEQ ID NO: 2437331 - RNA, 13 nt, Bordetella pertussis
ggcgccgcacccg

SEQ ID NO: 2437332 - RNA, 12 nt, Bordetella pertussis
ggcgccgccccg

SEQ ID NO: 2437333 - RNA, 14 nt, Bordetella pertussis
ggcgccgccccguc

SEQ ID NO: 2437334 - RNA, 14 nt, Bordetella pertussis
ggcgccgccgcccg

SEQ ID NO: 2437335 - RNA, 13 nt, Bordetella pertussis
ggcgccgccggcc

SEQ ID NO: 2437336 - RNA, 14 nt, Bordetella pertussis
ggcgccgccggcca

SEQ ID NO: 2437337 - RNA, 15 nt, Bordetella pertussis
ggcgccgccggcggc

SEQ ID NO: 2437338 - RNA, 17 nt, Bordetella pertussis
ggcgccgccggcggccu

SEQ ID NO: 2437339 - RNA, 19 nt, Bordetella pertussis
ggcgccgccggcggccugg

SEQ ID NO: 2437340 - RNA, 20 nt, Bordetella pertussis
ggcgccgccggcggccugga

SEQ ID NO: 2437341 - RNA, 18 nt, Bordetella pertussis
ggcgccgccggguuucuc

SEQ ID NO: 2437342 - RNA, 19 nt, Bordetella pertussis
ggcgccgccggguuucucg

SEQ ID NO: 2437343 - RNA, 17 nt, Bordetella pertussis
ggcgccgccgugcgcgg

SEQ ID NO: 2437344 - RNA, 20 nt, Bordetella pertussis
ggcgccgccgugcgcgggcg

SEQ ID NO: 2437345 - RNA, 18 nt, Bordetella pertussis
ggcgccgccucaggccgg

SEQ ID NO: 2437346 - RNA, 22 nt, Bordetella pertussis
ggcgccgccucaggccggcgcc

SEQ ID NO: 2437347 - RNA, 16 nt, Bordetella pertussis
ggcgccgccucgggca

SEQ ID NO: 2437348 - RNA, 12 nt, Bordetella pertussis
ggcgccgcgcac

SEQ ID NO: 2437349 - RNA, 13 nt, Bordetella pertussis
ggcgccgcgcacg

SEQ ID NO: 2437350 - RNA, 12 nt, Bordetella pertussis
ggcgccgcgccc

SEQ ID NO: 2437351 - RNA, 18 nt, Bordetella pertussis
ggcgccgcgcccggccgg

SEQ ID NO: 2437352 - RNA, 13 nt, Bordetella pertussis
ggcgccgcgccgc

SEQ ID NO: 2437353 - RNA, 14 nt, Bordetella pertussis
ggcgccgcgccggg

SEQ ID NO: 2437354 - RNA, 19 nt, Bordetella pertussis
ggcgccgcgccggggcggc

SEQ ID NO: 2437355 - RNA, 19 nt, Bordetella pertussis
ggcgccgcgcgccauccgg

SEQ ID NO: 2437356 - RNA, 23 nt, Bordetella pertussis
ggcgccgcgcgccauccggcgca

SEQ ID NO: 2437357 - RNA, 15 nt, Bordetella pertussis
ggcgccgcgcgccgc

SEQ ID NO: 2437358 - RNA, 17 nt, Bordetella pertussis
ggcgccgcgcgccgcgg

SEQ ID NO: 2437359 - RNA, 16 nt, Bordetella pertussis
ggcgccgcgcgcuggu

SEQ ID NO: 2437360 - RNA, 16 nt, Bordetella pertussis
ggcgccgcgcggucgc

SEQ ID NO: 2437361 - RNA, 20 nt, Bordetella pertussis
ggcgccgcgcguaugcaccg

SEQ ID NO: 2437362 - RNA, 15 nt, Bordetella pertussis
ggcgccgcgcucgcg

SEQ ID NO: 2437363 - RNA, 20 nt, Bordetella pertussis
ggcgccgcgcucgcgccagg

SEQ ID NO: 2437364 - RNA, 22 nt, Bordetella pertussis
ggcgccgcgcucgcgccaggcc

SEQ ID NO: 2437365 - RNA, 18 nt, Bordetella pertussis
ggcgccgcgcugauccug

SEQ ID NO: 2437366 - RNA, 15 nt, Bordetella pertussis
ggcgccgcggaggcg

SEQ ID NO: 2437367 - RNA, 11 nt, Bordetella pertussis
ggcgccgcggc

SEQ ID NO: 2437368 - RNA, 13 nt, Bordetella pertussis
ggcgccgcggccg

SEQ ID NO: 2437369 - RNA, 15 nt, Bordetella pertussis
ggcgccgcggcggcg

SEQ ID NO: 2437370 - RNA, 12 nt, Bordetella pertussis
ggcgccgcgggc

SEQ ID NO: 2437371 - RNA, 14 nt, Bordetella pertussis
ggcgccgcgggccu

SEQ ID NO: 2437372 - RNA, 14 nt, Bordetella pertussis
ggcgccgcggggcg

SEQ ID NO: 2437373 - RNA, 13 nt, Bordetella pertussis
ggcgccgcggggg

SEQ ID NO: 2437374 - RNA, 15 nt, Bordetella pertussis
ggcgccgcgggggug

SEQ ID NO: 2437375 - RNA, 18 nt, Bordetella pertussis
ggcgccgcguccggcgcc

SEQ ID NO: 2437376 - RNA, 19 nt, Bordetella pertussis
ggcgccgcguucacgccgg

SEQ ID NO: 2437377 - RNA, 21 nt, Bordetella pertussis
ggcgccgcguucacgccggcg

SEQ ID NO: 2437378 - RNA, 23 nt, Bordetella pertussis
ggcgccgcguucacgccggcgcg

SEQ ID NO: 2437379 - RNA, 17 nt, Bordetella pertussis
ggcgccgcucagcgcgg

SEQ ID NO: 2437380 - RNA, 19 nt, Bordetella pertussis
ggcgccgcucagcgcggcg

SEQ ID NO: 2437381 - RNA, 19 nt, Bordetella pertussis
ggcgccgcuuccggcauga

SEQ ID NO: 2437382 - RNA, 16 nt, Bordetella pertussis
ggcgccggacugggcg

SEQ ID NO: 2437383 - RNA, 19 nt, Bordetella pertussis
ggcgccggacugggcgucg

SEQ ID NO: 2437384 - RNA, 13 nt, Bordetella pertussis
ggcgccggaucgg

SEQ ID NO: 2437385 - RNA, 20 nt, Bordetella pertussis
ggcgccggaucggccggcag

SEQ ID NO: 2437386 - RNA, 18 nt, Bordetella pertussis
ggcgccggcaaacccggc

SEQ ID NO: 2437387 - RNA, 17 nt, Bordetella pertussis
ggcgccggcacgacgau

SEQ ID NO: 2437388 - RNA, 12 nt, Bordetella pertussis
ggcgccggccac

SEQ ID NO: 2437389 - RNA, 16 nt, Bordetella pertussis
ggcgccggccagcgcg

SEQ ID NO: 2437390 - RNA, 17 nt, Bordetella pertussis
ggcgccggccagcgcgc

SEQ ID NO: 2437391 - RNA, 20 nt, Bordetella pertussis
ggcgccggccagcgcgccgg

SEQ ID NO: 2437392 - RNA, 15 nt, Bordetella pertussis
ggcgccggccaggau

SEQ ID NO: 2437393 - RNA, 18 nt, Bordetella pertussis
ggcgccggccaggaugag

SEQ ID NO: 2437394 - RNA, 19 nt, Bordetella pertussis
ggcgccggccaggaugagg

SEQ ID NO: 2437395 - RNA, 11 nt, Bordetella pertussis
ggcgccggccg

SEQ ID NO: 2437396 - RNA, 12 nt, Bordetella pertussis
ggcgccggccgc

SEQ ID NO: 2437397 - RNA, 20 nt, Bordetella pertussis
ggcgccggccgcccgccugc

SEQ ID NO: 2437398 - RNA, 13 nt, Bordetella pertussis
ggcgccggccgcg

SEQ ID NO: 2437399 - RNA, 21 nt, Bordetella pertussis
ggcgccggccgcgcgcgccau

SEQ ID NO: 2437400 - RNA, 23 nt, Bordetella pertussis
ggcgccggccgcgcgcgccaugu

SEQ ID NO: 2437401 - RNA, 13 nt, Bordetella pertussis
ggcgccggccucc

SEQ ID NO: 2437402 - RNA, 23 nt, Bordetella pertussis
ggcgccggccuccagcaucgccg

SEQ ID NO: 2437403 - RNA, 16 nt, Bordetella pertussis
ggcgccggccuugccg

SEQ ID NO: 2437404 - RNA, 14 nt, Bordetella pertussis
ggcgccggcgcccg

SEQ ID NO: 2437405 - RNA, 17 nt, Bordetella pertussis
ggcgccggcgcccggca

SEQ ID NO: 2437406 - RNA, 16 nt, Bordetella pertussis
ggcgccggcgccgggc

SEQ ID NO: 2437407 - RNA, 17 nt, Bordetella pertussis
ggcgccggcgccgggca

SEQ ID NO: 2437408 - RNA, 13 nt, Bordetella pertussis
ggcgccggcggcc

SEQ ID NO: 2437409 - RNA, 16 nt, Bordetella pertussis
ggcgccggcggccucc

SEQ ID NO: 2437410 - RNA, 14 nt, Bordetella pertussis
ggcgccggcggcga

SEQ ID NO: 2437411 - RNA, 22 nt, Bordetella pertussis
ggcgccggcggcgaugcgggcc

SEQ ID NO: 2437412 - RNA, 16 nt, Bordetella pertussis
ggcgccggcggcgcgg

SEQ ID NO: 2437413 - RNA, 22 nt, Bordetella pertussis
ggcgccggcgucacgcggccgg

SEQ ID NO: 2437414 - RNA, 14 nt, Bordetella pertussis
ggcgccggcgucca

SEQ ID NO: 2437415 - RNA, 19 nt, Bordetella pertussis
ggcgccggcguccacggca

SEQ ID NO: 2437416 - RNA, 23 nt, Bordetella pertussis
ggcgccggcuccgauagcggcgc

SEQ ID NO: 2437417 - RNA, 23 nt, Bordetella pertussis
ggcgccggcuggcaugcggcgga

SEQ ID NO: 2437418 - RNA, 13 nt, Bordetella pertussis
ggcgccggcuucg

SEQ ID NO: 2437419 - RNA, 16 nt, Bordetella pertussis
ggcgccggcuucguca

SEQ ID NO: 2437420 - RNA, 17 nt, Bordetella pertussis
ggcgccgggcagcccgc

SEQ ID NO: 2437421 - RNA, 14 nt, Bordetella pertussis
ggcgccgggccgcu

SEQ ID NO: 2437422 - RNA, 23 nt, Bordetella pertussis
ggcgccgggcgacggcgugcugc

SEQ ID NO: 2437423 - RNA, 17 nt, Bordetella pertussis
ggcgccgggcuggugcg

SEQ ID NO: 2437424 - RNA, 23 nt, Bordetella pertussis
ggcgccgggcuggugcgccgugc

SEQ ID NO: 2437425 - RNA, 13 nt, Bordetella pertussis
ggcgcgcagcagc

SEQ ID NO: 2437426 - RNA, 16 nt, Bordetella pertussis
ggcgcgcagcaggccc

SEQ ID NO: 2437427 - RNA, 16 nt, Bordetella pertussis
ggcgcgcagcgccugc

SEQ ID NO: 2437428 - RNA, 23 nt, Bordetella pertussis
ggcgcgcagcgccugcaggcggu

SEQ ID NO: 2437429 - RNA, 14 nt, Bordetella pertussis
ggcgcgcagcgcga

SEQ ID NO: 2437430 - RNA, 14 nt, Bordetella pertussis
ggcgcgcagcuccg

SEQ ID NO: 2437431 - RNA, 13 nt, Bordetella pertussis
ggcgcgcaggccu

SEQ ID NO: 2437432 - RNA, 20 nt, Bordetella pertussis
ggcgcgcaggcgggccucga

SEQ ID NO: 2437433 - RNA, 12 nt, Bordetella pertussis
ggcgcgcaucgc

SEQ ID NO: 2437434 - RNA, 19 nt, Bordetella pertussis
ggcgcgcaucgcgcggcau

SEQ ID NO: 2437435 - RNA, 23 nt, Bordetella pertussis
ggcgcgcaucgcgcggcaugggc

SEQ ID NO: 2437436 - RNA, 15 nt, Bordetella pertussis
ggcgcgcaucggcgc

SEQ ID NO: 2437437 - RNA, 20 nt, Bordetella pertussis
ggcgcgcaucgucaggcagg

SEQ ID NO: 2437438 - RNA, 21 nt, Bordetella pertussis
ggcgcgcaucgucaggcaggc

SEQ ID NO: 2437439 - RNA, 16 nt, Bordetella pertussis
ggcgcgccagcccgcc

SEQ ID NO: 2437440 - RNA, 18 nt, Bordetella pertussis
ggcgcgccagcccgccgc

SEQ ID NO: 2437441 - RNA, 22 nt, Bordetella pertussis
ggcgcgccagcccgccgcuggu

SEQ ID NO: 2437442 - RNA, 15 nt, Bordetella pertussis
ggcgcgccagccgcu

SEQ ID NO: 2437443 - RNA, 17 nt, Bordetella pertussis
ggcgcgccagccgcugc

SEQ ID NO: 2437444 - RNA, 14 nt, Bordetella pertussis
ggcgcgccagcgcg

SEQ ID NO: 2437445 - RNA, 24 nt, Bordetella pertussis
ggcgcgccagcgcggccagcgcgu

SEQ ID NO: 2437446 - RNA, 16 nt, Bordetella pertussis
ggcgcgccagcucgcg

SEQ ID NO: 2437447 - RNA, 12 nt, Bordetella pertussis
ggcgcgccagga

SEQ ID NO: 2437448 - RNA, 21 nt, Bordetella pertussis
ggcgcgccaggaagcgcgccg

SEQ ID NO: 2437449 - RNA, 23 nt, Bordetella pertussis
ggcgcgccaggaagcgcgccgcg

SEQ ID NO: 2437450 - RNA, 23 nt, Bordetella pertussis
ggcgcgccaggggaugacgggcg

SEQ ID NO: 2437451 - RNA, 15 nt, Bordetella pertussis
ggcgcgccauccuga

SEQ ID NO: 2437452 - RNA, 17 nt, Bordetella pertussis
ggcgcgccaugucgggg

SEQ ID NO: 2437453 - RNA, 20 nt, Bordetella pertussis
ggcgcgccaugucggggcuu

SEQ ID NO: 2437454 - RNA, 15 nt, Bordetella pertussis
ggcgcgcccaccagg

SEQ ID NO: 2437455 - RNA, 17 nt, Bordetella pertussis
ggcgcgcccaccagggu

SEQ ID NO: 2437456 - RNA, 23 nt, Bordetella pertussis
ggcgcgcccaccagggugccgcc

SEQ ID NO: 2437457 - RNA, 12 nt, Bordetella pertussis
ggcgcgcccagc

SEQ ID NO: 2437458 - RNA, 14 nt, Bordetella pertussis
ggcgcgcccagcgg

SEQ ID NO: 2437459 - RNA, 15 nt, Bordetella pertussis
ggcgcgcccagcggc

SEQ ID NO: 2437460 - RNA, 18 nt, Bordetella pertussis
ggcgcgcccagcggcagg

SEQ ID NO: 2437461 - RNA, 15 nt, Bordetella pertussis
ggcgcgcccaggggc

SEQ ID NO: 2437462 - RNA, 22 nt, Bordetella pertussis
ggcgcgcccaggggccggcgcg

SEQ ID NO: 2437463 - RNA, 19 nt, Bordetella pertussis
ggcgcgcccgcaggcggcg

SEQ ID NO: 2437464 - RNA, 13 nt, Bordetella pertussis
ggcgcgcccgcca

SEQ ID NO: 2437465 - RNA, 16 nt, Bordetella pertussis
ggcgcgcccgccccgc

SEQ ID NO: 2437466 - RNA, 19 nt, Bordetella pertussis
ggcgcgcccgccuucggcg

SEQ ID NO: 2437467 - RNA, 22 nt, Bordetella pertussis
ggcgcgcccgccuucggcggcg

SEQ ID NO: 2437468 - RNA, 12 nt, Bordetella pertussis
ggcgcgcccggc

SEQ ID NO: 2437469 - RNA, 15 nt, Bordetella pertussis
ggcgcgcccggcgcg

SEQ ID NO: 2437470 - RNA, 17 nt, Bordetella pertussis
ggcgcgcccggcgcgcc

SEQ ID NO: 2437471 - RNA, 24 nt, Bordetella pertussis
ggcgcgcccuugccguuguccgcc

SEQ ID NO: 2437472 - RNA, 13 nt, Bordetella pertussis
ggcgcgccgcccg

SEQ ID NO: 2437473 - RNA, 12 nt, Bordetella pertussis
ggcgcgccgccg

SEQ ID NO: 2437474 - RNA, 15 nt, Bordetella pertussis
ggcgcgccgccucgc

SEQ ID NO: 2437475 - RNA, 20 nt, Bordetella pertussis
ggcgcgccgccucgcgcucc

SEQ ID NO: 2437476 - RNA, 15 nt, Bordetella pertussis
ggcgcgccgcgccgc

SEQ ID NO: 2437477 - RNA, 14 nt, Bordetella pertussis
ggcgcgccgcggcg

SEQ ID NO: 2437478 - RNA, 23 nt, Bordetella pertussis
ggcgcgccgcggcgggcuuggcg

SEQ ID NO: 2437479 - RNA, 12 nt, Bordetella pertussis
ggcgcgccggcc

SEQ ID NO: 2437480 - RNA, 16 nt, Bordetella pertussis
ggcgcgccggccgcca

SEQ ID NO: 2437481 - RNA, 17 nt, Bordetella pertussis
ggcgcgccggccgccag

SEQ ID NO: 2437482 - RNA, 19 nt, Bordetella pertussis
ggcgcgccggccgccagca

SEQ ID NO: 2437483 - RNA, 17 nt, Bordetella pertussis
ggcgcgccggccgcggg

SEQ ID NO: 2437484 - RNA, 21 nt, Bordetella pertussis
ggcgcgccggccgcggggcug

SEQ ID NO: 2437485 - RNA, 14 nt, Bordetella pertussis
ggcgcgccggccgg

SEQ ID NO: 2437486 - RNA, 14 nt, Bordetella pertussis
ggcgcgccggccug

SEQ ID NO: 2437487 - RNA, 14 nt, Bordetella pertussis
ggcgcgccggcggg

SEQ ID NO: 2437488 - RNA, 15 nt, Bordetella pertussis
ggcgcgccggcgggc

SEQ ID NO: 2437489 - RNA, 19 nt, Bordetella pertussis
ggcgcgccggcgggcgcug

SEQ ID NO: 2437490 - RNA, 16 nt, Bordetella pertussis
ggcgcgccgggccaga

SEQ ID NO: 2437491 - RNA, 22 nt, Bordetella pertussis
ggcgcgccgggccuagcccggc

SEQ ID NO: 2437492 - RNA, 17 nt, Bordetella pertussis
ggcgcgccgucgcuggg

SEQ ID NO: 2437493 - RNA, 20 nt, Bordetella pertussis
ggcgcgccgucgcuggggcg

SEQ ID NO: 2437494 - RNA, 21 nt, Bordetella pertussis
ggcgcgccgucgcuggggcgc

SEQ ID NO: 2437495 - RNA, 18 nt, Bordetella pertussis
ggcgcgccuccagcucca

SEQ ID NO: 2437496 - RNA, 21 nt, Bordetella pertussis
ggcgcgccuccagcuccagcg

SEQ ID NO: 2437497 - RNA, 14 nt, Bordetella pertussis
ggcgcgccucggcg

SEQ ID NO: 2437498 - RNA, 15 nt, Bordetella pertussis
ggcgcgccucggcgc

SEQ ID NO: 2437499 - RNA, 18 nt, Bordetella pertussis
ggcgcgccuggcgcgccc

SEQ ID NO: 2437500 - RNA, 18 nt, Bordetella pertussis
ggcgcgccuugcgcggcg

SEQ ID NO: 2437501 - RNA, 19 nt, Bordetella pertussis
ggcgcgcgaccaggcugga

SEQ ID NO: 2437502 - RNA, 14 nt, Bordetella pertussis
ggcgcgcgacggcg

SEQ ID NO: 2437503 - RNA, 16 nt, Bordetella pertussis
ggcgcgcgacggcgcc

SEQ ID NO: 2437504 - RNA, 17 nt, Bordetella pertussis
ggcgcgcgacggcgccg

SEQ ID NO: 2437505 - RNA, 18 nt, Bordetella pertussis
ggcgcgcgauacgucgaa

SEQ ID NO: 2437506 - RNA, 17 nt, Bordetella pertussis
ggcgcgcgaucucgggc

SEQ ID NO: 2437507 - RNA, 12 nt, Bordetella pertussis
ggcgcgcgcacg

SEQ ID NO: 2437508 - RNA, 19 nt, Bordetella pertussis
ggcgcgcgcaggcgcucga

SEQ ID NO: 2437509 - RNA, 13 nt, Bordetella pertussis
ggcgcgcgcaggu

SEQ ID NO: 2437510 - RNA, 20 nt, Bordetella pertussis
ggcgcgcgcaucgggauccg

SEQ ID NO: 2437511 - RNA, 17 nt, Bordetella pertussis
ggcgcgcgcaugcccga

SEQ ID NO: 2437512 - RNA, 12 nt, Bordetella pertussis
ggcgcgcgccag

SEQ ID NO: 2437513 - RNA, 13 nt, Bordetella pertussis
ggcgcgcgccagc

SEQ ID NO: 2437514 - RNA, 15 nt, Bordetella pertussis
ggcgcgcgccagcgg

SEQ ID NO: 2437515 - RNA, 15 nt, Bordetella pertussis
ggcgcgcgccagggc

SEQ ID NO: 2437516 - RNA, 18 nt, Bordetella pertussis
ggcgcgcgccagggcgcc

SEQ ID NO: 2437517 - RNA, 21 nt, Bordetella pertussis
ggcgcgcgccagggcgccgcg

SEQ ID NO: 2437518 - RNA, 23 nt, Bordetella pertussis
ggcgcgcgccagggcgccgcggg

SEQ ID NO: 2437519 - RNA, 13 nt, Bordetella pertussis
ggcgcgcgccauc

SEQ ID NO: 2437520 - RNA, 14 nt, Bordetella pertussis
ggcgcgcgccaucg

SEQ ID NO: 2437521 - RNA, 19 nt, Bordetella pertussis
ggcgcgcgcccaggccagc

SEQ ID NO: 2437522 - RNA, 14 nt, Bordetella pertussis
ggcgcgcgccccgc

SEQ ID NO: 2437523 - RNA, 12 nt, Bordetella pertussis
ggcgcgcgccga

SEQ ID NO: 2437524 - RNA, 23 nt, Bordetella pertussis
ggcgcgcgccgaugcgccaggcu

SEQ ID NO: 2437525 - RNA, 21 nt, Bordetella pertussis
ggcgcgcgccggcggccugca

SEQ ID NO: 2437526 - RNA, 13 nt, Bordetella pertussis
ggcgcgcgccugc

SEQ ID NO: 2437527 - RNA, 15 nt, Bordetella pertussis
ggcgcgcgcgaccac

SEQ ID NO: 2437528 - RNA, 19 nt, Bordetella pertussis
ggcgcgcgcgacuccaccg

SEQ ID NO: 2437529 - RNA, 22 nt, Bordetella pertussis
ggcgcgcgcgacuccaccggcg

SEQ ID NO: 2437530 - RNA, 13 nt, Bordetella pertussis
ggcgcgcgcgccg

SEQ ID NO: 2437531 - RNA, 14 nt, Bordetella pertussis
ggcgcgcgcgccgc

SEQ ID NO: 2437532 - RNA, 18 nt, Bordetella pertussis
ggcgcgcgcgccgccuac

SEQ ID NO: 2437533 - RNA, 16 nt, Bordetella pertussis
ggcgcgcgcgcgcagc

SEQ ID NO: 2437534 - RNA, 14 nt, Bordetella pertussis
ggcgcgcgcgcgcc

SEQ ID NO: 2437535 - RNA, 20 nt, Bordetella pertussis
ggcgcgcgcgcgccgcacgc

SEQ ID NO: 2437536 - RNA, 23 nt, Bordetella pertussis
ggcgcgcgcgcggauauucgucg

SEQ ID NO: 2437537 - RNA, 13 nt, Bordetella pertussis
ggcgcgcgcggcc

SEQ ID NO: 2437538 - RNA, 15 nt, Bordetella pertussis
ggcgcgcgcggcgcc

SEQ ID NO: 2437539 - RNA, 18 nt, Bordetella pertussis
ggcgcgguccacgcgggc

SEQ ID NO: 2437540 - RNA, 17 nt, Bordetella pertussis
ggcgcggucggcgggcu

SEQ ID NO: 2437541 - RNA, 19 nt, Bordetella pertussis
ggcgcggugaggcggccgg

SEQ ID NO: 2437542 - RNA, 22 nt, Bordetella pertussis
ggcgcggugccugugcccgcag

SEQ ID NO: 2437543 - RNA, 20 nt, Bordetella pertussis
ggcgcgguggccaugcuggg

SEQ ID NO: 2437544 - RNA, 22 nt, Bordetella pertussis
ggcgcgguggccaugcugggcg

SEQ ID NO: 2437545 - RNA, 21 nt, Bordetella pertussis
ggcgcguaguagucgguggcc

SEQ ID NO: 2437546 - RNA, 18 nt, Bordetella pertussis
ggcgcguaugacgcgcug

SEQ ID NO: 2437547 - RNA, 19 nt, Bordetella pertussis
ggcgcguaugacgcgcuga

SEQ ID NO: 2437548 - RNA, 22 nt, Bordetella pertussis
ggcgcgucaguugggcgcgccc

SEQ ID NO: 2437549 - RNA, 23 nt, Bordetella pertussis
ggcgcgucaguugggcgcgccca

SEQ ID NO: 2437550 - RNA, 16 nt, Bordetella pertussis
ggcgcguccacgccgu

SEQ ID NO: 2437551 - RNA, 13 nt, Bordetella pertussis
ggcgcgucgaccu

SEQ ID NO: 2437552 - RNA, 21 nt, Bordetella pertussis
ggcgcgucgcgcgccaggcgg

SEQ ID NO: 2437553 - RNA, 14 nt, Bordetella pertussis
ggcgcgucgcgcgg

SEQ ID NO: 2437554 - RNA, 16 nt, Bordetella pertussis
ggcgcgucgcgcggcg

SEQ ID NO: 2437555 - RNA, 19 nt, Bordetella pertussis
ggcgcgucgcgcggcggca

SEQ ID NO: 2437556 - RNA, 20 nt, Bordetella pertussis
ggcgcgucgcgguacaggcu

SEQ ID NO: 2437557 - RNA, 21 nt, Bordetella pertussis
ggcgcgucgcgguacaggcug

SEQ ID NO: 2437558 - RNA, 17 nt, Bordetella pertussis
ggcgcgucggcgcgcgc

SEQ ID NO: 2437559 - RNA, 20 nt, Bordetella pertussis
ggcgcgucggcgcgcgcgac

SEQ ID NO: 2437560 - RNA, 13 nt, Bordetella pertussis
ggcgcgugccagc

SEQ ID NO: 2437561 - RNA, 14 nt, Bordetella pertussis
ggcgcgugccagca

SEQ ID NO: 2437562 - RNA, 15 nt, Bordetella pertussis
ggcgcgugccagcag

SEQ ID NO: 2437563 - RNA, 16 nt, Bordetella pertussis
ggcgcgugccagcagg

SEQ ID NO: 2437564 - RNA, 20 nt, Bordetella pertussis
ggcgcgugcgcgcgccaugg

SEQ ID NO: 2437565 - RNA, 21 nt, Bordetella pertussis
ggcgcgugcggaugcagcagc

SEQ ID NO: 2437566 - RNA, 20 nt, Bordetella pertussis
ggcgcgugcucaucggcagg

SEQ ID NO: 2437567 - RNA, 24 nt, Bordetella pertussis
ggcgcgugcucaucggcaggccgg

SEQ ID NO: 2437568 - RNA, 16 nt, Bordetella pertussis
ggcgcgugcuggcgca

SEQ ID NO: 2437569 - RNA, 18 nt, Bordetella pertussis
ggcgcgugcuggcgcagc

SEQ ID NO: 2437570 - RNA, 19 nt, Bordetella pertussis
ggcgcgugcuggcgcagca

SEQ ID NO: 2437571 - RNA, 20 nt, Bordetella pertussis
ggcgcgugcuggcgcagcag

SEQ ID NO: 2437572 - RNA, 18 nt, Bordetella pertussis
ggcgcguggcccgcgccg

SEQ ID NO: 2437573 - RNA, 19 nt, Bordetella pertussis
ggcgcguggcccgcgccgc

SEQ ID NO: 2437574 - RNA, 18 nt, Bordetella pertussis
ggcgcguggccgccacgc

SEQ ID NO: 2437575 - RNA, 13 nt, Bordetella pertussis
ggcgcguggcgcc

SEQ ID NO: 2437576 - RNA, 17 nt, Bordetella pertussis
ggcgcguggcgcccagc

SEQ ID NO: 2437577 - RNA, 17 nt, Bordetella pertussis
ggcgcgugggcaggugc

SEQ ID NO: 2437578 - RNA, 13 nt, Bordetella pertussis
ggcgcgugucaug

SEQ ID NO: 2437579 - RNA, 16 nt, Bordetella pertussis
ggcgcguucagcagca

SEQ ID NO: 2437580 - RNA, 18 nt, Bordetella pertussis
ggcgcguucagcagcagg

SEQ ID NO: 2437581 - RNA, 19 nt, Bordetella pertussis
ggcgcguucagggcgccgc

SEQ ID NO: 2437582 - RNA, 22 nt, Bordetella pertussis
ggcgcguucagggcgccgcggc

SEQ ID NO: 2437583 - RNA, 16 nt, Bordetella pertussis
ggcgcguuccaugcga

SEQ ID NO: 2437584 - RNA, 21 nt, Bordetella pertussis
ggcgcguugcgcaucgcgcac

SEQ ID NO: 2437585 - RNA, 23 nt, Bordetella pertussis
ggcgcguugcgcaucgcgcaccc

SEQ ID NO: 2437586 - RNA, 22 nt, Bordetella pertussis
ggcgcguugcgcuugcgcuugg

SEQ ID NO: 2437587 - RNA, 13 nt, Bordetella pertussis
ggcgcucaagggc

SEQ ID NO: 2437588 - RNA, 16 nt, Bordetella pertussis
ggcgcucagagcccca

SEQ ID NO: 2437589 - RNA, 13 nt, Bordetella pertussis
ggcgcucagccgu

SEQ ID NO: 2437590 - RNA, 15 nt, Bordetella pertussis
ggcgcucagcgacgc

SEQ ID NO: 2437591 - RNA, 14 nt, Bordetella pertussis
ggcgcucagcgcgc

SEQ ID NO: 2437592 - RNA, 17 nt, Bordetella pertussis
ggcgcucagcgcgccga

SEQ ID NO: 2437593 - RNA, 13 nt, Bordetella pertussis
ggcgcucagcgua

SEQ ID NO: 2437594 - RNA, 19 nt, Bordetella pertussis
ggcgcucaggaaccagcgg

SEQ ID NO: 2437595 - RNA, 21 nt, Bordetella pertussis
ggcgcucaggaaccagcggcu

SEQ ID NO: 2437596 - RNA, 15 nt, Bordetella pertussis
ggcgcucaucaucgc

SEQ ID NO: 2437597 - RNA, 17 nt, Bordetella pertussis
ggcgcuccagcaccugc

SEQ ID NO: 2437598 - RNA, 12 nt, Bordetella pertussis
ggcgcuccagcc

SEQ ID NO: 2437599 - RNA, 18 nt, Bordetella pertussis
ggcgcuccaugcggcggc

SEQ ID NO: 2437600 - RNA, 13 nt, Bordetella pertussis
ggcgcuccauggc

SEQ ID NO: 2437601 - RNA, 16 nt, Bordetella pertussis
ggcgcuccauggcgcc

SEQ ID NO: 2437602 - RNA, 17 nt, Bordetella pertussis
ggcgcuccauggcgccg

SEQ ID NO: 2437603 - RNA, 16 nt, Bordetella pertussis
ggcgcuccucgcgcgc

SEQ ID NO: 2437604 - RNA, 13 nt, Bordetella pertussis
ggcgcucgagcgc

SEQ ID NO: 2437605 - RNA, 17 nt, Bordetella pertussis
ggcgcucgagcgccugc

SEQ ID NO: 2437606 - RNA, 14 nt, Bordetella pertussis
ggcgcucgaggcgc

SEQ ID NO: 2437607 - RNA, 20 nt, Bordetella pertussis
ggcgcucgaggcgcuggcgu

SEQ ID NO: 2437608 - RNA, 15 nt, Bordetella pertussis
ggcgcucgccccggc

SEQ ID NO: 2437609 - RNA, 13 nt, Bordetella pertussis
ggcgcucgcgccc

SEQ ID NO: 2437610 - RNA, 13 nt, Bordetella pertussis
ggcgcucgcgcgc

SEQ ID NO: 2437611 - RNA, 15 nt, Bordetella pertussis
ggcgcucgcgcgcca

SEQ ID NO: 2437612 - RNA, 16 nt, Bordetella pertussis
ggcgcucgcgcgccag

SEQ ID NO: 2437613 - RNA, 18 nt, Bordetella pertussis
ggcgcucgcgcgccagca

SEQ ID NO: 2437614 - RNA, 19 nt, Bordetella pertussis
ggcgcucgcgcgccagcag

SEQ ID NO: 2437615 - RNA, 20 nt, Bordetella pertussis
ggcgcucgcgggugcgcagc

SEQ ID NO: 2437616 - RNA, 21 nt, Bordetella pertussis
ggcgcucgcgggugcgcagca

SEQ ID NO: 2437617 - RNA, 13 nt, Bordetella pertussis
ggcgcucggccag

SEQ ID NO: 2437618 - RNA, 14 nt, Bordetella pertussis
ggcgcucggccagc

SEQ ID NO: 2437619 - RNA, 16 nt, Bordetella pertussis
ggcgcucggccagcga

SEQ ID NO: 2437620 - RNA, 19 nt, Bordetella pertussis
ggcgcucggccagcgaggc

SEQ ID NO: 2437621 - RNA, 13 nt, Bordetella pertussis
ggcgcucgggcgc

SEQ ID NO: 2437622 - RNA, 14 nt, Bordetella pertussis
ggcgcucgggcgcg

SEQ ID NO: 2437623 - RNA, 16 nt, Bordetella pertussis
ggcgcugaccugcacg

SEQ ID NO: 2437624 - RNA, 23 nt, Bordetella pertussis
ggcgcugaugccguaccaggugc

SEQ ID NO: 2437625 - RNA, 15 nt, Bordetella pertussis
ggcgcugcacgcagc

SEQ ID NO: 2437626 - RNA, 12 nt, Bordetella pertussis
ggcgcugcagca

SEQ ID NO: 2437627 - RNA, 15 nt, Bordetella pertussis
ggcgcugccgaccag

SEQ ID NO: 2437628 - RNA, 20 nt, Bordetella pertussis
ggcgcugccgaccagcacgg

SEQ ID NO: 2437629 - RNA, 15 nt, Bordetella pertussis
ggcgcugccugccgg

SEQ ID NO: 2437630 - RNA, 18 nt, Bordetella pertussis
ggcgcugccugccggccg

SEQ ID NO: 2437631 - RNA, 21 nt, Bordetella pertussis
ggcgcugccugccggccggcc

SEQ ID NO: 2437632 - RNA, 14 nt, Bordetella pertussis
ggcgcugcgcagca

SEQ ID NO: 2437633 - RNA, 15 nt, Bordetella pertussis
ggcgcugcgcagcag

SEQ ID NO: 2437634 - RNA, 22 nt, Bordetella pertussis
ggcgcugcgcagcagggcggcg

SEQ ID NO: 2437635 - RNA, 14 nt, Bordetella pertussis
ggcgcugcgccggc

SEQ ID NO: 2437636 - RNA, 15 nt, Bordetella pertussis
ggcgcugcgccggcg

SEQ ID NO: 2437637 - RNA, 17 nt, Bordetella pertussis
ggcgcugcgccggcggc

SEQ ID NO: 2437638 - RNA, 21 nt, Bordetella pertussis
ggcgcugcgcgaaacggccgg

SEQ ID NO: 2437639 - RNA, 23 nt, Bordetella pertussis
ggcgcugcgcgaaacggccgggu

SEQ ID NO: 2437640 - RNA, 20 nt, Bordetella pertussis
ggcgcugcgcgaacgcggcc

SEQ ID NO: 2437641 - RNA, 12 nt, Bordetella pertussis
ggcgcugcgcgg

SEQ ID NO: 2437642 - RNA, 23 nt, Bordetella pertussis
ggcgcugcugcuggcugcccugg

SEQ ID NO: 2437643 - RNA, 19 nt, Bordetella pertussis
ggcgcugcuggccggccag

SEQ ID NO: 2437644 - RNA, 15 nt, Bordetella pertussis
ggcgcugcugucgcg

SEQ ID NO: 2437645 - RNA, 15 nt, Bordetella pertussis
ggcgcuggcaggcgc

SEQ ID NO: 2437646 - RNA, 13 nt, Bordetella pertussis
ggcgcuggccauc

SEQ ID NO: 2437647 - RNA, 14 nt, Bordetella pertussis
ggcgcuggccauca

SEQ ID NO: 2437648 - RNA, 19 nt, Bordetella pertussis
ggcgcuggccaucaccgcc

SEQ ID NO: 2437649 - RNA, 15 nt, Bordetella pertussis
ggcgcuggccgcccg

SEQ ID NO: 2437650 - RNA, 16 nt, Bordetella pertussis
ggcgcuggccgcccgc

SEQ ID NO: 2437651 - RNA, 22 nt, Bordetella pertussis
ggcgcuggccggcgugcccaau

SEQ ID NO: 2437652 - RNA, 24 nt, Bordetella pertussis
ggcggcaucguucaggcgcauggu

SEQ ID NO: 2437653 - RNA, 19 nt, Bordetella pertussis
ggcggcaucucgcggcggu

SEQ ID NO: 2437654 - RNA, 23 nt, Bordetella pertussis
ggcggcaucuugccuuggcgaau

SEQ ID NO: 2437655 - RNA, 19 nt, Bordetella pertussis
ggcggcaugcgccagccag

SEQ ID NO: 2437656 - RNA, 22 nt, Bordetella pertussis
ggcggcaugcgccagccagcgc

SEQ ID NO: 2437657 - RNA, 13 nt, Bordetella pertussis
ggcggcaugcugg

SEQ ID NO: 2437658 - RNA, 19 nt, Bordetella pertussis
ggcggcauucagcgcugca

SEQ ID NO: 2437659 - RNA, 15 nt, Bordetella pertussis
ggcggccacgaccgg

SEQ ID NO: 2437660 - RNA, 12 nt, Bordetella pertussis
ggcggccagcag

SEQ ID NO: 2437661 - RNA, 15 nt, Bordetella pertussis
ggcggccagcagcgg

SEQ ID NO: 2437662 - RNA, 20 nt, Bordetella pertussis
ggcggccagcagcggcaggu

SEQ ID NO: 2437663 - RNA, 13 nt, Bordetella pertussis
ggcggccagcaug

SEQ ID NO: 2437664 - RNA, 14 nt, Bordetella pertussis
ggcggccagcaugc

SEQ ID NO: 2437665 - RNA, 23 nt, Bordetella pertussis
ggcggccagcaugcuggguugcc

SEQ ID NO: 2437666 - RNA, 12 nt, Bordetella pertussis
ggcggccagccg

SEQ ID NO: 2437667 - RNA, 14 nt, Bordetella pertussis
ggcggccagccggc

SEQ ID NO: 2437668 - RNA, 14 nt, Bordetella pertussis
ggcggccagcgcgc

SEQ ID NO: 2437669 - RNA, 23 nt, Bordetella pertussis
ggcggccagcuuguagcggccau

SEQ ID NO: 2437670 - RNA, 10 nt, Bordetella pertussis
ggcggccagg

SEQ ID NO: 2437671 - RNA, 20 nt, Bordetella pertussis
ggcggccaggaucgcggcca

SEQ ID NO: 2437672 - RNA, 12 nt, Bordetella pertussis
ggcggccaggcc

SEQ ID NO: 2437673 - RNA, 13 nt, Bordetella pertussis
ggcggccaggccc

SEQ ID NO: 2437674 - RNA, 17 nt, Bordetella pertussis
ggcggccaggccgaacg

SEQ ID NO: 2437675 - RNA, 14 nt, Bordetella pertussis
ggcggccaggccgg

SEQ ID NO: 2437676 - RNA, 16 nt, Bordetella pertussis
ggcggccaggccggcg

SEQ ID NO: 2437677 - RNA, 20 nt, Bordetella pertussis
ggcggccaggccggugggcg

SEQ ID NO: 2437678 - RNA, 20 nt, Bordetella pertussis
ggcggccaggcgcgccgcga

SEQ ID NO: 2437679 - RNA, 18 nt, Bordetella pertussis
ggcggccaggcguacgcu

SEQ ID NO: 2437680 - RNA, 18 nt, Bordetella pertussis
ggcggccagggaaggggc

SEQ ID NO: 2437681 - RNA, 21 nt, Bordetella pertussis
ggcggccagggaaggggcggc

SEQ ID NO: 2437682 - RNA, 12 nt, Bordetella pertussis
ggcggccagggc

SEQ ID NO: 2437683 - RNA, 16 nt, Bordetella pertussis
ggcggccagggccugc

SEQ ID NO: 2437684 - RNA, 23 nt, Bordetella pertussis
ggcggccaucgccauggccacga

SEQ ID NO: 2437685 - RNA, 21 nt, Bordetella pertussis
ggcggccaucgccgccacgug

SEQ ID NO: 2437686 - RNA, 18 nt, Bordetella pertussis
ggcggccaucuuggugcg

SEQ ID NO: 2437687 - RNA, 23 nt, Bordetella pertussis
ggcggccaucuuggugcgcgcca

SEQ ID NO: 2437688 - RNA, 16 nt, Bordetella pertussis
ggcggccauggcauga

SEQ ID NO: 2437689 - RNA, 17 nt, Bordetella pertussis
ggcggcccacagcgccc

SEQ ID NO: 2437690 - RNA, 14 nt, Bordetella pertussis
ggcggcccagcgug

SEQ ID NO: 2437691 - RNA, 19 nt, Bordetella pertussis
ggcggcccagcguggcggu

SEQ ID NO: 2437692 - RNA, 12 nt, Bordetella pertussis
ggcggcccaggc

SEQ ID NO: 2437693 - RNA, 14 nt, Bordetella pertussis
ggcggcccaggcgu

SEQ ID NO: 2437694 - RNA, 20 nt, Bordetella pertussis
ggcggcccauucgcccaugg

SEQ ID NO: 2437695 - RNA, 18 nt, Bordetella pertussis
ggcggcccauucgcgcac

SEQ ID NO: 2437696 - RNA, 19 nt, Bordetella pertussis
ggcggccccggccgccccc

SEQ ID NO: 2437697 - RNA, 13 nt, Bordetella pertussis
ggcggcccggccg

SEQ ID NO: 2437698 - RNA, 21 nt, Bordetella pertussis
ggcggcccggccgccgccggc

SEQ ID NO: 2437699 - RNA, 15 nt, Bordetella pertussis
ggcggcccggcggca

SEQ ID NO: 2437700 - RNA, 15 nt, Bordetella pertussis
ggcggccgaagcgca

SEQ ID NO: 2437701 - RNA, 13 nt, Bordetella pertussis
ggcggccgccagc

SEQ ID NO: 2437702 - RNA, 15 nt, Bordetella pertussis
ggcggccgcccagca

SEQ ID NO: 2437703 - RNA, 16 nt, Bordetella pertussis
ggcggccgcccagcag

SEQ ID NO: 2437704 - RNA, 15 nt, Bordetella pertussis
ggcggccgccgccag

SEQ ID NO: 2437705 - RNA, 13 nt, Bordetella pertussis
ggcggccgccugc

SEQ ID NO: 2437706 - RNA, 12 nt, Bordetella pertussis
ggcggccgcggg

SEQ ID NO: 2437707 - RNA, 17 nt, Bordetella pertussis
ggcggccgcgggcagca

SEQ ID NO: 2437708 - RNA, 14 nt, Bordetella pertussis
ggcggccgcgggcg

SEQ ID NO: 2437709 - RNA, 15 nt, Bordetella pertussis
ggcggccgcgggcgg

SEQ ID NO: 2437710 - RNA, 16 nt, Bordetella pertussis
ggcggccgcgggcggc

SEQ ID NO: 2437711 - RNA, 17 nt, Bordetella pertussis
ggcggccgcgggcggcg

SEQ ID NO: 2437712 - RNA, 17 nt, Bordetella pertussis
ggcggccgcgggcgugc

SEQ ID NO: 2437713 - RNA, 18 nt, Bordetella pertussis
ggcggccgcgggcgugcu

SEQ ID NO: 2437714 - RNA, 22 nt, Bordetella pertussis
ggcggccgcguccagcgcgcgg

SEQ ID NO: 2437715 - RNA, 13 nt, Bordetella pertussis
ggcggccggcacg

SEQ ID NO: 2437716 - RNA, 12 nt, Bordetella pertussis
ggcggccggcca

SEQ ID NO: 2437717 - RNA, 13 nt, Bordetella pertussis
ggcggccggccag

SEQ ID NO: 2437718 - RNA, 13 nt, Bordetella pertussis
ggcggccggcgcg

SEQ ID NO: 2437719 - RNA, 13 nt, Bordetella pertussis
ggcggccggcucg

SEQ ID NO: 2437720 - RNA, 14 nt, Bordetella pertussis
ggcggccggcugca

SEQ ID NO: 2437721 - RNA, 14 nt, Bordetella pertussis
ggcggccggggccg

SEQ ID NO: 2437722 - RNA, 16 nt, Bordetella pertussis
ggcggccggggccgcc

SEQ ID NO: 2437723 - RNA, 20 nt, Bordetella pertussis
ggcggccggggccgcccugc

SEQ ID NO: 2437724 - RNA, 21 nt, Bordetella pertussis
ggcggccggggccgcccugcc

SEQ ID NO: 2437725 - RNA, 21 nt, Bordetella pertussis
ggcggccgguaucggccucga

SEQ ID NO: 2437726 - RNA, 12 nt, Bordetella pertussis
ggcggccgucgg

SEQ ID NO: 2437727 - RNA, 13 nt, Bordetella pertussis
ggcggccgucggg

SEQ ID NO: 2437728 - RNA, 17 nt, Bordetella pertussis
ggcggccgucggggccg

SEQ ID NO: 2437729 - RNA, 17 nt, Bordetella pertussis
ggcggccguuggcgugc

SEQ ID NO: 2437730 - RNA, 18 nt, Bordetella pertussis
ggcggccuaucaccuggg

SEQ ID NO: 2437731 - RNA, 20 nt, Bordetella pertussis
ggcggccuaugugcaggcca

SEQ ID NO: 2437732 - RNA, 16 nt, Bordetella pertussis
ggcggccuccagcagg

SEQ ID NO: 2437733 - RNA, 20 nt, Bordetella pertussis
ggcggccuccagcagggacu

SEQ ID NO: 2437734 - RNA, 14 nt, Bordetella pertussis
ggcggccucggcca

SEQ ID NO: 2437735 - RNA, 15 nt, Bordetella pertussis
ggcggccucggccag

SEQ ID NO: 2437736 - RNA, 17 nt, Bordetella pertussis
ggcggccucggccagcu

SEQ ID NO: 2437737 - RNA, 21 nt, Bordetella pertussis
ggcggccucggccagcuggga

SEQ ID NO: 2437738 - RNA, 16 nt, Bordetella pertussis
ggcggccugcaggccg

SEQ ID NO: 2437739 - RNA, 14 nt, Bordetella pertussis
ggcggccugcuugg

SEQ ID NO: 2437740 - RNA, 21 nt, Bordetella pertussis
ggcggccugcuuggcagccuu

SEQ ID NO: 2437741 - RNA, 13 nt, Bordetella pertussis
ggcggccuggccg

SEQ ID NO: 2437742 - RNA, 20 nt, Bordetella pertussis
ggcggccuggccgcgcgccu

SEQ ID NO: 2437743 - RNA, 18 nt, Bordetella pertussis
ggcggccugggaggcgcu

SEQ ID NO: 2437744 - RNA, 20 nt, Bordetella pertussis
ggcggccugggaggcgcuga

SEQ ID NO: 2437745 - RNA, 21 nt, Bordetella pertussis
ggcggccugggaggcgcugau

SEQ ID NO: 2437746 - RNA, 13 nt, Bordetella pertussis
ggcggccugggcc

SEQ ID NO: 2437747 - RNA, 16 nt, Bordetella pertussis
ggcggccugggcgggc

SEQ ID NO: 2437748 - RNA, 18 nt, Bordetella pertussis
ggcggccugggcgggccg

SEQ ID NO: 2437749 - RNA, 14 nt, Bordetella pertussis
ggcggccuugaugg

SEQ ID NO: 2437750 - RNA, 16 nt, Bordetella pertussis
ggcggccuugcgggcc

SEQ ID NO: 2437751 - RNA, 17 nt, Bordetella pertussis
ggcggccuugcgggccg

SEQ ID NO: 2437752 - RNA, 16 nt, Bordetella pertussis
ggcggccuuggccgca

SEQ ID NO: 2437753 - RNA, 17 nt, Bordetella pertussis
ggcggccuugugcgcca

SEQ ID NO: 2437754 - RNA, 15 nt, Bordetella pertussis
ggcggcgaccggcgc

SEQ ID NO: 2437755 - RNA, 16 nt, Bordetella pertussis
ggcggcgaccggcgcc

SEQ ID NO: 2437756 - RNA, 21 nt, Bordetella pertussis
ggcggcgacgaacccgggcgu

SEQ ID NO: 2437757 - RNA, 14 nt, Bordetella pertussis
ggcggcgacgcagc

SEQ ID NO: 2437758 - RNA, 15 nt, Bordetella pertussis
ggcggcgacgcagca

SEQ ID NO: 2437759 - RNA, 19 nt, Bordetella pertussis
ggcggcgacgcagcacggc

SEQ ID NO: 2437760 - RNA, 15 nt, Bordetella pertussis
ggcggcgacucggca

SEQ ID NO: 2437761 - RNA, 22 nt, Bordetella pertussis
ggcggcgagaugccgucgaagg

SEQ ID NO: 2437762 - RNA, 21 nt, Bordetella pertussis
ggcggcgagcuggcccugggc

SEQ ID NO: 2437763 - RNA, 24 nt, Bordetella pertussis
ggcggcgaucaacgugcgccaggc

SEQ ID NO: 2437764 - RNA, 19 nt, Bordetella pertussis
ggcggcgaucacgccgucg

SEQ ID NO: 2437765 - RNA, 17 nt, Bordetella pertussis
ggcggcgaucucgcgcg

SEQ ID NO: 2437766 - RNA, 14 nt, Bordetella pertussis
ggcgggcgggcgca

SEQ ID NO: 2437767 - RNA, 23 nt, Bordetella pertussis
ggcgggcguacccgucgaagcug

SEQ ID NO: 2437768 - RNA, 20 nt, Bordetella pertussis
ggcgggcgugaugccgacca

SEQ ID NO: 2437769 - RNA, 20 nt, Bordetella pertussis
ggcgggcucagcccgccugg

SEQ ID NO: 2437770 - RNA, 13 nt, Bordetella pertussis
ggcgggcucggcg

SEQ ID NO: 2437771 - RNA, 13 nt, Bordetella pertussis
ggcgggcuggucg

SEQ ID NO: 2437772 - RNA, 18 nt, Bordetella pertussis
ggcgggcuggucgcgccg

SEQ ID NO: 2437773 - RNA, 20 nt, Bordetella pertussis
ggcgggcuggucgcgccggu

SEQ ID NO: 2437774 - RNA, 19 nt, Bordetella pertussis
ggcgggcugguggugggcg

SEQ ID NO: 2437775 - RNA, 18 nt, Bordetella pertussis
ggcggggauggcuggccg

SEQ ID NO: 2437776 - RNA, 21 nt, Bordetella pertussis
ggcggggcgugagcaggcgcc

SEQ ID NO: 2437777 - RNA, 18 nt, Bordetella pertussis
ggcggggugaucugcgcc

SEQ ID NO: 2437778 - RNA, 13 nt, Bordetella pertussis
ggcgggguuggcc

SEQ ID NO: 2437779 - RNA, 19 nt, Bordetella pertussis
ggcgggguuggccgccagg

SEQ ID NO: 2437780 - RNA, 21 nt, Bordetella pertussis
ggcgggucaaguccggcgccg

SEQ ID NO: 2437781 - RNA, 18 nt, Bordetella pertussis
ggcgggugcugcagcgca

SEQ ID NO: 2437782 - RNA, 19 nt, Bordetella pertussis
ggcggguugugcccgcccg

SEQ ID NO: 2437783 - RNA, 19 nt, Bordetella pertussis
ggcgguaagcguccgcgcg

SEQ ID NO: 2437784 - RNA, 17 nt, Bordetella pertussis
ggcgguacaggccggcg

SEQ ID NO: 2437785 - RNA, 21 nt, Bordetella pertussis
ggcgguacaggccggcggcga

SEQ ID NO: 2437786 - RNA, 13 nt, Bordetella pertussis
ggcgguaccaggc

SEQ ID NO: 2437787 - RNA, 21 nt, Bordetella pertussis
ggcgguaccaggccgagaugu

SEQ ID NO: 2437788 - RNA, 15 nt, Bordetella pertussis
ggcgguaccguccug

SEQ ID NO: 2437789 - RNA, 18 nt, Bordetella pertussis
ggcgguaccguccuggca

SEQ ID NO: 2437790 - RNA, 18 nt, Bordetella pertussis
ggcgguagcgcucgucca

SEQ ID NO: 2437791 - RNA, 16 nt, Bordetella pertussis
ggcgguaugcggcgcc

SEQ ID NO: 2437792 - RNA, 14 nt, Bordetella pertussis
ggcggucaccaacg

SEQ ID NO: 2437793 - RNA, 22 nt, Bordetella pertussis
ggcggucaccaacgcgaucuca

SEQ ID NO: 2437794 - RNA, 14 nt, Bordetella pertussis
ggcggucagcgcgg

SEQ ID NO: 2437795 - RNA, 14 nt, Bordetella pertussis
ggcggucccgagcg

SEQ ID NO: 2437796 - RNA, 20 nt, Bordetella pertussis
ggcggucccgagcgcucccg

SEQ ID NO: 2437797 - RNA, 15 nt, Bordetella pertussis
ggcgguccgguucgc

SEQ ID NO: 2437798 - RNA, 19 nt, Bordetella pertussis
ggcgguccgguucgcccac

SEQ ID NO: 2437799 - RNA, 13 nt, Bordetella pertussis
ggcggucgcgcug

SEQ ID NO: 2437800 - RNA, 16 nt, Bordetella pertussis
ggcggucugggcgucc

SEQ ID NO: 2437801 - RNA, 14 nt, Bordetella pertussis
ggcggucuucgaug

SEQ ID NO: 2437802 - RNA, 17 nt, Bordetella pertussis
ggcggugaaggcgcccg

SEQ ID NO: 2437803 - RNA, 14 nt, Bordetella pertussis
ggcggugaccacca

SEQ ID NO: 2437804 - RNA, 16 nt, Bordetella pertussis
ggcggugacgcccugc

SEQ ID NO: 2437805 - RNA, 19 nt, Bordetella pertussis
ggcggugaucugcucgccg

SEQ ID NO: 2437806 - RNA, 23 nt, Bordetella pertussis
ggcggugaucugcucgccgcgcg

SEQ ID NO: 2437807 - RNA, 19 nt, Bordetella pertussis
ggcggugaugucgccgguc

SEQ ID NO: 2437808 - RNA, 15 nt, Bordetella pertussis
ggcggugccagcgca

SEQ ID NO: 2437809 - RNA, 20 nt, Bordetella pertussis
ggcggugccagcgcaagggu

SEQ ID NO: 2437810 - RNA, 15 nt, Bordetella pertussis
ggcggugcgcgcggc

SEQ ID NO: 2437811 - RNA, 16 nt, Bordetella pertussis
ggcggugcgcgcggcc

SEQ ID NO: 2437812 - RNA, 19 nt, Bordetella pertussis
ggcggugcgcgcggccgag

SEQ ID NO: 2437813 - RNA, 20 nt, Bordetella pertussis
ggcggugcgcgcggccgagg

SEQ ID NO: 2437814 - RNA, 14 nt, Bordetella pertussis
ggcggugcggccuc

SEQ ID NO: 2437815 - RNA, 15 nt, Bordetella pertussis
ggcggugcggccucg

SEQ ID NO: 2437816 - RNA, 21 nt, Bordetella pertussis
ggcggugcguccaggacgcga

SEQ ID NO: 2437817 - RNA, 16 nt, Bordetella pertussis
ggcggugcgugcgccc

SEQ ID NO: 2437818 - RNA, 14 nt, Bordetella pertussis
ggcgguggccagcg

SEQ ID NO: 2437819 - RNA, 14 nt, Bordetella pertussis
ggcgguggccgcgc

SEQ ID NO: 2437820 - RNA, 17 nt, Bordetella pertussis
ggcgguggccucgucca

SEQ ID NO: 2437821 - RNA, 14 nt, Bordetella pertussis
ggcggugggcagcg

SEQ ID NO: 2437822 - RNA, 17 nt, Bordetella pertussis
ggcgguguagaccacca

SEQ ID NO: 2437823 - RNA, 23 nt, Bordetella pertussis
ggcgguguagaccaccagcagga

SEQ ID NO: 2437824 - RNA, 20 nt, Bordetella pertussis
ggcgguucaggccccggccg

SEQ ID NO: 2437825 - RNA, 21 nt, Bordetella pertussis
ggcgguucaggccccggccgg

SEQ ID NO: 2437826 - RNA, 15 nt, Bordetella pertussis
ggcgguuccagccug

SEQ ID NO: 2437827 - RNA, 16 nt, Bordetella pertussis
ggcgguuccagccugg

SEQ ID NO: 2437828 - RNA, 22 nt, Bordetella pertussis
ggcgguucguccucgucggcca

SEQ ID NO: 2437829 - RNA, 15 nt, Bordetella pertussis
ggcgguugcgcugcu

SEQ ID NO: 2437830 - RNA, 22 nt, Bordetella pertussis
ggcgguuggccuugacggcgcg

SEQ ID NO: 2437831 - RNA, 20 nt, Bordetella pertussis
ggcgguuggugucgcgcagc

SEQ ID NO: 2437832 - RNA, 21 nt, Bordetella pertussis
ggcgguuggugucgcgcagcg

SEQ ID NO: 2437833 - RNA, 17 nt, Bordetella pertussis
ggcgguuucggccggga

SEQ ID NO: 2437834 - RNA, 22 nt, Bordetella pertussis
ggcgguuucggccgggaaggcg

SEQ ID NO: 2437835 - RNA, 23 nt, Bordetella pertussis
ggcgguuucguagaugggcaggc

SEQ ID NO: 2437836 - RNA, 18 nt, Bordetella pertussis
ggcgguuucuuccagcag

SEQ ID NO: 2437837 - RNA, 20 nt, Bordetella pertussis
ggcgguuucuuccagcaggg

SEQ ID NO: 2437838 - RNA, 22 nt, Bordetella pertussis
ggcgguuuuucuuuggccgcgc

SEQ ID NO: 2437839 - RNA, 23 nt, Bordetella pertussis
ggcgguuuuucuuuggccgcgcg

SEQ ID NO: 2437840 - RNA, 22 nt, Bordetella pertussis
ggcgguuuuuucuugccggccc

SEQ ID NO: 2437841 - RNA, 14 nt, Bordetella pertussis
ggcguaaggccgcc

SEQ ID NO: 2437842 - RNA, 18 nt, Bordetella pertussis
ggcguaaggccgccggcc

SEQ ID NO: 2437843 - RNA, 20 nt, Bordetella pertussis
ggcguaaggccgccggccac

SEQ ID NO: 2437844 - RNA, 14 nt, Bordetella pertussis
ggcguacagcaggg

SEQ ID NO: 2437845 - RNA, 18 nt, Bordetella pertussis
ggcguaccgguccagaug

SEQ ID NO: 2437846 - RNA, 18 nt, Bordetella pertussis
ggcguacgacggggugcc

SEQ ID NO: 2437847 - RNA, 14 nt, Bordetella pertussis
ggcguacgaggacc

SEQ ID NO: 2437848 - RNA, 16 nt, Bordetella pertussis
ggcguacgcuuaucgc

SEQ ID NO: 2437849 - RNA, 21 nt, Bordetella pertussis
ggcguacgcuuaucgcggcgc

SEQ ID NO: 2437850 - RNA, 13 nt, Bordetella pertussis
ggcguacggcgcg

SEQ ID NO: 2437851 - RNA, 16 nt, Bordetella pertussis
ggcguacuggcgcggc

SEQ ID NO: 2437852 - RNA, 22 nt, Bordetella pertussis
ggcguacuggcgcggcggccag

SEQ ID NO: 2437853 - RNA, 15 nt, Bordetella pertussis
ggcguagagcgccgc

SEQ ID NO: 2437854 - RNA, 16 nt, Bordetella pertussis
ggcguagagcgccgcg

SEQ ID NO: 2437855 - RNA, 21 nt, Bordetella pertussis
ggcguagauccaggcggccac

SEQ ID NO: 2437856 - RNA, 23 nt, Bordetella pertussis
ggcguagauccaggcggccacca

SEQ ID NO: 2437857 - RNA, 21 nt, Bordetella pertussis
ggcguagcccuuguggccgcc

SEQ ID NO: 2437858 - RNA, 22 nt, Bordetella pertussis
ggcguagcccuuguggccgccg

SEQ ID NO: 2437859 - RNA, 15 nt, Bordetella pertussis
ggcguagcugcgccg

SEQ ID NO: 2437860 - RNA, 13 nt, Bordetella pertussis
ggcguaggccucg

SEQ ID NO: 2437861 - RNA, 20 nt, Bordetella pertussis
ggcguaguagcccaggccca

SEQ ID NO: 2437862 - RNA, 21 nt, Bordetella pertussis
ggcguagucguugccggccag

SEQ ID NO: 2437863 - RNA, 19 nt, Bordetella pertussis
ggcguaucgauagccgacg

SEQ ID NO: 2437864 - RNA, 15 nt, Bordetella pertussis
ggcguauggcgcggg

SEQ ID NO: 2437865 - RNA, 20 nt, Bordetella pertussis
ggcgucaagccagcggcgcg

SEQ ID NO: 2437866 - RNA, 19 nt, Bordetella pertussis
ggcgucaaugccagucgcc

SEQ ID NO: 2437867 - RNA, 15 nt, Bordetella pertussis
ggcgucaccuuggga

SEQ ID NO: 2437868 - RNA, 21 nt, Bordetella pertussis
ggcgucacgcggccgggcaca

SEQ ID NO: 2437869 - RNA, 17 nt, Bordetella pertussis
ggcgucagcgugcgccc

SEQ ID NO: 2437870 - RNA, 15 nt, Bordetella pertussis
ggcgucaggccgucg

SEQ ID NO: 2437871 - RNA, 15 nt, Bordetella pertussis
ggcgucaucggcgcg

SEQ ID NO: 2437872 - RNA, 19 nt, Bordetella pertussis
ggcgucaucggcgcgcagc

SEQ ID NO: 2437873 - RNA, 20 nt, Bordetella pertussis
ggcgucaugcgcuugucgcc

SEQ ID NO: 2437874 - RNA, 21 nt, Bordetella pertussis
ggcgucaugcgcuugucgccg

SEQ ID NO: 2437875 - RNA, 21 nt, Bordetella pertussis
ggcguccaccgccgaugccgc

SEQ ID NO: 2437876 - RNA, 20 nt, Bordetella pertussis
ggcguccaccuugacgcgca

SEQ ID NO: 2437877 - RNA, 13 nt, Bordetella pertussis
ggcguccacggca

SEQ ID NO: 2437878 - RNA, 22 nt, Bordetella pertussis
ggcgugcccugcggcgcggcca

SEQ ID NO: 2437879 - RNA, 23 nt, Bordetella pertussis
ggcgugcccuugagcgugggcug

SEQ ID NO: 2437880 - RNA, 13 nt, Bordetella pertussis
ggcgugccgcgca

SEQ ID NO: 2437881 - RNA, 17 nt, Bordetella pertussis
ggcgugccgcgcugggc

SEQ ID NO: 2437882 - RNA, 23 nt, Bordetella pertussis
ggcgugccgcgcugggcgcugcu

SEQ ID NO: 2437883 - RNA, 23 nt, Bordetella pertussis
ggcgugccugcuuguacaggcgc

SEQ ID NO: 2437884 - RNA, 13 nt, Bordetella pertussis
ggcgugcgccugc

SEQ ID NO: 2437885 - RNA, 17 nt, Bordetella pertussis
ggcgugcgcgagcuggu

SEQ ID NO: 2437886 - RNA, 21 nt, Bordetella pertussis
ggcgugcgcgggcgccaucgc

SEQ ID NO: 2437887 - RNA, 13 nt, Bordetella pertussis
ggcgugcgcuggc

SEQ ID NO: 2437888 - RNA, 20 nt, Bordetella pertussis
ggcgugcgcuggcugggccu

SEQ ID NO: 2437889 - RNA, 12 nt, Bordetella pertussis
ggcgugcggaug

SEQ ID NO: 2437890 - RNA, 21 nt, Bordetella pertussis
ggcgugcggauggucgagcgc

SEQ ID NO: 2437891 - RNA, 12 nt, Bordetella pertussis
ggcgugcggccc

SEQ ID NO: 2437892 - RNA, 15 nt, Bordetella pertussis
ggcgugcggcccagc

SEQ ID NO: 2437893 - RNA, 16 nt, Bordetella pertussis
ggcgugcggcccagcc

SEQ ID NO: 2437894 - RNA, 18 nt, Bordetella pertussis
ggcgugcggcccagccgc

SEQ ID NO: 2437895 - RNA, 15 nt, Bordetella pertussis
ggcgugcugcaccug

SEQ ID NO: 2437896 - RNA, 20 nt, Bordetella pertussis
ggcgugcugcagggcugcga

SEQ ID NO: 2437897 - RNA, 23 nt, Bordetella pertussis
ggcgugcugcggcugaucaccgc

SEQ ID NO: 2437898 - RNA, 16 nt, Bordetella pertussis
ggcgugcuugccgccg

SEQ ID NO: 2437899 - RNA, 23 nt, Bordetella pertussis
ggcgugcuugccgccggacggcg

SEQ ID NO: 2437900 - RNA, 20 nt, Bordetella pertussis
ggcguggaacgaccacggaa

SEQ ID NO: 2437901 - RNA, 20 nt, Bordetella pertussis
ggcguggcaggugcggccgc

SEQ ID NO: 2437902 - RNA, 16 nt, Bordetella pertussis
ggcguggccgcaguca

SEQ ID NO: 2437903 - RNA, 15 nt, Bordetella pertussis
ggcguggccugcccg

SEQ ID NO: 2437904 - RNA, 15 nt, Bordetella pertussis
ggcguggcgacagca

SEQ ID NO: 2437905 - RNA, 16 nt, Bordetella pertussis
ggcguggcgcagggug

SEQ ID NO: 2437906 - RNA, 21 nt, Bordetella pertussis
ggcguggcgccgaaggcggcg

SEQ ID NO: 2437907 - RNA, 15 nt, Bordetella pertussis
ggcguggcgcgcaac

SEQ ID NO: 2437908 - RNA, 14 nt, Bordetella pertussis
ggcguggcgcgcac

SEQ ID NO: 2437909 - RNA, 15 nt, Bordetella pertussis
ggcguggcgcgcaca

SEQ ID NO: 2437910 - RNA, 16 nt, Bordetella pertussis
ggcguggcgcgcgccg

SEQ ID NO: 2437911 - RNA, 14 nt, Bordetella pertussis
ggcguggcggccag

SEQ ID NO: 2437912 - RNA, 17 nt, Bordetella pertussis
ggcguggcggccaggcc

SEQ ID NO: 2437913 - RNA, 13 nt, Bordetella pertussis
ggcguggcggggc

SEQ ID NO: 2437914 - RNA, 14 nt, Bordetella pertussis
ggcguggcggggcg

SEQ ID NO: 2437915 - RNA, 16 nt, Bordetella pertussis
ggcguggcuggcgucg

SEQ ID NO: 2437916 - RNA, 18 nt, Bordetella pertussis
ggcguggggccggccgcg

SEQ ID NO: 2437917 - RNA, 20 nt, Bordetella pertussis
ggcguggggccggccgcgcg

SEQ ID NO: 2437918 - RNA, 15 nt, Bordetella pertussis
ggcgugguaucgcgc

SEQ ID NO: 2437919 - RNA, 18 nt, Bordetella pertussis
ggcgugguaucgcgccag

SEQ ID NO: 2437920 - RNA, 19 nt, Bordetella pertussis
ggcgugguaucgcgccagc

SEQ ID NO: 2437921 - RNA, 16 nt, Bordetella pertussis
ggcguggugcugacgg

SEQ ID NO: 2437922 - RNA, 17 nt, Bordetella pertussis
ggcguguccagcggcgc

SEQ ID NO: 2437923 - RNA, 18 nt, Bordetella pertussis
ggcguguccagcggcgcc

SEQ ID NO: 2437924 - RNA, 21 nt, Bordetella pertussis
ggcguguccagcggcgccagc

SEQ ID NO: 2437925 - RNA, 22 nt, Bordetella pertussis
ggcguguccagcggcgccagcg

SEQ ID NO: 2437926 - RNA, 14 nt, Bordetella pertussis
ggcgugugcccagc

SEQ ID NO: 2437927 - RNA, 15 nt, Bordetella pertussis
ggcguucaaucgcgc

SEQ ID NO: 2437928 - RNA, 19 nt, Bordetella pertussis
ggcguucaaucgcgcuucu

SEQ ID NO: 2437929 - RNA, 19 nt, Bordetella pertussis
ggcguucaccaggaagcgc

SEQ ID NO: 2437930 - RNA, 23 nt, Bordetella pertussis
ggcguucaccaggaagcgcgccu

SEQ ID NO: 2437931 - RNA, 17 nt, Bordetella pertussis
ggcguucagcgggcgcg

SEQ ID NO: 2437932 - RNA, 14 nt, Bordetella pertussis
ggcguuccuggcgc

SEQ ID NO: 2437933 - RNA, 17 nt, Bordetella pertussis
ggcguuccuggcgcugu

SEQ ID NO: 2437934 - RNA, 18 nt, Bordetella pertussis
ggcguucgcgcgcggggu

SEQ ID NO: 2437935 - RNA, 18 nt, Bordetella pertussis
ggcguucggcaccggcag

SEQ ID NO: 2437936 - RNA, 20 nt, Bordetella pertussis
ggcguucggcaccggcagcc

SEQ ID NO: 2437937 - RNA, 22 nt, Bordetella pertussis
ggcguucggcaccggcagccau

SEQ ID NO: 2437938 - RNA, 15 nt, Bordetella pertussis
ggcguucggccacuu

SEQ ID NO: 2437939 - RNA, 23 nt, Bordetella pertussis
ggcguucucgacccgcucggcca

SEQ ID NO: 2437940 - RNA, 20 nt, Bordetella pertussis
ggcguucucguugggaugga

SEQ ID NO: 2437941 - RNA, 17 nt, Bordetella pertussis
ggcguucugcagcgcgg

SEQ ID NO: 2437942 - RNA, 23 nt, Bordetella pertussis
ggcguucuggucagccgugucgc

SEQ ID NO: 2437943 - RNA, 14 nt, Bordetella pertussis
ggcguugaaggcga

SEQ ID NO: 2437944 - RNA, 20 nt, Bordetella pertussis
ggcguugaccggguugagcg

SEQ ID NO: 2437945 - RNA, 20 nt, Bordetella pertussis
ggcguugaccuggucgggcg

SEQ ID NO: 2437946 - RNA, 17 nt, Bordetella pertussis
ggcguugacggcccagc

SEQ ID NO: 2437947 - RNA, 16 nt, Bordetella pertussis
ggcguugccggccuga

SEQ ID NO: 2437948 - RNA, 22 nt, Bordetella pertussis
ggcguugccggccugaggcccg

SEQ ID NO: 2437949 - RNA, 18 nt, Bordetella pertussis
ggcguugcggcgccauuc

SEQ ID NO: 2437950 - RNA, 19 nt, Bordetella pertussis
ggcguugcuggcaaagcgc

SEQ ID NO: 2437951 - RNA, 15 nt, Bordetella pertussis
ggcguugugccggcg

SEQ ID NO: 2437952 - RNA, 17 nt, Bordetella pertussis
ggcguugugccggcgca

SEQ ID NO: 2437953 - RNA, 23 nt, Bordetella pertussis
ggcguuugcccuucgcggcuggu

SEQ ID NO: 2437954 - RNA, 16 nt, Bordetella pertussis
ggcguuugcgcgcgcg

SEQ ID NO: 2437955 - RNA, 16 nt, Bordetella pertussis
ggcguuuuccagcauc

SEQ ID NO: 2437956 - RNA, 18 nt, Bordetella pertussis
ggcuacagcucgccggcg

SEQ ID NO: 2437957 - RNA, 19 nt, Bordetella pertussis
ggcuaccacguggucugga

SEQ ID NO: 2437958 - RNA, 15 nt, Bordetella pertussis
ggcuacgacccgcug

SEQ ID NO: 2437959 - RNA, 16 nt, Bordetella pertussis
ggcuaggcgcagcagg

SEQ ID NO: 2437960 - RNA, 17 nt, Bordetella pertussis
ggcuaggcgcagcaggc

SEQ ID NO: 2437961 - RNA, 22 nt, Bordetella pertussis
ggcucagccccccguaggcggc

SEQ ID NO: 2437962 - RNA, 23 nt, Bordetella pertussis
ggcucagccccccguaggcggcc

SEQ ID NO: 2437963 - RNA, 13 nt, Bordetella pertussis
ggcucagcgggcu

SEQ ID NO: 2437964 - RNA, 12 nt, Bordetella pertussis
ggcucaggccag

SEQ ID NO: 2437965 - RNA, 14 nt, Bordetella pertussis
ggcucaggccagcg

SEQ ID NO: 2437966 - RNA, 17 nt, Bordetella pertussis
ggcucaggccagcgacc

SEQ ID NO: 2437967 - RNA, 16 nt, Bordetella pertussis
ggcucaggccugcacg

SEQ ID NO: 2437968 - RNA, 13 nt, Bordetella pertussis
ggcucaggcggcc

SEQ ID NO: 2437969 - RNA, 13 nt, Bordetella pertussis
ggcucaggcugcg

SEQ ID NO: 2437970 - RNA, 20 nt, Bordetella pertussis
ggcucaggcugcgcgucggc

SEQ ID NO: 2437971 - RNA, 21 nt, Bordetella pertussis
ggcucaggcugcgcgucggca

SEQ ID NO: 2437972 - RNA, 16 nt, Bordetella pertussis
ggcucagucggccugg

SEQ ID NO: 2437973 - RNA, 21 nt, Bordetella pertussis
ggcucaugguuucgagcauca

SEQ ID NO: 2437974 - RNA, 20 nt, Bordetella pertussis
ggcucauucggcgcgcucgg

SEQ ID NO: 2437975 - RNA, 19 nt, Bordetella pertussis
ggcuccagcucagcagcgc

SEQ ID NO: 2437976 - RNA, 22 nt, Bordetella pertussis
ggcuccagcucagcagcgccag

SEQ ID NO: 2437977 - RNA, 23 nt, Bordetella pertussis
ggcuccagcucagcagcgccagg

SEQ ID NO: 2437978 - RNA, 14 nt, Bordetella pertussis
ggcuccaggccgcc

SEQ ID NO: 2437979 - RNA, 18 nt, Bordetella pertussis
ggcuccaggccgcccagc

SEQ ID NO: 2437980 - RNA, 22 nt, Bordetella pertussis
ggcucccaccggugcggaucau

SEQ ID NO: 2437981 - RNA, 18 nt, Bordetella pertussis
ggcuccccugcuaaggga

SEQ ID NO: 2437982 - RNA, 12 nt, Bordetella pertussis
ggcuccccuggu

SEQ ID NO: 2437983 - RNA, 22 nt, Bordetella pertussis
ggcuccccuggucagggcugca

SEQ ID NO: 2437984 - RNA, 18 nt, Bordetella pertussis
ggcucccgagggaucagc

SEQ ID NO: 2437985 - RNA, 20 nt, Bordetella pertussis
ggcucccgcuggcggcacac

SEQ ID NO: 2437986 - RNA, 15 nt, Bordetella pertussis
ggcuccgagggacac

SEQ ID NO: 2437987 - RNA, 18 nt, Bordetella pertussis
ggcuccgauagcggcgcc

SEQ ID NO: 2437988 - RNA, 19 nt, Bordetella pertussis
ggcuccgauagcggcgccg

SEQ ID NO: 2437989 - RNA, 20 nt, Bordetella pertussis
ggcuccgauagcggcgccgc

SEQ ID NO: 2437990 - RNA, 17 nt, Bordetella pertussis
ggcugccgugaggcagc

SEQ ID NO: 2437991 - RNA, 19 nt, Bordetella pertussis
ggcugccgugaggcagccu

SEQ ID NO: 2437992 - RNA, 17 nt, Bordetella pertussis
ggcugcgaaaggccgag

SEQ ID NO: 2437993 - RNA, 16 nt, Bordetella pertussis
ggcugcgacaggcgca

SEQ ID NO: 2437994 - RNA, 17 nt, Bordetella pertussis
ggcugcgaugcgggccu

SEQ ID NO: 2437995 - RNA, 12 nt, Bordetella pertussis
ggcugcgcaggc

SEQ ID NO: 2437996 - RNA, 15 nt, Bordetella pertussis
ggcugcgcaggcgcc

SEQ ID NO: 2437997 - RNA, 16 nt, Bordetella pertussis
ggcugcgcaggcgccg

SEQ ID NO: 2437998 - RNA, 20 nt, Bordetella pertussis
ggcugcgcaggcgccgcagu

SEQ ID NO: 2437999 - RNA, 18 nt, Bordetella pertussis
ggcugcgcaggucggcca

SEQ ID NO: 2438000 - RNA, 21 nt, Bordetella pertussis
ggcugcgcaggucggccagga

SEQ ID NO: 2438001 - RNA, 13 nt, Bordetella pertussis
ggcugcgcgccga

SEQ ID NO: 2438002 - RNA, 15 nt, Bordetella pertussis
ggcugcgcgccggcg

SEQ ID NO: 2438003 - RNA, 17 nt, Bordetella pertussis
ggcugcgcgccggcgcc

SEQ ID NO: 2438004 - RNA, 22 nt, Bordetella pertussis
ggcugcgcgccggcgccuuggc

SEQ ID NO: 2438005 - RNA, 16 nt, Bordetella pertussis
ggcugcgcgccuggca

SEQ ID NO: 2438006 - RNA, 18 nt, Bordetella pertussis
ggcugcgcgcgcagccag

SEQ ID NO: 2438007 - RNA, 21 nt, Bordetella pertussis
ggcugcgcgcgcagccaggua

SEQ ID NO: 2438008 - RNA, 15 nt, Bordetella pertussis
ggcugcgcgcgccag

SEQ ID NO: 2438009 - RNA, 17 nt, Bordetella pertussis
ggcugcgcggccgagcg

SEQ ID NO: 2438010 - RNA, 19 nt, Bordetella pertussis
ggcugcgcggguccggcgu

SEQ ID NO: 2438011 - RNA, 15 nt, Bordetella pertussis
ggcugcgcgucggca

SEQ ID NO: 2438012 - RNA, 13 nt, Bordetella pertussis
ggcugcggcggau

SEQ ID NO: 2438013 - RNA, 15 nt, Bordetella pertussis
ggcugcggcguggcg

SEQ ID NO: 2438014 - RNA, 19 nt, Bordetella pertussis
ggcugcggcguggcgccga

SEQ ID NO: 2438015 - RNA, 21 nt, Bordetella pertussis
ggcugcggcuccugcuggcgc

SEQ ID NO: 2438016 - RNA, 14 nt, Bordetella pertussis
ggcugcgggccggc

SEQ ID NO: 2438017 - RNA, 18 nt, Bordetella pertussis
ggcugcgggccggcgccg

SEQ ID NO: 2438018 - RNA, 20 nt, Bordetella pertussis
ggcugcgggcgcaagccagc

SEQ ID NO: 2438019 - RNA, 23 nt, Bordetella pertussis
ggcugcgggcgcaagccagcacg

SEQ ID NO: 2438020 - RNA, 19 nt, Bordetella pertussis
ggcugcucguucugcgcgc

SEQ ID NO: 2438021 - RNA, 22 nt, Bordetella pertussis
ggcugcugcacgcgcgcgggcg

SEQ ID NO: 2438022 - RNA, 19 nt, Bordetella pertussis
ggcugcugcccgaagcgca

SEQ ID NO: 2438023 - RNA, 16 nt, Bordetella pertussis
ggcugcugugccugcc

SEQ ID NO: 2438024 - RNA, 21 nt, Bordetella pertussis
ggcugcuugagcagccacugc

SEQ ID NO: 2438025 - RNA, 15 nt, Bordetella pertussis
ggcugcuugcccagc

SEQ ID NO: 2438026 - RNA, 17 nt, Bordetella pertussis
ggcugcuugcccagcgg

SEQ ID NO: 2438027 - RNA, 19 nt, Bordetella pertussis
ggcuggaagucagccggug

SEQ ID NO: 2438028 - RNA, 17 nt, Bordetella pertussis
ggcuggacccggagcug

SEQ ID NO: 2438029 - RNA, 16 nt, Bordetella pertussis
ggcuggacgcgcgcgg

SEQ ID NO: 2438030 - RNA, 20 nt, Bordetella pertussis
ggcuggacgcgcgcggcgac

SEQ ID NO: 2438031 - RNA, 21 nt, Bordetella pertussis
ggcuggacgcgcgcggcgacc

SEQ ID NO: 2438032 - RNA, 21 nt, Bordetella pertussis
ggcuggagcucuaugucgccg

SEQ ID NO: 2438033 - RNA, 16 nt, Bordetella pertussis
ggcuggauccggcgcu

SEQ ID NO: 2438034 - RNA, 18 nt, Bordetella pertussis
ggcuggauccggcgcugg

SEQ ID NO: 2438035 - RNA, 20 nt, Bordetella pertussis
ggcuggcauugagggcguac

SEQ ID NO: 2438036 - RNA, 23 nt, Bordetella pertussis
ggcuggccagccggcccagcaug

SEQ ID NO: 2438037 - RNA, 22 nt, Bordetella pertussis
ggcuggccagcggggccgugac

SEQ ID NO: 2438038 - RNA, 14 nt, Bordetella pertussis
ggcuggccagcugg

SEQ ID NO: 2438039 - RNA, 15 nt, Bordetella pertussis
ggcuggccagcuggc

SEQ ID NO: 2438040 - RNA, 18 nt, Bordetella pertussis
ggcuggccagcuggcggc

SEQ ID NO: 2438041 - RNA, 21 nt, Bordetella pertussis
ggcuggccagcuggcggcgca

SEQ ID NO: 2438042 - RNA, 11 nt, Bordetella pertussis
ggcuggccgag

SEQ ID NO: 2438043 - RNA, 12 nt, Bordetella pertussis
ggcuggccgccg

SEQ ID NO: 2438044 - RNA, 19 nt, Bordetella pertussis
ggcuggccgccgcggccuc

SEQ ID NO: 2438045 - RNA, 13 nt, Bordetella pertussis
ggcuggccgccug

SEQ ID NO: 2438046 - RNA, 14 nt, Bordetella pertussis
ggcuggccgccugc

SEQ ID NO: 2438047 - RNA, 16 nt, Bordetella pertussis
ggcuggccggccaaca

SEQ ID NO: 2438048 - RNA, 20 nt, Bordetella pertussis
ggcuggccggcguggccugc

SEQ ID NO: 2438049 - RNA, 12 nt, Bordetella pertussis
ggcuggcgauca

SEQ ID NO: 2438050 - RNA, 13 nt, Bordetella pertussis
ggcuggcgcggcc

SEQ ID NO: 2438051 - RNA, 14 nt, Bordetella pertussis
ggcuggcgcggcug

SEQ ID NO: 2438052 - RNA, 15 nt, Bordetella pertussis
ggcuggcgcggcugg

SEQ ID NO: 2438053 - RNA, 16 nt, Bordetella pertussis
ggcuggcggugcgugc

SEQ ID NO: 2438054 - RNA, 20 nt, Bordetella pertussis
ggcuggcggugcgugcgccc

SEQ ID NO: 2438055 - RNA, 18 nt, Bordetella pertussis
ggcuggcugggcgcgccg

SEQ ID NO: 2438056 - RNA, 16 nt, Bordetella pertussis
ggcugggagagccggc

SEQ ID NO: 2438057 - RNA, 19 nt, Bordetella pertussis
ggcugggagagccggccac

SEQ ID NO: 2438058 - RNA, 13 nt, Bordetella pertussis
ggcugggccagau

SEQ ID NO: 2438059 - RNA, 14 nt, Bordetella pertussis
ggcugggccagaug

SEQ ID NO: 2438060 - RNA, 14 nt, Bordetella pertussis
ggcugggcgcgccg

SEQ ID NO: 2438061 - RNA, 16 nt, Bordetella pertussis
ggcugggcggccuugg

SEQ ID NO: 2438062 - RNA, 18 nt, Bordetella pertussis
ggcugggcggccuuggcc

SEQ ID NO: 2438063 - RNA, 19 nt, Bordetella pertussis
ggcuggggcaggcacuggc

SEQ ID NO: 2438064 - RNA, 21 nt, Bordetella pertussis
ggcuggggcaggcacuggcgc

SEQ ID NO: 2438065 - RNA, 15 nt, Bordetella pertussis
ggcuggggccgagcg

SEQ ID NO: 2438066 - RNA, 21 nt, Bordetella pertussis
ggcuggggcugcugggccggc

SEQ ID NO: 2438067 - RNA, 17 nt, Bordetella pertussis
ggcugggucggcgugac

SEQ ID NO: 2438068 - RNA, 16 nt, Bordetella pertussis
ggcuggguucaggccu

SEQ ID NO: 2438069 - RNA, 14 nt, Bordetella pertussis
ggcugguaggggau

SEQ ID NO: 2438070 - RNA, 13 nt, Bordetella pertussis
ggcuggucgccgu

SEQ ID NO: 2438071 - RNA, 15 nt, Bordetella pertussis
ggcuggucgcgccgg

SEQ ID NO: 2438072 - RNA, 17 nt, Bordetella pertussis
ggcuggucuucgagcgc

SEQ ID NO: 2438073 - RNA, 14 nt, Bordetella pertussis
ggcuggugccgacg

SEQ ID NO: 2438074 - RNA, 17 nt, Bordetella pertussis
ggcuggugccgacggcg

SEQ ID NO: 2438075 - RNA, 17 nt, Bordetella pertussis
ggcuggugcgccgugcc

SEQ ID NO: 2438076 - RNA, 14 nt, Bordetella pertussis
ggcugguggcgucg

SEQ ID NO: 2438077 - RNA, 18 nt, Bordetella pertussis
ggcugguggugccgcgca

SEQ ID NO: 2438078 - RNA, 18 nt, Bordetella pertussis
ggcuguaccuggcgaucg

SEQ ID NO: 2438079 - RNA, 12 nt, Bordetella pertussis
ggcuguauagau

SEQ ID NO: 2438080 - RNA, 21 nt, Bordetella pertussis
ggcuguauagaugcgcggggc

SEQ ID NO: 2438081 - RNA, 22 nt, Bordetella pertussis
ggcuguauagaugcgcggggcc

SEQ ID NO: 2438082 - RNA, 14 nt, Bordetella pertussis
ggcugucccagaug

SEQ ID NO: 2438083 - RNA, 15 nt, Bordetella pertussis
ggcuguccccgcgcg

SEQ ID NO: 2438084 - RNA, 16 nt, Bordetella pertussis
ggcuguccccgcgcgg

SEQ ID NO: 2438085 - RNA, 19 nt, Bordetella pertussis
ggcuguccccgcgcggggg

SEQ ID NO: 2438086 - RNA, 18 nt, Bordetella pertussis
ggcugucgcaacagcccc

SEQ ID NO: 2438087 - RNA, 20 nt, Bordetella pertussis
ggcugucgcagucggggccg

SEQ ID NO: 2438088 - RNA, 14 nt, Bordetella pertussis
ggcugucgcgcgca

SEQ ID NO: 2438089 - RNA, 18 nt, Bordetella pertussis
ggcugucgcgcgcaucgc

SEQ ID NO: 2438090 - RNA, 21 nt, Bordetella pertussis
ggcugucgggcggcgccuggu

SEQ ID NO: 2438091 - RNA, 17 nt, Bordetella pertussis
ggcugucgucgucggca

SEQ ID NO: 2438092 - RNA, 17 nt, Bordetella pertussis
ggcugugcccgccccau

SEQ ID NO: 2438093 - RNA, 16 nt, Bordetella pertussis
ggcuguucgcgcagca

SEQ ID NO: 2438094 - RNA, 17 nt, Bordetella pertussis
ggcuguucgcgcagcag

SEQ ID NO: 2438095 - RNA, 19 nt, Bordetella pertussis
ggcuguucguagucgagcc

SEQ ID NO: 2438096 - RNA, 21 nt, Bordetella pertussis
ggcuuccagcagcaugccgcg

SEQ ID NO: 2438097 - RNA, 19 nt, Bordetella pertussis
ggcuuccaguucgcgcaga

SEQ ID NO: 2438098 - RNA, 21 nt, Bordetella pertussis
ggcuucccgguccaggccgaa

SEQ ID NO: 2438099 - RNA, 19 nt, Bordetella pertussis
ggcuuccugcaccucagga

SEQ ID NO: 2438100 - RNA, 15 nt, Bordetella pertussis
ggcuucgaccacgcg

SEQ ID NO: 2438101 - RNA, 20 nt, Bordetella pertussis
ggcuucgaccacgcggcggu

SEQ ID NO: 2438102 - RNA, 17 nt, Bordetella pertussis
ggcuucgagcgcgacga

SEQ ID NO: 2438103 - RNA, 20 nt, Bordetella pertussis
gggauuucgcuggccaucgu

SEQ ID NO: 2438104 - RNA, 15 nt, Bordetella pertussis
gggcaaaacgcgcau

SEQ ID NO: 2438105 - RNA, 18 nt, Bordetella pertussis
gggcaaacggcggcaggc

SEQ ID NO: 2438106 - RNA, 20 nt, Bordetella pertussis
gggcaaacggcggcaggccg

SEQ ID NO: 2438107 - RNA, 22 nt, Bordetella pertussis
gggcaaagaaauugggcguggc

SEQ ID NO: 2438108 - RNA, 14 nt, Bordetella pertussis
gggcaacgacgcag

SEQ ID NO: 2438109 - RNA, 22 nt, Bordetella pertussis
gggcaacgacgcaggcgccgca

SEQ ID NO: 2438110 - RNA, 18 nt, Bordetella pertussis
gggcaagcgcgucgaugg

SEQ ID NO: 2438111 - RNA, 15 nt, Bordetella pertussis
gggcacaacccgccc

SEQ ID NO: 2438112 - RNA, 22 nt, Bordetella pertussis
gggcacaccgucacgcgcaagg

SEQ ID NO: 2438113 - RNA, 14 nt, Bordetella pertussis
gggcacauccagcg

SEQ ID NO: 2438114 - RNA, 18 nt, Bordetella pertussis
gggcacaucggccacccg

SEQ ID NO: 2438115 - RNA, 16 nt, Bordetella pertussis
gggcaccaccaccgcc

SEQ ID NO: 2438116 - RNA, 21 nt, Bordetella pertussis
gggcaccagguccuggcggcc

SEQ ID NO: 2438117 - RNA, 22 nt, Bordetella pertussis
gggcaccagguccuggcggccg

SEQ ID NO: 2438118 - RNA, 23 nt, Bordetella pertussis
gggcaccagguccuggcggccgc

SEQ ID NO: 2438119 - RNA, 17 nt, Bordetella pertussis
gggcaccaucucccgca

SEQ ID NO: 2438120 - RNA, 21 nt, Bordetella pertussis
gggcacccaggcgggcuggcg

SEQ ID NO: 2438121 - RNA, 18 nt, Bordetella pertussis
gggcaccgacacgcuggc

SEQ ID NO: 2438122 - RNA, 14 nt, Bordetella pertussis
gggcaccgagccgc

SEQ ID NO: 2438123 - RNA, 22 nt, Bordetella pertussis
gggcaccgagccgcagguccag

SEQ ID NO: 2438124 - RNA, 20 nt, Bordetella pertussis
gggcaccgugaugcgcgccg

SEQ ID NO: 2438125 - RNA, 16 nt, Bordetella pertussis
gggcacgaucaccgcc

SEQ ID NO: 2438126 - RNA, 12 nt, Bordetella pertussis
gggcacgauggc

SEQ ID NO: 2438127 - RNA, 12 nt, Bordetella pertussis
gggcacggccag

SEQ ID NO: 2438128 - RNA, 15 nt, Bordetella pertussis
gggcacggccagcac

SEQ ID NO: 2438129 - RNA, 15 nt, Bordetella pertussis
gggcacucggccaug

SEQ ID NO: 2438130 - RNA, 17 nt, Bordetella pertussis
gggcacucggccauggu

SEQ ID NO: 2438131 - RNA, 20 nt, Bordetella pertussis
gggcacucggccauggugcc

SEQ ID NO: 2438132 - RNA, 14 nt, Bordetella pertussis
gggcagcacgcgca

SEQ ID NO: 2438133 - RNA, 15 nt, Bordetella pertussis
gggcagcagcagggc

SEQ ID NO: 2438134 - RNA, 20 nt, Bordetella pertussis
gggcagcagcagggccaggc

SEQ ID NO: 2438135 - RNA, 21 nt, Bordetella pertussis
gggcagcagcagggccaggcc

SEQ ID NO: 2438136 - RNA, 14 nt, Bordetella pertussis
gggcagcaggcgca

SEQ ID NO: 2438137 - RNA, 17 nt, Bordetella pertussis
gggcagcaggcgcauca

SEQ ID NO: 2438138 - RNA, 20 nt, Bordetella pertussis
gggcagcaggucacgggcga

SEQ ID NO: 2438139 - RNA, 17 nt, Bordetella pertussis
gggcagcgagauggggc

SEQ ID NO: 2438140 - RNA, 13 nt, Bordetella pertussis
gggcagcgcggcg

SEQ ID NO: 2438141 - RNA, 12 nt, Bordetella pertussis
gggcagcggcca

SEQ ID NO: 2438142 - RNA, 15 nt, Bordetella pertussis
gggcagcggcgacgg

SEQ ID NO: 2438143 - RNA, 16 nt, Bordetella pertussis
gggcagcggcgacggc

SEQ ID NO: 2438144 - RNA, 19 nt, Bordetella pertussis
gggcagcggcgacggcgcc

SEQ ID NO: 2438145 - RNA, 12 nt, Bordetella pertussis
gggcagcucgcg

SEQ ID NO: 2438146 - RNA, 15 nt, Bordetella pertussis
gggcagcucgcgguc

SEQ ID NO: 2438147 - RNA, 21 nt, Bordetella pertussis
gggcagcucggugcagcccag

SEQ ID NO: 2438148 - RNA, 22 nt, Bordetella pertussis
gggcagcucggugcagcccagc

SEQ ID NO: 2438149 - RNA, 17 nt, Bordetella pertussis
gggcaggaagccggccc

SEQ ID NO: 2438150 - RNA, 20 nt, Bordetella pertussis
gggcaggacgccggcgccgg

SEQ ID NO: 2438151 - RNA, 13 nt, Bordetella pertussis
gggcaggcccagc

SEQ ID NO: 2438152 - RNA, 15 nt, Bordetella pertussis
gggcaggcccagcca

SEQ ID NO: 2438153 - RNA, 18 nt, Bordetella pertussis
gggcaggcccagccagcg

SEQ ID NO: 2438154 - RNA, 20 nt, Bordetella pertussis
gggcaggcccagccagcggu

SEQ ID NO: 2438155 - RNA, 22 nt, Bordetella pertussis
gggcaggcccaugacgccggug

SEQ ID NO: 2438156 - RNA, 13 nt, Bordetella pertussis
gggcaggccgaug

SEQ ID NO: 2438157 - RNA, 15 nt, Bordetella pertussis
gggcaggccuggucg

SEQ ID NO: 2438158 - RNA, 19 nt, Bordetella pertussis
gggcaggccuggucgagcg

SEQ ID NO: 2438159 - RNA, 15 nt, Bordetella pertussis
gggcaggccuucgcg

SEQ ID NO: 2438160 - RNA, 12 nt, Bordetella pertussis
gggcaggcggcu

SEQ ID NO: 2438161 - RNA, 21 nt, Bordetella pertussis
gggcaggcggcuuucaugggc

SEQ ID NO: 2438162 - RNA, 20 nt, Bordetella pertussis
gggcaggcgggccaggccgg

SEQ ID NO: 2438163 - RNA, 22 nt, Bordetella pertussis
gggcaggcgggccaggccggug

SEQ ID NO: 2438164 - RNA, 13 nt, Bordetella pertussis
gggcaggcucagc

SEQ ID NO: 2438165 - RNA, 15 nt, Bordetella pertussis
gggcaggcucagccc

SEQ ID NO: 2438166 - RNA, 18 nt, Bordetella pertussis
gggcaggcucagcccggc

SEQ ID NO: 2438167 - RNA, 18 nt, Bordetella pertussis
gggcaggcuggcgcgguc

SEQ ID NO: 2438168 - RNA, 14 nt, Bordetella pertussis
gggcagggcgacgu

SEQ ID NO: 2438169 - RNA, 15 nt, Bordetella pertussis
gggcagggcgacguc

SEQ ID NO: 2438170 - RNA, 12 nt, Bordetella pertussis
gggcagggcgcc

SEQ ID NO: 2438171 - RNA, 15 nt, Bordetella pertussis
gggcaggucgccagc

SEQ ID NO: 2438172 - RNA, 19 nt, Bordetella pertussis
gggcaggucgccagcaggc

SEQ ID NO: 2438173 - RNA, 21 nt, Bordetella pertussis
gggcaggucgccagcaggccc

SEQ ID NO: 2438174 - RNA, 22 nt, Bordetella pertussis
gggcaggucgccagcaggcccu

SEQ ID NO: 2438175 - RNA, 16 nt, Bordetella pertussis
gggcaggucggccagc

SEQ ID NO: 2438176 - RNA, 17 nt, Bordetella pertussis
gggcaggucggccagcg

SEQ ID NO: 2438177 - RNA, 16 nt, Bordetella pertussis
gggcaggucggcgcgg

SEQ ID NO: 2438178 - RNA, 19 nt, Bordetella pertussis
gggcaggucggcgcggggc

SEQ ID NO: 2438179 - RNA, 16 nt, Bordetella pertussis
gggcaggucgggcagg

SEQ ID NO: 2438180 - RNA, 19 nt, Bordetella pertussis
gggcaggucgucgagccgg

SEQ ID NO: 2438181 - RNA, 20 nt, Bordetella pertussis
gggcaggucgucgagccggg

SEQ ID NO: 2438182 - RNA, 23 nt, Bordetella pertussis
gggcaggugccccacgccgaugc

SEQ ID NO: 2438183 - RNA, 19 nt, Bordetella pertussis
gggcaguccuucagcuuga

SEQ ID NO: 2438184 - RNA, 12 nt, Bordetella pertussis
gggcagugcgcc

SEQ ID NO: 2438185 - RNA, 18 nt, Bordetella pertussis
gggcaguugcuggcggcc

SEQ ID NO: 2438186 - RNA, 22 nt, Bordetella pertussis
gggcaucaauagcccgugcggg

SEQ ID NO: 2438187 - RNA, 23 nt, Bordetella pertussis
gggcaucaccaucgauguggccu

SEQ ID NO: 2438188 - RNA, 17 nt, Bordetella pertussis
gggcaucaggggcucgg

SEQ ID NO: 2438189 - RNA, 23 nt, Bordetella pertussis
gggcaucaggggcucggccaggu

SEQ ID NO: 2438190 - RNA, 14 nt, Bordetella pertussis
gggcaucgcccugc

SEQ ID NO: 2438191 - RNA, 17 nt, Bordetella pertussis
gggcaucgcccugcucg

SEQ ID NO: 2438192 - RNA, 19 nt, Bordetella pertussis
gggcaugacgaucacgggc

SEQ ID NO: 2438193 - RNA, 14 nt, Bordetella pertussis
gggcaugcaccagg

SEQ ID NO: 2438194 - RNA, 20 nt, Bordetella pertussis
gggcaugcgaaagccggccu

SEQ ID NO: 2438195 - RNA, 17 nt, Bordetella pertussis
gggcauggcccggcucg

SEQ ID NO: 2438196 - RNA, 13 nt, Bordetella pertussis
gggcaugggcccc

SEQ ID NO: 2438197 - RNA, 15 nt, Bordetella pertussis
gggcaugucgcggcc

SEQ ID NO: 2438198 - RNA, 15 nt, Bordetella pertussis
gggcauguugcgcga

SEQ ID NO: 2438199 - RNA, 23 nt, Bordetella pertussis
gggcauugccggagcagcagcgg

SEQ ID NO: 2438200 - RNA, 15 nt, Bordetella pertussis
gggcauugggcagcg

SEQ ID NO: 2438201 - RNA, 20 nt, Bordetella pertussis
gggcauugggcagcggacgg

SEQ ID NO: 2438202 - RNA, 18 nt, Bordetella pertussis
gggcauuucccagccguc

SEQ ID NO: 2438203 - RNA, 20 nt, Bordetella pertussis
gggccacauggucgcccagc

SEQ ID NO: 2438204 - RNA, 17 nt, Bordetella pertussis
gggccacccgccgccgg

SEQ ID NO: 2438205 - RNA, 15 nt, Bordetella pertussis
gggccacgcccacgc

SEQ ID NO: 2438206 - RNA, 15 nt, Bordetella pertussis
gggccacgccggccg

SEQ ID NO: 2438207 - RNA, 19 nt, Bordetella pertussis
gggccacgccggccggggu

SEQ ID NO: 2438208 - RNA, 22 nt, Bordetella pertussis
gggccacucgaugggcgcgcgc

SEQ ID NO: 2438209 - RNA, 16 nt, Bordetella pertussis
gggccagaccgcgcgc

SEQ ID NO: 2438210 - RNA, 19 nt, Bordetella pertussis
gggccagcagcuggcgcag

SEQ ID NO: 2438211 - RNA, 20 nt, Bordetella pertussis
gggccagcagcuggcgcagc

SEQ ID NO: 2438212 - RNA, 21 nt, Bordetella pertussis
gggccagcagcuggcgcagca

SEQ ID NO: 2438213 - RNA, 21 nt, Bordetella pertussis
gggccagcaggcucagcgggc

SEQ ID NO: 2438214 - RNA, 20 nt, Bordetella pertussis
gggccagcaucggcacccag

SEQ ID NO: 2438215 - RNA, 22 nt, Bordetella pertussis
gggccagcaucggcacccagcc

SEQ ID NO: 2438216 - RNA, 12 nt, Bordetella pertussis
gggccgggccgg

SEQ ID NO: 2438217 - RNA, 14 nt, Bordetella pertussis
gggccgggcgccag

SEQ ID NO: 2438218 - RNA, 21 nt, Bordetella pertussis
gggccgguccgcucgaggcca

SEQ ID NO: 2438219 - RNA, 19 nt, Bordetella pertussis
gggccgguuucggccugca

SEQ ID NO: 2438220 - RNA, 16 nt, Bordetella pertussis
gggccgucaugcgccg

SEQ ID NO: 2438221 - RNA, 18 nt, Bordetella pertussis
gggccgucaugcgccguc

SEQ ID NO: 2438222 - RNA, 15 nt, Bordetella pertussis
gggccguccggccgu

SEQ ID NO: 2438223 - RNA, 22 nt, Bordetella pertussis
gggccguccggccgugccgccc

SEQ ID NO: 2438224 - RNA, 17 nt, Bordetella pertussis
gggccgucgccgcgcgg

SEQ ID NO: 2438225 - RNA, 19 nt, Bordetella pertussis
gggccgucgugcgccuggc

SEQ ID NO: 2438226 - RNA, 23 nt, Bordetella pertussis
gggccgucgugcgccuggcggcu

SEQ ID NO: 2438227 - RNA, 19 nt, Bordetella pertussis
gggccgucuacaggcccag

SEQ ID NO: 2438228 - RNA, 14 nt, Bordetella pertussis
gggccgugcgccgg

SEQ ID NO: 2438229 - RNA, 17 nt, Bordetella pertussis
gggccguggcgauccag

SEQ ID NO: 2438230 - RNA, 22 nt, Bordetella pertussis
gggccguuuuauuuggcaaggc

SEQ ID NO: 2438231 - RNA, 13 nt, Bordetella pertussis
gggccuagcccgg

SEQ ID NO: 2438232 - RNA, 18 nt, Bordetella pertussis
gggccucaugacggggcc

SEQ ID NO: 2438233 - RNA, 17 nt, Bordetella pertussis
gggccuccugcagcagg

SEQ ID NO: 2438234 - RNA, 16 nt, Bordetella pertussis
gggccucgaagcccgg

SEQ ID NO: 2438235 - RNA, 20 nt, Bordetella pertussis
gggccucgaagcccggcagg

SEQ ID NO: 2438236 - RNA, 22 nt, Bordetella pertussis
gggccucgaagcccggcagggu

SEQ ID NO: 2438237 - RNA, 18 nt, Bordetella pertussis
gggccucgaugaccgggu

SEQ ID NO: 2438238 - RNA, 14 nt, Bordetella pertussis
gggccucgcgggcc

SEQ ID NO: 2438239 - RNA, 13 nt, Bordetella pertussis
gggccucggccag

SEQ ID NO: 2438240 - RNA, 12 nt, Bordetella pertussis
gggccugcagca

SEQ ID NO: 2438241 - RNA, 23 nt, Bordetella pertussis
gggccugcaguucggccgccagg

SEQ ID NO: 2438242 - RNA, 21 nt, Bordetella pertussis
gggccugcccauggccugcaa

SEQ ID NO: 2438243 - RNA, 17 nt, Bordetella pertussis
gggccugcgggccgggc

SEQ ID NO: 2438244 - RNA, 14 nt, Bordetella pertussis
gggccugcugucgc

SEQ ID NO: 2438245 - RNA, 18 nt, Bordetella pertussis
gggccugcugucgcuggg

SEQ ID NO: 2438246 - RNA, 21 nt, Bordetella pertussis
gggccuggaagcuggccagcg

SEQ ID NO: 2438247 - RNA, 18 nt, Bordetella pertussis
gggccuggcagaugcgcg

SEQ ID NO: 2438248 - RNA, 23 nt, Bordetella pertussis
gggccuggcagaugcgcgccagg

SEQ ID NO: 2438249 - RNA, 17 nt, Bordetella pertussis
gggccuggccugcgccg

SEQ ID NO: 2438250 - RNA, 22 nt, Bordetella pertussis
gggccuggcggaucucggccag

SEQ ID NO: 2438251 - RNA, 20 nt, Bordetella pertussis
gggccuggcguucggcaccg

SEQ ID NO: 2438252 - RNA, 21 nt, Bordetella pertussis
gggccuggcguucggcaccgg

SEQ ID NO: 2438253 - RNA, 20 nt, Bordetella pertussis
gggccuggcucaggccugca

SEQ ID NO: 2438254 - RNA, 17 nt, Bordetella pertussis
gggccugguacaggccg

SEQ ID NO: 2438255 - RNA, 16 nt, Bordetella pertussis
gggccuggucagcgcc

SEQ ID NO: 2438256 - RNA, 17 nt, Bordetella pertussis
gggccuggucagcgccg

SEQ ID NO: 2438257 - RNA, 18 nt, Bordetella pertussis
gggccuggucagcgccga

SEQ ID NO: 2438258 - RNA, 21 nt, Bordetella pertussis
gggccuucuugucgcuggaga

SEQ ID NO: 2438259 - RNA, 17 nt, Bordetella pertussis
gggcgaaacggccagcg

SEQ ID NO: 2438260 - RNA, 18 nt, Bordetella pertussis
gggcgaaccgcggcgcag

SEQ ID NO: 2438261 - RNA, 21 nt, Bordetella pertussis
gggcgaaccgcggcgcagguc

SEQ ID NO: 2438262 - RNA, 19 nt, Bordetella pertussis
gggcgaaccgguggccaug

SEQ ID NO: 2438263 - RNA, 14 nt, Bordetella pertussis
gggcgaacugcucg

SEQ ID NO: 2438264 - RNA, 15 nt, Bordetella pertussis
gggcgaagcggaccu

SEQ ID NO: 2438265 - RNA, 16 nt, Bordetella pertussis
gggcgaauccaccggc

SEQ ID NO: 2438266 - RNA, 12 nt, Bordetella pertussis
gggcgacaggcg

SEQ ID NO: 2438267 - RNA, 13 nt, Bordetella pertussis
gggcgacaggcgc

SEQ ID NO: 2438268 - RNA, 14 nt, Bordetella pertussis
gggcgacaggcgcg

SEQ ID NO: 2438269 - RNA, 23 nt, Bordetella pertussis
gggcgacgcggcguacuggcgcg

SEQ ID NO: 2438270 - RNA, 16 nt, Bordetella pertussis
gggcgacgucccaggc

SEQ ID NO: 2438271 - RNA, 18 nt, Bordetella pertussis
gggcgacgucccaggccg

SEQ ID NO: 2438272 - RNA, 17 nt, Bordetella pertussis
gggcgacuccagcccga

SEQ ID NO: 2438273 - RNA, 16 nt, Bordetella pertussis
gggcgacugcagcagg

SEQ ID NO: 2438274 - RNA, 22 nt, Bordetella pertussis
gggcgacugcagcaggcugggc

SEQ ID NO: 2438275 - RNA, 17 nt, Bordetella pertussis
gggcgagaucagccacc

SEQ ID NO: 2438276 - RNA, 12 nt, Bordetella pertussis
gggcgagcaggc

SEQ ID NO: 2438277 - RNA, 14 nt, Bordetella pertussis
gggcgagcgggccg

SEQ ID NO: 2438278 - RNA, 15 nt, Bordetella pertussis
gggcgagcgggccgg

SEQ ID NO: 2438279 - RNA, 14 nt, Bordetella pertussis
gggcgaggcggggc

SEQ ID NO: 2438280 - RNA, 21 nt, Bordetella pertussis
gggcgagguagggcgcggcca

SEQ ID NO: 2438281 - RNA, 18 nt, Bordetella pertussis
gggcgaggucagcccggc

SEQ ID NO: 2438282 - RNA, 20 nt, Bordetella pertussis
gggcgauauccaucggcgcg

SEQ ID NO: 2438283 - RNA, 15 nt, Bordetella pertussis
gggcgaucagcaccg

SEQ ID NO: 2438284 - RNA, 21 nt, Bordetella pertussis
gggcgaucagcaccgcggcgg

SEQ ID NO: 2438285 - RNA, 14 nt, Bordetella pertussis
gggcgaucaugcag

SEQ ID NO: 2438286 - RNA, 22 nt, Bordetella pertussis
gggcgaucgcgucggccaaggc

SEQ ID NO: 2438287 - RNA, 22 nt, Bordetella pertussis
gggcgaugcauucggcggccgg

SEQ ID NO: 2438288 - RNA, 13 nt, Bordetella pertussis
gggcgaugcggcg

SEQ ID NO: 2438289 - RNA, 12 nt, Bordetella pertussis
gggcgauggcgc

SEQ ID NO: 2438290 - RNA, 17 nt, Bordetella pertussis
gggcgauggcgcgucgc

SEQ ID NO: 2438291 - RNA, 19 nt, Bordetella pertussis
gggcgauuugccgcagccc

SEQ ID NO: 2438292 - RNA, 23 nt, Bordetella pertussis
gggcgcaaaagcaacaaccgcgc

SEQ ID NO: 2438293 - RNA, 16 nt, Bordetella pertussis
gggcgcaaguguggcg

SEQ ID NO: 2438294 - RNA, 21 nt, Bordetella pertussis
gggcgcacaguugcaggccau

SEQ ID NO: 2438295 - RNA, 13 nt, Bordetella pertussis
gggcgcaccaugc

SEQ ID NO: 2438296 - RNA, 20 nt, Bordetella pertussis
gggcgcaccaugcggugcgc

SEQ ID NO: 2438297 - RNA, 14 nt, Bordetella pertussis
gggcgcaccugguc

SEQ ID NO: 2438298 - RNA, 12 nt, Bordetella pertussis
gggcgcacgccg

SEQ ID NO: 2438299 - RNA, 14 nt, Bordetella pertussis
gggcgcacgccgcg

SEQ ID NO: 2438300 - RNA, 20 nt, Bordetella pertussis
gggcgcacgccgcgccggcg

SEQ ID NO: 2438301 - RNA, 23 nt, Bordetella pertussis
gggcgcacgccgcgccggcgcgc

SEQ ID NO: 2438302 - RNA, 12 nt, Bordetella pertussis
gggcgcaggccg

SEQ ID NO: 2438303 - RNA, 16 nt, Bordetella pertussis
gggcgcaggccgccac

SEQ ID NO: 2438304 - RNA, 21 nt, Bordetella pertussis
gggcgcaucaugaggcggcgg

SEQ ID NO: 2438305 - RNA, 17 nt, Bordetella pertussis
gggcgcauccagcucgg

SEQ ID NO: 2438306 - RNA, 18 nt, Bordetella pertussis
gggcgcauuggcccugcu

SEQ ID NO: 2438307 - RNA, 14 nt, Bordetella pertussis
gggcgccagcagca

SEQ ID NO: 2438308 - RNA, 15 nt, Bordetella pertussis
gggcgccagcagcac

SEQ ID NO: 2438309 - RNA, 20 nt, Bordetella pertussis
gggcgccagcagcgggcugg

SEQ ID NO: 2438310 - RNA, 22 nt, Bordetella pertussis
gggcgccaggcugaaugccgcc

SEQ ID NO: 2438311 - RNA, 14 nt, Bordetella pertussis
gggcgcccagcgcg

SEQ ID NO: 2438312 - RNA, 19 nt, Bordetella pertussis
gggcgcccgcgcgcgagcu

SEQ ID NO: 2438313 - RNA, 18 nt, Bordetella pertussis
gggcgccgaccgggccga

SEQ ID NO: 2438314 - RNA, 14 nt, Bordetella pertussis
gggcgccgauccag

SEQ ID NO: 2438315 - RNA, 15 nt, Bordetella pertussis
gggcgccgauccagc

SEQ ID NO: 2438316 - RNA, 18 nt, Bordetella pertussis
gggcgccgauccagccca

SEQ ID NO: 2438317 - RNA, 19 nt, Bordetella pertussis
gggcgccgcaacgccgggc

SEQ ID NO: 2438318 - RNA, 16 nt, Bordetella pertussis
gggcgccgcgcacgca

SEQ ID NO: 2438319 - RNA, 15 nt, Bordetella pertussis
gggcgccgcgcccca

SEQ ID NO: 2438320 - RNA, 13 nt, Bordetella pertussis
gggcgccgcgccg

SEQ ID NO: 2438321 - RNA, 14 nt, Bordetella pertussis
gggcgccgcggcgg

SEQ ID NO: 2438322 - RNA, 15 nt, Bordetella pertussis
gggcgccgcggcggc

SEQ ID NO: 2438323 - RNA, 17 nt, Bordetella pertussis
gggcgccgcggcggcga

SEQ ID NO: 2438324 - RNA, 15 nt, Bordetella pertussis
gggcgccgcggggcg

SEQ ID NO: 2438325 - RNA, 12 nt, Bordetella pertussis
gggcgccggcca

SEQ ID NO: 2438326 - RNA, 14 nt, Bordetella pertussis
gggcgccggccagg

SEQ ID NO: 2438327 - RNA, 22 nt, Bordetella pertussis
gggcgccggcgucacgcggccg

SEQ ID NO: 2438328 - RNA, 19 nt, Bordetella pertussis
gggcgccuacacgguggcg

SEQ ID NO: 2438329 - RNA, 15 nt, Bordetella pertussis
gggcguggcgcaggg

SEQ ID NO: 2438330 - RNA, 17 nt, Bordetella pertussis
gggcguggcgcgcgugc

SEQ ID NO: 2438331 - RNA, 22 nt, Bordetella pertussis
gggcguggugcugacggacugg

SEQ ID NO: 2438332 - RNA, 21 nt, Bordetella pertussis
gggcguucgacgggcaggccc

SEQ ID NO: 2438333 - RNA, 22 nt, Bordetella pertussis
gggcguuuuugcguccggcgcg

SEQ ID NO: 2438334 - RNA, 23 nt, Bordetella pertussis
gggcguuuuugcguccggcgcgc

SEQ ID NO: 2438335 - RNA, 14 nt, Bordetella pertussis
gggcucaggcugcg

SEQ ID NO: 2438336 - RNA, 21 nt, Bordetella pertussis
gggcucaggcugcgcgucggc

SEQ ID NO: 2438337 - RNA, 13 nt, Bordetella pertussis
gggcuccaggcug

SEQ ID NO: 2438338 - RNA, 17 nt, Bordetella pertussis
gggcuccaggcugagcg

SEQ ID NO: 2438339 - RNA, 20 nt, Bordetella pertussis
gggcuccaggcugagcguga

SEQ ID NO: 2438340 - RNA, 18 nt, Bordetella pertussis
gggcuccguuccgaugcu

SEQ ID NO: 2438341 - RNA, 21 nt, Bordetella pertussis
gggcuccucgcccgaccugcu

SEQ ID NO: 2438342 - RNA, 21 nt, Bordetella pertussis
gggcuccugugggggcgcggc

SEQ ID NO: 2438343 - RNA, 15 nt, Bordetella pertussis
gggcucgaccgccgc

SEQ ID NO: 2438344 - RNA, 18 nt, Bordetella pertussis
gggcucgaccgccgccac

SEQ ID NO: 2438345 - RNA, 20 nt, Bordetella pertussis
gggcucgcgcccgagcgcca

SEQ ID NO: 2438346 - RNA, 16 nt, Bordetella pertussis
gggcucgcgcgagccc

SEQ ID NO: 2438347 - RNA, 16 nt, Bordetella pertussis
gggcucgcgcgcgcgg

SEQ ID NO: 2438348 - RNA, 19 nt, Bordetella pertussis
gggcucgcgcgcgcgggcg

SEQ ID NO: 2438349 - RNA, 13 nt, Bordetella pertussis
gggcucgcugacc

SEQ ID NO: 2438350 - RNA, 13 nt, Bordetella pertussis
gggcucggccagg

SEQ ID NO: 2438351 - RNA, 14 nt, Bordetella pertussis
gggcucggcgccgg

SEQ ID NO: 2438352 - RNA, 18 nt, Bordetella pertussis
gggcucgucgacgcggcc

SEQ ID NO: 2438353 - RNA, 19 nt, Bordetella pertussis
gggcucgucgacgcggccg

SEQ ID NO: 2438354 - RNA, 20 nt, Bordetella pertussis
gggcucgucgacgcggccgu

SEQ ID NO: 2438355 - RNA, 14 nt, Bordetella pertussis
gggcucgugguggg

SEQ ID NO: 2438356 - RNA, 23 nt, Bordetella pertussis
gggcucgugguggguuggccuug

SEQ ID NO: 2438357 - RNA, 16 nt, Bordetella pertussis
gggcucuucgacagcg

SEQ ID NO: 2438358 - RNA, 18 nt, Bordetella pertussis
gggcugaacauccugacc

SEQ ID NO: 2438359 - RNA, 19 nt, Bordetella pertussis
gggcugauccgcaccggcg

SEQ ID NO: 2438360 - RNA, 23 nt, Bordetella pertussis
gggcugauccgcaccggcgugcg

SEQ ID NO: 2438361 - RNA, 24 nt, Bordetella pertussis
gggcugauccgcaccggcgugcgc

SEQ ID NO: 2438362 - RNA, 18 nt, Bordetella pertussis
gggcugaugcaggccugc

SEQ ID NO: 2438363 - RNA, 21 nt, Bordetella pertussis
gggcugaugcaggccugcacg

SEQ ID NO: 2438364 - RNA, 14 nt, Bordetella pertussis
gggcugcccucgcc

SEQ ID NO: 2438365 - RNA, 22 nt, Bordetella pertussis
gggcugcccucgcccgugcgcg

SEQ ID NO: 2438366 - RNA, 13 nt, Bordetella pertussis
gggcugccggcag

SEQ ID NO: 2438367 - RNA, 18 nt, Bordetella pertussis
gggcugccguagcccagg

SEQ ID NO: 2438368 - RNA, 16 nt, Bordetella pertussis
gggcugcgaugcgggc

SEQ ID NO: 2438369 - RNA, 19 nt, Bordetella pertussis
gggcugcgcggguccggcg

SEQ ID NO: 2438370 - RNA, 21 nt, Bordetella pertussis
gggcugcggauacgaaaccag

SEQ ID NO: 2438371 - RNA, 12 nt, Bordetella pertussis
gggcugcggcgg

SEQ ID NO: 2438372 - RNA, 20 nt, Bordetella pertussis
gggcugcugcacgcgcgcgg

SEQ ID NO: 2438373 - RNA, 14 nt, Bordetella pertussis
gggcugcuggacgg

SEQ ID NO: 2438374 - RNA, 13 nt, Bordetella pertussis
gggcugcugggcc

SEQ ID NO: 2438375 - RNA, 18 nt, Bordetella pertussis
gggcugcugggccggcgc

SEQ ID NO: 2438376 - RNA, 19 nt, Bordetella pertussis
gggcuggagaacgagccgg

SEQ ID NO: 2438377 - RNA, 18 nt, Bordetella pertussis
gggcuggccgccgcggcc

SEQ ID NO: 2438378 - RNA, 16 nt, Bordetella pertussis
gggcuggccgccugcu

SEQ ID NO: 2438379 - RNA, 15 nt, Bordetella pertussis
gggcuggccggccaa

SEQ ID NO: 2438380 - RNA, 16 nt, Bordetella pertussis
gggcuggucagccugg

SEQ ID NO: 2438381 - RNA, 18 nt, Bordetella pertussis
gggcuggucgcgccgguc

SEQ ID NO: 2438382 - RNA, 14 nt, Bordetella pertussis
gggcuggugcgccg

SEQ ID NO: 2438383 - RNA, 14 nt, Bordetella pertussis
gggcuguccgccac

SEQ ID NO: 2438384 - RNA, 17 nt, Bordetella pertussis
gggcuguucgcgcagca

SEQ ID NO: 2438385 - RNA, 19 nt, Bordetella pertussis
gggcuuccaguucgcgcag

SEQ ID NO: 2438386 - RNA, 15 nt, Bordetella pertussis
gggcuugacgcgcgu

SEQ ID NO: 2438387 - RNA, 17 nt, Bordetella pertussis
gggcuugauggccagcg

SEQ ID NO: 2438388 - RNA, 24 nt, Bordetella pertussis
gggcuugauggccagcgcgcgggc

SEQ ID NO: 2438389 - RNA, 23 nt, Bordetella pertussis
gggcuugccguucaugccgacca

SEQ ID NO: 2438390 - RNA, 20 nt, Bordetella pertussis
gggcuugucgcugcgcaugg

SEQ ID NO: 2438391 - RNA, 23 nt, Bordetella pertussis
gggcuuuuugccuuggggcggcc

SEQ ID NO: 2438392 - RNA, 20 nt, Bordetella pertussis
gggcuuuuuguugcgcgccg

SEQ ID NO: 2438393 - RNA, 20 nt, Bordetella pertussis
ggggaaaagccggcggccgg

SEQ ID NO: 2438394 - RNA, 15 nt, Bordetella pertussis
ggggaaacggccaag

SEQ ID NO: 2438395 - RNA, 22 nt, Bordetella pertussis
ggggaaacggccaagcagcgcc

SEQ ID NO: 2438396 - RNA, 20 nt, Bordetella pertussis
ggggaacaggcgcgccagcc

SEQ ID NO: 2438397 - RNA, 23 nt, Bordetella pertussis
ggggaacaggcgcgccagccgcg

SEQ ID NO: 2438398 - RNA, 16 nt, Bordetella pertussis
ggggaaccgcaccgga

SEQ ID NO: 2438399 - RNA, 22 nt, Bordetella pertussis
ggggaagauguggucggcgccg

SEQ ID NO: 2438400 - RNA, 21 nt, Bordetella pertussis
ggggacaggcaccgaacccug

SEQ ID NO: 2438401 - RNA, 12 nt, Bordetella pertussis
ggggacaggcgc

SEQ ID NO: 2438402 - RNA, 19 nt, Bordetella pertussis
ggggacggcgcacccgcgg

SEQ ID NO: 2438403 - RNA, 13 nt, Bordetella pertussis
ggggacgggcgca

SEQ ID NO: 2438404 - RNA, 17 nt, Bordetella pertussis
ggggacuggcacccgca

SEQ ID NO: 2438405 - RNA, 17 nt, Bordetella pertussis
ggggacuggcaccggca

SEQ ID NO: 2438406 - RNA, 14 nt, Bordetella pertussis
ggggagcgcggccc

SEQ ID NO: 2438407 - RNA, 23 nt, Bordetella pertussis
ggggcaccuagcauaucggugcc

SEQ ID NO: 2438408 - RNA, 14 nt, Bordetella pertussis
ggggcagcaggccg

SEQ ID NO: 2438409 - RNA, 22 nt, Bordetella pertussis
ggggcagcaggccggcggcgau

SEQ ID NO: 2438410 - RNA, 22 nt, Bordetella pertussis
ggggcagccauccucgcccagc

SEQ ID NO: 2438411 - RNA, 18 nt, Bordetella pertussis
ggggcaggacgccggcgc

SEQ ID NO: 2438412 - RNA, 21 nt, Bordetella pertussis
ggggcaggacgccggcgccgg

SEQ ID NO: 2438413 - RNA, 13 nt, Bordetella pertussis
ggggcaggcacug

SEQ ID NO: 2438414 - RNA, 22 nt, Bordetella pertussis
ggggcaggccgauguagcccau

SEQ ID NO: 2438415 - RNA, 21 nt, Bordetella pertussis
ggggcaguuuccagggcuugc

SEQ ID NO: 2438416 - RNA, 21 nt, Bordetella pertussis
ggggcauggcgccgcgcgccg

SEQ ID NO: 2438417 - RNA, 13 nt, Bordetella pertussis
ggggccagccugg

SEQ ID NO: 2438418 - RNA, 14 nt, Bordetella pertussis
ggggccagccuggc

SEQ ID NO: 2438419 - RNA, 16 nt, Bordetella pertussis
ggggccagccuggccu

SEQ ID NO: 2438420 - RNA, 11 nt, Bordetella pertussis
ggggccaggcg

SEQ ID NO: 2438421 - RNA, 14 nt, Bordetella pertussis
ggggcccgcgggcg

SEQ ID NO: 2438422 - RNA, 18 nt, Bordetella pertussis
ggggcccgcgggcgcccg

SEQ ID NO: 2438423 - RNA, 21 nt, Bordetella pertussis
ggggcccgcgggcgcccggcc

SEQ ID NO: 2438424 - RNA, 23 nt, Bordetella pertussis
ggggccgauggucagcgugucgc

SEQ ID NO: 2438425 - RNA, 22 nt, Bordetella pertussis
ggggccgccaacgccaagcugc

SEQ ID NO: 2438426 - RNA, 16 nt, Bordetella pertussis
ggggccgcccagcacc

SEQ ID NO: 2438427 - RNA, 17 nt, Bordetella pertussis
ggggccgcccagcaccu

SEQ ID NO: 2438428 - RNA, 20 nt, Bordetella pertussis
ggggccgccucggcggccag

SEQ ID NO: 2438429 - RNA, 18 nt, Bordetella pertussis
ggggccgccuggaccuga

SEQ ID NO: 2438430 - RNA, 13 nt, Bordetella pertussis
ggggccgcgccgg

SEQ ID NO: 2438431 - RNA, 17 nt, Bordetella pertussis
ggggccgcggcgcgcgc

SEQ ID NO: 2438432 - RNA, 20 nt, Bordetella pertussis
ggggccgcuucggccugcgc

SEQ ID NO: 2438433 - RNA, 14 nt, Bordetella pertussis
ggggccggccgcgc

SEQ ID NO: 2438434 - RNA, 17 nt, Bordetella pertussis
ggggccggccgcgcgcg

SEQ ID NO: 2438435 - RNA, 15 nt, Bordetella pertussis
ggggcgagcgcagcc

SEQ ID NO: 2438436 - RNA, 13 nt, Bordetella pertussis
ggggcgagcgggc

SEQ ID NO: 2438437 - RNA, 18 nt, Bordetella pertussis
ggggcgcaucaugaggcg

SEQ ID NO: 2438438 - RNA, 20 nt, Bordetella pertussis
ggggcgcaucaugaggcggc

SEQ ID NO: 2438439 - RNA, 22 nt, Bordetella pertussis
ggggcgcccagcgcgucggcca

SEQ ID NO: 2438440 - RNA, 20 nt, Bordetella pertussis
ggggcgccccaacgcggcca

SEQ ID NO: 2438441 - RNA, 15 nt, Bordetella pertussis
gggucugcaggccga

SEQ ID NO: 2438442 - RNA, 12 nt, Bordetella pertussis
gggucugcccca

SEQ ID NO: 2438443 - RNA, 22 nt, Bordetella pertussis
gggucugccccauggccugggu

SEQ ID NO: 2438444 - RNA, 12 nt, Bordetella pertussis
gggucugcgcga

SEQ ID NO: 2438445 - RNA, 22 nt, Bordetella pertussis
gggucugcuggucgcgggccag

SEQ ID NO: 2438446 - RNA, 14 nt, Bordetella pertussis
gggucuggcggccg

SEQ ID NO: 2438447 - RNA, 15 nt, Bordetella pertussis
gggucuggcggccgg

SEQ ID NO: 2438448 - RNA, 15 nt, Bordetella pertussis
gggucuugccgcgca

SEQ ID NO: 2438449 - RNA, 18 nt, Bordetella pertussis
gggucuugccgcgcagcg

SEQ ID NO: 2438450 - RNA, 14 nt, Bordetella pertussis
gggugaggcgacgg

SEQ ID NO: 2438451 - RNA, 15 nt, Bordetella pertussis
gggugaggcgacggu

SEQ ID NO: 2438452 - RNA, 15 nt, Bordetella pertussis
gggugagugcccaug

SEQ ID NO: 2438453 - RNA, 19 nt, Bordetella pertussis
gggugaucacggccgucaa

SEQ ID NO: 2438454 - RNA, 20 nt, Bordetella pertussis
gggugcccaguucgcggccg

SEQ ID NO: 2438455 - RNA, 21 nt, Bordetella pertussis
gggugcccaguucgcggccgg

SEQ ID NO: 2438456 - RNA, 12 nt, Bordetella pertussis
gggugccccgcc

SEQ ID NO: 2438457 - RNA, 21 nt, Bordetella pertussis
gggugccguucggccagcgcg

SEQ ID NO: 2438458 - RNA, 13 nt, Bordetella pertussis
gggugccuguccc

SEQ ID NO: 2438459 - RNA, 20 nt, Bordetella pertussis
gggugccuguccccgcaggg

SEQ ID NO: 2438460 - RNA, 21 nt, Bordetella pertussis
gggugccuguccccgcgggga

SEQ ID NO: 2438461 - RNA, 19 nt, Bordetella pertussis
gggugccugucccggcugg

SEQ ID NO: 2438462 - RNA, 20 nt, Bordetella pertussis
gggugcgaggcgaacauggc

SEQ ID NO: 2438463 - RNA, 15 nt, Bordetella pertussis
gggugcuccugccag

SEQ ID NO: 2438464 - RNA, 15 nt, Bordetella pertussis
ggguggagcgcggcg

SEQ ID NO: 2438465 - RNA, 14 nt, Bordetella pertussis
ggguggccggcgcg

SEQ ID NO: 2438466 - RNA, 20 nt, Bordetella pertussis
ggguggcgccggccaccgcc

SEQ ID NO: 2438467 - RNA, 22 nt, Bordetella pertussis
ggguggucuuccaggcgcaggc

SEQ ID NO: 2438468 - RNA, 15 nt, Bordetella pertussis
ggguggugaagaacc

SEQ ID NO: 2438469 - RNA, 11 nt, Bordetella pertussis
gggugguggcc

SEQ ID NO: 2438470 - RNA, 18 nt, Bordetella pertussis
ggguguccuggucggcgc

SEQ ID NO: 2438471 - RNA, 20 nt, Bordetella pertussis
gggugucgacgcgaugcccg

SEQ ID NO: 2438472 - RNA, 17 nt, Bordetella pertussis
gggugucgccggggcgc

SEQ ID NO: 2438473 - RNA, 16 nt, Bordetella pertussis
gggugucgcuccccca

SEQ ID NO: 2438474 - RNA, 18 nt, Bordetella pertussis
gggugucgcucccccaug

SEQ ID NO: 2438475 - RNA, 12 nt, Bordetella pertussis
ggguuccacagc

SEQ ID NO: 2438476 - RNA, 22 nt, Bordetella pertussis
ggguuccacagcgccgaccgca

SEQ ID NO: 2438477 - RNA, 14 nt, Bordetella pertussis
ggguucgcagggcg

SEQ ID NO: 2438478 - RNA, 19 nt, Bordetella pertussis
ggguucgccgcugucgcag

SEQ ID NO: 2438479 - RNA, 20 nt, Bordetella pertussis
ggguucgcuggggcugccgg

SEQ ID NO: 2438480 - RNA, 20 nt, Bordetella pertussis
ggguucuguccggcgcuggc

SEQ ID NO: 2438481 - RNA, 20 nt, Bordetella pertussis
ggguugcaguucgccggcgc

SEQ ID NO: 2438482 - RNA, 21 nt, Bordetella pertussis
ggguugccaagauggcccagg

SEQ ID NO: 2438483 - RNA, 22 nt, Bordetella pertussis
ggguugccaagauggcccaggg

SEQ ID NO: 2438484 - RNA, 17 nt, Bordetella pertussis
ggguugccauucggugg

SEQ ID NO: 2438485 - RNA, 14 nt, Bordetella pertussis
ggguugcgcgccag

SEQ ID NO: 2438486 - RNA, 22 nt, Bordetella pertussis
ggguugcgcgccagcucgcgca

SEQ ID NO: 2438487 - RNA, 15 nt, Bordetella pertussis
ggguuggccuugcgc

SEQ ID NO: 2438488 - RNA, 18 nt, Bordetella pertussis
ggguugugggccgucaug

SEQ ID NO: 2438489 - RNA, 20 nt, Bordetella pertussis
ggguuuuuuuuugggaaggc

SEQ ID NO: 2438490 - RNA, 15 nt, Bordetella pertussis
gguaaagcgccggcc

SEQ ID NO: 2438491 - RNA, 18 nt, Bordetella pertussis
gguaaagcgccggcccgc

SEQ ID NO: 2438492 - RNA, 23 nt, Bordetella pertussis
gguaagcuggcgcuuggccagcu

SEQ ID NO: 2438493 - RNA, 21 nt, Bordetella pertussis
gguaaugacgcagccgcccgg

SEQ ID NO: 2438494 - RNA, 23 nt, Bordetella pertussis
gguacaacaucaaugacauggcc

SEQ ID NO: 2438495 - RNA, 24 nt, Bordetella pertussis
gguacaacaucaaugacauggcca

SEQ ID NO: 2438496 - RNA, 24 nt, Bordetella pertussis
gguacaccugacgcgaaaaucgcc

SEQ ID NO: 2438497 - RNA, 17 nt, Bordetella pertussis
gguacagccaggccagc

SEQ ID NO: 2438498 - RNA, 18 nt, Bordetella pertussis
gguacagccaggccagca

SEQ ID NO: 2438499 - RNA, 13 nt, Bordetella pertussis
gguacagccccag

SEQ ID NO: 2438500 - RNA, 19 nt, Bordetella pertussis
gguacagccccagcgccag

SEQ ID NO: 2438501 - RNA, 17 nt, Bordetella pertussis
gguacagcgcgcccgau

SEQ ID NO: 2438502 - RNA, 22 nt, Bordetella pertussis
gguacagcgcgcccgaugccuu

SEQ ID NO: 2438503 - RNA, 17 nt, Bordetella pertussis
gguacaggccggcggcg

SEQ ID NO: 2438504 - RNA, 21 nt, Bordetella pertussis
gguacaggucguagaccgccg

SEQ ID NO: 2438505 - RNA, 22 nt, Bordetella pertussis
gguacccaugcggggcggcggg

SEQ ID NO: 2438506 - RNA, 22 nt, Bordetella pertussis
gguacccccagcggcgcaccga

SEQ ID NO: 2438507 - RNA, 11 nt, Bordetella pertussis
gguacccgcgc

SEQ ID NO: 2438508 - RNA, 17 nt, Bordetella pertussis
gguacgacgagcgcacc

SEQ ID NO: 2438509 - RNA, 15 nt, Bordetella pertussis
gguacgcccagcugg

SEQ ID NO: 2438510 - RNA, 18 nt, Bordetella pertussis
gguacgcccagcugggcc

SEQ ID NO: 2438511 - RNA, 17 nt, Bordetella pertussis
gguacgcgcaguccgca

SEQ ID NO: 2438512 - RNA, 21 nt, Bordetella pertussis
gguacuccuugacgcgcgcgg

SEQ ID NO: 2438513 - RNA, 19 nt, Bordetella pertussis
gguagacaugcucgaugcc

SEQ ID NO: 2438514 - RNA, 13 nt, Bordetella pertussis
gguagacgaccga

SEQ ID NO: 2438515 - RNA, 19 nt, Bordetella pertussis
gguagaucagcgcgucggc

SEQ ID NO: 2438516 - RNA, 14 nt, Bordetella pertussis
gguagaugcgcgcg

SEQ ID NO: 2438517 - RNA, 17 nt, Bordetella pertussis
gguagaugcgcgcgacc

SEQ ID NO: 2438518 - RNA, 18 nt, Bordetella pertussis
gguagccgccgucgaugu

SEQ ID NO: 2438519 - RNA, 23 nt, Bordetella pertussis
gguagcgccucgcaucggccugc

SEQ ID NO: 2438520 - RNA, 19 nt, Bordetella pertussis
gguagcgguccagcugcgc

SEQ ID NO: 2438521 - RNA, 16 nt, Bordetella pertussis
gguagcggucgccgcg

SEQ ID NO: 2438522 - RNA, 18 nt, Bordetella pertussis
gguagcugaccgaagcgc

SEQ ID NO: 2438523 - RNA, 23 nt, Bordetella pertussis
gguagcugaccgaagcgcgggcg

SEQ ID NO: 2438524 - RNA, 22 nt, Bordetella pertussis
gguagcugcugacugugcagcc

SEQ ID NO: 2438525 - RNA, 19 nt, Bordetella pertussis
gguaggacggcagcaccgc

SEQ ID NO: 2438526 - RNA, 18 nt, Bordetella pertussis
gguaggcaaagcgcagca

SEQ ID NO: 2438527 - RNA, 21 nt, Bordetella pertussis
gguaggccacgcgcgggcugg

SEQ ID NO: 2438528 - RNA, 13 nt, Bordetella pertussis
gguaggcccagca

SEQ ID NO: 2438529 - RNA, 14 nt, Bordetella pertussis
gguaggccggcgcg

SEQ ID NO: 2438530 - RNA, 15 nt, Bordetella pertussis
gguaggcggcgcgcc

SEQ ID NO: 2438531 - RNA, 21 nt, Bordetella pertussis
gguaggcgggacuggcgagca

SEQ ID NO: 2438532 - RNA, 14 nt, Bordetella pertussis
gguagggcgcggcc

SEQ ID NO: 2438533 - RNA, 15 nt, Bordetella pertussis
gguaggugugagcgu

SEQ ID NO: 2438534 - RNA, 17 nt, Bordetella pertussis
gguaguaaucgcgcgcc

SEQ ID NO: 2438535 - RNA, 18 nt, Bordetella pertussis
gguaguaaucgcgcgcca

SEQ ID NO: 2438536 - RNA, 21 nt, Bordetella pertussis
gguagucgccggcuuccagca

SEQ ID NO: 2438537 - RNA, 15 nt, Bordetella pertussis
gguagugcggcgcca

SEQ ID NO: 2438538 - RNA, 17 nt, Bordetella pertussis
gguagugcggcgccagc

SEQ ID NO: 2438539 - RNA, 19 nt, Bordetella pertussis
gguagugcggcgccagcug

SEQ ID NO: 2438540 - RNA, 16 nt, Bordetella pertussis
gguaguucagcagcgc

SEQ ID NO: 2438541 - RNA, 19 nt, Bordetella pertussis
gguaguucagcagcgccac

SEQ ID NO: 2438542 - RNA, 14 nt, Bordetella pertussis
gguaguuggccagg

SEQ ID NO: 2438543 - RNA, 18 nt, Bordetella pertussis
gguauagaguugcucggg

SEQ ID NO: 2438544 - RNA, 22 nt, Bordetella pertussis
gguaucccaccugcagccagau

SEQ ID NO: 2438545 - RNA, 13 nt, Bordetella pertussis
gguauccggcgca

SEQ ID NO: 2438546 - RNA, 16 nt, Bordetella pertussis
gguauccggcgcacgc

SEQ ID NO: 2438547 - RNA, 14 nt, Bordetella pertussis
gguaucggccagca

SEQ ID NO: 2438548 - RNA, 17 nt, Bordetella pertussis
gguaucggccagcacgu

SEQ ID NO: 2438549 - RNA, 20 nt, Bordetella pertussis
gguaucggccgggccgggca

SEQ ID NO: 2438550 - RNA, 14 nt, Bordetella pertussis
gguaucgggcaaca

SEQ ID NO: 2438551 - RNA, 18 nt, Bordetella pertussis
gguaucgggcaacaaggc

SEQ ID NO: 2438552 - RNA, 21 nt, Bordetella pertussis
gguaucguucgcgcgcgcggu

SEQ ID NO: 2438553 - RNA, 18 nt, Bordetella pertussis
acggugccuugcggcgcc

SEQ ID NO: 2438554 - RNA, 20 nt, Bordetella pertussis
acggugccuugcggcgccgu

SEQ ID NO: 2438555 - RNA, 14 nt, Bordetella pertussis
acggugcgcacgau

SEQ ID NO: 2438556 - RNA, 14 nt, Bordetella pertussis
acggugcgcgccac

SEQ ID NO: 2438557 - RNA, 20 nt, Bordetella pertussis
acgguggauucggacgccuc

SEQ ID NO: 2438558 - RNA, 23 nt, Bordetella pertussis
acgguggauucggacgccucgcc

SEQ ID NO: 2438559 - RNA, 20 nt, Bordetella pertussis
acgguggcgaaggccgccgc

SEQ ID NO: 2438560 - RNA, 23 nt, Bordetella pertussis
acgguggcgaaggccgccgcgcc

SEQ ID NO: 2438561 - RNA, 13 nt, Bordetella pertussis
acgguggcgccgu

SEQ ID NO: 2438562 - RNA, 21 nt, Bordetella pertussis
acgguggcguaguagcccagg

SEQ ID NO: 2438563 - RNA, 12 nt, Bordetella pertussis
acggugggcagc

SEQ ID NO: 2438564 - RNA, 16 nt, Bordetella pertussis
acggugggcagcagca

SEQ ID NO: 2438565 - RNA, 17 nt, Bordetella pertussis
acggugggcagcagcac

SEQ ID NO: 2438566 - RNA, 20 nt, Bordetella pertussis
acggugggcagcagcacgcc

SEQ ID NO: 2438567 - RNA, 14 nt, Bordetella pertussis
acggugggcgacgc

SEQ ID NO: 2438568 - RNA, 19 nt, Bordetella pertussis
acgguggugucggcggcca

SEQ ID NO: 2438569 - RNA, 15 nt, Bordetella pertussis
acgguguugaccacc

SEQ ID NO: 2438570 - RNA, 12 nt, Bordetella pertussis
acgguguugcuc

SEQ ID NO: 2438571 - RNA, 24 nt, Bordetella pertussis
acgguucagcgcgccagcgcgcga

SEQ ID NO: 2438572 - RNA, 17 nt, Bordetella pertussis
acguaccaagccugcuu

SEQ ID NO: 2438573 - RNA, 15 nt, Bordetella pertussis
acguacucgccgucg

SEQ ID NO: 2438574 - RNA, 19 nt, Bordetella pertussis
acguacuucucgucgcgca

SEQ ID NO: 2438575 - RNA, 17 nt, Bordetella pertussis
acguagaaauacgcgcg

SEQ ID NO: 2438576 - RNA, 13 nt, Bordetella pertussis
acguagccggcca

SEQ ID NO: 2438577 - RNA, 14 nt, Bordetella pertussis
acguagcggaucgc

SEQ ID NO: 2438578 - RNA, 17 nt, Bordetella pertussis
acguaggcaaagcgcgg

SEQ ID NO: 2438579 - RNA, 16 nt, Bordetella pertussis
acguaguacagcagca

SEQ ID NO: 2438580 - RNA, 17 nt, Bordetella pertussis
acguaguacagcagcag

SEQ ID NO: 2438581 - RNA, 23 nt, Bordetella pertussis
acguaguugguggcaggcgccca

SEQ ID NO: 2438582 - RNA, 16 nt, Bordetella pertussis
acgucaaggccugccc

SEQ ID NO: 2438583 - RNA, 22 nt, Bordetella pertussis
acgucaccccgcccugcccggc

SEQ ID NO: 2438584 - RNA, 19 nt, Bordetella pertussis
acgucaguccguggcgcgg

SEQ ID NO: 2438585 - RNA, 12 nt, Bordetella pertussis
acgucaucgugg

SEQ ID NO: 2438586 - RNA, 13 nt, Bordetella pertussis
acgucaucguggc

SEQ ID NO: 2438587 - RNA, 18 nt, Bordetella pertussis
acgucaucguggccgcgc

SEQ ID NO: 2438588 - RNA, 14 nt, Bordetella pertussis
acgucauggccgau

SEQ ID NO: 2438589 - RNA, 18 nt, Bordetella pertussis
acgucauugcaucgcagc

SEQ ID NO: 2438590 - RNA, 12 nt, Bordetella pertussis
acguccagccag

SEQ ID NO: 2438591 - RNA, 14 nt, Bordetella pertussis
acguccagcgccac

SEQ ID NO: 2438592 - RNA, 15 nt, Bordetella pertussis
acguccagcgccacc

SEQ ID NO: 2438593 - RNA, 21 nt, Bordetella pertussis
acguccagcgccaccagcagc

SEQ ID NO: 2438594 - RNA, 16 nt, Bordetella pertussis
acguccagcgccgcgc

SEQ ID NO: 2438595 - RNA, 17 nt, Bordetella pertussis
acguccagcggcgcgac

SEQ ID NO: 2438596 - RNA, 21 nt, Bordetella pertussis
acguccccaccuccaccucga

SEQ ID NO: 2438597 - RNA, 23 nt, Bordetella pertussis
acgucgaauuccaguugcgcgcc

SEQ ID NO: 2438598 - RNA, 17 nt, Bordetella pertussis
acgucgaccucgagcac

SEQ ID NO: 2438599 - RNA, 23 nt, Bordetella pertussis
acgucgacguugcgcgacaggcc

SEQ ID NO: 2438600 - RNA, 21 nt, Bordetella pertussis
acgucgcccuggauggcggcc

SEQ ID NO: 2438601 - RNA, 18 nt, Bordetella pertussis
acgucggccucgcgcagg

SEQ ID NO: 2438602 - RNA, 20 nt, Bordetella pertussis
acgucggcgauggcccggua

SEQ ID NO: 2438603 - RNA, 15 nt, Bordetella pertussis
acgucggcggccgcc

SEQ ID NO: 2438604 - RNA, 20 nt, Bordetella pertussis
acgucgguggugaccacggc

SEQ ID NO: 2438605 - RNA, 14 nt, Bordetella pertussis
acgucguaccccga

SEQ ID NO: 2438606 - RNA, 15 nt, Bordetella pertussis
acgucguagcgcugc

SEQ ID NO: 2438607 - RNA, 17 nt, Bordetella pertussis
acgucguagugcgcgcc

SEQ ID NO: 2438608 - RNA, 20 nt, Bordetella pertussis
acgucguagugcgcgccgcu

SEQ ID NO: 2438609 - RNA, 23 nt, Bordetella pertussis
acgucgucgaugaugacgaccuu

SEQ ID NO: 2438610 - RNA, 17 nt, Bordetella pertussis
acgucgucgaugccgac

SEQ ID NO: 2438611 - RNA, 17 nt, Bordetella pertussis
acgucgucgguggggca

SEQ ID NO: 2438612 - RNA, 14 nt, Bordetella pertussis
acgucuugcugccg

SEQ ID NO: 2438613 - RNA, 15 nt, Bordetella pertussis
acgugaagcgccgcg

SEQ ID NO: 2438614 - RNA, 16 nt, Bordetella pertussis
acgugccggauggcgc

SEQ ID NO: 2438615 - RNA, 17 nt, Bordetella pertussis
acgugccggauggcgcg

SEQ ID NO: 2438616 - RNA, 22 nt, Bordetella pertussis
acgugccggccgccuccaggcg

SEQ ID NO: 2438617 - RNA, 19 nt, Bordetella pertussis
acgugccgucgggcgccgc

SEQ ID NO: 2438618 - RNA, 12 nt, Bordetella pertussis
acgugcgcgcca

SEQ ID NO: 2438619 - RNA, 14 nt, Bordetella pertussis
acgugcgcgccagc

SEQ ID NO: 2438620 - RNA, 18 nt, Bordetella pertussis
acgugcgcgccagcucuu

SEQ ID NO: 2438621 - RNA, 21 nt, Bordetella pertussis
acgugcggcagggccuccugc

SEQ ID NO: 2438622 - RNA, 22 nt, Bordetella pertussis
acgugcugaccgacgugcgccg

SEQ ID NO: 2438623 - RNA, 13 nt, Bordetella pertussis
acgugcugcugca

SEQ ID NO: 2438624 - RNA, 14 nt, Bordetella pertussis
acgugcugcugcac

SEQ ID NO: 2438625 - RNA, 18 nt, Bordetella pertussis
acgugcugcugcacguga

SEQ ID NO: 2438626 - RNA, 15 nt, Bordetella pertussis
acguggacaggcacc

SEQ ID NO: 2438627 - RNA, 22 nt, Bordetella pertussis
acguggacucgauggcgcaggc

SEQ ID NO: 2438628 - RNA, 20 nt, Bordetella pertussis
acguggauggcuuuggcgaa

SEQ ID NO: 2438629 - RNA, 19 nt, Bordetella pertussis
acguggcaguccucguugc

SEQ ID NO: 2438630 - RNA, 15 nt, Bordetella pertussis
acguggccccaggcg

SEQ ID NO: 2438631 - RNA, 20 nt, Bordetella pertussis
acguggcccgcgugacggcc

SEQ ID NO: 2438632 - RNA, 22 nt, Bordetella pertussis
acguggcccgcgugacggccgc

SEQ ID NO: 2438633 - RNA, 22 nt, Bordetella pertussis
acguggccugcuugaagacgcc

SEQ ID NO: 2438634 - RNA, 13 nt, Bordetella pertussis
acguggcgcggcu

SEQ ID NO: 2438635 - RNA, 12 nt, Bordetella pertussis
acguggcggcga

SEQ ID NO: 2438636 - RNA, 16 nt, Bordetella pertussis
acguggcguccacgcg

SEQ ID NO: 2438637 - RNA, 18 nt, Bordetella pertussis
acguggcguccacgcggg

SEQ ID NO: 2438638 - RNA, 17 nt, Bordetella pertussis
ggucaucaccagggugg

SEQ ID NO: 2438639 - RNA, 19 nt, Bordetella pertussis
ggucaucaccaggguggcg

SEQ ID NO: 2438640 - RNA, 13 nt, Bordetella pertussis
ggucaucacgcgg

SEQ ID NO: 2438641 - RNA, 22 nt, Bordetella pertussis
ggucaucacgcggucgaugcgc

SEQ ID NO: 2438642 - RNA, 16 nt, Bordetella pertussis
ggucaucgagguggcg

SEQ ID NO: 2438643 - RNA, 14 nt, Bordetella pertussis
ggucaucgaugcgc

SEQ ID NO: 2438644 - RNA, 13 nt, Bordetella pertussis
ggucaucgccagg

SEQ ID NO: 2438645 - RNA, 15 nt, Bordetella pertussis
ggucaucgccaggcg

SEQ ID NO: 2438646 - RNA, 18 nt, Bordetella pertussis
ggucaucgccaggcgcgu

SEQ ID NO: 2438647 - RNA, 12 nt, Bordetella pertussis
ggucaucgccau

SEQ ID NO: 2438648 - RNA, 14 nt, Bordetella pertussis
ggucaucgccaugc

SEQ ID NO: 2438649 - RNA, 17 nt, Bordetella pertussis
ggucaucgccaugcugc

SEQ ID NO: 2438650 - RNA, 22 nt, Bordetella pertussis
ggucaucgcgcuggcgguggcc

SEQ ID NO: 2438651 - RNA, 14 nt, Bordetella pertussis
ggucaugacgggcg

SEQ ID NO: 2438652 - RNA, 20 nt, Bordetella pertussis
ggucaugacgggcggcggcg

SEQ ID NO: 2438653 - RNA, 18 nt, Bordetella pertussis
ggucaugcccaugccgcc

SEQ ID NO: 2438654 - RNA, 22 nt, Bordetella pertussis
ggucaugcccaugccgccaugc

SEQ ID NO: 2438655 - RNA, 21 nt, Bordetella pertussis
ggucauguccagcgccaggcc

SEQ ID NO: 2438656 - RNA, 23 nt, Bordetella pertussis
gguccaccaccuucagggcgccg

SEQ ID NO: 2438657 - RNA, 17 nt, Bordetella pertussis
gguccaccucgucgucc

SEQ ID NO: 2438658 - RNA, 23 nt, Bordetella pertussis
gguccaccucgucguccagcguc

SEQ ID NO: 2438659 - RNA, 23 nt, Bordetella pertussis
gguccacgcccuggcuggcggcc

SEQ ID NO: 2438660 - RNA, 12 nt, Bordetella pertussis
gguccacgccgg

SEQ ID NO: 2438661 - RNA, 19 nt, Bordetella pertussis
gguccacggcauggccagc

SEQ ID NO: 2438662 - RNA, 20 nt, Bordetella pertussis
gguccacggcauggccagcu

SEQ ID NO: 2438663 - RNA, 23 nt, Bordetella pertussis
gguccagcaaaugggccgcagcg

SEQ ID NO: 2438664 - RNA, 15 nt, Bordetella pertussis
gguccagcaaggcgu

SEQ ID NO: 2438665 - RNA, 21 nt, Bordetella pertussis
gguccagcaaggcgucgaagc

SEQ ID NO: 2438666 - RNA, 15 nt, Bordetella pertussis
ggucgcgcuggcccg

SEQ ID NO: 2438667 - RNA, 17 nt, Bordetella pertussis
ggucgcgcugggucagg

SEQ ID NO: 2438668 - RNA, 15 nt, Bordetella pertussis
ggucgcggccgaggc

SEQ ID NO: 2438669 - RNA, 20 nt, Bordetella pertussis
ggucgcggccgaggccagcg

SEQ ID NO: 2438670 - RNA, 16 nt, Bordetella pertussis
ggucgcgggccaggcc

SEQ ID NO: 2438671 - RNA, 19 nt, Bordetella pertussis
ggucgcgggccaggccggc

SEQ ID NO: 2438672 - RNA, 15 nt, Bordetella pertussis
ggucgcggugcgcca

SEQ ID NO: 2438673 - RNA, 17 nt, Bordetella pertussis
ggucgcugcccagcaug

SEQ ID NO: 2438674 - RNA, 21 nt, Bordetella pertussis
ggucgcuguagcgcagccccg

SEQ ID NO: 2438675 - RNA, 17 nt, Bordetella pertussis
ggucgcugugcgcggcg

SEQ ID NO: 2438676 - RNA, 16 nt, Bordetella pertussis
ggucgcuuccagcgca

SEQ ID NO: 2438677 - RNA, 20 nt, Bordetella pertussis
ggucggaaacacguccagcg

SEQ ID NO: 2438678 - RNA, 12 nt, Bordetella pertussis
ggucggacgcgc

SEQ ID NO: 2438679 - RNA, 13 nt, Bordetella pertussis
ggucggacgcgcc

SEQ ID NO: 2438680 - RNA, 18 nt, Bordetella pertussis
ggucggacgcgccgggcg

SEQ ID NO: 2438681 - RNA, 14 nt, Bordetella pertussis
ggucggagucggcg

SEQ ID NO: 2438682 - RNA, 17 nt, Bordetella pertussis
ggucggagucggcgccg

SEQ ID NO: 2438683 - RNA, 19 nt, Bordetella pertussis
ggucggagucggcgccgcg

SEQ ID NO: 2438684 - RNA, 20 nt, Bordetella pertussis
ggucggagucggcgccgcgc

SEQ ID NO: 2438685 - RNA, 23 nt, Bordetella pertussis
ggucggagucggcgccgcgcagc

SEQ ID NO: 2438686 - RNA, 23 nt, Bordetella pertussis
ggucggauagaguucggcgcggc

SEQ ID NO: 2438687 - RNA, 22 nt, Bordetella pertussis
ggucggcacgucgggcaggaug

SEQ ID NO: 2438688 - RNA, 15 nt, Bordetella pertussis
ggucggcaugucgau

SEQ ID NO: 2438689 - RNA, 17 nt, Bordetella pertussis
ggucggccaccaccagg

SEQ ID NO: 2438690 - RNA, 14 nt, Bordetella pertussis
ggucggccagccgg

SEQ ID NO: 2438691 - RNA, 12 nt, Bordetella pertussis
ggucggccagcg

SEQ ID NO: 2438692 - RNA, 16 nt, Bordetella pertussis
ggucggccgcuccgcc

SEQ ID NO: 2438693 - RNA, 17 nt, Bordetella pertussis
ggucggccgcuccgcca

SEQ ID NO: 2438694 - RNA, 13 nt, Bordetella pertussis
ggucggccggcag

SEQ ID NO: 2438695 - RNA, 14 nt, Bordetella pertussis
ggucggcgaacagc

SEQ ID NO: 2438696 - RNA, 15 nt, Bordetella pertussis
ggucggcgaccgugc

SEQ ID NO: 2438697 - RNA, 19 nt, Bordetella pertussis
ggucggcgaugcgcggggc

SEQ ID NO: 2438698 - RNA, 21 nt, Bordetella pertussis
ggucggcgaugcgcggggccg

SEQ ID NO: 2438699 - RNA, 19 nt, Bordetella pertussis
ggucggcgcaauccccgcu

SEQ ID NO: 2438700 - RNA, 15 nt, Bordetella pertussis
ggucggcgcccacgc

SEQ ID NO: 2438701 - RNA, 12 nt, Bordetella pertussis
ggucggcgccga

SEQ ID NO: 2438702 - RNA, 15 nt, Bordetella pertussis
ggucggcgcggcgcc

SEQ ID NO: 2438703 - RNA, 18 nt, Bordetella pertussis
ggucggcgcggcgccguc

SEQ ID NO: 2438704 - RNA, 14 nt, Bordetella pertussis
ggucggcgcggggc

SEQ ID NO: 2438705 - RNA, 15 nt, Bordetella pertussis
ggucggcgcggggca

SEQ ID NO: 2438706 - RNA, 12 nt, Bordetella pertussis
ggucggcgcgua

SEQ ID NO: 2438707 - RNA, 18 nt, Bordetella pertussis
ggucggcggccagcgcgc

SEQ ID NO: 2438708 - RNA, 22 nt, Bordetella pertussis
ggucggcuugauaugggcgagc

SEQ ID NO: 2438709 - RNA, 23 nt, Bordetella pertussis
ggucggcuugauaugggcgagca

SEQ ID NO: 2438710 - RNA, 16 nt, Bordetella pertussis
ggucgggccgcgcgcg

SEQ ID NO: 2438711 - RNA, 17 nt, Bordetella pertussis
ggucgggcgugagcgcc

SEQ ID NO: 2438712 - RNA, 14 nt, Bordetella pertussis
ggucggguagcugc

SEQ ID NO: 2438713 - RNA, 22 nt, Bordetella pertussis
ggucguacagcgccugcgcggc

SEQ ID NO: 2438714 - RNA, 23 nt, Bordetella pertussis
ggucguacagcgccugcgcggcg

SEQ ID NO: 2438715 - RNA, 20 nt, Bordetella pertussis
ggucguagaccgccgcgccc

SEQ ID NO: 2438716 - RNA, 21 nt, Bordetella pertussis
ggucguagaccgccgcgccca

SEQ ID NO: 2438717 - RNA, 23 nt, Bordetella pertussis
ggucguaguauccgacgcguucg

SEQ ID NO: 2438718 - RNA, 14 nt, Bordetella pertussis
ggucgucagcgccg

SEQ ID NO: 2438719 - RNA, 16 nt, Bordetella pertussis
ggucgucagcgccgcg

SEQ ID NO: 2438720 - RNA, 12 nt, Bordetella pertussis
ggucgucgagcc

SEQ ID NO: 2438721 - RNA, 17 nt, Bordetella pertussis
ggucgucgagccgggcc

SEQ ID NO: 2438722 - RNA, 13 nt, Bordetella pertussis
ggucgucgcggcc

SEQ ID NO: 2438723 - RNA, 17 nt, Bordetella pertussis
ggucgucgcggcccugg

SEQ ID NO: 2438724 - RNA, 14 nt, Bordetella pertussis
ggucgucggccacg

SEQ ID NO: 2438725 - RNA, 18 nt, Bordetella pertussis
ggucgucgggcggcgcga

SEQ ID NO: 2438726 - RNA, 23 nt, Bordetella pertussis
ggucgucgggcggcgcgaacggc

SEQ ID NO: 2438727 - RNA, 23 nt, Bordetella pertussis
ggucgugcggcacgcacagcaug

SEQ ID NO: 2438728 - RNA, 18 nt, Bordetella pertussis
ggucguggccagcguauu

SEQ ID NO: 2438729 - RNA, 17 nt, Bordetella pertussis
ggucguggcccagccgg

SEQ ID NO: 2438730 - RNA, 19 nt, Bordetella pertussis
ggucguggcugaccagcag

SEQ ID NO: 2438731 - RNA, 18 nt, Bordetella pertussis
ggucguguagcugugaac

SEQ ID NO: 2438732 - RNA, 20 nt, Bordetella pertussis
ggucguuccagaacggcgcg

SEQ ID NO: 2438733 - RNA, 16 nt, Bordetella pertussis
ggucguuggucggguu

SEQ ID NO: 2438734 - RNA, 14 nt, Bordetella pertussis
ggucucagaccauc

SEQ ID NO: 2438735 - RNA, 13 nt, Bordetella pertussis
ggucuccagcgcg

SEQ ID NO: 2438736 - RNA, 18 nt, Bordetella pertussis
ggucuccagcgcgucggc

SEQ ID NO: 2438737 - RNA, 23 nt, Bordetella pertussis
ggucucccggcaugauggcccgg

SEQ ID NO: 2438738 - RNA, 11 nt, Bordetella pertussis
ggucucggcca

SEQ ID NO: 2438739 - RNA, 12 nt, Bordetella pertussis
ggucucggcguc

SEQ ID NO: 2438740 - RNA, 18 nt, Bordetella pertussis
ggucucguagaccggcac

SEQ ID NO: 2438741 - RNA, 23 nt, Bordetella pertussis
ggucugcaagguggcgugcagca

SEQ ID NO: 2438742 - RNA, 18 nt, Bordetella pertussis
ggucugcacgccgggcgc

SEQ ID NO: 2438743 - RNA, 15 nt, Bordetella pertussis
ggucugcaggccgaa

SEQ ID NO: 2438744 - RNA, 23 nt, Bordetella pertussis
ggucugccccauggccugggugc

SEQ ID NO: 2438745 - RNA, 18 nt, Bordetella pertussis
ggucugccguuccagcug

SEQ ID NO: 2438746 - RNA, 13 nt, Bordetella pertussis
ggucugcuucauc

SEQ ID NO: 2438747 - RNA, 18 nt, Bordetella pertussis
ggucuggcccacgcgcac

SEQ ID NO: 2438748 - RNA, 23 nt, Bordetella pertussis
ggucuggccggugaugcggcgcg

SEQ ID NO: 2438749 - RNA, 14 nt, Bordetella pertussis
ggucugggccagca

SEQ ID NO: 2438750 - RNA, 16 nt, Bordetella pertussis
ggucuggucgcacgac

SEQ ID NO: 2438751 - RNA, 20 nt, Bordetella pertussis
ggucugguuuuucgaagagc

SEQ ID NO: 2438752 - RNA, 18 nt, Bordetella pertussis
ggucuucacauagcccgg

SEQ ID NO: 2438753 - RNA, 20 nt, Bordetella pertussis
ggucuucacauagcccggcg

SEQ ID NO: 2438754 - RNA, 22 nt, Bordetella pertussis
ggucuucacauagcccggcgcg

SEQ ID NO: 2438755 - RNA, 21 nt, Bordetella pertussis
ggucuuccaggcgcaggcgcg

SEQ ID NO: 2438756 - RNA, 13 nt, Bordetella pertussis
ggucuucgagcgc

SEQ ID NO: 2438757 - RNA, 15 nt, Bordetella pertussis
ggugaaacagcauca

SEQ ID NO: 2438758 - RNA, 23 nt, Bordetella pertussis
ggugaaacagcaucagcggcagc

SEQ ID NO: 2438759 - RNA, 17 nt, Bordetella pertussis
ggugaaagccgccggcg

SEQ ID NO: 2438760 - RNA, 19 nt, Bordetella pertussis
ggugaacggccccgccagg

SEQ ID NO: 2438761 - RNA, 16 nt, Bordetella pertussis
ggugaagaaccgccgc

SEQ ID NO: 2438762 - RNA, 19 nt, Bordetella pertussis
ggugaaggcgcccgggcug

SEQ ID NO: 2438763 - RNA, 16 nt, Bordetella pertussis
ggugaccaccaggccg

SEQ ID NO: 2438764 - RNA, 16 nt, Bordetella pertussis
ggugaccacggcgcgc

SEQ ID NO: 2438765 - RNA, 18 nt, Bordetella pertussis
ggugaccacggcgcgccc

SEQ ID NO: 2438766 - RNA, 22 nt, Bordetella pertussis
ggugaccacggcgcgcccgcag

SEQ ID NO: 2438767 - RNA, 17 nt, Bordetella pertussis
ggugaccaugucgccgu

SEQ ID NO: 2438768 - RNA, 14 nt, Bordetella pertussis
ggugaccggcguga

SEQ ID NO: 2438769 - RNA, 19 nt, Bordetella pertussis
ggugaccggcgugacgcgc

SEQ ID NO: 2438770 - RNA, 14 nt, Bordetella pertussis
ggugaccuggcgcg

SEQ ID NO: 2438771 - RNA, 22 nt, Bordetella pertussis
ggugaccuggggguucgugggc

SEQ ID NO: 2438772 - RNA, 23 nt, Bordetella pertussis
ggugaccuggggguucgugggcg

SEQ ID NO: 2438773 - RNA, 14 nt, Bordetella pertussis
ggugaccuuggucg

SEQ ID NO: 2438774 - RNA, 14 nt, Bordetella pertussis
ggugacgcccugcc

SEQ ID NO: 2438775 - RNA, 18 nt, Bordetella pertussis
ggugacgcuggagcgcgg

SEQ ID NO: 2438776 - RNA, 22 nt, Bordetella pertussis
ggugacgcuggagcgcggcggc

SEQ ID NO: 2438777 - RNA, 16 nt, Bordetella pertussis
ggugacggcguagccg

SEQ ID NO: 2438778 - RNA, 21 nt, Bordetella pertussis
ggugacgggcugggccgaggc

SEQ ID NO: 2438779 - RNA, 13 nt, Bordetella pertussis
ggugcgcgacagc

SEQ ID NO: 2438780 - RNA, 15 nt, Bordetella pertussis
ggugcgcgcagggcg

SEQ ID NO: 2438781 - RNA, 20 nt, Bordetella pertussis
ggugcgcgcagggcggccgg

SEQ ID NO: 2438782 - RNA, 22 nt, Bordetella pertussis
ggugcgcgcagggcggccggca

SEQ ID NO: 2438783 - RNA, 20 nt, Bordetella pertussis
ggugcgcgccacauccugca

SEQ ID NO: 2438784 - RNA, 14 nt, Bordetella pertussis
ggugcgcgccacgg

SEQ ID NO: 2438785 - RNA, 17 nt, Bordetella pertussis
ggugcgcgccacggcgu

SEQ ID NO: 2438786 - RNA, 22 nt, Bordetella pertussis
ggugcgcgccacggcgucgccg

SEQ ID NO: 2438787 - RNA, 13 nt, Bordetella pertussis
ggugcgcgcgccc

SEQ ID NO: 2438788 - RNA, 12 nt, Bordetella pertussis
ggugcgcgcggc

SEQ ID NO: 2438789 - RNA, 13 nt, Bordetella pertussis
ggugcgcgcggcc

SEQ ID NO: 2438790 - RNA, 17 nt, Bordetella pertussis
ggugcgcgcggccgagg

SEQ ID NO: 2438791 - RNA, 17 nt, Bordetella pertussis
ggugcgcggcuugcagc

SEQ ID NO: 2438792 - RNA, 18 nt, Bordetella pertussis
ggugcgcguccugggccg

SEQ ID NO: 2438793 - RNA, 14 nt, Bordetella pertussis
ggugcgcgugggca

SEQ ID NO: 2438794 - RNA, 14 nt, Bordetella pertussis
ggugcggaggcggc

SEQ ID NO: 2438795 - RNA, 22 nt, Bordetella pertussis
ggugcggaggcggccgcgggcg

SEQ ID NO: 2438796 - RNA, 15 nt, Bordetella pertussis
ggugcggaucacggg

SEQ ID NO: 2438797 - RNA, 20 nt, Bordetella pertussis
ggugcggccaugauacccau

SEQ ID NO: 2438798 - RNA, 12 nt, Bordetella pertussis
ggugcggccgca

SEQ ID NO: 2438799 - RNA, 15 nt, Bordetella pertussis
ggugcggccgcagcg

SEQ ID NO: 2438800 - RNA, 23 nt, Bordetella pertussis
ggugcggccucggcgggcggcgc

SEQ ID NO: 2438801 - RNA, 23 nt, Bordetella pertussis
ggugcggcgccacugccaggcgc

SEQ ID NO: 2438802 - RNA, 14 nt, Bordetella pertussis
ggugcgggagccgg

SEQ ID NO: 2438803 - RNA, 14 nt, Bordetella pertussis
ggugcgggccgcgc

SEQ ID NO: 2438804 - RNA, 16 nt, Bordetella pertussis
ggugcgggccgcgcug

SEQ ID NO: 2438805 - RNA, 14 nt, Bordetella pertussis
ggugcgggccggcg

SEQ ID NO: 2438806 - RNA, 16 nt, Bordetella pertussis
ggugcgggccggcgcg

SEQ ID NO: 2438807 - RNA, 19 nt, Bordetella pertussis
ggugcggggugccuguccc

SEQ ID NO: 2438808 - RNA, 15 nt, Bordetella pertussis
ggugcgggugggcgc

SEQ ID NO: 2438809 - RNA, 21 nt, Bordetella pertussis
ggugcgggugggcgcgccgcg

SEQ ID NO: 2438810 - RNA, 23 nt, Bordetella pertussis
ggugcgguaggcgcccgacggcg

SEQ ID NO: 2438811 - RNA, 21 nt, Bordetella pertussis
ggugcgguugcgaggcggccu

SEQ ID NO: 2438812 - RNA, 22 nt, Bordetella pertussis
ggugcgguugcgaggcggccuu

SEQ ID NO: 2438813 - RNA, 13 nt, Bordetella pertussis
ggugcguaccagc

SEQ ID NO: 2438814 - RNA, 14 nt, Bordetella pertussis
ggugcguccaggac

SEQ ID NO: 2438815 - RNA, 17 nt, Bordetella pertussis
ggugcgugcgcccaugg

SEQ ID NO: 2438816 - RNA, 22 nt, Bordetella pertussis
ggugcucaaccucgacgcgcau

SEQ ID NO: 2438817 - RNA, 15 nt, Bordetella pertussis
ggugcuccugccagg

SEQ ID NO: 2438818 - RNA, 15 nt, Bordetella pertussis
ggugcucggccagcg

SEQ ID NO: 2438819 - RNA, 16 nt, Bordetella pertussis
ggugcucuggcccgcc

SEQ ID NO: 2438820 - RNA, 14 nt, Bordetella pertussis
ggugcugaacgccu

SEQ ID NO: 2438821 - RNA, 18 nt, Bordetella pertussis
ggugcugcagcgcaccac

SEQ ID NO: 2438822 - RNA, 14 nt, Bordetella pertussis
ggugcugccgccga

SEQ ID NO: 2438823 - RNA, 20 nt, Bordetella pertussis
ggugcugccgcugcccaccu

SEQ ID NO: 2438824 - RNA, 15 nt, Bordetella pertussis
ggugcugcgggucga

SEQ ID NO: 2438825 - RNA, 19 nt, Bordetella pertussis
ggugcugcucaacggccac

SEQ ID NO: 2438826 - RNA, 21 nt, Bordetella pertussis
ggugcugcucaacggccacca

SEQ ID NO: 2438827 - RNA, 20 nt, Bordetella pertussis
ggugcugcugggcgccaugc

SEQ ID NO: 2438828 - RNA, 16 nt, Bordetella pertussis
ggugcugggcggcggg

SEQ ID NO: 2438829 - RNA, 16 nt, Bordetella pertussis
ggugcugggcuuugcc

SEQ ID NO: 2438830 - RNA, 15 nt, Bordetella pertussis
ggugcugggucauca

SEQ ID NO: 2438831 - RNA, 19 nt, Bordetella pertussis
ggugcugggucaucagcac

SEQ ID NO: 2438832 - RNA, 18 nt, Bordetella pertussis
ggugcuguuucgcgagga

SEQ ID NO: 2438833 - RNA, 16 nt, Bordetella pertussis
ggugcuugaugcccag

SEQ ID NO: 2438834 - RNA, 18 nt, Bordetella pertussis
ggugcuugaugcccagcu

SEQ ID NO: 2438835 - RNA, 16 nt, Bordetella pertussis
gguggaaaugccggcg

SEQ ID NO: 2438836 - RNA, 17 nt, Bordetella pertussis
gguggaaaugccggcgg

SEQ ID NO: 2438837 - RNA, 18 nt, Bordetella pertussis
gguggaaaugccggcggc

SEQ ID NO: 2438838 - RNA, 19 nt, Bordetella pertussis
gguggaaaugccggcggcg

SEQ ID NO: 2438839 - RNA, 13 nt, Bordetella pertussis
gguggacacgccc

SEQ ID NO: 2438840 - RNA, 13 nt, Bordetella pertussis
gguggacagcgcc

SEQ ID NO: 2438841 - RNA, 16 nt, Bordetella pertussis
gguggacagcgccagc

SEQ ID NO: 2438842 - RNA, 21 nt, Bordetella pertussis
gguggaccugccguucgcgcu

SEQ ID NO: 2438843 - RNA, 18 nt, Bordetella pertussis
gguggagcgcggcgcugg

SEQ ID NO: 2438844 - RNA, 15 nt, Bordetella pertussis
gguggauucggacgc

SEQ ID NO: 2438845 - RNA, 22 nt, Bordetella pertussis
gguggcagagggcgacggcggc

SEQ ID NO: 2438846 - RNA, 23 nt, Bordetella pertussis
gguggcagagggcgacggcggcg

SEQ ID NO: 2438847 - RNA, 16 nt, Bordetella pertussis
gguggccaccagcccc

SEQ ID NO: 2438848 - RNA, 13 nt, Bordetella pertussis
gguggccacgccc

SEQ ID NO: 2438849 - RNA, 14 nt, Bordetella pertussis
gguggccagcgccu

SEQ ID NO: 2438850 - RNA, 19 nt, Bordetella pertussis
gguggccagcugcguggcg

SEQ ID NO: 2438851 - RNA, 17 nt, Bordetella pertussis
gguggccgccgcgcgcc

SEQ ID NO: 2438852 - RNA, 22 nt, Bordetella pertussis
gguggccgcgcaugccagcuug

SEQ ID NO: 2438853 - RNA, 11 nt, Bordetella pertussis
gguggccgcgg

SEQ ID NO: 2438854 - RNA, 19 nt, Bordetella pertussis
gguggccgcgguccgggcc

SEQ ID NO: 2438855 - RNA, 21 nt, Bordetella pertussis
gguggccgcuccagagcgcgc

SEQ ID NO: 2438856 - RNA, 17 nt, Bordetella pertussis
gguggccggcgcgcggc

SEQ ID NO: 2438857 - RNA, 12 nt, Bordetella pertussis
gguggccucgcc

SEQ ID NO: 2438858 - RNA, 23 nt, Bordetella pertussis
gguggccuggguggccagcugcg

SEQ ID NO: 2438859 - RNA, 17 nt, Bordetella pertussis
gguggcgaucaguuccu

SEQ ID NO: 2438860 - RNA, 13 nt, Bordetella pertussis
gguggcgccaugu

SEQ ID NO: 2438861 - RNA, 19 nt, Bordetella pertussis
gguggcgccggccaccgcc

SEQ ID NO: 2438862 - RNA, 19 nt, Bordetella pertussis
gguggcgcgcaacacgcgc

SEQ ID NO: 2438863 - RNA, 16 nt, Bordetella pertussis
gguggcgcucgcgccc

SEQ ID NO: 2438864 - RNA, 17 nt, Bordetella pertussis
gguggcggacaggcccu

SEQ ID NO: 2438865 - RNA, 12 nt, Bordetella pertussis
gguggcggcggc

SEQ ID NO: 2438866 - RNA, 12 nt, Bordetella pertussis
gguggcgggcgc

SEQ ID NO: 2438867 - RNA, 14 nt, Bordetella pertussis
gguggcgggcgugc

SEQ ID NO: 2438868 - RNA, 14 nt, Bordetella pertussis
gguggcggggcgca

SEQ ID NO: 2438869 - RNA, 18 nt, Bordetella pertussis
gguggcguguccgccgua

SEQ ID NO: 2438870 - RNA, 15 nt, Bordetella pertussis
gguggcugcgcaggu

SEQ ID NO: 2438871 - RNA, 17 nt, Bordetella pertussis
gguggcuggggcuggca

SEQ ID NO: 2438872 - RNA, 14 nt, Bordetella pertussis
gguggcuggugcca

SEQ ID NO: 2438873 - RNA, 22 nt, Bordetella pertussis
ggugggaaucggcaccucggcg

SEQ ID NO: 2438874 - RNA, 22 nt, Bordetella pertussis
ggugggauccucgcugccggcg

SEQ ID NO: 2438875 - RNA, 17 nt, Bordetella pertussis
ggugggcacgcgcgcgg

SEQ ID NO: 2438876 - RNA, 19 nt, Bordetella pertussis
ggugggcagcagcacgccc

SEQ ID NO: 2438877 - RNA, 17 nt, Bordetella pertussis
ggugggcagcgcgucga

SEQ ID NO: 2438878 - RNA, 15 nt, Bordetella pertussis
ggugggcauccagcg

SEQ ID NO: 2438879 - RNA, 17 nt, Bordetella pertussis
ggugggcauccagcggc

SEQ ID NO: 2438880 - RNA, 21 nt, Bordetella pertussis
ggugggcgaaccgcggcgcag

SEQ ID NO: 2438881 - RNA, 22 nt, Bordetella pertussis
ggugggcgaaccgcggcgcagg

SEQ ID NO: 2438882 - RNA, 24 nt, Bordetella pertussis
ggugggcgaugcauucggcggccg

SEQ ID NO: 2438883 - RNA, 16 nt, Bordetella pertussis
ggugggcgcgccgcga

SEQ ID NO: 2438884 - RNA, 19 nt, Bordetella pertussis
ggugggcgcgcucagcgcc

SEQ ID NO: 2438885 - RNA, 14 nt, Bordetella pertussis
ggugggcggcagca

SEQ ID NO: 2438886 - RNA, 13 nt, Bordetella pertussis
gguggggcagcag

SEQ ID NO: 2438887 - RNA, 16 nt, Bordetella pertussis
gguggguguggccaug

SEQ ID NO: 2438888 - RNA, 15 nt, Bordetella pertussis
gguggguucgggcgu

SEQ ID NO: 2438889 - RNA, 20 nt, Bordetella pertussis
gguggguuggccuugcgcgu

SEQ ID NO: 2438890 - RNA, 15 nt, Bordetella pertussis
gguggucagcauggu

SEQ ID NO: 2438891 - RNA, 21 nt, Bordetella pertussis
gguggucaucgaugcgccgca

SEQ ID NO: 2438892 - RNA, 13 nt, Bordetella pertussis
guacagccccagc

SEQ ID NO: 2438893 - RNA, 19 nt, Bordetella pertussis
guacagccgccuggcgcgg

SEQ ID NO: 2438894 - RNA, 20 nt, Bordetella pertussis
guacagccgccuggcgcggc

SEQ ID NO: 2438895 - RNA, 11 nt, Bordetella pertussis
guacagccgcg

SEQ ID NO: 2438896 - RNA, 17 nt, Bordetella pertussis
guacagcgccugcgcgg

SEQ ID NO: 2438897 - RNA, 11 nt, Bordetella pertussis
guacagcgcgc

SEQ ID NO: 2438898 - RNA, 13 nt, Bordetella pertussis
guacagcgcgccc

SEQ ID NO: 2438899 - RNA, 16 nt, Bordetella pertussis
guacaggccgccgguc

SEQ ID NO: 2438900 - RNA, 22 nt, Bordetella pertussis
guacaggccgccggucacugcc

SEQ ID NO: 2438901 - RNA, 15 nt, Bordetella pertussis
guacaggccggcggc

SEQ ID NO: 2438902 - RNA, 16 nt, Bordetella pertussis
guacaggccggcggcg

SEQ ID NO: 2438903 - RNA, 23 nt, Bordetella pertussis
guacaggccggcggcgagcgcgg

SEQ ID NO: 2438904 - RNA, 16 nt, Bordetella pertussis
guacaggcgcggcacg

SEQ ID NO: 2438905 - RNA, 22 nt, Bordetella pertussis
guacaggcgcguggcgcccagc

SEQ ID NO: 2438906 - RNA, 15 nt, Bordetella pertussis
guacaggcugccguc

SEQ ID NO: 2438907 - RNA, 20 nt, Bordetella pertussis
guacaggcugccgucggcca

SEQ ID NO: 2438908 - RNA, 21 nt, Bordetella pertussis
guacaggcugccgucggccag

SEQ ID NO: 2438909 - RNA, 16 nt, Bordetella pertussis
guacaucauccccagc

SEQ ID NO: 2438910 - RNA, 23 nt, Bordetella pertussis
guacauggccagguacaggccgc

SEQ ID NO: 2438911 - RNA, 14 nt, Bordetella pertussis
guaccaauacagga

SEQ ID NO: 2438912 - RNA, 21 nt, Bordetella pertussis
guaccaauacaggaagcgcug

SEQ ID NO: 2438913 - RNA, 23 nt, Bordetella pertussis
guaccaauacaggaagcgcuggc

SEQ ID NO: 2438914 - RNA, 19 nt, Bordetella pertussis
guaccacaguucggccagc

SEQ ID NO: 2438915 - RNA, 20 nt, Bordetella pertussis
guaccagaugagacacggca

SEQ ID NO: 2438916 - RNA, 13 nt, Bordetella pertussis
guaccagcccagc

SEQ ID NO: 2438917 - RNA, 24 nt, Bordetella pertussis
guaccagcccaguugcuggcccag

SEQ ID NO: 2438918 - RNA, 16 nt, Bordetella pertussis
guaccaggcagccggc

SEQ ID NO: 2438919 - RNA, 18 nt, Bordetella pertussis
guaccaggcagccggccc

SEQ ID NO: 2438920 - RNA, 13 nt, Bordetella pertussis
guaccaggcggcg

SEQ ID NO: 2438921 - RNA, 23 nt, Bordetella pertussis
guaccaguacaccggcgugcaga

SEQ ID NO: 2438922 - RNA, 23 nt, Bordetella pertussis
guacccaguacgagaacgcgucg

SEQ ID NO: 2438923 - RNA, 15 nt, Bordetella pertussis
guacccaugcggggc

SEQ ID NO: 2438924 - RNA, 17 nt, Bordetella pertussis
guacccaugcggggcgg

SEQ ID NO: 2438925 - RNA, 14 nt, Bordetella pertussis
guacccccagcggc

SEQ ID NO: 2438926 - RNA, 19 nt, Bordetella pertussis
guacccggcuucuggguca

SEQ ID NO: 2438927 - RNA, 23 nt, Bordetella pertussis
guacccggugcagcguggcgcgg

SEQ ID NO: 2438928 - RNA, 17 nt, Bordetella pertussis
guaccgccgccugcgcg

SEQ ID NO: 2438929 - RNA, 14 nt, Bordetella pertussis
guaccgggcggucc

SEQ ID NO: 2438930 - RNA, 17 nt, Bordetella pertussis
guaccguacccgcgccg

SEQ ID NO: 2438931 - RNA, 23 nt, Bordetella pertussis
guaccucagccugcuggugcugg

SEQ ID NO: 2438932 - RNA, 16 nt, Bordetella pertussis
guaccugcagcaggcg

SEQ ID NO: 2438933 - RNA, 15 nt, Bordetella pertussis
guacgaagcaaacag

SEQ ID NO: 2438934 - RNA, 14 nt, Bordetella pertussis
guacgacagcaagg

SEQ ID NO: 2438935 - RNA, 22 nt, Bordetella pertussis
guacgacgagcgcaccauggcg

SEQ ID NO: 2438936 - RNA, 20 nt, Bordetella pertussis
guacgacgccgugcugaucg

SEQ ID NO: 2438937 - RNA, 14 nt, Bordetella pertussis
guacgacggccggg

SEQ ID NO: 2438938 - RNA, 15 nt, Bordetella pertussis
guacgacggccgggg

SEQ ID NO: 2438939 - RNA, 16 nt, Bordetella pertussis
guacgacggccggggc

SEQ ID NO: 2438940 - RNA, 15 nt, Bordetella pertussis
guacgacggggugcc

SEQ ID NO: 2438941 - RNA, 22 nt, Bordetella pertussis
guacgagaacgcgucgcucaug

SEQ ID NO: 2438942 - RNA, 11 nt, Bordetella pertussis
guacgaggacc

SEQ ID NO: 2438943 - RNA, 22 nt, Bordetella pertussis
guacgaggaccuguggcgcacc

SEQ ID NO: 2438944 - RNA, 23 nt, Bordetella pertussis
guacgaggcauacaggcuguggc

SEQ ID NO: 2438945 - RNA, 16 nt, Bordetella pertussis
guacgauagcggauga

SEQ ID NO: 2438946 - RNA, 20 nt, Bordetella pertussis
guacgauagcggaugauggg

SEQ ID NO: 2438947 - RNA, 21 nt, Bordetella pertussis
guacgaucaggcggcgcggcg

SEQ ID NO: 2438948 - RNA, 14 nt, Bordetella pertussis
guacgcaccgccgc

SEQ ID NO: 2438949 - RNA, 18 nt, Bordetella pertussis
guacgcaucggcgccggc

SEQ ID NO: 2438950 - RNA, 17 nt, Bordetella pertussis
guacgccacuuccuugc

SEQ ID NO: 2438951 - RNA, 14 nt, Bordetella pertussis
guacgcccggccgc

SEQ ID NO: 2438952 - RNA, 15 nt, Bordetella pertussis
guacgccggccugac

SEQ ID NO: 2438953 - RNA, 21 nt, Bordetella pertussis
guacgcuuaucgcggcgcggc

SEQ ID NO: 2438954 - RNA, 18 nt, Bordetella pertussis
guacggcgaugccggcgc

SEQ ID NO: 2438955 - RNA, 20 nt, Bordetella pertussis
guacggcgaugccggcgcug

SEQ ID NO: 2438956 - RNA, 11 nt, Bordetella pertussis
guacggcgcgg

SEQ ID NO: 2438957 - RNA, 16 nt, Bordetella pertussis
guacggcgcggugccu

SEQ ID NO: 2438958 - RNA, 14 nt, Bordetella pertussis
guacggcugcacca

SEQ ID NO: 2438959 - RNA, 14 nt, Bordetella pertussis
guacguaccaggcc

SEQ ID NO: 2438960 - RNA, 15 nt, Bordetella pertussis
guacguaccaggccg

SEQ ID NO: 2438961 - RNA, 14 nt, Bordetella pertussis
guacguacgcccgg

SEQ ID NO: 2438962 - RNA, 15 nt, Bordetella pertussis
guacguacgcccggc

SEQ ID NO: 2438963 - RNA, 18 nt, Bordetella pertussis
guacguacugccauggcc

SEQ ID NO: 2438964 - RNA, 14 nt, Bordetella pertussis
guacgucaaggccu

SEQ ID NO: 2438965 - RNA, 19 nt, Bordetella pertussis
guacgucaaggccugcccg

SEQ ID NO: 2438966 - RNA, 23 nt, Bordetella pertussis
guacgucggacagggccccggcc

SEQ ID NO: 2438967 - RNA, 15 nt, Bordetella pertussis
guacguggccccagg

SEQ ID NO: 2438968 - RNA, 18 nt, Bordetella pertussis
guacguggccccaggcgu

SEQ ID NO: 2438969 - RNA, 22 nt, Bordetella pertussis
guacuacaguaugggcugucgc

SEQ ID NO: 2438970 - RNA, 22 nt, Bordetella pertussis
guacuccaucuguucggcgccg

SEQ ID NO: 2438971 - RNA, 22 nt, Bordetella pertussis
guacuccuaucuuucgggcgcg

SEQ ID NO: 2438972 - RNA, 20 nt, Bordetella pertussis
guacuccuugacgcgcgcgg

SEQ ID NO: 2438973 - RNA, 15 nt, Bordetella pertussis
guacucgaucgccau

SEQ ID NO: 2438974 - RNA, 16 nt, Bordetella pertussis
guacucgccggcgcug

SEQ ID NO: 2438975 - RNA, 17 nt, Bordetella pertussis
guacucgccggucgcgg

SEQ ID NO: 2438976 - RNA, 15 nt, Bordetella pertussis
guacucgcugcgcgg

SEQ ID NO: 2438977 - RNA, 21 nt, Bordetella pertussis
guacucguacgaagcaaacag

SEQ ID NO: 2438978 - RNA, 16 nt, Bordetella pertussis
guacucguacgaggca

SEQ ID NO: 2438979 - RNA, 22 nt, Bordetella pertussis
guacugccauggccccgggcgg

SEQ ID NO: 2438980 - RNA, 13 nt, Bordetella pertussis
guacugcugcaag

SEQ ID NO: 2438981 - RNA, 11 nt, Bordetella pertussis
guacuggcgcg

SEQ ID NO: 2438982 - RNA, 21 nt, Bordetella pertussis
guacuggcgcggcggccaggc

SEQ ID NO: 2438983 - RNA, 22 nt, Bordetella pertussis
guacuggcgcggcggccaggcg

SEQ ID NO: 2438984 - RNA, 22 nt, Bordetella pertussis
guacugguaccaggcggcgacg

SEQ ID NO: 2438985 - RNA, 23 nt, Bordetella pertussis
guacugguaccaggcggcgacga

SEQ ID NO: 2438986 - RNA, 16 nt, Bordetella pertussis
guacuggugggccgac

SEQ ID NO: 2438987 - RNA, 15 nt, Bordetella pertussis
guacuuggcgauggc

SEQ ID NO: 2438988 - RNA, 22 nt, Bordetella pertussis
guacuuggcgauggccgccagc

SEQ ID NO: 2438989 - RNA, 13 nt, Bordetella pertussis
guagaacgccagg

SEQ ID NO: 2438990 - RNA, 16 nt, Bordetella pertussis
guagaccaccagcagg

SEQ ID NO: 2438991 - RNA, 21 nt, Bordetella pertussis
guagaccaccagcaggaugga

SEQ ID NO: 2438992 - RNA, 15 nt, Bordetella pertussis
guagaccacgcgcug

SEQ ID NO: 2438993 - RNA, 20 nt, Bordetella pertussis
guagaccugcgggccgcaca

SEQ ID NO: 2438994 - RNA, 17 nt, Bordetella pertussis
guagacgcagccgcagu

SEQ ID NO: 2438995 - RNA, 19 nt, Bordetella pertussis
guagagcaggccgcccagc

SEQ ID NO: 2438996 - RNA, 14 nt, Bordetella pertussis
guagagcgccgcgu

SEQ ID NO: 2438997 - RNA, 16 nt, Bordetella pertussis
guagagcgccgcgugg

SEQ ID NO: 2438998 - RNA, 23 nt, Bordetella pertussis
guagagcgccgcgugguggcgca

SEQ ID NO: 2438999 - RNA, 18 nt, Bordetella pertussis
guagagcugcggcgcggc

SEQ ID NO: 2439000 - RNA, 14 nt, Bordetella pertussis
guagaggcgcggcu

SEQ ID NO: 2439001 - RNA, 22 nt, Bordetella pertussis
guagaucagccgcugcagcacg

SEQ ID NO: 2439002 - RNA, 17 nt, Bordetella pertussis
guagauccaggcggcca

SEQ ID NO: 2439003 - RNA, 16 nt, Bordetella pertussis
guagaugggcaggccc

SEQ ID NO: 2439004 - RNA, 17 nt, Bordetella pertussis
guagcaggcgcgcucag

SEQ ID NO: 2439005 - RNA, 21 nt, Bordetella pertussis
guaucugucccggcggggaca

SEQ ID NO: 2439006 - RNA, 16 nt, Bordetella pertussis
guaugaccggcgcggc

SEQ ID NO: 2439007 - RNA, 19 nt, Bordetella pertussis
guaugcaccgggccgaaca

SEQ ID NO: 2439008 - RNA, 17 nt, Bordetella pertussis
guaugcacgaccaggcc

SEQ ID NO: 2439009 - RNA, 17 nt, Bordetella pertussis
guaugcacgaugccguc

SEQ ID NO: 2439010 - RNA, 23 nt, Bordetella pertussis
guaugcacgaugccgucgccgcc

SEQ ID NO: 2439011 - RNA, 14 nt, Bordetella pertussis
guaugcccacuccc

SEQ ID NO: 2439012 - RNA, 16 nt, Bordetella pertussis
guaugccugccagccc

SEQ ID NO: 2439013 - RNA, 17 nt, Bordetella pertussis
guaugcggcagcagggc

SEQ ID NO: 2439014 - RNA, 22 nt, Bordetella pertussis
guaugcggcgcccaggcccagc

SEQ ID NO: 2439015 - RNA, 18 nt, Bordetella pertussis
guauggcccgccaccacg

SEQ ID NO: 2439016 - RNA, 14 nt, Bordetella pertussis
guauggcggcgccg

SEQ ID NO: 2439017 - RNA, 17 nt, Bordetella pertussis
guauggcugcaccugcc

SEQ ID NO: 2439018 - RNA, 16 nt, Bordetella pertussis
guaugguuggccacga

SEQ ID NO: 2439019 - RNA, 18 nt, Bordetella pertussis
guauucagugcgacggau

SEQ ID NO: 2439020 - RNA, 21 nt, Bordetella pertussis
guauuccaucuugccggccug

SEQ ID NO: 2439021 - RNA, 20 nt, Bordetella pertussis
guauucgaaggcagcaccgc

SEQ ID NO: 2439022 - RNA, 15 nt, Bordetella pertussis
guauucgcgcuggcg

SEQ ID NO: 2439023 - RNA, 19 nt, Bordetella pertussis
guauucgggaugggccacc

SEQ ID NO: 2439024 - RNA, 19 nt, Bordetella pertussis
guauugcaugaccgccggc

SEQ ID NO: 2439025 - RNA, 15 nt, Bordetella pertussis
guauugcuccacagg

SEQ ID NO: 2439026 - RNA, 12 nt, Bordetella pertussis
guauugcugcug

SEQ ID NO: 2439027 - RNA, 17 nt, Bordetella pertussis
guauugugcaugcgcgc

SEQ ID NO: 2439028 - RNA, 17 nt, Bordetella pertussis
gucaaccacgccaagga

SEQ ID NO: 2439029 - RNA, 16 nt, Bordetella pertussis
gucaacccgucgacgc

SEQ ID NO: 2439030 - RNA, 17 nt, Bordetella pertussis
gucaagcagcgccggcu

SEQ ID NO: 2439031 - RNA, 20 nt, Bordetella pertussis
gucaagcagcgccggcuggg

SEQ ID NO: 2439032 - RNA, 17 nt, Bordetella pertussis
gucaagccagcggcgcg

SEQ ID NO: 2439033 - RNA, 14 nt, Bordetella pertussis
gucaagcgucgaug

SEQ ID NO: 2439034 - RNA, 21 nt, Bordetella pertussis
gucaaggccugcccgggcacc

SEQ ID NO: 2439035 - RNA, 14 nt, Bordetella pertussis
gucaaggcggggcu

SEQ ID NO: 2439036 - RNA, 13 nt, Bordetella pertussis
gucaagggcggcc

SEQ ID NO: 2439037 - RNA, 15 nt, Bordetella pertussis
gucaaguccggcgcc

SEQ ID NO: 2439038 - RNA, 16 nt, Bordetella pertussis
gucaaguccggcgccg

SEQ ID NO: 2439039 - RNA, 19 nt, Bordetella pertussis
gucaauagguuguauucgu

SEQ ID NO: 2439040 - RNA, 18 nt, Bordetella pertussis
gucaauccgccgccagca

SEQ ID NO: 2439041 - RNA, 19 nt, Bordetella pertussis
gucaauccgccgccagcac

SEQ ID NO: 2439042 - RNA, 21 nt, Bordetella pertussis
gucaaugccagucgccgcggu

SEQ ID NO: 2439043 - RNA, 14 nt, Bordetella pertussis
gucaaugcggcggc

SEQ ID NO: 2439044 - RNA, 15 nt, Bordetella pertussis
gucaaugcggcggcg

SEQ ID NO: 2439045 - RNA, 19 nt, Bordetella pertussis
gucaaugcggcggcgcugg

SEQ ID NO: 2439046 - RNA, 22 nt, Bordetella pertussis
gucacaccccaccacgucgcgg

SEQ ID NO: 2439047 - RNA, 19 nt, Bordetella pertussis
gucacacugucgccacggg

SEQ ID NO: 2439048 - RNA, 21 nt, Bordetella pertussis
gucaccacccgcacgccggcc

SEQ ID NO: 2439049 - RNA, 12 nt, Bordetella pertussis
gucaccagcagg

SEQ ID NO: 2439050 - RNA, 13 nt, Bordetella pertussis
gucaccagcaggc

SEQ ID NO: 2439051 - RNA, 16 nt, Bordetella pertussis
gucaccagcaggcggc

SEQ ID NO: 2439052 - RNA, 18 nt, Bordetella pertussis
gucaccccgcccugcccg

SEQ ID NO: 2439053 - RNA, 21 nt, Bordetella pertussis
gucaccccgcccugcccggcg

SEQ ID NO: 2439054 - RNA, 16 nt, Bordetella pertussis
gucaccccugcgcugc

SEQ ID NO: 2439055 - RNA, 19 nt, Bordetella pertussis
gucacccgccgcaccagcc

SEQ ID NO: 2439056 - RNA, 16 nt, Bordetella pertussis
gucaccgacgccagca

SEQ ID NO: 2439057 - RNA, 19 nt, Bordetella pertussis
gucaccgagaggaaauggu

SEQ ID NO: 2439058 - RNA, 23 nt, Bordetella pertussis
gucaccgagcugagcaccagcag

SEQ ID NO: 2439059 - RNA, 17 nt, Bordetella pertussis
gucaccgccgccgcgcc

SEQ ID NO: 2439060 - RNA, 20 nt, Bordetella pertussis
gucaccuugggaucguccca

SEQ ID NO: 2439061 - RNA, 17 nt, Bordetella pertussis
gucacgcccaggcgcug

SEQ ID NO: 2439062 - RNA, 19 nt, Bordetella pertussis
gucacgccgaugaccaggg

SEQ ID NO: 2439063 - RNA, 17 nt, Bordetella pertussis
gucacgcugguggccac

SEQ ID NO: 2439064 - RNA, 15 nt, Bordetella pertussis
gucacggaucagccg

SEQ ID NO: 2439065 - RNA, 22 nt, Bordetella pertussis
gucacggcaagacggcgcucgg

SEQ ID NO: 2439066 - RNA, 16 nt, Bordetella pertussis
gucacggucuggccca

SEQ ID NO: 2439067 - RNA, 19 nt, Bordetella pertussis
gucacggucuggcccacgc

SEQ ID NO: 2439068 - RNA, 19 nt, Bordetella pertussis
gucacguacucgccgucga

SEQ ID NO: 2439069 - RNA, 21 nt, Bordetella pertussis
gucacguucagcgccggcaug

SEQ ID NO: 2439070 - RNA, 20 nt, Bordetella pertussis
gucacguucgaccugccgcc

SEQ ID NO: 2439071 - RNA, 20 nt, Bordetella pertussis
gucacugccgaaacgcuggc

SEQ ID NO: 2439072 - RNA, 23 nt, Bordetella pertussis
gucacugccgaaacgcuggcgua

SEQ ID NO: 2439073 - RNA, 16 nt, Bordetella pertussis
gucagaacgacgaucu

SEQ ID NO: 2439074 - RNA, 13 nt, Bordetella pertussis
gucagacgcgcuu

SEQ ID NO: 2439075 - RNA, 22 nt, Bordetella pertussis
gucagcaaccccagcagcgccg

SEQ ID NO: 2439076 - RNA, 18 nt, Bordetella pertussis
gucagcacaucgcccggc

SEQ ID NO: 2439077 - RNA, 20 nt, Bordetella pertussis
gucagcaccucggcgcccag

SEQ ID NO: 2439078 - RNA, 22 nt, Bordetella pertussis
gucagcacgaacgacacccggu

SEQ ID NO: 2439079 - RNA, 19 nt, Bordetella pertussis
gucagcacgcccuggcuga

SEQ ID NO: 2439080 - RNA, 22 nt, Bordetella pertussis
gucagcacgcccuggcugagcg

SEQ ID NO: 2439081 - RNA, 18 nt, Bordetella pertussis
gucagcacuugccggccg

SEQ ID NO: 2439082 - RNA, 19 nt, Bordetella pertussis
gucagcacuugccggccgc

SEQ ID NO: 2439083 - RNA, 20 nt, Bordetella pertussis
gucagcacuugccggccgcc

SEQ ID NO: 2439084 - RNA, 13 nt, Bordetella pertussis
gucagcagcacgc

SEQ ID NO: 2439085 - RNA, 14 nt, Bordetella pertussis
gucagcagggcgcc

SEQ ID NO: 2439086 - RNA, 17 nt, Bordetella pertussis
gucagcagggcgccgac

SEQ ID NO: 2439087 - RNA, 19 nt, Bordetella pertussis
gucagcagggcgccgacga

SEQ ID NO: 2439088 - RNA, 19 nt, Bordetella pertussis
gucagcaucagcagacccu

SEQ ID NO: 2439089 - RNA, 21 nt, Bordetella pertussis
gucagcaugaagcugcccagc

SEQ ID NO: 2439090 - RNA, 15 nt, Bordetella pertussis
gucagcccgccaucg

SEQ ID NO: 2439091 - RNA, 17 nt, Bordetella pertussis
gucagcccgccaucgcg

SEQ ID NO: 2439092 - RNA, 21 nt, Bordetella pertussis
gucagccguucauggcguaga

SEQ ID NO: 2439093 - RNA, 15 nt, Bordetella pertussis
gucagccugggcgcc

SEQ ID NO: 2439094 - RNA, 22 nt, Bordetella pertussis
gucagccugggcgccuggcugc

SEQ ID NO: 2439095 - RNA, 14 nt, Bordetella pertussis
gucagccuggggca

SEQ ID NO: 2439096 - RNA, 16 nt, Bordetella pertussis
gucagcgaaaugccga

SEQ ID NO: 2439097 - RNA, 22 nt, Bordetella pertussis
gucagcgcaaacgggggcaggc

SEQ ID NO: 2439098 - RNA, 23 nt, Bordetella pertussis
gucagcgcaaacgggggcaggcc

SEQ ID NO: 2439099 - RNA, 14 nt, Bordetella pertussis
gucagcgccagggu

SEQ ID NO: 2439100 - RNA, 14 nt, Bordetella pertussis
gucagcgccgacga

SEQ ID NO: 2439101 - RNA, 12 nt, Bordetella pertussis
gucagcgccgcg

SEQ ID NO: 2439102 - RNA, 17 nt, Bordetella pertussis
gucagcgccgcgaugcg

SEQ ID NO: 2439103 - RNA, 13 nt, Bordetella pertussis
gucagcgccggca

SEQ ID NO: 2439104 - RNA, 14 nt, Bordetella pertussis
gucagcgccggcac

SEQ ID NO: 2439105 - RNA, 15 nt, Bordetella pertussis
gucagcgcggcgcac

SEQ ID NO: 2439106 - RNA, 16 nt, Bordetella pertussis
gucagcgcggcgcaca

SEQ ID NO: 2439107 - RNA, 19 nt, Bordetella pertussis
gucagcgcggcgccggccu

SEQ ID NO: 2439108 - RNA, 23 nt, Bordetella pertussis
gucagcggccggcccgugcgcaa

SEQ ID NO: 2439109 - RNA, 13 nt, Bordetella pertussis
gucagcggcgcgc

SEQ ID NO: 2439110 - RNA, 14 nt, Bordetella pertussis
gucagcggcgcgcc

SEQ ID NO: 2439111 - RNA, 15 nt, Bordetella pertussis
gucagcggcgcgccc

SEQ ID NO: 2439112 - RNA, 19 nt, Bordetella pertussis
gucagcggcuucgagcgcg

SEQ ID NO: 2439113 - RNA, 16 nt, Bordetella pertussis
gucagcgugcgccccg

SEQ ID NO: 2439114 - RNA, 23 nt, Bordetella pertussis
gucagcucaagaagaagccgggc

SEQ ID NO: 2439115 - RNA, 19 nt, Bordetella pertussis
gucagcucgaucaggcgcu

SEQ ID NO: 2439116 - RNA, 18 nt, Bordetella pertussis
gucagcucgucgccgcug

SEQ ID NO: 2439117 - RNA, 18 nt, Bordetella pertussis
gucagcugggcaugcacg

SEQ ID NO: 2439118 - RNA, 14 nt, Bordetella pertussis
guccacgcccagcg

SEQ ID NO: 2439119 - RNA, 19 nt, Bordetella pertussis
guccacgcccagcgccggc

SEQ ID NO: 2439120 - RNA, 22 nt, Bordetella pertussis
guccacgcccagcgccggcacg

SEQ ID NO: 2439121 - RNA, 13 nt, Bordetella pertussis
guccacgcccugg

SEQ ID NO: 2439122 - RNA, 14 nt, Bordetella pertussis
guccacgccgaagu

SEQ ID NO: 2439123 - RNA, 17 nt, Bordetella pertussis
guccacgccgaaguggc

SEQ ID NO: 2439124 - RNA, 14 nt, Bordetella pertussis
guccacgcgggugg

SEQ ID NO: 2439125 - RNA, 14 nt, Bordetella pertussis
guccacggcaucgg

SEQ ID NO: 2439126 - RNA, 18 nt, Bordetella pertussis
guccacggcaucggccag

SEQ ID NO: 2439127 - RNA, 13 nt, Bordetella pertussis
guccacggcaugg

SEQ ID NO: 2439128 - RNA, 14 nt, Bordetella pertussis
guccacggcauggc

SEQ ID NO: 2439129 - RNA, 20 nt, Bordetella pertussis
guccacggcauggccagcuu

SEQ ID NO: 2439130 - RNA, 17 nt, Bordetella pertussis
guccacggucgccggca

SEQ ID NO: 2439131 - RNA, 16 nt, Bordetella pertussis
guccacgucgucgaug

SEQ ID NO: 2439132 - RNA, 22 nt, Bordetella pertussis
guccacugaaagaaccgccuuc

SEQ ID NO: 2439133 - RNA, 19 nt, Bordetella pertussis
guccagcaccagggcgcgc

SEQ ID NO: 2439134 - RNA, 21 nt, Bordetella pertussis
guccagcaccagggcgcgcag

SEQ ID NO: 2439135 - RNA, 23 nt, Bordetella pertussis
guccagcaccagggcgcgcagca

SEQ ID NO: 2439136 - RNA, 14 nt, Bordetella pertussis
guccagcaccggcu

SEQ ID NO: 2439137 - RNA, 17 nt, Bordetella pertussis
guccagcaccggcugcc

SEQ ID NO: 2439138 - RNA, 18 nt, Bordetella pertussis
guccagcaccggcugcca

SEQ ID NO: 2439139 - RNA, 23 nt, Bordetella pertussis
guccagcaccggcugccagggcc

SEQ ID NO: 2439140 - RNA, 17 nt, Bordetella pertussis
guccagcacggccgcgg

SEQ ID NO: 2439141 - RNA, 20 nt, Bordetella pertussis
guccagcacggccgcggccg

SEQ ID NO: 2439142 - RNA, 22 nt, Bordetella pertussis
guccagcacggccgcggccggc

SEQ ID NO: 2439143 - RNA, 23 nt, Bordetella pertussis
guccagcacggcgaggaugccgc

SEQ ID NO: 2439144 - RNA, 17 nt, Bordetella pertussis
guccagcagcagcgccg

SEQ ID NO: 2439145 - RNA, 12 nt, Bordetella pertussis
guccagcagcgu

SEQ ID NO: 2439146 - RNA, 13 nt, Bordetella pertussis
guccagcagcgug

SEQ ID NO: 2439147 - RNA, 17 nt, Bordetella pertussis
guccagcaggauggcga

SEQ ID NO: 2439148 - RNA, 18 nt, Bordetella pertussis
guccagccccacgccgac

SEQ ID NO: 2439149 - RNA, 18 nt, Bordetella pertussis
guccagccccugcccguc

SEQ ID NO: 2439150 - RNA, 12 nt, Bordetella pertussis
guccagccgagc

SEQ ID NO: 2439151 - RNA, 16 nt, Bordetella pertussis
guccagccugcccggg

SEQ ID NO: 2439152 - RNA, 20 nt, Bordetella pertussis
guccagccugcccgggcagc

SEQ ID NO: 2439153 - RNA, 20 nt, Bordetella pertussis
guccagcgacucggucagca

SEQ ID NO: 2439154 - RNA, 13 nt, Bordetella pertussis
guccagcgccacc

SEQ ID NO: 2439155 - RNA, 19 nt, Bordetella pertussis
guccagcgccaccagcagc

SEQ ID NO: 2439156 - RNA, 20 nt, Bordetella pertussis
guccagcgccaccagcagcg

SEQ ID NO: 2439157 - RNA, 17 nt, Bordetella pertussis
guccagcgccacggcgg

SEQ ID NO: 2439158 - RNA, 16 nt, Bordetella pertussis
guccagcgccagcagg

SEQ ID NO: 2439159 - RNA, 13 nt, Bordetella pertussis
guccagcgccagg

SEQ ID NO: 2439160 - RNA, 15 nt, Bordetella pertussis
guccagcgccaggcc

SEQ ID NO: 2439161 - RNA, 16 nt, Bordetella pertussis
guccagcgccaggccg

SEQ ID NO: 2439162 - RNA, 17 nt, Bordetella pertussis
guccagcgccaggccgc

SEQ ID NO: 2439163 - RNA, 19 nt, Bordetella pertussis
guccagcgccaggccgcgc

SEQ ID NO: 2439164 - RNA, 20 nt, Bordetella pertussis
guccagcgccaggccgcgca

SEQ ID NO: 2439165 - RNA, 13 nt, Bordetella pertussis
guccagcgcgccc

SEQ ID NO: 2439166 - RNA, 15 nt, Bordetella pertussis
guccagcgcgccgcg

SEQ ID NO: 2439167 - RNA, 16 nt, Bordetella pertussis
guccagcgcgccgcga

SEQ ID NO: 2439168 - RNA, 16 nt, Bordetella pertussis
guccagcgcgcggccu

SEQ ID NO: 2439169 - RNA, 13 nt, Bordetella pertussis
guccagcgcggca

SEQ ID NO: 2439170 - RNA, 19 nt, Bordetella pertussis
guccagcggcagcgggucg

SEQ ID NO: 2439171 - RNA, 14 nt, Bordetella pertussis
guccagcggcgcca

SEQ ID NO: 2439172 - RNA, 19 nt, Bordetella pertussis
guccagcggcgccagcgga

SEQ ID NO: 2439173 - RNA, 16 nt, Bordetella pertussis
guccagcggcgcgacg

SEQ ID NO: 2439174 - RNA, 23 nt, Bordetella pertussis
guccagcgucaugcgcaccuugu

SEQ ID NO: 2439175 - RNA, 15 nt, Bordetella pertussis
guccagcguggcgca

SEQ ID NO: 2439176 - RNA, 17 nt, Bordetella pertussis
guccagcguggcgcagu

SEQ ID NO: 2439177 - RNA, 21 nt, Bordetella pertussis
guccagcguggcgcagucgag

SEQ ID NO: 2439178 - RNA, 11 nt, Bordetella pertussis
guccagcucca

SEQ ID NO: 2439179 - RNA, 14 nt, Bordetella pertussis
guccagcuccagcg

SEQ ID NO: 2439180 - RNA, 15 nt, Bordetella pertussis
guccagcuccagcgc

SEQ ID NO: 2439181 - RNA, 16 nt, Bordetella pertussis
guccagcuccagcgcu

SEQ ID NO: 2439182 - RNA, 20 nt, Bordetella pertussis
guccagcuccagcgcuucgu

SEQ ID NO: 2439183 - RNA, 20 nt, Bordetella pertussis
guccagcugcgcgcgagcgg

SEQ ID NO: 2439184 - RNA, 18 nt, Bordetella pertussis
guccagcuuggacagcgc

SEQ ID NO: 2439185 - RNA, 19 nt, Bordetella pertussis
guccagcuuggacagcgcg

SEQ ID NO: 2439186 - RNA, 15 nt, Bordetella pertussis
guccaggaagcagcc

SEQ ID NO: 2439187 - RNA, 19 nt, Bordetella pertussis
guccaggaagcagcccagc

SEQ ID NO: 2439188 - RNA, 20 nt, Bordetella pertussis
guccaggaagcagcccagca

SEQ ID NO: 2439189 - RNA, 16 nt, Bordetella pertussis
guccaggacgcgaaga

SEQ ID NO: 2439190 - RNA, 13 nt, Bordetella pertussis
guccaggcccagc

SEQ ID NO: 2439191 - RNA, 16 nt, Bordetella pertussis
guccaggcccagcgcg

SEQ ID NO: 2439192 - RNA, 17 nt, Bordetella pertussis
guccaggcccagcgcgu

SEQ ID NO: 2439193 - RNA, 15 nt, Bordetella pertussis
guccaggcccuggcg

SEQ ID NO: 2439194 - RNA, 20 nt, Bordetella pertussis
guccaggcccuggcggcgca

SEQ ID NO: 2439195 - RNA, 20 nt, Bordetella pertussis
guccaggccgaucagcgaca

SEQ ID NO: 2439196 - RNA, 13 nt, Bordetella pertussis
guccaggccggcc

SEQ ID NO: 2439197 - RNA, 15 nt, Bordetella pertussis
guccaggccggggcc

SEQ ID NO: 2439198 - RNA, 14 nt, Bordetella pertussis
guccaggcgccgca

SEQ ID NO: 2439199 - RNA, 13 nt, Bordetella pertussis
guccaggcgcgca

SEQ ID NO: 2439200 - RNA, 14 nt, Bordetella pertussis
guccaggcgcgcca

SEQ ID NO: 2439201 - RNA, 16 nt, Bordetella pertussis
guccaggcgcgccagc

SEQ ID NO: 2439202 - RNA, 16 nt, Bordetella pertussis
guccaggcggccaucg

SEQ ID NO: 2439203 - RNA, 13 nt, Bordetella pertussis
guccaggcggccg

SEQ ID NO: 2439204 - RNA, 13 nt, Bordetella pertussis
guccaggcggugc

SEQ ID NO: 2439205 - RNA, 15 nt, Bordetella pertussis
guccaggcggugcgu

SEQ ID NO: 2439206 - RNA, 15 nt, Bordetella pertussis
guccaggcgguuggc

SEQ ID NO: 2439207 - RNA, 20 nt, Bordetella pertussis
guccaggcgguuggccuuga

SEQ ID NO: 2439208 - RNA, 14 nt, Bordetella pertussis
guccaggcugccgg

SEQ ID NO: 2439209 - RNA, 20 nt, Bordetella pertussis
guccaggguguccuggucgg

SEQ ID NO: 2439210 - RNA, 18 nt, Bordetella pertussis
guccaggugcggcggcga

SEQ ID NO: 2439211 - RNA, 15 nt, Bordetella pertussis
guccaguccuucgcg

SEQ ID NO: 2439212 - RNA, 18 nt, Bordetella pertussis
guccaugaacgccgcgcc

SEQ ID NO: 2439213 - RNA, 14 nt, Bordetella pertussis
guccaugccgccca

SEQ ID NO: 2439214 - RNA, 13 nt, Bordetella pertussis
guccaugccggcc

SEQ ID NO: 2439215 - RNA, 18 nt, Bordetella pertussis
guccaugcgaaagcggcc

SEQ ID NO: 2439216 - RNA, 20 nt, Bordetella pertussis
guccaugcgaaagcggccag

SEQ ID NO: 2439217 - RNA, 21 nt, Bordetella pertussis
guccaugcgaaagcggccagc

SEQ ID NO: 2439218 - RNA, 20 nt, Bordetella pertussis
guccaugcugauccuggcau

SEQ ID NO: 2439219 - RNA, 20 nt, Bordetella pertussis
guccauuagggcccagcugc

SEQ ID NO: 2439220 - RNA, 21 nt, Bordetella pertussis
gucccaaccgggacaggcacc

SEQ ID NO: 2439221 - RNA, 19 nt, Bordetella pertussis
gucccacaggcgcgcggcg

SEQ ID NO: 2439222 - RNA, 22 nt, Bordetella pertussis
gucccacugccaguaggcgccc

SEQ ID NO: 2439223 - RNA, 14 nt, Bordetella pertussis
gucccagauggcgc

SEQ ID NO: 2439224 - RNA, 14 nt, Bordetella pertussis
gucccagccggccc

SEQ ID NO: 2439225 - RNA, 18 nt, Bordetella pertussis
gucccagcgcucguccac

SEQ ID NO: 2439226 - RNA, 14 nt, Bordetella pertussis
gucccagcggggac

SEQ ID NO: 2439227 - RNA, 21 nt, Bordetella pertussis
gucccagcggggacaggcacc

SEQ ID NO: 2439228 - RNA, 24 nt, Bordetella pertussis
gucccagcuucucgcaagugcugg

SEQ ID NO: 2439229 - RNA, 13 nt, Bordetella pertussis
gucccaggcgcuc

SEQ ID NO: 2439230 - RNA, 18 nt, Bordetella pertussis
gucccagggggucagggc

SEQ ID NO: 2439231 - RNA, 15 nt, Bordetella pertussis
gucccaggugccggu

SEQ ID NO: 2439232 - RNA, 16 nt, Bordetella pertussis
guccggcacggcggca

SEQ ID NO: 2439233 - RNA, 18 nt, Bordetella pertussis
guccggcagcacccagcg

SEQ ID NO: 2439234 - RNA, 16 nt, Bordetella pertussis
guccggccccaggaug

SEQ ID NO: 2439235 - RNA, 19 nt, Bordetella pertussis
guccggccccaggaugcgc

SEQ ID NO: 2439236 - RNA, 20 nt, Bordetella pertussis
guccggccccaggaugcgca

SEQ ID NO: 2439237 - RNA, 21 nt, Bordetella pertussis
guccggccccaggaugcgcac

SEQ ID NO: 2439238 - RNA, 14 nt, Bordetella pertussis
guccggccgcgcaa

SEQ ID NO: 2439239 - RNA, 20 nt, Bordetella pertussis
guccggccgcgcaaggcggc

SEQ ID NO: 2439240 - RNA, 21 nt, Bordetella pertussis
guccggcgcccgccgccgggc

SEQ ID NO: 2439241 - RNA, 14 nt, Bordetella pertussis
guccggcgcgucgc

SEQ ID NO: 2439242 - RNA, 13 nt, Bordetella pertussis
guccggcgcucgc

SEQ ID NO: 2439243 - RNA, 19 nt, Bordetella pertussis
guccggcgcucgccccggc

SEQ ID NO: 2439244 - RNA, 23 nt, Bordetella pertussis
guccggcgcucgccccggcgcgc

SEQ ID NO: 2439245 - RNA, 16 nt, Bordetella pertussis
guccggcgggccgcug

SEQ ID NO: 2439246 - RNA, 17 nt, Bordetella pertussis
guccggcgggccgcugu

SEQ ID NO: 2439247 - RNA, 18 nt, Bordetella pertussis
guccggcgugccauggac

SEQ ID NO: 2439248 - RNA, 22 nt, Bordetella pertussis
guccgggccgguuucggccugc

SEQ ID NO: 2439249 - RNA, 12 nt, Bordetella pertussis
guccgggcggcg

SEQ ID NO: 2439250 - RNA, 13 nt, Bordetella pertussis
guccgggcggcgu

SEQ ID NO: 2439251 - RNA, 15 nt, Bordetella pertussis
guccggggcgggcgc

SEQ ID NO: 2439252 - RNA, 22 nt, Bordetella pertussis
guccggguugcccacgccuucc

SEQ ID NO: 2439253 - RNA, 18 nt, Bordetella pertussis
guccgguauccuggcgcg

SEQ ID NO: 2439254 - RNA, 13 nt, Bordetella pertussis
guccggucgcgcg

SEQ ID NO: 2439255 - RNA, 14 nt, Bordetella pertussis
guccgguucgccca

SEQ ID NO: 2439256 - RNA, 22 nt, Bordetella pertussis
guccguacgccacuuccuugcc

SEQ ID NO: 2439257 - RNA, 18 nt, Bordetella pertussis
guccguaguugcgccccg

SEQ ID NO: 2439258 - RNA, 14 nt, Bordetella pertussis
guccguaucgcggc

SEQ ID NO: 2439259 - RNA, 16 nt, Bordetella pertussis
guccguaucgcggccg

SEQ ID NO: 2439260 - RNA, 18 nt, Bordetella pertussis
guccguaucgcggccgag

SEQ ID NO: 2439261 - RNA, 15 nt, Bordetella pertussis
guccgucgggcaagc

SEQ ID NO: 2439262 - RNA, 16 nt, Bordetella pertussis
guccgucgggcaagcg

SEQ ID NO: 2439263 - RNA, 17 nt, Bordetella pertussis
guccgucucgcccaggc

SEQ ID NO: 2439264 - RNA, 21 nt, Bordetella pertussis
guccgucucgcccaggcccag

SEQ ID NO: 2439265 - RNA, 16 nt, Bordetella pertussis
guccguggccggcgcg

SEQ ID NO: 2439266 - RNA, 13 nt, Bordetella pertussis
guccguggcgcgg

SEQ ID NO: 2439267 - RNA, 14 nt, Bordetella pertussis
guccguggcggccg

SEQ ID NO: 2439268 - RNA, 15 nt, Bordetella pertussis
guccguggcggccgc

SEQ ID NO: 2439269 - RNA, 18 nt, Bordetella pertussis
guccuaaauugccgcgag

SEQ ID NO: 2439270 - RNA, 22 nt, Bordetella pertussis
guccuaaauugccgcgaggcgc

SEQ ID NO: 2439271 - RNA, 14 nt, Bordetella pertussis
guccucaggcccgc

SEQ ID NO: 2439272 - RNA, 21 nt, Bordetella pertussis
guccucaggcccgcggcgcca

SEQ ID NO: 2439273 - RNA, 22 nt, Bordetella pertussis
guccucaggcccgcggcgccag

SEQ ID NO: 2439274 - RNA, 18 nt, Bordetella pertussis
guccucaugcgggacagg

SEQ ID NO: 2439275 - RNA, 23 nt, Bordetella pertussis
guccucgacguaagugcccaggc

SEQ ID NO: 2439276 - RNA, 17 nt, Bordetella pertussis
guccucgaugacgacga

SEQ ID NO: 2439277 - RNA, 21 nt, Bordetella pertussis
guccucgcacgugacgccggc

SEQ ID NO: 2439278 - RNA, 13 nt, Bordetella pertussis
guccucgccgguc

SEQ ID NO: 2439279 - RNA, 14 nt, Bordetella pertussis
guccucgcgguccu

SEQ ID NO: 2439280 - RNA, 11 nt, Bordetella pertussis
guccucggcca

SEQ ID NO: 2439281 - RNA, 13 nt, Bordetella pertussis
guccucggccacg

SEQ ID NO: 2439282 - RNA, 16 nt, Bordetella pertussis
guccucggccagccgg

SEQ ID NO: 2439283 - RNA, 17 nt, Bordetella pertussis
guccucggccagccggg

SEQ ID NO: 2439284 - RNA, 18 nt, Bordetella pertussis
guccucggccagccgggc

SEQ ID NO: 2439285 - RNA, 14 nt, Bordetella pertussis
guccucggccuggc

SEQ ID NO: 2439286 - RNA, 17 nt, Bordetella pertussis
guccucggccuggcccc

SEQ ID NO: 2439287 - RNA, 17 nt, Bordetella pertussis
guccucgucggccaugc

SEQ ID NO: 2439288 - RNA, 21 nt, Bordetella pertussis
guccucgucggccaugcgcgc

SEQ ID NO: 2439289 - RNA, 14 nt, Bordetella pertussis
guccucgucggcga

SEQ ID NO: 2439290 - RNA, 16 nt, Bordetella pertussis
guccucgucggcgaag

SEQ ID NO: 2439291 - RNA, 18 nt, Bordetella pertussis
guccugaaucgcccgggc

SEQ ID NO: 2439292 - RNA, 19 nt, Bordetella pertussis
guccugaaucgcccgggcg

SEQ ID NO: 2439293 - RNA, 17 nt, Bordetella pertussis
guccugaccggcggcgc

SEQ ID NO: 2439294 - RNA, 21 nt, Bordetella pertussis
guccugaccggcggcgcucau

SEQ ID NO: 2439295 - RNA, 15 nt, Bordetella pertussis
guccugaggccaggc

SEQ ID NO: 2439296 - RNA, 17 nt, Bordetella pertussis
guccugauucacaggcc

SEQ ID NO: 2439297 - RNA, 21 nt, Bordetella pertussis
guccugcagcagggucaugau

SEQ ID NO: 2439298 - RNA, 18 nt, Bordetella pertussis
guccugcaggaaggccgc

SEQ ID NO: 2439299 - RNA, 13 nt, Bordetella pertussis
guccugcaggccc

SEQ ID NO: 2439300 - RNA, 20 nt, Bordetella pertussis
guccugcaggcccggcgcga

SEQ ID NO: 2439301 - RNA, 22 nt, Bordetella pertussis
guccugcaggcccggcgcgacg

SEQ ID NO: 2439302 - RNA, 16 nt, Bordetella pertussis
guccugcaggcggcgc

SEQ ID NO: 2439303 - RNA, 20 nt, Bordetella pertussis
guccugcaggcggcgcauca

SEQ ID NO: 2439304 - RNA, 11 nt, Bordetella pertussis
guccugcaggu

SEQ ID NO: 2439305 - RNA, 19 nt, Bordetella pertussis
guccugcagguccugguag

SEQ ID NO: 2439306 - RNA, 19 nt, Bordetella pertussis
guccugcaucgccaugccg

SEQ ID NO: 2439307 - RNA, 20 nt, Bordetella pertussis
guccugccauugcgcggccu

SEQ ID NO: 2439308 - RNA, 21 nt, Bordetella pertussis
guccugccauugcgcggccug

SEQ ID NO: 2439309 - RNA, 22 nt, Bordetella pertussis
guccugccauugcgcggccugc

SEQ ID NO: 2439310 - RNA, 13 nt, Bordetella pertussis
guccugcgcgccg

SEQ ID NO: 2439311 - RNA, 15 nt, Bordetella pertussis
guccugcggcggcag

SEQ ID NO: 2439312 - RNA, 23 nt, Bordetella pertussis
guccugcucggugcucuggcccg

SEQ ID NO: 2439313 - RNA, 14 nt, Bordetella pertussis
guccugcugaucca

SEQ ID NO: 2439314 - RNA, 18 nt, Bordetella pertussis
guccuggacagugcccug

SEQ ID NO: 2439315 - RNA, 11 nt, Bordetella pertussis
guccuggagac

SEQ ID NO: 2439316 - RNA, 14 nt, Bordetella pertussis
guccuggcaggccg

SEQ ID NO: 2439317 - RNA, 14 nt, Bordetella pertussis
guccuggccacugc

SEQ ID NO: 2439318 - RNA, 18 nt, Bordetella pertussis
guccuggcgaccggcggc

SEQ ID NO: 2439319 - RNA, 21 nt, Bordetella pertussis
guccuggcgaccggcggcacc

SEQ ID NO: 2439320 - RNA, 14 nt, Bordetella pertussis
guccuggcgcgcca

SEQ ID NO: 2439321 - RNA, 22 nt, Bordetella pertussis
guccuggcggccgcccagcaga

SEQ ID NO: 2439322 - RNA, 19 nt, Bordetella pertussis
guccugggccgagcgcgcc

SEQ ID NO: 2439323 - RNA, 22 nt, Bordetella pertussis
guccugguaagaaaccuggccc

SEQ ID NO: 2439324 - RNA, 22 nt, Bordetella pertussis
guccugguagaucagcgcgucg

SEQ ID NO: 2439325 - RNA, 20 nt, Bordetella pertussis
guccugguaucccucgccca

SEQ ID NO: 2439326 - RNA, 14 nt, Bordetella pertussis
guccuggucgacca

SEQ ID NO: 2439327 - RNA, 17 nt, Bordetella pertussis
guccuggucgaccaggc

SEQ ID NO: 2439328 - RNA, 18 nt, Bordetella pertussis
guccuggucggcgcggca

SEQ ID NO: 2439329 - RNA, 14 nt, Bordetella pertussis
guccuggugcacgc

SEQ ID NO: 2439330 - RNA, 18 nt, Bordetella pertussis
guccugguggaccugccg

SEQ ID NO: 2439331 - RNA, 18 nt, Bordetella pertussis
guccuuacuugcgcacgg

SEQ ID NO: 2439332 - RNA, 19 nt, Bordetella pertussis
guccuuacuugcgcacggc

SEQ ID NO: 2439333 - RNA, 14 nt, Bordetella pertussis
guccuucagcacgc

SEQ ID NO: 2439334 - RNA, 15 nt, Bordetella pertussis
guccuucagcacgcu

SEQ ID NO: 2439335 - RNA, 15 nt, Bordetella pertussis
guccuucucuucgcg

SEQ ID NO: 2439336 - RNA, 13 nt, Bordetella pertussis
guccuugaacgcc

SEQ ID NO: 2439337 - RNA, 17 nt, Bordetella pertussis
guccuugacgccgccga

SEQ ID NO: 2439338 - RNA, 20 nt, Bordetella pertussis
guccuugacgccgccgaacg

SEQ ID NO: 2439339 - RNA, 14 nt, Bordetella pertussis
guccuugagcgcca

SEQ ID NO: 2439340 - RNA, 16 nt, Bordetella pertussis
guccuugagcgccagc

SEQ ID NO: 2439341 - RNA, 23 nt, Bordetella pertussis
guccuugagcgccagcucggcca

SEQ ID NO: 2439342 - RNA, 21 nt, Bordetella pertussis
guccuugagggcgcgggccag

SEQ ID NO: 2439343 - RNA, 19 nt, Bordetella pertussis
guccuuggcgccggcgaug

SEQ ID NO: 2439344 - RNA, 15 nt, Bordetella pertussis
guccuuggcggccuu

SEQ ID NO: 2439345 - RNA, 22 nt, Bordetella pertussis
gucgaugaccagccagccgccg

SEQ ID NO: 2439346 - RNA, 18 nt, Bordetella pertussis
gucgaugaccagcgccgg

SEQ ID NO: 2439347 - RNA, 19 nt, Bordetella pertussis
gucgaugaccagcgccggc

SEQ ID NO: 2439348 - RNA, 13 nt, Bordetella pertussis
gucgaugacgcgc

SEQ ID NO: 2439349 - RNA, 15 nt, Bordetella pertussis
gucgaugacgcgccg

SEQ ID NO: 2439350 - RNA, 23 nt, Bordetella pertussis
gucgaugauccacagucggucgc

SEQ ID NO: 2439351 - RNA, 14 nt, Bordetella pertussis
gucgaugaugacga

SEQ ID NO: 2439352 - RNA, 22 nt, Bordetella pertussis
gucgaugaugcgguugaucagg

SEQ ID NO: 2439353 - RNA, 11 nt, Bordetella pertussis
gucgaugccag

SEQ ID NO: 2439354 - RNA, 22 nt, Bordetella pertussis
gucgaugccaguuguaguggug

SEQ ID NO: 2439355 - RNA, 14 nt, Bordetella pertussis
gucgaugccgacca

SEQ ID NO: 2439356 - RNA, 22 nt, Bordetella pertussis
gucgaugccgaccaggcugcgc

SEQ ID NO: 2439357 - RNA, 16 nt, Bordetella pertussis
gucgaugccggcggcc

SEQ ID NO: 2439358 - RNA, 14 nt, Bordetella pertussis
gucgaugccguaca

SEQ ID NO: 2439359 - RNA, 15 nt, Bordetella pertussis
gucgaugcgcacgcc

SEQ ID NO: 2439360 - RNA, 16 nt, Bordetella pertussis
gucgaugcgcacgccc

SEQ ID NO: 2439361 - RNA, 18 nt, Bordetella pertussis
gucgaugcgcacgcccag

SEQ ID NO: 2439362 - RNA, 22 nt, Bordetella pertussis
gucgaugcgguuguugccgcgu

SEQ ID NO: 2439363 - RNA, 16 nt, Bordetella pertussis
gucgaugggcccgggc

SEQ ID NO: 2439364 - RNA, 19 nt, Bordetella pertussis
gucgaugggcccgggcagg

SEQ ID NO: 2439365 - RNA, 21 nt, Bordetella pertussis
gucgauggggucgggccgcgc

SEQ ID NO: 2439366 - RNA, 14 nt, Bordetella pertussis
gucgauguccagcg

SEQ ID NO: 2439367 - RNA, 20 nt, Bordetella pertussis
gucgauuaugccgcccgcaa

SEQ ID NO: 2439368 - RNA, 19 nt, Bordetella pertussis
gucgcaaucgacgaacaag

SEQ ID NO: 2439369 - RNA, 20 nt, Bordetella pertussis
gucgcacaucaggucgaccu

SEQ ID NO: 2439370 - RNA, 22 nt, Bordetella pertussis
gucgcacaucaggucgaccugc

SEQ ID NO: 2439371 - RNA, 22 nt, Bordetella pertussis
gucgcacuggguggccagcgcc

SEQ ID NO: 2439372 - RNA, 15 nt, Bordetella pertussis
gucgcagcacgccca

SEQ ID NO: 2439373 - RNA, 14 nt, Bordetella pertussis
gucgcaggccgcgg

SEQ ID NO: 2439374 - RNA, 16 nt, Bordetella pertussis
gucgcaggccgcggcc

SEQ ID NO: 2439375 - RNA, 17 nt, Bordetella pertussis
gucgcaggccgcggcca

SEQ ID NO: 2439376 - RNA, 18 nt, Bordetella pertussis
gucgcaggccgcggccag

SEQ ID NO: 2439377 - RNA, 13 nt, Bordetella pertussis
gucgcaggcgcug

SEQ ID NO: 2439378 - RNA, 17 nt, Bordetella pertussis
gucgcaguucggccuca

SEQ ID NO: 2439379 - RNA, 16 nt, Bordetella pertussis
gucgcauuggccgccg

SEQ ID NO: 2439380 - RNA, 17 nt, Bordetella pertussis
gucgccaccgcccagaa

SEQ ID NO: 2439381 - RNA, 16 nt, Bordetella pertussis
gucgccacgccauugc

SEQ ID NO: 2439382 - RNA, 17 nt, Bordetella pertussis
gucgccacgggcgucac

SEQ ID NO: 2439383 - RNA, 12 nt, Bordetella pertussis
gucgccagcacg

SEQ ID NO: 2439384 - RNA, 13 nt, Bordetella pertussis
gucgccagcacgc

SEQ ID NO: 2439385 - RNA, 17 nt, Bordetella pertussis
gucgccagcacgcgcag

SEQ ID NO: 2439386 - RNA, 14 nt, Bordetella pertussis
gucgccagcaggcc

SEQ ID NO: 2439387 - RNA, 15 nt, Bordetella pertussis
gucgccagcaggccc

SEQ ID NO: 2439388 - RNA, 19 nt, Bordetella pertussis
gucgccagcgacgacuuga

SEQ ID NO: 2439389 - RNA, 16 nt, Bordetella pertussis
gucgccagcgauccau

SEQ ID NO: 2439390 - RNA, 16 nt, Bordetella pertussis
gucgccagggcgauga

SEQ ID NO: 2439391 - RNA, 22 nt, Bordetella pertussis
gucgccagggcgaugaccggca

SEQ ID NO: 2439392 - RNA, 16 nt, Bordetella pertussis
gucgccaucggccggc

SEQ ID NO: 2439393 - RNA, 23 nt, Bordetella pertussis
gucgccaucugcugcgagacgcg

SEQ ID NO: 2439394 - RNA, 16 nt, Bordetella pertussis
gucgccaugcggcugg

SEQ ID NO: 2439395 - RNA, 16 nt, Bordetella pertussis
gucgcccaacccggcg

SEQ ID NO: 2439396 - RNA, 17 nt, Bordetella pertussis
gucgcccaacgaggaca

SEQ ID NO: 2439397 - RNA, 20 nt, Bordetella pertussis
gucgcccacauagaccggcu

SEQ ID NO: 2439398 - RNA, 22 nt, Bordetella pertussis
gucgcccacauagaccggcugc

SEQ ID NO: 2439399 - RNA, 18 nt, Bordetella pertussis
gucgcccaccacgccgcc

SEQ ID NO: 2439400 - RNA, 21 nt, Bordetella pertussis
gucgcccaccacgccgcccag

SEQ ID NO: 2439401 - RNA, 13 nt, Bordetella pertussis
gucgcccagcaga

SEQ ID NO: 2439402 - RNA, 23 nt, Bordetella pertussis
gucgccccccaugccggaacagg

SEQ ID NO: 2439403 - RNA, 23 nt, Bordetella pertussis
gucgccccgacgcgcuuccagga

SEQ ID NO: 2439404 - RNA, 12 nt, Bordetella pertussis
gucgcccgccgc

SEQ ID NO: 2439405 - RNA, 17 nt, Bordetella pertussis
gucgcccggggcggcgu

SEQ ID NO: 2439406 - RNA, 13 nt, Bordetella pertussis
gucgcccuggcgg

SEQ ID NO: 2439407 - RNA, 20 nt, Bordetella pertussis
gucgcccuggcggcggucaa

SEQ ID NO: 2439408 - RNA, 21 nt, Bordetella pertussis
gucgcccuugauggccucggc

SEQ ID NO: 2439409 - RNA, 16 nt, Bordetella pertussis
gucgccgaagggcagg

SEQ ID NO: 2439410 - RNA, 17 nt, Bordetella pertussis
gucgccgaucggcuugc

SEQ ID NO: 2439411 - RNA, 18 nt, Bordetella pertussis
gucgccgcccacggcgac

SEQ ID NO: 2439412 - RNA, 20 nt, Bordetella pertussis
gucgccgcccaugcgcaugg

SEQ ID NO: 2439413 - RNA, 16 nt, Bordetella pertussis
gucgccgcccugcugc

SEQ ID NO: 2439414 - RNA, 22 nt, Bordetella pertussis
gucgccgcccugcugcccgccg

SEQ ID NO: 2439415 - RNA, 16 nt, Bordetella pertussis
gucgccgccgcgcacc

SEQ ID NO: 2439416 - RNA, 16 nt, Bordetella pertussis
gucgccgccugcggcg

SEQ ID NO: 2439417 - RNA, 13 nt, Bordetella pertussis
gucgccgcgcacg

SEQ ID NO: 2439418 - RNA, 13 nt, Bordetella pertussis
gucgccgcgcccg

SEQ ID NO: 2439419 - RNA, 23 nt, Bordetella pertussis
gucgccgcgggcaaagcccagca

SEQ ID NO: 2439420 - RNA, 17 nt, Bordetella pertussis
gucgccgcggucgcaga

SEQ ID NO: 2439421 - RNA, 14 nt, Bordetella pertussis
gucgccgcugccgg

SEQ ID NO: 2439422 - RNA, 23 nt, Bordetella pertussis
gucgccgcuggacagauccagcg

SEQ ID NO: 2439423 - RNA, 14 nt, Bordetella pertussis
gucgccgcuggcca

SEQ ID NO: 2439424 - RNA, 15 nt, Bordetella pertussis
gucgccgcuggccag

SEQ ID NO: 2439425 - RNA, 20 nt, Bordetella pertussis
gucgccggccaguggcgcgg

SEQ ID NO: 2439426 - RNA, 13 nt, Bordetella pertussis
gucgccggcgaug

SEQ ID NO: 2439427 - RNA, 18 nt, Bordetella pertussis
gucgccggcgaugacggc

SEQ ID NO: 2439428 - RNA, 15 nt, Bordetella pertussis
gucgccggcgcaacg

SEQ ID NO: 2439429 - RNA, 15 nt, Bordetella pertussis
gucgccggcgcugcu

SEQ ID NO: 2439430 - RNA, 20 nt, Bordetella pertussis
gucgccggcgcugcugucgc

SEQ ID NO: 2439431 - RNA, 14 nt, Bordetella pertussis
gucgccggcguugg

SEQ ID NO: 2439432 - RNA, 15 nt, Bordetella pertussis
gucgccggcguuggu

SEQ ID NO: 2439433 - RNA, 11 nt, Bordetella pertussis
gucgccgggca

SEQ ID NO: 2439434 - RNA, 16 nt, Bordetella pertussis
gucgccgggcagcggg

SEQ ID NO: 2439435 - RNA, 23 nt, Bordetella pertussis
gucgccgggcagcgggccgcagc

SEQ ID NO: 2439436 - RNA, 14 nt, Bordetella pertussis
gucgccgguggugu

SEQ ID NO: 2439437 - RNA, 23 nt, Bordetella pertussis
gucgccgucaggaucaggccggc

SEQ ID NO: 2439438 - RNA, 17 nt, Bordetella pertussis
gucgccgucgcccuggc

SEQ ID NO: 2439439 - RNA, 20 nt, Bordetella pertussis
gucgccguucuggcugcgcg

SEQ ID NO: 2439440 - RNA, 21 nt, Bordetella pertussis
gucgccguucuggcugcgcgc

SEQ ID NO: 2439441 - RNA, 22 nt, Bordetella pertussis
gucgccguucuggcugcgcgcc

SEQ ID NO: 2439442 - RNA, 23 nt, Bordetella pertussis
gucgccguucuggcugcgcgccu

SEQ ID NO: 2439443 - RNA, 21 nt, Bordetella pertussis
gucgccucccauugcgcggcc

SEQ ID NO: 2439444 - RNA, 22 nt, Bordetella pertussis
gucgccucccauugcgcggcca

SEQ ID NO: 2439445 - RNA, 23 nt, Bordetella pertussis
gucgccucccauugcgcggccag

SEQ ID NO: 2439446 - RNA, 19 nt, Bordetella pertussis
gucgccugcccgcacgggc

SEQ ID NO: 2439447 - RNA, 20 nt, Bordetella pertussis
gucgccuggucgacgccggc

SEQ ID NO: 2439448 - RNA, 22 nt, Bordetella pertussis
gucgccuguaucagcgccugca

SEQ ID NO: 2439449 - RNA, 17 nt, Bordetella pertussis
gucgccuucggcggcga

SEQ ID NO: 2439450 - RNA, 16 nt, Bordetella pertussis
gucgccuugucgggga

SEQ ID NO: 2439451 - RNA, 19 nt, Bordetella pertussis
gucgcgaccgccgccuugg

SEQ ID NO: 2439452 - RNA, 16 nt, Bordetella pertussis
gucgcgaccucggcgg

SEQ ID NO: 2439453 - RNA, 18 nt, Bordetella pertussis
gucgcgaccucggcggcg

SEQ ID NO: 2439454 - RNA, 16 nt, Bordetella pertussis
gucgcgagcugcgcga

SEQ ID NO: 2439455 - RNA, 13 nt, Bordetella pertussis
gucgcgaugcgcc

SEQ ID NO: 2439456 - RNA, 15 nt, Bordetella pertussis
gucgcgaugcgccag

SEQ ID NO: 2439457 - RNA, 16 nt, Bordetella pertussis
gucgcgaugcgccagg

SEQ ID NO: 2439458 - RNA, 16 nt, Bordetella pertussis
gucggccagcgugccg

SEQ ID NO: 2439459 - RNA, 22 nt, Bordetella pertussis
gucggccagcgugccggugacg

SEQ ID NO: 2439460 - RNA, 15 nt, Bordetella pertussis
gucggccagcuugcc

SEQ ID NO: 2439461 - RNA, 13 nt, Bordetella pertussis
gucggccaggccg

SEQ ID NO: 2439462 - RNA, 14 nt, Bordetella pertussis
gucggccaggccga

SEQ ID NO: 2439463 - RNA, 12 nt, Bordetella pertussis
gucggccaggcg

SEQ ID NO: 2439464 - RNA, 16 nt, Bordetella pertussis
gucggccaggcgccag

SEQ ID NO: 2439465 - RNA, 12 nt, Bordetella pertussis
gucggccagggc

SEQ ID NO: 2439466 - RNA, 17 nt, Bordetella pertussis
gucggccauggcgcugu

SEQ ID NO: 2439467 - RNA, 22 nt, Bordetella pertussis
gucggcccaggucaucgccagg

SEQ ID NO: 2439468 - RNA, 18 nt, Bordetella pertussis
gucggcccugucggccga

SEQ ID NO: 2439469 - RNA, 19 nt, Bordetella pertussis
gucggcccugucggccgaa

SEQ ID NO: 2439470 - RNA, 16 nt, Bordetella pertussis
gucggccgaaccgcgc

SEQ ID NO: 2439471 - RNA, 18 nt, Bordetella pertussis
gucggccgaaccgcgcag

SEQ ID NO: 2439472 - RNA, 21 nt, Bordetella pertussis
gucggccgaaccgcgcagccg

SEQ ID NO: 2439473 - RNA, 23 nt, Bordetella pertussis
gucggccgaaccgcgcagccgcu

SEQ ID NO: 2439474 - RNA, 14 nt, Bordetella pertussis
gucggccgaccacu

SEQ ID NO: 2439475 - RNA, 12 nt, Bordetella pertussis
gucggccgccag

SEQ ID NO: 2439476 - RNA, 13 nt, Bordetella pertussis
gucggccgccagc

SEQ ID NO: 2439477 - RNA, 14 nt, Bordetella pertussis
gucggccgccagcc

SEQ ID NO: 2439478 - RNA, 17 nt, Bordetella pertussis
gucggccgccagccacc

SEQ ID NO: 2439479 - RNA, 14 nt, Bordetella pertussis
gucggccgccgccg

SEQ ID NO: 2439480 - RNA, 17 nt, Bordetella pertussis
gucggccgccgccguga

SEQ ID NO: 2439481 - RNA, 13 nt, Bordetella pertussis
gucggccgcgccc

SEQ ID NO: 2439482 - RNA, 17 nt, Bordetella pertussis
gucggccgcgcccaggu

SEQ ID NO: 2439483 - RNA, 12 nt, Bordetella pertussis
gucggccgcgcg

SEQ ID NO: 2439484 - RNA, 16 nt, Bordetella pertussis
gucggccgcgcgcauc

SEQ ID NO: 2439485 - RNA, 18 nt, Bordetella pertussis
gucggccgcuccgccaug

SEQ ID NO: 2439486 - RNA, 23 nt, Bordetella pertussis
gucggccggaugcgcaggacggc

SEQ ID NO: 2439487 - RNA, 22 nt, Bordetella pertussis
gucggccggcagcggcgccaug

SEQ ID NO: 2439488 - RNA, 14 nt, Bordetella pertussis
gucggccucggcga

SEQ ID NO: 2439489 - RNA, 16 nt, Bordetella pertussis
gucggccucggcgaag

SEQ ID NO: 2439490 - RNA, 15 nt, Bordetella pertussis
gucggccugcacgcu

SEQ ID NO: 2439491 - RNA, 17 nt, Bordetella pertussis
gucggccugccagccug

SEQ ID NO: 2439492 - RNA, 13 nt, Bordetella pertussis
gucggccuggcgc

SEQ ID NO: 2439493 - RNA, 14 nt, Bordetella pertussis
gucggccuggcgcu

SEQ ID NO: 2439494 - RNA, 20 nt, Bordetella pertussis
gucggccuggcgcuccucgc

SEQ ID NO: 2439495 - RNA, 19 nt, Bordetella pertussis
gucggccugguccgccgcg

SEQ ID NO: 2439496 - RNA, 20 nt, Bordetella pertussis
gucggccuucugcgccagcg

SEQ ID NO: 2439497 - RNA, 13 nt, Bordetella pertussis
gucggcgaacagc

SEQ ID NO: 2439498 - RNA, 17 nt, Bordetella pertussis
gucggcgaacagcgcgu

SEQ ID NO: 2439499 - RNA, 18 nt, Bordetella pertussis
gucggcgaagccuugcgc

SEQ ID NO: 2439500 - RNA, 14 nt, Bordetella pertussis
gucggcgaccgugc

SEQ ID NO: 2439501 - RNA, 15 nt, Bordetella pertussis
gucggcgaucaccug

SEQ ID NO: 2439502 - RNA, 12 nt, Bordetella pertussis
gucggcgaugcg

SEQ ID NO: 2439503 - RNA, 22 nt, Bordetella pertussis
gucggcgaugcgcggggccggu

SEQ ID NO: 2439504 - RNA, 13 nt, Bordetella pertussis
gucggcgauggcg

SEQ ID NO: 2439505 - RNA, 18 nt, Bordetella pertussis
gucggcgauggcgcgcgc

SEQ ID NO: 2439506 - RNA, 21 nt, Bordetella pertussis
gucggcgauggcgcgcgccac

SEQ ID NO: 2439507 - RNA, 18 nt, Bordetella pertussis
gucggcgcagauggcggc

SEQ ID NO: 2439508 - RNA, 19 nt, Bordetella pertussis
gucggcgccacaggugcgc

SEQ ID NO: 2439509 - RNA, 23 nt, Bordetella pertussis
gucggcgccacaggugcgcggcg

SEQ ID NO: 2439510 - RNA, 16 nt, Bordetella pertussis
gucggcgccaugcugg

SEQ ID NO: 2439511 - RNA, 21 nt, Bordetella pertussis
gucggcgccaugcuggccgcc

SEQ ID NO: 2439512 - RNA, 16 nt, Bordetella pertussis
gucggcgcccacgccg

SEQ ID NO: 2439513 - RNA, 20 nt, Bordetella pertussis
gucggcgcccacgccgaaua

SEQ ID NO: 2439514 - RNA, 12 nt, Bordetella pertussis
gucggcgcccag

SEQ ID NO: 2439515 - RNA, 14 nt, Bordetella pertussis
gucggcgcccagcu

SEQ ID NO: 2439516 - RNA, 13 nt, Bordetella pertussis
gucggcgcccggc

SEQ ID NO: 2439517 - RNA, 14 nt, Bordetella pertussis
gucggcgcccggcg

SEQ ID NO: 2439518 - RNA, 21 nt, Bordetella pertussis
gucggcgcccggcgccgcgcg

SEQ ID NO: 2439519 - RNA, 19 nt, Bordetella pertussis
gucggcgccgaucagcagg

SEQ ID NO: 2439520 - RNA, 12 nt, Bordetella pertussis
gucggcgccgcg

SEQ ID NO: 2439521 - RNA, 14 nt, Bordetella pertussis
gucggcgcgcgcca

SEQ ID NO: 2439522 - RNA, 15 nt, Bordetella pertussis
gucggcgcgcgccag

SEQ ID NO: 2439523 - RNA, 12 nt, Bordetella pertussis
gucggcgcggca

SEQ ID NO: 2439524 - RNA, 15 nt, Bordetella pertussis
gucggcgcggcgccg

SEQ ID NO: 2439525 - RNA, 19 nt, Bordetella pertussis
gucggcgcggcgccgucca

SEQ ID NO: 2439526 - RNA, 12 nt, Bordetella pertussis
gucggcgcgguc

SEQ ID NO: 2439527 - RNA, 13 nt, Bordetella pertussis
gucggcgcggucg

SEQ ID NO: 2439528 - RNA, 15 nt, Bordetella pertussis
gucggcgcggucggc

SEQ ID NO: 2439529 - RNA, 17 nt, Bordetella pertussis
gucggcgcugcagcgca

SEQ ID NO: 2439530 - RNA, 11 nt, Bordetella pertussis
gucggcgcugg

SEQ ID NO: 2439531 - RNA, 15 nt, Bordetella pertussis
gucggcgcuggccau

SEQ ID NO: 2439532 - RNA, 16 nt, Bordetella pertussis
gucggcgcuggcgcgc

SEQ ID NO: 2439533 - RNA, 14 nt, Bordetella pertussis
gucggcggcaagca

SEQ ID NO: 2439534 - RNA, 20 nt, Bordetella pertussis
gucggcggcaagcagccgga

SEQ ID NO: 2439535 - RNA, 12 nt, Bordetella pertussis
gucggcggccag

SEQ ID NO: 2439536 - RNA, 20 nt, Bordetella pertussis
gucggcggccagcagcggca

SEQ ID NO: 2439537 - RNA, 14 nt, Bordetella pertussis
gucggcggccagcg

SEQ ID NO: 2439538 - RNA, 21 nt, Bordetella pertussis
gucggcggcccacagcgcccc

SEQ ID NO: 2439539 - RNA, 13 nt, Bordetella pertussis
gucggcgggacgc

SEQ ID NO: 2439540 - RNA, 20 nt, Bordetella pertussis
gucggcgguccacagcccgg

SEQ ID NO: 2439541 - RNA, 20 nt, Bordetella pertussis
gucggcguaaggccgccggc

SEQ ID NO: 2439542 - RNA, 21 nt, Bordetella pertussis
gucggcguaaggccgccggcc

SEQ ID NO: 2439543 - RNA, 22 nt, Bordetella pertussis
gucggcguaaggccgccggcca

SEQ ID NO: 2439544 - RNA, 20 nt, Bordetella pertussis
gucggcguccauuagggccc

SEQ ID NO: 2439545 - RNA, 21 nt, Bordetella pertussis
gucggcguugugccggcgcag

SEQ ID NO: 2439546 - RNA, 20 nt, Bordetella pertussis
gucggcuaccacguggucug

SEQ ID NO: 2439547 - RNA, 13 nt, Bordetella pertussis
gucggcucagucc

SEQ ID NO: 2439548 - RNA, 19 nt, Bordetella pertussis
gucggcucaguccaagguc

SEQ ID NO: 2439549 - RNA, 16 nt, Bordetella pertussis
gucggcucgucgaaca

SEQ ID NO: 2439550 - RNA, 22 nt, Bordetella pertussis
gucgggaccgaacaccaccgag

SEQ ID NO: 2439551 - RNA, 16 nt, Bordetella pertussis
gucgggaccggcgcgu

SEQ ID NO: 2439552 - RNA, 15 nt, Bordetella pertussis
gucgggaugccccgc

SEQ ID NO: 2439553 - RNA, 17 nt, Bordetella pertussis
gucgggcaagcggcgua

SEQ ID NO: 2439554 - RNA, 15 nt, Bordetella pertussis
gucgggcaccagcac

SEQ ID NO: 2439555 - RNA, 23 nt, Bordetella pertussis
gucgggcacgaucaccgccgcgg

SEQ ID NO: 2439556 - RNA, 14 nt, Bordetella pertussis
gucgggcagcgccc

SEQ ID NO: 2439557 - RNA, 15 nt, Bordetella pertussis
gucgggcagcgcccg

SEQ ID NO: 2439558 - RNA, 22 nt, Bordetella pertussis
gucgggcagcgcccgcgccauc

SEQ ID NO: 2439559 - RNA, 18 nt, Bordetella pertussis
gucgggcagcgcggcggc

SEQ ID NO: 2439560 - RNA, 15 nt, Bordetella pertussis
gucgggcagggcgac

SEQ ID NO: 2439561 - RNA, 19 nt, Bordetella pertussis
gucgggcaggucggcgcgg

SEQ ID NO: 2439562 - RNA, 18 nt, Bordetella pertussis
gucgggcaguugcuggcg

SEQ ID NO: 2439563 - RNA, 22 nt, Bordetella pertussis
gucgggcaguugcuggcggccg

SEQ ID NO: 2439564 - RNA, 17 nt, Bordetella pertussis
gucgggccgcgcgcggg

SEQ ID NO: 2439565 - RNA, 14 nt, Bordetella pertussis
gucgggcgccgcaa

SEQ ID NO: 2439566 - RNA, 12 nt, Bordetella pertussis
gucgggcggcgc

SEQ ID NO: 2439567 - RNA, 17 nt, Bordetella pertussis
gucgggcggcgccuggu

SEQ ID NO: 2439568 - RNA, 13 nt, Bordetella pertussis
gucgggcggcgcg

SEQ ID NO: 2439569 - RNA, 14 nt, Bordetella pertussis
gucgggcggcgcga

SEQ ID NO: 2439570 - RNA, 13 nt, Bordetella pertussis
gucgggcggcggc

SEQ ID NO: 2439571 - RNA, 14 nt, Bordetella pertussis
gucgggcggcggcg

SEQ ID NO: 2439572 - RNA, 15 nt, Bordetella pertussis
gucucgcgcggccgg

SEQ ID NO: 2439573 - RNA, 20 nt, Bordetella pertussis
gucucggaaaacuggcgggu

SEQ ID NO: 2439574 - RNA, 19 nt, Bordetella pertussis
gucucggccacggucggca

SEQ ID NO: 2439575 - RNA, 17 nt, Bordetella pertussis
gucucggcuucuccucu

SEQ ID NO: 2439576 - RNA, 17 nt, Bordetella pertussis
gucucgguggaggacgc

SEQ ID NO: 2439577 - RNA, 18 nt, Bordetella pertussis
gucucguccacccccguc

SEQ ID NO: 2439578 - RNA, 17 nt, Bordetella pertussis
gucucgugccccgcaug

SEQ ID NO: 2439579 - RNA, 15 nt, Bordetella pertussis
gucucguuccagaug

SEQ ID NO: 2439580 - RNA, 22 nt, Bordetella pertussis
gucucguuccagaugcgcagca

SEQ ID NO: 2439581 - RNA, 13 nt, Bordetella pertussis
gucugagcgccgg

SEQ ID NO: 2439582 - RNA, 15 nt, Bordetella pertussis
gucugagcgccgggg

SEQ ID NO: 2439583 - RNA, 19 nt, Bordetella pertussis
gucugcaccugcguggccu

SEQ ID NO: 2439584 - RNA, 13 nt, Bordetella pertussis
gucugcacgccgg

SEQ ID NO: 2439585 - RNA, 14 nt, Bordetella pertussis
gucugcaggcucug

SEQ ID NO: 2439586 - RNA, 12 nt, Bordetella pertussis
gucugcaggugc

SEQ ID NO: 2439587 - RNA, 21 nt, Bordetella pertussis
gucugcauguaguucacccag

SEQ ID NO: 2439588 - RNA, 17 nt, Bordetella pertussis
gucugccacaucacgcc

SEQ ID NO: 2439589 - RNA, 21 nt, Bordetella pertussis
gucugcccgcgguccagcacg

SEQ ID NO: 2439590 - RNA, 15 nt, Bordetella pertussis
gucugcccgugcggg

SEQ ID NO: 2439591 - RNA, 19 nt, Bordetella pertussis
gucugccguuccagcugcu

SEQ ID NO: 2439592 - RNA, 19 nt, Bordetella pertussis
gucugcgcaucgaugcggc

SEQ ID NO: 2439593 - RNA, 15 nt, Bordetella pertussis
gucugcgccgccgcg

SEQ ID NO: 2439594 - RNA, 13 nt, Bordetella pertussis
gucugcgccuucc

SEQ ID NO: 2439595 - RNA, 16 nt, Bordetella pertussis
gucugcgccuuccggg

SEQ ID NO: 2439596 - RNA, 16 nt, Bordetella pertussis
gucugcgugcgcggcg

SEQ ID NO: 2439597 - RNA, 16 nt, Bordetella pertussis
gucugcgugugccgcc

SEQ ID NO: 2439598 - RNA, 18 nt, Bordetella pertussis
gucugcgugugccgccag

SEQ ID NO: 2439599 - RNA, 17 nt, Bordetella pertussis
gucugcuacaccgugcu

SEQ ID NO: 2439600 - RNA, 22 nt, Bordetella pertussis
gucugcuggucgcgggccaggc

SEQ ID NO: 2439601 - RNA, 23 nt, Bordetella pertussis
gucuggagauggguacagcgcgc

SEQ ID NO: 2439602 - RNA, 14 nt, Bordetella pertussis
gucuggagcggccu

SEQ ID NO: 2439603 - RNA, 15 nt, Bordetella pertussis
gucuggagcggccug

SEQ ID NO: 2439604 - RNA, 16 nt, Bordetella pertussis
gucuggagcggccugg

SEQ ID NO: 2439605 - RNA, 17 nt, Bordetella pertussis
gucuggagcggccuggc

SEQ ID NO: 2439606 - RNA, 19 nt, Bordetella pertussis
gucuggagcggccuggccc

SEQ ID NO: 2439607 - RNA, 15 nt, Bordetella pertussis
gucuggaggacgagc

SEQ ID NO: 2439608 - RNA, 16 nt, Bordetella pertussis
gucuggaggacgagcg

SEQ ID NO: 2439609 - RNA, 16 nt, Bordetella pertussis
gucuggcaccugccga

SEQ ID NO: 2439610 - RNA, 15 nt, Bordetella pertussis
gucuggccggccgcg

SEQ ID NO: 2439611 - RNA, 16 nt, Bordetella pertussis
gucuggccggugaugc

SEQ ID NO: 2439612 - RNA, 14 nt, Bordetella pertussis
gucuggcggccggu

SEQ ID NO: 2439613 - RNA, 14 nt, Bordetella pertussis
gucugggccagcag

SEQ ID NO: 2439614 - RNA, 13 nt, Bordetella pertussis
gucugggccaugc

SEQ ID NO: 2439615 - RNA, 18 nt, Bordetella pertussis
gucugggccgaguuggca

SEQ ID NO: 2439616 - RNA, 19 nt, Bordetella pertussis
gucugggcgucccaggcca

SEQ ID NO: 2439617 - RNA, 21 nt, Bordetella pertussis
gucugggcgucccaggccacg

SEQ ID NO: 2439618 - RNA, 23 nt, Bordetella pertussis
gucugguggcgauccauguggcc

SEQ ID NO: 2439619 - RNA, 11 nt, Bordetella pertussis
gucuguaucgu

SEQ ID NO: 2439620 - RNA, 21 nt, Bordetella pertussis
gucugugcgccccgcuggccg

SEQ ID NO: 2439621 - RNA, 22 nt, Bordetella pertussis
gucuucaguugacgccggcggc

SEQ ID NO: 2439622 - RNA, 15 nt, Bordetella pertussis
gucuuccaggcgcag

SEQ ID NO: 2439623 - RNA, 18 nt, Bordetella pertussis
gucuuccgguacgcgcag

SEQ ID NO: 2439624 - RNA, 17 nt, Bordetella pertussis
gucuucgagcgcgagca

SEQ ID NO: 2439625 - RNA, 17 nt, Bordetella pertussis
gucuucgaugcuggcgc

SEQ ID NO: 2439626 - RNA, 19 nt, Bordetella pertussis
gucuucgaugcuggcgcgg

SEQ ID NO: 2439627 - RNA, 23 nt, Bordetella pertussis
gucuucgaugcuggcgcggaccu

SEQ ID NO: 2439628 - RNA, 14 nt, Bordetella pertussis
gucuucggcgcggc

SEQ ID NO: 2439629 - RNA, 23 nt, Bordetella pertussis
gucuucggcgcggcgggcucagc

SEQ ID NO: 2439630 - RNA, 22 nt, Bordetella pertussis
gucuugaggauaucggccaggc

SEQ ID NO: 2439631 - RNA, 13 nt, Bordetella pertussis
gucuugccgcgca

SEQ ID NO: 2439632 - RNA, 12 nt, Bordetella pertussis
gucuugcgcugg

SEQ ID NO: 2439633 - RNA, 14 nt, Bordetella pertussis
gucuuggcgggcac

SEQ ID NO: 2439634 - RNA, 22 nt, Bordetella pertussis
gucuuggcgugcaggcuggacc

SEQ ID NO: 2439635 - RNA, 17 nt, Bordetella pertussis
gucuuugaagggcggcg

SEQ ID NO: 2439636 - RNA, 14 nt, Bordetella pertussis
gugaaacagcagcg

SEQ ID NO: 2439637 - RNA, 22 nt, Bordetella pertussis
gugaaacagcaucagcggcagc

SEQ ID NO: 2439638 - RNA, 19 nt, Bordetella pertussis
gugaacgccaccaggccga

SEQ ID NO: 2439639 - RNA, 13 nt, Bordetella pertussis
gugaacgccccgg

SEQ ID NO: 2439640 - RNA, 18 nt, Bordetella pertussis
gugaacgccccggccgau

SEQ ID NO: 2439641 - RNA, 13 nt, Bordetella pertussis
gugaacgcgcauu

SEQ ID NO: 2439642 - RNA, 19 nt, Bordetella pertussis
gugaagccaagcagggcau

SEQ ID NO: 2439643 - RNA, 15 nt, Bordetella pertussis
gugaagcccauggcg

SEQ ID NO: 2439644 - RNA, 13 nt, Bordetella pertussis
gugacaugcacga

SEQ ID NO: 2439645 - RNA, 13 nt, Bordetella pertussis
gugaccagcugca

SEQ ID NO: 2439646 - RNA, 19 nt, Bordetella pertussis
gugacccggggcaggaagc

SEQ ID NO: 2439647 - RNA, 14 nt, Bordetella pertussis
gugaccgacaggcc

SEQ ID NO: 2439648 - RNA, 18 nt, Bordetella pertussis
gugaccgacaggccuggc

SEQ ID NO: 2439649 - RNA, 14 nt, Bordetella pertussis
gugaccgccagcag

SEQ ID NO: 2439650 - RNA, 15 nt, Bordetella pertussis
gugaccgccagcagg

SEQ ID NO: 2439651 - RNA, 17 nt, Bordetella pertussis
gugaccgccagcaggcg

SEQ ID NO: 2439652 - RNA, 19 nt, Bordetella pertussis
gugaccgccagcaggcgcu

SEQ ID NO: 2439653 - RNA, 14 nt, Bordetella pertussis
gugaccgcgacgcg

SEQ ID NO: 2439654 - RNA, 18 nt, Bordetella pertussis
gugaccgcgacgcgccug

SEQ ID NO: 2439655 - RNA, 23 nt, Bordetella pertussis
gugaccgcgacgcgccugcgcgc

SEQ ID NO: 2439656 - RNA, 14 nt, Bordetella pertussis
gugaccggacuguc

SEQ ID NO: 2439657 - RNA, 18 nt, Bordetella pertussis
gugaccggcgugacgcgc

SEQ ID NO: 2439658 - RNA, 17 nt, Bordetella pertussis
gugaccggguggcugcg

SEQ ID NO: 2439659 - RNA, 21 nt, Bordetella pertussis
gugaccugcgucugcgugccg

SEQ ID NO: 2439660 - RNA, 13 nt, Bordetella pertussis
gugaccugcucgu

SEQ ID NO: 2439661 - RNA, 21 nt, Bordetella pertussis
gugaccugcucgucgccaugc

SEQ ID NO: 2439662 - RNA, 23 nt, Bordetella pertussis
gugacgacgcguuguucgggccg

SEQ ID NO: 2439663 - RNA, 17 nt, Bordetella pertussis
gugacgauauccaggcg

SEQ ID NO: 2439664 - RNA, 17 nt, Bordetella pertussis
gugacgauggugcgcag

SEQ ID NO: 2439665 - RNA, 15 nt, Bordetella pertussis
gugacgcccugccau

SEQ ID NO: 2439666 - RNA, 14 nt, Bordetella pertussis
gugacgcugauggc

SEQ ID NO: 2439667 - RNA, 21 nt, Bordetella pertussis
gugacgcugauggccgccagc

SEQ ID NO: 2439668 - RNA, 22 nt, Bordetella pertussis
gugacgcugauggccgccagcg

SEQ ID NO: 2439669 - RNA, 17 nt, Bordetella pertussis
gugacgcuggagcgcgg

SEQ ID NO: 2439670 - RNA, 19 nt, Bordetella pertussis
gugacgcuggagcgcggcg

SEQ ID NO: 2439671 - RNA, 23 nt, Bordetella pertussis
gugacggaccuuguauuccaucu

SEQ ID NO: 2439672 - RNA, 19 nt, Bordetella pertussis
gugacggauucccagcucc

SEQ ID NO: 2439673 - RNA, 13 nt, Bordetella pertussis
gugacggccgcca

SEQ ID NO: 2439674 - RNA, 20 nt, Bordetella pertussis
gugacggccgccacgcccug

SEQ ID NO: 2439675 - RNA, 15 nt, Bordetella pertussis
gugacggcggcgcgc

SEQ ID NO: 2439676 - RNA, 14 nt, Bordetella pertussis
gugacgggcugggc

SEQ ID NO: 2439677 - RNA, 19 nt, Bordetella pertussis
gugacgggcugggccgagg

SEQ ID NO: 2439678 - RNA, 19 nt, Bordetella pertussis
gugacguagcgguagggcg

SEQ ID NO: 2439679 - RNA, 17 nt, Bordetella pertussis
gugacguugaccuugcc

SEQ ID NO: 2439680 - RNA, 18 nt, Bordetella pertussis
gugacguugagcgccggg

SEQ ID NO: 2439681 - RNA, 21 nt, Bordetella pertussis
gugacguugagcgccggggcg

SEQ ID NO: 2439682 - RNA, 13 nt, Bordetella pertussis
gugacuuccuggu

SEQ ID NO: 2439683 - RNA, 14 nt, Bordetella pertussis
gugacuucggccgc

SEQ ID NO: 2439684 - RNA, 20 nt, Bordetella pertussis
gugagcacgacguugggcau

SEQ ID NO: 2439685 - RNA, 21 nt, Bordetella pertussis
gugcccagcgagaucagcacc

SEQ ID NO: 2439686 - RNA, 13 nt, Bordetella pertussis
gugcccagcgagc

SEQ ID NO: 2439687 - RNA, 16 nt, Bordetella pertussis
gugcccagcgagcggg

SEQ ID NO: 2439688 - RNA, 18 nt, Bordetella pertussis
gugcccagcgagcggggc

SEQ ID NO: 2439689 - RNA, 13 nt, Bordetella pertussis
gugcccagcuggc

SEQ ID NO: 2439690 - RNA, 20 nt, Bordetella pertussis
gugcccaguucgcggccggc

SEQ ID NO: 2439691 - RNA, 13 nt, Bordetella pertussis
gugcccaucgcgc

SEQ ID NO: 2439692 - RNA, 14 nt, Bordetella pertussis
gugccccacgccga

SEQ ID NO: 2439693 - RNA, 23 nt, Bordetella pertussis
gugccccacgccgaugccgcgca

SEQ ID NO: 2439694 - RNA, 18 nt, Bordetella pertussis
gugcccccacgcugcgcc

SEQ ID NO: 2439695 - RNA, 20 nt, Bordetella pertussis
gugcccccacgcugcgcccg

SEQ ID NO: 2439696 - RNA, 13 nt, Bordetella pertussis
gugccccggccuc

SEQ ID NO: 2439697 - RNA, 15 nt, Bordetella pertussis
gugcccgagggcgcg

SEQ ID NO: 2439698 - RNA, 22 nt, Bordetella pertussis
gugcccgagggcgcgucgaccu

SEQ ID NO: 2439699 - RNA, 16 nt, Bordetella pertussis
gugcccgccacccagg

SEQ ID NO: 2439700 - RNA, 21 nt, Bordetella pertussis
gugcccgccacccagggcuug

SEQ ID NO: 2439701 - RNA, 14 nt, Bordetella pertussis
gugcccgcuggcca

SEQ ID NO: 2439702 - RNA, 15 nt, Bordetella pertussis
gugcccgcuggccau

SEQ ID NO: 2439703 - RNA, 16 nt, Bordetella pertussis
gugcccgcuggccaug

SEQ ID NO: 2439704 - RNA, 13 nt, Bordetella pertussis
gugcccggcgggc

SEQ ID NO: 2439705 - RNA, 14 nt, Bordetella pertussis
gugcccggcgggcc

SEQ ID NO: 2439706 - RNA, 19 nt, Bordetella pertussis
gugcccgguucugcggcgc

SEQ ID NO: 2439707 - RNA, 18 nt, Bordetella pertussis
gugcccguugccgcgcgc

SEQ ID NO: 2439708 - RNA, 12 nt, Bordetella pertussis
gugcccucgcug

SEQ ID NO: 2439709 - RNA, 16 nt, Bordetella pertussis
gugcccucgcugcgcg

SEQ ID NO: 2439710 - RNA, 21 nt, Bordetella pertussis
gugcccugacccgcuggcugg

SEQ ID NO: 2439711 - RNA, 16 nt, Bordetella pertussis
gugcccugcggcgcgg

SEQ ID NO: 2439712 - RNA, 23 nt, Bordetella pertussis
gugcccugcggcgcggccagcac

SEQ ID NO: 2439713 - RNA, 22 nt, Bordetella pertussis
gugcccuugaccgacgugcugc

SEQ ID NO: 2439714 - RNA, 15 nt, Bordetella pertussis
gugcccuugggggcc

SEQ ID NO: 2439715 - RNA, 18 nt, Bordetella pertussis
gugccgacgaugccgccg

SEQ ID NO: 2439716 - RNA, 12 nt, Bordetella pertussis
gugccgacggcg

SEQ ID NO: 2439717 - RNA, 15 nt, Bordetella pertussis
gugccgacggcgcgg

SEQ ID NO: 2439718 - RNA, 23 nt, Bordetella pertussis
gugccgcacgguggcgccgucgc

SEQ ID NO: 2439719 - RNA, 18 nt, Bordetella pertussis
gugccgcagacggucgac

SEQ ID NO: 2439720 - RNA, 14 nt, Bordetella pertussis
gugccgcagcgagg

SEQ ID NO: 2439721 - RNA, 13 nt, Bordetella pertussis
gugccgcaggcca

SEQ ID NO: 2439722 - RNA, 14 nt, Bordetella pertussis
gugccgcaggccag

SEQ ID NO: 2439723 - RNA, 14 nt, Bordetella pertussis
gugccgccagcggg

SEQ ID NO: 2439724 - RNA, 16 nt, Bordetella pertussis
gugccgcccaggagca

SEQ ID NO: 2439725 - RNA, 13 nt, Bordetella pertussis
gugccgccgagca

SEQ ID NO: 2439726 - RNA, 15 nt, Bordetella pertussis
gugccgccgagcagg

SEQ ID NO: 2439727 - RNA, 14 nt, Bordetella pertussis
gugccgccggcgcg

SEQ ID NO: 2439728 - RNA, 22 nt, Bordetella pertussis
gugccgccggcgcggcugcugg

SEQ ID NO: 2439729 - RNA, 16 nt, Bordetella pertussis
gugccgccuggccaga

SEQ ID NO: 2439730 - RNA, 19 nt, Bordetella pertussis
gugccgccuucgccguggu

SEQ ID NO: 2439731 - RNA, 17 nt, Bordetella pertussis
gugccgcgagaaaaucg

SEQ ID NO: 2439732 - RNA, 19 nt, Bordetella pertussis
gugccgcgcacccaggccc

SEQ ID NO: 2439733 - RNA, 15 nt, Bordetella pertussis
gugccgcgcaggccc

SEQ ID NO: 2439734 - RNA, 14 nt, Bordetella pertussis
gugccgcgcgcggc

SEQ ID NO: 2439735 - RNA, 17 nt, Bordetella pertussis
gugccgcgcgcggccgg

SEQ ID NO: 2439736 - RNA, 20 nt, Bordetella pertussis
gugccgcgcgcggccggcac

SEQ ID NO: 2439737 - RNA, 21 nt, Bordetella pertussis
gugccgcgcgcggccggcacc

SEQ ID NO: 2439738 - RNA, 18 nt, Bordetella pertussis
gugccgcgcugggcgcug

SEQ ID NO: 2439739 - RNA, 23 nt, Bordetella pertussis
gugccgcggcgcggcccgccacg

SEQ ID NO: 2439740 - RNA, 22 nt, Bordetella pertussis
gugccgcguaugcggcagcagg

SEQ ID NO: 2439741 - RNA, 12 nt, Bordetella pertussis
gugccgcuggcg

SEQ ID NO: 2439742 - RNA, 14 nt, Bordetella pertussis
gugccgcuggcggc

SEQ ID NO: 2439743 - RNA, 17 nt, Bordetella pertussis
gugccgcuggcggcccu

SEQ ID NO: 2439744 - RNA, 20 nt, Bordetella pertussis
gugccgcuggcggcccugcc

SEQ ID NO: 2439745 - RNA, 15 nt, Bordetella pertussis
gugccggacgccgac

SEQ ID NO: 2439746 - RNA, 18 nt, Bordetella pertussis
gugccggacgccgacugg

SEQ ID NO: 2439747 - RNA, 13 nt, Bordetella pertussis
gugccggccagcc

SEQ ID NO: 2439748 - RNA, 14 nt, Bordetella pertussis
gugccggccgucuu

SEQ ID NO: 2439749 - RNA, 21 nt, Bordetella pertussis
gugccgggaugcugcucggcc

SEQ ID NO: 2439750 - RNA, 22 nt, Bordetella pertussis
gugccgggaugcugcucggcca

SEQ ID NO: 2439751 - RNA, 14 nt, Bordetella pertussis
gugccgggccuggu

SEQ ID NO: 2439752 - RNA, 15 nt, Bordetella pertussis
gugccgggccuggug

SEQ ID NO: 2439753 - RNA, 12 nt, Bordetella pertussis
gugccgggcuug

SEQ ID NO: 2439754 - RNA, 15 nt, Bordetella pertussis
gugccgggcuugcgc

SEQ ID NO: 2439755 - RNA, 16 nt, Bordetella pertussis
gugccggggaucacca

SEQ ID NO: 2439756 - RNA, 22 nt, Bordetella pertussis
gugccggggaucaccagcccgg

SEQ ID NO: 2439757 - RNA, 17 nt, Bordetella pertussis
gugccgguugcgcgccg

SEQ ID NO: 2439758 - RNA, 16 nt, Bordetella pertussis
gugccguccagcgcgg

SEQ ID NO: 2439759 - RNA, 21 nt, Bordetella pertussis
gugccguccagcgcggcgcca

SEQ ID NO: 2439760 - RNA, 12 nt, Bordetella pertussis
gugccgucgaug

SEQ ID NO: 2439761 - RNA, 17 nt, Bordetella pertussis
gugccguucccgccggg

SEQ ID NO: 2439762 - RNA, 20 nt, Bordetella pertussis
gugccguucggccagcgcgc

SEQ ID NO: 2439763 - RNA, 23 nt, Bordetella pertussis
gugccugccccugcggggacagg

SEQ ID NO: 2439764 - RNA, 23 nt, Bordetella pertussis
gugccugcgaacgcccggcccag

SEQ ID NO: 2439765 - RNA, 14 nt, Bordetella pertussis
gugccuggacgcgc

SEQ ID NO: 2439766 - RNA, 20 nt, Bordetella pertussis
gugccuggacgcgcuggccg

SEQ ID NO: 2439767 - RNA, 22 nt, Bordetella pertussis
gugccuggacgcgcuggccgac

SEQ ID NO: 2439768 - RNA, 24 nt, Bordetella pertussis
gugccuggacgcgcuggccgacaa

SEQ ID NO: 2439769 - RNA, 11 nt, Bordetella pertussis
gugccuguccc

SEQ ID NO: 2439770 - RNA, 18 nt, Bordetella pertussis
gugccuguccccacaggg

SEQ ID NO: 2439771 - RNA, 21 nt, Bordetella pertussis
gugccuguccccacaugggga

SEQ ID NO: 2439772 - RNA, 17 nt, Bordetella pertussis
gugccuguccccaccgg

SEQ ID NO: 2439773 - RNA, 19 nt, Bordetella pertussis
gugccuguccccaccggga

SEQ ID NO: 2439774 - RNA, 23 nt, Bordetella pertussis
gugccuguccccaccgggacagg

SEQ ID NO: 2439775 - RNA, 19 nt, Bordetella pertussis
gugccuguccccacgggga

SEQ ID NO: 2439776 - RNA, 20 nt, Bordetella pertussis
gugccuguccccacggggac

SEQ ID NO: 2439777 - RNA, 21 nt, Bordetella pertussis
gugccuguccccacggggaca

SEQ ID NO: 2439778 - RNA, 13 nt, Bordetella pertussis
gugccuguccccg

SEQ ID NO: 2439779 - RNA, 22 nt, Bordetella pertussis
gugccuguccccgcacggggac

SEQ ID NO: 2439780 - RNA, 23 nt, Bordetella pertussis
gugccuguccccgcacggggaca

SEQ ID NO: 2439781 - RNA, 19 nt, Bordetella pertussis
gugccuguccccgcaggga

SEQ ID NO: 2439782 - RNA, 20 nt, Bordetella pertussis
gugccuguccccgcagggac

SEQ ID NO: 2439783 - RNA, 23 nt, Bordetella pertussis
gugccuguccccgcagggacagg

SEQ ID NO: 2439784 - RNA, 16 nt, Bordetella pertussis
gugccuguccccgccg

SEQ ID NO: 2439785 - RNA, 20 nt, Bordetella pertussis
gugccuguccccgccgggac

SEQ ID NO: 2439786 - RNA, 23 nt, Bordetella pertussis
gugccuguccccgccgggacagg

SEQ ID NO: 2439787 - RNA, 20 nt, Bordetella pertussis
gugccuguccccgcggggac

SEQ ID NO: 2439788 - RNA, 22 nt, Bordetella pertussis
gugccuguccccgcggggacag

SEQ ID NO: 2439789 - RNA, 23 nt, Bordetella pertussis
gugccuguccccgcggggacaga

SEQ ID NO: 2439790 - RNA, 23 nt, Bordetella pertussis
gugccuguccccgcugggacagg

SEQ ID NO: 2439791 - RNA, 20 nt, Bordetella pertussis
gugccuguccccguggggac

SEQ ID NO: 2439792 - RNA, 22 nt, Bordetella pertussis
gugccuguccccguggggacag

SEQ ID NO: 2439793 - RNA, 23 nt, Bordetella pertussis
gugccuguccccguggggacaga

SEQ ID NO: 2439794 - RNA, 20 nt, Bordetella pertussis
gugccugucccggcugggac

SEQ ID NO: 2439795 - RNA, 20 nt, Bordetella pertussis
gugccugucccugccgggac

SEQ ID NO: 2439796 - RNA, 15 nt, Bordetella pertussis
gugccuguccucccc

SEQ ID NO: 2439797 - RNA, 17 nt, Bordetella pertussis
gugcugcggcagccagg

SEQ ID NO: 2439798 - RNA, 12 nt, Bordetella pertussis
gugcugcggcug

SEQ ID NO: 2439799 - RNA, 13 nt, Bordetella pertussis
gugcugcggcuga

SEQ ID NO: 2439800 - RNA, 19 nt, Bordetella pertussis
gugcugcucaacggccacc

SEQ ID NO: 2439801 - RNA, 13 nt, Bordetella pertussis
gugcugcugcacg

SEQ ID NO: 2439802 - RNA, 15 nt, Bordetella pertussis
gugcugcugggcgcc

SEQ ID NO: 2439803 - RNA, 11 nt, Bordetella pertussis
gugcugcuguu

SEQ ID NO: 2439804 - RNA, 17 nt, Bordetella pertussis
gugcuggacccgcugcg

SEQ ID NO: 2439805 - RNA, 10 nt, Bordetella pertussis
gugcuggagg

SEQ ID NO: 2439806 - RNA, 16 nt, Bordetella pertussis
gugcuggccaacgcca

SEQ ID NO: 2439807 - RNA, 13 nt, Bordetella pertussis
gugcuggccaucu

SEQ ID NO: 2439808 - RNA, 17 nt, Bordetella pertussis
gugcuggcccgccagca

SEQ ID NO: 2439809 - RNA, 20 nt, Bordetella pertussis
gugcuggccgaaccauugca

SEQ ID NO: 2439810 - RNA, 23 nt, Bordetella pertussis
gugcuggccgacgcgcugguccg

SEQ ID NO: 2439811 - RNA, 17 nt, Bordetella pertussis
gugcuggcugagcaggc

SEQ ID NO: 2439812 - RNA, 15 nt, Bordetella pertussis
gugcugggcggccag

SEQ ID NO: 2439813 - RNA, 17 nt, Bordetella pertussis
gugcugggcggccaggc

SEQ ID NO: 2439814 - RNA, 14 nt, Bordetella pertussis
gugcugggcggcgg

SEQ ID NO: 2439815 - RNA, 15 nt, Bordetella pertussis
gugcugggcggcggg

SEQ ID NO: 2439816 - RNA, 16 nt, Bordetella pertussis
gugcugggcggcgggc

SEQ ID NO: 2439817 - RNA, 19 nt, Bordetella pertussis
gugcugggcggcgggcacg

SEQ ID NO: 2439818 - RNA, 18 nt, Bordetella pertussis
gugcuggucauugaccug

SEQ ID NO: 2439819 - RNA, 16 nt, Bordetella pertussis
gugcuggugccgcugg

SEQ ID NO: 2439820 - RNA, 14 nt, Bordetella pertussis
gugcuggugcuggu

SEQ ID NO: 2439821 - RNA, 19 nt, Bordetella pertussis
gugcuggugcuggugccgc

SEQ ID NO: 2439822 - RNA, 22 nt, Bordetella pertussis
gugcuguaccucagccugcugg

SEQ ID NO: 2439823 - RNA, 19 nt, Bordetella pertussis
gugcuguucaggcgcucga

SEQ ID NO: 2439824 - RNA, 12 nt, Bordetella pertussis
gugcuugccgca

SEQ ID NO: 2439825 - RNA, 13 nt, Bordetella pertussis
gugcuugccgcag

SEQ ID NO: 2439826 - RNA, 16 nt, Bordetella pertussis
gugcuugccgcagcgg

SEQ ID NO: 2439827 - RNA, 17 nt, Bordetella pertussis
gugcuugccgcagcggc

SEQ ID NO: 2439828 - RNA, 20 nt, Bordetella pertussis
gugcuugccgcagcggccau

SEQ ID NO: 2439829 - RNA, 13 nt, Bordetella pertussis
gugcuugcggcug

SEQ ID NO: 2439830 - RNA, 14 nt, Bordetella pertussis
gugcuugcggcugu

SEQ ID NO: 2439831 - RNA, 22 nt, Bordetella pertussis
guggaaaucgugcuagaauccu

SEQ ID NO: 2439832 - RNA, 18 nt, Bordetella pertussis
guggaaaugccggcggcg

SEQ ID NO: 2439833 - RNA, 12 nt, Bordetella pertussis
guggacacgccc

SEQ ID NO: 2439834 - RNA, 15 nt, Bordetella pertussis
guggacacgcccaug

SEQ ID NO: 2439835 - RNA, 16 nt, Bordetella pertussis
guggacagcgccagcc

SEQ ID NO: 2439836 - RNA, 21 nt, Bordetella pertussis
guggacaggaacuccggcggc

SEQ ID NO: 2439837 - RNA, 10 nt, Bordetella pertussis
guggacaggc

SEQ ID NO: 2439838 - RNA, 24 nt, Bordetella pertussis
guggacaggcaccugcgaccgagc

SEQ ID NO: 2439839 - RNA, 20 nt, Bordetella pertussis
guggacgaauacgcuggcgc

SEQ ID NO: 2439840 - RNA, 21 nt, Bordetella pertussis
guggacgaauacgcuggcgcg

SEQ ID NO: 2439841 - RNA, 16 nt, Bordetella pertussis
guggacgccgccggcc

SEQ ID NO: 2439842 - RNA, 14 nt, Bordetella pertussis
guggacggccagca

SEQ ID NO: 2439843 - RNA, 17 nt, Bordetella pertussis
guggagcgcggcgcugg

SEQ ID NO: 2439844 - RNA, 14 nt, Bordetella pertussis
guggagcugcucac

SEQ ID NO: 2439845 - RNA, 15 nt, Bordetella pertussis
guggaggacgccgac

SEQ ID NO: 2439846 - RNA, 13 nt, Bordetella pertussis
guggcacagccgc

SEQ ID NO: 2439847 - RNA, 14 nt, Bordetella pertussis
guggcacagccgca

SEQ ID NO: 2439848 - RNA, 13 nt, Bordetella pertussis
guggcacaucagc

SEQ ID NO: 2439849 - RNA, 19 nt, Bordetella pertussis
guggcacaucagcgugccg

SEQ ID NO: 2439850 - RNA, 21 nt, Bordetella pertussis
guggcagagggcgacggcggc

SEQ ID NO: 2439851 - RNA, 16 nt, Bordetella pertussis
guggcaggccagcgcc

SEQ ID NO: 2439852 - RNA, 17 nt, Bordetella pertussis
guggcaggcgcccaacc

SEQ ID NO: 2439853 - RNA, 18 nt, Bordetella pertussis
guggcaggugcggccgca

SEQ ID NO: 2439854 - RNA, 21 nt, Bordetella pertussis
guggcauagaaguagcugcgg

SEQ ID NO: 2439855 - RNA, 22 nt, Bordetella pertussis
guggcauagaaguagcugcggu

SEQ ID NO: 2439856 - RNA, 19 nt, Bordetella pertussis
guggcauugacgcccacgc

SEQ ID NO: 2439857 - RNA, 21 nt, Bordetella pertussis
guggcauugacgcccacgcuc

SEQ ID NO: 2439858 - RNA, 16 nt, Bordetella pertussis
guggccaagggcgccg

SEQ ID NO: 2439859 - RNA, 21 nt, Bordetella pertussis
guggccaagggcgccgcgccg

SEQ ID NO: 2439860 - RNA, 15 nt, Bordetella pertussis
guggccaccaggcgc

SEQ ID NO: 2439861 - RNA, 22 nt, Bordetella pertussis
guggccaccaggcgcgcgccau

SEQ ID NO: 2439862 - RNA, 14 nt, Bordetella pertussis
guggccacggccgc

SEQ ID NO: 2439863 - RNA, 11 nt, Bordetella pertussis
guggccagcac

SEQ ID NO: 2439864 - RNA, 22 nt, Bordetella pertussis
guggccagcacggcgcacacca

SEQ ID NO: 2439865 - RNA, 13 nt, Bordetella pertussis
guggccagcagcu

SEQ ID NO: 2439866 - RNA, 14 nt, Bordetella pertussis
guggccagccaggc

SEQ ID NO: 2439867 - RNA, 20 nt, Bordetella pertussis
guggccagccaggcgguggc

SEQ ID NO: 2439868 - RNA, 13 nt, Bordetella pertussis
guggccagcccgg

SEQ ID NO: 2439869 - RNA, 13 nt, Bordetella pertussis
guggccagcgccg

SEQ ID NO: 2439870 - RNA, 14 nt, Bordetella pertussis
guggccagcgccgc

SEQ ID NO: 2439871 - RNA, 15 nt, Bordetella pertussis
guggccagcgccgcc

SEQ ID NO: 2439872 - RNA, 17 nt, Bordetella pertussis
guggccagcgccgccag

SEQ ID NO: 2439873 - RNA, 19 nt, Bordetella pertussis
guggccagcgccgccagcc

SEQ ID NO: 2439874 - RNA, 12 nt, Bordetella pertussis
guggccagcgua

SEQ ID NO: 2439875 - RNA, 22 nt, Bordetella pertussis
guggccagcuccaccgggcuga

SEQ ID NO: 2439876 - RNA, 17 nt, Bordetella pertussis
guggccagcugcguggc

SEQ ID NO: 2439877 - RNA, 19 nt, Bordetella pertussis
guggccaugcaccagcaca

SEQ ID NO: 2439878 - RNA, 12 nt, Bordetella pertussis
guggccaugcug

SEQ ID NO: 2439879 - RNA, 21 nt, Bordetella pertussis
guggcccaagcccguggcggg

SEQ ID NO: 2439880 - RNA, 14 nt, Bordetella pertussis
guggcccagcaccg

SEQ ID NO: 2439881 - RNA, 14 nt, Bordetella pertussis
guggcccagccgca

SEQ ID NO: 2439882 - RNA, 19 nt, Bordetella pertussis
guggcccagccgcaugccg

SEQ ID NO: 2439883 - RNA, 20 nt, Bordetella pertussis
guggcccagccgcaugccgg

SEQ ID NO: 2439884 - RNA, 14 nt, Bordetella pertussis
guggcccagccggu

SEQ ID NO: 2439885 - RNA, 22 nt, Bordetella pertussis
guggccccaggcgugaacgccc

SEQ ID NO: 2439886 - RNA, 19 nt, Bordetella pertussis
guggcccgcaccgggcggc

SEQ ID NO: 2439887 - RNA, 13 nt, Bordetella pertussis
guggcccgccauu

SEQ ID NO: 2439888 - RNA, 21 nt, Bordetella pertussis
guggcccgccauugcacgcgc

SEQ ID NO: 2439889 - RNA, 17 nt, Bordetella pertussis
guggcccgcgccgcguc

SEQ ID NO: 2439890 - RNA, 16 nt, Bordetella pertussis
guggcccgcgugacgg

SEQ ID NO: 2439891 - RNA, 18 nt, Bordetella pertussis
guggccgauuccagcgcc

SEQ ID NO: 2439892 - RNA, 20 nt, Bordetella pertussis
guggccgcagucaggaaaau

SEQ ID NO: 2439893 - RNA, 14 nt, Bordetella pertussis
guggccgccggguc

SEQ ID NO: 2439894 - RNA, 21 nt, Bordetella pertussis
guggccgccgggucgcugugc

SEQ ID NO: 2439895 - RNA, 11 nt, Bordetella pertussis
guggccgcgca

SEQ ID NO: 2439896 - RNA, 13 nt, Bordetella pertussis
guggccgcgcaag

SEQ ID NO: 2439897 - RNA, 15 nt, Bordetella pertussis
guggccgcgcaaggc

SEQ ID NO: 2439898 - RNA, 23 nt, Bordetella pertussis
guggccgcgcaaggccugcucgg

SEQ ID NO: 2439899 - RNA, 20 nt, Bordetella pertussis
guggccgcggcccagcgcgg

SEQ ID NO: 2439900 - RNA, 14 nt, Bordetella pertussis
guggccgcuccaga

SEQ ID NO: 2439901 - RNA, 22 nt, Bordetella pertussis
guggccgcuccagagcgcgcac

SEQ ID NO: 2439902 - RNA, 18 nt, Bordetella pertussis
guggccggcaucgcgcug

SEQ ID NO: 2439903 - RNA, 13 nt, Bordetella pertussis
guggccggcgacg

SEQ ID NO: 2439904 - RNA, 15 nt, Bordetella pertussis
guggccggcgacggc

SEQ ID NO: 2439905 - RNA, 13 nt, Bordetella pertussis
guggccggcgcgc

SEQ ID NO: 2439906 - RNA, 15 nt, Bordetella pertussis
guggccggcgcgcgg

SEQ ID NO: 2439907 - RNA, 17 nt, Bordetella pertussis
guggccggcgcgcggcc

SEQ ID NO: 2439908 - RNA, 21 nt, Bordetella pertussis
guggccggcgcggcagccugg

SEQ ID NO: 2439909 - RNA, 15 nt, Bordetella pertussis
guggccggcgggggc

SEQ ID NO: 2439910 - RNA, 22 nt, Bordetella pertussis
guggccguagagggucuggcgg

SEQ ID NO: 2439911 - RNA, 18 nt, Bordetella pertussis
guggggguuguggcgggu

SEQ ID NO: 2439912 - RNA, 13 nt, Bordetella pertussis
guggguggacagg

SEQ ID NO: 2439913 - RNA, 13 nt, Bordetella pertussis
guggguguggcca

SEQ ID NO: 2439914 - RNA, 20 nt, Bordetella pertussis
guggguuggccuugcgcguc

SEQ ID NO: 2439915 - RNA, 13 nt, Bordetella pertussis
gugguagaccggg

SEQ ID NO: 2439916 - RNA, 15 nt, Bordetella pertussis
gugguagccgccguc

SEQ ID NO: 2439917 - RNA, 20 nt, Bordetella pertussis
gugguaugaccggcgcggcc

SEQ ID NO: 2439918 - RNA, 13 nt, Bordetella pertussis
guggucaacggca

SEQ ID NO: 2439919 - RNA, 17 nt, Bordetella pertussis
guggucacguucgaccu

SEQ ID NO: 2439920 - RNA, 23 nt, Bordetella pertussis
guggucacguucgaccugccgcc

SEQ ID NO: 2439921 - RNA, 14 nt, Bordetella pertussis
guggucgccagcac

SEQ ID NO: 2439922 - RNA, 22 nt, Bordetella pertussis
guggucgccguucuggugggca

SEQ ID NO: 2439923 - RNA, 10 nt, Bordetella pertussis
guggucgcgc

SEQ ID NO: 2439924 - RNA, 17 nt, Bordetella pertussis
guggucgcgcccgccgu

SEQ ID NO: 2439925 - RNA, 14 nt, Bordetella pertussis
guggucgugcagga

SEQ ID NO: 2439926 - RNA, 16 nt, Bordetella pertussis
guggucgugcuggcgc

SEQ ID NO: 2439927 - RNA, 15 nt, Bordetella pertussis
guggucuuccaggcg

SEQ ID NO: 2439928 - RNA, 18 nt, Bordetella pertussis
guggucuuccaggcgcag

SEQ ID NO: 2439929 - RNA, 18 nt, Bordetella pertussis
guggugaaagccgccggc

SEQ ID NO: 2439930 - RNA, 20 nt, Bordetella pertussis
guggugaaagccgccggcgc

SEQ ID NO: 2439931 - RNA, 15 nt, Bordetella pertussis
guggugaccacggcg

SEQ ID NO: 2439932 - RNA, 15 nt, Bordetella pertussis
guggugacgaugccc

SEQ ID NO: 2439933 - RNA, 14 nt, Bordetella pertussis
guggugcagcggca

SEQ ID NO: 2439934 - RNA, 13 nt, Bordetella pertussis
guggugccgcgca

SEQ ID NO: 2439935 - RNA, 13 nt, Bordetella pertussis
guggugcgcgguc

SEQ ID NO: 2439936 - RNA, 16 nt, Bordetella pertussis
guggugcgggccgcgc

SEQ ID NO: 2439937 - RNA, 12 nt, Bordetella pertussis
guggugcugcuc

SEQ ID NO: 2439938 - RNA, 16 nt, Bordetella pertussis
gugguggggccgggcu

SEQ ID NO: 2439939 - RNA, 23 nt, Bordetella pertussis
gugguggucacguucgaccugcc

SEQ ID NO: 2439940 - RNA, 15 nt, Bordetella pertussis
gugguggugacguug

SEQ ID NO: 2439941 - RNA, 22 nt, Bordetella pertussis
guggugucgaacagcgagacgg

SEQ ID NO: 2439942 - RNA, 19 nt, Bordetella pertussis
guggugucggcggccagca

SEQ ID NO: 2439943 - RNA, 15 nt, Bordetella pertussis
guggugugcgaggac

SEQ ID NO: 2439944 - RNA, 15 nt, Bordetella pertussis
guguacagccgccug

SEQ ID NO: 2439945 - RNA, 22 nt, Bordetella pertussis
guguacagccgccuggcgcggc

SEQ ID NO: 2439946 - RNA, 18 nt, Bordetella pertussis
guguaccgggccgacgcg

SEQ ID NO: 2439947 - RNA, 21 nt, Bordetella pertussis
guguaccguacccgcgccguc

SEQ ID NO: 2439948 - RNA, 21 nt, Bordetella pertussis
guguagaagaacagcagaugg

SEQ ID NO: 2439949 - RNA, 22 nt, Bordetella pertussis
guguagaagaacagcagauggc

SEQ ID NO: 2439950 - RNA, 23 nt, Bordetella pertussis
guguagguaucguucgcgcgcgc

SEQ ID NO: 2439951 - RNA, 23 nt, Bordetella pertussis
gugucaggaugcccuggguggcg

SEQ ID NO: 2439952 - RNA, 17 nt, Bordetella pertussis
gugucauagcgccagcg

SEQ ID NO: 2439953 - RNA, 15 nt, Bordetella pertussis
guguccacgaacgcg

SEQ ID NO: 2439954 - RNA, 14 nt, Bordetella pertussis
guguccagcggcgc

SEQ ID NO: 2439955 - RNA, 16 nt, Bordetella pertussis
guguccagcggcgcca

SEQ ID NO: 2439956 - RNA, 21 nt, Bordetella pertussis
gugucccggcggggcaggcgc

SEQ ID NO: 2439957 - RNA, 15 nt, Bordetella pertussis
guguccugccggggc

SEQ ID NO: 2439958 - RNA, 22 nt, Bordetella pertussis
guguccugccggggcacccagg

SEQ ID NO: 2439959 - RNA, 17 nt, Bordetella pertussis
guguccuggucggcgcg

SEQ ID NO: 2439960 - RNA, 18 nt, Bordetella pertussis
gugucgaacggaaacccu

SEQ ID NO: 2439961 - RNA, 13 nt, Bordetella pertussis
gugucgcaccgca

SEQ ID NO: 2439962 - RNA, 18 nt, Bordetella pertussis
gugucgcaccgcaaggaa

SEQ ID NO: 2439963 - RNA, 17 nt, Bordetella pertussis
gugucgccggggcgcac

SEQ ID NO: 2439964 - RNA, 14 nt, Bordetella pertussis
gugucgccguggcg

SEQ ID NO: 2439965 - RNA, 23 nt, Bordetella pertussis
gugucgcucccccaugcggggac

SEQ ID NO: 2439966 - RNA, 13 nt, Bordetella pertussis
gugucggccacca

SEQ ID NO: 2439967 - RNA, 20 nt, Bordetella pertussis
gugucggccaccacgauggc

SEQ ID NO: 2439968 - RNA, 13 nt, Bordetella pertussis
gugucggccaggg

SEQ ID NO: 2439969 - RNA, 13 nt, Bordetella pertussis
gugucggcggcca

SEQ ID NO: 2439970 - RNA, 13 nt, Bordetella pertussis
gugucggggccgg

SEQ ID NO: 2439971 - RNA, 13 nt, Bordetella pertussis
gugucuccgggcg

SEQ ID NO: 2439972 - RNA, 14 nt, Bordetella pertussis
gugugaucgccgac

SEQ ID NO: 2439973 - RNA, 17 nt, Bordetella pertussis
gugugccugucccagcg

SEQ ID NO: 2439974 - RNA, 15 nt, Bordetella pertussis
gugugccuguccccg

SEQ ID NO: 2439975 - RNA, 18 nt, Bordetella pertussis
guguggccaugcaccagc

SEQ ID NO: 2439976 - RNA, 14 nt, Bordetella pertussis
gugugguuggcgcu

SEQ ID NO: 2439977 - RNA, 17 nt, Bordetella pertussis
guguuccagcgccuggc

SEQ ID NO: 2439978 - RNA, 22 nt, Bordetella pertussis
guguuccagcgccuggcgggcc

SEQ ID NO: 2439979 - RNA, 17 nt, Bordetella pertussis
guguuccggcgcgcggu

SEQ ID NO: 2439980 - RNA, 21 nt, Bordetella pertussis
guguucgagcaggcgcgcggu

SEQ ID NO: 2439981 - RNA, 16 nt, Bordetella pertussis
guguucgauggcggcc

SEQ ID NO: 2439982 - RNA, 19 nt, Bordetella pertussis
guguucgauggcggccagg

SEQ ID NO: 2439983 - RNA, 14 nt, Bordetella pertussis
guguucgcgcacca

SEQ ID NO: 2439984 - RNA, 15 nt, Bordetella pertussis
guguucucgcuggug

SEQ ID NO: 2439985 - RNA, 23 nt, Bordetella pertussis
guguugagauuggccgagcgcgg

SEQ ID NO: 2439986 - RNA, 20 nt, Bordetella pertussis
guguugcgugcgagcagaug

SEQ ID NO: 2439987 - RNA, 18 nt, Bordetella pertussis
guuacacuggcccuggca

SEQ ID NO: 2439988 - RNA, 14 nt, Bordetella pertussis
guuacagcuuuucg

SEQ ID NO: 2439989 - RNA, 15 nt, Bordetella pertussis
guuauuuccggccgc

SEQ ID NO: 2439990 - RNA, 18 nt, Bordetella pertussis
guucaccaggaagcgcgc

SEQ ID NO: 2439991 - RNA, 19 nt, Bordetella pertussis
guucaccaggaagcgcgcc

SEQ ID NO: 2439992 - RNA, 22 nt, Bordetella pertussis
guucacccagguaucggccagc

SEQ ID NO: 2439993 - RNA, 23 nt, Bordetella pertussis
guucacccagguaucggccagca

SEQ ID NO: 2439994 - RNA, 14 nt, Bordetella pertussis
guucacgcccagga

SEQ ID NO: 2439995 - RNA, 16 nt, Bordetella pertussis
guucacgccggcgcgc

SEQ ID NO: 2439996 - RNA, 20 nt, Bordetella pertussis
guucacgccggcgcgccggg

SEQ ID NO: 2439997 - RNA, 15 nt, Bordetella pertussis
guucacgcgcagcgu

SEQ ID NO: 2439998 - RNA, 18 nt, Bordetella pertussis
guucacguagaaauacgc

SEQ ID NO: 2439999 - RNA, 23 nt, Bordetella pertussis
guucacguagaaauacgcgcgcg

SEQ ID NO: 2440000 - RNA, 14 nt, Bordetella pertussis
guucagacugcugc

SEQ ID NO: 2440001 - RNA, 13 nt, Bordetella pertussis
guucagcagcagg

SEQ ID NO: 2440002 - RNA, 14 nt, Bordetella pertussis
guucagcagcgcca

SEQ ID NO: 2440003 - RNA, 15 nt, Bordetella pertussis
guucagcagcgccac

SEQ ID NO: 2440004 - RNA, 21 nt, Bordetella pertussis
guucagcauuucgcaaagaag

SEQ ID NO: 2440005 - RNA, 17 nt, Bordetella pertussis
guucagcgcgccagcgc

SEQ ID NO: 2440006 - RNA, 20 nt, Bordetella pertussis
guucagcgcgcgcgccgacg

SEQ ID NO: 2440007 - RNA, 20 nt, Bordetella pertussis
guucagcgggcgcgcccggc

SEQ ID NO: 2440008 - RNA, 17 nt, Bordetella pertussis
guucagcgucucgggcu

SEQ ID NO: 2440009 - RNA, 17 nt, Bordetella pertussis
guucaggccccggccgg

SEQ ID NO: 2440010 - RNA, 18 nt, Bordetella pertussis
guucaggccccggccggu

SEQ ID NO: 2440011 - RNA, 21 nt, Bordetella pertussis
guucaggccuguucggccggg

SEQ ID NO: 2440012 - RNA, 14 nt, Bordetella pertussis
guucaggcgagcgg

SEQ ID NO: 2440013 - RNA, 18 nt, Bordetella pertussis
guucagggcgaacugcuc

SEQ ID NO: 2440014 - RNA, 23 nt, Bordetella pertussis
guucaucagcgcgcgcagccgcg

SEQ ID NO: 2440015 - RNA, 18 nt, Bordetella pertussis
guucaucgggccggcggc

SEQ ID NO: 2440016 - RNA, 20 nt, Bordetella pertussis
guucaugaccaucgcgcacu

SEQ ID NO: 2440017 - RNA, 19 nt, Bordetella pertussis
guucaugaccgccgcgccg

SEQ ID NO: 2440018 - RNA, 20 nt, Bordetella pertussis
guucaugaccgccgcgccgg

SEQ ID NO: 2440019 - RNA, 22 nt, Bordetella pertussis
guucaugcgucgaacggccggg

SEQ ID NO: 2440020 - RNA, 18 nt, Bordetella pertussis
guucaugcguucggccag

SEQ ID NO: 2440021 - RNA, 19 nt, Bordetella pertussis
guucaugcguucggccagc

SEQ ID NO: 2440022 - RNA, 20 nt, Bordetella pertussis
guucaugcguucggccagcc

SEQ ID NO: 2440023 - RNA, 23 nt, Bordetella pertussis
guucauggcguaauugggcuggu

SEQ ID NO: 2440024 - RNA, 18 nt, Bordetella pertussis
guugaccggguugagcgu

SEQ ID NO: 2440025 - RNA, 16 nt, Bordetella pertussis
guugagaaugcccagg

SEQ ID NO: 2440026 - RNA, 16 nt, Bordetella pertussis
guugagcagcaccugg

SEQ ID NO: 2440027 - RNA, 22 nt, Bordetella pertussis
guugagcagcaccugguccugc

SEQ ID NO: 2440028 - RNA, 20 nt, Bordetella pertussis
guugagcagcaugugcucgg

SEQ ID NO: 2440029 - RNA, 13 nt, Bordetella pertussis
guugaggaugugc

SEQ ID NO: 2440030 - RNA, 16 nt, Bordetella pertussis
guugagucuggagaug

SEQ ID NO: 2440031 - RNA, 19 nt, Bordetella pertussis
guugaucucgcccagcagg

SEQ ID NO: 2440032 - RNA, 19 nt, Bordetella pertussis
guugaugaugaucggcgcc

SEQ ID NO: 2440033 - RNA, 18 nt, Bordetella pertussis
guugcaaauucugcaaaa

SEQ ID NO: 2440034 - RNA, 22 nt, Bordetella pertussis
guugcaccgcgucggccugcca

SEQ ID NO: 2440035 - RNA, 16 nt, Bordetella pertussis
guugcagccacaggcc

SEQ ID NO: 2440036 - RNA, 14 nt, Bordetella pertussis
guugcagcgcgcca

SEQ ID NO: 2440037 - RNA, 18 nt, Bordetella pertussis
guugcaggaugcgcggca

SEQ ID NO: 2440038 - RNA, 13 nt, Bordetella pertussis
guugcaggccagg

SEQ ID NO: 2440039 - RNA, 15 nt, Bordetella pertussis
guugcaggccaggcu

SEQ ID NO: 2440040 - RNA, 19 nt, Bordetella pertussis
guugcaggccaggcucagc

SEQ ID NO: 2440041 - RNA, 12 nt, Bordetella pertussis
guugcaggccau

SEQ ID NO: 2440042 - RNA, 16 nt, Bordetella pertussis
guugcaguucgccggc

SEQ ID NO: 2440043 - RNA, 20 nt, Bordetella pertussis
guugcaguucgccggcgccg

SEQ ID NO: 2440044 - RNA, 19 nt, Bordetella pertussis
guugccaagauggcccagg

SEQ ID NO: 2440045 - RNA, 12 nt, Bordetella pertussis
guugccaggcga

SEQ ID NO: 2440046 - RNA, 24 nt, Bordetella pertussis
guugcccaccagccgggcggccac

SEQ ID NO: 2440047 - RNA, 22 nt, Bordetella pertussis
guugcccgagcgcgacagcacc

SEQ ID NO: 2440048 - RNA, 14 nt, Bordetella pertussis
guugcccggcaggc

SEQ ID NO: 2440049 - RNA, 15 nt, Bordetella pertussis
guugcccggcaggca

SEQ ID NO: 2440050 - RNA, 19 nt, Bordetella pertussis
guugccgaagcgucggccu

SEQ ID NO: 2440051 - RNA, 21 nt, Bordetella pertussis
guugccgaagcgucggccugc

SEQ ID NO: 2440052 - RNA, 15 nt, Bordetella pertussis
guugccgccgccggc

SEQ ID NO: 2440053 - RNA, 14 nt, Bordetella pertussis
guugccgccggcca

SEQ ID NO: 2440054 - RNA, 18 nt, Bordetella pertussis
guugccgccggccagggc

SEQ ID NO: 2440055 - RNA, 15 nt, Bordetella pertussis
guugccgcugcaugg

SEQ ID NO: 2440056 - RNA, 17 nt, Bordetella pertussis
guugccgcugcaugggc

SEQ ID NO: 2440057 - RNA, 20 nt, Bordetella pertussis
guugccgcuguggcgcgcca

SEQ ID NO: 2440058 - RNA, 14 nt, Bordetella pertussis
guugccggccagca

SEQ ID NO: 2440059 - RNA, 23 nt, Bordetella pertussis
guugccgggauccacgccgccgg

SEQ ID NO: 2440060 - RNA, 18 nt, Bordetella pertussis
guugcgaaacccgcuggg

SEQ ID NO: 2440061 - RNA, 18 nt, Bordetella pertussis
guugcgaggcggccuuga

SEQ ID NO: 2440062 - RNA, 16 nt, Bordetella pertussis
guugcgcaccaugugc

SEQ ID NO: 2440063 - RNA, 22 nt, Bordetella pertussis
guugcgcaccgcuucuucgucg

SEQ ID NO: 2440064 - RNA, 17 nt, Bordetella pertussis
guugcgccggcucagcc

SEQ ID NO: 2440065 - RNA, 13 nt, Bordetella pertussis
guugcgcgccguc

SEQ ID NO: 2440066 - RNA, 21 nt, Bordetella pertussis
guugcgcgccgucggcgucga

SEQ ID NO: 2440067 - RNA, 13 nt, Bordetella pertussis
guugcgcugcccg

SEQ ID NO: 2440068 - RNA, 22 nt, Bordetella pertussis
guugcgcugcugucgcgcugcc

SEQ ID NO: 2440069 - RNA, 18 nt, Bordetella pertussis
guugcggcagcggcccac

SEQ ID NO: 2440070 - RNA, 14 nt, Bordetella pertussis
guugcggcccgccg

SEQ ID NO: 2440071 - RNA, 17 nt, Bordetella pertussis
guugcggccgugcgcca

SEQ ID NO: 2440072 - RNA, 22 nt, Bordetella pertussis
guugcggccgugcgccagcgcc

SEQ ID NO: 2440073 - RNA, 13 nt, Bordetella pertussis
guugcgggcgcac

SEQ ID NO: 2440074 - RNA, 20 nt, Bordetella pertussis
guugcgguagcgcaagcagg

SEQ ID NO: 2440075 - RNA, 18 nt, Bordetella pertussis
guugcgguaguucagcag

SEQ ID NO: 2440076 - RNA, 18 nt, Bordetella pertussis
guugcgucuccagcgcgg

SEQ ID NO: 2440077 - RNA, 23 nt, Bordetella pertussis
guugcgucuccagcgcggcggac

SEQ ID NO: 2440078 - RNA, 17 nt, Bordetella pertussis
guugcuccagccaggcg

SEQ ID NO: 2440079 - RNA, 16 nt, Bordetella pertussis
guugcucgugcuggcc

SEQ ID NO: 2440080 - RNA, 12 nt, Bordetella pertussis
guugcuggccac

SEQ ID NO: 2440081 - RNA, 14 nt, Bordetella pertussis
guugcuggcccagg

SEQ ID NO: 2440082 - RNA, 22 nt, Bordetella pertussis
guugcuggcggccgugccucaa

SEQ ID NO: 2440083 - RNA, 21 nt, Bordetella pertussis
guuggaccccaguuccagcac

SEQ ID NO: 2440084 - RNA, 19 nt, Bordetella pertussis
guuggagaucaugaccacg

SEQ ID NO: 2440085 - RNA, 14 nt, Bordetella pertussis
guuggcaggccagc

SEQ ID NO: 2440086 - RNA, 15 nt, Bordetella pertussis
guuggcaggccagca

SEQ ID NO: 2440087 - RNA, 16 nt, Bordetella pertussis
guuggcaggccagcau

SEQ ID NO: 2440088 - RNA, 13 nt, Bordetella pertussis
guuggccagcgcc

SEQ ID NO: 2440089 - RNA, 14 nt, Bordetella pertussis
guuggccagcgcgc

SEQ ID NO: 2440090 - RNA, 14 nt, Bordetella pertussis
guuggccagcucca

SEQ ID NO: 2440091 - RNA, 17 nt, Bordetella pertussis
guuggccgccagccggc

SEQ ID NO: 2440092 - RNA, 22 nt, Bordetella pertussis
guuggccgggucgcgcagcagg

SEQ ID NO: 2440093 - RNA, 12 nt, Bordetella pertussis
guuggccugcca

SEQ ID NO: 2440094 - RNA, 19 nt, Bordetella pertussis
guuggccugccauccggcc

SEQ ID NO: 2440095 - RNA, 21 nt, Bordetella pertussis
guuggccugccauccggccgc

SEQ ID NO: 2440096 - RNA, 23 nt, Bordetella pertussis
guuggcgaaugccugguaggcga

SEQ ID NO: 2440097 - RNA, 14 nt, Bordetella pertussis
guuggcgaugcuca

SEQ ID NO: 2440098 - RNA, 15 nt, Bordetella pertussis
guuggcgccggccgc

SEQ ID NO: 2440099 - RNA, 21 nt, Bordetella pertussis
guuggcgccggccgcgcgcgc

SEQ ID NO: 2440100 - RNA, 23 nt, Bordetella pertussis
guuggcgccggccgcgcgcgcca

SEQ ID NO: 2440101 - RNA, 14 nt, Bordetella pertussis
guuggcgccuuccg

SEQ ID NO: 2440102 - RNA, 16 nt, Bordetella pertussis
guuggcgcugcugcug

SEQ ID NO: 2440103 - RNA, 13 nt, Bordetella pertussis
guuggcguccagg

SEQ ID NO: 2440104 - RNA, 19 nt, Bordetella pertussis
guuggcguccaggcgcgcc

SEQ ID NO: 2440105 - RNA, 16 nt, Bordetella pertussis
guugggccaccuggca

SEQ ID NO: 2440106 - RNA, 18 nt, Bordetella pertussis
guugggcgcgcccagccc

SEQ ID NO: 2440107 - RNA, 23 nt, Bordetella pertussis
guuggucgaauuucccggguggc

SEQ ID NO: 2440108 - RNA, 16 nt, Bordetella pertussis
guuggucgccacgcca

SEQ ID NO: 2440109 - RNA, 21 nt, Bordetella pertussis
guuggugacgauggugcgcag

SEQ ID NO: 2440110 - RNA, 22 nt, Bordetella pertussis
guuggugacgauggugcgcagg

SEQ ID NO: 2440111 - RNA, 16 nt, Bordetella pertussis
guuggugcccagcgag

SEQ ID NO: 2440112 - RNA, 20 nt, Bordetella pertussis
guuggugcccagcgagcggg

SEQ ID NO: 2440113 - RNA, 20 nt, Bordetella pertussis
guuggugcgaaucacuucuu

SEQ ID NO: 2440114 - RNA, 20 nt, Bordetella pertussis
guugguuugcggcgcgaccu

SEQ ID NO: 2440115 - RNA, 17 nt, Bordetella pertussis
guuguauucguccaggu

SEQ ID NO: 2440116 - RNA, 13 nt, Bordetella pertussis
guuguccagcgcg

SEQ ID NO: 2440117 - RNA, 14 nt, Bordetella pertussis
guuguccagcgcgc

SEQ ID NO: 2440118 - RNA, 15 nt, Bordetella pertussis
guugucgcgcgcgcg

SEQ ID NO: 2440119 - RNA, 17 nt, Bordetella pertussis
guugucggcgcagaugg

SEQ ID NO: 2440120 - RNA, 17 nt, Bordetella pertussis
guugucggcgccacagg

SEQ ID NO: 2440121 - RNA, 23 nt, Bordetella pertussis
guugucguugaugguccgcaggu

SEQ ID NO: 2440122 - RNA, 17 nt, Bordetella pertussis
guuguucaggaaggccc

SEQ ID NO: 2440123 - RNA, 16 nt, Bordetella pertussis
guuguucagguuggca

SEQ ID NO: 2440124 - RNA, 20 nt, Bordetella pertussis
guuucaggccugcggcgcca

SEQ ID NO: 2440125 - RNA, 19 nt, Bordetella pertussis
guuuccaagcgcacgcgca

SEQ ID NO: 2440126 - RNA, 12 nt, Bordetella pertussis
guuuccagggcu

SEQ ID NO: 2440127 - RNA, 18 nt, Bordetella pertussis
guuuccaucggggggcag

SEQ ID NO: 2440128 - RNA, 15 nt, Bordetella pertussis
guuucccgauuccag

SEQ ID NO: 2440129 - RNA, 23 nt, Bordetella pertussis
guuuccgcacccgguauccgcgc

SEQ ID NO: 2440130 - RNA, 12 nt, Bordetella pertussis
guuuccgccaug

SEQ ID NO: 2440131 - RNA, 16 nt, Bordetella pertussis
guuuccgccaugcggc

SEQ ID NO: 2440132 - RNA, 14 nt, Bordetella pertussis
guuuccgggccugg

SEQ ID NO: 2440133 - RNA, 17 nt, Bordetella pertussis
guuuccgggccuggccu

SEQ ID NO: 2440134 - RNA, 16 nt, Bordetella pertussis
guuuccucgccgacga

SEQ ID NO: 2440135 - RNA, 19 nt, Bordetella pertussis
guuucgagcaucauggcgc

SEQ ID NO: 2440136 - RNA, 21 nt, Bordetella pertussis
guuucgcgaccaccaggucgu

SEQ ID NO: 2440137 - RNA, 16 nt, Bordetella pertussis
uacgcauagguaucgg

SEQ ID NO: 2440138 - RNA, 23 nt, Bordetella pertussis
uacgcauagguaucggcccgcgc

SEQ ID NO: 2440139 - RNA, 15 nt, Bordetella pertussis
uacgcaucggcgccg

SEQ ID NO: 2440140 - RNA, 17 nt, Bordetella pertussis
uacgccacuuccuugcc

SEQ ID NO: 2440141 - RNA, 22 nt, Bordetella pertussis
uacgccaucgacgcuugccggc

SEQ ID NO: 2440142 - RNA, 20 nt, Bordetella pertussis
uacgccaugaacgcuugacg

SEQ ID NO: 2440143 - RNA, 22 nt, Bordetella pertussis
uacgccaugaacgcuugacggc

SEQ ID NO: 2440144 - RNA, 15 nt, Bordetella pertussis
uacgccaugagcgcu

SEQ ID NO: 2440145 - RNA, 22 nt, Bordetella pertussis
uacgccaugagcgcuugacggc

SEQ ID NO: 2440146 - RNA, 22 nt, Bordetella pertussis
uacgccgaauugcuggagcgcc

SEQ ID NO: 2440147 - RNA, 16 nt, Bordetella pertussis
uacgccgauggcgcgg

SEQ ID NO: 2440148 - RNA, 14 nt, Bordetella pertussis
uacgccgccgaggc

SEQ ID NO: 2440149 - RNA, 18 nt, Bordetella pertussis
uacgccguugcggcccgc

SEQ ID NO: 2440150 - RNA, 21 nt, Bordetella pertussis
uacgccguugcggcccgccga

SEQ ID NO: 2440151 - RNA, 14 nt, Bordetella pertussis
uacgccugcaccgc

SEQ ID NO: 2440152 - RNA, 15 nt, Bordetella pertussis
uacgcgaccagcuuc

SEQ ID NO: 2440153 - RNA, 13 nt, Bordetella pertussis
uacgcgaugccga

SEQ ID NO: 2440154 - RNA, 14 nt, Bordetella pertussis
uacgcgaugccgau

SEQ ID NO: 2440155 - RNA, 12 nt, Bordetella pertussis
uacgcgcuggcg

SEQ ID NO: 2440156 - RNA, 12 nt, Bordetella pertussis
uacgcggcgcgc

SEQ ID NO: 2440157 - RNA, 11 nt, Bordetella pertussis
uacgcggcguc

SEQ ID NO: 2440158 - RNA, 20 nt, Bordetella pertussis
uacgcggguucgacgccggc

SEQ ID NO: 2440159 - RNA, 18 nt, Bordetella pertussis
uacgcgguccgcagcgcu

SEQ ID NO: 2440160 - RNA, 13 nt, Bordetella pertussis
uacgcgugcgcgg

SEQ ID NO: 2440161 - RNA, 15 nt, Bordetella pertussis
uacgcgugcgcggcc

SEQ ID NO: 2440162 - RNA, 14 nt, Bordetella pertussis
uacgcuggaagaga

SEQ ID NO: 2440163 - RNA, 17 nt, Bordetella pertussis
uacgcuggaagagaccg

SEQ ID NO: 2440164 - RNA, 13 nt, Bordetella pertussis
uacgcuggcgcgu

SEQ ID NO: 2440165 - RNA, 14 nt, Bordetella pertussis
uacgcuggcgcguc

SEQ ID NO: 2440166 - RNA, 21 nt, Bordetella pertussis
uacggcaagguccaggcgcgc

SEQ ID NO: 2440167 - RNA, 23 nt, Bordetella pertussis
uacggcagaugaucuacgcgcgc

SEQ ID NO: 2440168 - RNA, 16 nt, Bordetella pertussis
uacggccggcuccgcu

SEQ ID NO: 2440169 - RNA, 13 nt, Bordetella pertussis
uacggcgaugccg

SEQ ID NO: 2440170 - RNA, 20 nt, Bordetella pertussis
uacggcgaugccggcgcugc

SEQ ID NO: 2440171 - RNA, 10 nt, Bordetella pertussis
uacggcgcga

SEQ ID NO: 2440172 - RNA, 22 nt, Bordetella pertussis
uacggcggacuggccgcgccgc

SEQ ID NO: 2440173 - RNA, 16 nt, Bordetella pertussis
uacggcggcggccauc

SEQ ID NO: 2440174 - RNA, 22 nt, Bordetella pertussis
uacgggcgcugcacgcagcgca

SEQ ID NO: 2440175 - RNA, 21 nt, Bordetella pertussis
uacgugguggugcgggccgcg

SEQ ID NO: 2440176 - RNA, 16 nt, Bordetella pertussis
uacuccuugacgcgcg

SEQ ID NO: 2440177 - RNA, 22 nt, Bordetella pertussis
uacucggaagacauggcgcgcg

SEQ ID NO: 2440178 - RNA, 13 nt, Bordetella pertussis
uacucggccaggc

SEQ ID NO: 2440179 - RNA, 16 nt, Bordetella pertussis
uacugcacgcggucca

SEQ ID NO: 2440180 - RNA, 12 nt, Bordetella pertussis
uacugcggcgcc

SEQ ID NO: 2440181 - RNA, 12 nt, Bordetella pertussis
uacugcugcaag

SEQ ID NO: 2440182 - RNA, 16 nt, Bordetella pertussis
uacugcugcaaggaca

SEQ ID NO: 2440183 - RNA, 20 nt, Bordetella pertussis
uacuggccgauggucagcau

SEQ ID NO: 2440184 - RNA, 11 nt, Bordetella pertussis
uacugggccac

SEQ ID NO: 2440185 - RNA, 20 nt, Bordetella pertussis
uacuuccucgaccagcccgg

SEQ ID NO: 2440186 - RNA, 20 nt, Bordetella pertussis
uacuucguggcgcagcuccg

SEQ ID NO: 2440187 - RNA, 12 nt, Bordetella pertussis
uacuugccggcg

SEQ ID NO: 2440188 - RNA, 19 nt, Bordetella pertussis
uagaacgcaugcgugcgca

SEQ ID NO: 2440189 - RNA, 22 nt, Bordetella pertussis
uagaacgcaugcgugcgcauca

SEQ ID NO: 2440190 - RNA, 17 nt, Bordetella pertussis
uagaccaccagcaggau

SEQ ID NO: 2440191 - RNA, 15 nt, Bordetella pertussis
uagaccacgcgcugc

SEQ ID NO: 2440192 - RNA, 20 nt, Bordetella pertussis
uagaccacgcgcugcgcgcc

SEQ ID NO: 2440193 - RNA, 17 nt, Bordetella pertussis
uagaccagcagcucggc

SEQ ID NO: 2440194 - RNA, 16 nt, Bordetella pertussis
uagaccugcgggccgc

SEQ ID NO: 2440195 - RNA, 22 nt, Bordetella pertussis
uagagcgccgcgugguggcgca

SEQ ID NO: 2440196 - RNA, 17 nt, Bordetella pertussis
uagagcugcggcgcggc

SEQ ID NO: 2440197 - RNA, 20 nt, Bordetella pertussis
uagagcuguugcagcggcuu

SEQ ID NO: 2440198 - RNA, 19 nt, Bordetella pertussis
uagaucagcgcgucggcgc

SEQ ID NO: 2440199 - RNA, 22 nt, Bordetella pertussis
uagauccaggcggccaccacca

SEQ ID NO: 2440200 - RNA, 15 nt, Bordetella pertussis
uagaucuugccggcc

SEQ ID NO: 2440201 - RNA, 12 nt, Bordetella pertussis
uagauggccagg

SEQ ID NO: 2440202 - RNA, 13 nt, Bordetella pertussis
uagauggccaggu

SEQ ID NO: 2440203 - RNA, 14 nt, Bordetella pertussis
uagauggccgccuu

SEQ ID NO: 2440204 - RNA, 13 nt, Bordetella pertussis
uagcacacgccga

SEQ ID NO: 2440205 - RNA, 24 nt, Bordetella pertussis
uagcacacgccgauugaggccagc

SEQ ID NO: 2440206 - RNA, 18 nt, Bordetella pertussis
uagccaggauuucauggc

SEQ ID NO: 2440207 - RNA, 18 nt, Bordetella pertussis
uagccaugcggacgccag

SEQ ID NO: 2440208 - RNA, 13 nt, Bordetella pertussis
uagcccagcaccu

SEQ ID NO: 2440209 - RNA, 19 nt, Bordetella pertussis
uagcccagcaccugcaggc

SEQ ID NO: 2440210 - RNA, 14 nt, Bordetella pertussis
uagcccaggccgcc

SEQ ID NO: 2440211 - RNA, 13 nt, Bordetella pertussis
uagcccaggcggg

SEQ ID NO: 2440212 - RNA, 16 nt, Bordetella pertussis
uagcccagguccagcg

SEQ ID NO: 2440213 - RNA, 17 nt, Bordetella pertussis
uagcccauguucugguc

SEQ ID NO: 2440214 - RNA, 19 nt, Bordetella pertussis
uagcccauguugaacugca

SEQ ID NO: 2440215 - RNA, 14 nt, Bordetella pertussis
uagcccggcgccac

SEQ ID NO: 2440216 - RNA, 17 nt, Bordetella pertussis
uagcccggcgccacccc

SEQ ID NO: 2440217 - RNA, 13 nt, Bordetella pertussis
uagcccggcgcga

SEQ ID NO: 2440218 - RNA, 17 nt, Bordetella pertussis
uagcccuuguggccgcc

SEQ ID NO: 2440219 - RNA, 22 nt, Bordetella pertussis
uagccgaagaaccaguagcaca

SEQ ID NO: 2440220 - RNA, 18 nt, Bordetella pertussis
uagccgaaguugucgcca

SEQ ID NO: 2440221 - RNA, 17 nt, Bordetella pertussis
uagccgaauccggccag

SEQ ID NO: 2440222 - RNA, 18 nt, Bordetella pertussis
uagccgaauccggccagc

SEQ ID NO: 2440223 - RNA, 20 nt, Bordetella pertussis
uagccgaccacccgcgccag

SEQ ID NO: 2440224 - RNA, 22 nt, Bordetella pertussis
uagccgcgcgccugcagcagcg

SEQ ID NO: 2440225 - RNA, 16 nt, Bordetella pertussis
uagccgcugcgcgcgg

SEQ ID NO: 2440226 - RNA, 17 nt, Bordetella pertussis
uagccgcugcgcgcggc

SEQ ID NO: 2440227 - RNA, 20 nt, Bordetella pertussis
uagccgcugcgcgcggccug

SEQ ID NO: 2440228 - RNA, 22 nt, Bordetella pertussis
uagccgcugcgcgcggccuggc

SEQ ID NO: 2440229 - RNA, 17 nt, Bordetella pertussis
uagccggcgacguggcg

SEQ ID NO: 2440230 - RNA, 19 nt, Bordetella pertussis
uagccgggucuggccggcc

SEQ ID NO: 2440231 - RNA, 22 nt, Bordetella pertussis
uagccgguaucgcggcgcaggc

SEQ ID NO: 2440232 - RNA, 17 nt, Bordetella pertussis
uagccggucuggucggc

SEQ ID NO: 2440233 - RNA, 21 nt, Bordetella pertussis
uagccguccucgcgggccugg

SEQ ID NO: 2440234 - RNA, 22 nt, Bordetella pertussis
uagccguccucgcgggccuggc

SEQ ID NO: 2440235 - RNA, 20 nt, Bordetella pertussis
uagcgcacgcaccgcgccag

SEQ ID NO: 2440236 - RNA, 13 nt, Bordetella pertussis
uagcgcagcagcg

SEQ ID NO: 2440237 - RNA, 19 nt, Bordetella pertussis
uagcgcaucgcgaugcgca

SEQ ID NO: 2440238 - RNA, 17 nt, Bordetella pertussis
uagcgcaugaugcugcc

SEQ ID NO: 2440239 - RNA, 20 nt, Bordetella pertussis
uagcgccggcuugcgccagc

SEQ ID NO: 2440240 - RNA, 16 nt, Bordetella pertussis
uagcgcguggccagca

SEQ ID NO: 2440241 - RNA, 16 nt, Bordetella pertussis
uagcgcuccagcguca

SEQ ID NO: 2440242 - RNA, 18 nt, Bordetella pertussis
uagcgcucgacuucgucg

SEQ ID NO: 2440243 - RNA, 18 nt, Bordetella pertussis
uagcgcucuucgcgguac

SEQ ID NO: 2440244 - RNA, 14 nt, Bordetella pertussis
uagcgcugggcgcc

SEQ ID NO: 2440245 - RNA, 23 nt, Bordetella pertussis
uagcgcugggcgccagcagcacg

SEQ ID NO: 2440246 - RNA, 12 nt, Bordetella pertussis
uagcgcuugccu

SEQ ID NO: 2440247 - RNA, 15 nt, Bordetella pertussis
uagcggccggcgcgc

SEQ ID NO: 2440248 - RNA, 12 nt, Bordetella pertussis
uagcgggcggcg

SEQ ID NO: 2440249 - RNA, 16 nt, Bordetella pertussis
uagcgguagccggcgu

SEQ ID NO: 2440250 - RNA, 19 nt, Bordetella pertussis
uagcgguaucccaccugca

SEQ ID NO: 2440251 - RNA, 20 nt, Bordetella pertussis
uagcggucaaugaagggcug

SEQ ID NO: 2440252 - RNA, 21 nt, Bordetella pertussis
uagcgguccagcugcgcgcga

SEQ ID NO: 2440253 - RNA, 21 nt, Bordetella pertussis
uagcgguggcgggccagcucc

SEQ ID NO: 2440254 - RNA, 12 nt, Bordetella pertussis
uagcguuuugua

SEQ ID NO: 2440255 - RNA, 11 nt, Bordetella pertussis
uagcucagccu

SEQ ID NO: 2440256 - RNA, 21 nt, Bordetella pertussis
uagcucgaccaucauggccag

SEQ ID NO: 2440257 - RNA, 14 nt, Bordetella pertussis
uagcuggcggcgcg

SEQ ID NO: 2440258 - RNA, 19 nt, Bordetella pertussis
uaggacagccccagcagca

SEQ ID NO: 2440259 - RNA, 16 nt, Bordetella pertussis
uaggacggcagcaccg

SEQ ID NO: 2440260 - RNA, 16 nt, Bordetella pertussis
uaggcaaagcgcagca

SEQ ID NO: 2440261 - RNA, 14 nt, Bordetella pertussis
uaggcaaagcgcgg

SEQ ID NO: 2440262 - RNA, 20 nt, Bordetella pertussis
uaggccaccccguugcagcc

SEQ ID NO: 2440263 - RNA, 18 nt, Bordetella pertussis
uaggccgcgaugucgcgc

SEQ ID NO: 2440264 - RNA, 14 nt, Bordetella pertussis
uaggcgaagcgcgg

SEQ ID NO: 2440265 - RNA, 13 nt, Bordetella pertussis
uaggcgcagcagg

SEQ ID NO: 2440266 - RNA, 16 nt, Bordetella pertussis
uaggcgcccgacggcg

SEQ ID NO: 2440267 - RNA, 23 nt, Bordetella pertussis
uaggcgccgcgcccguccacggc

SEQ ID NO: 2440268 - RNA, 16 nt, Bordetella pertussis
uaggcgcgcaccagcc

SEQ ID NO: 2440269 - RNA, 15 nt, Bordetella pertussis
uaggcgcuguuggcc

SEQ ID NO: 2440270 - RNA, 13 nt, Bordetella pertussis
uaggcggccaggc

SEQ ID NO: 2440271 - RNA, 16 nt, Bordetella pertussis
uaggcggccaggccga

SEQ ID NO: 2440272 - RNA, 17 nt, Bordetella pertussis
uaggcggccaggccgaa

SEQ ID NO: 2440273 - RNA, 14 nt, Bordetella pertussis
uaggcggcccaggc

SEQ ID NO: 2440274 - RNA, 18 nt, Bordetella pertussis
uaggcggcgcaggccagc

SEQ ID NO: 2440275 - RNA, 15 nt, Bordetella pertussis
uaggcggcgcgcccg

SEQ ID NO: 2440276 - RNA, 15 nt, Bordetella pertussis
uaggcugcagccagu

SEQ ID NO: 2440277 - RNA, 15 nt, Bordetella pertussis
uaggcuugcagcuug

SEQ ID NO: 2440278 - RNA, 11 nt, Bordetella pertussis
uagggcccagc

SEQ ID NO: 2440279 - RNA, 14 nt, Bordetella pertussis
uagggcccagcugc

SEQ ID NO: 2440280 - RNA, 16 nt, Bordetella pertussis
uagggcgacugcagca

SEQ ID NO: 2440281 - RNA, 17 nt, Bordetella pertussis
uagggcgacugcagcag

SEQ ID NO: 2440282 - RNA, 21 nt, Bordetella pertussis
uagggcgauggcgcgucgccg

SEQ ID NO: 2440283 - RNA, 15 nt, Bordetella pertussis
uagggggcauggcgc

SEQ ID NO: 2440284 - RNA, 17 nt, Bordetella pertussis
uagggugccuguccccg

SEQ ID NO: 2440285 - RNA, 15 nt, Bordetella pertussis
uaggucaggcccacg

SEQ ID NO: 2440286 - RNA, 13 nt, Bordetella pertussis
uaguacagcagca

SEQ ID NO: 2440287 - RNA, 16 nt, Bordetella pertussis
uaguacagcagcagca

SEQ ID NO: 2440288 - RNA, 13 nt, Bordetella pertussis
uaguacucgcugc

SEQ ID NO: 2440289 - RNA, 14 nt, Bordetella pertussis
uaguagcccaggcc

SEQ ID NO: 2440290 - RNA, 21 nt, Bordetella pertussis
uaguagccgaauccggccagc

SEQ ID NO: 2440291 - RNA, 13 nt, Bordetella pertussis
uaguccagcaccg

SEQ ID NO: 2440292 - RNA, 13 nt, Bordetella pertussis
uaguccagcagca

SEQ ID NO: 2440293 - RNA, 21 nt, Bordetella pertussis
uaguccucuacuggcugauca

SEQ ID NO: 2440294 - RNA, 15 nt, Bordetella pertussis
uagucgcacgcggcu

SEQ ID NO: 2440295 - RNA, 22 nt, Bordetella pertussis
uagucgccggcuuccagcagca

SEQ ID NO: 2440296 - RNA, 14 nt, Bordetella pertussis
uagucgcggccgua

SEQ ID NO: 2440297 - RNA, 17 nt, Bordetella pertussis
uagucgucgaaggcgcg

SEQ ID NO: 2440298 - RNA, 19 nt, Bordetella pertussis
uagucgucgcuggcccacu

SEQ ID NO: 2440299 - RNA, 15 nt, Bordetella pertussis
uagucguugccggcc

SEQ ID NO: 2440300 - RNA, 18 nt, Bordetella pertussis
uagucguugccggccagc

SEQ ID NO: 2440301 - RNA, 18 nt, Bordetella pertussis
uagugcaggccgcgcagc

SEQ ID NO: 2440302 - RNA, 18 nt, Bordetella pertussis
uagugcuccaccaccauc

SEQ ID NO: 2440303 - RNA, 13 nt, Bordetella pertussis
uaguucggcgcgu

SEQ ID NO: 2440304 - RNA, 17 nt, Bordetella pertussis
uaguugcgccccgccau

SEQ ID NO: 2440305 - RNA, 13 nt, Bordetella pertussis
uaguuggccaggg

SEQ ID NO: 2440306 - RNA, 15 nt, Bordetella pertussis
uaguugguggcaggc

SEQ ID NO: 2440307 - RNA, 12 nt, Bordetella pertussis
uauacggcgcga

SEQ ID NO: 2440308 - RNA, 21 nt, Bordetella pertussis
uauagaugcgcggggccaggc

SEQ ID NO: 2440309 - RNA, 23 nt, Bordetella pertussis
uauagggggcauggcgccgcgcg

SEQ ID NO: 2440310 - RNA, 18 nt, Bordetella pertussis
uaucagcgcgucacgcug

SEQ ID NO: 2440311 - RNA, 12 nt, Bordetella pertussis
uaucauccgcgc

SEQ ID NO: 2440312 - RNA, 14 nt, Bordetella pertussis
uauccacgccacug

SEQ ID NO: 2440313 - RNA, 18 nt, Bordetella pertussis
uauccagcaucaccagcu

SEQ ID NO: 2440314 - RNA, 20 nt, Bordetella pertussis
uauccagguaggcggcgcgc

SEQ ID NO: 2440315 - RNA, 21 nt, Bordetella pertussis
uauccagguaggcggcgcgcc

SEQ ID NO: 2440316 - RNA, 14 nt, Bordetella pertussis
uauccaucggcgcg

SEQ ID NO: 2440317 - RNA, 22 nt, Bordetella pertussis
uaucccaccugcagccagaucu

SEQ ID NO: 2440318 - RNA, 23 nt, Bordetella pertussis
uauccgccguugcucgcgcgcag

SEQ ID NO: 2440319 - RNA, 12 nt, Bordetella pertussis
uauccgcgcaug

SEQ ID NO: 2440320 - RNA, 13 nt, Bordetella pertussis
uauccuggcgcgg

SEQ ID NO: 2440321 - RNA, 14 nt, Bordetella pertussis
uauccuggcgcgga

SEQ ID NO: 2440322 - RNA, 21 nt, Bordetella pertussis
uauccuugaggaucaggaaga

SEQ ID NO: 2440323 - RNA, 18 nt, Bordetella pertussis
uaucgacccaggccggcg

SEQ ID NO: 2440324 - RNA, 24 nt, Bordetella pertussis
uaucgacgcgcgucgugcccgcca

SEQ ID NO: 2440325 - RNA, 22 nt, Bordetella pertussis
uaucgagguuuccgccaugcgg

SEQ ID NO: 2440326 - RNA, 19 nt, Bordetella pertussis
uaucgcauacucgaugccc

SEQ ID NO: 2440327 - RNA, 13 nt, Bordetella pertussis
uaucgcccgcgcg

SEQ ID NO: 2440328 - RNA, 20 nt, Bordetella pertussis
uaucgcgccagcgccgcgcg

SEQ ID NO: 2440329 - RNA, 19 nt, Bordetella pertussis
uaucgcggccgagcuccuc

SEQ ID NO: 2440330 - RNA, 15 nt, Bordetella pertussis
uaucgcggcgcaggc

SEQ ID NO: 2440331 - RNA, 12 nt, Bordetella pertussis
uaucgcggcgcg

SEQ ID NO: 2440332 - RNA, 20 nt, Bordetella pertussis
uaucggcgcgagcgaugccc

SEQ ID NO: 2440333 - RNA, 18 nt, Bordetella pertussis
uaucgucgcugcggccgg

SEQ ID NO: 2440334 - RNA, 19 nt, Bordetella pertussis
uaucucagcgcgccgcgcc

SEQ ID NO: 2440335 - RNA, 13 nt, Bordetella pertussis
uaucugccgcgca

SEQ ID NO: 2440336 - RNA, 20 nt, Bordetella pertussis
uaucugucccggcggggaca

SEQ ID NO: 2440337 - RNA, 20 nt, Bordetella pertussis
uaucuuucgggcgcgggagc

SEQ ID NO: 2440338 - RNA, 18 nt, Bordetella pertussis
uaugccgcccgcaaggac

SEQ ID NO: 2440339 - RNA, 18 nt, Bordetella pertussis
uaugcgccaggcccuuga

SEQ ID NO: 2440340 - RNA, 16 nt, Bordetella pertussis
uaugcggcagcagggc

SEQ ID NO: 2440341 - RNA, 11 nt, Bordetella pertussis
uaugcggcgcc

SEQ ID NO: 2440342 - RNA, 21 nt, Bordetella pertussis
uaugcggcgcccaggcccagc

SEQ ID NO: 2440343 - RNA, 21 nt, Bordetella pertussis
uaugcgggcuugcugcccccc

SEQ ID NO: 2440344 - RNA, 19 nt, Bordetella pertussis
uauggccguuggccagcgc

SEQ ID NO: 2440345 - RNA, 21 nt, Bordetella pertussis
uauggccuggaugugcaggcc

SEQ ID NO: 2440346 - RNA, 12 nt, Bordetella pertussis
uaugggccugau

SEQ ID NO: 2440347 - RNA, 14 nt, Bordetella pertussis
uaugggggcgagcg

SEQ ID NO: 2440348 - RNA, 18 nt, Bordetella pertussis
uauuccucgacgauggcg

SEQ ID NO: 2440349 - RNA, 22 nt, Bordetella pertussis
uauucgcgcggcgacaccccca

SEQ ID NO: 2440350 - RNA, 22 nt, Bordetella pertussis
uauucggccaacggcuggcugg

SEQ ID NO: 2440351 - RNA, 17 nt, Bordetella pertussis
uauucgggaugggccac

SEQ ID NO: 2440352 - RNA, 18 nt, Bordetella pertussis
uauucgucggccgccgcc

SEQ ID NO: 2440353 - RNA, 21 nt, Bordetella pertussis
uauugaaggccgaggccaggu

SEQ ID NO: 2440354 - RNA, 15 nt, Bordetella pertussis
uauugcuccacaggc

SEQ ID NO: 2440355 - RNA, 19 nt, Bordetella pertussis
uauuggcuguaucuggccu

SEQ ID NO: 2440356 - RNA, 17 nt, Bordetella pertussis
uauugugcaugcgcgcc

SEQ ID NO: 2440357 - RNA, 20 nt, Bordetella pertussis
uauuuccggccgcacugggu

SEQ ID NO: 2440358 - RNA, 22 nt, Bordetella pertussis
uauuuggcggccuggccgcgcg

SEQ ID NO: 2440359 - RNA, 14 nt, Bordetella pertussis
uauuuguccagguu

SEQ ID NO: 2440360 - RNA, 14 nt, Bordetella pertussis
uauuuuuccaugca

SEQ ID NO: 2440361 - RNA, 20 nt, Bordetella pertussis
ucaaaccaagcagggacaga

SEQ ID NO: 2440362 - RNA, 18 nt, Bordetella pertussis
ucaaacgcggcgccgccg

SEQ ID NO: 2440363 - RNA, 19 nt, Bordetella pertussis
ucaacccgccggccaucac

SEQ ID NO: 2440364 - RNA, 18 nt, Bordetella pertussis
ucacuccauagcgccgcu

SEQ ID NO: 2440365 - RNA, 18 nt, Bordetella pertussis
ucacugccgaaacgcugg

SEQ ID NO: 2440366 - RNA, 20 nt, Bordetella pertussis
ucacugccgaaacgcuggcg

SEQ ID NO: 2440367 - RNA, 15 nt, Bordetella pertussis
ucagaaaggcagcgg

SEQ ID NO: 2440368 - RNA, 15 nt, Bordetella pertussis
ucagaacgacgaucu

SEQ ID NO: 2440369 - RNA, 23 nt, Bordetella pertussis
ucagaagcgccauggcagggucc

SEQ ID NO: 2440370 - RNA, 21 nt, Bordetella pertussis
ucagaccacgacggucugggc

SEQ ID NO: 2440371 - RNA, 16 nt, Bordetella pertussis
ucagaccaucuugucc

SEQ ID NO: 2440372 - RNA, 17 nt, Bordetella pertussis
ucagaccaucuuguccu

SEQ ID NO: 2440373 - RNA, 22 nt, Bordetella pertussis
ucagauacaaaauacuuguccg

SEQ ID NO: 2440374 - RNA, 15 nt, Bordetella pertussis
ucagauggcgcagcg

SEQ ID NO: 2440375 - RNA, 15 nt, Bordetella pertussis
ucagcaaccccagca

SEQ ID NO: 2440376 - RNA, 18 nt, Bordetella pertussis
ucagcaaccccagcagcg

SEQ ID NO: 2440377 - RNA, 19 nt, Bordetella pertussis
ucagcaaccccagcagcgc

SEQ ID NO: 2440378 - RNA, 14 nt, Bordetella pertussis
ucagcacaucgccc

SEQ ID NO: 2440379 - RNA, 17 nt, Bordetella pertussis
ucagcaccacggcggcc

SEQ ID NO: 2440380 - RNA, 18 nt, Bordetella pertussis
ucagcaccacggcggcca

SEQ ID NO: 2440381 - RNA, 15 nt, Bordetella pertussis
ucagcaccagcuccu

SEQ ID NO: 2440382 - RNA, 18 nt, Bordetella pertussis
ucagcaccgcggcgggcu

SEQ ID NO: 2440383 - RNA, 17 nt, Bordetella pertussis
ucagcaccucggcgccc

SEQ ID NO: 2440384 - RNA, 16 nt, Bordetella pertussis
ucagcacggucggcgc

SEQ ID NO: 2440385 - RNA, 18 nt, Bordetella pertussis
ucagcacggucggcgcgu

SEQ ID NO: 2440386 - RNA, 16 nt, Bordetella pertussis
ucagcacuugccggcc

SEQ ID NO: 2440387 - RNA, 18 nt, Bordetella pertussis
ucagcacuugccggccgc

SEQ ID NO: 2440388 - RNA, 20 nt, Bordetella pertussis
ucagcagcaggcccuccggc

SEQ ID NO: 2440389 - RNA, 22 nt, Bordetella pertussis
ucagcagcaggcccuccggcgc

SEQ ID NO: 2440390 - RNA, 17 nt, Bordetella pertussis
ucagcagcaugccuucg

SEQ ID NO: 2440391 - RNA, 19 nt, Bordetella pertussis
ucagcagcgccagggccag

SEQ ID NO: 2440392 - RNA, 21 nt, Bordetella pertussis
ucagcagcgccagggccaggc

SEQ ID NO: 2440393 - RNA, 18 nt, Bordetella pertussis
acgugggcacgccggccu

SEQ ID NO: 2440394 - RNA, 20 nt, Bordetella pertussis
acgugguccacgaagcaggu

SEQ ID NO: 2440395 - RNA, 17 nt, Bordetella pertussis
acguggucgugcaggac

SEQ ID NO: 2440396 - RNA, 19 nt, Bordetella pertussis
acgugguggugcgggccgc

SEQ ID NO: 2440397 - RNA, 23 nt, Bordetella pertussis
acgugguggugcgggccgcgcug

SEQ ID NO: 2440398 - RNA, 14 nt, Bordetella pertussis
acgugucggccacc

SEQ ID NO: 2440399 - RNA, 18 nt, Bordetella pertussis
acguugaccuugccgauc

SEQ ID NO: 2440400 - RNA, 16 nt, Bordetella pertussis
acguugauccagcgcu

SEQ ID NO: 2440401 - RNA, 16 nt, Bordetella pertussis
acguugcggaucacgc

SEQ ID NO: 2440402 - RNA, 21 nt, Bordetella pertussis
acguugcugcagcgucuggca

SEQ ID NO: 2440403 - RNA, 14 nt, Bordetella pertussis
acguuguccaggcc

SEQ ID NO: 2440404 - RNA, 18 nt, Bordetella pertussis
acuacggcggacuggccg

SEQ ID NO: 2440405 - RNA, 21 nt, Bordetella pertussis
acuauggcgcgcgcacgcugg

SEQ ID NO: 2440406 - RNA, 21 nt, Bordetella pertussis
acucaccgccgcccgcaggca

SEQ ID NO: 2440407 - RNA, 14 nt, Bordetella pertussis
acucacgcaaggcc

SEQ ID NO: 2440408 - RNA, 20 nt, Bordetella pertussis
acucagcgcacugaucgccg

SEQ ID NO: 2440409 - RNA, 12 nt, Bordetella pertussis
acuccaccggcg

SEQ ID NO: 2440410 - RNA, 12 nt, Bordetella pertussis
acuccaggagcu

SEQ ID NO: 2440411 - RNA, 16 nt, Bordetella pertussis
acuccauagcgccgcu

SEQ ID NO: 2440412 - RNA, 17 nt, Bordetella pertussis
acucccacgcucuggag

SEQ ID NO: 2440413 - RNA, 23 nt, Bordetella pertussis
acucccacgcucuggagccacca

SEQ ID NO: 2440414 - RNA, 16 nt, Bordetella pertussis
acucccaugacccugc

SEQ ID NO: 2440415 - RNA, 18 nt, Bordetella pertussis
acuccccagacgcagacc

SEQ ID NO: 2440416 - RNA, 17 nt, Bordetella pertussis
acuccggauaccgccgc

SEQ ID NO: 2440417 - RNA, 18 nt, Bordetella pertussis
acuccugcaacuggugca

SEQ ID NO: 2440418 - RNA, 16 nt, Bordetella pertussis
acucgaaacgggcggc

SEQ ID NO: 2440419 - RNA, 15 nt, Bordetella pertussis
acucgaacaccggcu

SEQ ID NO: 2440420 - RNA, 20 nt, Bordetella pertussis
acucgaccgccgggacaggc

SEQ ID NO: 2440421 - RNA, 17 nt, Bordetella pertussis
acucgagccggcuccag

SEQ ID NO: 2440422 - RNA, 14 nt, Bordetella pertussis
acucgaggcggcgc

SEQ ID NO: 2440423 - RNA, 15 nt, Bordetella pertussis
acucgauccgggccu

SEQ ID NO: 2440424 - RNA, 17 nt, Bordetella pertussis
acucgauccgggccugg

SEQ ID NO: 2440425 - RNA, 17 nt, Bordetella pertussis
acucgaugcccagcacc

SEQ ID NO: 2440426 - RNA, 17 nt, Bordetella pertussis
acucgcccgaugccgau

SEQ ID NO: 2440427 - RNA, 21 nt, Bordetella pertussis
acucgccgaacugccggcgcg

SEQ ID NO: 2440428 - RNA, 15 nt, Bordetella pertussis
acucgccgugcuggg

SEQ ID NO: 2440429 - RNA, 15 nt, Bordetella pertussis
acucgcgcucggcca

SEQ ID NO: 2440430 - RNA, 22 nt, Bordetella pertussis
acucggaagacauggcgcgcgc

SEQ ID NO: 2440431 - RNA, 14 nt, Bordetella pertussis
acucggccagcagc

SEQ ID NO: 2440432 - RNA, 15 nt, Bordetella pertussis
acucggccagcagcu

SEQ ID NO: 2440433 - RNA, 16 nt, Bordetella pertussis
acucggccagcgcgcg

SEQ ID NO: 2440434 - RNA, 13 nt, Bordetella pertussis
acucggccaggcc

SEQ ID NO: 2440435 - RNA, 14 nt, Bordetella pertussis
acucggccauggug

SEQ ID NO: 2440436 - RNA, 14 nt, Bordetella pertussis
acucggugcgcgcg

SEQ ID NO: 2440437 - RNA, 16 nt, Bordetella pertussis
acucggugcgcgcgcc

SEQ ID NO: 2440438 - RNA, 14 nt, Bordetella pertussis
acucguuggccagc

SEQ ID NO: 2440439 - RNA, 18 nt, Bordetella pertussis
acucugcccgaagcggcc

SEQ ID NO: 2440440 - RNA, 21 nt, Bordetella pertussis
acucuguucuaccugaucgcc

SEQ ID NO: 2440441 - RNA, 23 nt, Bordetella pertussis
acucuuccccgucggcggcaagc

SEQ ID NO: 2440442 - RNA, 16 nt, Bordetella pertussis
acucuuuuggagaugu

SEQ ID NO: 2440443 - RNA, 18 nt, Bordetella pertussis
acugagaaaggccgccac

SEQ ID NO: 2440444 - RNA, 13 nt, Bordetella pertussis
acugaucgccgcc

SEQ ID NO: 2440445 - RNA, 15 nt, Bordetella pertussis
acugaugcuggucag

SEQ ID NO: 2440446 - RNA, 15 nt, Bordetella pertussis
acugcaaggcccgcc

SEQ ID NO: 2440447 - RNA, 20 nt, Bordetella pertussis
acugcacgcgguccacgccg

SEQ ID NO: 2440448 - RNA, 17 nt, Bordetella pertussis
acugcagcaguucggcg

SEQ ID NO: 2440449 - RNA, 20 nt, Bordetella pertussis
acugcagcaguucggcgucg

SEQ ID NO: 2440450 - RNA, 21 nt, Bordetella pertussis
acugcagcaguucggcgucgg

SEQ ID NO: 2440451 - RNA, 20 nt, Bordetella pertussis
acugcaggaugaggcgccgg

SEQ ID NO: 2440452 - RNA, 16 nt, Bordetella pertussis
acugcaggccaucgcg

SEQ ID NO: 2440453 - RNA, 13 nt, Bordetella pertussis
acugcaggccgcc

SEQ ID NO: 2440454 - RNA, 19 nt, Bordetella pertussis
acugcaggccgccggccuc

SEQ ID NO: 2440455 - RNA, 14 nt, Bordetella pertussis
acugcaggcgcugc

SEQ ID NO: 2440456 - RNA, 11 nt, Bordetella pertussis
acugccaggcg

SEQ ID NO: 2440457 - RNA, 15 nt, Bordetella pertussis
acugccaggcgagcg

SEQ ID NO: 2440458 - RNA, 18 nt, Bordetella pertussis
acugccaggcgagcgccg

SEQ ID NO: 2440459 - RNA, 13 nt, Bordetella pertussis
acugccaggcgcc

SEQ ID NO: 2440460 - RNA, 15 nt, Bordetella pertussis
acugccauccucguc

SEQ ID NO: 2440461 - RNA, 12 nt, Bordetella pertussis
acugccccagcg

SEQ ID NO: 2440462 - RNA, 16 nt, Bordetella pertussis
acugccccagcggcug

SEQ ID NO: 2440463 - RNA, 23 nt, Bordetella pertussis
acugccccauggcaugcaccgcg

SEQ ID NO: 2440464 - RNA, 15 nt, Bordetella pertussis
acugcccgcgccgua

SEQ ID NO: 2440465 - RNA, 23 nt, Bordetella pertussis
acugcccgucuuggcgugguggg

SEQ ID NO: 2440466 - RNA, 14 nt, Bordetella pertussis
acugccggcgcggg

SEQ ID NO: 2440467 - RNA, 16 nt, Bordetella pertussis
acugccggcgcgggcg

SEQ ID NO: 2440468 - RNA, 13 nt, Bordetella pertussis
acugccugcagcg

SEQ ID NO: 2440469 - RNA, 17 nt, Bordetella pertussis
acugccugcagcgcgcg

SEQ ID NO: 2440470 - RNA, 18 nt, Bordetella pertussis
acugccugcagcgcgcgc

SEQ ID NO: 2440471 - RNA, 14 nt, Bordetella pertussis
acugcgcauggucg

SEQ ID NO: 2440472 - RNA, 18 nt, Bordetella pertussis
acugcgccugggcggcgc

SEQ ID NO: 2440473 - RNA, 12 nt, Bordetella pertussis
acugcggcgccu

SEQ ID NO: 2440474 - RNA, 15 nt, Bordetella pertussis
acugcggcgccuggg

SEQ ID NO: 2440475 - RNA, 21 nt, Bordetella pertussis
acugcggcgccugggccuucu

SEQ ID NO: 2440476 - RNA, 20 nt, Bordetella pertussis
acugcguucgggacgcagga

SEQ ID NO: 2440477 - RNA, 23 nt, Bordetella pertussis
ucagcggcggcacgcgcgccggc

SEQ ID NO: 2440478 - RNA, 19 nt, Bordetella pertussis
ucagcggcuucgagcgcga

SEQ ID NO: 2440479 - RNA, 13 nt, Bordetella pertussis
ucagcgggccggc

SEQ ID NO: 2440480 - RNA, 13 nt, Bordetella pertussis
ucagcgggcgcgc

SEQ ID NO: 2440481 - RNA, 14 nt, Bordetella pertussis
ucagcgggcugcug

SEQ ID NO: 2440482 - RNA, 16 nt, Bordetella pertussis
ucagcgggcuggccag

SEQ ID NO: 2440483 - RNA, 17 nt, Bordetella pertussis
ucagcgggcuggccagc

SEQ ID NO: 2440484 - RNA, 16 nt, Bordetella pertussis
ucagcgucucgggcug

SEQ ID NO: 2440485 - RNA, 18 nt, Bordetella pertussis
ucagcgugccgccggcgc

SEQ ID NO: 2440486 - RNA, 14 nt, Bordetella pertussis
ucagcgugcgcccc

SEQ ID NO: 2440487 - RNA, 17 nt, Bordetella pertussis
ucagcgugcgccccgcc

SEQ ID NO: 2440488 - RNA, 14 nt, Bordetella pertussis
ucagcgugucgccg

SEQ ID NO: 2440489 - RNA, 17 nt, Bordetella pertussis
ucagcguuuccagggcg

SEQ ID NO: 2440490 - RNA, 15 nt, Bordetella pertussis
ucagcuacggcuggc

SEQ ID NO: 2440491 - RNA, 19 nt, Bordetella pertussis
ucagcuacggcuggccguc

SEQ ID NO: 2440492 - RNA, 13 nt, Bordetella pertussis
ucagcucgucgcc

SEQ ID NO: 2440493 - RNA, 14 nt, Bordetella pertussis
ucagcugcggcccc

SEQ ID NO: 2440494 - RNA, 17 nt, Bordetella pertussis
ucagcugcggccccggc

SEQ ID NO: 2440495 - RNA, 17 nt, Bordetella pertussis
ucagcuggaucugguga

SEQ ID NO: 2440496 - RNA, 17 nt, Bordetella pertussis
ucagcuuccagaucgac

SEQ ID NO: 2440497 - RNA, 17 nt, Bordetella pertussis
ucagcuugaugccggcg

SEQ ID NO: 2440498 - RNA, 18 nt, Bordetella pertussis
ucagcuugaugccggcgu

SEQ ID NO: 2440499 - RNA, 19 nt, Bordetella pertussis
ucagcuugaugccggcguu

SEQ ID NO: 2440500 - RNA, 21 nt, Bordetella pertussis
ucagcuuggcguacggcugca

SEQ ID NO: 2440501 - RNA, 19 nt, Bordetella pertussis
ucagcuuggucacggccuc

SEQ ID NO: 2440502 - RNA, 21 nt, Bordetella pertussis
ucaggaacauguccaccagcc

SEQ ID NO: 2440503 - RNA, 14 nt, Bordetella pertussis
ucaggaaccagcgg

SEQ ID NO: 2440504 - RNA, 17 nt, Bordetella pertussis
ucaggaaccagcggcug

SEQ ID NO: 2440505 - RNA, 16 nt, Bordetella pertussis
ucaggaaguccugguu

SEQ ID NO: 2440506 - RNA, 19 nt, Bordetella pertussis
ucaggaucaggccggcgau

SEQ ID NO: 2440507 - RNA, 14 nt, Bordetella pertussis
ucaggaugcgcgcc

SEQ ID NO: 2440508 - RNA, 15 nt, Bordetella pertussis
ucaggaugggcgcgg

SEQ ID NO: 2440509 - RNA, 13 nt, Bordetella pertussis
ucaggcagcaacc

SEQ ID NO: 2440510 - RNA, 18 nt, Bordetella pertussis
ucaggcagcaaccggaac

SEQ ID NO: 2440511 - RNA, 14 nt, Bordetella pertussis
ucaggcaggcgcgc

SEQ ID NO: 2440512 - RNA, 15 nt, Bordetella pertussis
ucaggcaggcgcgcc

SEQ ID NO: 2440513 - RNA, 15 nt, Bordetella pertussis
ucaggccagcgaccc

SEQ ID NO: 2440514 - RNA, 19 nt, Bordetella pertussis
ucaggccaugcugggccau

SEQ ID NO: 2440515 - RNA, 14 nt, Bordetella pertussis
ucaggccccggccg

SEQ ID NO: 2440516 - RNA, 18 nt, Bordetella pertussis
ucaggcccgcggcgccag

SEQ ID NO: 2440517 - RNA, 19 nt, Bordetella pertussis
ucaggcccuggggccgcgg

SEQ ID NO: 2440518 - RNA, 19 nt, Bordetella pertussis
ucaggccgaacugggacag

SEQ ID NO: 2440519 - RNA, 16 nt, Bordetella pertussis
ucaggccgaggcugcg

SEQ ID NO: 2440520 - RNA, 19 nt, Bordetella pertussis
ucaggccgaggcugcgcgc

SEQ ID NO: 2440521 - RNA, 21 nt, Bordetella pertussis
ucaggccgaggcugcgcgcgc

SEQ ID NO: 2440522 - RNA, 22 nt, Bordetella pertussis
ucaggccgaggcugcgcgcgcc

SEQ ID NO: 2440523 - RNA, 23 nt, Bordetella pertussis
ucaggccgaugcguccgccgugc

SEQ ID NO: 2440524 - RNA, 14 nt, Bordetella pertussis
ucaggccgccggcg

SEQ ID NO: 2440525 - RNA, 23 nt, Bordetella pertussis
ucaggccggcccgccccacggcg

SEQ ID NO: 2440526 - RNA, 23 nt, Bordetella pertussis
ucaggccggcgccuggggcgggc

SEQ ID NO: 2440527 - RNA, 18 nt, Bordetella pertussis
ucaggccgucgagccggg

SEQ ID NO: 2440528 - RNA, 22 nt, Bordetella pertussis
ucaggccgucgagccgggcgcc

SEQ ID NO: 2440529 - RNA, 17 nt, Bordetella pertussis
ucaggccguuggcgcgc

SEQ ID NO: 2440530 - RNA, 21 nt, Bordetella pertussis
ucaggccguuggcgcgccuug

SEQ ID NO: 2440531 - RNA, 23 nt, Bordetella pertussis
ucaggccguuuacuccccagacg

SEQ ID NO: 2440532 - RNA, 16 nt, Bordetella pertussis
ucaggcgagcgcggcg

SEQ ID NO: 2440533 - RNA, 19 nt, Bordetella pertussis
ucaggcgauccugcccacc

SEQ ID NO: 2440534 - RNA, 23 nt, Bordetella pertussis
ucaggcgauccugcccaccgccg

SEQ ID NO: 2440535 - RNA, 23 nt, Bordetella pertussis
ucaggcgcaucgacagcgcgccc

SEQ ID NO: 2440536 - RNA, 23 nt, Bordetella pertussis
ucaggcgcauggugagggccacg

SEQ ID NO: 2440537 - RNA, 17 nt, Bordetella pertussis
ucaggcgcggcuggaug

SEQ ID NO: 2440538 - RNA, 22 nt, Bordetella pertussis
ucaggcgcuccauggcgccggc

SEQ ID NO: 2440539 - RNA, 15 nt, Bordetella pertussis
ucaggcggagucgcc

SEQ ID NO: 2440540 - RNA, 16 nt, Bordetella pertussis
ucaggcggagucgccc

SEQ ID NO: 2440541 - RNA, 23 nt, Bordetella pertussis
ucaggcggaugcgguacugcggc

SEQ ID NO: 2440542 - RNA, 14 nt, Bordetella pertussis
ucaggcggccaggg

SEQ ID NO: 2440543 - RNA, 13 nt, Bordetella pertussis
ucaggcggcugcc

SEQ ID NO: 2440544 - RNA, 20 nt, Bordetella pertussis
ucaggcggugccccggccuc

SEQ ID NO: 2440545 - RNA, 19 nt, Bordetella pertussis
ucaggcguggcgacagcaa

SEQ ID NO: 2440546 - RNA, 20 nt, Bordetella pertussis
ucaggcugggagagccggcc

SEQ ID NO: 2440547 - RNA, 21 nt, Bordetella pertussis
ucaggcuugcagcaacgcggc

SEQ ID NO: 2440548 - RNA, 16 nt, Bordetella pertussis
ucagggacgggccagc

SEQ ID NO: 2440549 - RNA, 13 nt, Bordetella pertussis
ucagggaggcugu

SEQ ID NO: 2440550 - RNA, 16 nt, Bordetella pertussis
ucagggccgcagcacc

SEQ ID NO: 2440551 - RNA, 11 nt, Bordetella pertussis
ucagggccgcc

SEQ ID NO: 2440552 - RNA, 12 nt, Bordetella pertussis
ucagggccgcca

SEQ ID NO: 2440553 - RNA, 13 nt, Bordetella pertussis
ucagggccgccag

SEQ ID NO: 2440554 - RNA, 22 nt, Bordetella pertussis
ucagggcgaacgggguggccgg

SEQ ID NO: 2440555 - RNA, 15 nt, Bordetella pertussis
ucagggcgccggcgu

SEQ ID NO: 2440556 - RNA, 17 nt, Bordetella pertussis
ucaggggcucggccagg

SEQ ID NO: 2440557 - RNA, 15 nt, Bordetella pertussis
ucagggugaggguga

SEQ ID NO: 2440558 - RNA, 19 nt, Bordetella pertussis
ucagggugggcacgcgcgc

SEQ ID NO: 2440559 - RNA, 14 nt, Bordetella pertussis
ucagggugucgccg

SEQ ID NO: 2440560 - RNA, 15 nt, Bordetella pertussis
ucagguagccgaagu

SEQ ID NO: 2440561 - RNA, 22 nt, Bordetella pertussis
ucagguagccgaaguugucgcc

SEQ ID NO: 2440562 - RNA, 22 nt, Bordetella pertussis
ucagguccaugaacgccgcgcc

SEQ ID NO: 2440563 - RNA, 15 nt, Bordetella pertussis
ucaggucgaugccgg

SEQ ID NO: 2440564 - RNA, 17 nt, Bordetella pertussis
ucaggucgaugccggcg

SEQ ID NO: 2440565 - RNA, 19 nt, Bordetella pertussis
ucaggucgauguggccguc

SEQ ID NO: 2440566 - RNA, 15 nt, Bordetella pertussis
ucaggugcagcgaga

SEQ ID NO: 2440567 - RNA, 18 nt, Bordetella pertussis
ucagguguucgcgcacca

SEQ ID NO: 2440568 - RNA, 15 nt, Bordetella pertussis
ucagguuguccagcg

SEQ ID NO: 2440569 - RNA, 15 nt, Bordetella pertussis
ucaguccgcccagcc

SEQ ID NO: 2440570 - RNA, 13 nt, Bordetella pertussis
ucaguccguggcg

SEQ ID NO: 2440571 - RNA, 17 nt, Bordetella pertussis
ucaguccguggcgcggc

SEQ ID NO: 2440572 - RNA, 19 nt, Bordetella pertussis
ucaguccucaugcgggaca

SEQ ID NO: 2440573 - RNA, 18 nt, Bordetella pertussis
ucagucgggacggcgcgg

SEQ ID NO: 2440574 - RNA, 19 nt, Bordetella pertussis
ucagucgggacggcgcggg

SEQ ID NO: 2440575 - RNA, 15 nt, Bordetella pertussis
ucagucgggcagcgc

SEQ ID NO: 2440576 - RNA, 15 nt, Bordetella pertussis
ucaguugacgccggc

SEQ ID NO: 2440577 - RNA, 15 nt, Bordetella pertussis
ucauacacggcgcgg

SEQ ID NO: 2440578 - RNA, 18 nt, Bordetella pertussis
ucauacgccaugaacgcu

SEQ ID NO: 2440579 - RNA, 14 nt, Bordetella pertussis
ucaucaaacgcggc

SEQ ID NO: 2440580 - RNA, 23 nt, Bordetella pertussis
ucaucaaacgcggcgccgccggc

SEQ ID NO: 2440581 - RNA, 14 nt, Bordetella pertussis
ucaucacgggcgcc

SEQ ID NO: 2440582 - RNA, 13 nt, Bordetella pertussis
ucaucagcacgau

SEQ ID NO: 2440583 - RNA, 16 nt, Bordetella pertussis
ucaucagcgcgcgcag

SEQ ID NO: 2440584 - RNA, 22 nt, Bordetella pertussis
ucaucagcgcgcgcagccgcgc

SEQ ID NO: 2440585 - RNA, 13 nt, Bordetella pertussis
ucaucaggaugaa

SEQ ID NO: 2440586 - RNA, 11 nt, Bordetella pertussis
ucauccacagg

SEQ ID NO: 2440587 - RNA, 19 nt, Bordetella pertussis
ucauccaggccgugagcgc

SEQ ID NO: 2440588 - RNA, 21 nt, Bordetella pertussis
ucauccagguggcggacaggc

SEQ ID NO: 2440589 - RNA, 13 nt, Bordetella pertussis
ucauccgcgcaug

SEQ ID NO: 2440590 - RNA, 19 nt, Bordetella pertussis
uccagcagcagcgccgcgc

SEQ ID NO: 2440591 - RNA, 22 nt, Bordetella pertussis
uccagcagcagcgccgcgccgc

SEQ ID NO: 2440592 - RNA, 14 nt, Bordetella pertussis
uccagcagcaugcc

SEQ ID NO: 2440593 - RNA, 15 nt, Bordetella pertussis
uccagcagcguggcc

SEQ ID NO: 2440594 - RNA, 17 nt, Bordetella pertussis
uccagcaucagggcgau

SEQ ID NO: 2440595 - RNA, 19 nt, Bordetella pertussis
uccagcauuucucgggcgc

SEQ ID NO: 2440596 - RNA, 21 nt, Bordetella pertussis
uccagccaccacugcaaggcc

SEQ ID NO: 2440597 - RNA, 22 nt, Bordetella pertussis
uccagccaccaugucccuggcc

SEQ ID NO: 2440598 - RNA, 23 nt, Bordetella pertussis
uccagccaccaugucccuggcca

SEQ ID NO: 2440599 - RNA, 15 nt, Bordetella pertussis
uccagccaggcgcgc

SEQ ID NO: 2440600 - RNA, 18 nt, Bordetella pertussis
uccagccaguacaggcug

SEQ ID NO: 2440601 - RNA, 22 nt, Bordetella pertussis
uccagccauggaagcggcagac

SEQ ID NO: 2440602 - RNA, 23 nt, Bordetella pertussis
uccagcccaccgcgaaccaggcc

SEQ ID NO: 2440603 - RNA, 18 nt, Bordetella pertussis
uccagccccacgccgacc

SEQ ID NO: 2440604 - RNA, 22 nt, Bordetella pertussis
uccagcccgcggguucgcccgg

SEQ ID NO: 2440605 - RNA, 14 nt, Bordetella pertussis
uccagcccgugggc

SEQ ID NO: 2440606 - RNA, 17 nt, Bordetella pertussis
uccagcccgugggcggc

SEQ ID NO: 2440607 - RNA, 15 nt, Bordetella pertussis
uccagccgagccugg

SEQ ID NO: 2440608 - RNA, 18 nt, Bordetella pertussis
uccagccgagccuggcgu

SEQ ID NO: 2440609 - RNA, 23 nt, Bordetella pertussis
uccagccgaucagccggccaugg

SEQ ID NO: 2440610 - RNA, 14 nt, Bordetella pertussis
uccagccugcccgg

SEQ ID NO: 2440611 - RNA, 19 nt, Bordetella pertussis
uccagccugcccgggcagc

SEQ ID NO: 2440612 - RNA, 23 nt, Bordetella pertussis
uccagccuggcaaugcguggccg

SEQ ID NO: 2440613 - RNA, 17 nt, Bordetella pertussis
uccagcgacuccggccg

SEQ ID NO: 2440614 - RNA, 15 nt, Bordetella pertussis
uccagcgagaccuug

SEQ ID NO: 2440615 - RNA, 16 nt, Bordetella pertussis
uccagcgccaccagca

SEQ ID NO: 2440616 - RNA, 19 nt, Bordetella pertussis
uccagcgccaccagcagcg

SEQ ID NO: 2440617 - RNA, 19 nt, Bordetella pertussis
uccagcgccagcaccggca

SEQ ID NO: 2440618 - RNA, 22 nt, Bordetella pertussis
uccagcgccagcaccggcacgc

SEQ ID NO: 2440619 - RNA, 14 nt, Bordetella pertussis
uccagcgccagcag

SEQ ID NO: 2440620 - RNA, 22 nt, Bordetella pertussis
uccagcgccagcagggucagcg

SEQ ID NO: 2440621 - RNA, 16 nt, Bordetella pertussis
uccagcgccaggccgc

SEQ ID NO: 2440622 - RNA, 13 nt, Bordetella pertussis
uccagcgcccgaa

SEQ ID NO: 2440623 - RNA, 13 nt, Bordetella pertussis
uccagcgccgccu

SEQ ID NO: 2440624 - RNA, 22 nt, Bordetella pertussis
uccagcgcgcgaucgccagcag

SEQ ID NO: 2440625 - RNA, 14 nt, Bordetella pertussis
uccagcgcgcggcc

SEQ ID NO: 2440626 - RNA, 14 nt, Bordetella pertussis
uccagcgcggcaug

SEQ ID NO: 2440627 - RNA, 19 nt, Bordetella pertussis
uccagcgcggcaugccgcu

SEQ ID NO: 2440628 - RNA, 23 nt, Bordetella pertussis
uccagcgcggcaugccgcugcag

SEQ ID NO: 2440629 - RNA, 13 nt, Bordetella pertussis
uccagcgcggcca

SEQ ID NO: 2440630 - RNA, 14 nt, Bordetella pertussis
uccagcgcggcgcc

SEQ ID NO: 2440631 - RNA, 18 nt, Bordetella pertussis
uccagcgcgucggccagg

SEQ ID NO: 2440632 - RNA, 19 nt, Bordetella pertussis
uccagcgcgucggccaggc

SEQ ID NO: 2440633 - RNA, 22 nt, Bordetella pertussis
uccagcgcucgggcucgcgcgc

SEQ ID NO: 2440634 - RNA, 18 nt, Bordetella pertussis
uccagcggacgggccagg

SEQ ID NO: 2440635 - RNA, 16 nt, Bordetella pertussis
uccagcggcagcgggu

SEQ ID NO: 2440636 - RNA, 12 nt, Bordetella pertussis
uccagcggcgcc

SEQ ID NO: 2440637 - RNA, 13 nt, Bordetella pertussis
uccagcggcgcca

SEQ ID NO: 2440638 - RNA, 15 nt, Bordetella pertussis
uccagcggcgccagc

SEQ ID NO: 2440639 - RNA, 17 nt, Bordetella pertussis
uccagcggcgccagcgg

SEQ ID NO: 2440640 - RNA, 14 nt, Bordetella pertussis
uccagcggcgcgac

SEQ ID NO: 2440641 - RNA, 23 nt, Bordetella pertussis
uccagcgucauggccuggcccag

SEQ ID NO: 2440642 - RNA, 22 nt, Bordetella pertussis
uccagcgucggcguaaggccgc

SEQ ID NO: 2440643 - RNA, 13 nt, Bordetella pertussis
uccagcguggcgc

SEQ ID NO: 2440644 - RNA, 21 nt, Bordetella pertussis
uccagcucagcagcgccaggg

SEQ ID NO: 2440645 - RNA, 17 nt, Bordetella pertussis
uccagcuccagcgcgcc

SEQ ID NO: 2440646 - RNA, 15 nt, Bordetella pertussis
uccagcuccagcgcu

SEQ ID NO: 2440647 - RNA, 14 nt, Bordetella pertussis
uccagcuccaggug

SEQ ID NO: 2440648 - RNA, 15 nt, Bordetella pertussis
uccagcuccggcggc

SEQ ID NO: 2440649 - RNA, 22 nt, Bordetella pertussis
uccagcucgguggucaacggca

SEQ ID NO: 2440650 - RNA, 17 nt, Bordetella pertussis
uccagcucugcucuguc

SEQ ID NO: 2440651 - RNA, 16 nt, Bordetella pertussis
uccagcugcgcgcgag

SEQ ID NO: 2440652 - RNA, 21 nt, Bordetella pertussis
uccagcuggcccuggcagacg

SEQ ID NO: 2440653 - RNA, 22 nt, Bordetella pertussis
uccagcuggcccuggcagacgu

SEQ ID NO: 2440654 - RNA, 17 nt, Bordetella pertussis
uccagcuucaucaccuu

SEQ ID NO: 2440655 - RNA, 15 nt, Bordetella pertussis
uccaggaaagaggcc

SEQ ID NO: 2440656 - RNA, 16 nt, Bordetella pertussis
uccaggaaagcgccgc

SEQ ID NO: 2440657 - RNA, 17 nt, Bordetella pertussis
uccaggaaagcgccgcc

SEQ ID NO: 2440658 - RNA, 18 nt, Bordetella pertussis
uccaggaaagcgccgccg

SEQ ID NO: 2440659 - RNA, 19 nt, Bordetella pertussis
uccaggaaagcgccgccgc

SEQ ID NO: 2440660 - RNA, 22 nt, Bordetella pertussis
uccaggaacugcuccacgugcg

SEQ ID NO: 2440661 - RNA, 23 nt, Bordetella pertussis
uccaggaagcagcccagcacgac

SEQ ID NO: 2440662 - RNA, 14 nt, Bordetella pertussis
uccaggaguuccca

SEQ ID NO: 2440663 - RNA, 20 nt, Bordetella pertussis
uccaggaguucccagcgcgc

SEQ ID NO: 2440664 - RNA, 16 nt, Bordetella pertussis
uccaggccaccgcggc

SEQ ID NO: 2440665 - RNA, 13 nt, Bordetella pertussis
uccaggcccagcg

SEQ ID NO: 2440666 - RNA, 13 nt, Bordetella pertussis
uccaggcccaggc

SEQ ID NO: 2440667 - RNA, 24 nt, Bordetella pertussis
uccaggcccgaaacgcgcagcacc

SEQ ID NO: 2440668 - RNA, 19 nt, Bordetella pertussis
uccaggcccuggcggcgca

SEQ ID NO: 2440669 - RNA, 22 nt, Bordetella pertussis
uccaggccgaucagcgacagca

SEQ ID NO: 2440670 - RNA, 13 nt, Bordetella pertussis
uccaggccuggga

SEQ ID NO: 2440671 - RNA, 19 nt, Bordetella pertussis
uccaggcgccgcacgccgg

SEQ ID NO: 2440672 - RNA, 16 nt, Bordetella pertussis
uccaggcgcgccagcc

SEQ ID NO: 2440673 - RNA, 20 nt, Bordetella pertussis
uccaggcgcgccagccgcug

SEQ ID NO: 2440674 - RNA, 23 nt, Bordetella pertussis
uccaggcgcgugggcaggugcuu

SEQ ID NO: 2440675 - RNA, 12 nt, Bordetella pertussis
uccaggcgcguu

SEQ ID NO: 2440676 - RNA, 13 nt, Bordetella pertussis
uccaggcggccac

SEQ ID NO: 2440677 - RNA, 17 nt, Bordetella pertussis
uccaggcggccaccacc

SEQ ID NO: 2440678 - RNA, 22 nt, Bordetella pertussis
uccaggcggccaccaccaggcc

SEQ ID NO: 2440679 - RNA, 21 nt, Bordetella pertussis
uccaggcggcggugccagcgc

SEQ ID NO: 2440680 - RNA, 19 nt, Bordetella pertussis
uccaggcucaggcggccag

SEQ ID NO: 2440681 - RNA, 21 nt, Bordetella pertussis
uccaggcucaggcggccaggg

SEQ ID NO: 2440682 - RNA, 14 nt, Bordetella pertussis
uccaggcugagcgu

SEQ ID NO: 2440683 - RNA, 10 nt, Bordetella pertussis
uccaggcugc

SEQ ID NO: 2440684 - RNA, 12 nt, Bordetella pertussis
uccaggcugccg

SEQ ID NO: 2440685 - RNA, 15 nt, Bordetella pertussis
uccagggccgcagca

SEQ ID NO: 2440686 - RNA, 15 nt, Bordetella pertussis
uccagggccgccagc

SEQ ID NO: 2440687 - RNA, 12 nt, Bordetella pertussis
uccagggcgcgc

SEQ ID NO: 2440688 - RNA, 19 nt, Bordetella pertussis
uccagggcgucggcgacgu

SEQ ID NO: 2440689 - RNA, 18 nt, Bordetella pertussis
uccagggcuugcggcgcu

SEQ ID NO: 2440690 - RNA, 20 nt, Bordetella pertussis
uccagggcuugcggcgcugg

SEQ ID NO: 2440691 - RNA, 21 nt, Bordetella pertussis
uccaggguguccuggucggcg

SEQ ID NO: 2440692 - RNA, 14 nt, Bordetella pertussis
uccagguaggcggc

SEQ ID NO: 2440693 - RNA, 18 nt, Bordetella pertussis
uccagguaggcggcgcgc

SEQ ID NO: 2440694 - RNA, 20 nt, Bordetella pertussis
uccagguaggcggcgcgccc

SEQ ID NO: 2440695 - RNA, 19 nt, Bordetella pertussis
uccagguagucguucuggg

SEQ ID NO: 2440696 - RNA, 20 nt, Bordetella pertussis
uccaggucgauaucgccauc

SEQ ID NO: 2440697 - RNA, 17 nt, Bordetella pertussis
uccaggugcggcggcga

SEQ ID NO: 2440698 - RNA, 14 nt, Bordetella pertussis
uccagguggcccgc

SEQ ID NO: 2440699 - RNA, 19 nt, Bordetella pertussis
uccagguggcccgcaccgg

SEQ ID NO: 2440700 - RNA, 19 nt, Bordetella pertussis
uccagguggcggacaggcc

SEQ ID NO: 2440701 - RNA, 12 nt, Bordetella pertussis
uccagguugggc

SEQ ID NO: 2440702 - RNA, 14 nt, Bordetella pertussis
uccagguugucgcg

SEQ ID NO: 2440703 - RNA, 12 nt, Bordetella pertussis
agaccagcagcu

SEQ ID NO: 2440704 - RNA, 14 nt, Bordetella pertussis
agaccaucuugucc

SEQ ID NO: 2440705 - RNA, 17 nt, Bordetella pertussis
agacccacagguuggcc

SEQ ID NO: 2440706 - RNA, 20 nt, Bordetella pertussis
agacccgggccgcuggcccg

SEQ ID NO: 2440707 - RNA, 13 nt, Bordetella pertussis
agacccuggcgcg

SEQ ID NO: 2440708 - RNA, 18 nt, Bordetella pertussis
agaccgagcgcgcccgcu

SEQ ID NO: 2440709 - RNA, 15 nt, Bordetella pertussis
agaccgcgcgcacca

SEQ ID NO: 2440710 - RNA, 16 nt, Bordetella pertussis
agaccgcggccgcgcu

SEQ ID NO: 2440711 - RNA, 14 nt, Bordetella pertussis
agaccggcgccugc

SEQ ID NO: 2440712 - RNA, 18 nt, Bordetella pertussis
agaccggcgccugcggca

SEQ ID NO: 2440713 - RNA, 21 nt, Bordetella pertussis
agaccggguugcccggcaggc

SEQ ID NO: 2440714 - RNA, 22 nt, Bordetella pertussis
agaccggguuuccagcccgugg

SEQ ID NO: 2440715 - RNA, 23 nt, Bordetella pertussis
agaccggguuuccagcccgugga

SEQ ID NO: 2440716 - RNA, 19 nt, Bordetella pertussis
agaccguagcgcaggcgcu

SEQ ID NO: 2440717 - RNA, 21 nt, Bordetella pertussis
agaccguggaaaccgcgucgu

SEQ ID NO: 2440718 - RNA, 20 nt, Bordetella pertussis
agaccugcgggccgcacagc

SEQ ID NO: 2440719 - RNA, 15 nt, Bordetella pertussis
agacgaaggcgccgg

SEQ ID NO: 2440720 - RNA, 17 nt, Bordetella pertussis
agacgaaggcgccggcc

SEQ ID NO: 2440721 - RNA, 17 nt, Bordetella pertussis
agacgaccgaaaagccc

SEQ ID NO: 2440722 - RNA, 16 nt, Bordetella pertussis
agacgaugcccaggcc

SEQ ID NO: 2440723 - RNA, 19 nt, Bordetella pertussis
agacgaugcccaggcccgc

SEQ ID NO: 2440724 - RNA, 22 nt, Bordetella pertussis
agacgauggccgaaugcccgcc

SEQ ID NO: 2440725 - RNA, 17 nt, Bordetella pertussis
agacgauggugccggcc

SEQ ID NO: 2440726 - RNA, 15 nt, Bordetella pertussis
agacgccgucgaccc

SEQ ID NO: 2440727 - RNA, 23 nt, Bordetella pertussis
agacgcgcuuuuccccgcccagc

SEQ ID NO: 2440728 - RNA, 16 nt, Bordetella pertussis
agacgcggggacaggc

SEQ ID NO: 2440729 - RNA, 20 nt, Bordetella pertussis
agacgcggggacaggcacac

SEQ ID NO: 2440730 - RNA, 15 nt, Bordetella pertussis
agacgcugucgcgcc

SEQ ID NO: 2440731 - RNA, 19 nt, Bordetella pertussis
agacggaugcuugcggggc

SEQ ID NO: 2440732 - RNA, 13 nt, Bordetella pertussis
agacggccagcgc

SEQ ID NO: 2440733 - RNA, 16 nt, Bordetella pertussis
agacggccagcgcgcg

SEQ ID NO: 2440734 - RNA, 13 nt, Bordetella pertussis
agacggccgccga

SEQ ID NO: 2440735 - RNA, 21 nt, Bordetella pertussis
agacggcgcucggccucgagg

SEQ ID NO: 2440736 - RNA, 13 nt, Bordetella pertussis
agacggcggcugg

SEQ ID NO: 2440737 - RNA, 21 nt, Bordetella pertussis
agacggcuugaccacggccag

SEQ ID NO: 2440738 - RNA, 17 nt, Bordetella pertussis
agacggucaccgcgccc

SEQ ID NO: 2440739 - RNA, 20 nt, Bordetella pertussis
agacggucaccgcgcccagg

SEQ ID NO: 2440740 - RNA, 16 nt, Bordetella pertussis
agacguagccgcugcc

SEQ ID NO: 2440741 - RNA, 21 nt, Bordetella pertussis
agacgucggcgauggcccggu

SEQ ID NO: 2440742 - RNA, 22 nt, Bordetella pertussis
agacuguucagaaaccugaccu

SEQ ID NO: 2440743 - RNA, 19 nt, Bordetella pertussis
agagcaggccgcccagcgc

SEQ ID NO: 2440744 - RNA, 19 nt, Bordetella pertussis
ucccagcggggacaggcac

SEQ ID NO: 2440745 - RNA, 21 nt, Bordetella pertussis
ucccagcggggacaggcaccc

SEQ ID NO: 2440746 - RNA, 13 nt, Bordetella pertussis
ucccagcuccagu

SEQ ID NO: 2440747 - RNA, 13 nt, Bordetella pertussis
ucccaggcccggc

SEQ ID NO: 2440748 - RNA, 14 nt, Bordetella pertussis
ucccaggcccggcc

SEQ ID NO: 2440749 - RNA, 15 nt, Bordetella pertussis
ucccaggcccggccg

SEQ ID NO: 2440750 - RNA, 19 nt, Bordetella pertussis
ucccaggcccggccgcagg

SEQ ID NO: 2440751 - RNA, 22 nt, Bordetella pertussis
ucccaggcccggccgcagggcg

SEQ ID NO: 2440752 - RNA, 12 nt, Bordetella pertussis
ucccaggccggc

SEQ ID NO: 2440753 - RNA, 21 nt, Bordetella pertussis
ucccaggcgaggcuggcgccc

SEQ ID NO: 2440754 - RNA, 18 nt, Bordetella pertussis
ucccaggcgcucagccgu

SEQ ID NO: 2440755 - RNA, 17 nt, Bordetella pertussis
ucccaguucugcagcgu

SEQ ID NO: 2440756 - RNA, 19 nt, Bordetella pertussis
ucccaugacccugcacgau

SEQ ID NO: 2440757 - RNA, 16 nt, Bordetella pertussis
ucccauugcgcggcca

SEQ ID NO: 2440758 - RNA, 19 nt, Bordetella pertussis
ucccauugcgcggccaggg

SEQ ID NO: 2440759 - RNA, 17 nt, Bordetella pertussis
uccccaaguacacgguc

SEQ ID NO: 2440760 - RNA, 18 nt, Bordetella pertussis
uccccacagggggacugg

SEQ ID NO: 2440761 - RNA, 22 nt, Bordetella pertussis
uccccacagggggacuggcacc

SEQ ID NO: 2440762 - RNA, 20 nt, Bordetella pertussis
uccccacagggggucuggca

SEQ ID NO: 2440763 - RNA, 17 nt, Bordetella pertussis
uccccaccgggacaggc

SEQ ID NO: 2440764 - RNA, 16 nt, Bordetella pertussis
uccccacggggacagg

SEQ ID NO: 2440765 - RNA, 18 nt, Bordetella pertussis
uccccacggggacaggca

SEQ ID NO: 2440766 - RNA, 14 nt, Bordetella pertussis
uccccacuggggga

SEQ ID NO: 2440767 - RNA, 18 nt, Bordetella pertussis
uccccacugggggacugg

SEQ ID NO: 2440768 - RNA, 20 nt, Bordetella pertussis
uccccacugggggacuggca

SEQ ID NO: 2440769 - RNA, 22 nt, Bordetella pertussis
uccccacugggggacuggcacc

SEQ ID NO: 2440770 - RNA, 17 nt, Bordetella pertussis
uccccagacgcagacca

SEQ ID NO: 2440771 - RNA, 21 nt, Bordetella pertussis
uccccagacgcagaccacgcc

SEQ ID NO: 2440772 - RNA, 23 nt, Bordetella pertussis
uccccagcacauagcgcaagccc

SEQ ID NO: 2440773 - RNA, 12 nt, Bordetella pertussis
uccccagcgccg

SEQ ID NO: 2440774 - RNA, 15 nt, Bordetella pertussis
uccccagcgccgcca

SEQ ID NO: 2440775 - RNA, 19 nt, Bordetella pertussis
uccccaggccagcugcgcc

SEQ ID NO: 2440776 - RNA, 19 nt, Bordetella pertussis
uccccaucaucugcggcac

SEQ ID NO: 2440777 - RNA, 20 nt, Bordetella pertussis
uccccaugcggggacuggca

SEQ ID NO: 2440778 - RNA, 22 nt, Bordetella pertussis
uccccaugcggggacuggcacc

SEQ ID NO: 2440779 - RNA, 23 nt, Bordetella pertussis
uccccaugcggggacuggcacca

SEQ ID NO: 2440780 - RNA, 15 nt, Bordetella pertussis
uccccauguggggac

SEQ ID NO: 2440781 - RNA, 21 nt, Bordetella pertussis
uccccauguggggacaggcac

SEQ ID NO: 2440782 - RNA, 22 nt, Bordetella pertussis
uccccauguggggacaggcacc

SEQ ID NO: 2440783 - RNA, 15 nt, Bordetella pertussis
ucccccacgccgccg

SEQ ID NO: 2440784 - RNA, 18 nt, Bordetella pertussis
ucccccacgccgccguag

SEQ ID NO: 2440785 - RNA, 19 nt, Bordetella pertussis
ucccccaugcggggacagg

SEQ ID NO: 2440786 - RNA, 23 nt, Bordetella pertussis
ucccccaugcggggacaggcacu

SEQ ID NO: 2440787 - RNA, 20 nt, Bordetella pertussis
uccccccauggggacuggca

SEQ ID NO: 2440788 - RNA, 22 nt, Bordetella pertussis
uccccccauggggacuggcacc

SEQ ID NO: 2440789 - RNA, 16 nt, Bordetella pertussis
ucccccgcggggacag

SEQ ID NO: 2440790 - RNA, 22 nt, Bordetella pertussis
ucccccgcgucggacgcgcgcc

SEQ ID NO: 2440791 - RNA, 20 nt, Bordetella pertussis
ucccccucggccugcgcgau

SEQ ID NO: 2440792 - RNA, 20 nt, Bordetella pertussis
ucccccugcggggacaggca

SEQ ID NO: 2440793 - RNA, 22 nt, Bordetella pertussis
ucccccugcggggacaggcacc

SEQ ID NO: 2440794 - RNA, 20 nt, Bordetella pertussis
uccccgaacggggacuggca

SEQ ID NO: 2440795 - RNA, 23 nt, Bordetella pertussis
uccccgaacggggacuggcacca

SEQ ID NO: 2440796 - RNA, 17 nt, Bordetella pertussis
uccccgaaggggacugg

SEQ ID NO: 2440797 - RNA, 22 nt, Bordetella pertussis
uccccgcaagggggacuggcac

SEQ ID NO: 2440798 - RNA, 23 nt, Bordetella pertussis
uccccgcaagggggacuggcacc

SEQ ID NO: 2440799 - RNA, 19 nt, Bordetella pertussis
uccccgcacggggacaggc

SEQ ID NO: 2440800 - RNA, 20 nt, Bordetella pertussis
uccccgcacggggacaggca

SEQ ID NO: 2440801 - RNA, 21 nt, Bordetella pertussis
uccccgcacggggacaggcac

SEQ ID NO: 2440802 - RNA, 18 nt, Bordetella pertussis
uccccgcacggggacugg

SEQ ID NO: 2440803 - RNA, 20 nt, Bordetella pertussis
uccccgcacggggacuggca

SEQ ID NO: 2440804 - RNA, 22 nt, Bordetella pertussis
uccccgcacggggacuggcacg

SEQ ID NO: 2440805 - RNA, 14 nt, Bordetella pertussis
uccccgcagggaca

SEQ ID NO: 2440806 - RNA, 16 nt, Bordetella pertussis
uccccgcagggacagg

SEQ ID NO: 2440807 - RNA, 17 nt, Bordetella pertussis
uccccgcagggacaggc

SEQ ID NO: 2440808 - RNA, 20 nt, Bordetella pertussis
uccccgcagggacaggcacc

SEQ ID NO: 2440809 - RNA, 18 nt, Bordetella pertussis
uccccgcagggacaggcu

SEQ ID NO: 2440810 - RNA, 20 nt, Bordetella pertussis
uccccgcagggacaggcucc

SEQ ID NO: 2440811 - RNA, 20 nt, Bordetella pertussis
uccccgcauggggacuggcg

SEQ ID NO: 2440812 - RNA, 21 nt, Bordetella pertussis
uccccgcaugggggcuggcgc

SEQ ID NO: 2440813 - RNA, 12 nt, Bordetella pertussis
uccccgcccagc

SEQ ID NO: 2440814 - RNA, 22 nt, Bordetella pertussis
uccgccauggaggcgcagcgcg

SEQ ID NO: 2440815 - RNA, 14 nt, Bordetella pertussis
uccgcccagccagg

SEQ ID NO: 2440816 - RNA, 17 nt, Bordetella pertussis
uccgcccagccaggcgc

SEQ ID NO: 2440817 - RNA, 18 nt, Bordetella pertussis
uccgcccagccaggcgcc

SEQ ID NO: 2440818 - RNA, 20 nt, Bordetella pertussis
uccgcccagccaggcgccag

SEQ ID NO: 2440819 - RNA, 23 nt, Bordetella pertussis
uccgcccagccaggcgccagcgg

SEQ ID NO: 2440820 - RNA, 22 nt, Bordetella pertussis
uccgccccauccacggcgccau

SEQ ID NO: 2440821 - RNA, 20 nt, Bordetella pertussis
uccgccccccugcauaccca

SEQ ID NO: 2440822 - RNA, 18 nt, Bordetella pertussis
uccgcccguugcggcgcc

SEQ ID NO: 2440823 - RNA, 19 nt, Bordetella pertussis
uccgccgagaaauccagcg

SEQ ID NO: 2440824 - RNA, 13 nt, Bordetella pertussis
uccgccgccagca

SEQ ID NO: 2440825 - RNA, 14 nt, Bordetella pertussis
uccgccgccagcac

SEQ ID NO: 2440826 - RNA, 15 nt, Bordetella pertussis
uccgccgccagcacg

SEQ ID NO: 2440827 - RNA, 16 nt, Bordetella pertussis
uccgccgccagcacgc

SEQ ID NO: 2440828 - RNA, 21 nt, Bordetella pertussis
uccgccgcgaccaccagcacc

SEQ ID NO: 2440829 - RNA, 15 nt, Bordetella pertussis
uccgccgcggccagc

SEQ ID NO: 2440830 - RNA, 20 nt, Bordetella pertussis
uccgccggcgauauggccag

SEQ ID NO: 2440831 - RNA, 16 nt, Bordetella pertussis
uccgccguagcgcgcc

SEQ ID NO: 2440832 - RNA, 17 nt, Bordetella pertussis
uccgccguagcgcgcca

SEQ ID NO: 2440833 - RNA, 19 nt, Bordetella pertussis
uccgccguugcucgcgcgc

SEQ ID NO: 2440834 - RNA, 17 nt, Bordetella pertussis
uccgccuacuggcgcgc

SEQ ID NO: 2440835 - RNA, 18 nt, Bordetella pertussis
uccgccuacuggcgcgcg

SEQ ID NO: 2440836 - RNA, 20 nt, Bordetella pertussis
uccgccugcggacggcgggc

SEQ ID NO: 2440837 - RNA, 15 nt, Bordetella pertussis
uccgcgaaacggcgg

SEQ ID NO: 2440838 - RNA, 18 nt, Bordetella pertussis
uccgcgacgcccuggccu

SEQ ID NO: 2440839 - RNA, 22 nt, Bordetella pertussis
uccgcgacgguccugcgcgccg

SEQ ID NO: 2440840 - RNA, 16 nt, Bordetella pertussis
uccgcgcacagcgcgg

SEQ ID NO: 2440841 - RNA, 21 nt, Bordetella pertussis
uccgcgcacagcgcggcgaug

SEQ ID NO: 2440842 - RNA, 21 nt, Bordetella pertussis
uccgcgcauggacugcaggcg

SEQ ID NO: 2440843 - RNA, 15 nt, Bordetella pertussis
uccgcgccaggaugg

SEQ ID NO: 2440844 - RNA, 13 nt, Bordetella pertussis
uccgcgccgacca

SEQ ID NO: 2440845 - RNA, 15 nt, Bordetella pertussis
uccgcgcucgcccag

SEQ ID NO: 2440846 - RNA, 20 nt, Bordetella pertussis
uccgcgggcgggccgcggac

SEQ ID NO: 2440847 - RNA, 12 nt, Bordetella pertussis
uccgcguccauc

SEQ ID NO: 2440848 - RNA, 14 nt, Bordetella pertussis
uccgcguccaucug

SEQ ID NO: 2440849 - RNA, 15 nt, Bordetella pertussis
uccgcgucgccgccg

SEQ ID NO: 2440850 - RNA, 14 nt, Bordetella pertussis
uccgcgucggccgc

SEQ ID NO: 2440851 - RNA, 19 nt, Bordetella pertussis
uccgcgugggcaugguggc

SEQ ID NO: 2440852 - RNA, 16 nt, Bordetella pertussis
uccgcuaccaggcgcg

SEQ ID NO: 2440853 - RNA, 20 nt, Bordetella pertussis
uccgcuaccaggcgcgcgcg

SEQ ID NO: 2440854 - RNA, 15 nt, Bordetella pertussis
uccgcucaugccggc

SEQ ID NO: 2440855 - RNA, 17 nt, Bordetella pertussis
uccgcucgaggccaggc

SEQ ID NO: 2440856 - RNA, 19 nt, Bordetella pertussis
uccgcucgaggccaggcug

SEQ ID NO: 2440857 - RNA, 14 nt, Bordetella pertussis
uccgcugcgccgag

SEQ ID NO: 2440858 - RNA, 18 nt, Bordetella pertussis
uccgcuggcgaucacggc

SEQ ID NO: 2440859 - RNA, 13 nt, Bordetella pertussis
uccgcuuccggcc

SEQ ID NO: 2440860 - RNA, 14 nt, Bordetella pertussis
uccgcuuccggccg

SEQ ID NO: 2440861 - RNA, 21 nt, Bordetella pertussis
uccgcuuccggccgggccagu

SEQ ID NO: 2440862 - RNA, 23 nt, Bordetella pertussis
uccgcuucgucgggcagcgcggc

SEQ ID NO: 2440863 - RNA, 22 nt, Bordetella pertussis
uccggacugaacgcguccaggc

SEQ ID NO: 2440864 - RNA, 14 nt, Bordetella pertussis
uccggcaacagcag

SEQ ID NO: 2440865 - RNA, 14 nt, Bordetella pertussis
uccggcacggcggc

SEQ ID NO: 2440866 - RNA, 13 nt, Bordetella pertussis
uccggcagcagca

SEQ ID NO: 2440867 - RNA, 13 nt, Bordetella pertussis
uccggcagcggcc

SEQ ID NO: 2440868 - RNA, 21 nt, Bordetella pertussis
uccggcagcggccagcgcggc

SEQ ID NO: 2440869 - RNA, 22 nt, Bordetella pertussis
uccggcagcggccagcgcggcg

SEQ ID NO: 2440870 - RNA, 18 nt, Bordetella pertussis
uccggcaugaccgcggac

SEQ ID NO: 2440871 - RNA, 20 nt, Bordetella pertussis
uccggcaugaccgcggacgc

SEQ ID NO: 2440872 - RNA, 15 nt, Bordetella pertussis
uccggccagcacgcc

SEQ ID NO: 2440873 - RNA, 22 nt, Bordetella pertussis
uccggccagcacgccggcgggc

SEQ ID NO: 2440874 - RNA, 14 nt, Bordetella pertussis
uccggcccagcgcc

SEQ ID NO: 2440875 - RNA, 17 nt, Bordetella pertussis
uccggcccagcgccauc

SEQ ID NO: 2440876 - RNA, 19 nt, Bordetella pertussis
uccggcccagcgccaucgg

SEQ ID NO: 2440877 - RNA, 17 nt, Bordetella pertussis
uccggcccggugcagcc

SEQ ID NO: 2440878 - RNA, 21 nt, Bordetella pertussis
uccggccgcacgcggccgcgg

SEQ ID NO: 2440879 - RNA, 12 nt, Bordetella pertussis
uccggccgcgca

SEQ ID NO: 2440880 - RNA, 14 nt, Bordetella pertussis
uccggccgcgcaag

SEQ ID NO: 2440881 - RNA, 24 nt, Bordetella pertussis
uccggccgcgcaaggcggcccggc

SEQ ID NO: 2440882 - RNA, 14 nt, Bordetella pertussis
uccggcgccagcau

SEQ ID NO: 2440883 - RNA, 22 nt, Bordetella pertussis
uccggcgccagcaugcgcgcgg

SEQ ID NO: 2440884 - RNA, 13 nt, Bordetella pertussis
uccggcgcccgcc

SEQ ID NO: 2440885 - RNA, 17 nt, Bordetella pertussis
uccggcgcccgccgccg

SEQ ID NO: 2440886 - RNA, 22 nt, Bordetella pertussis
uccggcgccgccggguuucucg

SEQ ID NO: 2440887 - RNA, 21 nt, Bordetella pertussis
uccggcgccgccucgggcacg

SEQ ID NO: 2440888 - RNA, 23 nt, Bordetella pertussis
uccggcgccgccucgggcacggc

SEQ ID NO: 2440889 - RNA, 14 nt, Bordetella pertussis
uccggcgccuggcc

SEQ ID NO: 2440890 - RNA, 13 nt, Bordetella pertussis
uccggcgcgcgca

SEQ ID NO: 2440891 - RNA, 15 nt, Bordetella pertussis
uccggcgcgcgcaag

SEQ ID NO: 2440892 - RNA, 15 nt, Bordetella pertussis
uccggcgcucgcccc

SEQ ID NO: 2440893 - RNA, 20 nt, Bordetella pertussis
uccggcgcucgccccggcgc

SEQ ID NO: 2440894 - RNA, 14 nt, Bordetella pertussis
uccggcgcuggcgc

SEQ ID NO: 2440895 - RNA, 20 nt, Bordetella pertussis
uccggcgugacguggcccac

SEQ ID NO: 2440896 - RNA, 20 nt, Bordetella pertussis
uccggcgugguaucgcgcca

SEQ ID NO: 2440897 - RNA, 21 nt, Bordetella pertussis
uccggcgugguaucgcgccag

SEQ ID NO: 2440898 - RNA, 17 nt, Bordetella pertussis
uccggcucggaccuggc

SEQ ID NO: 2440899 - RNA, 15 nt, Bordetella pertussis
uccggcugcgcgcgc

SEQ ID NO: 2440900 - RNA, 17 nt, Bordetella pertussis
uccggcugcgcgcgcag

SEQ ID NO: 2440901 - RNA, 21 nt, Bordetella pertussis
uccggcugcgcgcgcagccag

SEQ ID NO: 2440902 - RNA, 15 nt, Bordetella pertussis
uccggcugcuugccc

SEQ ID NO: 2440903 - RNA, 20 nt, Bordetella pertussis
uccggcuggauggugccgcc

SEQ ID NO: 2440904 - RNA, 15 nt, Bordetella pertussis
uccggcuugccgaag

SEQ ID NO: 2440905 - RNA, 16 nt, Bordetella pertussis
uccgggagccuguccc

SEQ ID NO: 2440906 - RNA, 18 nt, Bordetella pertussis
uccgggagccuguccccg

SEQ ID NO: 2440907 - RNA, 14 nt, Bordetella pertussis
uccgggccuggccu

SEQ ID NO: 2440908 - RNA, 13 nt, Bordetella pertussis
uccgggccuggcg

SEQ ID NO: 2440909 - RNA, 14 nt, Bordetella pertussis
uccgggccuggcgu

SEQ ID NO: 2440910 - RNA, 13 nt, Bordetella pertussis
uccgggcggcguu

SEQ ID NO: 2440911 - RNA, 15 nt, Bordetella pertussis
uccggggugccuguc

SEQ ID NO: 2440912 - RNA, 16 nt, Bordetella pertussis
uccggggugccugucc

SEQ ID NO: 2440913 - RNA, 18 nt, Bordetella pertussis
uccggguccagccccacg

SEQ ID NO: 2440914 - RNA, 13 nt, Bordetella pertussis
uccgggucgagcg

SEQ ID NO: 2440915 - RNA, 16 nt, Bordetella pertussis
uccgggucgcggcacg

SEQ ID NO: 2440916 - RNA, 20 nt, Bordetella pertussis
uccgggugaaguugucgucg

SEQ ID NO: 2440917 - RNA, 19 nt, Bordetella pertussis
uccggguugcccacgccuu

SEQ ID NO: 2440918 - RNA, 17 nt, Bordetella pertussis
uccgguauccuggcgcg

SEQ ID NO: 2440919 - RNA, 16 nt, Bordetella pertussis
uccggugccuggcucc

SEQ ID NO: 2440920 - RNA, 19 nt, Bordetella pertussis
uccggugccuggcuccccg

SEQ ID NO: 2440921 - RNA, 15 nt, Bordetella pertussis
uccgguggugcuggg

SEQ ID NO: 2440922 - RNA, 17 nt, Bordetella pertussis
uccguaaagaugcgcgc

SEQ ID NO: 2440923 - RNA, 14 nt, Bordetella pertussis
uccguaguccagca

SEQ ID NO: 2440924 - RNA, 18 nt, Bordetella pertussis
uccguaguccagcagcag

SEQ ID NO: 2440925 - RNA, 15 nt, Bordetella pertussis
uccguccuggccacu

SEQ ID NO: 2440926 - RNA, 17 nt, Bordetella pertussis
uccguccuggccacugc

SEQ ID NO: 2440927 - RNA, 18 nt, Bordetella pertussis
ucgaacucgauggccucg

SEQ ID NO: 2440928 - RNA, 12 nt, Bordetella pertussis
ucgaacucgccg

SEQ ID NO: 2440929 - RNA, 15 nt, Bordetella pertussis
ucgaacucgccgaac

SEQ ID NO: 2440930 - RNA, 19 nt, Bordetella pertussis
ucgaacugguacagcguga

SEQ ID NO: 2440931 - RNA, 14 nt, Bordetella pertussis
ucgaacuugcgcgc

SEQ ID NO: 2440932 - RNA, 22 nt, Bordetella pertussis
ucgaagaaggccuuggccuggg

SEQ ID NO: 2440933 - RNA, 19 nt, Bordetella pertussis
ucgaagagcagaagcauuc

SEQ ID NO: 2440934 - RNA, 22 nt, Bordetella pertussis
ucgaagaucaacaaggcgacgg

SEQ ID NO: 2440935 - RNA, 16 nt, Bordetella pertussis
ucgaagcacugcaggc

SEQ ID NO: 2440936 - RNA, 22 nt, Bordetella pertussis
ucgaagcaggcgguacagcgga

SEQ ID NO: 2440937 - RNA, 13 nt, Bordetella pertussis
ucgaagccggcgc

SEQ ID NO: 2440938 - RNA, 15 nt, Bordetella pertussis
ucgaagcgcucgucc

SEQ ID NO: 2440939 - RNA, 20 nt, Bordetella pertussis
ucgaagcggcucaggcgcgg

SEQ ID NO: 2440940 - RNA, 14 nt, Bordetella pertussis
ucgaaggcagcacc

SEQ ID NO: 2440941 - RNA, 14 nt, Bordetella pertussis
ucgaaggcagcgcg

SEQ ID NO: 2440942 - RNA, 18 nt, Bordetella pertussis
ucgaaggccgccggacgc

SEQ ID NO: 2440943 - RNA, 18 nt, Bordetella pertussis
ucgaaggcgaccggcacc

SEQ ID NO: 2440944 - RNA, 14 nt, Bordetella pertussis
ucgaaggcgccgac

SEQ ID NO: 2440945 - RNA, 17 nt, Bordetella pertussis
ucgaaggcgccgacggc

SEQ ID NO: 2440946 - RNA, 12 nt, Bordetella pertussis
ucgaaggcgcgc

SEQ ID NO: 2440947 - RNA, 13 nt, Bordetella pertussis
ucgaaggcgcgcu

SEQ ID NO: 2440948 - RNA, 15 nt, Bordetella pertussis
ucgaaggcgcgcucc

SEQ ID NO: 2440949 - RNA, 20 nt, Bordetella pertussis
ucgaaggcgcgcuccagcau

SEQ ID NO: 2440950 - RNA, 15 nt, Bordetella pertussis
ucgaaguccgcgcgc

SEQ ID NO: 2440951 - RNA, 19 nt, Bordetella pertussis
ucgaauggcugcgcgccgu

SEQ ID NO: 2440952 - RNA, 20 nt, Bordetella pertussis
ucgaauuccaguugcgcgcc

SEQ ID NO: 2440953 - RNA, 23 nt, Bordetella pertussis
ucgaauuccaguugcgcgccguc

SEQ ID NO: 2440954 - RNA, 13 nt, Bordetella pertussis
ucgacacggggca

SEQ ID NO: 2440955 - RNA, 18 nt, Bordetella pertussis
ucgacagcagcccgcugg

SEQ ID NO: 2440956 - RNA, 22 nt, Bordetella pertussis
ucgacagcaugaacggcagcgc

SEQ ID NO: 2440957 - RNA, 23 nt, Bordetella pertussis
ucgacagcaugaacggcagcgcg

SEQ ID NO: 2440958 - RNA, 14 nt, Bordetella pertussis
ucgacagcgcgcag

SEQ ID NO: 2440959 - RNA, 18 nt, Bordetella pertussis
ucgacaggaacagcacgu

SEQ ID NO: 2440960 - RNA, 23 nt, Bordetella pertussis
ucgacauacgcgaugccgaucgc

SEQ ID NO: 2440961 - RNA, 13 nt, Bordetella pertussis
ucgaccaccagca

SEQ ID NO: 2440962 - RNA, 13 nt, Bordetella pertussis
ucgaccaccagcg

SEQ ID NO: 2440963 - RNA, 22 nt, Bordetella pertussis
ucgaccaccggcuugggcgugc

SEQ ID NO: 2440964 - RNA, 16 nt, Bordetella pertussis
ucgaccacgcgcgcgc

SEQ ID NO: 2440965 - RNA, 17 nt, Bordetella pertussis
ucgaccacgcgcgcgcc

SEQ ID NO: 2440966 - RNA, 15 nt, Bordetella pertussis
ucgaccacgcguccc

SEQ ID NO: 2440967 - RNA, 14 nt, Bordetella pertussis
ucgaccacggcggc

SEQ ID NO: 2440968 - RNA, 13 nt, Bordetella pertussis
ucgaccagcaucc

SEQ ID NO: 2440969 - RNA, 21 nt, Bordetella pertussis
ucgaccagcccggccgccagc

SEQ ID NO: 2440970 - RNA, 13 nt, Bordetella pertussis
ucgaccagcgaca

SEQ ID NO: 2440971 - RNA, 13 nt, Bordetella pertussis
ucgaccagcgcgc

SEQ ID NO: 2440972 - RNA, 21 nt, Bordetella pertussis
ucgaccaggaaguugcccacc

SEQ ID NO: 2440973 - RNA, 21 nt, Bordetella pertussis
ucgaccaggcgggcaucgccc

SEQ ID NO: 2440974 - RNA, 22 nt, Bordetella pertussis
ucgaccaguucggccagcagcu

SEQ ID NO: 2440975 - RNA, 23 nt, Bordetella pertussis
ucgaccauuucgauuucggcggc

SEQ ID NO: 2440976 - RNA, 14 nt, Bordetella pertussis
ucgacccgaaggcg

SEQ ID NO: 2440977 - RNA, 18 nt, Bordetella pertussis
ucgacccgaaggcgcggc

SEQ ID NO: 2440978 - RNA, 19 nt, Bordetella pertussis
ucgacccgcucggccacgc

SEQ ID NO: 2440979 - RNA, 21 nt, Bordetella pertussis
ucgacccggacaacgcgcgcc

SEQ ID NO: 2440980 - RNA, 16 nt, Bordetella pertussis
ucgaccgacagcacau

SEQ ID NO: 2440981 - RNA, 23 nt, Bordetella pertussis
ucgaccgacagcacauggcgcgc

SEQ ID NO: 2440982 - RNA, 18 nt, Bordetella pertussis
ucgaccgauucgcgcacc

SEQ ID NO: 2440983 - RNA, 15 nt, Bordetella pertussis
ucgaccgcaugcggc

SEQ ID NO: 2440984 - RNA, 16 nt, Bordetella pertussis
ucgaccgccagcaggc

SEQ ID NO: 2440985 - RNA, 16 nt, Bordetella pertussis
ucgaccgccgccacgc

SEQ ID NO: 2440986 - RNA, 23 nt, Bordetella pertussis
ucgaccgccgccacgcgcacggc

SEQ ID NO: 2440987 - RNA, 19 nt, Bordetella pertussis
ucgaccgccgggacaggca

SEQ ID NO: 2440988 - RNA, 21 nt, Bordetella pertussis
ucgaccgccgggacaggcacc

SEQ ID NO: 2440989 - RNA, 18 nt, Bordetella pertussis
ucgaccgccucgacgccc

SEQ ID NO: 2440990 - RNA, 11 nt, Bordetella pertussis
ucgaccgcgaa

SEQ ID NO: 2440991 - RNA, 18 nt, Bordetella pertussis
ucgaccgcgaagcgcgcc

SEQ ID NO: 2440992 - RNA, 19 nt, Bordetella pertussis
ucgaccggcagggugccca

SEQ ID NO: 2440993 - RNA, 13 nt, Bordetella pertussis
ucgaccggcccgc

SEQ ID NO: 2440994 - RNA, 15 nt, Bordetella pertussis
ucgaccucgagcacc

SEQ ID NO: 2440995 - RNA, 21 nt, Bordetella pertussis
ucgaccugcgcaccggccggc

SEQ ID NO: 2440996 - RNA, 22 nt, Bordetella pertussis
ucgaccugcuugcccagcagau

SEQ ID NO: 2440997 - RNA, 19 nt, Bordetella pertussis
ucgaccugcuuggcgaaca

SEQ ID NO: 2440998 - RNA, 21 nt, Bordetella pertussis
ucgaccugcuuggcgaacacc

SEQ ID NO: 2440999 - RNA, 18 nt, Bordetella pertussis
ucgacgaaauagccgacc

SEQ ID NO: 2441000 - RNA, 19 nt, Bordetella pertussis
ucgacgaaauagccgacca

SEQ ID NO: 2441001 - RNA, 18 nt, Bordetella pertussis
ucgacgaacaaggccgga

SEQ ID NO: 2441002 - RNA, 19 nt, Bordetella pertussis
ucgacgaucaggcccuggg

SEQ ID NO: 2441003 - RNA, 18 nt, Bordetella pertussis
ucgacgaucucgcggcug

SEQ ID NO: 2441004 - RNA, 19 nt, Bordetella pertussis
ucgacgaugcccugcgcca

SEQ ID NO: 2441005 - RNA, 18 nt, Bordetella pertussis
ucgacgauggccggggcg

SEQ ID NO: 2441006 - RNA, 13 nt, Bordetella pertussis
ucgacgccaucuc

SEQ ID NO: 2441007 - RNA, 20 nt, Bordetella pertussis
ucgacgcccaugcgaucggc

SEQ ID NO: 2441008 - RNA, 17 nt, Bordetella pertussis
ucgacgcccgcgcccag

SEQ ID NO: 2441009 - RNA, 18 nt, Bordetella pertussis
ucgacgcccgcgcccagu

SEQ ID NO: 2441010 - RNA, 16 nt, Bordetella pertussis
ucgacgcccgggcggc

SEQ ID NO: 2441011 - RNA, 17 nt, Bordetella pertussis
ucgacgccggcagcgac

SEQ ID NO: 2441012 - RNA, 17 nt, Bordetella pertussis
ucgacgccuuccuugaa

SEQ ID NO: 2441013 - RNA, 12 nt, Bordetella pertussis
ucgacgcgacgc

SEQ ID NO: 2441014 - RNA, 16 nt, Bordetella pertussis
ucgacgcgaugcccgc

SEQ ID NO: 2441015 - RNA, 22 nt, Bordetella pertussis
ucgacgcgaugcccgcgcacca

SEQ ID NO: 2441016 - RNA, 23 nt, Bordetella pertussis
ucgacgcgaugcccgcgcaccag

SEQ ID NO: 2441017 - RNA, 20 nt, Bordetella pertussis
ucgacgcgcauuucgaccug

SEQ ID NO: 2441018 - RNA, 23 nt, Bordetella pertussis
ucgacgcgcgucgugcccgccac

SEQ ID NO: 2441019 - RNA, 14 nt, Bordetella pertussis
ucgacgcggccgac

SEQ ID NO: 2441020 - RNA, 14 nt, Bordetella pertussis
ucgacgcggccgug

SEQ ID NO: 2441021 - RNA, 13 nt, Bordetella pertussis
ucgacgcugaucg

SEQ ID NO: 2441022 - RNA, 22 nt, Bordetella pertussis
ucgacgcugaucucggccugcc

SEQ ID NO: 2441023 - RNA, 20 nt, Bordetella pertussis
ucgacgcuguagaggcgcgg

SEQ ID NO: 2441024 - RNA, 18 nt, Bordetella pertussis
ucgacgcuugccggcgau

SEQ ID NO: 2441025 - RNA, 15 nt, Bordetella pertussis
ucgacggccgccgga

SEQ ID NO: 2441026 - RNA, 17 nt, Bordetella pertussis
ucgacggcgcgcgcguu

SEQ ID NO: 2441027 - RNA, 18 nt, Bordetella pertussis
ucgacgggcaggcccagc

SEQ ID NO: 2441028 - RNA, 12 nt, Bordetella pertussis
ucgacgggcggc

SEQ ID NO: 2441029 - RNA, 16 nt, Bordetella pertussis
ucgacgggcggcugcc

SEQ ID NO: 2441030 - RNA, 14 nt, Bordetella pertussis
ucgacggugcgcgc

SEQ ID NO: 2441031 - RNA, 15 nt, Bordetella pertussis
ucgacggugcgcgcc

SEQ ID NO: 2441032 - RNA, 18 nt, Bordetella pertussis
ucgacguaagugcccagg

SEQ ID NO: 2441033 - RNA, 15 nt, Bordetella pertussis
ucgacguccagcccg

SEQ ID NO: 2441034 - RNA, 15 nt, Bordetella pertussis
ucgacguccgcccgg

SEQ ID NO: 2441035 - RNA, 16 nt, Bordetella pertussis
ucgacguugcgcgaca

SEQ ID NO: 2441036 - RNA, 14 nt, Bordetella pertussis
ucgacucggccgag

SEQ ID NO: 2441037 - RNA, 22 nt, Bordetella pertussis
ucgacuuggccugguuggccgc

SEQ ID NO: 2441038 - RNA, 18 nt, Bordetella pertussis
ucgagaccagcagcgggu

SEQ ID NO: 2441039 - RNA, 20 nt, Bordetella pertussis
ucgagagccugggcgcgcgc

SEQ ID NO: 2441040 - RNA, 16 nt, Bordetella pertussis
ucgcacacaccgcguc

SEQ ID NO: 2441041 - RNA, 18 nt, Bordetella pertussis
ucgcacacgcgcugggcg

SEQ ID NO: 2441042 - RNA, 21 nt, Bordetella pertussis
ucgcacaguucgugcaccagc

SEQ ID NO: 2441043 - RNA, 20 nt, Bordetella pertussis
ucgcacgcggcuucgcccgg

SEQ ID NO: 2441044 - RNA, 22 nt, Bordetella pertussis
ucgcacggcaauguccggggcg

SEQ ID NO: 2441045 - RNA, 21 nt, Bordetella pertussis
ucgcacggccgucaacagcau

SEQ ID NO: 2441046 - RNA, 23 nt, Bordetella pertussis
ucgcacuggguuuuuccggcucu

SEQ ID NO: 2441047 - RNA, 18 nt, Bordetella pertussis
ucgcagacgaugaagacg

SEQ ID NO: 2441048 - RNA, 15 nt, Bordetella pertussis
ucgcagcacgcccag

SEQ ID NO: 2441049 - RNA, 17 nt, Bordetella pertussis
ucgcaggccgcggccag

SEQ ID NO: 2441050 - RNA, 18 nt, Bordetella pertussis
ucgcaggccgcggccagg

SEQ ID NO: 2441051 - RNA, 13 nt, Bordetella pertussis
ucgcaggccugcu

SEQ ID NO: 2441052 - RNA, 20 nt, Bordetella pertussis
ucgcaggccugcugcagcgu

SEQ ID NO: 2441053 - RNA, 20 nt, Bordetella pertussis
ucgcagggcgcaacgccggc

SEQ ID NO: 2441054 - RNA, 15 nt, Bordetella pertussis
ucgcagucccagucc

SEQ ID NO: 2441055 - RNA, 15 nt, Bordetella pertussis
ucgcagucggggccg

SEQ ID NO: 2441056 - RNA, 14 nt, Bordetella pertussis
ucgcauaccggccg

SEQ ID NO: 2441057 - RNA, 21 nt, Bordetella pertussis
ucgcauaccggccgcgggugg

SEQ ID NO: 2441058 - RNA, 22 nt, Bordetella pertussis
ucgcauacggacgagcgcagca

SEQ ID NO: 2441059 - RNA, 15 nt, Bordetella pertussis
ucgcaucggccugca

SEQ ID NO: 2441060 - RNA, 17 nt, Bordetella pertussis
ucgcaugcgguuucuca

SEQ ID NO: 2441061 - RNA, 21 nt, Bordetella pertussis
ucgcaugcgguuucucagcgc

SEQ ID NO: 2441062 - RNA, 18 nt, Bordetella pertussis
ucgcauuucucggccugg

SEQ ID NO: 2441063 - RNA, 17 nt, Bordetella pertussis
ucgccaaagcgcagcgu

SEQ ID NO: 2441064 - RNA, 19 nt, Bordetella pertussis
ucgccaacgucggcagcca

SEQ ID NO: 2441065 - RNA, 20 nt, Bordetella pertussis
ucgccaacgucggcagccag

SEQ ID NO: 2441066 - RNA, 12 nt, Bordetella pertussis
ucgccaccgccc

SEQ ID NO: 2441067 - RNA, 14 nt, Bordetella pertussis
ucgccaccgcccag

SEQ ID NO: 2441068 - RNA, 21 nt, Bordetella pertussis
ucgccaccucgaucaccaccg

SEQ ID NO: 2441069 - RNA, 23 nt, Bordetella pertussis
ucgccagcaggcccugggcgagg

SEQ ID NO: 2441070 - RNA, 20 nt, Bordetella pertussis
ucgccagcgccggggucagc

SEQ ID NO: 2441071 - RNA, 23 nt, Bordetella pertussis
ucgccagcgccggggucagcgcc

SEQ ID NO: 2441072 - RNA, 16 nt, Bordetella pertussis
ucgccagcggcagcgc

SEQ ID NO: 2441073 - RNA, 22 nt, Bordetella pertussis
ucgccagcggcagcgcgcagga

SEQ ID NO: 2441074 - RNA, 20 nt, Bordetella pertussis
ucgccaggacguccaggccu

SEQ ID NO: 2441075 - RNA, 13 nt, Bordetella pertussis
ucgccaggcgcgu

SEQ ID NO: 2441076 - RNA, 18 nt, Bordetella pertussis
ucgccaggucggccagcc

SEQ ID NO: 2441077 - RNA, 14 nt, Bordetella pertussis
ucgccaucggccgg

SEQ ID NO: 2441078 - RNA, 13 nt, Bordetella pertussis
ucgccaucugcug

SEQ ID NO: 2441079 - RNA, 23 nt, Bordetella pertussis
ucgccaugacgcuggucgagagc

SEQ ID NO: 2441080 - RNA, 15 nt, Bordetella pertussis
ucgcccaacgaggac

SEQ ID NO: 2441081 - RNA, 22 nt, Bordetella pertussis
ucgcccagcagauaccggcaug

SEQ ID NO: 2441082 - RNA, 24 nt, Bordetella pertussis
ucgcccagcagauaccggcauggc

SEQ ID NO: 2441083 - RNA, 22 nt, Bordetella pertussis
ucgcccagcagguccugcacgc

SEQ ID NO: 2441084 - RNA, 13 nt, Bordetella pertussis
ucgcccagccgcc

SEQ ID NO: 2441085 - RNA, 17 nt, Bordetella pertussis
ucgcccagccgccugag

SEQ ID NO: 2441086 - RNA, 19 nt, Bordetella pertussis
ucgcccagcgagccggcca

SEQ ID NO: 2441087 - RNA, 20 nt, Bordetella pertussis
ucgcccagcgagccggccag

SEQ ID NO: 2441088 - RNA, 23 nt, Bordetella pertussis
ucgcccagcgagccggccagcgc

SEQ ID NO: 2441089 - RNA, 19 nt, Bordetella pertussis
ucgcccagcgcuugcacgc

SEQ ID NO: 2441090 - RNA, 23 nt, Bordetella pertussis
ucgcccagcgcuugcacgccaua

SEQ ID NO: 2441091 - RNA, 13 nt, Bordetella pertussis
ucgcccagcggcg

SEQ ID NO: 2441092 - RNA, 15 nt, Bordetella pertussis
ucgcccagcggcgcc

SEQ ID NO: 2441093 - RNA, 19 nt, Bordetella pertussis
ucgcccaggccgggcgagc

SEQ ID NO: 2441094 - RNA, 19 nt, Bordetella pertussis
ucgcccaugaucagggccg

SEQ ID NO: 2441095 - RNA, 23 nt, Bordetella pertussis
ucgcccaugaucagggccgugcc

SEQ ID NO: 2441096 - RNA, 16 nt, Bordetella pertussis
ucgcccaugcgggcgu

SEQ ID NO: 2441097 - RNA, 16 nt, Bordetella pertussis
ucgcccauugcggcgg

SEQ ID NO: 2441098 - RNA, 18 nt, Bordetella pertussis
ucgcccauugcggcgggc

SEQ ID NO: 2441099 - RNA, 19 nt, Bordetella pertussis
ucgccccccgaggccaccu

SEQ ID NO: 2441100 - RNA, 19 nt, Bordetella pertussis
ucgcccccgaaggccgcgc

SEQ ID NO: 2441101 - RNA, 20 nt, Bordetella pertussis
ucgcccccgaaggccgcgcc

SEQ ID NO: 2441102 - RNA, 18 nt, Bordetella pertussis
ucgcccccgcgccgcgca

SEQ ID NO: 2441103 - RNA, 14 nt, Bordetella pertussis
ucgccccggcgcgc

SEQ ID NO: 2441104 - RNA, 15 nt, Bordetella pertussis
ucgcccgaccugcug

SEQ ID NO: 2441105 - RNA, 21 nt, Bordetella pertussis
ucgcccgaccugcuggcgcgc

SEQ ID NO: 2441106 - RNA, 22 nt, Bordetella pertussis
ucgcccgaccugcuggcgcgca

SEQ ID NO: 2441107 - RNA, 19 nt, Bordetella pertussis
ucgcccgaucggccggccg

SEQ ID NO: 2441108 - RNA, 20 nt, Bordetella pertussis
ucgcccgcauagacgccgac

SEQ ID NO: 2441109 - RNA, 21 nt, Bordetella pertussis
ucgcccgcauagacgccgacc

SEQ ID NO: 2441110 - RNA, 24 nt, Bordetella pertussis
ucgcccgcccacauggcggcgaac

SEQ ID NO: 2441111 - RNA, 22 nt, Bordetella pertussis
ucgcccgcgcgguauugcgcca

SEQ ID NO: 2441112 - RNA, 14 nt, Bordetella pertussis
ucgcccgcgugcgu

SEQ ID NO: 2441113 - RNA, 21 nt, Bordetella pertussis
ucgcccgcgugcgugccgacg

SEQ ID NO: 2441114 - RNA, 19 nt, Bordetella pertussis
ucgcccggauacugcacgc

SEQ ID NO: 2441115 - RNA, 13 nt, Bordetella pertussis
ucgcccggcgcca

SEQ ID NO: 2441116 - RNA, 14 nt, Bordetella pertussis
ucgcccggcuccag

SEQ ID NO: 2441117 - RNA, 17 nt, Bordetella pertussis
ucgcccggcuccaggcc

SEQ ID NO: 2441118 - RNA, 14 nt, Bordetella pertussis
ucgcccgggcgccg

SEQ ID NO: 2441119 - RNA, 14 nt, Bordetella pertussis
ucgcccggggcggc

SEQ ID NO: 2441120 - RNA, 16 nt, Bordetella pertussis
ucgcccggggcggcgu

SEQ ID NO: 2441121 - RNA, 14 nt, Bordetella pertussis
ucgcccgugcgcgg

SEQ ID NO: 2441122 - RNA, 15 nt, Bordetella pertussis
ucgcccucgcgccac

SEQ ID NO: 2441123 - RNA, 13 nt, Bordetella pertussis
ucgcccugcuggc

SEQ ID NO: 2441124 - RNA, 14 nt, Bordetella pertussis
ucgcccugcuggcg

SEQ ID NO: 2441125 - RNA, 16 nt, Bordetella pertussis
ucgcccugcuggcgca

SEQ ID NO: 2441126 - RNA, 17 nt, Bordetella pertussis
ucgcccugcuggcgcag

SEQ ID NO: 2441127 - RNA, 12 nt, Bordetella pertussis
ucgcccuggcgc

SEQ ID NO: 2441128 - RNA, 13 nt, Bordetella pertussis
ucgcccuggcgca

SEQ ID NO: 2441129 - RNA, 18 nt, Bordetella pertussis
ucgcccuugcggcgaggc

SEQ ID NO: 2441130 - RNA, 16 nt, Bordetella pertussis
ucgcccuuguaguggc

SEQ ID NO: 2441131 - RNA, 17 nt, Bordetella pertussis
ucgccgaacugccggcg

SEQ ID NO: 2441132 - RNA, 20 nt, Bordetella pertussis
ucgccgaagcaaugcagcgc

SEQ ID NO: 2441133 - RNA, 18 nt, Bordetella pertussis
ucgccgaagucggcgcgc

SEQ ID NO: 2441134 - RNA, 19 nt, Bordetella pertussis
ucgccgaccagcucgacgc

SEQ ID NO: 2441135 - RNA, 15 nt, Bordetella pertussis
ucgccgacccgggcg

SEQ ID NO: 2441136 - RNA, 20 nt, Bordetella pertussis
ucgccgacgaaagcggcaaa

SEQ ID NO: 2441137 - RNA, 19 nt, Bordetella pertussis
ucgccgagccgcugucgca

SEQ ID NO: 2441138 - RNA, 21 nt, Bordetella pertussis
ucgccgaucgagcaggccgcc

SEQ ID NO: 2441139 - RNA, 21 nt, Bordetella pertussis
ucgccgaucggcuugccgcgc

SEQ ID NO: 2441140 - RNA, 21 nt, Bordetella pertussis
ucgccgaugaccagcagcgcc

SEQ ID NO: 2441141 - RNA, 16 nt, Bordetella pertussis
ucgccgcaccaggccg

SEQ ID NO: 2441142 - RNA, 15 nt, Bordetella pertussis
ucgccgcagccguug

SEQ ID NO: 2441143 - RNA, 16 nt, Bordetella pertussis
ucgccgcaggcgugcc

SEQ ID NO: 2441144 - RNA, 14 nt, Bordetella pertussis
ucgccgcaguucca

SEQ ID NO: 2441145 - RNA, 18 nt, Bordetella pertussis
ucgccgcaguuccaggca

SEQ ID NO: 2441146 - RNA, 20 nt, Bordetella pertussis
ucgccgcaugggcgcgcccg

SEQ ID NO: 2441147 - RNA, 21 nt, Bordetella pertussis
ucgccgcaugggcgcgcccgg

SEQ ID NO: 2441148 - RNA, 19 nt, Bordetella pertussis
ucgccgccacgugcacgau

SEQ ID NO: 2441149 - RNA, 23 nt, Bordetella pertussis
ucgccgccagcuuggugcucagu

SEQ ID NO: 2441150 - RNA, 15 nt, Bordetella pertussis
ucgccgcccacggcg

SEQ ID NO: 2441151 - RNA, 14 nt, Bordetella pertussis
ucgccgcccagccg

SEQ ID NO: 2441152 - RNA, 17 nt, Bordetella pertussis
ucgcgcaccgccugcgg

SEQ ID NO: 2441153 - RNA, 16 nt, Bordetella pertussis
ucgcgcacggugcgca

SEQ ID NO: 2441154 - RNA, 22 nt, Bordetella pertussis
ucgcgcacggugcgcacgaugg

SEQ ID NO: 2441155 - RNA, 19 nt, Bordetella pertussis
ucgcgcacuuguggaccgc

SEQ ID NO: 2441156 - RNA, 14 nt, Bordetella pertussis
ucgcgcagcaccgc

SEQ ID NO: 2441157 - RNA, 22 nt, Bordetella pertussis
ucgcgcagcaccgccagcgcgu

SEQ ID NO: 2441158 - RNA, 14 nt, Bordetella pertussis
ucgcgcagcacgau

SEQ ID NO: 2441159 - RNA, 21 nt, Bordetella pertussis
ucgcgcagcacgauggggcca

SEQ ID NO: 2441160 - RNA, 15 nt, Bordetella pertussis
ucgcgcagcagcuug

SEQ ID NO: 2441161 - RNA, 13 nt, Bordetella pertussis
ucgcgcagcaggc

SEQ ID NO: 2441162 - RNA, 14 nt, Bordetella pertussis
ucgcgcagcaggcc

SEQ ID NO: 2441163 - RNA, 15 nt, Bordetella pertussis
ucgcgcagcaggccg

SEQ ID NO: 2441164 - RNA, 15 nt, Bordetella pertussis
ucgcgcagcagggcc

SEQ ID NO: 2441165 - RNA, 17 nt, Bordetella pertussis
ucgcgcagcagggccug

SEQ ID NO: 2441166 - RNA, 19 nt, Bordetella pertussis
ucgcgcagccacagcgcgu

SEQ ID NO: 2441167 - RNA, 21 nt, Bordetella pertussis
ucgcgcagccacagcgcgugg

SEQ ID NO: 2441168 - RNA, 13 nt, Bordetella pertussis
ucgcgcagcgagu

SEQ ID NO: 2441169 - RNA, 13 nt, Bordetella pertussis
ucgcgcagcgccg

SEQ ID NO: 2441170 - RNA, 14 nt, Bordetella pertussis
ucgcgcagcgccug

SEQ ID NO: 2441171 - RNA, 15 nt, Bordetella pertussis
ucgcgcagcgccugg

SEQ ID NO: 2441172 - RNA, 21 nt, Bordetella pertussis
ucgcgcagcgccuggccgagc

SEQ ID NO: 2441173 - RNA, 15 nt, Bordetella pertussis
ucgcgcagcggcgcg

SEQ ID NO: 2441174 - RNA, 15 nt, Bordetella pertussis
ucgcgcaugcagcga

SEQ ID NO: 2441175 - RNA, 18 nt, Bordetella pertussis
ucgcgcaugcagcgagcg

SEQ ID NO: 2441176 - RNA, 13 nt, Bordetella pertussis
ucgcgccaccaug

SEQ ID NO: 2441177 - RNA, 22 nt, Bordetella pertussis
ucgcgccacggcuucgcccagc

SEQ ID NO: 2441178 - RNA, 15 nt, Bordetella pertussis
ucgcgccagcgccgc

SEQ ID NO: 2441179 - RNA, 17 nt, Bordetella pertussis
ucgcgccagcgccgcgc

SEQ ID NO: 2441180 - RNA, 18 nt, Bordetella pertussis
ucgcgccagcgccgcgcg

SEQ ID NO: 2441181 - RNA, 24 nt, Bordetella pertussis
ucgcgccagcgccgcgcgcgugcc

SEQ ID NO: 2441182 - RNA, 15 nt, Bordetella pertussis
ucgcgccagcggccg

SEQ ID NO: 2441183 - RNA, 16 nt, Bordetella pertussis
ucgcgccagcggccgu

SEQ ID NO: 2441184 - RNA, 13 nt, Bordetella pertussis
ucgcgccaggccg

SEQ ID NO: 2441185 - RNA, 20 nt, Bordetella pertussis
ucgcgccaggcgccgggccg

SEQ ID NO: 2441186 - RNA, 15 nt, Bordetella pertussis
ucgcgcccagcgagc

SEQ ID NO: 2441187 - RNA, 13 nt, Bordetella pertussis
ucgcgcccaucuc

SEQ ID NO: 2441188 - RNA, 18 nt, Bordetella pertussis
ucgcgcccaucucggccg

SEQ ID NO: 2441189 - RNA, 22 nt, Bordetella pertussis
ucgcgcccaucucggccgcggc

SEQ ID NO: 2441190 - RNA, 14 nt, Bordetella pertussis
ucgcgcccgagcgc

SEQ ID NO: 2441191 - RNA, 19 nt, Bordetella pertussis
ucgcgccgcgaugcacgga

SEQ ID NO: 2441192 - RNA, 22 nt, Bordetella pertussis
ucgcgccgcgucuucggcgcgg

SEQ ID NO: 2441193 - RNA, 14 nt, Bordetella pertussis
ucgcgccggccgac

SEQ ID NO: 2441194 - RNA, 16 nt, Bordetella pertussis
ucgcgccggccgacgg

SEQ ID NO: 2441195 - RNA, 23 nt, Bordetella pertussis
ucgcgccggccgacggcgcuggc

SEQ ID NO: 2441196 - RNA, 14 nt, Bordetella pertussis
ucgcgccggccugg

SEQ ID NO: 2441197 - RNA, 19 nt, Bordetella pertussis
ucgcgccggccugggcggc

SEQ ID NO: 2441198 - RNA, 18 nt, Bordetella pertussis
ucgcgccggucacgcugg

SEQ ID NO: 2441199 - RNA, 23 nt, Bordetella pertussis
ucgcgccggucacgcugguggcc

SEQ ID NO: 2441200 - RNA, 19 nt, Bordetella pertussis
ucgcgccuaccggcgccga

SEQ ID NO: 2441201 - RNA, 20 nt, Bordetella pertussis
ucgcgccuaccggcgccgac

SEQ ID NO: 2441202 - RNA, 14 nt, Bordetella pertussis
ucgcgccugcccgc

SEQ ID NO: 2441203 - RNA, 20 nt, Bordetella pertussis
ucgcgccugcccgcaacgcc

SEQ ID NO: 2441204 - RNA, 21 nt, Bordetella pertussis
ucgcgcgacgugucggccacc

SEQ ID NO: 2441205 - RNA, 16 nt, Bordetella pertussis
ucgcgcgacuggccca

SEQ ID NO: 2441206 - RNA, 19 nt, Bordetella pertussis
ucgcgcgagaauggcgcga

SEQ ID NO: 2441207 - RNA, 20 nt, Bordetella pertussis
ucgcgcgagaauggcgcgau

SEQ ID NO: 2441208 - RNA, 15 nt, Bordetella pertussis
ucgcgcgagaccagc

SEQ ID NO: 2441209 - RNA, 17 nt, Bordetella pertussis
ucgcgcgagaccagcgg

SEQ ID NO: 2441210 - RNA, 22 nt, Bordetella pertussis
ucgcgcgauguucaggccggcc

SEQ ID NO: 2441211 - RNA, 16 nt, Bordetella pertussis
ucgcgcgcaucgccga

SEQ ID NO: 2441212 - RNA, 11 nt, Bordetella pertussis
ucgcgcgccac

SEQ ID NO: 2441213 - RNA, 16 nt, Bordetella pertussis
ucgcgcgccagcgcgg

SEQ ID NO: 2441214 - RNA, 21 nt, Bordetella pertussis
ucgcgcgccaggugcacggug

SEQ ID NO: 2441215 - RNA, 14 nt, Bordetella pertussis
ucgcgcgccgccgc

SEQ ID NO: 2441216 - RNA, 18 nt, Bordetella pertussis
ucgcgcgccggcagggcg

SEQ ID NO: 2441217 - RNA, 19 nt, Bordetella pertussis
ucgcgcgccugcgcgccgc

SEQ ID NO: 2441218 - RNA, 14 nt, Bordetella pertussis
ucgcgcgcgccggc

SEQ ID NO: 2441219 - RNA, 15 nt, Bordetella pertussis
ucgcgcgcgcggauc

SEQ ID NO: 2441220 - RNA, 19 nt, Bordetella pertussis
ucgcgcgcgcggauccagc

SEQ ID NO: 2441221 - RNA, 15 nt, Bordetella pertussis
ucgcgcgcgcgggcg

SEQ ID NO: 2441222 - RNA, 19 nt, Bordetella pertussis
ucgcgcgcgcgggcgcgca

SEQ ID NO: 2441223 - RNA, 22 nt, Bordetella pertussis
ucgcgcgcgcgguccaugguga

SEQ ID NO: 2441224 - RNA, 15 nt, Bordetella pertussis
ucgcgcgcgcucagg

SEQ ID NO: 2441225 - RNA, 21 nt, Bordetella pertussis
ucgcgcgcgcucagggggcgc

SEQ ID NO: 2441226 - RNA, 13 nt, Bordetella pertussis
ucgcgcgcggggu

SEQ ID NO: 2441227 - RNA, 21 nt, Bordetella pertussis
ucgcgcgcgugcucgcgcaac

SEQ ID NO: 2441228 - RNA, 17 nt, Bordetella pertussis
ucgcgcggauccuugac

SEQ ID NO: 2441229 - RNA, 13 nt, Bordetella pertussis
ucgcgcggccggu

SEQ ID NO: 2441230 - RNA, 21 nt, Bordetella pertussis
ucgcgcggcgacacccccagg

SEQ ID NO: 2441231 - RNA, 15 nt, Bordetella pertussis
ucgcgcgugcaggcc

SEQ ID NO: 2441232 - RNA, 16 nt, Bordetella pertussis
ucgcgcgugcaggccg

SEQ ID NO: 2441233 - RNA, 14 nt, Bordetella pertussis
ucgcgcucgagcgc

SEQ ID NO: 2441234 - RNA, 18 nt, Bordetella pertussis
ucgcgcucgagcgcggcg

SEQ ID NO: 2441235 - RNA, 14 nt, Bordetella pertussis
ucgcgcucgcccgg

SEQ ID NO: 2441236 - RNA, 17 nt, Bordetella pertussis
ucgcgcucgcccggcca

SEQ ID NO: 2441237 - RNA, 18 nt, Bordetella pertussis
ucgcgcucgcccggccac

SEQ ID NO: 2441238 - RNA, 17 nt, Bordetella pertussis
ucgcgcucgcgcucggc

SEQ ID NO: 2441239 - RNA, 19 nt, Bordetella pertussis
ucgcgcucgcgcucggcca

SEQ ID NO: 2441240 - RNA, 15 nt, Bordetella pertussis
ucgcgcucggccagc

SEQ ID NO: 2441241 - RNA, 17 nt, Bordetella pertussis
ucgcgcucggccagcau

SEQ ID NO: 2441242 - RNA, 20 nt, Bordetella pertussis
ucgcgcugcaauugcgcggc

SEQ ID NO: 2441243 - RNA, 22 nt, Bordetella pertussis
ucgcgcugcaggaucgcggcca

SEQ ID NO: 2441244 - RNA, 13 nt, Bordetella pertussis
ucgcgcugcgcgc

SEQ ID NO: 2441245 - RNA, 15 nt, Bordetella pertussis
ucgcgcugcgcgccg

SEQ ID NO: 2441246 - RNA, 19 nt, Bordetella pertussis
ucgcgcugcgcgccgccgc

SEQ ID NO: 2441247 - RNA, 23 nt, Bordetella pertussis
ucgcgcugcgcgccgccgcgcug

SEQ ID NO: 2441248 - RNA, 13 nt, Bordetella pertussis
ucgcgcuggcccc

SEQ ID NO: 2441249 - RNA, 14 nt, Bordetella pertussis
ucgcgcuggcccca

SEQ ID NO: 2441250 - RNA, 18 nt, Bordetella pertussis
ucgcgcuggcccgcgcga

SEQ ID NO: 2441251 - RNA, 13 nt, Bordetella pertussis
ucgcgcuggcgcg

SEQ ID NO: 2441252 - RNA, 14 nt, Bordetella pertussis
ucgcgcuggcgcgc

SEQ ID NO: 2441253 - RNA, 16 nt, Bordetella pertussis
ucgcgcuguuccagcc

SEQ ID NO: 2441254 - RNA, 18 nt, Bordetella pertussis
ucgcgcuguuccagccag

SEQ ID NO: 2441255 - RNA, 15 nt, Bordetella pertussis
ucgcgcuucuugucc

SEQ ID NO: 2441256 - RNA, 21 nt, Bordetella pertussis
ucgcgcuucuuguccuugaac

SEQ ID NO: 2441257 - RNA, 15 nt, Bordetella pertussis
ucgcgcuugcggccg

SEQ ID NO: 2441258 - RNA, 17 nt, Bordetella pertussis
ucgcgcuugcggccguc

SEQ ID NO: 2441259 - RNA, 17 nt, Bordetella pertussis
ucgcggaaauccgggcg

SEQ ID NO: 2441260 - RNA, 21 nt, Bordetella pertussis
ucgcggaaauccgggcgcugc

SEQ ID NO: 2441261 - RNA, 14 nt, Bordetella pertussis
ucgcggaugcgcgc

SEQ ID NO: 2441262 - RNA, 21 nt, Bordetella pertussis
ucgcggcacgaaaagccgcgg

SEQ ID NO: 2441263 - RNA, 22 nt, Bordetella pertussis
ucgcggcacgaaaagccgcggc

SEQ ID NO: 2441264 - RNA, 15 nt, Bordetella pertussis
ucgcggcagcccggc

SEQ ID NO: 2441265 - RNA, 15 nt, Bordetella pertussis
ucggcaggccggcgc

SEQ ID NO: 2441266 - RNA, 15 nt, Bordetella pertussis
ucggcaggcgccggc

SEQ ID NO: 2441267 - RNA, 18 nt, Bordetella pertussis
ucggcauccagcucggcg

SEQ ID NO: 2441268 - RNA, 16 nt, Bordetella pertussis
ucggcaucggccacgc

SEQ ID NO: 2441269 - RNA, 15 nt, Bordetella pertussis
ucggcauggccagga

SEQ ID NO: 2441270 - RNA, 20 nt, Bordetella pertussis
ucggcauggccaggaagaac

SEQ ID NO: 2441271 - RNA, 14 nt, Bordetella pertussis
ucggcauggccauc

SEQ ID NO: 2441272 - RNA, 15 nt, Bordetella pertussis
ucggcauggcgcgcg

SEQ ID NO: 2441273 - RNA, 16 nt, Bordetella pertussis
ucggccaacggcuggc

SEQ ID NO: 2441274 - RNA, 18 nt, Bordetella pertussis
ucggccaacggcuggcug

SEQ ID NO: 2441275 - RNA, 21 nt, Bordetella pertussis
ucggccaaggcauuggcgccg

SEQ ID NO: 2441276 - RNA, 17 nt, Bordetella pertussis
ucggccaaggccggcgc

SEQ ID NO: 2441277 - RNA, 19 nt, Bordetella pertussis
ucggccaaggccggcgcgu

SEQ ID NO: 2441278 - RNA, 17 nt, Bordetella pertussis
ucggccaaucggccugc

SEQ ID NO: 2441279 - RNA, 14 nt, Bordetella pertussis
ucggccaccaggcc

SEQ ID NO: 2441280 - RNA, 15 nt, Bordetella pertussis
ucggccacccggccc

SEQ ID NO: 2441281 - RNA, 14 nt, Bordetella pertussis
ucggccaccugguc

SEQ ID NO: 2441282 - RNA, 18 nt, Bordetella pertussis
ucggccacgcgcaacgcc

SEQ ID NO: 2441283 - RNA, 15 nt, Bordetella pertussis
ucggccacgcgcugc

SEQ ID NO: 2441284 - RNA, 16 nt, Bordetella pertussis
ucggccacgcugcccu

SEQ ID NO: 2441285 - RNA, 20 nt, Bordetella pertussis
ucggccacgcugcccugcug

SEQ ID NO: 2441286 - RNA, 15 nt, Bordetella pertussis
ucggccacggucggc

SEQ ID NO: 2441287 - RNA, 18 nt, Bordetella pertussis
ucggccacgucggcggcc

SEQ ID NO: 2441288 - RNA, 20 nt, Bordetella pertussis
ucggccacuuucgcgcgcgc

SEQ ID NO: 2441289 - RNA, 21 nt, Bordetella pertussis
ucggccacuuucgcgcgcgcc

SEQ ID NO: 2441290 - RNA, 23 nt, Bordetella pertussis
ucggccagcacgucauccugggc

SEQ ID NO: 2441291 - RNA, 13 nt, Bordetella pertussis
ucggccagcagcg

SEQ ID NO: 2441292 - RNA, 15 nt, Bordetella pertussis
ucggccagcagcuug

SEQ ID NO: 2441293 - RNA, 15 nt, Bordetella pertussis
ucggccagcaguguu

SEQ ID NO: 2441294 - RNA, 17 nt, Bordetella pertussis
ucggccagccccaccuu

SEQ ID NO: 2441295 - RNA, 13 nt, Bordetella pertussis
ucggccagccggc

SEQ ID NO: 2441296 - RNA, 16 nt, Bordetella pertussis
ucggccagcgaggccg

SEQ ID NO: 2441297 - RNA, 16 nt, Bordetella pertussis
ucggccagcgccgaaa

SEQ ID NO: 2441298 - RNA, 13 nt, Bordetella pertussis
ucggccagcgcgc

SEQ ID NO: 2441299 - RNA, 17 nt, Bordetella pertussis
ucggccagcgcgcggcc

SEQ ID NO: 2441300 - RNA, 23 nt, Bordetella pertussis
ucggccagcgcgcggcgcagcgc

SEQ ID NO: 2441301 - RNA, 21 nt, Bordetella pertussis
ucggccagcgcgcggggcagg

SEQ ID NO: 2441302 - RNA, 16 nt, Bordetella pertussis
ucggccagcggcaggc

SEQ ID NO: 2441303 - RNA, 14 nt, Bordetella pertussis
ucggccagcgugcc

SEQ ID NO: 2441304 - RNA, 20 nt, Bordetella pertussis
ucggccagcgugccggugac

SEQ ID NO: 2441305 - RNA, 15 nt, Bordetella pertussis
ucggccagcuugccg

SEQ ID NO: 2441306 - RNA, 10 nt, Bordetella pertussis
ucggccagga

SEQ ID NO: 2441307 - RNA, 19 nt, Bordetella pertussis
ucggccaggaaagccggcg

SEQ ID NO: 2441308 - RNA, 23 nt, Bordetella pertussis
ucggccaggacggugucgcugac

SEQ ID NO: 2441309 - RNA, 21 nt, Bordetella pertussis
ucggccaggccauggcgcgau

SEQ ID NO: 2441310 - RNA, 20 nt, Bordetella pertussis
ucggccaggccgaugaauug

SEQ ID NO: 2441311 - RNA, 19 nt, Bordetella pertussis
ucggccaggccggccugca

SEQ ID NO: 2441312 - RNA, 17 nt, Bordetella pertussis
ucggccaggcgccagau

SEQ ID NO: 2441313 - RNA, 17 nt, Bordetella pertussis
ucggccaggcgccugag

SEQ ID NO: 2441314 - RNA, 17 nt, Bordetella pertussis
ucggccagggaggcgau

SEQ ID NO: 2441315 - RNA, 15 nt, Bordetella pertussis
ucggccaggugcgcc

SEQ ID NO: 2441316 - RNA, 13 nt, Bordetella pertussis
ucggccauggugc

SEQ ID NO: 2441317 - RNA, 20 nt, Bordetella pertussis
ucggccauggugccccaugc

SEQ ID NO: 2441318 - RNA, 19 nt, Bordetella pertussis
ucggcccacuggaucgccg

SEQ ID NO: 2441319 - RNA, 18 nt, Bordetella pertussis
ucggcccgcgccagcgcc

SEQ ID NO: 2441320 - RNA, 15 nt, Bordetella pertussis
ucggccgaaccgcgc

SEQ ID NO: 2441321 - RNA, 18 nt, Bordetella pertussis
ucggccgaaccgcgcagc

SEQ ID NO: 2441322 - RNA, 23 nt, Bordetella pertussis
ucggccgacucgaaacgggcggc

SEQ ID NO: 2441323 - RNA, 17 nt, Bordetella pertussis
ucggccgcauggcggcc

SEQ ID NO: 2441324 - RNA, 16 nt, Bordetella pertussis
ucggccgccagccggc

SEQ ID NO: 2441325 - RNA, 21 nt, Bordetella pertussis
ucggccgccagccggcccagc

SEQ ID NO: 2441326 - RNA, 23 nt, Bordetella pertussis
ucggccgccagguagcggguggc

SEQ ID NO: 2441327 - RNA, 20 nt, Bordetella pertussis
ucggccgccaggucggccac

SEQ ID NO: 2441328 - RNA, 22 nt, Bordetella pertussis
ucggccgccgccgugacgcuga

SEQ ID NO: 2441329 - RNA, 12 nt, Bordetella pertussis
ucggccgccggc

SEQ ID NO: 2441330 - RNA, 13 nt, Bordetella pertussis
ucggccgccggcg

SEQ ID NO: 2441331 - RNA, 16 nt, Bordetella pertussis
ucggccgccggcgaga

SEQ ID NO: 2441332 - RNA, 11 nt, Bordetella pertussis
ucggccgcgcc

SEQ ID NO: 2441333 - RNA, 14 nt, Bordetella pertussis
ucggccgcgcccag

SEQ ID NO: 2441334 - RNA, 18 nt, Bordetella pertussis
ucggccgcgcccaggucc

SEQ ID NO: 2441335 - RNA, 13 nt, Bordetella pertussis
ucggccgcgccgc

SEQ ID NO: 2441336 - RNA, 22 nt, Bordetella pertussis
ucggccggaugcgcaggacggc

SEQ ID NO: 2441337 - RNA, 23 nt, Bordetella pertussis
ucggccggaugcgcaggacggcg

SEQ ID NO: 2441338 - RNA, 11 nt, Bordetella pertussis
ucggccggcaa

SEQ ID NO: 2441339 - RNA, 14 nt, Bordetella pertussis
ucggccggcagcgc

SEQ ID NO: 2441340 - RNA, 15 nt, Bordetella pertussis
ucggccggcagcggc

SEQ ID NO: 2441341 - RNA, 19 nt, Bordetella pertussis
ucggccggcagcggcgcca

SEQ ID NO: 2441342 - RNA, 17 nt, Bordetella pertussis
ucggccggcggucgcgc

SEQ ID NO: 2441343 - RNA, 12 nt, Bordetella pertussis
ucggccgggccg

SEQ ID NO: 2441344 - RNA, 17 nt, Bordetella pertussis
ucggccgggccgggcac

SEQ ID NO: 2441345 - RNA, 20 nt, Bordetella pertussis
ucggccgucagcagcaggcu

SEQ ID NO: 2441346 - RNA, 13 nt, Bordetella pertussis
ucggccgucuggg

SEQ ID NO: 2441347 - RNA, 16 nt, Bordetella pertussis
ucggccgucugggcgu

SEQ ID NO: 2441348 - RNA, 20 nt, Bordetella pertussis
ucggccucaucgagcgccug

SEQ ID NO: 2441349 - RNA, 22 nt, Bordetella pertussis
ucggccucaucgagcgccuggg

SEQ ID NO: 2441350 - RNA, 21 nt, Bordetella pertussis
ucggccucccgucgucgucca

SEQ ID NO: 2441351 - RNA, 13 nt, Bordetella pertussis
ucggccucgccca

SEQ ID NO: 2441352 - RNA, 17 nt, Bordetella pertussis
ucggccucgcgcagggc

SEQ ID NO: 2441353 - RNA, 19 nt, Bordetella pertussis
ucggccucgcggcgcagca

SEQ ID NO: 2441354 - RNA, 18 nt, Bordetella pertussis
ucggccucgcuggcgaag

SEQ ID NO: 2441355 - RNA, 14 nt, Bordetella pertussis
ucggccugcacgcu

SEQ ID NO: 2441356 - RNA, 14 nt, Bordetella pertussis
ucggccugcaggcc

SEQ ID NO: 2441357 - RNA, 18 nt, Bordetella pertussis
ucggccugccaccagcgc

SEQ ID NO: 2441358 - RNA, 22 nt, Bordetella pertussis
ucggccugccaccagcgcgcca

SEQ ID NO: 2441359 - RNA, 23 nt, Bordetella pertussis
ucggccugccaccagcgcgccag

SEQ ID NO: 2441360 - RNA, 22 nt, Bordetella pertussis
ucggccugcccguucacgcgca

SEQ ID NO: 2441361 - RNA, 13 nt, Bordetella pertussis
ucggccugccggc

SEQ ID NO: 2441362 - RNA, 15 nt, Bordetella pertussis
ucggccugccggcgc

SEQ ID NO: 2441363 - RNA, 17 nt, Bordetella pertussis
ucggccugccggcgcgc

SEQ ID NO: 2441364 - RNA, 21 nt, Bordetella pertussis
ucggccugcggcucgaggaac

SEQ ID NO: 2441365 - RNA, 18 nt, Bordetella pertussis
ucggccugcucgcaggcc

SEQ ID NO: 2441366 - RNA, 18 nt, Bordetella pertussis
ucggccugcuggugcagc

SEQ ID NO: 2441367 - RNA, 21 nt, Bordetella pertussis
ucggccuggaacauggcccgg

SEQ ID NO: 2441368 - RNA, 13 nt, Bordetella pertussis
ucggccuggcccc

SEQ ID NO: 2441369 - RNA, 13 nt, Bordetella pertussis
ucggccugggcgc

SEQ ID NO: 2441370 - RNA, 23 nt, Bordetella pertussis
ucggccuugccguuggucuuggg

SEQ ID NO: 2441371 - RNA, 19 nt, Bordetella pertussis
ucggcgaagccgcagcggc

SEQ ID NO: 2441372 - RNA, 22 nt, Bordetella pertussis
ucggcgaagccgcagcggcagc

SEQ ID NO: 2441373 - RNA, 22 nt, Bordetella pertussis
ucggcgaagccuugcgcggcca

SEQ ID NO: 2441374 - RNA, 22 nt, Bordetella pertussis
ucggcgaccaggugcgggccgc

SEQ ID NO: 2441375 - RNA, 19 nt, Bordetella pertussis
ucggcgaccgccggccggu

SEQ ID NO: 2441376 - RNA, 19 nt, Bordetella pertussis
ucggcgaccgugcgccaac

SEQ ID NO: 2441377 - RNA, 17 nt, Bordetella pertussis
ucggcgacuucggcggc

SEQ ID NO: 2441378 - RNA, 12 nt, Bordetella pertussis
ucgggcagcgcc

SEQ ID NO: 2441379 - RNA, 15 nt, Bordetella pertussis
ucgggcagcgcggcg

SEQ ID NO: 2441380 - RNA, 19 nt, Bordetella pertussis
ucgggcagcuuggcgcgcc

SEQ ID NO: 2441381 - RNA, 17 nt, Bordetella pertussis
ucgggcaggauggccau

SEQ ID NO: 2441382 - RNA, 21 nt, Bordetella pertussis
ucgggcagggcgacgucccag

SEQ ID NO: 2441383 - RNA, 22 nt, Bordetella pertussis
ucgggcagggugggcacgcgcu

SEQ ID NO: 2441384 - RNA, 18 nt, Bordetella pertussis
ucgggcaggucggccagc

SEQ ID NO: 2441385 - RNA, 16 nt, Bordetella pertussis
ucgggcaggucggcgc

SEQ ID NO: 2441386 - RNA, 14 nt, Bordetella pertussis
ucgggcaugucgcg

SEQ ID NO: 2441387 - RNA, 21 nt, Bordetella pertussis
ucgggcaugucgcggcccacg

SEQ ID NO: 2441388 - RNA, 18 nt, Bordetella pertussis
ucgggccggcggcagccg

SEQ ID NO: 2441389 - RNA, 16 nt, Bordetella pertussis
ucgggcgacaggcgcg

SEQ ID NO: 2441390 - RNA, 21 nt, Bordetella pertussis
ucgggcgaggucagcccggcg

SEQ ID NO: 2441391 - RNA, 22 nt, Bordetella pertussis
ucgggcgcaacgucgaacagcu

SEQ ID NO: 2441392 - RNA, 13 nt, Bordetella pertussis
ucgggcgcggcau

SEQ ID NO: 2441393 - RNA, 15 nt, Bordetella pertussis
ucgggcgcggugcgc

SEQ ID NO: 2441394 - RNA, 12 nt, Bordetella pertussis
ucgggcggcgcc

SEQ ID NO: 2441395 - RNA, 14 nt, Bordetella pertussis
ucgggcgucaugcg

SEQ ID NO: 2441396 - RNA, 16 nt, Bordetella pertussis
ucgggcucgcgcgcgc

SEQ ID NO: 2441397 - RNA, 17 nt, Bordetella pertussis
ucgggcugcggcuccug

SEQ ID NO: 2441398 - RNA, 17 nt, Bordetella pertussis
ucggggaaauugacggc

SEQ ID NO: 2441399 - RNA, 18 nt, Bordetella pertussis
ucggggaaauugacggcg

SEQ ID NO: 2441400 - RNA, 20 nt, Bordetella pertussis
ucggggcaacgacgcaggcg

SEQ ID NO: 2441401 - RNA, 17 nt, Bordetella pertussis
ucggggccgcagcugga

SEQ ID NO: 2441402 - RNA, 17 nt, Bordetella pertussis
ucggggccgggccggcg

SEQ ID NO: 2441403 - RNA, 19 nt, Bordetella pertussis
ucggggcgcaagaucugga

SEQ ID NO: 2441404 - RNA, 20 nt, Bordetella pertussis
ucggggcgcucgagcgccug

SEQ ID NO: 2441405 - RNA, 13 nt, Bordetella pertussis
ucggggugcagcu

SEQ ID NO: 2441406 - RNA, 14 nt, Bordetella pertussis
ucgggguggcgccg

SEQ ID NO: 2441407 - RNA, 16 nt, Bordetella pertussis
ucggguccagcacgcc

SEQ ID NO: 2441408 - RNA, 16 nt, Bordetella pertussis
ucggguuucuugcugc

SEQ ID NO: 2441409 - RNA, 17 nt, Bordetella pertussis
ucgguaaugagcccgau

SEQ ID NO: 2441410 - RNA, 16 nt, Bordetella pertussis
ucgguaucgggcaaca

SEQ ID NO: 2441411 - RNA, 14 nt, Bordetella pertussis
ucggucagcacuug

SEQ ID NO: 2441412 - RNA, 16 nt, Bordetella pertussis
ucggucagcugcuguu

SEQ ID NO: 2441413 - RNA, 21 nt, Bordetella pertussis
ucggucagggcgaagcgcgcc

SEQ ID NO: 2441414 - RNA, 17 nt, Bordetella pertussis
ucggucauguccagcgc

SEQ ID NO: 2441415 - RNA, 18 nt, Bordetella pertussis
ucggucauguccagcgcc

SEQ ID NO: 2441416 - RNA, 20 nt, Bordetella pertussis
ucggucauguccagcgccag

SEQ ID NO: 2441417 - RNA, 17 nt, Bordetella pertussis
ucggucgcuuccagcgc

SEQ ID NO: 2441418 - RNA, 22 nt, Bordetella pertussis
ucggucggcuugauaugggcga

SEQ ID NO: 2441419 - RNA, 17 nt, Bordetella pertussis
ucggucucgcgcggccg

SEQ ID NO: 2441420 - RNA, 16 nt, Bordetella pertussis
ucggugaaggccacgc

SEQ ID NO: 2441421 - RNA, 19 nt, Bordetella pertussis
ucggugaugauggccaggu

SEQ ID NO: 2441422 - RNA, 16 nt, Bordetella pertussis
ucggugaugcucugcc

SEQ ID NO: 2441423 - RNA, 22 nt, Bordetella pertussis
ucggugcaaugcccaguucguc

SEQ ID NO: 2441424 - RNA, 16 nt, Bordetella pertussis
ucggugcacacgccuu

SEQ ID NO: 2441425 - RNA, 15 nt, Bordetella pertussis
ucggugcagcccagc

SEQ ID NO: 2441426 - RNA, 20 nt, Bordetella pertussis
ucggugccguccagcgcggc

SEQ ID NO: 2441427 - RNA, 21 nt, Bordetella pertussis
ucggugccguccagcgcggcg

SEQ ID NO: 2441428 - RNA, 13 nt, Bordetella pertussis
ucggugccugucc

SEQ ID NO: 2441429 - RNA, 14 nt, Bordetella pertussis
ucggugccuguccc

SEQ ID NO: 2441430 - RNA, 16 nt, Bordetella pertussis
ucggugccuguccccg

SEQ ID NO: 2441431 - RNA, 21 nt, Bordetella pertussis
ucggugccuguucccgccggg

SEQ ID NO: 2441432 - RNA, 16 nt, Bordetella pertussis
ucggugcgcagcggca

SEQ ID NO: 2441433 - RNA, 17 nt, Bordetella pertussis
ucggugcgcagcggcag

SEQ ID NO: 2441434 - RNA, 18 nt, Bordetella pertussis
ucggugcgcagcggcagg

SEQ ID NO: 2441435 - RNA, 23 nt, Bordetella pertussis
ucggugcgccgccgccgcggccu

SEQ ID NO: 2441436 - RNA, 19 nt, Bordetella pertussis
ucggugcgcgcgcccaccg

SEQ ID NO: 2441437 - RNA, 23 nt, Bordetella pertussis
ucggugcggaucaagcggcccgc

SEQ ID NO: 2441438 - RNA, 14 nt, Bordetella pertussis
ucggugcucuggcc

SEQ ID NO: 2441439 - RNA, 17 nt, Bordetella pertussis
ucggugcucuggcccgc

SEQ ID NO: 2441440 - RNA, 12 nt, Bordetella pertussis
ucgguggccagc

SEQ ID NO: 2441441 - RNA, 14 nt, Bordetella pertussis
ucgguggccagcca

SEQ ID NO: 2441442 - RNA, 14 nt, Bordetella pertussis
ucgguggcgcgcag

SEQ ID NO: 2441443 - RNA, 13 nt, Bordetella pertussis
ucgguggggcagg

SEQ ID NO: 2441444 - RNA, 19 nt, Bordetella pertussis
ucgguggucaacggcaaga

SEQ ID NO: 2441445 - RNA, 19 nt, Bordetella pertussis
ucgguugcccgugacccgg

SEQ ID NO: 2441446 - RNA, 15 nt, Bordetella pertussis
ucguaaacaucgcgc

SEQ ID NO: 2441447 - RNA, 17 nt, Bordetella pertussis
ucguacacaugcuugcc

SEQ ID NO: 2441448 - RNA, 14 nt, Bordetella pertussis
ucguacagccugcc

SEQ ID NO: 2441449 - RNA, 15 nt, Bordetella pertussis
ucguacagcggcaau

SEQ ID NO: 2441450 - RNA, 17 nt, Bordetella pertussis
ucguacgcgugggcggc

SEQ ID NO: 2441451 - RNA, 17 nt, Bordetella pertussis
ucguagaacacgucgau

SEQ ID NO: 2441452 - RNA, 17 nt, Bordetella pertussis
ucguagcccucgcccag

SEQ ID NO: 2441453 - RNA, 14 nt, Bordetella pertussis
ucguagccgccgac

SEQ ID NO: 2441454 - RNA, 16 nt, Bordetella pertussis
ucguagccgccgacga

SEQ ID NO: 2441455 - RNA, 16 nt, Bordetella pertussis
ucguagucgagccagg

SEQ ID NO: 2441456 - RNA, 14 nt, Bordetella pertussis
ucgucagcagcacg

SEQ ID NO: 2441457 - RNA, 15 nt, Bordetella pertussis
ucgucagcagcacgc

SEQ ID NO: 2441458 - RNA, 20 nt, Bordetella pertussis
ucgucaucaccaagggcgcc

SEQ ID NO: 2441459 - RNA, 14 nt, Bordetella pertussis
ucguccacgcccgg

SEQ ID NO: 2441460 - RNA, 13 nt, Bordetella pertussis
ucguccagcacgc

SEQ ID NO: 2441461 - RNA, 19 nt, Bordetella pertussis
ucguccagcgacuccggcc

SEQ ID NO: 2441462 - RNA, 20 nt, Bordetella pertussis
ucguccagcgucaugcgcac

SEQ ID NO: 2441463 - RNA, 15 nt, Bordetella pertussis
ucguccaggcgcacc

SEQ ID NO: 2441464 - RNA, 21 nt, Bordetella pertussis
ucgucccagcgcacgcagcgc

SEQ ID NO: 2441465 - RNA, 18 nt, Bordetella pertussis
ucgucccagggggucagg

SEQ ID NO: 2441466 - RNA, 19 nt, Bordetella pertussis
ucguccccacggggacugg

SEQ ID NO: 2441467 - RNA, 23 nt, Bordetella pertussis
ucguccccacggggacuggcucc

SEQ ID NO: 2441468 - RNA, 16 nt, Bordetella pertussis
ucgucccccuacugcc

SEQ ID NO: 2441469 - RNA, 19 nt, Bordetella pertussis
ucguccgcggcccgcccgc

SEQ ID NO: 2441470 - RNA, 12 nt, Bordetella pertussis
ucguccgcuucg

SEQ ID NO: 2441471 - RNA, 15 nt, Bordetella pertussis
ucguccgcuucgucg

SEQ ID NO: 2441472 - RNA, 21 nt, Bordetella pertussis
ucguccgcuucgucgggcagc

SEQ ID NO: 2441473 - RNA, 14 nt, Bordetella pertussis
ucguccggcgcguc

SEQ ID NO: 2441474 - RNA, 21 nt, Bordetella pertussis
ucguccguccuggccacugcc

SEQ ID NO: 2441475 - RNA, 20 nt, Bordetella pertussis
ucguccguggccggcgcggc

SEQ ID NO: 2441476 - RNA, 14 nt, Bordetella pertussis
ucguccucggcacg

SEQ ID NO: 2441477 - RNA, 16 nt, Bordetella pertussis
ucguccucggccacgu

SEQ ID NO: 2441478 - RNA, 20 nt, Bordetella pertussis
ucguccucggccacgucggc

SEQ ID NO: 2441479 - RNA, 15 nt, Bordetella pertussis
ucguccucggugcug

SEQ ID NO: 2441480 - RNA, 24 nt, Bordetella pertussis
ucguccucgucggccaugcgcgcc

SEQ ID NO: 2441481 - RNA, 23 nt, Bordetella pertussis
ucguccugaucgaggagcugcug

SEQ ID NO: 2441482 - RNA, 21 nt, Bordetella pertussis
ucguccugcaggaaggccgcc

SEQ ID NO: 2441483 - RNA, 13 nt, Bordetella pertussis
ucguccugcaggc

SEQ ID NO: 2441484 - RNA, 16 nt, Bordetella pertussis
ucguccugccauugcg

SEQ ID NO: 2441485 - RNA, 22 nt, Bordetella pertussis
ucgucgaacagcaucagcuugg

SEQ ID NO: 2441486 - RNA, 19 nt, Bordetella pertussis
ucgucgaccaccagcaucg

SEQ ID NO: 2441487 - RNA, 19 nt, Bordetella pertussis
ucgucgaccacgccggcgg

SEQ ID NO: 2441488 - RNA, 24 nt, Bordetella pertussis
ucgucgagcacuucgagcgacggc

SEQ ID NO: 2441489 - RNA, 15 nt, Bordetella pertussis
ucgucgagccgggcc

SEQ ID NO: 2441490 - RNA, 19 nt, Bordetella pertussis
ucgucgagccgggccacgc

SEQ ID NO: 2441491 - RNA, 19 nt, Bordetella pertussis
ucucgaacgccgcgucgcu

SEQ ID NO: 2441492 - RNA, 21 nt, Bordetella pertussis
ucucgaagaagcagccgcgcu

SEQ ID NO: 2441493 - RNA, 18 nt, Bordetella pertussis
ucucgacccgcucggcca

SEQ ID NO: 2441494 - RNA, 13 nt, Bordetella pertussis
ucucgaugcgcgc

SEQ ID NO: 2441495 - RNA, 16 nt, Bordetella pertussis
ucucgaugcgcgccac

SEQ ID NO: 2441496 - RNA, 22 nt, Bordetella pertussis
ucucgaugcggucggccgcgcc

SEQ ID NO: 2441497 - RNA, 20 nt, Bordetella pertussis
ucucgcccaggcccagcauc

SEQ ID NO: 2441498 - RNA, 14 nt, Bordetella pertussis
ucucgcccugcucg

SEQ ID NO: 2441499 - RNA, 19 nt, Bordetella pertussis
ucucgcccugcucgcgcag

SEQ ID NO: 2441500 - RNA, 19 nt, Bordetella pertussis
ucucgcgcaggguggcauc

SEQ ID NO: 2441501 - RNA, 13 nt, Bordetella pertussis
ucucgcgcgccag

SEQ ID NO: 2441502 - RNA, 20 nt, Bordetella pertussis
ucucggcaucggccacgcug

SEQ ID NO: 2441503 - RNA, 21 nt, Bordetella pertussis
ucucggcaucggccacgcugc

SEQ ID NO: 2441504 - RNA, 23 nt, Bordetella pertussis
ucucggccacggucggcacgucg

SEQ ID NO: 2441505 - RNA, 14 nt, Bordetella pertussis
ucucggccagcagc

SEQ ID NO: 2441506 - RNA, 17 nt, Bordetella pertussis
ucucggccagcagcgcc

SEQ ID NO: 2441507 - RNA, 14 nt, Bordetella pertussis
ucucggccagcgcc

SEQ ID NO: 2441508 - RNA, 16 nt, Bordetella pertussis
ucucggccgcggcguu

SEQ ID NO: 2441509 - RNA, 19 nt, Bordetella pertussis
ucucggccucgcggcgcag

SEQ ID NO: 2441510 - RNA, 20 nt, Bordetella pertussis
ucucggcguugaccggguug

SEQ ID NO: 2441511 - RNA, 21 nt, Bordetella pertussis
ucucgggcaggucggccagcg

SEQ ID NO: 2441512 - RNA, 22 nt, Bordetella pertussis
ucucggugcgccgccgccgcgg

SEQ ID NO: 2441513 - RNA, 15 nt, Bordetella pertussis
ucucguccgauggcg

SEQ ID NO: 2441514 - RNA, 21 nt, Bordetella pertussis
ucucgucgaggaucaaggccc

SEQ ID NO: 2441515 - RNA, 22 nt, Bordetella pertussis
ucucuccauggcagcucgcuaa

SEQ ID NO: 2441516 - RNA, 13 nt, Bordetella pertussis
ucucuccgaacgc

SEQ ID NO: 2441517 - RNA, 16 nt, Bordetella pertussis
ucugagcgccggggug

SEQ ID NO: 2441518 - RNA, 12 nt, Bordetella pertussis
ucugaucaucuu

SEQ ID NO: 2441519 - RNA, 15 nt, Bordetella pertussis
ucugaucggacuggg

SEQ ID NO: 2441520 - RNA, 19 nt, Bordetella pertussis
ucugcacccccuuggcuuc

SEQ ID NO: 2441521 - RNA, 18 nt, Bordetella pertussis
ucugcaccggcgccacgg

SEQ ID NO: 2441522 - RNA, 17 nt, Bordetella pertussis
ucugcaccugcguggcc

SEQ ID NO: 2441523 - RNA, 18 nt, Bordetella pertussis
ucugcaccugcguggccu

SEQ ID NO: 2441524 - RNA, 19 nt, Bordetella pertussis
ucugcaccuugggcgccug

SEQ ID NO: 2441525 - RNA, 19 nt, Bordetella pertussis
ucugcaccuuguacugguc

SEQ ID NO: 2441526 - RNA, 23 nt, Bordetella pertussis
ucugcaccuuguacuggucgcgc

SEQ ID NO: 2441527 - RNA, 14 nt, Bordetella pertussis
ucugcacgaggcgc

SEQ ID NO: 2441528 - RNA, 18 nt, Bordetella pertussis
ucugcacgccgggcgcgc

SEQ ID NO: 2441529 - RNA, 11 nt, Bordetella pertussis
ucugcagcgcg

SEQ ID NO: 2441530 - RNA, 21 nt, Bordetella pertussis
ucugcaugccgaccaccagca

SEQ ID NO: 2441531 - RNA, 21 nt, Bordetella pertussis
ucugcauguacucggccaggc

SEQ ID NO: 2441532 - RNA, 22 nt, Bordetella pertussis
ucugcauguacucggccaggcc

SEQ ID NO: 2441533 - RNA, 13 nt, Bordetella pertussis
ucugccacaucac

SEQ ID NO: 2441534 - RNA, 17 nt, Bordetella pertussis
ucugccagacggccagc

SEQ ID NO: 2441535 - RNA, 23 nt, Bordetella pertussis
ucugccaguugaaccgcaacgcc

SEQ ID NO: 2441536 - RNA, 14 nt, Bordetella pertussis
ucugccccauggcc

SEQ ID NO: 2441537 - RNA, 20 nt, Bordetella pertussis
ucugcccgugcgugcgccug

SEQ ID NO: 2441538 - RNA, 20 nt, Bordetella pertussis
ucugcccgugcgugugccug

SEQ ID NO: 2441539 - RNA, 22 nt, Bordetella pertussis
ucugcccgugcgugugccuguc

SEQ ID NO: 2441540 - RNA, 22 nt, Bordetella pertussis
ucugccgcgcauuugccgcggc

SEQ ID NO: 2441541 - RNA, 19 nt, Bordetella pertussis
ucugccgcugaccggcggc

SEQ ID NO: 2441542 - RNA, 13 nt, Bordetella pertussis
ucugccgcugauc

SEQ ID NO: 2441543 - RNA, 15 nt, Bordetella pertussis
ucugccguuccagcu

SEQ ID NO: 2441544 - RNA, 14 nt, Bordetella pertussis
ucugcgagccguag

SEQ ID NO: 2441545 - RNA, 20 nt, Bordetella pertussis
ucugcgagccuucggccggc

SEQ ID NO: 2441546 - RNA, 19 nt, Bordetella pertussis
ucugcgcaucgaugcggcc

SEQ ID NO: 2441547 - RNA, 13 nt, Bordetella pertussis
ucugcgccgccgc

SEQ ID NO: 2441548 - RNA, 22 nt, Bordetella pertussis
ucugcgccgccgcguggcggcg

SEQ ID NO: 2441549 - RNA, 14 nt, Bordetella pertussis
ucugcgccugcugg

SEQ ID NO: 2441550 - RNA, 16 nt, Bordetella pertussis
ucugcgccugcugguc

SEQ ID NO: 2441551 - RNA, 16 nt, Bordetella pertussis
ucugcgcguucauguc

SEQ ID NO: 2441552 - RNA, 14 nt, Bordetella pertussis
ucugcgugccggag

SEQ ID NO: 2441553 - RNA, 13 nt, Bordetella pertussis
ucugcgugcgcgg

SEQ ID NO: 2441554 - RNA, 15 nt, Bordetella pertussis
ucugcgugcgcggcg

SEQ ID NO: 2441555 - RNA, 20 nt, Bordetella pertussis
ucugcgugugccgccagcgg

SEQ ID NO: 2441556 - RNA, 17 nt, Bordetella pertussis
ucugcguuuucuggccu

SEQ ID NO: 2441557 - RNA, 18 nt, Bordetella pertussis
ucugcuacaccgugcugg

SEQ ID NO: 2441558 - RNA, 20 nt, Bordetella pertussis
ucugcuacaccgugcuggcc

SEQ ID NO: 2441559 - RNA, 16 nt, Bordetella pertussis
ucugcugguacagccc

SEQ ID NO: 2441560 - RNA, 22 nt, Bordetella pertussis
ucugcuggucgcgggccaggcc

SEQ ID NO: 2441561 - RNA, 15 nt, Bordetella pertussis
ucugcuugccggccc

SEQ ID NO: 2441562 - RNA, 19 nt, Bordetella pertussis
ucuggaagauguaccagcc

SEQ ID NO: 2441563 - RNA, 17 nt, Bordetella pertussis
ucuggacuugcggcacg

SEQ ID NO: 2441564 - RNA, 16 nt, Bordetella pertussis
ucuggcacaccagcgc

SEQ ID NO: 2441565 - RNA, 17 nt, Bordetella pertussis
ucuggcacaccagcgcc

SEQ ID NO: 2441566 - RNA, 19 nt, Bordetella pertussis
ucuggcacaccagcgccag

SEQ ID NO: 2441567 - RNA, 15 nt, Bordetella pertussis
ucuggcacgcuugcc

SEQ ID NO: 2441568 - RNA, 21 nt, Bordetella pertussis
ucuggcagugcgccuggcuga

SEQ ID NO: 2441569 - RNA, 20 nt, Bordetella pertussis
ucuggcccacgcgcacgacg

SEQ ID NO: 2441570 - RNA, 12 nt, Bordetella pertussis
ucuggccgacca

SEQ ID NO: 2441571 - RNA, 18 nt, Bordetella pertussis
ucuggccggccgcguuca

SEQ ID NO: 2441572 - RNA, 21 nt, Bordetella pertussis
ucuggccggccgcguucagca

SEQ ID NO: 2441573 - RNA, 23 nt, Bordetella pertussis
ucuggccggcgcugggcaggcug

SEQ ID NO: 2441574 - RNA, 22 nt, Bordetella pertussis
ucuggccgucgagccgguccgc

SEQ ID NO: 2441575 - RNA, 18 nt, Bordetella pertussis
ucuggccugucugguggc

SEQ ID NO: 2441576 - RNA, 17 nt, Bordetella pertussis
ucuggcgcagcaaggcg

SEQ ID NO: 2441577 - RNA, 18 nt, Bordetella pertussis
ucuggcgcauggccggcg

SEQ ID NO: 2441578 - RNA, 16 nt, Bordetella pertussis
ucuggcgcgcgaccag

SEQ ID NO: 2441579 - RNA, 13 nt, Bordetella pertussis
ucuggcggcagcu

SEQ ID NO: 2441580 - RNA, 16 nt, Bordetella pertussis
ucuggcugcgcgccug

SEQ ID NO: 2441581 - RNA, 19 nt, Bordetella pertussis
ucugggccucggccagcug

SEQ ID NO: 2441582 - RNA, 14 nt, Bordetella pertussis
ucugggcgcggaac

SEQ ID NO: 2441583 - RNA, 21 nt, Bordetella pertussis
ucugggcgcggaacagccugg

SEQ ID NO: 2441584 - RNA, 20 nt, Bordetella pertussis
ucugggcgugaaaggccagc

SEQ ID NO: 2441585 - RNA, 22 nt, Bordetella pertussis
ucugggcgugaaaggccagcgg

SEQ ID NO: 2441586 - RNA, 20 nt, Bordetella pertussis
ucuggucagccgugucgccc

SEQ ID NO: 2441587 - RNA, 14 nt, Bordetella pertussis
ucugguccacggcg

SEQ ID NO: 2441588 - RNA, 13 nt, Bordetella pertussis
ucugguccugggc

SEQ ID NO: 2441589 - RNA, 20 nt, Bordetella pertussis
ucugucccggcggggacagg

SEQ ID NO: 2441590 - RNA, 18 nt, Bordetella pertussis
ucugugcgccccgcuggc

SEQ ID NO: 2441591 - RNA, 12 nt, Bordetella pertussis
ucuucacguagc

SEQ ID NO: 2441592 - RNA, 13 nt, Bordetella pertussis
ucuucagcaccag

SEQ ID NO: 2441593 - RNA, 19 nt, Bordetella pertussis
ucuucagcaccagcuccuc

SEQ ID NO: 2441594 - RNA, 21 nt, Bordetella pertussis
ucuucagcauggagcuggggc

SEQ ID NO: 2441595 - RNA, 16 nt, Bordetella pertussis
ucuucagcuuggucac

SEQ ID NO: 2441596 - RNA, 14 nt, Bordetella pertussis
ucuuccaggcgccc

SEQ ID NO: 2441597 - RNA, 16 nt, Bordetella pertussis
ucuuccauccugaugu

SEQ ID NO: 2441598 - RNA, 19 nt, Bordetella pertussis
ucuucgaaguauuucagga

SEQ ID NO: 2441599 - RNA, 15 nt, Bordetella pertussis
ucuucgacagcgcgc

SEQ ID NO: 2441600 - RNA, 17 nt, Bordetella pertussis
ucuucgagcgcggcgcg

SEQ ID NO: 2441601 - RNA, 18 nt, Bordetella pertussis
ucuucgaucgccuggggc

SEQ ID NO: 2441602 - RNA, 15 nt, Bordetella pertussis
ucuucgaugcuggcg

SEQ ID NO: 2441603 - RNA, 21 nt, Bordetella pertussis
ucuucgccugcauggugggca

SEQ ID NO: 2441604 - RNA, 22 nt, Bordetella pertussis
agauccgguaugccugccagcc

SEQ ID NO: 2441605 - RNA, 17 nt, Bordetella pertussis
agaucgauaccgucgcg

SEQ ID NO: 2441606 - RNA, 19 nt, Bordetella pertussis
agaucgauccagaagauau

SEQ ID NO: 2441607 - RNA, 21 nt, Bordetella pertussis
agaucgcccgcgugcgugccg

SEQ ID NO: 2441608 - RNA, 13 nt, Bordetella pertussis
agaucgccgccgc

SEQ ID NO: 2441609 - RNA, 22 nt, Bordetella pertussis
agaucgcgccuaccggcgccga

SEQ ID NO: 2441610 - RNA, 23 nt, Bordetella pertussis
agaucgcggcggguggccucgcc

SEQ ID NO: 2441611 - RNA, 16 nt, Bordetella pertussis
agaucggcccggcgcc

SEQ ID NO: 2441612 - RNA, 16 nt, Bordetella pertussis
agaucggcgcuggccu

SEQ ID NO: 2441613 - RNA, 22 nt, Bordetella pertussis
agaucggcgcuggccuggccgc

SEQ ID NO: 2441614 - RNA, 15 nt, Bordetella pertussis
agaucggcggccugg

SEQ ID NO: 2441615 - RNA, 20 nt, Bordetella pertussis
agaucuccggcgccuggccg

SEQ ID NO: 2441616 - RNA, 15 nt, Bordetella pertussis
agaucucgacgucgu

SEQ ID NO: 2441617 - RNA, 13 nt, Bordetella pertussis
agaucuggcgcgu

SEQ ID NO: 2441618 - RNA, 15 nt, Bordetella pertussis
agaucuggcgcguca

SEQ ID NO: 2441619 - RNA, 16 nt, Bordetella pertussis
agaugauccggacuga

SEQ ID NO: 2441620 - RNA, 16 nt, Bordetella pertussis
agaugaucuacgcgcg

SEQ ID NO: 2441621 - RNA, 19 nt, Bordetella pertussis
agaugaucuacgcgcgcgc

SEQ ID NO: 2441622 - RNA, 15 nt, Bordetella pertussis
agaugcaccggccag

SEQ ID NO: 2441623 - RNA, 17 nt, Bordetella pertussis
agaugccagcggcgcag

SEQ ID NO: 2441624 - RNA, 20 nt, Bordetella pertussis
agaugccgaacagccagggc

SEQ ID NO: 2441625 - RNA, 16 nt, Bordetella pertussis
agaugccgaugauggc

SEQ ID NO: 2441626 - RNA, 22 nt, Bordetella pertussis
agaugccgaugauggccauggc

SEQ ID NO: 2441627 - RNA, 23 nt, Bordetella pertussis
agaugccggucaggaugcgcgcc

SEQ ID NO: 2441628 - RNA, 19 nt, Bordetella pertussis
agaugcgacuggcggcugc

SEQ ID NO: 2441629 - RNA, 12 nt, Bordetella pertussis
agaugcgcagca

SEQ ID NO: 2441630 - RNA, 12 nt, Bordetella pertussis
agaugcgccgca

SEQ ID NO: 2441631 - RNA, 16 nt, Bordetella pertussis
agaugcgcgccaggcg

SEQ ID NO: 2441632 - RNA, 17 nt, Bordetella pertussis
agaugcgcgccaggcgc

SEQ ID NO: 2441633 - RNA, 19 nt, Bordetella pertussis
agaugcgcgccaggcgcgc

SEQ ID NO: 2441634 - RNA, 12 nt, Bordetella pertussis
agaugcgcgccg

SEQ ID NO: 2441635 - RNA, 20 nt, Bordetella pertussis
agaugcgcgccguacagccg

SEQ ID NO: 2441636 - RNA, 20 nt, Bordetella pertussis
agauggccagcagcgccgcc

SEQ ID NO: 2441637 - RNA, 20 nt, Bordetella pertussis
agauggccagguggcggcgg

SEQ ID NO: 2441638 - RNA, 13 nt, Bordetella pertussis
agauggcccaggg

SEQ ID NO: 2441639 - RNA, 20 nt, Bordetella pertussis
agauggcccagggcagcggc

SEQ ID NO: 2441640 - RNA, 13 nt, Bordetella pertussis
agauggcgccgau

SEQ ID NO: 2441641 - RNA, 12 nt, Bordetella pertussis
agauggcggcga

SEQ ID NO: 2441642 - RNA, 16 nt, Bordetella pertussis
agauggguacagcgcg

SEQ ID NO: 2441643 - RNA, 18 nt, Bordetella pertussis
agauggguacagcgcgcc

SEQ ID NO: 2441644 - RNA, 16 nt, Bordetella pertussis
agaugucaguccucau

SEQ ID NO: 2441645 - RNA, 22 nt, Bordetella pertussis
agaugucaguccucaugcggga

SEQ ID NO: 2441646 - RNA, 20 nt, Bordetella pertussis
agauguggucggcgccgagg

SEQ ID NO: 2441647 - RNA, 15 nt, Bordetella pertussis
agauucaugggcggc

SEQ ID NO: 2441648 - RNA, 18 nt, Bordetella pertussis
agauugaugcccaugcgc

SEQ ID NO: 2441649 - RNA, 14 nt, Bordetella pertussis
agauuggccgagcg

SEQ ID NO: 2441650 - RNA, 16 nt, Bordetella pertussis
agauuguccagcggca

SEQ ID NO: 2441651 - RNA, 14 nt, Bordetella pertussis
agauugugcagcaa

SEQ ID NO: 2441652 - RNA, 20 nt, Bordetella pertussis
agauuucauggcgucugccc

SEQ ID NO: 2441653 - RNA, 17 nt, Bordetella pertussis
agcaaaugggccgcagc

SEQ ID NO: 2441654 - RNA, 12 nt, Bordetella pertussis
agcaacaaccgc

SEQ ID NO: 2441655 - RNA, 13 nt, Bordetella pertussis
agcaaccccagca

SEQ ID NO: 2441656 - RNA, 14 nt, Bordetella pertussis
agcaaccccagcag

SEQ ID NO: 2441657 - RNA, 16 nt, Bordetella pertussis
agcaaccccagcagcg

SEQ ID NO: 2441658 - RNA, 17 nt, Bordetella pertussis
agcaaccggaacaccag

SEQ ID NO: 2441659 - RNA, 19 nt, Bordetella pertussis
agcaaccggaacaccagca

SEQ ID NO: 2441660 - RNA, 12 nt, Bordetella pertussis
agcaacgccggc

SEQ ID NO: 2441661 - RNA, 20 nt, Bordetella pertussis
agcaacggugagccggccac

SEQ ID NO: 2441662 - RNA, 21 nt, Bordetella pertussis
agcaacggugagccggccacc

SEQ ID NO: 2441663 - RNA, 14 nt, Bordetella pertussis
agcaacuggggcgc

SEQ ID NO: 2441664 - RNA, 13 nt, Bordetella pertussis
agcaagacagcaa

SEQ ID NO: 2441665 - RNA, 17 nt, Bordetella pertussis
agcaagcccacaccauc

SEQ ID NO: 2441666 - RNA, 16 nt, Bordetella pertussis
agcaagcccaccgggc

SEQ ID NO: 2441667 - RNA, 15 nt, Bordetella pertussis
agcaagcgcgccaug

SEQ ID NO: 2441668 - RNA, 13 nt, Bordetella pertussis
agcaagcgcucgg

SEQ ID NO: 2441669 - RNA, 18 nt, Bordetella pertussis
agcaaggacaaggcgcgu

SEQ ID NO: 2441670 - RNA, 22 nt, Bordetella pertussis
agcaaggcggcaaacccggcga

SEQ ID NO: 2441671 - RNA, 22 nt, Bordetella pertussis
agcaaggcgucgaagccgguga

SEQ ID NO: 2441672 - RNA, 19 nt, Bordetella pertussis
agcaaggcgucggccaggc

SEQ ID NO: 2441673 - RNA, 13 nt, Bordetella pertussis
agcaagggcccca

SEQ ID NO: 2441674 - RNA, 20 nt, Bordetella pertussis
agcaagggcgucuucgccga

SEQ ID NO: 2441675 - RNA, 21 nt, Bordetella pertussis
agcaagggguccguggcggcc

SEQ ID NO: 2441676 - RNA, 16 nt, Bordetella pertussis
ugaagcccgagcggcg

SEQ ID NO: 2441677 - RNA, 20 nt, Bordetella pertussis
ugaagccguccuuggcgccg

SEQ ID NO: 2441678 - RNA, 19 nt, Bordetella pertussis
ugaagcgccgccacaggcu

SEQ ID NO: 2441679 - RNA, 22 nt, Bordetella pertussis
ugaagcggucgauguccagcgc

SEQ ID NO: 2441680 - RNA, 17 nt, Bordetella pertussis
ugaaggccgaggccagg

SEQ ID NO: 2441681 - RNA, 19 nt, Bordetella pertussis
ugaaggcgaugggcaccug

SEQ ID NO: 2441682 - RNA, 14 nt, Bordetella pertussis
ugaaggcggccagc

SEQ ID NO: 2441683 - RNA, 13 nt, Bordetella pertussis
ugaagggcggcgc

SEQ ID NO: 2441684 - RNA, 19 nt, Bordetella pertussis
ugaagggcugcaaggcagc

SEQ ID NO: 2441685 - RNA, 16 nt, Bordetella pertussis
ugaagggcuggccggc

SEQ ID NO: 2441686 - RNA, 23 nt, Bordetella pertussis
ugaaggucgcuucgguggcgcgc

SEQ ID NO: 2441687 - RNA, 16 nt, Bordetella pertussis
ugaaguaguacucgcc

SEQ ID NO: 2441688 - RNA, 20 nt, Bordetella pertussis
ugaaguucaugcucuugcuc

SEQ ID NO: 2441689 - RNA, 14 nt, Bordetella pertussis
ugaaucgcccgggc

SEQ ID NO: 2441690 - RNA, 18 nt, Bordetella pertussis
ugaaucgcccgggcgccg

SEQ ID NO: 2441691 - RNA, 17 nt, Bordetella pertussis
ugacagggugccugucc

SEQ ID NO: 2441692 - RNA, 20 nt, Bordetella pertussis
ugacagggugccuguccccg

SEQ ID NO: 2441693 - RNA, 22 nt, Bordetella pertussis
ugacauggccacggcccugguc

SEQ ID NO: 2441694 - RNA, 13 nt, Bordetella pertussis
ugaccaccaggcc

SEQ ID NO: 2441695 - RNA, 14 nt, Bordetella pertussis
ugaccacgcccugg

SEQ ID NO: 2441696 - RNA, 15 nt, Bordetella pertussis
ugaccacgcccugga

SEQ ID NO: 2441697 - RNA, 22 nt, Bordetella pertussis
ugaccacgcccuggaucagggu

SEQ ID NO: 2441698 - RNA, 23 nt, Bordetella pertussis
ugaccacggccagcagcacgauc

SEQ ID NO: 2441699 - RNA, 17 nt, Bordetella pertussis
ugaccacggcgcgcccg

SEQ ID NO: 2441700 - RNA, 19 nt, Bordetella pertussis
ugaccacggcgcgcccgca

SEQ ID NO: 2441701 - RNA, 21 nt, Bordetella pertussis
ugaccacgucgaucaggccca

SEQ ID NO: 2441702 - RNA, 12 nt, Bordetella pertussis
ugaccagcacca

SEQ ID NO: 2441703 - RNA, 17 nt, Bordetella pertussis
ugaccagcaccagcgcc

SEQ ID NO: 2441704 - RNA, 18 nt, Bordetella pertussis
ugaccagcaccagcgccu

SEQ ID NO: 2441705 - RNA, 21 nt, Bordetella pertussis
ugaccagcaccagcgccugcc

SEQ ID NO: 2441706 - RNA, 17 nt, Bordetella pertussis
ugaccagcacgaugguc

SEQ ID NO: 2441707 - RNA, 14 nt, Bordetella pertussis
ugaccagcagcacc

SEQ ID NO: 2441708 - RNA, 12 nt, Bordetella pertussis
ugaccagcagcg

SEQ ID NO: 2441709 - RNA, 15 nt, Bordetella pertussis
ugaccagcagcgccg

SEQ ID NO: 2441710 - RNA, 18 nt, Bordetella pertussis
ugaccagcagcgccgggg

SEQ ID NO: 2441711 - RNA, 16 nt, Bordetella pertussis
ugaccagccagccgcc

SEQ ID NO: 2441712 - RNA, 14 nt, Bordetella pertussis
ugaccagcgcggcc

SEQ ID NO: 2441713 - RNA, 15 nt, Bordetella pertussis
ugaccagcgcggccg

SEQ ID NO: 2441714 - RNA, 16 nt, Bordetella pertussis
ugaccagcgcggccgu

SEQ ID NO: 2441715 - RNA, 16 nt, Bordetella pertussis
ugaccagcugcaccag

SEQ ID NO: 2441716 - RNA, 21 nt, Bordetella pertussis
ugaccagcugcaccaggcuuu

SEQ ID NO: 2441717 - RNA, 14 nt, Bordetella pertussis
ugagaaugcccagg

SEQ ID NO: 2441718 - RNA, 22 nt, Bordetella pertussis
ugagaaugcccaggaugcccuu

SEQ ID NO: 2441719 - RNA, 14 nt, Bordetella pertussis
ugagaauggcgcgg

SEQ ID NO: 2441720 - RNA, 21 nt, Bordetella pertussis
ugagacggaugcuugcggggc

SEQ ID NO: 2441721 - RNA, 15 nt, Bordetella pertussis
ugagauugugcagca

SEQ ID NO: 2441722 - RNA, 14 nt, Bordetella pertussis
ugagcaagcgcugg

SEQ ID NO: 2441723 - RNA, 18 nt, Bordetella pertussis
ugagcaagcgcuggaugg

SEQ ID NO: 2441724 - RNA, 13 nt, Bordetella pertussis
ugagcaccgccgc

SEQ ID NO: 2441725 - RNA, 14 nt, Bordetella pertussis
ugagcagcaccugg

SEQ ID NO: 2441726 - RNA, 16 nt, Bordetella pertussis
ugagcagcaugugcuc

SEQ ID NO: 2441727 - RNA, 18 nt, Bordetella pertussis
ugagcagcguugcggcgu

SEQ ID NO: 2441728 - RNA, 13 nt, Bordetella pertussis
ugagcaggccggg

SEQ ID NO: 2441729 - RNA, 15 nt, Bordetella pertussis
ugagcaggccggguc

SEQ ID NO: 2441730 - RNA, 14 nt, Bordetella pertussis
ugagcaggcgccug

SEQ ID NO: 2441731 - RNA, 19 nt, Bordetella pertussis
ugagcaggcgccugccccg

SEQ ID NO: 2441732 - RNA, 14 nt, Bordetella pertussis
ugagcaggcgcugg

SEQ ID NO: 2441733 - RNA, 16 nt, Bordetella pertussis
ugagcaugauuuccug

SEQ ID NO: 2441734 - RNA, 17 nt, Bordetella pertussis
ugagccaggcgcccggc

SEQ ID NO: 2441735 - RNA, 18 nt, Bordetella pertussis
ugagccccaagcgggaau

SEQ ID NO: 2441736 - RNA, 14 nt, Bordetella pertussis
ugagcccgaugccg

SEQ ID NO: 2441737 - RNA, 15 nt, Bordetella pertussis
ugagcccgaugccgc

SEQ ID NO: 2441738 - RNA, 19 nt, Bordetella pertussis
ugagcgaaauggcggccuc

SEQ ID NO: 2441739 - RNA, 14 nt, Bordetella pertussis
ugagcgccagcucg

SEQ ID NO: 2441740 - RNA, 17 nt, Bordetella pertussis
ugagcgccgacgggccg

SEQ ID NO: 2441741 - RNA, 20 nt, Bordetella pertussis
ugagcgccgccgccaugguc

SEQ ID NO: 2441742 - RNA, 21 nt, Bordetella pertussis
ugagcgccgccgccauggucg

SEQ ID NO: 2441743 - RNA, 11 nt, Bordetella pertussis
ugagcgccggg

SEQ ID NO: 2441744 - RNA, 23 nt, Bordetella pertussis
ugagcgccggggcguggccgcag

SEQ ID NO: 2441745 - RNA, 22 nt, Bordetella pertussis
ugagcgcgccgccguaggacag

SEQ ID NO: 2441746 - RNA, 13 nt, Bordetella pertussis
ugagcggcacgac

SEQ ID NO: 2441747 - RNA, 16 nt, Bordetella pertussis
ugagcggcccgggcga

SEQ ID NO: 2441748 - RNA, 22 nt, Bordetella pertussis
ugagcguaagcccacucacgca

SEQ ID NO: 2441749 - RNA, 15 nt, Bordetella pertussis
ugagcugaugcucgc

SEQ ID NO: 2441750 - RNA, 18 nt, Bordetella pertussis
ugaggaacggcaccagcc

SEQ ID NO: 2441751 - RNA, 21 nt, Bordetella pertussis
ugaggaacuggacggcgcugg

SEQ ID NO: 2441752 - RNA, 13 nt, Bordetella pertussis
ugaggaugcgcgc

SEQ ID NO: 2441753 - RNA, 22 nt, Bordetella pertussis
ugaggaugcgcgcggccauguc

SEQ ID NO: 2441754 - RNA, 20 nt, Bordetella pertussis
ugaggauguucaugaccgcc

SEQ ID NO: 2441755 - RNA, 17 nt, Bordetella pertussis
ugaggauuuccagcucg

SEQ ID NO: 2441756 - RNA, 24 nt, Bordetella pertussis
ugaggcccgauggcggggauggag

SEQ ID NO: 2441757 - RNA, 14 nt, Bordetella pertussis
ugaggccgcgcgcc

SEQ ID NO: 2441758 - RNA, 18 nt, Bordetella pertussis
ugaggcgacgguggcugg

SEQ ID NO: 2441759 - RNA, 19 nt, Bordetella pertussis
ugaggcgacgguggcuggg

SEQ ID NO: 2441760 - RNA, 20 nt, Bordetella pertussis
ugaggcgacgguggcugggg

SEQ ID NO: 2441761 - RNA, 14 nt, Bordetella pertussis
ugaggcggccgggc

SEQ ID NO: 2441762 - RNA, 19 nt, Bordetella pertussis
ugaggcuuucgaagcgcuc

SEQ ID NO: 2441763 - RNA, 16 nt, Bordetella pertussis
ugagggcgcgggccag

SEQ ID NO: 2441764 - RNA, 17 nt, Bordetella pertussis
ugagggcgcgggccagc

SEQ ID NO: 2441765 - RNA, 12 nt, Bordetella pertussis
ugaggggccagc

SEQ ID NO: 2441766 - RNA, 14 nt, Bordetella pertussis
ugaggggccagccu

SEQ ID NO: 2441767 - RNA, 16 nt, Bordetella pertussis
ugagugcccauggaga

SEQ ID NO: 2441768 - RNA, 17 nt, Bordetella pertussis
ugaguucgcgcgccggc

SEQ ID NO: 2441769 - RNA, 14 nt, Bordetella pertussis
ugaguucuggcauc

SEQ ID NO: 2441770 - RNA, 21 nt, Bordetella pertussis
ugauacguucagauacaaaau

SEQ ID NO: 2441771 - RNA, 19 nt, Bordetella pertussis
ugauagacauugcccagca

SEQ ID NO: 2441772 - RNA, 23 nt, Bordetella pertussis
ugauagcacugcaccugcuccag

SEQ ID NO: 2441773 - RNA, 17 nt, Bordetella pertussis
ugauaucgaagcgagug

SEQ ID NO: 2441774 - RNA, 23 nt, Bordetella pertussis
ugauauuggcgaacgugcgcgcc

SEQ ID NO: 2441775 - RNA, 16 nt, Bordetella pertussis
ugaucaccaaacacca

SEQ ID NO: 2441776 - RNA, 21 nt, Bordetella pertussis
ugaucacccacagcagcgcgc

SEQ ID NO: 2441777 - RNA, 14 nt, Bordetella pertussis
ugaucaccgccaug

SEQ ID NO: 2441778 - RNA, 14 nt, Bordetella pertussis
ugaucaccgccggu

SEQ ID NO: 2441779 - RNA, 14 nt, Bordetella pertussis
ugaucacgcgcucc

SEQ ID NO: 2441780 - RNA, 14 nt, Bordetella pertussis
ugaucagcaggccc

SEQ ID NO: 2441781 - RNA, 13 nt, Bordetella pertussis
ugaucagggccgc

SEQ ID NO: 2441782 - RNA, 16 nt, Bordetella pertussis
ugaucagggccgccag

SEQ ID NO: 2441783 - RNA, 23 nt, Bordetella pertussis
ugaucagggccgccagggcggcu

SEQ ID NO: 2441784 - RNA, 20 nt, Bordetella pertussis
ugaucagggccgugcccgag

SEQ ID NO: 2441785 - RNA, 12 nt, Bordetella pertussis
ugaucaggucca

SEQ ID NO: 2441786 - RNA, 16 nt, Bordetella pertussis
ugaucaguccgacgac

SEQ ID NO: 2441787 - RNA, 13 nt, Bordetella pertussis
ugaucaugccgcu

SEQ ID NO: 2441788 - RNA, 22 nt, Bordetella pertussis
ugauccacagucggucgccgca

SEQ ID NO: 2441789 - RNA, 14 nt, Bordetella pertussis
ugauccacugcagc

SEQ ID NO: 2441790 - RNA, 19 nt, Bordetella pertussis
ugaucccggcgcuggccgc

SEQ ID NO: 2441791 - RNA, 20 nt, Bordetella pertussis
ugaucgacaugcuggcccag

SEQ ID NO: 2441792 - RNA, 21 nt, Bordetella pertussis
ugaucgaucagccagccggcg

SEQ ID NO: 2441793 - RNA, 23 nt, Bordetella pertussis
ugaucgccagcgccggggucagc

SEQ ID NO: 2441794 - RNA, 14 nt, Bordetella pertussis
ugaucgccggcaac

SEQ ID NO: 2441795 - RNA, 18 nt, Bordetella pertussis
ugaucgccggcgccccca

SEQ ID NO: 2441796 - RNA, 16 nt, Bordetella pertussis
ugaucgcgcagcaccg

SEQ ID NO: 2441797 - RNA, 19 nt, Bordetella pertussis
ugaucgcgcagcaccgcca

SEQ ID NO: 2441798 - RNA, 16 nt, Bordetella pertussis
ugaucgcgccgacgac

SEQ ID NO: 2441799 - RNA, 15 nt, Bordetella pertussis
ugaucggccgacugc

SEQ ID NO: 2441800 - RNA, 17 nt, Bordetella pertussis
ugaucuacgcgcgcgcc

SEQ ID NO: 2441801 - RNA, 20 nt, Bordetella pertussis
ugaucuacgcgcgcgccggc

SEQ ID NO: 2441802 - RNA, 21 nt, Bordetella pertussis
ugaucugcauguacucggcca

SEQ ID NO: 2441803 - RNA, 22 nt, Bordetella pertussis
ugaucugcauguacucggccag

SEQ ID NO: 2441804 - RNA, 12 nt, Bordetella pertussis
ugaucugcugcg

SEQ ID NO: 2441805 - RNA, 18 nt, Bordetella pertussis
ugaucugcuugaggccgc

SEQ ID NO: 2441806 - RNA, 21 nt, Bordetella pertussis
ugaucugcuugaggccgcgcg

SEQ ID NO: 2441807 - RNA, 19 nt, Bordetella pertussis
ugaucuugccgaugcggcg

SEQ ID NO: 2441808 - RNA, 15 nt, Bordetella pertussis
ugaugagcgcgccgc

SEQ ID NO: 2441809 - RNA, 23 nt, Bordetella pertussis
ugaugagguaggugaacgacagc

SEQ ID NO: 2441810 - RNA, 13 nt, Bordetella pertussis
ugaugauccugcu

SEQ ID NO: 2441811 - RNA, 14 nt, Bordetella pertussis
ugaugauggccagg

SEQ ID NO: 2441812 - RNA, 15 nt, Bordetella pertussis
ugaugauggccaggu

SEQ ID NO: 2441813 - RNA, 12 nt, Bordetella pertussis
ugaugcagcacg

SEQ ID NO: 2441814 - RNA, 12 nt, Bordetella pertussis
ugaugcaggccu

SEQ ID NO: 2441815 - RNA, 11 nt, Bordetella pertussis
ugaugcccagc

SEQ ID NO: 2441816 - RNA, 15 nt, Bordetella pertussis
ugaugcccagcucau

SEQ ID NO: 2441817 - RNA, 21 nt, Bordetella pertussis
ugaugcccagcucauggcaca

SEQ ID NO: 2441818 - RNA, 14 nt, Bordetella pertussis
ugaugcccaggauc

SEQ ID NO: 2441819 - RNA, 23 nt, Bordetella pertussis
ugaugcccaugcgcugcgccuug

SEQ ID NO: 2441820 - RNA, 18 nt, Bordetella pertussis
ugaugcccuucggcaugc

SEQ ID NO: 2441821 - RNA, 16 nt, Bordetella pertussis
ugaugccgaccaggcc

SEQ ID NO: 2441822 - RNA, 20 nt, Bordetella pertussis
ugaugccgaccaggcccgcc

SEQ ID NO: 2441823 - RNA, 13 nt, Bordetella pertussis
ugaugccgcccag

SEQ ID NO: 2441824 - RNA, 19 nt, Bordetella pertussis
ugaugccgucgagcgcggc

SEQ ID NO: 2441825 - RNA, 16 nt, Bordetella pertussis
ugaugccugucccgca

SEQ ID NO: 2441826 - RNA, 22 nt, Bordetella pertussis
ugaugccugucccgcacgcagc

SEQ ID NO: 2441827 - RNA, 14 nt, Bordetella pertussis
ugaugcgcgcggcc

SEQ ID NO: 2441828 - RNA, 15 nt, Bordetella pertussis
ugaugcgcgcggcca

SEQ ID NO: 2441829 - RNA, 14 nt, Bordetella pertussis
ugaugcgcugggcc

SEQ ID NO: 2441830 - RNA, 20 nt, Bordetella pertussis
ugaugcggccguugcuccag

SEQ ID NO: 2441831 - RNA, 14 nt, Bordetella pertussis
ugcagcaggcuggg

SEQ ID NO: 2441832 - RNA, 23 nt, Bordetella pertussis
ugcagcagggucaugaugucggc

SEQ ID NO: 2441833 - RNA, 12 nt, Bordetella pertussis
ugcagcagguag

SEQ ID NO: 2441834 - RNA, 14 nt, Bordetella pertussis
ugcagcaugaaaug

SEQ ID NO: 2441835 - RNA, 11 nt, Bordetella pertussis
ugcagcaugau

SEQ ID NO: 2441836 - RNA, 21 nt, Bordetella pertussis
ugcagcaugaucuugccgacc

SEQ ID NO: 2441837 - RNA, 22 nt, Bordetella pertussis
ugcagccacaggcccaugccgc

SEQ ID NO: 2441838 - RNA, 15 nt, Bordetella pertussis
ugcagccacgccugg

SEQ ID NO: 2441839 - RNA, 18 nt, Bordetella pertussis
ugcagccacgccuggccg

SEQ ID NO: 2441840 - RNA, 14 nt, Bordetella pertussis
ugcagccagcggcc

SEQ ID NO: 2441841 - RNA, 15 nt, Bordetella pertussis
ugcagccagcggccg

SEQ ID NO: 2441842 - RNA, 18 nt, Bordetella pertussis
ugcagccaguugggccag

SEQ ID NO: 2441843 - RNA, 21 nt, Bordetella pertussis
ugcagccaguugggccagggc

SEQ ID NO: 2441844 - RNA, 18 nt, Bordetella pertussis
ugcagccauucggccagg

SEQ ID NO: 2441845 - RNA, 12 nt, Bordetella pertussis
ugcagcccagca

SEQ ID NO: 2441846 - RNA, 13 nt, Bordetella pertussis
ugcagcccagcac

SEQ ID NO: 2441847 - RNA, 15 nt, Bordetella pertussis
ugcagcccagcacca

SEQ ID NO: 2441848 - RNA, 16 nt, Bordetella pertussis
ugcagcccagcaccac

SEQ ID NO: 2441849 - RNA, 20 nt, Bordetella pertussis
ugcagcccagcaccacggca

SEQ ID NO: 2441850 - RNA, 12 nt, Bordetella pertussis
ugcagcccagcg

SEQ ID NO: 2441851 - RNA, 13 nt, Bordetella pertussis
ugcagcccagcgc

SEQ ID NO: 2441852 - RNA, 14 nt, Bordetella pertussis
ugcagcccggccag

SEQ ID NO: 2441853 - RNA, 14 nt, Bordetella pertussis
ugcagccgcaccag

SEQ ID NO: 2441854 - RNA, 17 nt, Bordetella pertussis
ugcagccgcaccagcgc

SEQ ID NO: 2441855 - RNA, 18 nt, Bordetella pertussis
ugcagccgcaccagcgca

SEQ ID NO: 2441856 - RNA, 14 nt, Bordetella pertussis
ugcagcgccgcgcg

SEQ ID NO: 2441857 - RNA, 20 nt, Bordetella pertussis
ugcagcgccgcgcgcucgga

SEQ ID NO: 2441858 - RNA, 16 nt, Bordetella pertussis
ugcagcgccucgggau

SEQ ID NO: 2441859 - RNA, 13 nt, Bordetella pertussis
ugcagcgcgccag

SEQ ID NO: 2441860 - RNA, 21 nt, Bordetella pertussis
ugcagcggcagcauggcgcgc

SEQ ID NO: 2441861 - RNA, 13 nt, Bordetella pertussis
ugcagcggcggca

SEQ ID NO: 2441862 - RNA, 16 nt, Bordetella pertussis
ugcagcggcggcacgg

SEQ ID NO: 2441863 - RNA, 13 nt, Bordetella pertussis
ugcagcugcgcca

SEQ ID NO: 2441864 - RNA, 14 nt, Bordetella pertussis
ugcagcugcgccag

SEQ ID NO: 2441865 - RNA, 17 nt, Bordetella pertussis
ugcagcuguagcccugg

SEQ ID NO: 2441866 - RNA, 23 nt, Bordetella pertussis
ugcagcuguagcccuggcgcugc

SEQ ID NO: 2441867 - RNA, 18 nt, Bordetella pertussis
ugcagcuugcgcgccagu

SEQ ID NO: 2441868 - RNA, 21 nt, Bordetella pertussis
ugcaggaacucgcacacgcgc

SEQ ID NO: 2441869 - RNA, 14 nt, Bordetella pertussis
ugcaggaagcgcac

SEQ ID NO: 2441870 - RNA, 17 nt, Bordetella pertussis
ugcaggaaggccgccgc

SEQ ID NO: 2441871 - RNA, 17 nt, Bordetella pertussis
ugcaggacgaacaggcc

SEQ ID NO: 2441872 - RNA, 19 nt, Bordetella pertussis
ugcaggacgaacaggccgc

SEQ ID NO: 2441873 - RNA, 21 nt, Bordetella pertussis
ugcaggacgaacaggccgccg

SEQ ID NO: 2441874 - RNA, 18 nt, Bordetella pertussis
ugcaggaucgcggccagc

SEQ ID NO: 2441875 - RNA, 16 nt, Bordetella pertussis
ugcaggaugcgcggca

SEQ ID NO: 2441876 - RNA, 22 nt, Bordetella pertussis
ugcaggauggcgucgaccgcca

SEQ ID NO: 2441877 - RNA, 20 nt, Bordetella pertussis
ugcaggaugggccguccggc

SEQ ID NO: 2441878 - RNA, 15 nt, Bordetella pertussis
ugcaggauuuccucg

SEQ ID NO: 2441879 - RNA, 20 nt, Bordetella pertussis
ugcaggauuuccucguccgu

SEQ ID NO: 2441880 - RNA, 17 nt, Bordetella pertussis
ugcaggccaccgacggc

SEQ ID NO: 2441881 - RNA, 12 nt, Bordetella pertussis
ugcaggccaggc

SEQ ID NO: 2441882 - RNA, 15 nt, Bordetella pertussis
ugcaggccaggcuca

SEQ ID NO: 2441883 - RNA, 16 nt, Bordetella pertussis
ugcaggccaggcucag

SEQ ID NO: 2441884 - RNA, 18 nt, Bordetella pertussis
ugcaggccaucgcggucg

SEQ ID NO: 2441885 - RNA, 18 nt, Bordetella pertussis
ugcaggccaugcucgucc

SEQ ID NO: 2441886 - RNA, 19 nt, Bordetella pertussis
ugcaggccaugcucgucca

SEQ ID NO: 2441887 - RNA, 21 nt, Bordetella pertussis
ugcaggcccaccggcaugccg

SEQ ID NO: 2441888 - RNA, 12 nt, Bordetella pertussis
ugcaggcccagc

SEQ ID NO: 2441889 - RNA, 13 nt, Bordetella pertussis
ugcaggcccagca

SEQ ID NO: 2441890 - RNA, 19 nt, Bordetella pertussis
ugcaggcccagcacgcgcg

SEQ ID NO: 2441891 - RNA, 20 nt, Bordetella pertussis
ugcaggcccagcacgcgcgc

SEQ ID NO: 2441892 - RNA, 22 nt, Bordetella pertussis
ugcaggcccagcacgcgcgcca

SEQ ID NO: 2441893 - RNA, 23 nt, Bordetella pertussis
ugcaggcccagcacgcgcgccag

SEQ ID NO: 2441894 - RNA, 17 nt, Bordetella pertussis
ugcaggcccgacaggaa

SEQ ID NO: 2441895 - RNA, 16 nt, Bordetella pertussis
ugcaggcccggcgcga

SEQ ID NO: 2441896 - RNA, 18 nt, Bordetella pertussis
ugcaggcccgggcgccug

SEQ ID NO: 2441897 - RNA, 23 nt, Bordetella pertussis
ugcaggcccgggcgccugcgcca

SEQ ID NO: 2441898 - RNA, 15 nt, Bordetella pertussis
ugcaggccgaggacc

SEQ ID NO: 2441899 - RNA, 17 nt, Bordetella pertussis
ugcaggccgcgaacaga

SEQ ID NO: 2441900 - RNA, 13 nt, Bordetella pertussis
ugcaggccgcgca

SEQ ID NO: 2441901 - RNA, 14 nt, Bordetella pertussis
ugcaggccgcgcag

SEQ ID NO: 2441902 - RNA, 15 nt, Bordetella pertussis
ugcaggccggcgcgc

SEQ ID NO: 2441903 - RNA, 16 nt, Bordetella pertussis
ugcaggccggcgcgca

SEQ ID NO: 2441904 - RNA, 17 nt, Bordetella pertussis
ugcaggccgggcagucc

SEQ ID NO: 2441905 - RNA, 20 nt, Bordetella pertussis
ugcaggcgccuucggcgcgg

SEQ ID NO: 2441906 - RNA, 21 nt, Bordetella pertussis
ugcaggcgccuucggcgcggc

SEQ ID NO: 2441907 - RNA, 22 nt, Bordetella pertussis
ugcaggcgccuucggcgcggcg

SEQ ID NO: 2441908 - RNA, 15 nt, Bordetella pertussis
ugcaggcgcugcgca

SEQ ID NO: 2441909 - RNA, 12 nt, Bordetella pertussis
ugcaggcucuug

SEQ ID NO: 2441910 - RNA, 23 nt, Bordetella pertussis
ugcaggcuggacccggagcugcc

SEQ ID NO: 2441911 - RNA, 22 nt, Bordetella pertussis
ugcagggcaugggcccgggcgc

SEQ ID NO: 2441912 - RNA, 13 nt, Bordetella pertussis
ugcagggccaggu

SEQ ID NO: 2441913 - RNA, 19 nt, Bordetella pertussis
ugcagggccuggaagcugg

SEQ ID NO: 2441914 - RNA, 20 nt, Bordetella pertussis
ugcagggcgucugcucgccg

SEQ ID NO: 2441915 - RNA, 14 nt, Bordetella pertussis
ugcaggggccgcac

SEQ ID NO: 2441916 - RNA, 19 nt, Bordetella pertussis
ugcaggggccgcacgcgcg

SEQ ID NO: 2441917 - RNA, 22 nt, Bordetella pertussis
ugcaggggccgcacgcgcggca

SEQ ID NO: 2441918 - RNA, 19 nt, Bordetella pertussis
ugcagggucagcccgccau

SEQ ID NO: 2441919 - RNA, 22 nt, Bordetella pertussis
ugcagguagucgaugaaggcgc

SEQ ID NO: 2441920 - RNA, 13 nt, Bordetella pertussis
ugcagguccgguc

SEQ ID NO: 2441921 - RNA, 19 nt, Bordetella pertussis
ugcagguccggucgcgcgu

SEQ ID NO: 2441922 - RNA, 22 nt, Bordetella pertussis
ugcagguccggucgcgcgugca

SEQ ID NO: 2441923 - RNA, 22 nt, Bordetella pertussis
ugcaggucgggauaguccagca

SEQ ID NO: 2441924 - RNA, 15 nt, Bordetella pertussis
ugcaggucguugaac

SEQ ID NO: 2441925 - RNA, 16 nt, Bordetella pertussis
ugcaggucuucgggcg

SEQ ID NO: 2441926 - RNA, 19 nt, Bordetella pertussis
ugcaggucuucgggcgugc

SEQ ID NO: 2441927 - RNA, 16 nt, Bordetella pertussis
ugcagguugauuuccg

SEQ ID NO: 2441928 - RNA, 14 nt, Bordetella pertussis
ugcaguacccagua

SEQ ID NO: 2441929 - RNA, 14 nt, Bordetella pertussis
ugcaguucgccggc

SEQ ID NO: 2441930 - RNA, 16 nt, Bordetella pertussis
ugcaguucggccgcca

SEQ ID NO: 2441931 - RNA, 16 nt, Bordetella pertussis
ugcaguucggcuuguu

SEQ ID NO: 2441932 - RNA, 15 nt, Bordetella pertussis
ugcauccggcccagc

SEQ ID NO: 2441933 - RNA, 17 nt, Bordetella pertussis
ugcaucgccaugccggc

SEQ ID NO: 2441934 - RNA, 14 nt, Bordetella pertussis
ugcaucggccggcg

SEQ ID NO: 2441935 - RNA, 15 nt, Bordetella pertussis
ugcaucggccggcgg

SEQ ID NO: 2441936 - RNA, 22 nt, Bordetella pertussis
ugcaucggccggcggucgcgcu

SEQ ID NO: 2441937 - RNA, 20 nt, Bordetella pertussis
ugcaucgugacaugcacgau

SEQ ID NO: 2441938 - RNA, 14 nt, Bordetella pertussis
ugcaucuccaggau

SEQ ID NO: 2441939 - RNA, 14 nt, Bordetella pertussis
ugcaucucgaagcg

SEQ ID NO: 2441940 - RNA, 16 nt, Bordetella pertussis
ugcaugaaccgcagcg

SEQ ID NO: 2441941 - RNA, 17 nt, Bordetella pertussis
ugcaugaccgccgccag

SEQ ID NO: 2441942 - RNA, 21 nt, Bordetella pertussis
ugcaugaccgccgccagcagc

SEQ ID NO: 2441943 - RNA, 15 nt, Bordetella pertussis
ugcaugacggccagg

SEQ ID NO: 2441944 - RNA, 21 nt, Bordetella pertussis
ugcaugacggccaggauggcg

SEQ ID NO: 2441945 - RNA, 23 nt, Bordetella pertussis
ugcccaggauggagagggccugg

SEQ ID NO: 2441946 - RNA, 12 nt, Bordetella pertussis
ugcccaggccag

SEQ ID NO: 2441947 - RNA, 14 nt, Bordetella pertussis
ugcccaggcccgcc

SEQ ID NO: 2441948 - RNA, 17 nt, Bordetella pertussis
ugcccaggcccgccagg

SEQ ID NO: 2441949 - RNA, 20 nt, Bordetella pertussis
ugcccaggcccgccagggcc

SEQ ID NO: 2441950 - RNA, 23 nt, Bordetella pertussis
ugcccaggcccgccagggccaug

SEQ ID NO: 2441951 - RNA, 21 nt, Bordetella pertussis
ugcccaggcccgugcuccaga

SEQ ID NO: 2441952 - RNA, 21 nt, Bordetella pertussis
ugcccaggcccuggcuggcca

SEQ ID NO: 2441953 - RNA, 18 nt, Bordetella pertussis
ugcccaggccggcgcgcu

SEQ ID NO: 2441954 - RNA, 16 nt, Bordetella pertussis
ugcccaggcugggcca

SEQ ID NO: 2441955 - RNA, 17 nt, Bordetella pertussis
ugcccaggcugggccag

SEQ ID NO: 2441956 - RNA, 20 nt, Bordetella pertussis
ugcccaggucguugcgcgaa

SEQ ID NO: 2441957 - RNA, 20 nt, Bordetella pertussis
ugcccaguacgaugccgucg

SEQ ID NO: 2441958 - RNA, 20 nt, Bordetella pertussis
ugcccaguucgcggccggcc

SEQ ID NO: 2441959 - RNA, 18 nt, Bordetella pertussis
ugcccaguucgucccagg

SEQ ID NO: 2441960 - RNA, 20 nt, Bordetella pertussis
ugcccaguuucgcgaccacc

SEQ ID NO: 2441961 - RNA, 17 nt, Bordetella pertussis
ugcccaucgcgcugacg

SEQ ID NO: 2441962 - RNA, 14 nt, Bordetella pertussis
ugcccaugccgcca

SEQ ID NO: 2441963 - RNA, 15 nt, Bordetella pertussis
ugcccaugcgcugcg

SEQ ID NO: 2441964 - RNA, 21 nt, Bordetella pertussis
ugcccauggagacggaugccg

SEQ ID NO: 2441965 - RNA, 21 nt, Bordetella pertussis
ugcccauuuccaccacgcggu

SEQ ID NO: 2441966 - RNA, 16 nt, Bordetella pertussis
ugccccaacggcgcac

SEQ ID NO: 2441967 - RNA, 18 nt, Bordetella pertussis
ugccccaacggcgcaccg

SEQ ID NO: 2441968 - RNA, 16 nt, Bordetella pertussis
ugccccacacgcgcgc

SEQ ID NO: 2441969 - RNA, 17 nt, Bordetella pertussis
ugccccacacgcgcgca

SEQ ID NO: 2441970 - RNA, 12 nt, Bordetella pertussis
ugccccagcacg

SEQ ID NO: 2441971 - RNA, 14 nt, Bordetella pertussis
ugccccagcacgaa

SEQ ID NO: 2441972 - RNA, 17 nt, Bordetella pertussis
ugccccagcggcuggcg

SEQ ID NO: 2441973 - RNA, 20 nt, Bordetella pertussis
ugccccagcuugucggccgc

SEQ ID NO: 2441974 - RNA, 18 nt, Bordetella pertussis
ugccccagguccgccggc

SEQ ID NO: 2441975 - RNA, 20 nt, Bordetella pertussis
ugccccaguccaggccggcc

SEQ ID NO: 2441976 - RNA, 24 nt, Bordetella pertussis
ugccccauccagcggacgggccag

SEQ ID NO: 2441977 - RNA, 14 nt, Bordetella pertussis
ugccccaugcgcgg

SEQ ID NO: 2441978 - RNA, 18 nt, Bordetella pertussis
ugccccauggcaugcacc

SEQ ID NO: 2441979 - RNA, 23 nt, Bordetella pertussis
ugccccauuuuuuugccugcucg

SEQ ID NO: 2441980 - RNA, 21 nt, Bordetella pertussis
ugcccccacgcugcgcccgcu

SEQ ID NO: 2441981 - RNA, 22 nt, Bordetella pertussis
ugcccccacgcugcgcccgcua

SEQ ID NO: 2441982 - RNA, 13 nt, Bordetella pertussis
ugccccccgaggg

SEQ ID NO: 2441983 - RNA, 16 nt, Bordetella pertussis
ugccccccgagggggc

SEQ ID NO: 2441984 - RNA, 19 nt, Bordetella pertussis
ugccccccgagggggcuuu

SEQ ID NO: 2441985 - RNA, 18 nt, Bordetella pertussis
ugccccgauccgcgggcg

SEQ ID NO: 2441986 - RNA, 18 nt, Bordetella pertussis
ugccccggccucgcggcg

SEQ ID NO: 2441987 - RNA, 21 nt, Bordetella pertussis
ugccccggccucgcggcgcgu

SEQ ID NO: 2441988 - RNA, 21 nt, Bordetella pertussis
ugccccgugccgcggcgcggc

SEQ ID NO: 2441989 - RNA, 15 nt, Bordetella pertussis
ugccccuccgggucg

SEQ ID NO: 2441990 - RNA, 21 nt, Bordetella pertussis
ugccccuccgggucgcggcac

SEQ ID NO: 2441991 - RNA, 22 nt, Bordetella pertussis
ugccccuccgggucgcggcacg

SEQ ID NO: 2441992 - RNA, 15 nt, Bordetella pertussis
ugccccugcggggac

SEQ ID NO: 2441993 - RNA, 22 nt, Bordetella pertussis
ugccccugcggggacaggcacc

SEQ ID NO: 2441994 - RNA, 21 nt, Bordetella pertussis
ugccccuugcccaacgcggcg

SEQ ID NO: 2441995 - RNA, 16 nt, Bordetella pertussis
ugcccgaagcgcagca

SEQ ID NO: 2441996 - RNA, 18 nt, Bordetella pertussis
ugcccgaagcgcagcacc

SEQ ID NO: 2441997 - RNA, 22 nt, Bordetella pertussis
ugcccgaagcgcagcaccaggu

SEQ ID NO: 2441998 - RNA, 17 nt, Bordetella pertussis
ugcccgaagcggcccgg

SEQ ID NO: 2441999 - RNA, 19 nt, Bordetella pertussis
ugcccgaaggcagcggcac

SEQ ID NO: 2442000 - RNA, 22 nt, Bordetella pertussis
ugcccgaaggcagcggcacauc

SEQ ID NO: 2442001 - RNA, 22 nt, Bordetella pertussis
ugcccgaccgcaugggcgccga

SEQ ID NO: 2442002 - RNA, 15 nt, Bordetella pertussis
ugcccgacggacugg

SEQ ID NO: 2442003 - RNA, 15 nt, Bordetella pertussis
ugcccgacggcgccg

SEQ ID NO: 2442004 - RNA, 13 nt, Bordetella pertussis
ugcccgagcgcga

SEQ ID NO: 2442005 - RNA, 22 nt, Bordetella pertussis
ugcccgagcgcgacagcaccaa

SEQ ID NO: 2442006 - RNA, 13 nt, Bordetella pertussis
ugcccgaggcggc

SEQ ID NO: 2442007 - RNA, 18 nt, Bordetella pertussis
ugcccgaggcggcgcggg

SEQ ID NO: 2442008 - RNA, 15 nt, Bordetella pertussis
ugcccgcacgggccg

SEQ ID NO: 2442009 - RNA, 19 nt, Bordetella pertussis
ugcccgcacgggccgacgg

SEQ ID NO: 2442010 - RNA, 22 nt, Bordetella pertussis
ugcccgcagagggagcgacacc

SEQ ID NO: 2442011 - RNA, 15 nt, Bordetella pertussis
ugcccgccacccagg

SEQ ID NO: 2442012 - RNA, 17 nt, Bordetella pertussis
ugcccgccccgugcacc

SEQ ID NO: 2442013 - RNA, 16 nt, Bordetella pertussis
ugcccgcccgacgagg

SEQ ID NO: 2442014 - RNA, 23 nt, Bordetella pertussis
ugcccgcccgacgaggagccggc

SEQ ID NO: 2442015 - RNA, 20 nt, Bordetella pertussis
ugcccgccgccgcccacgcc

SEQ ID NO: 2442016 - RNA, 18 nt, Bordetella pertussis
ugcccgccggcacccggc

SEQ ID NO: 2442017 - RNA, 21 nt, Bordetella pertussis
ugcccgccuggucgcuggcgc

SEQ ID NO: 2442018 - RNA, 18 nt, Bordetella pertussis
ugcccgcgcaccaggcgc

SEQ ID NO: 2442019 - RNA, 21 nt, Bordetella pertussis
ugcccgcgcaccaggcgcggc

SEQ ID NO: 2442020 - RNA, 15 nt, Bordetella pertussis
ugcccgcgguccagc

SEQ ID NO: 2442021 - RNA, 18 nt, Bordetella pertussis
ugcccgcgguccagcacg

SEQ ID NO: 2442022 - RNA, 22 nt, Bordetella pertussis
ugcccgcgguccagcacggcga

SEQ ID NO: 2442023 - RNA, 19 nt, Bordetella pertussis
ugcccgcggucgagacgau

SEQ ID NO: 2442024 - RNA, 24 nt, Bordetella pertussis
ugcccgcggucgagacgauggccg

SEQ ID NO: 2442025 - RNA, 18 nt, Bordetella pertussis
ugcccgcuggccaugccg

SEQ ID NO: 2442026 - RNA, 14 nt, Bordetella pertussis
ugcccggcaggcac

SEQ ID NO: 2442027 - RNA, 22 nt, Bordetella pertussis
ugcccggcaggcacacgaccgg

SEQ ID NO: 2442028 - RNA, 19 nt, Bordetella pertussis
ugcccgggcaccagguccu

SEQ ID NO: 2442029 - RNA, 15 nt, Bordetella pertussis
ugcccgggcagcacc

SEQ ID NO: 2442030 - RNA, 23 nt, Bordetella pertussis
ugcccgggcuggccgccugcugc

SEQ ID NO: 2442031 - RNA, 17 nt, Bordetella pertussis
ugcccgguucugcggcg

SEQ ID NO: 2442032 - RNA, 20 nt, Bordetella pertussis
ugcccgguucugcggcgcgu

SEQ ID NO: 2442033 - RNA, 21 nt, Bordetella pertussis
ugcccguacgucaaggccugc

SEQ ID NO: 2442034 - RNA, 20 nt, Bordetella pertussis
ugcccgugccuugccggccg

SEQ ID NO: 2442035 - RNA, 19 nt, Bordetella pertussis
ugcccguucacgcgcagcg

SEQ ID NO: 2442036 - RNA, 20 nt, Bordetella pertussis
ugcccguucacgcgcagcgu

SEQ ID NO: 2442037 - RNA, 17 nt, Bordetella pertussis
ugcccguugccgcgcgc

SEQ ID NO: 2442038 - RNA, 18 nt, Bordetella pertussis
ugcccguugccgcgcgcg

SEQ ID NO: 2442039 - RNA, 17 nt, Bordetella pertussis
ugcccuacgacacgcuc

SEQ ID NO: 2442040 - RNA, 22 nt, Bordetella pertussis
ugcccucccagaaacuggcgcu

SEQ ID NO: 2442041 - RNA, 17 nt, Bordetella pertussis
ugcccuccucggccagg

SEQ ID NO: 2442042 - RNA, 23 nt, Bordetella pertussis
ugcccuccucggccaggucgcgc

SEQ ID NO: 2442043 - RNA, 20 nt, Bordetella pertussis
ugcccucgggaaacaggccc

SEQ ID NO: 2442044 - RNA, 16 nt, Bordetella pertussis
ugcccucgggcgacag

SEQ ID NO: 2442045 - RNA, 19 nt, Bordetella pertussis
ugcccucgggcgacaggcg

SEQ ID NO: 2442046 - RNA, 22 nt, Bordetella pertussis
ugcccucgggcgacaggcgcgc

SEQ ID NO: 2442047 - RNA, 16 nt, Bordetella pertussis
ugcccucggucagcgc

SEQ ID NO: 2442048 - RNA, 19 nt, Bordetella pertussis
ugcccucuucggcggccag

SEQ ID NO: 2442049 - RNA, 20 nt, Bordetella pertussis
ugcccucuucggcggccagc

SEQ ID NO: 2442050 - RNA, 13 nt, Bordetella pertussis
ugcccugcgccag

SEQ ID NO: 2442051 - RNA, 14 nt, Bordetella pertussis
ugcccugcggaccc

SEQ ID NO: 2442052 - RNA, 12 nt, Bordetella pertussis
ugcccugcggcg

SEQ ID NO: 2442053 - RNA, 16 nt, Bordetella pertussis
ugcccugcggcgcggc

SEQ ID NO: 2442054 - RNA, 18 nt, Bordetella pertussis
ugcccugcggcgcggcca

SEQ ID NO: 2442055 - RNA, 22 nt, Bordetella pertussis
ugcccugcggcuugggcccggc

SEQ ID NO: 2442056 - RNA, 15 nt, Bordetella pertussis
ugcccugcgugugcc

SEQ ID NO: 2442057 - RNA, 22 nt, Bordetella pertussis
ugcccuggaucaggaugggcgc

SEQ ID NO: 2442058 - RNA, 12 nt, Bordetella pertussis
ugcccuggaugg

SEQ ID NO: 2442059 - RNA, 16 nt, Bordetella pertussis
ugcccuggauggccug

SEQ ID NO: 2442060 - RNA, 17 nt, Bordetella pertussis
ugcccuggauggccugg

SEQ ID NO: 2442061 - RNA, 13 nt, Bordetella pertussis
ugcccuggccacg

SEQ ID NO: 2442062 - RNA, 13 nt, Bordetella pertussis
ugcccuggcccag

SEQ ID NO: 2442063 - RNA, 13 nt, Bordetella pertussis
ugcccuggcgcug

SEQ ID NO: 2442064 - RNA, 14 nt, Bordetella pertussis
ugcccuucgcggcu

SEQ ID NO: 2442065 - RNA, 15 nt, Bordetella pertussis
ugcccuucgcggcug

SEQ ID NO: 2442066 - RNA, 17 nt, Bordetella pertussis
ugcccuugagcgugggc

SEQ ID NO: 2442067 - RNA, 23 nt, Bordetella pertussis
ugcccuugcucccaguucugcag

SEQ ID NO: 2442068 - RNA, 17 nt, Bordetella pertussis
ugcccuuugcagccaga

SEQ ID NO: 2442069 - RNA, 17 nt, Bordetella pertussis
ugccgaaaggggcugcc

SEQ ID NO: 2442070 - RNA, 13 nt, Bordetella pertussis
ugccgaacagcau

SEQ ID NO: 2442071 - RNA, 15 nt, Bordetella pertussis
ugccgaacucgcgcu

SEQ ID NO: 2442072 - RNA, 18 nt, Bordetella pertussis
ugccgaacugucgcgcca

SEQ ID NO: 2442073 - RNA, 19 nt, Bordetella pertussis
ugccgaacugucgcgccac

SEQ ID NO: 2442074 - RNA, 21 nt, Bordetella pertussis
ugccgaagaaauagcccgcgg

SEQ ID NO: 2442075 - RNA, 14 nt, Bordetella pertussis
ugccgaagcgcgcg

SEQ ID NO: 2442076 - RNA, 15 nt, Bordetella pertussis
ugccgaagcgcgcgu

SEQ ID NO: 2442077 - RNA, 20 nt, Bordetella pertussis
ugccgaagcgcgcgugcagg

SEQ ID NO: 2442078 - RNA, 22 nt, Bordetella pertussis
ugccgaaggguugcaguucgcc

SEQ ID NO: 2442079 - RNA, 19 nt, Bordetella pertussis
ugccgaaucggccccugcc

SEQ ID NO: 2442080 - RNA, 20 nt, Bordetella pertussis
ugccgaccaccagcaccgau

SEQ ID NO: 2442081 - RNA, 13 nt, Bordetella pertussis
ugccgaccagcac

SEQ ID NO: 2442082 - RNA, 17 nt, Bordetella pertussis
ugccgaccaggcccgcc

SEQ ID NO: 2442083 - RNA, 15 nt, Bordetella pertussis
ugccgaccaggcugc

SEQ ID NO: 2442084 - RNA, 21 nt, Bordetella pertussis
ugccgaccaggcugcgcgccg

SEQ ID NO: 2442085 - RNA, 16 nt, Bordetella pertussis
ugccgaccuccaggcc

SEQ ID NO: 2442086 - RNA, 19 nt, Bordetella pertussis
ugccgaccuccaggcccag

SEQ ID NO: 2442087 - RNA, 20 nt, Bordetella pertussis
ugccgaccuccaggcccagg

SEQ ID NO: 2442088 - RNA, 16 nt, Bordetella pertussis
ugccgacgaugccgcc

SEQ ID NO: 2442089 - RNA, 20 nt, Bordetella pertussis
ugccgacgaugccgccgccg

SEQ ID NO: 2442090 - RNA, 21 nt, Bordetella pertussis
ugccgacggauucgcccaggg

SEQ ID NO: 2442091 - RNA, 12 nt, Bordetella pertussis
ugccgacggcgc

SEQ ID NO: 2442092 - RNA, 14 nt, Bordetella pertussis
ugccgacggcgcgg

SEQ ID NO: 2442093 - RNA, 15 nt, Bordetella pertussis
ugccgacggcgcggg

SEQ ID NO: 2442094 - RNA, 14 nt, Bordetella pertussis
ugccgauccagcgc

SEQ ID NO: 2442095 - RNA, 20 nt, Bordetella pertussis
ugccgauccagcgccugggg

SEQ ID NO: 2442096 - RNA, 13 nt, Bordetella pertussis
ugccgaucggcgu

SEQ ID NO: 2442097 - RNA, 16 nt, Bordetella pertussis
ugccgaugauggccau

SEQ ID NO: 2442098 - RNA, 11 nt, Bordetella pertussis
ugccgaugccg

SEQ ID NO: 2442099 - RNA, 22 nt, Bordetella pertussis
ugccgaugcgguaggcccagca

SEQ ID NO: 2442100 - RNA, 20 nt, Bordetella pertussis
ugccgauguuguuggccgcc

SEQ ID NO: 2442101 - RNA, 21 nt, Bordetella pertussis
ugccgauguuguuggccgcca

SEQ ID NO: 2442102 - RNA, 16 nt, Bordetella pertussis
ugccgauugugcauga

SEQ ID NO: 2442103 - RNA, 21 nt, Bordetella pertussis
ugccgauugugcaugacggcc

SEQ ID NO: 2442104 - RNA, 17 nt, Bordetella pertussis
ugccgcacgaucgcgcc

SEQ ID NO: 2442105 - RNA, 22 nt, Bordetella pertussis
ugccgcacgaucgcgccggccu

SEQ ID NO: 2442106 - RNA, 18 nt, Bordetella pertussis
ugccgcacgguggcgccg

SEQ ID NO: 2442107 - RNA, 17 nt, Bordetella pertussis
ugccgcagauggccagc

SEQ ID NO: 2442108 - RNA, 12 nt, Bordetella pertussis
ugccgcagcacc

SEQ ID NO: 2442109 - RNA, 15 nt, Bordetella pertussis
ugccgcagcccgcgc

SEQ ID NO: 2442110 - RNA, 20 nt, Bordetella pertussis
ugccgcagcccgcgcgccug

SEQ ID NO: 2442111 - RNA, 13 nt, Bordetella pertussis
ugccgcagcggcc

SEQ ID NO: 2442112 - RNA, 15 nt, Bordetella pertussis
ugccgcagcggccau

SEQ ID NO: 2442113 - RNA, 23 nt, Bordetella pertussis
ugccgcagcggggacaggcgccc

SEQ ID NO: 2442114 - RNA, 12 nt, Bordetella pertussis
ugccgcaggcca

SEQ ID NO: 2442115 - RNA, 15 nt, Bordetella pertussis
ugccgcaggccagcc

SEQ ID NO: 2442116 - RNA, 20 nt, Bordetella pertussis
ugccgcaggccagcccgcgc

SEQ ID NO: 2442117 - RNA, 17 nt, Bordetella pertussis
ugccgcaguugaacacg

SEQ ID NO: 2442118 - RNA, 15 nt, Bordetella pertussis
ugccgcaucccgccc

SEQ ID NO: 2442119 - RNA, 19 nt, Bordetella pertussis
ugccgcaucccgcccccgc

SEQ ID NO: 2442120 - RNA, 16 nt, Bordetella pertussis
ugccgccaacgcggcg

SEQ ID NO: 2442121 - RNA, 19 nt, Bordetella pertussis
ugccgccaacgcggcgcgu

SEQ ID NO: 2442122 - RNA, 22 nt, Bordetella pertussis
ugccgccaagggcgcgccagca

SEQ ID NO: 2442123 - RNA, 22 nt, Bordetella pertussis
ugccgccacgggcccgcgcaga

SEQ ID NO: 2442124 - RNA, 12 nt, Bordetella pertussis
ugccgccaggca

SEQ ID NO: 2442125 - RNA, 16 nt, Bordetella pertussis
ugccgccaugcgccag

SEQ ID NO: 2442126 - RNA, 17 nt, Bordetella pertussis
ugccgccaugcgccagc

SEQ ID NO: 2442127 - RNA, 18 nt, Bordetella pertussis
ugccgccaugcgccagca

SEQ ID NO: 2442128 - RNA, 20 nt, Bordetella pertussis
ugccgcccaccgugaccagc

SEQ ID NO: 2442129 - RNA, 17 nt, Bordetella pertussis
ugccgcccacugccagg

SEQ ID NO: 2442130 - RNA, 11 nt, Bordetella pertussis
ugccgcccagc

SEQ ID NO: 2442131 - RNA, 19 nt, Bordetella pertussis
ugccgcccagcaugcgcgc

SEQ ID NO: 2442132 - RNA, 21 nt, Bordetella pertussis
ugccgcccagcaugcgcgcga

SEQ ID NO: 2442133 - RNA, 21 nt, Bordetella pertussis
ugccgcccaggucggacgcgc

SEQ ID NO: 2442134 - RNA, 19 nt, Bordetella pertussis
ugccgcccgagcuggccgg

SEQ ID NO: 2442135 - RNA, 16 nt, Bordetella pertussis
ugccgcccgcaaggac

SEQ ID NO: 2442136 - RNA, 21 nt, Bordetella pertussis
ugccgcccgcaugcagguccu

SEQ ID NO: 2442137 - RNA, 21 nt, Bordetella pertussis
ugccgccgaaccagcgcacca

SEQ ID NO: 2442138 - RNA, 15 nt, Bordetella pertussis
ugccgccgagcaggg

SEQ ID NO: 2442139 - RNA, 19 nt, Bordetella pertussis
ugccgccgaugugcggcgu

SEQ ID NO: 2442140 - RNA, 14 nt, Bordetella pertussis
ugccgccgcccgac

SEQ ID NO: 2442141 - RNA, 18 nt, Bordetella pertussis
ugccgccgcccgacagca

SEQ ID NO: 2442142 - RNA, 16 nt, Bordetella pertussis
ugccgccgccgcgcgc

SEQ ID NO: 2442143 - RNA, 19 nt, Bordetella pertussis
ugccgccgccgcgcgcggc

SEQ ID NO: 2442144 - RNA, 13 nt, Bordetella pertussis
ugccgccgccggc

SEQ ID NO: 2442145 - RNA, 15 nt, Bordetella pertussis
ugccgccgccggcgc

SEQ ID NO: 2442146 - RNA, 17 nt, Bordetella pertussis
ugccgccgccggcgcgg

SEQ ID NO: 2442147 - RNA, 12 nt, Bordetella pertussis
ugccgccgcgca

SEQ ID NO: 2442148 - RNA, 16 nt, Bordetella pertussis
ugccgccgcgcagccg

SEQ ID NO: 2442149 - RNA, 15 nt, Bordetella pertussis
ugccgccgcgcagga

SEQ ID NO: 2442150 - RNA, 17 nt, Bordetella pertussis
ugccgccgcugccggcc

SEQ ID NO: 2442151 - RNA, 18 nt, Bordetella pertussis
ugccgccgcugccggccg

SEQ ID NO: 2442152 - RNA, 23 nt, Bordetella pertussis
ugccgccgcugccggccgaccgg

SEQ ID NO: 2442153 - RNA, 13 nt, Bordetella pertussis
ugccgccggccag

SEQ ID NO: 2442154 - RNA, 14 nt, Bordetella pertussis
ugccgccggcgcgg

SEQ ID NO: 2442155 - RNA, 15 nt, Bordetella pertussis
ugccgccggcgcggc

SEQ ID NO: 2442156 - RNA, 17 nt, Bordetella pertussis
ugccgccggcgcggcug

SEQ ID NO: 2442157 - RNA, 21 nt, Bordetella pertussis
ugccgccggcgcggcugcugg

SEQ ID NO: 2442158 - RNA, 22 nt, Bordetella pertussis
ugccgccggcgcggcugcuggg

SEQ ID NO: 2442159 - RNA, 23 nt, Bordetella pertussis
ugccgccggcgcggcugcugggc

SEQ ID NO: 2442160 - RNA, 14 nt, Bordetella pertussis
ugccgccggcgggc

SEQ ID NO: 2442161 - RNA, 16 nt, Bordetella pertussis
ugccgccgugaugccg

SEQ ID NO: 2442162 - RNA, 19 nt, Bordetella pertussis
ugccgccgugaugccgccc

SEQ ID NO: 2442163 - RNA, 16 nt, Bordetella pertussis
ugccgccgugcgagca

SEQ ID NO: 2442164 - RNA, 20 nt, Bordetella pertussis
ugccgccuucgucgcgcacc

SEQ ID NO: 2442165 - RNA, 14 nt, Bordetella pertussis
ugccgcgaggcgca

SEQ ID NO: 2442166 - RNA, 23 nt, Bordetella pertussis
ugccgcgaggcgcaggccgacgc

SEQ ID NO: 2442167 - RNA, 20 nt, Bordetella pertussis
ugccgcgcaccugggcgucg

SEQ ID NO: 2442168 - RNA, 15 nt, Bordetella pertussis
ugccgcgcacgaugg

SEQ ID NO: 2442169 - RNA, 22 nt, Bordetella pertussis
ugccguagcccagguccagcgc

SEQ ID NO: 2442170 - RNA, 19 nt, Bordetella pertussis
ugccguagcgcguggccag

SEQ ID NO: 2442171 - RNA, 21 nt, Bordetella pertussis
ugccguagcgcguggccagca

SEQ ID NO: 2442172 - RNA, 17 nt, Bordetella pertussis
ugccguaggcgccggcc

SEQ ID NO: 2442173 - RNA, 20 nt, Bordetella pertussis
ugccguaggcgccggccuug

SEQ ID NO: 2442174 - RNA, 16 nt, Bordetella pertussis
ugccguaggguucgcc

SEQ ID NO: 2442175 - RNA, 19 nt, Bordetella pertussis
ugccguaggguucgccgcu

SEQ ID NO: 2442176 - RNA, 19 nt, Bordetella pertussis
ugccguccacgcccagcgc

SEQ ID NO: 2442177 - RNA, 13 nt, Bordetella pertussis
ugccguccagcgc

SEQ ID NO: 2442178 - RNA, 20 nt, Bordetella pertussis
ugccguccagcgcggcgcca

SEQ ID NO: 2442179 - RNA, 13 nt, Bordetella pertussis
ugccguccugcug

SEQ ID NO: 2442180 - RNA, 15 nt, Bordetella pertussis
ugccguccugcugcg

SEQ ID NO: 2442181 - RNA, 14 nt, Bordetella pertussis
ugccguccuggccg

SEQ ID NO: 2442182 - RNA, 15 nt, Bordetella pertussis
ugccguccuggcgac

SEQ ID NO: 2442183 - RNA, 21 nt, Bordetella pertussis
ugccguccuggcgaccggcgg

SEQ ID NO: 2442184 - RNA, 19 nt, Bordetella pertussis
ugccgucgagaaugacggu

SEQ ID NO: 2442185 - RNA, 15 nt, Bordetella pertussis
ugccgucgagcgcga

SEQ ID NO: 2442186 - RNA, 16 nt, Bordetella pertussis
ugccgucgagcgcggc

SEQ ID NO: 2442187 - RNA, 20 nt, Bordetella pertussis
ugccgucgccaaagcgcagc

SEQ ID NO: 2442188 - RNA, 21 nt, Bordetella pertussis
ugccgucgccaaagcgcagcg

SEQ ID NO: 2442189 - RNA, 14 nt, Bordetella pertussis
ugccgucgccgccc

SEQ ID NO: 2442190 - RNA, 16 nt, Bordetella pertussis
ugccgucgcgcaccac

SEQ ID NO: 2442191 - RNA, 14 nt, Bordetella pertussis
ugccgucggccagc

SEQ ID NO: 2442192 - RNA, 18 nt, Bordetella pertussis
ugccgucggccagcuugc

SEQ ID NO: 2442193 - RNA, 13 nt, Bordetella pertussis
ugccgucggccgc

SEQ ID NO: 2442194 - RNA, 13 nt, Bordetella pertussis
ugccgucggccug

SEQ ID NO: 2442195 - RNA, 14 nt, Bordetella pertussis
ugccgucggccugg

SEQ ID NO: 2442196 - RNA, 21 nt, Bordetella pertussis
ugccgucggcguugugccggc

SEQ ID NO: 2442197 - RNA, 15 nt, Bordetella pertussis
ugccgucuggcggca

SEQ ID NO: 2442198 - RNA, 13 nt, Bordetella pertussis
ugccgugcagaug

SEQ ID NO: 2442199 - RNA, 13 nt, Bordetella pertussis
ugccgugccagau

SEQ ID NO: 2442200 - RNA, 18 nt, Bordetella pertussis
ugccgugggacaggcacc

SEQ ID NO: 2442201 - RNA, 16 nt, Bordetella pertussis
ugccguuauauauaga

SEQ ID NO: 2442202 - RNA, 14 nt, Bordetella pertussis
ugccguucccgccg

SEQ ID NO: 2442203 - RNA, 14 nt, Bordetella pertussis
ugccguucgcgcug

SEQ ID NO: 2442204 - RNA, 15 nt, Bordetella pertussis
ugccguucggccagc

SEQ ID NO: 2442205 - RNA, 14 nt, Bordetella pertussis
ugccguugcccaga

SEQ ID NO: 2442206 - RNA, 20 nt, Bordetella pertussis
ugccguuucucaacccgccg

SEQ ID NO: 2442207 - RNA, 23 nt, Bordetella pertussis
ugccguuucucaacccgccggcc

SEQ ID NO: 2442208 - RNA, 14 nt, Bordetella pertussis
ugccuauuggcugu

SEQ ID NO: 2442209 - RNA, 19 nt, Bordetella pertussis
ugccucaacuggccggccu

SEQ ID NO: 2442210 - RNA, 21 nt, Bordetella pertussis
ugccucaacuggccggccugg

SEQ ID NO: 2442211 - RNA, 11 nt, Bordetella pertussis
ugccucagguc

SEQ ID NO: 2442212 - RNA, 14 nt, Bordetella pertussis
ugccuccaggcgca

SEQ ID NO: 2442213 - RNA, 14 nt, Bordetella pertussis
ugccucgcggcagu

SEQ ID NO: 2442214 - RNA, 22 nt, Bordetella pertussis
ugccucguucaugucgcgggug

SEQ ID NO: 2442215 - RNA, 15 nt, Bordetella pertussis
ugccugacgugcgcc

SEQ ID NO: 2442216 - RNA, 22 nt, Bordetella pertussis
ugccugacgugcgccacagcau

SEQ ID NO: 2442217 - RNA, 16 nt, Bordetella pertussis
ugccugagcaccgccg

SEQ ID NO: 2442218 - RNA, 17 nt, Bordetella pertussis
ugccugagcaccgccgc

SEQ ID NO: 2442219 - RNA, 22 nt, Bordetella pertussis
ugccugagcaccgccgcguccu

SEQ ID NO: 2442220 - RNA, 15 nt, Bordetella pertussis
ugccugauggcgcgu

SEQ ID NO: 2442221 - RNA, 16 nt, Bordetella pertussis
ugccugauggcgcgug

SEQ ID NO: 2442222 - RNA, 13 nt, Bordetella pertussis
ugccugcagcgcg

SEQ ID NO: 2442223 - RNA, 20 nt, Bordetella pertussis
ugccugccccugcggggaca

SEQ ID NO: 2442224 - RNA, 13 nt, Bordetella pertussis
ugccugccggccg

SEQ ID NO: 2442225 - RNA, 16 nt, Bordetella pertussis
ugccugccggccggcc

SEQ ID NO: 2442226 - RNA, 19 nt, Bordetella pertussis
ugccugccggccggccagu

SEQ ID NO: 2442227 - RNA, 17 nt, Bordetella pertussis
ugccugcgaugccggcg

SEQ ID NO: 2442228 - RNA, 18 nt, Bordetella pertussis
ugccugcgaugccggcgu

SEQ ID NO: 2442229 - RNA, 20 nt, Bordetella pertussis
ugccugcgaugccggcgugg

SEQ ID NO: 2442230 - RNA, 19 nt, Bordetella pertussis
ugccugcuuguacaggcgc

SEQ ID NO: 2442231 - RNA, 16 nt, Bordetella pertussis
ugccuggacgcgcugg

SEQ ID NO: 2442232 - RNA, 18 nt, Bordetella pertussis
ugccuggcuccccgggca

SEQ ID NO: 2442233 - RNA, 17 nt, Bordetella pertussis
ugccugggugcuggugc

SEQ ID NO: 2442234 - RNA, 14 nt, Bordetella pertussis
ugccugucccaacc

SEQ ID NO: 2442235 - RNA, 15 nt, Bordetella pertussis
ugccugucccaaucc

SEQ ID NO: 2442236 - RNA, 13 nt, Bordetella pertussis
ugccuguccccac

SEQ ID NO: 2442237 - RNA, 18 nt, Bordetella pertussis
ugccuguccccacagggg

SEQ ID NO: 2442238 - RNA, 24 nt, Bordetella pertussis
ugccuguccccaccgggacaggca

SEQ ID NO: 2442239 - RNA, 20 nt, Bordetella pertussis
ugccuguccccacggggaca

SEQ ID NO: 2442240 - RNA, 20 nt, Bordetella pertussis
ugccuguccccacguggaca

SEQ ID NO: 2442241 - RNA, 24 nt, Bordetella pertussis
ugccuguccccacguggacaggca

SEQ ID NO: 2442242 - RNA, 17 nt, Bordetella pertussis
ugccuguccccacuggg

SEQ ID NO: 2442243 - RNA, 20 nt, Bordetella pertussis
ugccuguccccacuggggga

SEQ ID NO: 2442244 - RNA, 21 nt, Bordetella pertussis
ugccuguccccacugggggac

SEQ ID NO: 2442245 - RNA, 14 nt, Bordetella pertussis
ugccuguccccgaa

SEQ ID NO: 2442246 - RNA, 17 nt, Bordetella pertussis
ugccuguccccgaacgg

SEQ ID NO: 2442247 - RNA, 19 nt, Bordetella pertussis
ugccuguccccgcacgggg

SEQ ID NO: 2442248 - RNA, 22 nt, Bordetella pertussis
ugccuguccccgcacggggaca

SEQ ID NO: 2442249 - RNA, 19 nt, Bordetella pertussis
ugccuguccccgcagggac

SEQ ID NO: 2442250 - RNA, 20 nt, Bordetella pertussis
ugccuguccccgcagggaca

SEQ ID NO: 2442251 - RNA, 18 nt, Bordetella pertussis
ugccuguccccgcuggga

SEQ ID NO: 2442252 - RNA, 20 nt, Bordetella pertussis
ugccuguccccgcugggaca

SEQ ID NO: 2442253 - RNA, 16 nt, Bordetella pertussis
ugccuguccccguggg

SEQ ID NO: 2442254 - RNA, 20 nt, Bordetella pertussis
ugccugucccggcugggaca

SEQ ID NO: 2442255 - RNA, 14 nt, Bordetella pertussis
ugccuguucccgcc

SEQ ID NO: 2442256 - RNA, 20 nt, Bordetella pertussis
ugccuguucccgccgggcca

SEQ ID NO: 2442257 - RNA, 13 nt, Bordetella pertussis
ugccuucgacggc

SEQ ID NO: 2442258 - RNA, 15 nt, Bordetella pertussis
ugccuucgacggcgg

SEQ ID NO: 2442259 - RNA, 16 nt, Bordetella pertussis
ugccuucgacggcggg

SEQ ID NO: 2442260 - RNA, 15 nt, Bordetella pertussis
ugccuugcgcggcca

SEQ ID NO: 2442261 - RNA, 16 nt, Bordetella pertussis
ugccuugcggcgccgu

SEQ ID NO: 2442262 - RNA, 22 nt, Bordetella pertussis
ugccuugggcaaaaaaagaggc

SEQ ID NO: 2442263 - RNA, 13 nt, Bordetella pertussis
ugccuuggggcgg

SEQ ID NO: 2442264 - RNA, 15 nt, Bordetella pertussis
ugccuuggggcggcc

SEQ ID NO: 2442265 - RNA, 20 nt, Bordetella pertussis
ugcgaaaaagcccgcgccac

SEQ ID NO: 2442266 - RNA, 19 nt, Bordetella pertussis
ugcgaaacccgcugggcca

SEQ ID NO: 2442267 - RNA, 21 nt, Bordetella pertussis
ugcgaaacccgcugggccagc

SEQ ID NO: 2442268 - RNA, 18 nt, Bordetella pertussis
ugcgaaagccggccuccg

SEQ ID NO: 2442269 - RNA, 15 nt, Bordetella pertussis
ugcgaaagcggccag

SEQ ID NO: 2442270 - RNA, 16 nt, Bordetella pertussis
ugcgaaagcggccagc

SEQ ID NO: 2442271 - RNA, 13 nt, Bordetella pertussis
ugcgaaaggccga

SEQ ID NO: 2442272 - RNA, 15 nt, Bordetella pertussis
ugcgaaaggccgagc

SEQ ID NO: 2442273 - RNA, 21 nt, Bordetella pertussis
ugcgaacccgccgcgaucagc

SEQ ID NO: 2442274 - RNA, 14 nt, Bordetella pertussis
ugcgaacggccgcc

SEQ ID NO: 2442275 - RNA, 21 nt, Bordetella pertussis
ugcgaaugccauacguccuuu

SEQ ID NO: 2442276 - RNA, 14 nt, Bordetella pertussis
ugcgacagcagcau

SEQ ID NO: 2442277 - RNA, 20 nt, Bordetella pertussis
ugcgacagcagcaugcggcc

SEQ ID NO: 2442278 - RNA, 20 nt, Bordetella pertussis
ugcgacagcagggccaggcc

SEQ ID NO: 2442279 - RNA, 17 nt, Bordetella pertussis
ugcgacagcgacagcca

SEQ ID NO: 2442280 - RNA, 20 nt, Bordetella pertussis
ugcgacagcgacagccaggc

SEQ ID NO: 2442281 - RNA, 15 nt, Bordetella pertussis
ugcgacaugagcugc

SEQ ID NO: 2442282 - RNA, 18 nt, Bordetella pertussis
ugcgcggcgcucagagcc

SEQ ID NO: 2442283 - RNA, 22 nt, Bordetella pertussis
ugcgcggcgggaccgugccgcc

SEQ ID NO: 2442284 - RNA, 19 nt, Bordetella pertussis
ugcgcggcgggacggccau

SEQ ID NO: 2442285 - RNA, 13 nt, Bordetella pertussis
ugcgcggcgggcu

SEQ ID NO: 2442286 - RNA, 15 nt, Bordetella pertussis
ugcgcggcggugccg

SEQ ID NO: 2442287 - RNA, 19 nt, Bordetella pertussis
ugcgcggcguguagagcug

SEQ ID NO: 2442288 - RNA, 12 nt, Bordetella pertussis
ugcgcgggcgcc

SEQ ID NO: 2442289 - RNA, 16 nt, Bordetella pertussis
ugcgcgggcgcggcag

SEQ ID NO: 2442290 - RNA, 14 nt, Bordetella pertussis
ugcgcgggcgcggg

SEQ ID NO: 2442291 - RNA, 22 nt, Bordetella pertussis
ugcgcgggcgcgggcugucgca

SEQ ID NO: 2442292 - RNA, 13 nt, Bordetella pertussis
ugcgcggggccag

SEQ ID NO: 2442293 - RNA, 15 nt, Bordetella pertussis
ugcgcggggccaggc

SEQ ID NO: 2442294 - RNA, 16 nt, Bordetella pertussis
ugcgcggggccaggcg

SEQ ID NO: 2442295 - RNA, 19 nt, Bordetella pertussis
ugcgcggucacaucugucc

SEQ ID NO: 2442296 - RNA, 16 nt, Bordetella pertussis
ugcgcgguucaggcuu

SEQ ID NO: 2442297 - RNA, 18 nt, Bordetella pertussis
ugcgcguacguggcgcgg

SEQ ID NO: 2442298 - RNA, 15 nt, Bordetella pertussis
ugcgcguaggcgcgc

SEQ ID NO: 2442299 - RNA, 16 nt, Bordetella pertussis
ugcgcguaggcgcgcg

SEQ ID NO: 2442300 - RNA, 17 nt, Bordetella pertussis
ugcgcguaggcgcgcgc

SEQ ID NO: 2442301 - RNA, 16 nt, Bordetella pertussis
ugcgcguauccagcau

SEQ ID NO: 2442302 - RNA, 18 nt, Bordetella pertussis
ugcgcgucaggcgagcgc

SEQ ID NO: 2442303 - RNA, 22 nt, Bordetella pertussis
ugcgcgucaggcgagcgcggcg

SEQ ID NO: 2442304 - RNA, 15 nt, Bordetella pertussis
ugcgcguccaggcca

SEQ ID NO: 2442305 - RNA, 17 nt, Bordetella pertussis
ugcgcguccaggcgguc

SEQ ID NO: 2442306 - RNA, 16 nt, Bordetella pertussis
ugcgcguccuggcgcg

SEQ ID NO: 2442307 - RNA, 17 nt, Bordetella pertussis
ugcgcguccuggcgcga

SEQ ID NO: 2442308 - RNA, 18 nt, Bordetella pertussis
ugcgcguccuggcgcgag

SEQ ID NO: 2442309 - RNA, 19 nt, Bordetella pertussis
ugcgcguccuggcgcgaga

SEQ ID NO: 2442310 - RNA, 16 nt, Bordetella pertussis
ugcgcguccugggccg

SEQ ID NO: 2442311 - RNA, 15 nt, Bordetella pertussis
ugcgcgucuccagcg

SEQ ID NO: 2442312 - RNA, 17 nt, Bordetella pertussis
ugcgcgucuccagcgcc

SEQ ID NO: 2442313 - RNA, 18 nt, Bordetella pertussis
ugcgcgucuccagcgccg

SEQ ID NO: 2442314 - RNA, 12 nt, Bordetella pertussis
ugcgcgugacga

SEQ ID NO: 2442315 - RNA, 19 nt, Bordetella pertussis
ugcgcgugacgauauccag

SEQ ID NO: 2442316 - RNA, 20 nt, Bordetella pertussis
ugcgcgugggcacccggccg

SEQ ID NO: 2442317 - RNA, 21 nt, Bordetella pertussis
ugcgcguuccggccgcgccag

SEQ ID NO: 2442318 - RNA, 14 nt, Bordetella pertussis
ugcgcucgcccagc

SEQ ID NO: 2442319 - RNA, 19 nt, Bordetella pertussis
ugcgcucggucauguccag

SEQ ID NO: 2442320 - RNA, 20 nt, Bordetella pertussis
ugcgcucgguguggauggcg

SEQ ID NO: 2442321 - RNA, 22 nt, Bordetella pertussis
ugcgcucgguguggauggcggu

SEQ ID NO: 2442322 - RNA, 12 nt, Bordetella pertussis
ugcgcugcccgu

SEQ ID NO: 2442323 - RNA, 15 nt, Bordetella pertussis
ugcgcugcccgucgc

SEQ ID NO: 2442324 - RNA, 15 nt, Bordetella pertussis
ugcgcugcucgucca

SEQ ID NO: 2442325 - RNA, 18 nt, Bordetella pertussis
ugcgcugcuggaggccgg

SEQ ID NO: 2442326 - RNA, 17 nt, Bordetella pertussis
ugcgcugcugucgcgcu

SEQ ID NO: 2442327 - RNA, 19 nt, Bordetella pertussis
ugcgcuggaauauggcguc

SEQ ID NO: 2442328 - RNA, 14 nt, Bordetella pertussis
ugcgcuggccggcc

SEQ ID NO: 2442329 - RNA, 13 nt, Bordetella pertussis
ugcgcuggcuggg

SEQ ID NO: 2442330 - RNA, 16 nt, Bordetella pertussis
ugcgcuggcugggccu

SEQ ID NO: 2442331 - RNA, 20 nt, Bordetella pertussis
ugcgcuggcugggccugcug

SEQ ID NO: 2442332 - RNA, 12 nt, Bordetella pertussis
ugcgcugggcau

SEQ ID NO: 2442333 - RNA, 19 nt, Bordetella pertussis
ugcgcugggcaugggcggc

SEQ ID NO: 2442334 - RNA, 14 nt, Bordetella pertussis
ugcgcugggccagg

SEQ ID NO: 2442335 - RNA, 16 nt, Bordetella pertussis
ugcgcugggccaggcc

SEQ ID NO: 2442336 - RNA, 15 nt, Bordetella pertussis
ugcgcuggucgcgca

SEQ ID NO: 2442337 - RNA, 16 nt, Bordetella pertussis
ugcgcuggucgcgcag

SEQ ID NO: 2442338 - RNA, 15 nt, Bordetella pertussis
ugcgcuugaccgccu

SEQ ID NO: 2442339 - RNA, 16 nt, Bordetella pertussis
ugcgcuugucgccgcu

SEQ ID NO: 2442340 - RNA, 18 nt, Bordetella pertussis
ugcgcuuuuuucuccagc

SEQ ID NO: 2442341 - RNA, 23 nt, Bordetella pertussis
ugcgcuuuuuucuccagcgccag

SEQ ID NO: 2442342 - RNA, 19 nt, Bordetella pertussis
ugcggacacugacguggau

SEQ ID NO: 2442343 - RNA, 22 nt, Bordetella pertussis
ugcggaccagcgguugcgccag

SEQ ID NO: 2442344 - RNA, 21 nt, Bordetella pertussis
ugcggacccaguucggccgcc

SEQ ID NO: 2442345 - RNA, 22 nt, Bordetella pertussis
ugcggacccaguucggccgcca

SEQ ID NO: 2442346 - RNA, 15 nt, Bordetella pertussis
ugcggacgcgugugc

SEQ ID NO: 2442347 - RNA, 16 nt, Bordetella pertussis
ugcggacggcgggcgc

SEQ ID NO: 2442348 - RNA, 14 nt, Bordetella pertussis
ugcggacgggccag

SEQ ID NO: 2442349 - RNA, 15 nt, Bordetella pertussis
ugcggaggcggccgc

SEQ ID NO: 2442350 - RNA, 21 nt, Bordetella pertussis
ugcggauacgaaaccaggccg

SEQ ID NO: 2442351 - RNA, 19 nt, Bordetella pertussis
ugcggaucaagcggcccgc

SEQ ID NO: 2442352 - RNA, 18 nt, Bordetella pertussis
ugcggcacaaccuggcgc

SEQ ID NO: 2442353 - RNA, 22 nt, Bordetella pertussis
ugcggcacaaccuggcgcgcgg

SEQ ID NO: 2442354 - RNA, 21 nt, Bordetella pertussis
ugcggcaccucggccggggcg

SEQ ID NO: 2442355 - RNA, 14 nt, Bordetella pertussis
ugcggcaccugcug

SEQ ID NO: 2442356 - RNA, 16 nt, Bordetella pertussis
ugcggcaccugcugcu

SEQ ID NO: 2442357 - RNA, 23 nt, Bordetella pertussis
ugcggcaccugcugcuugaccuu

SEQ ID NO: 2442358 - RNA, 20 nt, Bordetella pertussis
ugcggcacgaucggcgccug

SEQ ID NO: 2442359 - RNA, 22 nt, Bordetella pertussis
ugcggcacgcacagcaugcgcu

SEQ ID NO: 2442360 - RNA, 14 nt, Bordetella pertussis
ugcggcacggccag

SEQ ID NO: 2442361 - RNA, 17 nt, Bordetella pertussis
ugcggcacggcuggguu

SEQ ID NO: 2442362 - RNA, 14 nt, Bordetella pertussis
ugcggcacgugccg

SEQ ID NO: 2442363 - RNA, 17 nt, Bordetella pertussis
ugcggcacgugccggau

SEQ ID NO: 2442364 - RNA, 16 nt, Bordetella pertussis
ugcggcagcagggcca

SEQ ID NO: 2442365 - RNA, 19 nt, Bordetella pertussis
ugcggcagcagggccacgc

SEQ ID NO: 2442366 - RNA, 21 nt, Bordetella pertussis
ugcggcagcagggccacgccc

SEQ ID NO: 2442367 - RNA, 12 nt, Bordetella pertussis
ugcggcagcgcc

SEQ ID NO: 2442368 - RNA, 13 nt, Bordetella pertussis
ugcggcagcgccg

SEQ ID NO: 2442369 - RNA, 14 nt, Bordetella pertussis
ugcggcagcgccgc

SEQ ID NO: 2442370 - RNA, 17 nt, Bordetella pertussis
ugcggcagcgccgcaac

SEQ ID NO: 2442371 - RNA, 14 nt, Bordetella pertussis
ugcggcaggccgca

SEQ ID NO: 2442372 - RNA, 19 nt, Bordetella pertussis
ugcggcaggugcgucacgc

SEQ ID NO: 2442373 - RNA, 12 nt, Bordetella pertussis
ugcggccaggcg

SEQ ID NO: 2442374 - RNA, 16 nt, Bordetella pertussis
ugcggccaggcggggu

SEQ ID NO: 2442375 - RNA, 22 nt, Bordetella pertussis
ugcggccccggcaccaucgccg

SEQ ID NO: 2442376 - RNA, 23 nt, Bordetella pertussis
ugcggcccgcgcuguugcuccag

SEQ ID NO: 2442377 - RNA, 22 nt, Bordetella pertussis
ugcggccgccacccaggcggca

SEQ ID NO: 2442378 - RNA, 14 nt, Bordetella pertussis
ugcggccgccgaac

SEQ ID NO: 2442379 - RNA, 20 nt, Bordetella pertussis
ugcggccggugaucuugccg

SEQ ID NO: 2442380 - RNA, 17 nt, Bordetella pertussis
ugcggccgucgccgccc

SEQ ID NO: 2442381 - RNA, 19 nt, Bordetella pertussis
ugcggccgugcgccagcgc

SEQ ID NO: 2442382 - RNA, 20 nt, Bordetella pertussis
ugcggccgugcgccagcgcc

SEQ ID NO: 2442383 - RNA, 21 nt, Bordetella pertussis
ugcggccguugcuccagccag

SEQ ID NO: 2442384 - RNA, 17 nt, Bordetella pertussis
ugcggccuucgccggug

SEQ ID NO: 2442385 - RNA, 22 nt, Bordetella pertussis
ugcggcgaugcacccaggcgcc

SEQ ID NO: 2442386 - RNA, 20 nt, Bordetella pertussis
ugcggcgauuucuacgccga

SEQ ID NO: 2442387 - RNA, 19 nt, Bordetella pertussis
ugcggcgcaugcugcgcga

SEQ ID NO: 2442388 - RNA, 17 nt, Bordetella pertussis
ugcggcgccacgcagaa

SEQ ID NO: 2442389 - RNA, 18 nt, Bordetella pertussis
ugcggcgccacugccagg

SEQ ID NO: 2442390 - RNA, 11 nt, Bordetella pertussis
ugcggcgccag

SEQ ID NO: 2442391 - RNA, 14 nt, Bordetella pertussis
ugcggcgccagcgc

SEQ ID NO: 2442392 - RNA, 19 nt, Bordetella pertussis
ugcggcgccagcugggcga

SEQ ID NO: 2442393 - RNA, 14 nt, Bordetella pertussis
ugcggcgcccaggc

SEQ ID NO: 2442394 - RNA, 17 nt, Bordetella pertussis
ugcggcgcccaggccca

SEQ ID NO: 2442395 - RNA, 19 nt, Bordetella pertussis
ugcuccagccaggcgcgca

SEQ ID NO: 2442396 - RNA, 19 nt, Bordetella pertussis
ugcuccagcuugcaaaagc

SEQ ID NO: 2442397 - RNA, 14 nt, Bordetella pertussis
ugcuccggcgugac

SEQ ID NO: 2442398 - RNA, 14 nt, Bordetella pertussis
ugcuccugccaggc

SEQ ID NO: 2442399 - RNA, 21 nt, Bordetella pertussis
ugcucgacagcagcccgcugg

SEQ ID NO: 2442400 - RNA, 24 nt, Bordetella pertussis
ugcucgacagcagcccgcuggccg

SEQ ID NO: 2442401 - RNA, 19 nt, Bordetella pertussis
ugcucgaccaggucgccgu

SEQ ID NO: 2442402 - RNA, 13 nt, Bordetella pertussis
ugcucgaugccgg

SEQ ID NO: 2442403 - RNA, 14 nt, Bordetella pertussis
ugcucgaugccggc

SEQ ID NO: 2442404 - RNA, 18 nt, Bordetella pertussis
ugcucgcaggccugcugc

SEQ ID NO: 2442405 - RNA, 20 nt, Bordetella pertussis
ugcucgcaggccugcugcag

SEQ ID NO: 2442406 - RNA, 22 nt, Bordetella pertussis
ugcucgcaggccugcugcagcg

SEQ ID NO: 2442407 - RNA, 21 nt, Bordetella pertussis
ugcucgcccacauagcggccg

SEQ ID NO: 2442408 - RNA, 22 nt, Bordetella pertussis
ugcucgcccacauagcggccgg

SEQ ID NO: 2442409 - RNA, 17 nt, Bordetella pertussis
ugcucgcccauggcauc

SEQ ID NO: 2442410 - RNA, 20 nt, Bordetella pertussis
ugcucgcccuugagcacggc

SEQ ID NO: 2442411 - RNA, 24 nt, Bordetella pertussis
ugcucgcccuugagcacggcgcgg

SEQ ID NO: 2442412 - RNA, 12 nt, Bordetella pertussis
ugcucgccggcc

SEQ ID NO: 2442413 - RNA, 14 nt, Bordetella pertussis
ugcucgccggccag

SEQ ID NO: 2442414 - RNA, 15 nt, Bordetella pertussis
ugcucgccggccagc

SEQ ID NO: 2442415 - RNA, 13 nt, Bordetella pertussis
ugcucgccggcgc

SEQ ID NO: 2442416 - RNA, 18 nt, Bordetella pertussis
ugcucgccggcgccgccc

SEQ ID NO: 2442417 - RNA, 20 nt, Bordetella pertussis
ugcucgccucgaugaaggug

SEQ ID NO: 2442418 - RNA, 21 nt, Bordetella pertussis
ugcucgcgcagcguggcggcg

SEQ ID NO: 2442419 - RNA, 21 nt, Bordetella pertussis
ugcucggccagcgcgcgccag

SEQ ID NO: 2442420 - RNA, 21 nt, Bordetella pertussis
ugcucggcgaacugggcgucg

SEQ ID NO: 2442421 - RNA, 14 nt, Bordetella pertussis
ugcucggcgaugcg

SEQ ID NO: 2442422 - RNA, 15 nt, Bordetella pertussis
ugcucggcggcaagu

SEQ ID NO: 2442423 - RNA, 20 nt, Bordetella pertussis
ugcucggcggucagcgcggc

SEQ ID NO: 2442424 - RNA, 12 nt, Bordetella pertussis
ugcucgggcgcc

SEQ ID NO: 2442425 - RNA, 13 nt, Bordetella pertussis
ugcucgggcgccu

SEQ ID NO: 2442426 - RNA, 22 nt, Bordetella pertussis
ugcucgggcucgacuucggccg

SEQ ID NO: 2442427 - RNA, 16 nt, Bordetella pertussis
ugcucgggcugcggcu

SEQ ID NO: 2442428 - RNA, 16 nt, Bordetella pertussis
ugcucggugcgggccg

SEQ ID NO: 2442429 - RNA, 19 nt, Bordetella pertussis
ugcucggugcgggccggcg

SEQ ID NO: 2442430 - RNA, 19 nt, Bordetella pertussis
ugcucggugcucuggcccg

SEQ ID NO: 2442431 - RNA, 21 nt, Bordetella pertussis
ugcucguagcugucgaccgga

SEQ ID NO: 2442432 - RNA, 22 nt, Bordetella pertussis
ugcucgugcugggcaugauggu

SEQ ID NO: 2442433 - RNA, 19 nt, Bordetella pertussis
ugcucguucugcgcgcccg

SEQ ID NO: 2442434 - RNA, 23 nt, Bordetella pertussis
ugcucguucugcgcgcccguguc

SEQ ID NO: 2442435 - RNA, 17 nt, Bordetella pertussis
ugcucuacaccaucaac

SEQ ID NO: 2442436 - RNA, 15 nt, Bordetella pertussis
ugcucuccaugcuga

SEQ ID NO: 2442437 - RNA, 14 nt, Bordetella pertussis
ugcucugcccguac

SEQ ID NO: 2442438 - RNA, 14 nt, Bordetella pertussis
ugcucuggcccgcc

SEQ ID NO: 2442439 - RNA, 15 nt, Bordetella pertussis
ugcucuugaccuggg

SEQ ID NO: 2442440 - RNA, 21 nt, Bordetella pertussis
ugcucuugaccugggccagca

SEQ ID NO: 2442441 - RNA, 16 nt, Bordetella pertussis
ugcugaaccugcuggc

SEQ ID NO: 2442442 - RNA, 17 nt, Bordetella pertussis
ugcugaaccugcuggcc

SEQ ID NO: 2442443 - RNA, 20 nt, Bordetella pertussis
ugcugaaccugcuggccgcc

SEQ ID NO: 2442444 - RNA, 16 nt, Bordetella pertussis
ugcugaauugcgggcc

SEQ ID NO: 2442445 - RNA, 14 nt, Bordetella pertussis
ugcugaccaccggg

SEQ ID NO: 2442446 - RNA, 19 nt, Bordetella pertussis
ugcugaccaccgggaugcc

SEQ ID NO: 2442447 - RNA, 20 nt, Bordetella pertussis
ugcugaccgacggccuggag

SEQ ID NO: 2442448 - RNA, 23 nt, Bordetella pertussis
ugcugacgcgauacugcgcaugg

SEQ ID NO: 2442449 - RNA, 17 nt, Bordetella pertussis
ugcugacggugccggcc

SEQ ID NO: 2442450 - RNA, 21 nt, Bordetella pertussis
ugcugacggugccggccagcc

SEQ ID NO: 2442451 - RNA, 24 nt, Bordetella pertussis
ugcugacggugccggccagccugc

SEQ ID NO: 2442452 - RNA, 21 nt, Bordetella pertussis
ugcugacugugcagccacgcc

SEQ ID NO: 2442453 - RNA, 14 nt, Bordetella pertussis
ugcugcagcgcauc

SEQ ID NO: 2442454 - RNA, 18 nt, Bordetella pertussis
ugcugcagcgucuggcac

SEQ ID NO: 2442455 - RNA, 20 nt, Bordetella pertussis
ugcugcagcgucuggcacgc

SEQ ID NO: 2442456 - RNA, 23 nt, Bordetella pertussis
ugcugcagcgucuggcacgcuug

SEQ ID NO: 2442457 - RNA, 22 nt, Bordetella pertussis
ugcugcagcugcuugcccaggc

SEQ ID NO: 2442458 - RNA, 14 nt, Bordetella pertussis
ugcugcaggccggc

SEQ ID NO: 2442459 - RNA, 15 nt, Bordetella pertussis
ugcugcaggccggcg

SEQ ID NO: 2442460 - RNA, 19 nt, Bordetella pertussis
ugcugcaggccggcgcgca

SEQ ID NO: 2442461 - RNA, 15 nt, Bordetella pertussis
ugcugcaguugcgcc

SEQ ID NO: 2442462 - RNA, 19 nt, Bordetella pertussis
ugcugccaugccgcgcgcc

SEQ ID NO: 2442463 - RNA, 21 nt, Bordetella pertussis
ugcugccaugccgcgcgccuu

SEQ ID NO: 2442464 - RNA, 18 nt, Bordetella pertussis
ugcugcccgccgccgccc

SEQ ID NO: 2442465 - RNA, 19 nt, Bordetella pertussis
ugcugcccgccgccgccca

SEQ ID NO: 2442466 - RNA, 15 nt, Bordetella pertussis
ugcugccgcugccca

SEQ ID NO: 2442467 - RNA, 17 nt, Bordetella pertussis
ugcugccguccuugugc

SEQ ID NO: 2442468 - RNA, 14 nt, Bordetella pertussis
ugcugccgucgcca

SEQ ID NO: 2442469 - RNA, 15 nt, Bordetella pertussis
ugcugccgucggcgu

SEQ ID NO: 2442470 - RNA, 15 nt, Bordetella pertussis
ugcugccguuucuca

SEQ ID NO: 2442471 - RNA, 19 nt, Bordetella pertussis
ugcugccguuucucaaccc

SEQ ID NO: 2442472 - RNA, 23 nt, Bordetella pertussis
ugcugccguuucucaacccgccg

SEQ ID NO: 2442473 - RNA, 20 nt, Bordetella pertussis
ugcugcgacagcagggccag

SEQ ID NO: 2442474 - RNA, 23 nt, Bordetella pertussis
ugcugcgacagcagggccaggcc

SEQ ID NO: 2442475 - RNA, 13 nt, Bordetella pertussis
ugcugcgccgccu

SEQ ID NO: 2442476 - RNA, 18 nt, Bordetella pertussis
ugcugcgccuggccgcgc

SEQ ID NO: 2442477 - RNA, 16 nt, Bordetella pertussis
ugcugcgcguggccau

SEQ ID NO: 2442478 - RNA, 15 nt, Bordetella pertussis
ugcugcggcacgauu

SEQ ID NO: 2442479 - RNA, 14 nt, Bordetella pertussis
ugcugcucggccau

SEQ ID NO: 2442480 - RNA, 15 nt, Bordetella pertussis
ugcugcugcagccac

SEQ ID NO: 2442481 - RNA, 22 nt, Bordetella pertussis
ugcugcugcagccacuggaaca

SEQ ID NO: 2442482 - RNA, 13 nt, Bordetella pertussis
ugcugcuggcugc

SEQ ID NO: 2442483 - RNA, 13 nt, Bordetella pertussis
ugcugcugggcgc

SEQ ID NO: 2442484 - RNA, 14 nt, Bordetella pertussis
ugcugcugggcgcc

SEQ ID NO: 2442485 - RNA, 16 nt, Bordetella pertussis
ugcugcugggcgccau

SEQ ID NO: 2442486 - RNA, 16 nt, Bordetella pertussis
ugcugcuguuuuucau

SEQ ID NO: 2442487 - RNA, 13 nt, Bordetella pertussis
ugcugcuugaccu

SEQ ID NO: 2442488 - RNA, 15 nt, Bordetella pertussis
ugcuggacccgcugc

SEQ ID NO: 2442489 - RNA, 16 nt, Bordetella pertussis
ugcuggaccugcuguu

SEQ ID NO: 2442490 - RNA, 13 nt, Bordetella pertussis
ugcuggaccuggc

SEQ ID NO: 2442491 - RNA, 15 nt, Bordetella pertussis
ugcuggaccuggcca

SEQ ID NO: 2442492 - RNA, 16 nt, Bordetella pertussis
ugcuggaccuggccac

SEQ ID NO: 2442493 - RNA, 22 nt, Bordetella pertussis
ugcuggagcgccacgccgucag

SEQ ID NO: 2442494 - RNA, 16 nt, Bordetella pertussis
ugcuggaggugccguc

SEQ ID NO: 2442495 - RNA, 21 nt, Bordetella pertussis
ugcuggcaaagcgcgcguccu

SEQ ID NO: 2442496 - RNA, 23 nt, Bordetella pertussis
ugcuggccaacgccacgcccauc

SEQ ID NO: 2442497 - RNA, 21 nt, Bordetella pertussis
ugcuggcccagaccaagcgcc

SEQ ID NO: 2442498 - RNA, 12 nt, Bordetella pertussis
ugcuggcccgcc

SEQ ID NO: 2442499 - RNA, 14 nt, Bordetella pertussis
ugcuggcccgccag

SEQ ID NO: 2442500 - RNA, 16 nt, Bordetella pertussis
ugcuggccgccgcgcu

SEQ ID NO: 2442501 - RNA, 12 nt, Bordetella pertussis
ugcuggccgcgg

SEQ ID NO: 2442502 - RNA, 13 nt, Bordetella pertussis
ugcuggcgcagca

SEQ ID NO: 2442503 - RNA, 18 nt, Bordetella pertussis
ugcuggcgcagcagcgcc

SEQ ID NO: 2442504 - RNA, 22 nt, Bordetella pertussis
ugcuggcgcagcagcgccggca

SEQ ID NO: 2442505 - RNA, 12 nt, Bordetella pertussis
ugcuggcgcgcc

SEQ ID NO: 2442506 - RNA, 11 nt, Bordetella pertussis
ugcuggcgcgg

SEQ ID NO: 2442507 - RNA, 13 nt, Bordetella pertussis
ugcuggcggcauc

SEQ ID NO: 2442508 - RNA, 21 nt, Bordetella pertussis
uggagaacgagccggccgcgc

SEQ ID NO: 2442509 - RNA, 14 nt, Bordetella pertussis
uggagaagcgccgc

SEQ ID NO: 2442510 - RNA, 17 nt, Bordetella pertussis
uggagaauucggcgcgu

SEQ ID NO: 2442511 - RNA, 15 nt, Bordetella pertussis
uggagacggaugccg

SEQ ID NO: 2442512 - RNA, 16 nt, Bordetella pertussis
uggagacggaugccgu

SEQ ID NO: 2442513 - RNA, 20 nt, Bordetella pertussis
uggagacgucuucguacagc

SEQ ID NO: 2442514 - RNA, 18 nt, Bordetella pertussis
uggagacuggcaccggcc

SEQ ID NO: 2442515 - RNA, 14 nt, Bordetella pertussis
uggagagggccugg

SEQ ID NO: 2442516 - RNA, 20 nt, Bordetella pertussis
uggagagggccuggucagcg

SEQ ID NO: 2442517 - RNA, 22 nt, Bordetella pertussis
uggagaucaugaccacgucgau

SEQ ID NO: 2442518 - RNA, 14 nt, Bordetella pertussis
uggagaucgccgag

SEQ ID NO: 2442519 - RNA, 15 nt, Bordetella pertussis
uggagaucgccgccg

SEQ ID NO: 2442520 - RNA, 19 nt, Bordetella pertussis
uggagaucgccgccgaagc

SEQ ID NO: 2442521 - RNA, 14 nt, Bordetella pertussis
uggagauggcgccg

SEQ ID NO: 2442522 - RNA, 16 nt, Bordetella pertussis
uggagaugugcccgag

SEQ ID NO: 2442523 - RNA, 13 nt, Bordetella pertussis
uggagccaggcgg

SEQ ID NO: 2442524 - RNA, 23 nt, Bordetella pertussis
uggagccggagcagucgcgcagc

SEQ ID NO: 2442525 - RNA, 16 nt, Bordetella pertussis
uggagcgcggcgcugg

SEQ ID NO: 2442526 - RNA, 17 nt, Bordetella pertussis
uggagcgcggcgcuggc

SEQ ID NO: 2442527 - RNA, 17 nt, Bordetella pertussis
uggagcggccuggcccc

SEQ ID NO: 2442528 - RNA, 19 nt, Bordetella pertussis
uggagcucgggugggccgg

SEQ ID NO: 2442529 - RNA, 20 nt, Bordetella pertussis
uggagcuggggccgcgcgcc

SEQ ID NO: 2442530 - RNA, 15 nt, Bordetella pertussis
uggaggacgccgacc

SEQ ID NO: 2442531 - RNA, 16 nt, Bordetella pertussis
uggaggccuuccacca

SEQ ID NO: 2442532 - RNA, 21 nt, Bordetella pertussis
uggaggccuuccaccagccgu

SEQ ID NO: 2442533 - RNA, 18 nt, Bordetella pertussis
uggaggcgcagcgcggca

SEQ ID NO: 2442534 - RNA, 23 nt, Bordetella pertussis
uggaggcgcauucgcgccugagc

SEQ ID NO: 2442535 - RNA, 16 nt, Bordetella pertussis
uggaggcggcggccgu

SEQ ID NO: 2442536 - RNA, 15 nt, Bordetella pertussis
uggaggggcgcaggc

SEQ ID NO: 2442537 - RNA, 23 nt, Bordetella pertussis
uggaggugccguccggcaccucg

SEQ ID NO: 2442538 - RNA, 17 nt, Bordetella pertussis
uggagucgggcugcugc

SEQ ID NO: 2442539 - RNA, 20 nt, Bordetella pertussis
uggagucugcgugugccgcc

SEQ ID NO: 2442540 - RNA, 17 nt, Bordetella pertussis
uggaucacgugccagcc

SEQ ID NO: 2442541 - RNA, 13 nt, Bordetella pertussis
uggaucaggguga

SEQ ID NO: 2442542 - RNA, 18 nt, Bordetella pertussis
uggaucgccgaucggcaa

SEQ ID NO: 2442543 - RNA, 19 nt, Bordetella pertussis
uggaucggggggugcgagg

SEQ ID NO: 2442544 - RNA, 17 nt, Bordetella pertussis
uggaugaagcguucggc

SEQ ID NO: 2442545 - RNA, 23 nt, Bordetella pertussis
uggaugaagcguucggccuugcc

SEQ ID NO: 2442546 - RNA, 15 nt, Bordetella pertussis
uggaugauggucugc

SEQ ID NO: 2442547 - RNA, 14 nt, Bordetella pertussis
uggaugcgcgcccc

SEQ ID NO: 2442548 - RNA, 21 nt, Bordetella pertussis
uggaugcgcuugccgcccacu

SEQ ID NO: 2442549 - RNA, 21 nt, Bordetella pertussis
uggaugcguucgaaagccagc

SEQ ID NO: 2442550 - RNA, 20 nt, Bordetella pertussis
uggaugcguucgcggcccug

SEQ ID NO: 2442551 - RNA, 12 nt, Bordetella pertussis
uggauggccugg

SEQ ID NO: 2442552 - RNA, 17 nt, Bordetella pertussis
uggauggcggccgccag

SEQ ID NO: 2442553 - RNA, 21 nt, Bordetella pertussis
uggauggcggccgccagcgcc

SEQ ID NO: 2442554 - RNA, 15 nt, Bordetella pertussis
uggauggcucgggca

SEQ ID NO: 2442555 - RNA, 17 nt, Bordetella pertussis
uggauggcucgggcagc

SEQ ID NO: 2442556 - RNA, 22 nt, Bordetella pertussis
uggauggucuugccgaugucga

SEQ ID NO: 2442557 - RNA, 15 nt, Bordetella pertussis
uggaugucggugaag

SEQ ID NO: 2442558 - RNA, 19 nt, Bordetella pertussis
uggaugucggugaaggcca

SEQ ID NO: 2442559 - RNA, 15 nt, Bordetella pertussis
uggaugugcaggccg

SEQ ID NO: 2442560 - RNA, 16 nt, Bordetella pertussis
uggauucgcgccggcc

SEQ ID NO: 2442561 - RNA, 15 nt, Bordetella pertussis
uggcaaagcgcgcgu

SEQ ID NO: 2442562 - RNA, 20 nt, Bordetella pertussis
uggcaacgggucgcgcagca

SEQ ID NO: 2442563 - RNA, 16 nt, Bordetella pertussis
uggcaaggcccgccgc

SEQ ID NO: 2442564 - RNA, 15 nt, Bordetella pertussis
uggcaaugguccagc

SEQ ID NO: 2442565 - RNA, 18 nt, Bordetella pertussis
uggcacagccgcagccgu

SEQ ID NO: 2442566 - RNA, 22 nt, Bordetella pertussis
uggcacagccgcagccgucgcg

SEQ ID NO: 2442567 - RNA, 20 nt, Bordetella pertussis
uggcacagcgcggcgaaggc

SEQ ID NO: 2442568 - RNA, 21 nt, Bordetella pertussis
uggcacaggccaucggcgcca

SEQ ID NO: 2442569 - RNA, 22 nt, Bordetella pertussis
uggcacccgccaauugcuugcc

SEQ ID NO: 2442570 - RNA, 19 nt, Bordetella pertussis
uggcacgcuggaaacuaaa

SEQ ID NO: 2442571 - RNA, 17 nt, Bordetella pertussis
uggcagaguggcaggag

SEQ ID NO: 2442572 - RNA, 14 nt, Bordetella pertussis
uggcagaugcgcgc

SEQ ID NO: 2442573 - RNA, 16 nt, Bordetella pertussis
uggcagaugcgcgcca

SEQ ID NO: 2442574 - RNA, 17 nt, Bordetella pertussis
uggcagaugcgcgccag

SEQ ID NO: 2442575 - RNA, 20 nt, Bordetella pertussis
uggcagcgaccgcggcgguc

SEQ ID NO: 2442576 - RNA, 10 nt, Bordetella pertussis
uggcagcugg

SEQ ID NO: 2442577 - RNA, 15 nt, Bordetella pertussis
uggcagcuggcgcgg

SEQ ID NO: 2442578 - RNA, 16 nt, Bordetella pertussis
uggcagcuggcgcggg

SEQ ID NO: 2442579 - RNA, 18 nt, Bordetella pertussis
uggcagcuggcgcgggcg

SEQ ID NO: 2442580 - RNA, 19 nt, Bordetella pertussis
uggcagcuggcgcgggcgg

SEQ ID NO: 2442581 - RNA, 14 nt, Bordetella pertussis
uggcaggccagcau

SEQ ID NO: 2442582 - RNA, 13 nt, Bordetella pertussis
uggcaggccgcuu

SEQ ID NO: 2442583 - RNA, 21 nt, Bordetella pertussis
uggcaggccgcuucgaugcug

SEQ ID NO: 2442584 - RNA, 22 nt, Bordetella pertussis
uggcaggcgucggccagcgcga

SEQ ID NO: 2442585 - RNA, 12 nt, Bordetella pertussis
uggcaggcuggc

SEQ ID NO: 2442586 - RNA, 17 nt, Bordetella pertussis
uggcaggcuggcauuga

SEQ ID NO: 2442587 - RNA, 17 nt, Bordetella pertussis
uggcagggcgccgcgcg

SEQ ID NO: 2442588 - RNA, 14 nt, Bordetella pertussis
uggcaggugcggcc

SEQ ID NO: 2442589 - RNA, 15 nt, Bordetella pertussis
uggcaggugcggccg

SEQ ID NO: 2442590 - RNA, 16 nt, Bordetella pertussis
uggcaggugcggccgc

SEQ ID NO: 2442591 - RNA, 19 nt, Bordetella pertussis
uggcaguacguacgcccgg

SEQ ID NO: 2442592 - RNA, 22 nt, Bordetella pertussis
uggcaguacguacgcccggccg

SEQ ID NO: 2442593 - RNA, 14 nt, Bordetella pertussis
uggcagucagccgu

SEQ ID NO: 2442594 - RNA, 18 nt, Bordetella pertussis
uggcaucagggcgaugcc

SEQ ID NO: 2442595 - RNA, 19 nt, Bordetella pertussis
uggcaucgaccacgcgcgc

SEQ ID NO: 2442596 - RNA, 23 nt, Bordetella pertussis
uggcaucgggcagggcuuccagu

SEQ ID NO: 2442597 - RNA, 17 nt, Bordetella pertussis
uggcaucgucgcgcugc

SEQ ID NO: 2442598 - RNA, 12 nt, Bordetella pertussis
uggcaugagcgc

SEQ ID NO: 2442599 - RNA, 17 nt, Bordetella pertussis
uggcaugccaugcgcac

SEQ ID NO: 2442600 - RNA, 13 nt, Bordetella pertussis
uggcaugcggcgg

SEQ ID NO: 2442601 - RNA, 13 nt, Bordetella pertussis
uggcauggcgcgu

SEQ ID NO: 2442602 - RNA, 14 nt, Bordetella pertussis
uggcauggggcagg

SEQ ID NO: 2442603 - RNA, 21 nt, Bordetella pertussis
uggcauugacgcccacgcuca

SEQ ID NO: 2442604 - RNA, 13 nt, Bordetella pertussis
uggccaacgccac

SEQ ID NO: 2442605 - RNA, 14 nt, Bordetella pertussis
uggccaagcgcgcc

SEQ ID NO: 2442606 - RNA, 16 nt, Bordetella pertussis
uggccaagggcgccgc

SEQ ID NO: 2442607 - RNA, 13 nt, Bordetella pertussis
uggccaaugcgcc

SEQ ID NO: 2442608 - RNA, 14 nt, Bordetella pertussis
uggccaauggccgc

SEQ ID NO: 2442609 - RNA, 16 nt, Bordetella pertussis
uggccaauggccgcgg

SEQ ID NO: 2442610 - RNA, 19 nt, Bordetella pertussis
uggccaauggccgcggcgu

SEQ ID NO: 2442611 - RNA, 19 nt, Bordetella pertussis
uggccacaagcggccccag

SEQ ID NO: 2442612 - RNA, 20 nt, Bordetella pertussis
uggccaccaaaaacggucug

SEQ ID NO: 2442613 - RNA, 14 nt, Bordetella pertussis
uggccaccacgccc

SEQ ID NO: 2442614 - RNA, 21 nt, Bordetella pertussis
uggccaccacgcccaucugcc

SEQ ID NO: 2442615 - RNA, 18 nt, Bordetella pertussis
uggccaccaggcgcgcgc

SEQ ID NO: 2442616 - RNA, 21 nt, Bordetella pertussis
uggccaccagguagggcagca

SEQ ID NO: 2442617 - RNA, 18 nt, Bordetella pertussis
uggccaccgaagcggcgu

SEQ ID NO: 2442618 - RNA, 18 nt, Bordetella pertussis
uggccacgaccaccagcg

SEQ ID NO: 2442619 - RNA, 16 nt, Bordetella pertussis
uggccacggcccuggu

SEQ ID NO: 2442620 - RNA, 18 nt, Bordetella pertussis
uggccacggcccuggucu

SEQ ID NO: 2442621 - RNA, 20 nt, Bordetella pertussis
uggccgcgccgcuggcggcc

SEQ ID NO: 2442622 - RNA, 14 nt, Bordetella pertussis
uggccgcgccguuc

SEQ ID NO: 2442623 - RNA, 15 nt, Bordetella pertussis
uggccgcgcgcagcg

SEQ ID NO: 2442624 - RNA, 12 nt, Bordetella pertussis
uggccgcgcgcc

SEQ ID NO: 2442625 - RNA, 15 nt, Bordetella pertussis
uggccgcgcgccggc

SEQ ID NO: 2442626 - RNA, 20 nt, Bordetella pertussis
uggccgcgcucagccuuguc

SEQ ID NO: 2442627 - RNA, 13 nt, Bordetella pertussis
uggccgcgcuggc

SEQ ID NO: 2442628 - RNA, 12 nt, Bordetella pertussis
uggccgcggccc

SEQ ID NO: 2442629 - RNA, 15 nt, Bordetella pertussis
uggccgcggcccagc

SEQ ID NO: 2442630 - RNA, 20 nt, Bordetella pertussis
uggccgcggcccagcgcggc

SEQ ID NO: 2442631 - RNA, 20 nt, Bordetella pertussis
uggccgcggcguccgcgccg

SEQ ID NO: 2442632 - RNA, 17 nt, Bordetella pertussis
uggccgcggcgugcugc

SEQ ID NO: 2442633 - RNA, 18 nt, Bordetella pertussis
uggccgcguacaacgccg

SEQ ID NO: 2442634 - RNA, 16 nt, Bordetella pertussis
uggccgcguagcccau

SEQ ID NO: 2442635 - RNA, 21 nt, Bordetella pertussis
uggccgcguaggcggucagcu

SEQ ID NO: 2442636 - RNA, 17 nt, Bordetella pertussis
uggccgcuccagagcgc

SEQ ID NO: 2442637 - RNA, 19 nt, Bordetella pertussis
uggccgcuccagagcgcgc

SEQ ID NO: 2442638 - RNA, 15 nt, Bordetella pertussis
uggccgcuucggcgg

SEQ ID NO: 2442639 - RNA, 19 nt, Bordetella pertussis
uggccgcuucggcggccau

SEQ ID NO: 2442640 - RNA, 18 nt, Bordetella pertussis
uggccgcuucggcggccg

SEQ ID NO: 2442641 - RNA, 19 nt, Bordetella pertussis
uggccggaucgagcgcggu

SEQ ID NO: 2442642 - RNA, 16 nt, Bordetella pertussis
uggccggcaucgcgcu

SEQ ID NO: 2442643 - RNA, 12 nt, Bordetella pertussis
uggccggccagc

SEQ ID NO: 2442644 - RNA, 18 nt, Bordetella pertussis
uggccggccgccgggccg

SEQ ID NO: 2442645 - RNA, 19 nt, Bordetella pertussis
uggccggccgcguggccgc

SEQ ID NO: 2442646 - RNA, 18 nt, Bordetella pertussis
uggccggccgcguucagc

SEQ ID NO: 2442647 - RNA, 12 nt, Bordetella pertussis
uggccggccugg

SEQ ID NO: 2442648 - RNA, 18 nt, Bordetella pertussis
uggccggccuggcgcgca

SEQ ID NO: 2442649 - RNA, 15 nt, Bordetella pertussis
uggccggcgacggca

SEQ ID NO: 2442650 - RNA, 13 nt, Bordetella pertussis
uggccggcgcgcc

SEQ ID NO: 2442651 - RNA, 16 nt, Bordetella pertussis
uggccggcgcgcccuu

SEQ ID NO: 2442652 - RNA, 18 nt, Bordetella pertussis
uggccggcgcgcccuugc

SEQ ID NO: 2442653 - RNA, 14 nt, Bordetella pertussis
uggccggcgcggca

SEQ ID NO: 2442654 - RNA, 15 nt, Bordetella pertussis
uggccggcgcggcag

SEQ ID NO: 2442655 - RNA, 15 nt, Bordetella pertussis
uggccggcgcugggc

SEQ ID NO: 2442656 - RNA, 20 nt, Bordetella pertussis
uggccggcgcugggcaggcu

SEQ ID NO: 2442657 - RNA, 13 nt, Bordetella pertussis
uggccggcgugcc

SEQ ID NO: 2442658 - RNA, 17 nt, Bordetella pertussis
uggccggcguggccugc

SEQ ID NO: 2442659 - RNA, 20 nt, Bordetella pertussis
uggccggcguggccugcccg

SEQ ID NO: 2442660 - RNA, 13 nt, Bordetella pertussis
uggccggcguugc

SEQ ID NO: 2442661 - RNA, 19 nt, Bordetella pertussis
uggccggcuugcauggugc

SEQ ID NO: 2442662 - RNA, 19 nt, Bordetella pertussis
uggccgggagcggccagca

SEQ ID NO: 2442663 - RNA, 14 nt, Bordetella pertussis
uggccgggccgugg

SEQ ID NO: 2442664 - RNA, 16 nt, Bordetella pertussis
uggccgggccguggcg

SEQ ID NO: 2442665 - RNA, 16 nt, Bordetella pertussis
uggccggggaagccgc

SEQ ID NO: 2442666 - RNA, 19 nt, Bordetella pertussis
uggccggggaagccgccgg

SEQ ID NO: 2442667 - RNA, 22 nt, Bordetella pertussis
uggccggggaagccgccggcgu

SEQ ID NO: 2442668 - RNA, 16 nt, Bordetella pertussis
uggccggggcgucguc

SEQ ID NO: 2442669 - RNA, 16 nt, Bordetella pertussis
uggccggugaugcggc

SEQ ID NO: 2442670 - RNA, 23 nt, Bordetella pertussis
uggccgguucgaugaccugggcc

SEQ ID NO: 2442671 - RNA, 17 nt, Bordetella pertussis
uggccguacauggccag

SEQ ID NO: 2442672 - RNA, 22 nt, Bordetella pertussis
uggccguagagggucuggcggc

SEQ ID NO: 2442673 - RNA, 23 nt, Bordetella pertussis
uggccguagcguuggcggccggc

SEQ ID NO: 2442674 - RNA, 15 nt, Bordetella pertussis
uggccgucgccgccc

SEQ ID NO: 2442675 - RNA, 19 nt, Bordetella pertussis
uggccgucgccgcccugcu

SEQ ID NO: 2442676 - RNA, 22 nt, Bordetella pertussis
uggccgucgccgcccugcugcc

SEQ ID NO: 2442677 - RNA, 18 nt, Bordetella pertussis
uggccgucuuuucguccu

SEQ ID NO: 2442678 - RNA, 21 nt, Bordetella pertussis
uggccgugaucuugaugccgc

SEQ ID NO: 2442679 - RNA, 16 nt, Bordetella pertussis
uggccgugcgcccgac

SEQ ID NO: 2442680 - RNA, 18 nt, Bordetella pertussis
uggccguggcgugcaggc

SEQ ID NO: 2442681 - RNA, 16 nt, Bordetella pertussis
uggccguucggugcgc

SEQ ID NO: 2442682 - RNA, 16 nt, Bordetella pertussis
uggccguuggccagcg

SEQ ID NO: 2442683 - RNA, 15 nt, Bordetella pertussis
uggccucgcccuggc

SEQ ID NO: 2442684 - RNA, 18 nt, Bordetella pertussis
uggccucgcccuggcgca

SEQ ID NO: 2442685 - RNA, 16 nt, Bordetella pertussis
uggccucgcugccagg

SEQ ID NO: 2442686 - RNA, 13 nt, Bordetella pertussis
uggccucggcaug

SEQ ID NO: 2442687 - RNA, 13 nt, Bordetella pertussis
uggccucggccgg

SEQ ID NO: 2442688 - RNA, 14 nt, Bordetella pertussis
uggccucggccggc

SEQ ID NO: 2442689 - RNA, 14 nt, Bordetella pertussis
uggccucggcggcc

SEQ ID NO: 2442690 - RNA, 17 nt, Bordetella pertussis
uggccucggcggccucc

SEQ ID NO: 2442691 - RNA, 14 nt, Bordetella pertussis
uggccugcaggaug

SEQ ID NO: 2442692 - RNA, 21 nt, Bordetella pertussis
uggccugcaggaugggccguc

SEQ ID NO: 2442693 - RNA, 18 nt, Bordetella pertussis
uggccugccauccggccg

SEQ ID NO: 2442694 - RNA, 15 nt, Bordetella pertussis
uggccugcccuggac

SEQ ID NO: 2442695 - RNA, 16 nt, Bordetella pertussis
uggccugcccuggacg

SEQ ID NO: 2442696 - RNA, 15 nt, Bordetella pertussis
uggccugcgccgccg

SEQ ID NO: 2442697 - RNA, 22 nt, Bordetella pertussis
uggccugcuugaagacgcccag

SEQ ID NO: 2442698 - RNA, 23 nt, Bordetella pertussis
uggccugcuugaagacgcccagg

SEQ ID NO: 2442699 - RNA, 18 nt, Bordetella pertussis
uggccugcuuggcgcgca

SEQ ID NO: 2442700 - RNA, 17 nt, Bordetella pertussis
uggccuggccgccggcg

SEQ ID NO: 2442701 - RNA, 18 nt, Bordetella pertussis
uggccuggccgccggcgg

SEQ ID NO: 2442702 - RNA, 16 nt, Bordetella pertussis
uggccugggccaggac

SEQ ID NO: 2442703 - RNA, 13 nt, Bordetella pertussis
uggccugggccga

SEQ ID NO: 2442704 - RNA, 12 nt, Bordetella pertussis
uggccugggcgc

SEQ ID NO: 2442705 - RNA, 17 nt, Bordetella pertussis
uggccuggguggccagc

SEQ ID NO: 2442706 - RNA, 21 nt, Bordetella pertussis
uggccugguuggccgccuggc

SEQ ID NO: 2442707 - RNA, 14 nt, Bordetella pertussis
uggccuuccugcug

SEQ ID NO: 2442708 - RNA, 15 nt, Bordetella pertussis
uggccuuccugcuga

SEQ ID NO: 2442709 - RNA, 16 nt, Bordetella pertussis
uggccuucgaccugcc

SEQ ID NO: 2442710 - RNA, 13 nt, Bordetella pertussis
uggccuugacggc

SEQ ID NO: 2442711 - RNA, 14 nt, Bordetella pertussis
uggccuugacggcg

SEQ ID NO: 2442712 - RNA, 15 nt, Bordetella pertussis
uggccuugcccaggc

SEQ ID NO: 2442713 - RNA, 22 nt, Bordetella pertussis
uggccuugcccaggcugggcca

SEQ ID NO: 2442714 - RNA, 22 nt, Bordetella pertussis
uggccuugcccuuggcggccuu

SEQ ID NO: 2442715 - RNA, 21 nt, Bordetella pertussis
uggccuugcgcguccaggcca

SEQ ID NO: 2442716 - RNA, 16 nt, Bordetella pertussis
uggccuuggcaucgac

SEQ ID NO: 2442717 - RNA, 14 nt, Bordetella pertussis
uggccuuggcggcc

SEQ ID NO: 2442718 - RNA, 19 nt, Bordetella pertussis
uggcgaaacuggccgacga

SEQ ID NO: 2442719 - RNA, 23 nt, Bordetella pertussis
uggcgaaaggcaccgagcacagc

SEQ ID NO: 2442720 - RNA, 20 nt, Bordetella pertussis
uggcgaacaccaggguggcg

SEQ ID NO: 2442721 - RNA, 18 nt, Bordetella pertussis
uggcgaacgugcgcgcca

SEQ ID NO: 2442722 - RNA, 19 nt, Bordetella pertussis
uggcgaacgugcgcgccag

SEQ ID NO: 2442723 - RNA, 20 nt, Bordetella pertussis
uggcgaacgugcgcgccagc

SEQ ID NO: 2442724 - RNA, 17 nt, Bordetella pertussis
uggcgaagaacaccgcc

SEQ ID NO: 2442725 - RNA, 18 nt, Bordetella pertussis
uggcgaagaacaccgccg

SEQ ID NO: 2442726 - RNA, 14 nt, Bordetella pertussis
uggcgaaggccgcc

SEQ ID NO: 2442727 - RNA, 16 nt, Bordetella pertussis
uggcgaaggccgccgc

SEQ ID NO: 2442728 - RNA, 19 nt, Bordetella pertussis
uggcgaaugccugguaggc

SEQ ID NO: 2442729 - RNA, 12 nt, Bordetella pertussis
uggcgacggccu

SEQ ID NO: 2442730 - RNA, 15 nt, Bordetella pertussis
uggcgacggccugcc

SEQ ID NO: 2442731 - RNA, 15 nt, Bordetella pertussis
uggcgagcacccgca

SEQ ID NO: 2442732 - RNA, 16 nt, Bordetella pertussis
uggcgagcacccgcag

SEQ ID NO: 2442733 - RNA, 19 nt, Bordetella pertussis
uggcgagcaguucgacacc

SEQ ID NO: 2442734 - RNA, 23 nt, Bordetella pertussis
uggcgaggacaggccagugccug

SEQ ID NO: 2442735 - RNA, 13 nt, Bordetella pertussis
uggcgcgcgccag

SEQ ID NO: 2442736 - RNA, 14 nt, Bordetella pertussis
uggcgcgcgccagc

SEQ ID NO: 2442737 - RNA, 21 nt, Bordetella pertussis
uggcgcgcgccgaugcgccag

SEQ ID NO: 2442738 - RNA, 17 nt, Bordetella pertussis
uggcgcgcggcuggcug

SEQ ID NO: 2442739 - RNA, 17 nt, Bordetella pertussis
uggcgcgcggcuggggc

SEQ ID NO: 2442740 - RNA, 21 nt, Bordetella pertussis
uggcgcgcgugcugggccaug

SEQ ID NO: 2442741 - RNA, 16 nt, Bordetella pertussis
uggcgcgcuguucggc

SEQ ID NO: 2442742 - RNA, 22 nt, Bordetella pertussis
uggcgcggaugaccugcgccag

SEQ ID NO: 2442743 - RNA, 20 nt, Bordetella pertussis
uggcgcggccccaugcgcgg

SEQ ID NO: 2442744 - RNA, 15 nt, Bordetella pertussis
uggcgcggccgccag

SEQ ID NO: 2442745 - RNA, 14 nt, Bordetella pertussis
uggcgcggcgccug

SEQ ID NO: 2442746 - RNA, 14 nt, Bordetella pertussis
uggcgcggcggcca

SEQ ID NO: 2442747 - RNA, 16 nt, Bordetella pertussis
uggcgcggcggccagg

SEQ ID NO: 2442748 - RNA, 22 nt, Bordetella pertussis
uggcgcggcgucgaaggccgcc

SEQ ID NO: 2442749 - RNA, 18 nt, Bordetella pertussis
uggcgcggcuggcgaugg

SEQ ID NO: 2442750 - RNA, 14 nt, Bordetella pertussis
uggcgcgggcggcc

SEQ ID NO: 2442751 - RNA, 14 nt, Bordetella pertussis
uggcgcgugcgcgc

SEQ ID NO: 2442752 - RNA, 17 nt, Bordetella pertussis
uggcgcgugcgcgcgcc

SEQ ID NO: 2442753 - RNA, 16 nt, Bordetella pertussis
uggcgcguugcgcauc

SEQ ID NO: 2442754 - RNA, 16 nt, Bordetella pertussis
uggcgcuccaugcggc

SEQ ID NO: 2442755 - RNA, 16 nt, Bordetella pertussis
uggcgcugcacaggga

SEQ ID NO: 2442756 - RNA, 19 nt, Bordetella pertussis
uggcgcugcugcuggcugc

SEQ ID NO: 2442757 - RNA, 13 nt, Bordetella pertussis
uggcgcuggcagg

SEQ ID NO: 2442758 - RNA, 15 nt, Bordetella pertussis
uggcgcuggcaggcg

SEQ ID NO: 2442759 - RNA, 14 nt, Bordetella pertussis
uggcgcuggcccag

SEQ ID NO: 2442760 - RNA, 19 nt, Bordetella pertussis
uggcgcuggcccaguucgc

SEQ ID NO: 2442761 - RNA, 17 nt, Bordetella pertussis
uggcgcuguccggcgcu

SEQ ID NO: 2442762 - RNA, 13 nt, Bordetella pertussis
uggcgcuguuggc

SEQ ID NO: 2442763 - RNA, 18 nt, Bordetella pertussis
uggcgcuguuggccggcg

SEQ ID NO: 2442764 - RNA, 21 nt, Bordetella pertussis
uggcgcuguuggccggcgcgc

SEQ ID NO: 2442765 - RNA, 22 nt, Bordetella pertussis
uggcgcuguuuccgggccuggc

SEQ ID NO: 2442766 - RNA, 21 nt, Bordetella pertussis
uggcgcuuacuggaucuuggc

SEQ ID NO: 2442767 - RNA, 20 nt, Bordetella pertussis
uggcggacgauggccugugc

SEQ ID NO: 2442768 - RNA, 17 nt, Bordetella pertussis
uggcggaucucggccag

SEQ ID NO: 2442769 - RNA, 18 nt, Bordetella pertussis
uggcggaucucggccagc

SEQ ID NO: 2442770 - RNA, 22 nt, Bordetella pertussis
uggcggcacacgcagacuccag

SEQ ID NO: 2442771 - RNA, 21 nt, Bordetella pertussis
uggcggccaggaucgcggcca

SEQ ID NO: 2442772 - RNA, 22 nt, Bordetella pertussis
uggcggccaggaucgcggccag

SEQ ID NO: 2442773 - RNA, 13 nt, Bordetella pertussis
uggcggccaggcc

SEQ ID NO: 2442774 - RNA, 16 nt, Bordetella pertussis
uggcggccaggcgcgc

SEQ ID NO: 2442775 - RNA, 18 nt, Bordetella pertussis
uggcggccaggcgcgccg

SEQ ID NO: 2442776 - RNA, 22 nt, Bordetella pertussis
uggcggcccauucgcccauggc

SEQ ID NO: 2442777 - RNA, 13 nt, Bordetella pertussis
uggcggccgacag

SEQ ID NO: 2442778 - RNA, 16 nt, Bordetella pertussis
uggcggccgacagcuu

SEQ ID NO: 2442779 - RNA, 13 nt, Bordetella pertussis
uggcggccgccag

SEQ ID NO: 2442780 - RNA, 14 nt, Bordetella pertussis
uggcggccgcccag

SEQ ID NO: 2442781 - RNA, 15 nt, Bordetella pertussis
uggcggccgccgcca

SEQ ID NO: 2442782 - RNA, 19 nt, Bordetella pertussis
uggcggccgccgccagcgc

SEQ ID NO: 2442783 - RNA, 14 nt, Bordetella pertussis
uggcggccggccag

SEQ ID NO: 2442784 - RNA, 17 nt, Bordetella pertussis
uggcggccggccagcca

SEQ ID NO: 2442785 - RNA, 13 nt, Bordetella pertussis
uggcggccggcgu

SEQ ID NO: 2442786 - RNA, 15 nt, Bordetella pertussis
uggcggccuggccgc

SEQ ID NO: 2442787 - RNA, 18 nt, Bordetella pertussis
uggcggccuugcgggccg

SEQ ID NO: 2442788 - RNA, 19 nt, Bordetella pertussis
uggcggccuugcgggccgg

SEQ ID NO: 2442789 - RNA, 23 nt, Bordetella pertussis
uggcggccuugcgggccggcugg

SEQ ID NO: 2442790 - RNA, 23 nt, Bordetella pertussis
uggcggcgaacacgucgcgggcg

SEQ ID NO: 2442791 - RNA, 22 nt, Bordetella pertussis
uggcggcgacggcgucggccug

SEQ ID NO: 2442792 - RNA, 16 nt, Bordetella pertussis
uggcggcgaugccgcu

SEQ ID NO: 2442793 - RNA, 19 nt, Bordetella pertussis
uggcggcgcagcaccaggc

SEQ ID NO: 2442794 - RNA, 13 nt, Bordetella pertussis
uggcggcgcagcc

SEQ ID NO: 2442795 - RNA, 14 nt, Bordetella pertussis
uggcggcgcagccg

SEQ ID NO: 2442796 - RNA, 15 nt, Bordetella pertussis
uggcggcgcaggccg

SEQ ID NO: 2442797 - RNA, 20 nt, Bordetella pertussis
uggcggcgcaggccgcgccg

SEQ ID NO: 2442798 - RNA, 22 nt, Bordetella pertussis
uggcggcgcaggccgcgccggc

SEQ ID NO: 2442799 - RNA, 21 nt, Bordetella pertussis
uggcggcgcaguucggagcgg

SEQ ID NO: 2442800 - RNA, 12 nt, Bordetella pertussis
uggcggcgcgcg

SEQ ID NO: 2442801 - RNA, 16 nt, Bordetella pertussis
uggcggcgcgcggcug

SEQ ID NO: 2442802 - RNA, 12 nt, Bordetella pertussis
uggcggcggcgu

SEQ ID NO: 2442803 - RNA, 14 nt, Bordetella pertussis
uggcggcggucaau

SEQ ID NO: 2442804 - RNA, 15 nt, Bordetella pertussis
uggcggcggucaaug

SEQ ID NO: 2442805 - RNA, 19 nt, Bordetella pertussis
uggcggcugcgggcgcaag

SEQ ID NO: 2442806 - RNA, 19 nt, Bordetella pertussis
uggcggcuggcgcggccgu

SEQ ID NO: 2442807 - RNA, 19 nt, Bordetella pertussis
uggcggcugucgggcggcg

SEQ ID NO: 2442808 - RNA, 23 nt, Bordetella pertussis
uggcggcugucgggcggcgccug

SEQ ID NO: 2442809 - RNA, 22 nt, Bordetella pertussis
uggcgggaggaagggugcggcg

SEQ ID NO: 2442810 - RNA, 13 nt, Bordetella pertussis
uggcgggcaccau

SEQ ID NO: 2442811 - RNA, 16 nt, Bordetella pertussis
uggcgggccugggcgu

SEQ ID NO: 2442812 - RNA, 21 nt, Bordetella pertussis
uggcgggcgacauugcgccag

SEQ ID NO: 2442813 - RNA, 21 nt, Bordetella pertussis
uggcgggcgccugcggcaggc

SEQ ID NO: 2442814 - RNA, 21 nt, Bordetella pertussis
uggcggggaauucgaccggac

SEQ ID NO: 2442815 - RNA, 14 nt, Bordetella pertussis
uggcggggauggcu

SEQ ID NO: 2442816 - RNA, 20 nt, Bordetella pertussis
uggcggggugccuguccccg

SEQ ID NO: 2442817 - RNA, 16 nt, Bordetella pertussis
uggcgggguuggccgc

SEQ ID NO: 2442818 - RNA, 17 nt, Bordetella pertussis
uggcgggguuggccgcc

SEQ ID NO: 2442819 - RNA, 19 nt, Bordetella pertussis
uggcgggguuggccgccag

SEQ ID NO: 2442820 - RNA, 22 nt, Bordetella pertussis
uggcggguccacguggcgacgu

SEQ ID NO: 2442821 - RNA, 19 nt, Bordetella pertussis
uggcgggucccaaccaggg

SEQ ID NO: 2442822 - RNA, 15 nt, Bordetella pertussis
uggcgggugcugcag

SEQ ID NO: 2442823 - RNA, 21 nt, Bordetella pertussis
uggcgggugcugcagcgcacc

SEQ ID NO: 2442824 - RNA, 19 nt, Bordetella pertussis
uggcgguagacgccgggac

SEQ ID NO: 2442825 - RNA, 20 nt, Bordetella pertussis
uggcgguagacgccgggacg

SEQ ID NO: 2442826 - RNA, 20 nt, Bordetella pertussis
uggcggucuugcgcuggauc

SEQ ID NO: 2442827 - RNA, 21 nt, Bordetella pertussis
uggcggugaaggcgcccgggc

SEQ ID NO: 2442828 - RNA, 16 nt, Bordetella pertussis
uggcggugcgugcgcc

SEQ ID NO: 2442829 - RNA, 16 nt, Bordetella pertussis
uggcgguggccagcgc

SEQ ID NO: 2442830 - RNA, 16 nt, Bordetella pertussis
uggcgguggccgcgca

SEQ ID NO: 2442831 - RNA, 20 nt, Bordetella pertussis
uggcgguuguugcccaccgc

SEQ ID NO: 2442832 - RNA, 15 nt, Bordetella pertussis
uggcgguuucggcgg

SEQ ID NO: 2442833 - RNA, 19 nt, Bordetella pertussis
uggcguaauagcuggcggc

SEQ ID NO: 2442834 - RNA, 20 nt, Bordetella pertussis
uggcguaauagcuggcggcg

SEQ ID NO: 2442835 - RNA, 23 nt, Bordetella pertussis
uggcguacggcugcaccaguuug

SEQ ID NO: 2442836 - RNA, 14 nt, Bordetella pertussis
uggcguagccggaa

SEQ ID NO: 2442837 - RNA, 15 nt, Bordetella pertussis
uggcguagccggugc

SEQ ID NO: 2442838 - RNA, 13 nt, Bordetella pertussis
uggcguaggcggc

SEQ ID NO: 2442839 - RNA, 18 nt, Bordetella pertussis
uggcguaguagcccaggc

SEQ ID NO: 2442840 - RNA, 21 nt, Bordetella pertussis
uggcguaguagcccaggccca

SEQ ID NO: 2442841 - RNA, 21 nt, Bordetella pertussis
uggcguaugcccacucccgua

SEQ ID NO: 2442842 - RNA, 13 nt, Bordetella pertussis
uggcgucaagcca

SEQ ID NO: 2442843 - RNA, 19 nt, Bordetella pertussis
uggcgucaagccagcggcg

SEQ ID NO: 2442844 - RNA, 22 nt, Bordetella pertussis
uggcguccaccuugacgcgcag

SEQ ID NO: 2442845 - RNA, 16 nt, Bordetella pertussis
uggcguccagcagcag

SEQ ID NO: 2442846 - RNA, 21 nt, Bordetella pertussis
uggcguccagccugcccgggc

SEQ ID NO: 2442847 - RNA, 19 nt, Bordetella pertussis
uggcguccaggcgcgccag

SEQ ID NO: 2442848 - RNA, 13 nt, Bordetella pertussis
ugggccggcgcgc

SEQ ID NO: 2442849 - RNA, 17 nt, Bordetella pertussis
ugggccggcgcgcgcag

SEQ ID NO: 2442850 - RNA, 16 nt, Bordetella pertussis
ugggccgucaugcgcc

SEQ ID NO: 2442851 - RNA, 15 nt, Bordetella pertussis
agcacuugccggccg

SEQ ID NO: 2442852 - RNA, 16 nt, Bordetella pertussis
agcacuugccggccgc

SEQ ID NO: 2442853 - RNA, 22 nt, Bordetella pertussis
agcacuugccggccgcccaggc

SEQ ID NO: 2442854 - RNA, 23 nt, Bordetella pertussis
agcacuuucgacacggggcaacc

SEQ ID NO: 2442855 - RNA, 17 nt, Bordetella pertussis
agcagaaugccgcccac

SEQ ID NO: 2442856 - RNA, 21 nt, Bordetella pertussis
agcagacccgcgcccagcugu

SEQ ID NO: 2442857 - RNA, 17 nt, Bordetella pertussis
agcagacccuggcgcgc

SEQ ID NO: 2442858 - RNA, 18 nt, Bordetella pertussis
agcagacgcuucaggccg

SEQ ID NO: 2442859 - RNA, 16 nt, Bordetella pertussis
agcagauaccggcaug

SEQ ID NO: 2442860 - RNA, 23 nt, Bordetella pertussis
agcagauaccggcauggcagcag

SEQ ID NO: 2442861 - RNA, 15 nt, Bordetella pertussis
agcagaucggcggcc

SEQ ID NO: 2442862 - RNA, 20 nt, Bordetella pertussis
agcagaucggcggccugggc

SEQ ID NO: 2442863 - RNA, 13 nt, Bordetella pertussis
agcagaugcaccg

SEQ ID NO: 2442864 - RNA, 15 nt, Bordetella pertussis
agcagaugcaccggc

SEQ ID NO: 2442865 - RNA, 19 nt, Bordetella pertussis
agcagaugcaccggccagu

SEQ ID NO: 2442866 - RNA, 19 nt, Bordetella pertussis
agcagaugcgacuggcggc

SEQ ID NO: 2442867 - RNA, 17 nt, Bordetella pertussis
agcagauggccaucgac

SEQ ID NO: 2442868 - RNA, 20 nt, Bordetella pertussis
agcagauucaugggcggcga

SEQ ID NO: 2442869 - RNA, 17 nt, Bordetella pertussis
agcagauugccgcgcgg

SEQ ID NO: 2442870 - RNA, 18 nt, Bordetella pertussis
agcagcacgaucgcggcg

SEQ ID NO: 2442871 - RNA, 23 nt, Bordetella pertussis
agcagcacgaucgcggcgcuggc

SEQ ID NO: 2442872 - RNA, 13 nt, Bordetella pertussis
agcagcacgccca

SEQ ID NO: 2442873 - RNA, 15 nt, Bordetella pertussis
agcagcacgccuucg

SEQ ID NO: 2442874 - RNA, 13 nt, Bordetella pertussis
agcagcacggcca

SEQ ID NO: 2442875 - RNA, 18 nt, Bordetella pertussis
agcagcagcgagcccgcc

SEQ ID NO: 2442876 - RNA, 15 nt, Bordetella pertussis
agcagcagcgccgcg

SEQ ID NO: 2442877 - RNA, 17 nt, Bordetella pertussis
agcagcagcgccgcgcc

SEQ ID NO: 2442878 - RNA, 13 nt, Bordetella pertussis
agcagcagcgggc

SEQ ID NO: 2442879 - RNA, 14 nt, Bordetella pertussis
agcagcaggcuggc

SEQ ID NO: 2442880 - RNA, 13 nt, Bordetella pertussis
agcagcagggcca

SEQ ID NO: 2442881 - RNA, 17 nt, Bordetella pertussis
agcagcagggccaggcc

SEQ ID NO: 2442882 - RNA, 18 nt, Bordetella pertussis
agcagcaguugcagcaug

SEQ ID NO: 2442883 - RNA, 19 nt, Bordetella pertussis
agcagcaguugcagcauga

SEQ ID NO: 2442884 - RNA, 15 nt, Bordetella pertussis
agcagcauggcgggc

SEQ ID NO: 2442885 - RNA, 16 nt, Bordetella pertussis
agcagcauggcgggcg

SEQ ID NO: 2442886 - RNA, 19 nt, Bordetella pertussis
agcagcauggcgggcgaga

SEQ ID NO: 2442887 - RNA, 15 nt, Bordetella pertussis
agcagcccagcacga

SEQ ID NO: 2442888 - RNA, 13 nt, Bordetella pertussis
agcagccgcgcgg

SEQ ID NO: 2442889 - RNA, 16 nt, Bordetella pertussis
agcagccgcgcggccg

SEQ ID NO: 2442890 - RNA, 18 nt, Bordetella pertussis
agcagccgguuggcgccu

SEQ ID NO: 2442891 - RNA, 16 nt, Bordetella pertussis
agcagcgagagcgcca

SEQ ID NO: 2442892 - RNA, 21 nt, Bordetella pertussis
agcagcgagagcgccacgcca

SEQ ID NO: 2442893 - RNA, 20 nt, Bordetella pertussis
agcagcgaggacacgcagcu

SEQ ID NO: 2442894 - RNA, 21 nt, Bordetella pertussis
agcagcgaggacacgcagcug

SEQ ID NO: 2442895 - RNA, 17 nt, Bordetella pertussis
agcagcgcaucgagcuc

SEQ ID NO: 2442896 - RNA, 23 nt, Bordetella pertussis
agcagcgcaucgaucucggccuc

SEQ ID NO: 2442897 - RNA, 16 nt, Bordetella pertussis
agcagcgcaucgcgcg

SEQ ID NO: 2442898 - RNA, 11 nt, Bordetella pertussis
agcagcgccac

SEQ ID NO: 2442899 - RNA, 16 nt, Bordetella pertussis
agcagcgccaccgugg

SEQ ID NO: 2442900 - RNA, 12 nt, Bordetella pertussis
agcagcgccagg

SEQ ID NO: 2442901 - RNA, 15 nt, Bordetella pertussis
agcagcgccagggcc

SEQ ID NO: 2442902 - RNA, 20 nt, Bordetella pertussis
agcagcgccgccagcauggc

SEQ ID NO: 2442903 - RNA, 20 nt, Bordetella pertussis
agcagcgccggcaggcgcgc

SEQ ID NO: 2442904 - RNA, 13 nt, Bordetella pertussis
agcagcgccggcu

SEQ ID NO: 2442905 - RNA, 19 nt, Bordetella pertussis
agcagcgccugggggucgg

SEQ ID NO: 2442906 - RNA, 20 nt, Bordetella pertussis
agcagcgcgccgggcggguc

SEQ ID NO: 2442907 - RNA, 15 nt, Bordetella pertussis
agcagcgcggcgccg

SEQ ID NO: 2442908 - RNA, 21 nt, Bordetella pertussis
agcagcgcggcgccggccguc

SEQ ID NO: 2442909 - RNA, 20 nt, Bordetella pertussis
agcagcggcagcucggcgaa

SEQ ID NO: 2442910 - RNA, 18 nt, Bordetella pertussis
agcagcggcucgagcggc

SEQ ID NO: 2442911 - RNA, 19 nt, Bordetella pertussis
agcagcggcucgagcggca

SEQ ID NO: 2442912 - RNA, 12 nt, Bordetella pertussis
agcagcgggcug

SEQ ID NO: 2442913 - RNA, 17 nt, Bordetella pertussis
agcagcgggcuggggca

SEQ ID NO: 2442914 - RNA, 21 nt, Bordetella pertussis
agcagcgggcuggggcaggca

SEQ ID NO: 2442915 - RNA, 20 nt, Bordetella pertussis
agcagcgugaugcggucggc

SEQ ID NO: 2442916 - RNA, 17 nt, Bordetella pertussis
agcagcgugcggucguc

SEQ ID NO: 2442917 - RNA, 18 nt, Bordetella pertussis
agcagcguggccaccagg

SEQ ID NO: 2442918 - RNA, 22 nt, Bordetella pertussis
agcagcguggccaccaggcgcg

SEQ ID NO: 2442919 - RNA, 15 nt, Bordetella pertussis
agcagcguggccgcc

SEQ ID NO: 2442920 - RNA, 16 nt, Bordetella pertussis
agcagcguggccgcca

SEQ ID NO: 2442921 - RNA, 18 nt, Bordetella pertussis
agcagcguugcggcgucg

SEQ ID NO: 2442922 - RNA, 13 nt, Bordetella pertussis
agcagcuccucgg

SEQ ID NO: 2442923 - RNA, 14 nt, Bordetella pertussis
agcagcucggccac

SEQ ID NO: 2442924 - RNA, 15 nt, Bordetella pertussis
agcagcucggccacc

SEQ ID NO: 2442925 - RNA, 19 nt, Bordetella pertussis
agcagcucggccaccgccg

SEQ ID NO: 2442926 - RNA, 16 nt, Bordetella pertussis
agcaggaacaggcugc

SEQ ID NO: 2442927 - RNA, 14 nt, Bordetella pertussis
agcaggagcccgcu

SEQ ID NO: 2442928 - RNA, 17 nt, Bordetella pertussis
agcaggagcccgcugcc

SEQ ID NO: 2442929 - RNA, 18 nt, Bordetella pertussis
agcaggagcccgcugccg

SEQ ID NO: 2442930 - RNA, 19 nt, Bordetella pertussis
agcaggauggaucccuggu

SEQ ID NO: 2442931 - RNA, 12 nt, Bordetella pertussis
agcaggccagga

SEQ ID NO: 2442932 - RNA, 13 nt, Bordetella pertussis
agcaggcccacca

SEQ ID NO: 2442933 - RNA, 17 nt, Bordetella pertussis
agcaggcccaccagggc

SEQ ID NO: 2442934 - RNA, 22 nt, Bordetella pertussis
agcaggcccugggccagcagcu

SEQ ID NO: 2442935 - RNA, 15 nt, Bordetella pertussis
agcaggcccugggcg

SEQ ID NO: 2442936 - RNA, 17 nt, Bordetella pertussis
agcaggccgcccagcgc

SEQ ID NO: 2442937 - RNA, 14 nt, Bordetella pertussis
agcaggccgcgcgu

SEQ ID NO: 2442938 - RNA, 22 nt, Bordetella pertussis
agcaggccguaaccggccaguc

SEQ ID NO: 2442939 - RNA, 20 nt, Bordetella pertussis
agcaggcgaaacgccagccc

SEQ ID NO: 2442940 - RNA, 16 nt, Bordetella pertussis
agcaggcgcaucagcu

SEQ ID NO: 2442941 - RNA, 15 nt, Bordetella pertussis
agcaggcgcgagcgc

SEQ ID NO: 2442942 - RNA, 16 nt, Bordetella pertussis
agcaggcgcgcggccu

SEQ ID NO: 2442943 - RNA, 17 nt, Bordetella pertussis
agcaggcgcgcggccuc

SEQ ID NO: 2442944 - RNA, 14 nt, Bordetella pertussis
agcaggcgcgcuca

SEQ ID NO: 2442945 - RNA, 21 nt, Bordetella pertussis
agcaggcgcgcucaggccgcc

SEQ ID NO: 2442946 - RNA, 19 nt, Bordetella pertussis
agcaggcgcucggccagcg

SEQ ID NO: 2442947 - RNA, 12 nt, Bordetella pertussis
agcaggcgcugg

SEQ ID NO: 2442948 - RNA, 20 nt, Bordetella pertussis
agcaggcggccgaccagcac

SEQ ID NO: 2442949 - RNA, 14 nt, Bordetella pertussis
agcaggcgguacag

SEQ ID NO: 2442950 - RNA, 20 nt, Bordetella pertussis
agcaggcgguacagcggaug

SEQ ID NO: 2442951 - RNA, 17 nt, Bordetella pertussis
agcaggcucagcgggcu

SEQ ID NO: 2442952 - RNA, 18 nt, Bordetella pertussis
agcagggcaucaccaucg

SEQ ID NO: 2442953 - RNA, 12 nt, Bordetella pertussis
agcagggccacg

SEQ ID NO: 2442954 - RNA, 16 nt, Bordetella pertussis
agcagggccacgccca

SEQ ID NO: 2442955 - RNA, 22 nt, Bordetella pertussis
agcagggccacgcccaggccgu

SEQ ID NO: 2442956 - RNA, 17 nt, Bordetella pertussis
agcagggccaggccgau

SEQ ID NO: 2442957 - RNA, 14 nt, Bordetella pertussis
agcagggccuggca

SEQ ID NO: 2442958 - RNA, 13 nt, Bordetella pertussis
agcagggcggcgu

SEQ ID NO: 2442959 - RNA, 16 nt, Bordetella pertussis
agcagggcggcgucga

SEQ ID NO: 2442960 - RNA, 22 nt, Bordetella pertussis
agcaggggcugccauuccagcu

SEQ ID NO: 2442961 - RNA, 20 nt, Bordetella pertussis
agcagggucgagaccagcag

SEQ ID NO: 2442962 - RNA, 22 nt, Bordetella pertussis
uggguggccagcgccgccagcc

SEQ ID NO: 2442963 - RNA, 15 nt, Bordetella pertussis
uggguggcggggcgc

SEQ ID NO: 2442964 - RNA, 14 nt, Bordetella pertussis
uggguuggccuugc

SEQ ID NO: 2442965 - RNA, 21 nt, Bordetella pertussis
ugguacagccccagcgccagc

SEQ ID NO: 2442966 - RNA, 18 nt, Bordetella pertussis
ugguacgaucaggcggcg

SEQ ID NO: 2442967 - RNA, 13 nt, Bordetella pertussis
ugguagcgcaacu

SEQ ID NO: 2442968 - RNA, 18 nt, Bordetella pertussis
ugguagcgguccagcugc

SEQ ID NO: 2442969 - RNA, 18 nt, Bordetella pertussis
ugguaguaaucgcgcgcc

SEQ ID NO: 2442970 - RNA, 20 nt, Bordetella pertussis
ugguaucgcgccagcgccgc

SEQ ID NO: 2442971 - RNA, 14 nt, Bordetella pertussis
ugguaucggccggg

SEQ ID NO: 2442972 - RNA, 17 nt, Bordetella pertussis
uggucaagggcggccau

SEQ ID NO: 2442973 - RNA, 20 nt, Bordetella pertussis
uggucaagggcggccaugcc

SEQ ID NO: 2442974 - RNA, 14 nt, Bordetella pertussis
uggucacacugucg

SEQ ID NO: 2442975 - RNA, 15 nt, Bordetella pertussis
uggucaccacccgca

SEQ ID NO: 2442976 - RNA, 21 nt, Bordetella pertussis
uggucacccggcgcaugcugg

SEQ ID NO: 2442977 - RNA, 22 nt, Bordetella pertussis
uggucacgcccaggcgcuggua

SEQ ID NO: 2442978 - RNA, 14 nt, Bordetella pertussis
uggucacggccucg

SEQ ID NO: 2442979 - RNA, 22 nt, Bordetella pertussis
uggucacguucgaccugccgcc

SEQ ID NO: 2442980 - RNA, 19 nt, Bordetella pertussis
uggucagcaccucggcgcc

SEQ ID NO: 2442981 - RNA, 14 nt, Bordetella pertussis
uggucagccugggc

SEQ ID NO: 2442982 - RNA, 17 nt, Bordetella pertussis
uggucagccugggcgcc

SEQ ID NO: 2442983 - RNA, 20 nt, Bordetella pertussis
uggucagccugggcgccugg

SEQ ID NO: 2442984 - RNA, 14 nt, Bordetella pertussis
uggucagggcugca

SEQ ID NO: 2442985 - RNA, 19 nt, Bordetella pertussis
uggucaguccgcccagcca

SEQ ID NO: 2442986 - RNA, 14 nt, Bordetella pertussis
uggucaucgauggc

SEQ ID NO: 2442987 - RNA, 19 nt, Bordetella pertussis
uggucaucgccaugcugcc

SEQ ID NO: 2442988 - RNA, 18 nt, Bordetella pertussis
uggucaucuacagcgccu

SEQ ID NO: 2442989 - RNA, 22 nt, Bordetella pertussis
ugguccugggccgucaugcgcc

SEQ ID NO: 2442990 - RNA, 19 nt, Bordetella pertussis
uggucgacauagacgcgca

SEQ ID NO: 2442991 - RNA, 14 nt, Bordetella pertussis
uggucgacgccggc

SEQ ID NO: 2442992 - RNA, 19 nt, Bordetella pertussis
uggucgagagccugggcgc

SEQ ID NO: 2442993 - RNA, 22 nt, Bordetella pertussis
uggucgagagccugggcgcgcg

SEQ ID NO: 2442994 - RNA, 19 nt, Bordetella pertussis
uggucgagcgccugcgcca

SEQ ID NO: 2442995 - RNA, 17 nt, Bordetella pertussis
uggucgagcgggcgcca

SEQ ID NO: 2442996 - RNA, 18 nt, Bordetella pertussis
uggucgccagcacgcgca

SEQ ID NO: 2442997 - RNA, 20 nt, Bordetella pertussis
uggucgccagcacgcgcagc

SEQ ID NO: 2442998 - RNA, 15 nt, Bordetella pertussis
uggucgccucgaccu

SEQ ID NO: 2442999 - RNA, 20 nt, Bordetella pertussis
uggucgcgaccaccgugaua

SEQ ID NO: 2443000 - RNA, 22 nt, Bordetella pertussis
uggucgcgaugcgucaggggca

SEQ ID NO: 2443001 - RNA, 15 nt, Bordetella pertussis
uggucgcgcagcugc

SEQ ID NO: 2443002 - RNA, 17 nt, Bordetella pertussis
uggucgcgcagcugccu

SEQ ID NO: 2443003 - RNA, 20 nt, Bordetella pertussis
uggucgcgcccgccguggcc

SEQ ID NO: 2443004 - RNA, 15 nt, Bordetella pertussis
uggucgcgggccagg

SEQ ID NO: 2443005 - RNA, 16 nt, Bordetella pertussis
uggucgcgggccaggc

SEQ ID NO: 2443006 - RNA, 17 nt, Bordetella pertussis
uggucgcgggugguggc

SEQ ID NO: 2443007 - RNA, 22 nt, Bordetella pertussis
uggucgcgggugguggccguga

SEQ ID NO: 2443008 - RNA, 14 nt, Bordetella pertussis
uggucgcuggcgcc

SEQ ID NO: 2443009 - RNA, 16 nt, Bordetella pertussis
uggucgcuggcgccgg

SEQ ID NO: 2443010 - RNA, 18 nt, Bordetella pertussis
uggucggcauggccagga

SEQ ID NO: 2443011 - RNA, 16 nt, Bordetella pertussis
uggucggcauggccau

SEQ ID NO: 2443012 - RNA, 17 nt, Bordetella pertussis
uggucggcauggccauc

SEQ ID NO: 2443013 - RNA, 18 nt, Bordetella pertussis
uggucggcgaccgugcgc

SEQ ID NO: 2443014 - RNA, 16 nt, Bordetella pertussis
uggucggcgcggcagu

SEQ ID NO: 2443015 - RNA, 14 nt, Bordetella pertussis
uggucggugccgcc

SEQ ID NO: 2443016 - RNA, 16 nt, Bordetella pertussis
uggucgucagcgccgc

SEQ ID NO: 2443017 - RNA, 22 nt, Bordetella pertussis
uggucguccaauucgagcaggc

SEQ ID NO: 2443018 - RNA, 15 nt, Bordetella pertussis
uggucgugcuggcgc

SEQ ID NO: 2443019 - RNA, 16 nt, Bordetella pertussis
uggucgugcuggcgcg

SEQ ID NO: 2443020 - RNA, 19 nt, Bordetella pertussis
uggucgugcuggcgcgugc

SEQ ID NO: 2443021 - RNA, 23 nt, Bordetella pertussis
uggucuauucgcauacggacgag

SEQ ID NO: 2443022 - RNA, 18 nt, Bordetella pertussis
uggucucccccucggccu

SEQ ID NO: 2443023 - RNA, 20 nt, Bordetella pertussis
uggucucccccucggccugc

SEQ ID NO: 2443024 - RNA, 21 nt, Bordetella pertussis
uggucucccccucggccugcg

SEQ ID NO: 2443025 - RNA, 19 nt, Bordetella pertussis
uggucucccggcaugaugg

SEQ ID NO: 2443026 - RNA, 16 nt, Bordetella pertussis
uggucugccacaucac

SEQ ID NO: 2443027 - RNA, 18 nt, Bordetella pertussis
uggucuucgagcgcgagc

SEQ ID NO: 2443028 - RNA, 13 nt, Bordetella pertussis
uggucuugccgcc

SEQ ID NO: 2443029 - RNA, 22 nt, Bordetella pertussis
uggugaaacagcaucagcggca

SEQ ID NO: 2443030 - RNA, 16 nt, Bordetella pertussis
uggugaaagccgccgg

SEQ ID NO: 2443031 - RNA, 19 nt, Bordetella pertussis
uggugaaaucccccgccac

SEQ ID NO: 2443032 - RNA, 16 nt, Bordetella pertussis
uggugacccguccguc

SEQ ID NO: 2443033 - RNA, 19 nt, Bordetella pertussis
uggugacguugaccuugcc

SEQ ID NO: 2443034 - RNA, 15 nt, Bordetella pertussis
uggugagcacgcgca

SEQ ID NO: 2443035 - RNA, 15 nt, Bordetella pertussis
uggugauaaggcuca

SEQ ID NO: 2443036 - RNA, 17 nt, Bordetella pertussis
uggugaucgcgcgggcu

SEQ ID NO: 2443037 - RNA, 14 nt, Bordetella pertussis
uggugaucugcugc

SEQ ID NO: 2443038 - RNA, 21 nt, Bordetella pertussis
uggugcaacuccacgcccugc

SEQ ID NO: 2443039 - RNA, 19 nt, Bordetella pertussis
uggugcaccacgcgcucca

SEQ ID NO: 2443040 - RNA, 23 nt, Bordetella pertussis
uggugcacgaugcccagggccgc

SEQ ID NO: 2443041 - RNA, 16 nt, Bordetella pertussis
uggugcagcggcagca

SEQ ID NO: 2443042 - RNA, 21 nt, Bordetella pertussis
uggugcagcggcagcauggcg

SEQ ID NO: 2443043 - RNA, 17 nt, Bordetella pertussis
uggugccgacggcgcgg

SEQ ID NO: 2443044 - RNA, 17 nt, Bordetella pertussis
uggugccgccgcccgac

SEQ ID NO: 2443045 - RNA, 13 nt, Bordetella pertussis
uggugccgcgcag

SEQ ID NO: 2443046 - RNA, 18 nt, Bordetella pertussis
uggugccguaauccgugg

SEQ ID NO: 2443047 - RNA, 14 nt, Bordetella pertussis
uggugcgcaccuug

SEQ ID NO: 2443048 - RNA, 21 nt, Bordetella pertussis
uggugcgccucgaagaucucg

SEQ ID NO: 2443049 - RNA, 13 nt, Bordetella pertussis
uggugcgcgccag

SEQ ID NO: 2443050 - RNA, 12 nt, Bordetella pertussis
uggugcugcuca

SEQ ID NO: 2443051 - RNA, 17 nt, Bordetella pertussis
uggugcugcugggcgcc

SEQ ID NO: 2443052 - RNA, 13 nt, Bordetella pertussis
uggugcugggcgg

SEQ ID NO: 2443053 - RNA, 15 nt, Bordetella pertussis
uggugcugggcggcg

SEQ ID NO: 2443054 - RNA, 16 nt, Bordetella pertussis
uggugcugggcggcgg

SEQ ID NO: 2443055 - RNA, 18 nt, Bordetella pertussis
uggugcuggugccgcugg

SEQ ID NO: 2443056 - RNA, 18 nt, Bordetella pertussis
uggugcuggugcuggugc

SEQ ID NO: 2443057 - RNA, 17 nt, Bordetella pertussis
ugguggauccgccggug

SEQ ID NO: 2443058 - RNA, 18 nt, Bordetella pertussis
ugguggcagagggcgacg

SEQ ID NO: 2443059 - RNA, 19 nt, Bordetella pertussis
uggugggauccucgcugcc

SEQ ID NO: 2443060 - RNA, 17 nt, Bordetella pertussis
uggugggcauagcgcgc

SEQ ID NO: 2443061 - RNA, 13 nt, Bordetella pertussis
uggugggcaugac

SEQ ID NO: 2443062 - RNA, 22 nt, Bordetella pertussis
uggugggccacucgaugggcgc

SEQ ID NO: 2443063 - RNA, 15 nt, Bordetella pertussis
ugguggguuggccuu

SEQ ID NO: 2443064 - RNA, 15 nt, Bordetella pertussis
ugguggucuggucgc

SEQ ID NO: 2443065 - RNA, 15 nt, Bordetella pertussis
ugguggugccgcgca

SEQ ID NO: 2443066 - RNA, 13 nt, Bordetella pertussis
uggugguggggga

SEQ ID NO: 2443067 - RNA, 15 nt, Bordetella pertussis
ugguguaccgggccg

SEQ ID NO: 2443068 - RNA, 14 nt, Bordetella pertussis
ugguguagccagga

SEQ ID NO: 2443069 - RNA, 20 nt, Bordetella pertussis
uggugucggcggcgagcugg

SEQ ID NO: 2443070 - RNA, 17 nt, Bordetella pertussis
uggugugccuguccccg

SEQ ID NO: 2443071 - RNA, 16 nt, Bordetella pertussis
ugguugggcucggucu

SEQ ID NO: 2443072 - RNA, 11 nt, Bordetella pertussis
uguaacaacac

SEQ ID NO: 2443073 - RNA, 22 nt, Bordetella pertussis
uguacaccaccaccaccucguc

SEQ ID NO: 2443074 - RNA, 13 nt, Bordetella pertussis
uguacaggcgcgg

SEQ ID NO: 2443075 - RNA, 23 nt, Bordetella pertussis
ugucgccggccaguggcgcggcg

SEQ ID NO: 2443076 - RNA, 13 nt, Bordetella pertussis
ugucgccggucac

SEQ ID NO: 2443077 - RNA, 23 nt, Bordetella pertussis
ugucgccggucacguacucgccg

SEQ ID NO: 2443078 - RNA, 14 nt, Bordetella pertussis
ugucgcgcaccgcc

SEQ ID NO: 2443079 - RNA, 15 nt, Bordetella pertussis
ugucgcgcaccgccu

SEQ ID NO: 2443080 - RNA, 19 nt, Bordetella pertussis
ugucgcgcaccgccugcgg

SEQ ID NO: 2443081 - RNA, 19 nt, Bordetella pertussis
ugucgcgcaccgccugcug

SEQ ID NO: 2443082 - RNA, 15 nt, Bordetella pertussis
ugucgcgcagcgagu

SEQ ID NO: 2443083 - RNA, 13 nt, Bordetella pertussis
ugucgcgcagcgc

SEQ ID NO: 2443084 - RNA, 19 nt, Bordetella pertussis
ugucgcgcgccugcgcgcc

SEQ ID NO: 2443085 - RNA, 17 nt, Bordetella pertussis
agcaggucgagguccug

SEQ ID NO: 2443086 - RNA, 19 nt, Bordetella pertussis
agcaggucgcgcacgcugg

SEQ ID NO: 2443087 - RNA, 14 nt, Bordetella pertussis
agcaggucggaguc

SEQ ID NO: 2443088 - RNA, 21 nt, Bordetella pertussis
agcaggucggagucggcgccg

SEQ ID NO: 2443089 - RNA, 23 nt, Bordetella pertussis
agcaggucggagucggcgccgcg

SEQ ID NO: 2443090 - RNA, 14 nt, Bordetella pertussis
agcaggucggcgcg

SEQ ID NO: 2443091 - RNA, 19 nt, Bordetella pertussis
agcaggugaugcgcgcggc

SEQ ID NO: 2443092 - RNA, 22 nt, Bordetella pertussis
agcaggugaugcgcgcggccag

SEQ ID NO: 2443093 - RNA, 24 nt, Bordetella pertussis
agcaggugaugcgcgcggccagcg

SEQ ID NO: 2443094 - RNA, 13 nt, Bordetella pertussis
agcagguggcgcu

SEQ ID NO: 2443095 - RNA, 15 nt, Bordetella pertussis
agcagguggcgcugu

SEQ ID NO: 2443096 - RNA, 22 nt, Bordetella pertussis
agcagguuggagaucaugacca

SEQ ID NO: 2443097 - RNA, 14 nt, Bordetella pertussis
agcaguacacgcgc

SEQ ID NO: 2443098 - RNA, 20 nt, Bordetella pertussis
agcaguacacgcgcaacaug

SEQ ID NO: 2443099 - RNA, 21 nt, Bordetella pertussis
agcaguacacgcgcaacaugg

SEQ ID NO: 2443100 - RNA, 20 nt, Bordetella pertussis
agcagucauggaucgacugc

SEQ ID NO: 2443101 - RNA, 14 nt, Bordetella pertussis
agcagucgcgcagc

SEQ ID NO: 2443102 - RNA, 16 nt, Bordetella pertussis
agcagucgcgcagcca

SEQ ID NO: 2443103 - RNA, 22 nt, Bordetella pertussis
agcagucgcgcagccacagcgc

SEQ ID NO: 2443104 - RNA, 20 nt, Bordetella pertussis
agcagugugccugucccagc

SEQ ID NO: 2443105 - RNA, 14 nt, Bordetella pertussis
agcaguuccacagg

SEQ ID NO: 2443106 - RNA, 19 nt, Bordetella pertussis
agcaguucgggguccagca

SEQ ID NO: 2443107 - RNA, 21 nt, Bordetella pertussis
agcaguucggucagcgcggcg

SEQ ID NO: 2443108 - RNA, 21 nt, Bordetella pertussis
agcaguugacccauaccagcc

SEQ ID NO: 2443109 - RNA, 15 nt, Bordetella pertussis
agcaguugcagcaug

SEQ ID NO: 2443110 - RNA, 15 nt, Bordetella pertussis
agcaguugcgccagu

SEQ ID NO: 2443111 - RNA, 22 nt, Bordetella pertussis
agcaguuucugcaccggcgcca

SEQ ID NO: 2443112 - RNA, 14 nt, Bordetella pertussis
agcauacccugcgc

SEQ ID NO: 2443113 - RNA, 20 nt, Bordetella pertussis
agcauaucgucgcugcggcc

SEQ ID NO: 2443114 - RNA, 14 nt, Bordetella pertussis
agcaucaccagcuc

SEQ ID NO: 2443115 - RNA, 20 nt, Bordetella pertussis
agcaucaccagcucgcggcc

SEQ ID NO: 2443116 - RNA, 20 nt, Bordetella pertussis
agcaucacggugccgccgau

SEQ ID NO: 2443117 - RNA, 17 nt, Bordetella pertussis
agcaucagcagacccug

SEQ ID NO: 2443118 - RNA, 22 nt, Bordetella pertussis
agcaucccagucgaugcaaccg

SEQ ID NO: 2443119 - RNA, 14 nt, Bordetella pertussis
agcaucccggcgcu

SEQ ID NO: 2443120 - RNA, 15 nt, Bordetella pertussis
agcauccgcgccagg

SEQ ID NO: 2443121 - RNA, 14 nt, Bordetella pertussis
agcaucgccgccag

SEQ ID NO: 2443122 - RNA, 13 nt, Bordetella pertussis
agcaucgcgccuu

SEQ ID NO: 2443123 - RNA, 21 nt, Bordetella pertussis
agcaucggcacccagccggac

SEQ ID NO: 2443124 - RNA, 15 nt, Bordetella pertussis
agcaucguaucgggc

SEQ ID NO: 2443125 - RNA, 15 nt, Bordetella pertussis
agcaucugccccagc

SEQ ID NO: 2443126 - RNA, 21 nt, Bordetella pertussis
agcaucugccccagcuugucg

SEQ ID NO: 2443127 - RNA, 17 nt, Bordetella pertussis
agcaucuuggccgccac

SEQ ID NO: 2443128 - RNA, 17 nt, Bordetella pertussis
agcaugaacggcagcgc

SEQ ID NO: 2443129 - RNA, 16 nt, Bordetella pertussis
agcaugaagcgguggc

SEQ ID NO: 2443130 - RNA, 20 nt, Bordetella pertussis
agcaugaagcugcccagcaa

SEQ ID NO: 2443131 - RNA, 15 nt, Bordetella pertussis
agcaugagcugaugc

SEQ ID NO: 2443132 - RNA, 19 nt, Bordetella pertussis
agcaugagcugaugcucgc

SEQ ID NO: 2443133 - RNA, 16 nt, Bordetella pertussis
agcaugaucaugccgc

SEQ ID NO: 2443134 - RNA, 17 nt, Bordetella pertussis
agcaugaucuugccgac

SEQ ID NO: 2443135 - RNA, 21 nt, Bordetella pertussis
agcaugaucuugccgaccgcg

SEQ ID NO: 2443136 - RNA, 23 nt, Bordetella pertussis
agcaugcacgacuacggcggacu

SEQ ID NO: 2443137 - RNA, 21 nt, Bordetella pertussis
agcaugccgauguuguuggcc

SEQ ID NO: 2443138 - RNA, 20 nt, Bordetella pertussis
agcaugccgcgguggcgggc

SEQ ID NO: 2443139 - RNA, 18 nt, Bordetella pertussis
agcaugccguuggagccg

SEQ ID NO: 2443140 - RNA, 15 nt, Bordetella pertussis
agcaugcgcgcggcc

SEQ ID NO: 2443141 - RNA, 13 nt, Bordetella pertussis
agcaugcggcguc

SEQ ID NO: 2443142 - RNA, 23 nt, Bordetella pertussis
agcaugcggcguccugccgcgac

SEQ ID NO: 2443143 - RNA, 14 nt, Bordetella pertussis
agcaugcgggccau

SEQ ID NO: 2443144 - RNA, 22 nt, Bordetella pertussis
agcauggagcuggggccgcgcg

SEQ ID NO: 2443145 - RNA, 23 nt, Bordetella pertussis
agcauggccguggcgugcaggcc

SEQ ID NO: 2443146 - RNA, 24 nt, Bordetella pertussis
agcauggccguggcgugcaggccg

SEQ ID NO: 2443147 - RNA, 16 nt, Bordetella pertussis
agcauggcgccagcug

SEQ ID NO: 2443148 - RNA, 14 nt, Bordetella pertussis
agcauggcgccaug

SEQ ID NO: 2443149 - RNA, 12 nt, Bordetella pertussis
agcauggcgcgc

SEQ ID NO: 2443150 - RNA, 12 nt, Bordetella pertussis
agcauggcggcc

SEQ ID NO: 2443151 - RNA, 16 nt, Bordetella pertussis
agcauggcggccaggc

SEQ ID NO: 2443152 - RNA, 17 nt, Bordetella pertussis
agcauggcggccaggcg

SEQ ID NO: 2443153 - RNA, 20 nt, Bordetella pertussis
agcauggcggccaggcgcgc

SEQ ID NO: 2443154 - RNA, 14 nt, Bordetella pertussis
agcauggcggcgcc

SEQ ID NO: 2443155 - RNA, 16 nt, Bordetella pertussis
agcauggcgggaauga

SEQ ID NO: 2443156 - RNA, 18 nt, Bordetella pertussis
agcauggcgguggccagc

SEQ ID NO: 2443157 - RNA, 19 nt, Bordetella pertussis
agcauggcgguggccagcg

SEQ ID NO: 2443158 - RNA, 21 nt, Bordetella pertussis
agcauggcgucgaaacgcugc

SEQ ID NO: 2443159 - RNA, 14 nt, Bordetella pertussis
agcauggucgccuc

SEQ ID NO: 2443160 - RNA, 19 nt, Bordetella pertussis
agcauguauucaucacggg

SEQ ID NO: 2443161 - RNA, 23 nt, Bordetella pertussis
agcauguauucaucacgggcgcc

SEQ ID NO: 2443162 - RNA, 15 nt, Bordetella pertussis
agcauguccgccaug

SEQ ID NO: 2443163 - RNA, 16 nt, Bordetella pertussis
agcauguccgccaugc

SEQ ID NO: 2443164 - RNA, 20 nt, Bordetella pertussis
agcauguccguaucgcggcc

SEQ ID NO: 2443165 - RNA, 20 nt, Bordetella pertussis
agcaugucguggcgauagcg

SEQ ID NO: 2443166 - RNA, 16 nt, Bordetella pertussis
agcaugugcgcggcgu

SEQ ID NO: 2443167 - RNA, 16 nt, Bordetella pertussis
agcaugugcucgggac

SEQ ID NO: 2443168 - RNA, 21 nt, Bordetella pertussis
agcaugugcucgggacgcagg

SEQ ID NO: 2443169 - RNA, 14 nt, Bordetella pertussis
agcauuucggcgcc

SEQ ID NO: 2443170 - RNA, 21 nt, Bordetella pertussis
agcauuucggcgccgccggcc

SEQ ID NO: 2443171 - RNA, 13 nt, Bordetella pertussis
agcauuucuucca

SEQ ID NO: 2443172 - RNA, 12 nt, Bordetella pertussis
agccaagcaggg

SEQ ID NO: 2443173 - RNA, 21 nt, Bordetella pertussis
agccaaugccgcgguugcggu

SEQ ID NO: 2443174 - RNA, 14 nt, Bordetella pertussis
agccacacgaucag

SEQ ID NO: 2443175 - RNA, 18 nt, Bordetella pertussis
agccacacgaucagcgcc

SEQ ID NO: 2443176 - RNA, 21 nt, Bordetella pertussis
agccacacgcugaagcgccgc

SEQ ID NO: 2443177 - RNA, 12 nt, Bordetella pertussis
agccacaggccc

SEQ ID NO: 2443178 - RNA, 17 nt, Bordetella pertussis
agccaccacugcaaggc

SEQ ID NO: 2443179 - RNA, 15 nt, Bordetella pertussis
agccaccccgucauc

SEQ ID NO: 2443180 - RNA, 16 nt, Bordetella pertussis
agccaccccgucaucg

SEQ ID NO: 2443181 - RNA, 19 nt, Bordetella pertussis
agccaccccgucaucgccg

SEQ ID NO: 2443182 - RNA, 22 nt, Bordetella pertussis
agccaccgguugcagcgcgcca

SEQ ID NO: 2443183 - RNA, 13 nt, Bordetella pertussis
agccacgccggcg

SEQ ID NO: 2443184 - RNA, 16 nt, Bordetella pertussis
agccacgcgcgauccg

SEQ ID NO: 2443185 - RNA, 19 nt, Bordetella pertussis
agccacgcgcgcuggcgcc

SEQ ID NO: 2443186 - RNA, 12 nt, Bordetella pertussis
agccacggcccg

SEQ ID NO: 2443187 - RNA, 13 nt, Bordetella pertussis
agccacggcccgc

SEQ ID NO: 2443188 - RNA, 18 nt, Bordetella pertussis
uguuuccgggccuggccu

SEQ ID NO: 2443189 - RNA, 17 nt, Bordetella pertussis
uuaaugaaacugcaaaa

SEQ ID NO: 2443190 - RNA, 20 nt, Bordetella pertussis
uuacaggcccaguacggccu

SEQ ID NO: 2443191 - RNA, 18 nt, Bordetella pertussis
uuacaugccgcgcgcgca

SEQ ID NO: 2443192 - RNA, 11 nt, Bordetella pertussis
uuaccagcaac

SEQ ID NO: 2443193 - RNA, 15 nt, Bordetella pertussis
uuacgcggcgcgcgc

SEQ ID NO: 2443194 - RNA, 20 nt, Bordetella pertussis
uuacuccggcugcuugccca

SEQ ID NO: 2443195 - RNA, 12 nt, Bordetella pertussis
uuauuuccucag

SEQ ID NO: 2443196 - RNA, 15 nt, Bordetella pertussis
uucaaagaucugcug

SEQ ID NO: 2443197 - RNA, 14 nt, Bordetella pertussis
uucaaggcgcgagu

SEQ ID NO: 2443198 - RNA, 14 nt, Bordetella pertussis
uucaccauugaaac

SEQ ID NO: 2443199 - RNA, 19 nt, Bordetella pertussis
uucaccccgccaccgcccc

SEQ ID NO: 2443200 - RNA, 16 nt, Bordetella pertussis
uucaccgaggcgcugc

SEQ ID NO: 2443201 - RNA, 17 nt, Bordetella pertussis
uucaccgcugaucaggu

SEQ ID NO: 2443202 - RNA, 12 nt, Bordetella pertussis
uucaccggcccc

SEQ ID NO: 2443203 - RNA, 17 nt, Bordetella pertussis
uucaccuaccucagcau

SEQ ID NO: 2443204 - RNA, 20 nt, Bordetella pertussis
uucacgacacgcccagcagg

SEQ ID NO: 2443205 - RNA, 23 nt, Bordetella pertussis
uucacgccccgcacgaucagcau

SEQ ID NO: 2443206 - RNA, 17 nt, Bordetella pertussis
uucacgccggcgcgccg

SEQ ID NO: 2443207 - RNA, 22 nt, Bordetella pertussis
uucagacagacgcugacugcgg

SEQ ID NO: 2443208 - RNA, 18 nt, Bordetella pertussis
uucagacugcugccggau

SEQ ID NO: 2443209 - RNA, 10 nt, Bordetella pertussis
uucagcagca

SEQ ID NO: 2443210 - RNA, 19 nt, Bordetella pertussis
uucagcagcucguugaccu

SEQ ID NO: 2443211 - RNA, 12 nt, Bordetella pertussis
uucagccagcga

SEQ ID NO: 2443212 - RNA, 15 nt, Bordetella pertussis
uucagcccggcgcgc

SEQ ID NO: 2443213 - RNA, 18 nt, Bordetella pertussis
uucagcccggcgcgccac

SEQ ID NO: 2443214 - RNA, 14 nt, Bordetella pertussis
uucagcgccggcau

SEQ ID NO: 2443215 - RNA, 16 nt, Bordetella pertussis
uucagcgcgccagcgc

SEQ ID NO: 2443216 - RNA, 17 nt, Bordetella pertussis
uucagcgggccggcacc

SEQ ID NO: 2443217 - RNA, 21 nt, Bordetella pertussis
uucagcgggcgcgcccggcgc

SEQ ID NO: 2443218 - RNA, 23 nt, Bordetella pertussis
uucagcgggcgcgcccggcgcgc

SEQ ID NO: 2443219 - RNA, 18 nt, Bordetella pertussis
uucagcuucagccugggc

SEQ ID NO: 2443220 - RNA, 15 nt, Bordetella pertussis
uucaggaugccgccu

SEQ ID NO: 2443221 - RNA, 15 nt, Bordetella pertussis
uucaggcgcgcggca

SEQ ID NO: 2443222 - RNA, 21 nt, Bordetella pertussis
uucagguagguggacacgccc

SEQ ID NO: 2443223 - RNA, 18 nt, Bordetella pertussis
uucagguguucgcgcacc

SEQ ID NO: 2443224 - RNA, 18 nt, Bordetella pertussis
uucaucaaacgcggcgcc

SEQ ID NO: 2443225 - RNA, 23 nt, Bordetella pertussis
uucaucaaacgcggcgccgccgg

SEQ ID NO: 2443226 - RNA, 17 nt, Bordetella pertussis
uucaucacgggcgccag

SEQ ID NO: 2443227 - RNA, 15 nt, Bordetella pertussis
uucaucagcgcgcgc

SEQ ID NO: 2443228 - RNA, 17 nt, Bordetella pertussis
uucaugaccgccgcgcc

SEQ ID NO: 2443229 - RNA, 23 nt, Bordetella pertussis
uucaugcguucggccagccccac

SEQ ID NO: 2443230 - RNA, 20 nt, Bordetella pertussis
uucaugcucuugaacgccuu

SEQ ID NO: 2443231 - RNA, 21 nt, Bordetella pertussis
uucauggcguaauugggcugg

SEQ ID NO: 2443232 - RNA, 13 nt, Bordetella pertussis
uucaugggccugg

SEQ ID NO: 2443233 - RNA, 18 nt, Bordetella pertussis
uucaugggccugggcgcc

SEQ ID NO: 2443234 - RNA, 18 nt, Bordetella pertussis
uuccaagcgcacgcgcag

SEQ ID NO: 2443235 - RNA, 16 nt, Bordetella pertussis
uuccacagccaggccg

SEQ ID NO: 2443236 - RNA, 20 nt, Bordetella pertussis
uuccacagcgccgaccgcac

SEQ ID NO: 2443237 - RNA, 17 nt, Bordetella pertussis
uuccaccgucuggcgua

SEQ ID NO: 2443238 - RNA, 16 nt, Bordetella pertussis
uuccagaugcgcagca

SEQ ID NO: 2443239 - RNA, 12 nt, Bordetella pertussis
uuccagcagcau

SEQ ID NO: 2443240 - RNA, 20 nt, Bordetella pertussis
uuccagccaguacaggcugc

SEQ ID NO: 2443241 - RNA, 17 nt, Bordetella pertussis
uuccagccuggcaaugc

SEQ ID NO: 2443242 - RNA, 23 nt, Bordetella pertussis
uuccagccuggcaaugcguggcc

SEQ ID NO: 2443243 - RNA, 11 nt, Bordetella pertussis
uuccagcgccu

SEQ ID NO: 2443244 - RNA, 14 nt, Bordetella pertussis
uuccagcgccuggc

SEQ ID NO: 2443245 - RNA, 16 nt, Bordetella pertussis
uuccagcgccuggcgg

SEQ ID NO: 2443246 - RNA, 16 nt, Bordetella pertussis
uuccagcuccggcggc

SEQ ID NO: 2443247 - RNA, 17 nt, Bordetella pertussis
uuccagcuccggcggca

SEQ ID NO: 2443248 - RNA, 18 nt, Bordetella pertussis
uuccagcuccggcggcag

SEQ ID NO: 2443249 - RNA, 20 nt, Bordetella pertussis
uuccaggaaagaggccaggc

SEQ ID NO: 2443250 - RNA, 14 nt, Bordetella pertussis
uuccaggaacucca

SEQ ID NO: 2443251 - RNA, 17 nt, Bordetella pertussis
uuccaggcgugcccggu

SEQ ID NO: 2443252 - RNA, 16 nt, Bordetella pertussis
uuccaguccagcgucg

SEQ ID NO: 2443253 - RNA, 16 nt, Bordetella pertussis
uuccaguugcgcgccg

SEQ ID NO: 2443254 - RNA, 17 nt, Bordetella pertussis
uuccaguugcgggcgca

SEQ ID NO: 2443255 - RNA, 19 nt, Bordetella pertussis
uuccaucggggggcaggcu

SEQ ID NO: 2443256 - RNA, 17 nt, Bordetella pertussis
uuccaugacggugccga

SEQ ID NO: 2443257 - RNA, 20 nt, Bordetella pertussis
uuccaugacguccagcgcca

SEQ ID NO: 2443258 - RNA, 18 nt, Bordetella pertussis
uuccaugcgauccagggc

SEQ ID NO: 2443259 - RNA, 20 nt, Bordetella pertussis
uuccccgaaacucaccgccg

SEQ ID NO: 2443260 - RNA, 14 nt, Bordetella pertussis
uucccgaugcuccg

SEQ ID NO: 2443261 - RNA, 14 nt, Bordetella pertussis
uucccuggcgcgcc

SEQ ID NO: 2443262 - RNA, 16 nt, Bordetella pertussis
uucccuggcgcgccag

SEQ ID NO: 2443263 - RNA, 19 nt, Bordetella pertussis
uucccuggcgcgccagcuc

SEQ ID NO: 2443264 - RNA, 22 nt, Bordetella pertussis
uuccgcacgccgaccuggcgcc

SEQ ID NO: 2443265 - RNA, 19 nt, Bordetella pertussis
uuccgccaacucgcuccag

SEQ ID NO: 2443266 - RNA, 16 nt, Bordetella pertussis
uuccgccaccgcgccg

SEQ ID NO: 2443267 - RNA, 17 nt, Bordetella pertussis
uuccgccaccgcgccgc

SEQ ID NO: 2443268 - RNA, 20 nt, Bordetella pertussis
uuccgcuuccggccgggcca

SEQ ID NO: 2443269 - RNA, 19 nt, Bordetella pertussis
uuccgguacgcgcaguccg

SEQ ID NO: 2443270 - RNA, 14 nt, Bordetella pertussis
uuccucgaccaggu

SEQ ID NO: 2443271 - RNA, 22 nt, Bordetella pertussis
uuccucgcggcuguccuggcgu

SEQ ID NO: 2443272 - RNA, 15 nt, Bordetella pertussis
uuccucggcgcgcgc

SEQ ID NO: 2443273 - RNA, 18 nt, Bordetella pertussis
uuccugaacgccgggccg

SEQ ID NO: 2443274 - RNA, 15 nt, Bordetella pertussis
uuccugccgcacuuc

SEQ ID NO: 2443275 - RNA, 21 nt, Bordetella pertussis
uuccugcucgggaaugcgggu

SEQ ID NO: 2443276 - RNA, 13 nt, Bordetella pertussis
uuccugcugcgcc

SEQ ID NO: 2443277 - RNA, 19 nt, Bordetella pertussis
uuccugcugcgccuggcgg

SEQ ID NO: 2443278 - RNA, 11 nt, Bordetella pertussis
uuccugcugga

SEQ ID NO: 2443279 - RNA, 23 nt, Bordetella pertussis
uuccugcuggaccugcuguucac

SEQ ID NO: 2443280 - RNA, 19 nt, Bordetella pertussis
uuccugcuuugagcaggcg

SEQ ID NO: 2443281 - RNA, 15 nt, Bordetella pertussis
uuccuggccggcgcc

SEQ ID NO: 2443282 - RNA, 14 nt, Bordetella pertussis
uuccuucagcagcu

SEQ ID NO: 2443283 - RNA, 21 nt, Bordetella pertussis
uuccuugccauccagccaggc

SEQ ID NO: 2443284 - RNA, 15 nt, Bordetella pertussis
uuccuugcgaugcca

SEQ ID NO: 2443285 - RNA, 16 nt, Bordetella pertussis
uuccuuggucagcgau

SEQ ID NO: 2443286 - RNA, 17 nt, Bordetella pertussis
uucgaaagccagcgccu

SEQ ID NO: 2443287 - RNA, 17 nt, Bordetella pertussis
uucgaacaacagcgccu

SEQ ID NO: 2443288 - RNA, 14 nt, Bordetella pertussis
uucgaagccgcccc

SEQ ID NO: 2443289 - RNA, 15 nt, Bordetella pertussis
uucgaagcgcucgac

SEQ ID NO: 2443290 - RNA, 21 nt, Bordetella pertussis
uucgaaguauuucaggaugcc

SEQ ID NO: 2443291 - RNA, 18 nt, Bordetella pertussis
uucgaauccucucgcccc

SEQ ID NO: 2443292 - RNA, 22 nt, Bordetella pertussis
uucgacccggacaacgcgcgcc

SEQ ID NO: 2443293 - RNA, 13 nt, Bordetella pertussis
uucgaccugcccg

SEQ ID NO: 2443294 - RNA, 15 nt, Bordetella pertussis
uucgaccugcccgag

SEQ ID NO: 2443295 - RNA, 16 nt, Bordetella pertussis
uucgaccuugcugacg

SEQ ID NO: 2443296 - RNA, 12 nt, Bordetella pertussis
uucgacgccggc

SEQ ID NO: 2443297 - RNA, 17 nt, Bordetella pertussis
uucgacgggcaggccca

SEQ ID NO: 2443298 - RNA, 20 nt, Bordetella pertussis
uucgagccgcagaacagcag

SEQ ID NO: 2443299 - RNA, 21 nt, Bordetella pertussis
uucgaguuccgcgacgcggac

SEQ ID NO: 2443300 - RNA, 19 nt, Bordetella pertussis
uucgaucacggcgcgcgcc

SEQ ID NO: 2443301 - RNA, 16 nt, Bordetella pertussis
uugagcaaucaagggc

SEQ ID NO: 2443302 - RNA, 22 nt, Bordetella pertussis
uugagcaccacguccuggggcg

SEQ ID NO: 2443303 - RNA, 19 nt, Bordetella pertussis
uugagcacguccagcggcg

SEQ ID NO: 2443304 - RNA, 22 nt, Bordetella pertussis
uugagcaggucgagguccugcu

SEQ ID NO: 2443305 - RNA, 17 nt, Bordetella pertussis
uugagcgccagcucggc

SEQ ID NO: 2443306 - RNA, 15 nt, Bordetella pertussis
uugagcgccagggcc

SEQ ID NO: 2443307 - RNA, 21 nt, Bordetella pertussis
uugagcgccggggcguggccg

SEQ ID NO: 2443308 - RNA, 20 nt, Bordetella pertussis
uugagcgcggccucgccggc

SEQ ID NO: 2443309 - RNA, 18 nt, Bordetella pertussis
uugaggaugcgcgcggcc

SEQ ID NO: 2443310 - RNA, 16 nt, Bordetella pertussis
uugaggccagcacgcc

SEQ ID NO: 2443311 - RNA, 12 nt, Bordetella pertussis
uugauggccggg

SEQ ID NO: 2443312 - RNA, 13 nt, Bordetella pertussis
uugauggccucgg

SEQ ID NO: 2443313 - RNA, 14 nt, Bordetella pertussis
uugauggccucggc

SEQ ID NO: 2443314 - RNA, 19 nt, Bordetella pertussis
uugauguccggguugccca

SEQ ID NO: 2443315 - RNA, 14 nt, Bordetella pertussis
uugcacaacgggca

SEQ ID NO: 2443316 - RNA, 12 nt, Bordetella pertussis
uugcacgccggc

SEQ ID NO: 2443317 - RNA, 16 nt, Bordetella pertussis
uugcagccacaggccc

SEQ ID NO: 2443318 - RNA, 13 nt, Bordetella pertussis
uugcaggccaggc

SEQ ID NO: 2443319 - RNA, 15 nt, Bordetella pertussis
uugcaggccaggcuc

SEQ ID NO: 2443320 - RNA, 22 nt, Bordetella pertussis
uugcaugcgccgcaccagcggc

SEQ ID NO: 2443321 - RNA, 23 nt, Bordetella pertussis
uugcaugcgccgcaccagcggcg

SEQ ID NO: 2443322 - RNA, 13 nt, Bordetella pertussis
uugccacggcggg

SEQ ID NO: 2443323 - RNA, 23 nt, Bordetella pertussis
uugccacggcgggccggcucggc

SEQ ID NO: 2443324 - RNA, 18 nt, Bordetella pertussis
uugccauaggccagcgcc

SEQ ID NO: 2443325 - RNA, 18 nt, Bordetella pertussis
uugccauccagccaggcc

SEQ ID NO: 2443326 - RNA, 15 nt, Bordetella pertussis
uugccauucgguggu

SEQ ID NO: 2443327 - RNA, 14 nt, Bordetella pertussis
uugcccacgcgcuc

SEQ ID NO: 2443328 - RNA, 17 nt, Bordetella pertussis
uugcccacgcgcuccug

SEQ ID NO: 2443329 - RNA, 17 nt, Bordetella pertussis
uugcccagcaccacggg

SEQ ID NO: 2443330 - RNA, 18 nt, Bordetella pertussis
uugcccagcaccacgggc

SEQ ID NO: 2443331 - RNA, 13 nt, Bordetella pertussis
uugccccagcacg

SEQ ID NO: 2443332 - RNA, 22 nt, Bordetella pertussis
uugccccagcacgaagggcagc

SEQ ID NO: 2443333 - RNA, 23 nt, Bordetella pertussis
uugccccagcacgaagggcagca

SEQ ID NO: 2443334 - RNA, 18 nt, Bordetella pertussis
uugcccgaaggcagcggc

SEQ ID NO: 2443335 - RNA, 14 nt, Bordetella pertussis
uugcccgcccgacg

SEQ ID NO: 2443336 - RNA, 22 nt, Bordetella pertussis
uugcccgggcuggccgccugcu

SEQ ID NO: 2443337 - RNA, 15 nt, Bordetella pertussis
uugcccuuggcggcc

SEQ ID NO: 2443338 - RNA, 18 nt, Bordetella pertussis
uugccgaggucgcccuug

SEQ ID NO: 2443339 - RNA, 16 nt, Bordetella pertussis
uugccgauccagcgcc

SEQ ID NO: 2443340 - RNA, 23 nt, Bordetella pertussis
uugccgaugcgguaggcccagca

SEQ ID NO: 2443341 - RNA, 23 nt, Bordetella pertussis
uugccgcacgaucgcgccggccu

SEQ ID NO: 2443342 - RNA, 12 nt, Bordetella pertussis
uugccgcagccc

SEQ ID NO: 2443343 - RNA, 13 nt, Bordetella pertussis
uugccgcagcggc

SEQ ID NO: 2443344 - RNA, 14 nt, Bordetella pertussis
uugccgcagcggcc

SEQ ID NO: 2443345 - RNA, 20 nt, Bordetella pertussis
uugccgccgcgcagccgaca

SEQ ID NO: 2443346 - RNA, 21 nt, Bordetella pertussis
uugccgccggacggcgccuug

SEQ ID NO: 2443347 - RNA, 20 nt, Bordetella pertussis
uugccgccgggcaugcacca

SEQ ID NO: 2443348 - RNA, 15 nt, Bordetella pertussis
uugccgcgaggcgca

SEQ ID NO: 2443349 - RNA, 21 nt, Bordetella pertussis
uugccgcgaggcgcaggccga

SEQ ID NO: 2443350 - RNA, 21 nt, Bordetella pertussis
uugccgcgcagcgucugcgca

SEQ ID NO: 2443351 - RNA, 13 nt, Bordetella pertussis
uugccgcgcgcga

SEQ ID NO: 2443352 - RNA, 22 nt, Bordetella pertussis
uugccgcggcgcggccuuccca

SEQ ID NO: 2443353 - RNA, 19 nt, Bordetella pertussis
uugccgcucaauucggccu

SEQ ID NO: 2443354 - RNA, 17 nt, Bordetella pertussis
uugccgcuggacgcgcc

SEQ ID NO: 2443355 - RNA, 20 nt, Bordetella pertussis
uugccggagcagcagcgggc

SEQ ID NO: 2443356 - RNA, 17 nt, Bordetella pertussis
uugccggaucagcgccu

SEQ ID NO: 2443357 - RNA, 13 nt, Bordetella pertussis
uugccggccagca

SEQ ID NO: 2443358 - RNA, 21 nt, Bordetella pertussis
uugccggccaggacgaucccg

SEQ ID NO: 2443359 - RNA, 20 nt, Bordetella pertussis
uugccggcgaucacgccgaa

SEQ ID NO: 2443360 - RNA, 20 nt, Bordetella pertussis
uugccguacgagugcaggcc

SEQ ID NO: 2443361 - RNA, 15 nt, Bordetella pertussis
uugccguccuggcga

SEQ ID NO: 2443362 - RNA, 13 nt, Bordetella pertussis
uugccgucggccg

SEQ ID NO: 2443363 - RNA, 18 nt, Bordetella pertussis
uugcgaaacccgcugggc

SEQ ID NO: 2443364 - RNA, 20 nt, Bordetella pertussis
uugcgauaggugcgcagccg

SEQ ID NO: 2443365 - RNA, 22 nt, Bordetella pertussis
uugcgcaagccggccgcgcggc

SEQ ID NO: 2443366 - RNA, 12 nt, Bordetella pertussis
uugcgcagcgcg

SEQ ID NO: 2443367 - RNA, 13 nt, Bordetella pertussis
uugcgcaggcugu

SEQ ID NO: 2443368 - RNA, 21 nt, Bordetella pertussis
uugcgccacggucugcacgcc

SEQ ID NO: 2443369 - RNA, 22 nt, Bordetella pertussis
uugcgccacggucugcacgccg

SEQ ID NO: 2443370 - RNA, 22 nt, Bordetella pertussis
uugcgccagcgcuguccaggcc

SEQ ID NO: 2443371 - RNA, 13 nt, Bordetella pertussis
uugcgccagcggc

SEQ ID NO: 2443372 - RNA, 14 nt, Bordetella pertussis
uugcgccagcuugc

SEQ ID NO: 2443373 - RNA, 20 nt, Bordetella pertussis
uugcgccccgccaugcgcag

SEQ ID NO: 2443374 - RNA, 20 nt, Bordetella pertussis
uugcgccgcaacgccgccgg

SEQ ID NO: 2443375 - RNA, 21 nt, Bordetella pertussis
uugcgccgcaacgccgccggc

SEQ ID NO: 2443376 - RNA, 18 nt, Bordetella pertussis
uugcgcgaaggccgcccc

SEQ ID NO: 2443377 - RNA, 13 nt, Bordetella pertussis
uugcgcgacagca

SEQ ID NO: 2443378 - RNA, 19 nt, Bordetella pertussis
uugcgcgccagcucgcgca

SEQ ID NO: 2443379 - RNA, 11 nt, Bordetella pertussis
uugcgcgccau

SEQ ID NO: 2443380 - RNA, 15 nt, Bordetella pertussis
uugcgcgccuuggcg

SEQ ID NO: 2443381 - RNA, 13 nt, Bordetella pertussis
uugcgcggccaug

SEQ ID NO: 2443382 - RNA, 21 nt, Bordetella pertussis
uugcgcggcgcgucgcgcgcc

SEQ ID NO: 2443383 - RNA, 15 nt, Bordetella pertussis
uugcgcguccaggcc

SEQ ID NO: 2443384 - RNA, 16 nt, Bordetella pertussis
uugcgcuggcgcgcgg

SEQ ID NO: 2443385 - RNA, 16 nt, Bordetella pertussis
uugcgcuuggcaggcg

SEQ ID NO: 2443386 - RNA, 17 nt, Bordetella pertussis
uugcggcaccugcugcu

SEQ ID NO: 2443387 - RNA, 13 nt, Bordetella pertussis
uugcggcacggcu

SEQ ID NO: 2443388 - RNA, 13 nt, Bordetella pertussis
uugcggcagcgcc

SEQ ID NO: 2443389 - RNA, 22 nt, Bordetella pertussis
uugcggcgaugcacccaggcgc

SEQ ID NO: 2443390 - RNA, 21 nt, Bordetella pertussis
uugcggcggacacgcaugcag

SEQ ID NO: 2443391 - RNA, 14 nt, Bordetella pertussis
uugcggcgggcggg

SEQ ID NO: 2443392 - RNA, 13 nt, Bordetella pertussis
uugcgggcgcgcu

SEQ ID NO: 2443393 - RNA, 17 nt, Bordetella pertussis
uugcgggcugcgcgggu

SEQ ID NO: 2443394 - RNA, 12 nt, Bordetella pertussis
uugcggggcgcg

SEQ ID NO: 2443395 - RNA, 14 nt, Bordetella pertussis
uugcggggcggcgu

SEQ ID NO: 2443396 - RNA, 23 nt, Bordetella pertussis
uugcgggugggcauccagcggca

SEQ ID NO: 2443397 - RNA, 14 nt, Bordetella pertussis
uugcgguaguucag

SEQ ID NO: 2443398 - RNA, 23 nt, Bordetella pertussis
uugcgguccaugucggccgacca

SEQ ID NO: 2443399 - RNA, 11 nt, Bordetella pertussis
uugcgugacga

SEQ ID NO: 2443400 - RNA, 22 nt, Bordetella pertussis
uugcgugggcuccguuccgaug

SEQ ID NO: 2443401 - RNA, 17 nt, Bordetella pertussis
uugcguuggcauggcgc

SEQ ID NO: 2443402 - RNA, 16 nt, Bordetella pertussis
uugcuccaggccggca

SEQ ID NO: 2443403 - RNA, 20 nt, Bordetella pertussis
uugcuccggcgugacguggc

SEQ ID NO: 2443404 - RNA, 22 nt, Bordetella pertussis
uugcuccggcgugacguggccc

SEQ ID NO: 2443405 - RNA, 15 nt, Bordetella pertussis
uugcugaaccugcug

SEQ ID NO: 2443406 - RNA, 23 nt, Bordetella pertussis
uugcugaaccugcuggccgccgg

SEQ ID NO: 2443407 - RNA, 13 nt, Bordetella pertussis
uugcuggcccagg

SEQ ID NO: 2443408 - RNA, 17 nt, Bordetella pertussis
uugcuguacucguacga

SEQ ID NO: 2443409 - RNA, 19 nt, Bordetella pertussis
uugcuguccagucuggaug

SEQ ID NO: 2443410 - RNA, 22 nt, Bordetella pertussis
uuggacagcaguucggccggcg

SEQ ID NO: 2443411 - RNA, 22 nt, Bordetella pertussis
uuggaccccaguuccagcacga

SEQ ID NO: 2443412 - RNA, 23 nt, Bordetella pertussis
uuggaccccaguuccagcacgac

SEQ ID NO: 2443413 - RNA, 19 nt, Bordetella pertussis
uuggaguagccgcucaggu

SEQ ID NO: 2443414 - RNA, 18 nt, Bordetella pertussis
aggcaagaaucgacucgg

SEQ ID NO: 2443415 - RNA, 17 nt, Bordetella pertussis
aggcaaucagccccagg

SEQ ID NO: 2443416 - RNA, 19 nt, Bordetella pertussis
aggcaaucgaugaucacgc

SEQ ID NO: 2443417 - RNA, 13 nt, Bordetella pertussis
aggcaaugcgcag

SEQ ID NO: 2443418 - RNA, 20 nt, Bordetella pertussis
aggcaaugcgcaggcccgac

SEQ ID NO: 2443419 - RNA, 20 nt, Bordetella pertussis
aggcacaaggccgaggugga

SEQ ID NO: 2443420 - RNA, 17 nt, Bordetella pertussis
aggcacaccacgcgaug

SEQ ID NO: 2443421 - RNA, 20 nt, Bordetella pertussis
aggcacaccacgcgaugcgg

SEQ ID NO: 2443422 - RNA, 22 nt, Bordetella pertussis
aggcacacccuccuacgccaug

SEQ ID NO: 2443423 - RNA, 17 nt, Bordetella pertussis
aggcacccccgaccgag

SEQ ID NO: 2443424 - RNA, 22 nt, Bordetella pertussis
aggcaccccggcgccgcguuca

SEQ ID NO: 2443425 - RNA, 22 nt, Bordetella pertussis
aggcaccccucccuguggggga

SEQ ID NO: 2443426 - RNA, 15 nt, Bordetella pertussis
aggcacccgcgcgca

SEQ ID NO: 2443427 - RNA, 13 nt, Bordetella pertussis
aggcacccggggu

SEQ ID NO: 2443428 - RNA, 22 nt, Bordetella pertussis
aggcacccugucauacgccaug

SEQ ID NO: 2443429 - RNA, 23 nt, Bordetella pertussis
aggcacccugucauacgccauga

SEQ ID NO: 2443430 - RNA, 17 nt, Bordetella pertussis
aggcaccgagcacagca

SEQ ID NO: 2443431 - RNA, 13 nt, Bordetella pertussis
aggcaccgccgca

SEQ ID NO: 2443432 - RNA, 17 nt, Bordetella pertussis
aggcaccgccgcacagc

SEQ ID NO: 2443433 - RNA, 18 nt, Bordetella pertussis
aggcaccucguucacccc

SEQ ID NO: 2443434 - RNA, 17 nt, Bordetella pertussis
aggcaccugcgaccgag

SEQ ID NO: 2443435 - RNA, 18 nt, Bordetella pertussis
aggcaccugcgaccgagc

SEQ ID NO: 2443436 - RNA, 20 nt, Bordetella pertussis
aggcacgcggaggagguggc

SEQ ID NO: 2443437 - RNA, 22 nt, Bordetella pertussis
aggcacuccggauaccgccgcc

SEQ ID NO: 2443438 - RNA, 17 nt, Bordetella pertussis
aggcacucuugccgcug

SEQ ID NO: 2443439 - RNA, 20 nt, Bordetella pertussis
aggcacucuugccgcugcgc

SEQ ID NO: 2443440 - RNA, 21 nt, Bordetella pertussis
aggcacucuugccgcugcgcg

SEQ ID NO: 2443441 - RNA, 22 nt, Bordetella pertussis
aggcagaaguggucgcgcaggc

SEQ ID NO: 2443442 - RNA, 14 nt, Bordetella pertussis
aggcagauccgccg

SEQ ID NO: 2443443 - RNA, 15 nt, Bordetella pertussis
aggcagcaccgccac

SEQ ID NO: 2443444 - RNA, 14 nt, Bordetella pertussis
aggcagccggcccc

SEQ ID NO: 2443445 - RNA, 17 nt, Bordetella pertussis
aggcagccggccccgca

SEQ ID NO: 2443446 - RNA, 21 nt, Bordetella pertussis
aggcagccugucguucggcug

SEQ ID NO: 2443447 - RNA, 16 nt, Bordetella pertussis
aggcagcgcggccggc

SEQ ID NO: 2443448 - RNA, 20 nt, Bordetella pertussis
aggcagcgcggccggcacca

SEQ ID NO: 2443449 - RNA, 11 nt, Bordetella pertussis
aggcagcggcc

SEQ ID NO: 2443450 - RNA, 20 nt, Bordetella pertussis
aggcagcggccgcgcgggcg

SEQ ID NO: 2443451 - RNA, 14 nt, Bordetella pertussis
aggcagcugcgcgu

SEQ ID NO: 2443452 - RNA, 17 nt, Bordetella pertussis
aggcagcugcgcgucga

SEQ ID NO: 2443453 - RNA, 14 nt, Bordetella pertussis
aggcaggcgggccc

SEQ ID NO: 2443454 - RNA, 17 nt, Bordetella pertussis
aggcaggcgggcccgca

SEQ ID NO: 2443455 - RNA, 17 nt, Bordetella pertussis
aggcaggggcuccagga

SEQ ID NO: 2443456 - RNA, 23 nt, Bordetella pertussis
aggcagugguggugcagcggcag

SEQ ID NO: 2443457 - RNA, 22 nt, Bordetella pertussis
aggcaguuggcggcgcagccgc

SEQ ID NO: 2443458 - RNA, 20 nt, Bordetella pertussis
aggcauacaggcuguggccg

SEQ ID NO: 2443459 - RNA, 17 nt, Bordetella pertussis
aggcaugcgccagcgcc

SEQ ID NO: 2443460 - RNA, 22 nt, Bordetella pertussis
aggcaugcgccagcgccugggc

SEQ ID NO: 2443461 - RNA, 18 nt, Bordetella pertussis
aggcauucccgcccagcg

SEQ ID NO: 2443462 - RNA, 15 nt, Bordetella pertussis
aggcauucgaacaac

SEQ ID NO: 2443463 - RNA, 18 nt, Bordetella pertussis
aggcauucgaacaacagc

SEQ ID NO: 2443464 - RNA, 17 nt, Bordetella pertussis
aggcauugcgccagccg

SEQ ID NO: 2443465 - RNA, 18 nt, Bordetella pertussis
aggcauuggcgccgcgcu

SEQ ID NO: 2443466 - RNA, 21 nt, Bordetella pertussis
aggcauuggcgccgcgcucgc

SEQ ID NO: 2443467 - RNA, 15 nt, Bordetella pertussis
aggcauuggcggcgg

SEQ ID NO: 2443468 - RNA, 19 nt, Bordetella pertussis
aggcauuggcggcggcguu

SEQ ID NO: 2443469 - RNA, 22 nt, Bordetella pertussis
aggccaccccguugcagcccag

SEQ ID NO: 2443470 - RNA, 18 nt, Bordetella pertussis
aggccacccgaagguggc

SEQ ID NO: 2443471 - RNA, 22 nt, Bordetella pertussis
aggccacccgccguaccgggcg

SEQ ID NO: 2443472 - RNA, 15 nt, Bordetella pertussis
aggccaccgacggcg

SEQ ID NO: 2443473 - RNA, 17 nt, Bordetella pertussis
aggccaccgacggcgcg

SEQ ID NO: 2443474 - RNA, 18 nt, Bordetella pertussis
aggccaccgacggcgcgg

SEQ ID NO: 2443475 - RNA, 18 nt, Bordetella pertussis
aggccaccgcggugccgc

SEQ ID NO: 2443476 - RNA, 20 nt, Bordetella pertussis
aggccaccgcggugccgcgc

SEQ ID NO: 2443477 - RNA, 19 nt, Bordetella pertussis
aggccacgaauuccucgcc

SEQ ID NO: 2443478 - RNA, 22 nt, Bordetella pertussis
aggccacgaugauggaggccag

SEQ ID NO: 2443479 - RNA, 13 nt, Bordetella pertussis
aggccacgcgcgg

SEQ ID NO: 2443480 - RNA, 14 nt, Bordetella pertussis
aggccacggcaaug

SEQ ID NO: 2443481 - RNA, 13 nt, Bordetella pertussis
aggccagcacgcc

SEQ ID NO: 2443482 - RNA, 13 nt, Bordetella pertussis
aggccagcagcuc

SEQ ID NO: 2443483 - RNA, 15 nt, Bordetella pertussis
aggccagcccgcgcg

SEQ ID NO: 2443484 - RNA, 17 nt, Bordetella pertussis
aggccagcccgcgcgcg

SEQ ID NO: 2443485 - RNA, 14 nt, Bordetella pertussis
aggccagcgccgcg

SEQ ID NO: 2443486 - RNA, 17 nt, Bordetella pertussis
aggccagcgccgcggcc

SEQ ID NO: 2443487 - RNA, 18 nt, Bordetella pertussis
aggccagcgccgcggccg

SEQ ID NO: 2443488 - RNA, 22 nt, Bordetella pertussis
aggccagcgccgcggccggcgg

SEQ ID NO: 2443489 - RNA, 17 nt, Bordetella pertussis
aggccagcgugcccagc

SEQ ID NO: 2443490 - RNA, 13 nt, Bordetella pertussis
aggccagcugcgc

SEQ ID NO: 2443491 - RNA, 12 nt, Bordetella pertussis
aggccaggcccu

SEQ ID NO: 2443492 - RNA, 19 nt, Bordetella pertussis
aggccaggcccucgcggcc

SEQ ID NO: 2443493 - RNA, 15 nt, Bordetella pertussis
aggccaggcucagca

SEQ ID NO: 2443494 - RNA, 12 nt, Bordetella pertussis
aggccaggcuga

SEQ ID NO: 2443495 - RNA, 20 nt, Bordetella pertussis
aggccagguucuggucgaac

SEQ ID NO: 2443496 - RNA, 22 nt, Bordetella pertussis
aggccagguugggugcgccgcc

SEQ ID NO: 2443497 - RNA, 16 nt, Bordetella pertussis
aggccagugccuggac

SEQ ID NO: 2443498 - RNA, 21 nt, Bordetella pertussis
aggccaguuccgugcgcgccc

SEQ ID NO: 2443499 - RNA, 23 nt, Bordetella pertussis
aggccaguuccgugcgcgcccga

SEQ ID NO: 2443500 - RNA, 22 nt, Bordetella pertussis
aggccaucgccgccgccgggcu

SEQ ID NO: 2443501 - RNA, 15 nt, Bordetella pertussis
aggccaugaucaggc

SEQ ID NO: 2443502 - RNA, 19 nt, Bordetella pertussis
aggccaugaucaggccgaa

SEQ ID NO: 2443503 - RNA, 20 nt, Bordetella pertussis
aggccaugcucguccaucgc

SEQ ID NO: 2443504 - RNA, 16 nt, Bordetella pertussis
aggccaugcugggcca

SEQ ID NO: 2443505 - RNA, 20 nt, Bordetella pertussis
aggccauugaaagcgcgagc

SEQ ID NO: 2443506 - RNA, 17 nt, Bordetella pertussis
aggccauugcuggcgcg

SEQ ID NO: 2443507 - RNA, 20 nt, Bordetella pertussis
aggcccaccagggccagcuu

SEQ ID NO: 2443508 - RNA, 19 nt, Bordetella pertussis
aggcccaccgcaucgcgca

SEQ ID NO: 2443509 - RNA, 14 nt, Bordetella pertussis
aggcccacgacgaa

SEQ ID NO: 2443510 - RNA, 19 nt, Bordetella pertussis
aggcccacggcaucgccgc

SEQ ID NO: 2443511 - RNA, 14 nt, Bordetella pertussis
aggcccagcacgcg

SEQ ID NO: 2443512 - RNA, 20 nt, Bordetella pertussis
aggcccagcacgcgcgccag

SEQ ID NO: 2443513 - RNA, 22 nt, Bordetella pertussis
aggcccagcacgcgcgccagcu

SEQ ID NO: 2443514 - RNA, 20 nt, Bordetella pertussis
aggcccagcaucaggcccga

SEQ ID NO: 2443515 - RNA, 14 nt, Bordetella pertussis
aggcccagccagcc

SEQ ID NO: 2443516 - RNA, 16 nt, Bordetella pertussis
aggcccagccagcccu

SEQ ID NO: 2443517 - RNA, 22 nt, Bordetella pertussis
aggcccagccagcccuggccca

SEQ ID NO: 2443518 - RNA, 16 nt, Bordetella pertussis
aggcccagccgcucgu

SEQ ID NO: 2443519 - RNA, 14 nt, Bordetella pertussis
aggcccagcgccag

SEQ ID NO: 2443520 - RNA, 19 nt, Bordetella pertussis
aggcccagcgccagcagca

SEQ ID NO: 2443521 - RNA, 20 nt, Bordetella pertussis
aggcccagcuugaacaggca

SEQ ID NO: 2443522 - RNA, 19 nt, Bordetella pertussis
aggcccaggcaaugcgcag

SEQ ID NO: 2443523 - RNA, 17 nt, Bordetella pertussis
aggcccaguucggcgcg

SEQ ID NO: 2443524 - RNA, 17 nt, Bordetella pertussis
aggcccauaugccgccg

SEQ ID NO: 2443525 - RNA, 23 nt, Bordetella pertussis
aggcccauaugccgccggccugc

SEQ ID NO: 2443526 - RNA, 18 nt, Bordetella pertussis
aggcccaugaaggcggcc

SEQ ID NO: 2443527 - RNA, 24 nt, Bordetella pertussis
aggcccaugaaggcggccagcaug

SEQ ID NO: 2443528 - RNA, 17 nt, Bordetella pertussis
aggcccaugacgccggu

SEQ ID NO: 2443529 - RNA, 10 nt, Bordetella pertussis
aggcccaugc

SEQ ID NO: 2443530 - RNA, 13 nt, Bordetella pertussis
aggccccgcgacc

SEQ ID NO: 2443531 - RNA, 13 nt, Bordetella pertussis
aggccccggcccg

SEQ ID NO: 2443532 - RNA, 17 nt, Bordetella pertussis
aggccccggcccggcgg

SEQ ID NO: 2443533 - RNA, 21 nt, Bordetella pertussis
aggccccggcccggcgggccg

SEQ ID NO: 2443534 - RNA, 12 nt, Bordetella pertussis
aggccccggccg

SEQ ID NO: 2443535 - RNA, 16 nt, Bordetella pertussis
aggcccgacaggaucg

SEQ ID NO: 2443536 - RNA, 22 nt, Bordetella pertussis
aggcccgacuuggugggcaccu

SEQ ID NO: 2443537 - RNA, 17 nt, Bordetella pertussis
aggcccgauggcgggga

SEQ ID NO: 2443538 - RNA, 19 nt, Bordetella pertussis
aggcccgauggcggggaug

SEQ ID NO: 2443539 - RNA, 21 nt, Bordetella pertussis
aggcccgccacggcgcccgag

SEQ ID NO: 2443540 - RNA, 16 nt, Bordetella pertussis
aggcccgcgcggccag

SEQ ID NO: 2443541 - RNA, 18 nt, Bordetella pertussis
aggcccgcgcggccagcg

SEQ ID NO: 2443542 - RNA, 19 nt, Bordetella pertussis
aggcccgcgucuuggcggg

SEQ ID NO: 2443543 - RNA, 22 nt, Bordetella pertussis
aggcccggauauggccggcgcg

SEQ ID NO: 2443544 - RNA, 13 nt, Bordetella pertussis
aggcccggccugc

SEQ ID NO: 2443545 - RNA, 11 nt, Bordetella pertussis
aggcccggcgc

SEQ ID NO: 2443546 - RNA, 17 nt, Bordetella pertussis
aggcccguguagacggc

SEQ ID NO: 2443547 - RNA, 15 nt, Bordetella pertussis
aggcccuccggcgcc

SEQ ID NO: 2443548 - RNA, 12 nt, Bordetella pertussis
aggcccugcgcg

SEQ ID NO: 2443549 - RNA, 17 nt, Bordetella pertussis
aggcccugggccagcag

SEQ ID NO: 2443550 - RNA, 19 nt, Bordetella pertussis
aggcccugggccagcagcu

SEQ ID NO: 2443551 - RNA, 21 nt, Bordetella pertussis
aggcccuggggccgcggcgcg

SEQ ID NO: 2443552 - RNA, 23 nt, Bordetella pertussis
aggccgaaauggcggcgguagcg

SEQ ID NO: 2443553 - RNA, 17 nt, Bordetella pertussis
aggccgaaccacagcau

SEQ ID NO: 2443554 - RNA, 14 nt, Bordetella pertussis
aggccgaacgcggu

SEQ ID NO: 2443555 - RNA, 19 nt, Bordetella pertussis
aggccgaacugggacaggc

SEQ ID NO: 2443556 - RNA, 22 nt, Bordetella pertussis
aggccgaccauguggcagaugg

SEQ ID NO: 2443557 - RNA, 19 nt, Bordetella pertussis
aggccgacgaggcgcuguu

SEQ ID NO: 2443558 - RNA, 17 nt, Bordetella pertussis
aggccgacgcgcugucc

SEQ ID NO: 2443559 - RNA, 19 nt, Bordetella pertussis
aggccgacgcgcuguccga

SEQ ID NO: 2443560 - RNA, 17 nt, Bordetella pertussis
aggccgagaugugcggc

SEQ ID NO: 2443561 - RNA, 16 nt, Bordetella pertussis
aggccgaggcugcgcg

SEQ ID NO: 2443562 - RNA, 19 nt, Bordetella pertussis
aggccgaguagcggcgcaa

SEQ ID NO: 2443563 - RNA, 22 nt, Bordetella pertussis
aggccgaguggccgcuguucgg

SEQ ID NO: 2443564 - RNA, 16 nt, Bordetella pertussis
aggccgauagcguucg

SEQ ID NO: 2443565 - RNA, 17 nt, Bordetella pertussis
aggccgaucagcgacag

SEQ ID NO: 2443566 - RNA, 23 nt, Bordetella pertussis
aggccgaucagcgacagcagggu

SEQ ID NO: 2443567 - RNA, 14 nt, Bordetella pertussis
aggccgaucagcgg

SEQ ID NO: 2443568 - RNA, 18 nt, Bordetella pertussis
aggccgaugaauugcgcc

SEQ ID NO: 2443569 - RNA, 20 nt, Bordetella pertussis
aggccgaugaauugcgccac

SEQ ID NO: 2443570 - RNA, 21 nt, Bordetella pertussis
aggccgaugaauugcgccacg

SEQ ID NO: 2443571 - RNA, 23 nt, Bordetella pertussis
aggccgauggcguccagcagcag

SEQ ID NO: 2443572 - RNA, 19 nt, Bordetella pertussis
aggccgauguagcccaugg

SEQ ID NO: 2443573 - RNA, 20 nt, Bordetella pertussis
aggccgcaacccacccccag

SEQ ID NO: 2443574 - RNA, 15 nt, Bordetella pertussis
aggccgcagcgggcc

SEQ ID NO: 2443575 - RNA, 21 nt, Bordetella pertussis
aggccgcagcgggcccgucgc

SEQ ID NO: 2443576 - RNA, 21 nt, Bordetella pertussis
aggccgccacgaaacccacgg

SEQ ID NO: 2443577 - RNA, 19 nt, Bordetella pertussis
aggccgccacuugcggcag

SEQ ID NO: 2443578 - RNA, 16 nt, Bordetella pertussis
aggccgccagggccga

SEQ ID NO: 2443579 - RNA, 13 nt, Bordetella pertussis
aggccgcccagcc

SEQ ID NO: 2443580 - RNA, 16 nt, Bordetella pertussis
aggccgcccagccgcg

SEQ ID NO: 2443581 - RNA, 21 nt, Bordetella pertussis
aggccgcccagccgcgccagg

SEQ ID NO: 2443582 - RNA, 16 nt, Bordetella pertussis
aggccgcccagcgcau

SEQ ID NO: 2443583 - RNA, 19 nt, Bordetella pertussis
aggccgcccgccccggcgc

SEQ ID NO: 2443584 - RNA, 20 nt, Bordetella pertussis
aggccgcccgccccggcgca

SEQ ID NO: 2443585 - RNA, 18 nt, Bordetella pertussis
aggccgccgcgcccagca

SEQ ID NO: 2443586 - RNA, 21 nt, Bordetella pertussis
aggccgccgcgcccagcagcg

SEQ ID NO: 2443587 - RNA, 22 nt, Bordetella pertussis
aggccgccgcgugcgccgggcu

SEQ ID NO: 2443588 - RNA, 23 nt, Bordetella pertussis
aggccgccgcgugcgccgggcug

SEQ ID NO: 2443589 - RNA, 10 nt, Bordetella pertussis
aggccgccgg

SEQ ID NO: 2443590 - RNA, 14 nt, Bordetella pertussis
aggccgccggccac

SEQ ID NO: 2443591 - RNA, 15 nt, Bordetella pertussis
aggccgccggccacc

SEQ ID NO: 2443592 - RNA, 16 nt, Bordetella pertussis
aggccgccggccacca

SEQ ID NO: 2443593 - RNA, 17 nt, Bordetella pertussis
aggcgcacaaccuggua

SEQ ID NO: 2443594 - RNA, 14 nt, Bordetella pertussis
aggcgcaccagcgc

SEQ ID NO: 2443595 - RNA, 19 nt, Bordetella pertussis
aggcgcaccagcgcgccga

SEQ ID NO: 2443596 - RNA, 21 nt, Bordetella pertussis
aggcgcaccagcgcgccgauc

SEQ ID NO: 2443597 - RNA, 15 nt, Bordetella pertussis
aggcgcacggcggca

SEQ ID NO: 2443598 - RNA, 15 nt, Bordetella pertussis
aggcgcagcaggcca

SEQ ID NO: 2443599 - RNA, 16 nt, Bordetella pertussis
aggcgcagcaggccag

SEQ ID NO: 2443600 - RNA, 12 nt, Bordetella pertussis
aggcgcagcgca

SEQ ID NO: 2443601 - RNA, 13 nt, Bordetella pertussis
aggcgcagcggcg

SEQ ID NO: 2443602 - RNA, 13 nt, Bordetella pertussis
aggcgcaggccga

SEQ ID NO: 2443603 - RNA, 15 nt, Bordetella pertussis
aggcgcaggccgacg

SEQ ID NO: 2443604 - RNA, 17 nt, Bordetella pertussis
aggcgcaggccgacgcg

SEQ ID NO: 2443605 - RNA, 16 nt, Bordetella pertussis
aggcgcaggccgcgcg

SEQ ID NO: 2443606 - RNA, 15 nt, Bordetella pertussis
aggcgcaguccagcg

SEQ ID NO: 2443607 - RNA, 19 nt, Bordetella pertussis
aggcgcaguccagcgugga

SEQ ID NO: 2443608 - RNA, 16 nt, Bordetella pertussis
aggcgcauauggagcc

SEQ ID NO: 2443609 - RNA, 19 nt, Bordetella pertussis
aggcgcauauggagccagg

SEQ ID NO: 2443610 - RNA, 21 nt, Bordetella pertussis
aggcgcauauggagccaggcg

SEQ ID NO: 2443611 - RNA, 14 nt, Bordetella pertussis
aggcgcaucagcuu

SEQ ID NO: 2443612 - RNA, 23 nt, Bordetella pertussis
aggcgcaucagcuuggccaccac

SEQ ID NO: 2443613 - RNA, 13 nt, Bordetella pertussis
aggcgcaugccac

SEQ ID NO: 2443614 - RNA, 19 nt, Bordetella pertussis
aggcgcauggugagggcca

SEQ ID NO: 2443615 - RNA, 21 nt, Bordetella pertussis
aggcgcauguccgccacgccg

SEQ ID NO: 2443616 - RNA, 17 nt, Bordetella pertussis
aggcgcauucgcgccug

SEQ ID NO: 2443617 - RNA, 12 nt, Bordetella pertussis
aggcgccacagg

SEQ ID NO: 2443618 - RNA, 14 nt, Bordetella pertussis
aggcgccagcggca

SEQ ID NO: 2443619 - RNA, 23 nt, Bordetella pertussis
aggcgccaguccccaugcgggga

SEQ ID NO: 2443620 - RNA, 14 nt, Bordetella pertussis
aggcgccccaggcg

SEQ ID NO: 2443621 - RNA, 18 nt, Bordetella pertussis
aggcgccccaggcgucgg

SEQ ID NO: 2443622 - RNA, 17 nt, Bordetella pertussis
aggcgcccgacggcgcg

SEQ ID NO: 2443623 - RNA, 20 nt, Bordetella pertussis
aggcgcccgacggcgcgccc

SEQ ID NO: 2443624 - RNA, 19 nt, Bordetella pertussis
aggcgcccgagagcugcgu

SEQ ID NO: 2443625 - RNA, 13 nt, Bordetella pertussis
aggcgcccgccac

SEQ ID NO: 2443626 - RNA, 15 nt, Bordetella pertussis
aggcgcccggcguga

SEQ ID NO: 2443627 - RNA, 15 nt, Bordetella pertussis
aggcgcccgugcgcg

SEQ ID NO: 2443628 - RNA, 18 nt, Bordetella pertussis
aggcgcccgugcgcggcg

SEQ ID NO: 2443629 - RNA, 19 nt, Bordetella pertussis
aggcgccgaaauuggcgac

SEQ ID NO: 2443630 - RNA, 12 nt, Bordetella pertussis
aggcgccgcaac

SEQ ID NO: 2443631 - RNA, 13 nt, Bordetella pertussis
aggcgccgcaaca

SEQ ID NO: 2443632 - RNA, 15 nt, Bordetella pertussis
aggcgccgcagaugg

SEQ ID NO: 2443633 - RNA, 22 nt, Bordetella pertussis
aggcgccgccccgucaucgggu

SEQ ID NO: 2443634 - RNA, 14 nt, Bordetella pertussis
aggcgccgccgccc

SEQ ID NO: 2443635 - RNA, 17 nt, Bordetella pertussis
aggcgccgccgugcgcg

SEQ ID NO: 2443636 - RNA, 23 nt, Bordetella pertussis
aggcgccgccgugcgcgggcgcg

SEQ ID NO: 2443637 - RNA, 13 nt, Bordetella pertussis
aggcgccgcgccc

SEQ ID NO: 2443638 - RNA, 22 nt, Bordetella pertussis
aggcgccgcguccggcgcccgc

SEQ ID NO: 2443639 - RNA, 22 nt, Bordetella pertussis
aggcgccgcucagcgcggcgcg

SEQ ID NO: 2443640 - RNA, 15 nt, Bordetella pertussis
aggcgccggccaggc

SEQ ID NO: 2443641 - RNA, 18 nt, Bordetella pertussis
aggcgccggccaggcccu

SEQ ID NO: 2443642 - RNA, 12 nt, Bordetella pertussis
aggcgccggccu

SEQ ID NO: 2443643 - RNA, 18 nt, Bordetella pertussis
aggcgccggcgccgggca

SEQ ID NO: 2443644 - RNA, 15 nt, Bordetella pertussis
aggcgccggcuggca

SEQ ID NO: 2443645 - RNA, 16 nt, Bordetella pertussis
aggcgccgggccgcua

SEQ ID NO: 2443646 - RNA, 19 nt, Bordetella pertussis
aggcgccgguccagcgccc

SEQ ID NO: 2443647 - RNA, 21 nt, Bordetella pertussis
aggcgccgguccagcgcccga

SEQ ID NO: 2443648 - RNA, 20 nt, Bordetella pertussis
aggcgccgucgaagccggcg

SEQ ID NO: 2443649 - RNA, 21 nt, Bordetella pertussis
aggcgccuacaguuccaccug

SEQ ID NO: 2443650 - RNA, 22 nt, Bordetella pertussis
aggcgccuacaguuccaccugc

SEQ ID NO: 2443651 - RNA, 16 nt, Bordetella pertussis
aggcgccucgcgacgg

SEQ ID NO: 2443652 - RNA, 15 nt, Bordetella pertussis
aggcgccugccccgc

SEQ ID NO: 2443653 - RNA, 17 nt, Bordetella pertussis
aggcgccugccccgccg

SEQ ID NO: 2443654 - RNA, 21 nt, Bordetella pertussis
aggcgccugcucacgccccgc

SEQ ID NO: 2443655 - RNA, 16 nt, Bordetella pertussis
aggcgccuucggcgcg

SEQ ID NO: 2443656 - RNA, 12 nt, Bordetella pertussis
aggcgcgcacca

SEQ ID NO: 2443657 - RNA, 16 nt, Bordetella pertussis
aggcgcgcaccagccc

SEQ ID NO: 2443658 - RNA, 23 nt, Bordetella pertussis
aggcgcgcaccagcccgcccgcg

SEQ ID NO: 2443659 - RNA, 18 nt, Bordetella pertussis
aggcgcgcaggcgggccu

SEQ ID NO: 2443660 - RNA, 19 nt, Bordetella pertussis
aggcgcgcaucgcgcggca

SEQ ID NO: 2443661 - RNA, 21 nt, Bordetella pertussis
aggcgcgccaccggucgccgu

SEQ ID NO: 2443662 - RNA, 22 nt, Bordetella pertussis
aggcgcgccagcccgccgcugg

SEQ ID NO: 2443663 - RNA, 14 nt, Bordetella pertussis
aggcgcgccagccg

SEQ ID NO: 2443664 - RNA, 19 nt, Bordetella pertussis
aggcgcgccagccgcgcga

SEQ ID NO: 2443665 - RNA, 11 nt, Bordetella pertussis
aggcgcgccau

SEQ ID NO: 2443666 - RNA, 14 nt, Bordetella pertussis
aggcgcgcccgcgu

SEQ ID NO: 2443667 - RNA, 20 nt, Bordetella pertussis
aggcgcgccgcgauggcgcc

SEQ ID NO: 2443668 - RNA, 22 nt, Bordetella pertussis
aggcgcgccgcgauggcgccgg

SEQ ID NO: 2443669 - RNA, 22 nt, Bordetella pertussis
aggcgcgccgggccggcgggca

SEQ ID NO: 2443670 - RNA, 18 nt, Bordetella pertussis
aggcgcgcgcaucggccg

SEQ ID NO: 2443671 - RNA, 11 nt, Bordetella pertussis
aggcgcgcgcc

SEQ ID NO: 2443672 - RNA, 22 nt, Bordetella pertussis
aggcgcgcgccaucgacgggcg

SEQ ID NO: 2443673 - RNA, 15 nt, Bordetella pertussis
aggcgcgcgcgcgga

SEQ ID NO: 2443674 - RNA, 16 nt, Bordetella pertussis
aggcgcgcggccucga

SEQ ID NO: 2443675 - RNA, 12 nt, Bordetella pertussis
aggcgcggcaaa

SEQ ID NO: 2443676 - RNA, 15 nt, Bordetella pertussis
aggcgcggccgggcu

SEQ ID NO: 2443677 - RNA, 24 nt, Bordetella pertussis
aggcgcggccgucgugcagcgugg

SEQ ID NO: 2443678 - RNA, 18 nt, Bordetella pertussis
aggcugcgcgccggcgcc

SEQ ID NO: 2443679 - RNA, 17 nt, Bordetella pertussis
aggcugcggcggauuca

SEQ ID NO: 2443680 - RNA, 21 nt, Bordetella pertussis
aggcugcggcggauucaggcg

SEQ ID NO: 2443681 - RNA, 18 nt, Bordetella pertussis
aggcuggacccggagcug

SEQ ID NO: 2443682 - RNA, 18 nt, Bordetella pertussis
aggcuggagucgggcugc

SEQ ID NO: 2443683 - RNA, 22 nt, Bordetella pertussis
aggcuggccaccgaagcggcgu

SEQ ID NO: 2443684 - RNA, 15 nt, Bordetella pertussis
aggcuggccggcgug

SEQ ID NO: 2443685 - RNA, 20 nt, Bordetella pertussis
aggcuggccggcguggccug

SEQ ID NO: 2443686 - RNA, 15 nt, Bordetella pertussis
aggcuggccugcagg

SEQ ID NO: 2443687 - RNA, 14 nt, Bordetella pertussis
aggcuggcgcccac

SEQ ID NO: 2443688 - RNA, 13 nt, Bordetella pertussis
aggcugggagagc

SEQ ID NO: 2443689 - RNA, 19 nt, Bordetella pertussis
aggcugggagagccggcca

SEQ ID NO: 2443690 - RNA, 20 nt, Bordetella pertussis
aggcugggagagccggccac

SEQ ID NO: 2443691 - RNA, 22 nt, Bordetella pertussis
aggcugggagagccggccacgc

SEQ ID NO: 2443692 - RNA, 20 nt, Bordetella pertussis
aggcugggcgaaacggccag

SEQ ID NO: 2443693 - RNA, 21 nt, Bordetella pertussis
aggcugggcgaaacggccagc

SEQ ID NO: 2443694 - RNA, 20 nt, Bordetella pertussis
aggcugucccagauggcgcc

SEQ ID NO: 2443695 - RNA, 17 nt, Bordetella pertussis
aggcuguccccgcaugg

SEQ ID NO: 2443696 - RNA, 18 nt, Bordetella pertussis
aggcuguccccgcaugga

SEQ ID NO: 2443697 - RNA, 22 nt, Bordetella pertussis
agggcgaucaugcaguacaggc

SEQ ID NO: 2443698 - RNA, 19 nt, Bordetella pertussis
agggcgaucuugccggccu

SEQ ID NO: 2443699 - RNA, 16 nt, Bordetella pertussis
agggcgaugccgcaga

SEQ ID NO: 2443700 - RNA, 22 nt, Bordetella pertussis
agggcgaugcgguaccacgcga

SEQ ID NO: 2443701 - RNA, 15 nt, Bordetella pertussis
agggcgauggcgcgu

SEQ ID NO: 2443702 - RNA, 17 nt, Bordetella pertussis
agggcgauuccgccaac

SEQ ID NO: 2443703 - RNA, 22 nt, Bordetella pertussis
agggcgcaacgccggccgccau

SEQ ID NO: 2443704 - RNA, 13 nt, Bordetella pertussis
agggcgccgcgcc

SEQ ID NO: 2443705 - RNA, 19 nt, Bordetella pertussis
agggcgccgcgccggggcg

SEQ ID NO: 2443706 - RNA, 20 nt, Bordetella pertussis
agggcgccgcggcggcgagg

SEQ ID NO: 2443707 - RNA, 14 nt, Bordetella pertussis
agggcgccgcgggg

SEQ ID NO: 2443708 - RNA, 13 nt, Bordetella pertussis
agggcgccgggcg

SEQ ID NO: 2443709 - RNA, 16 nt, Bordetella pertussis
agggcgcgcagcaggc

SEQ ID NO: 2443710 - RNA, 14 nt, Bordetella pertussis
agggcgcgccagca

SEQ ID NO: 2443711 - RNA, 15 nt, Bordetella pertussis
agggcgcgccagcac

SEQ ID NO: 2443712 - RNA, 16 nt, Bordetella pertussis
agggcgcgccagcacg

SEQ ID NO: 2443713 - RNA, 21 nt, Bordetella pertussis
agggcgcgccggaacauggcg

SEQ ID NO: 2443714 - RNA, 12 nt, Bordetella pertussis
agggcgcggacu

SEQ ID NO: 2443715 - RNA, 15 nt, Bordetella pertussis
agggcgcggccaggg

SEQ ID NO: 2443716 - RNA, 16 nt, Bordetella pertussis
agggcgcggccagggu

SEQ ID NO: 2443717 - RNA, 17 nt, Bordetella pertussis
agggcgcgggccagcuc

SEQ ID NO: 2443718 - RNA, 22 nt, Bordetella pertussis
agggcggaaaacagcaccagca

SEQ ID NO: 2443719 - RNA, 12 nt, Bordetella pertussis
agggcggccagg

SEQ ID NO: 2443720 - RNA, 15 nt, Bordetella pertussis
agggcggccaugccg

SEQ ID NO: 2443721 - RNA, 19 nt, Bordetella pertussis
agggcggccaugccgucac

SEQ ID NO: 2443722 - RNA, 15 nt, Bordetella pertussis
agggcggccggcacg

SEQ ID NO: 2443723 - RNA, 19 nt, Bordetella pertussis
agggcgggcggugcggccu

SEQ ID NO: 2443724 - RNA, 21 nt, Bordetella pertussis
agggcgggggacgcccgcccg

SEQ ID NO: 2443725 - RNA, 18 nt, Bordetella pertussis
agggcggggugccugcau

SEQ ID NO: 2443726 - RNA, 14 nt, Bordetella pertussis
agggcggugcgcuc

SEQ ID NO: 2443727 - RNA, 16 nt, Bordetella pertussis
agggcggugggcagcg

SEQ ID NO: 2443728 - RNA, 18 nt, Bordetella pertussis
agggcguacgacggggug

SEQ ID NO: 2443729 - RNA, 14 nt, Bordetella pertussis
agggcgucaucggc

SEQ ID NO: 2443730 - RNA, 14 nt, Bordetella pertussis
agggcgucgcggcg

SEQ ID NO: 2443731 - RNA, 14 nt, Bordetella pertussis
agggcgucggccgc

SEQ ID NO: 2443732 - RNA, 18 nt, Bordetella pertussis
agggugggcacgcgcgcg

SEQ ID NO: 2443733 - RNA, 15 nt, Bordetella pertussis
agggugucgccgggg

SEQ ID NO: 2443734 - RNA, 17 nt, Bordetella pertussis
agggugucgccggggcg

SEQ ID NO: 2443735 - RNA, 18 nt, Bordetella pertussis
agggugucggccagggcg

SEQ ID NO: 2443736 - RNA, 22 nt, Bordetella pertussis
agggugucggccagggcggcga

SEQ ID NO: 2443737 - RNA, 14 nt, Bordetella pertussis
aggguguugccgag

SEQ ID NO: 2443738 - RNA, 17 nt, Bordetella pertussis
aggguuauuuccggccg

SEQ ID NO: 2443739 - RNA, 18 nt, Bordetella pertussis
aggguuauuuccggccgc

SEQ ID NO: 2443740 - RNA, 19 nt, Bordetella pertussis
aggguuauuuccggccgca

SEQ ID NO: 2443741 - RNA, 21 nt, Bordetella pertussis
aggguucggugccuguccccg

SEQ ID NO: 2443742 - RNA, 18 nt, Bordetella pertussis
aggguugcaguucgccgg

SEQ ID NO: 2443743 - RNA, 20 nt, Bordetella pertussis
aggguugcaguucgccggcg

SEQ ID NO: 2443744 - RNA, 21 nt, Bordetella pertussis
aggguuguccgaaccacccgg

SEQ ID NO: 2443745 - RNA, 18 nt, Bordetella pertussis
aggguuguggccguggcg

SEQ ID NO: 2443746 - RNA, 21 nt, Bordetella pertussis
agguacccccagcggcgcacc

SEQ ID NO: 2443747 - RNA, 16 nt, Bordetella pertussis
agguagaccacgcaaa

SEQ ID NO: 2443748 - RNA, 18 nt, Bordetella pertussis
agguagggcgcggccagg

SEQ ID NO: 2443749 - RNA, 19 nt, Bordetella pertussis
agguagguggacacgccca

SEQ ID NO: 2443750 - RNA, 19 nt, Bordetella pertussis
agguagucgaugaaggcgc

SEQ ID NO: 2443751 - RNA, 20 nt, Bordetella pertussis
agguagucgaugaaggcgcc

SEQ ID NO: 2443752 - RNA, 15 nt, Bordetella pertussis
agguagucggucacc

SEQ ID NO: 2443753 - RNA, 23 nt, Bordetella pertussis
agguaucgacccaggccggcgcc

SEQ ID NO: 2443754 - RNA, 18 nt, Bordetella pertussis
agguaugcacgaccaggc

SEQ ID NO: 2443755 - RNA, 20 nt, Bordetella pertussis
agguaugcacgaccaggccg

SEQ ID NO: 2443756 - RNA, 20 nt, Bordetella pertussis
agguauucgcgcgauugcau

SEQ ID NO: 2443757 - RNA, 17 nt, Bordetella pertussis
agguauugcggggcggc

SEQ ID NO: 2443758 - RNA, 14 nt, Bordetella pertussis
agguauugcucggc

SEQ ID NO: 2443759 - RNA, 19 nt, Bordetella pertussis
aggucagcaugaagcugcc

SEQ ID NO: 2443760 - RNA, 15 nt, Bordetella pertussis
aggucagcccggcgg

SEQ ID NO: 2443761 - RNA, 16 nt, Bordetella pertussis
aggucaggcccacgcc

SEQ ID NO: 2443762 - RNA, 19 nt, Bordetella pertussis
aggucaggcccacgccgcc

SEQ ID NO: 2443763 - RNA, 21 nt, Bordetella pertussis
aggucaggcccacgccgccga

SEQ ID NO: 2443764 - RNA, 17 nt, Bordetella pertussis
aggucaucaccagggug

SEQ ID NO: 2443765 - RNA, 19 nt, Bordetella pertussis
aggucaugcagaacagggu

SEQ ID NO: 2443766 - RNA, 17 nt, Bordetella pertussis
agguccagcgccacggc

SEQ ID NO: 2443767 - RNA, 13 nt, Bordetella pertussis
agguccaggcgcg

SEQ ID NO: 2443768 - RNA, 19 nt, Bordetella pertussis
agguccaugaacgccgcgc

SEQ ID NO: 2443769 - RNA, 16 nt, Bordetella pertussis
agguccgccggcacgc

SEQ ID NO: 2443770 - RNA, 16 nt, Bordetella pertussis
agguccggucgcgcgu

SEQ ID NO: 2443771 - RNA, 18 nt, Bordetella pertussis
agguccugcacgcgggcc

SEQ ID NO: 2443772 - RNA, 19 nt, Bordetella pertussis
agguccugcacgcgggcca

SEQ ID NO: 2443773 - RNA, 23 nt, Bordetella pertussis
agguccugcacgcgggccaguug

SEQ ID NO: 2443774 - RNA, 16 nt, Bordetella pertussis
agguccugcgccagcu

SEQ ID NO: 2443775 - RNA, 13 nt, Bordetella pertussis
agguccugcucgg

SEQ ID NO: 2443776 - RNA, 18 nt, Bordetella pertussis
agguccuggcggccgccc

SEQ ID NO: 2443777 - RNA, 22 nt, Bordetella pertussis
agguccuggcggccgcccagca

SEQ ID NO: 2443778 - RNA, 21 nt, Bordetella pertussis
aggucgaugccggcggccugc

SEQ ID NO: 2443779 - RNA, 15 nt, Bordetella pertussis
aggucgccagcaggc

SEQ ID NO: 2443780 - RNA, 23 nt, Bordetella pertussis
aggucgcgcgacgugucggccac

SEQ ID NO: 2443781 - RNA, 17 nt, Bordetella pertussis
aggucgcggugcgccac

SEQ ID NO: 2443782 - RNA, 19 nt, Bordetella pertussis
aggucgcuucgguggcgcg

SEQ ID NO: 2443783 - RNA, 12 nt, Bordetella pertussis
aggucggccacc

SEQ ID NO: 2443784 - RNA, 18 nt, Bordetella pertussis
aucuugccaggcccggcg

SEQ ID NO: 2443785 - RNA, 21 nt, Bordetella pertussis
aucuugccaggcccggcgcgc

SEQ ID NO: 2443786 - RNA, 13 nt, Bordetella pertussis
aucuugccgccgg

SEQ ID NO: 2443787 - RNA, 16 nt, Bordetella pertussis
aucuugccgccgggca

SEQ ID NO: 2443788 - RNA, 23 nt, Bordetella pertussis
aucuugccggccuguucuuucuu

SEQ ID NO: 2443789 - RNA, 13 nt, Bordetella pertussis
aucuugcgccgcu

SEQ ID NO: 2443790 - RNA, 15 nt, Bordetella pertussis
aucuuggugcgcgcc

SEQ ID NO: 2443791 - RNA, 21 nt, Bordetella pertussis
augaaagcgaacagggcgcga

SEQ ID NO: 2443792 - RNA, 21 nt, Bordetella pertussis
augaacagcggcacgccggcg

SEQ ID NO: 2443793 - RNA, 21 nt, Bordetella pertussis
augaacggcagcgcgcgcgug

SEQ ID NO: 2443794 - RNA, 21 nt, Bordetella pertussis
augaacucgcgcucggcgacg

SEQ ID NO: 2443795 - RNA, 16 nt, Bordetella pertussis
augaagaccacgugga

SEQ ID NO: 2443796 - RNA, 17 nt, Bordetella pertussis
augaagaccacguggau

SEQ ID NO: 2443797 - RNA, 15 nt, Bordetella pertussis
augaagaugccgaac

SEQ ID NO: 2443798 - RNA, 14 nt, Bordetella pertussis
augaagcgcagcag

SEQ ID NO: 2443799 - RNA, 17 nt, Bordetella pertussis
augaagcugcccagcaa

SEQ ID NO: 2443800 - RNA, 15 nt, Bordetella pertussis
augaaggcggccagc

SEQ ID NO: 2443801 - RNA, 16 nt, Bordetella pertussis
augaaggcggccagca

SEQ ID NO: 2443802 - RNA, 19 nt, Bordetella pertussis
augaagggcuggccggcca

SEQ ID NO: 2443803 - RNA, 16 nt, Bordetella pertussis
augaaggugcgcagca

SEQ ID NO: 2443804 - RNA, 23 nt, Bordetella pertussis
augaagucgucgauggcccgcag

SEQ ID NO: 2443805 - RNA, 20 nt, Bordetella pertussis
augaauuccagccaggccuc

SEQ ID NO: 2443806 - RNA, 23 nt, Bordetella pertussis
augacaucgccgcugcgcagcag

SEQ ID NO: 2443807 - RNA, 15 nt, Bordetella pertussis
augacaugcgggccu

SEQ ID NO: 2443808 - RNA, 19 nt, Bordetella pertussis
augaccagccagccgccgc

SEQ ID NO: 2443809 - RNA, 16 nt, Bordetella pertussis
augaccagcgccggcg

SEQ ID NO: 2443810 - RNA, 18 nt, Bordetella pertussis
augaccagcgccggcgca

SEQ ID NO: 2443811 - RNA, 15 nt, Bordetella pertussis
augaccagcggcgug

SEQ ID NO: 2443812 - RNA, 16 nt, Bordetella pertussis
augaccagcggcguga

SEQ ID NO: 2443813 - RNA, 22 nt, Bordetella pertussis
augacccugcacgauuccgccu

SEQ ID NO: 2443814 - RNA, 14 nt, Bordetella pertussis
augaccgacgccgu

SEQ ID NO: 2443815 - RNA, 14 nt, Bordetella pertussis
augaccgccgccag

SEQ ID NO: 2443816 - RNA, 17 nt, Bordetella pertussis
augaccgccgccagcag

SEQ ID NO: 2443817 - RNA, 19 nt, Bordetella pertussis
augaccgccgccagcagcg

SEQ ID NO: 2443818 - RNA, 14 nt, Bordetella pertussis
augaccgccgcgcc

SEQ ID NO: 2443819 - RNA, 16 nt, Bordetella pertussis
augaccgccgcgccgg

SEQ ID NO: 2443820 - RNA, 17 nt, Bordetella pertussis
augaccgccgcgccggu

SEQ ID NO: 2443821 - RNA, 18 nt, Bordetella pertussis
augaccgccggcaccagc

SEQ ID NO: 2443822 - RNA, 14 nt, Bordetella pertussis
augaccggccaggc

SEQ ID NO: 2443823 - RNA, 15 nt, Bordetella pertussis
augaccggccaggcg

SEQ ID NO: 2443824 - RNA, 13 nt, Bordetella pertussis
augaccggcgcgg

SEQ ID NO: 2443825 - RNA, 14 nt, Bordetella pertussis
augaccggcgcggc

SEQ ID NO: 2443826 - RNA, 16 nt, Bordetella pertussis
augaccggcgcggccu

SEQ ID NO: 2443827 - RNA, 17 nt, Bordetella pertussis
augaccggcgcggccug

SEQ ID NO: 2443828 - RNA, 22 nt, Bordetella pertussis
augaccggcguguccagcggcg

SEQ ID NO: 2443829 - RNA, 19 nt, Bordetella pertussis
augaccucggcgagcgccu

SEQ ID NO: 2443830 - RNA, 20 nt, Bordetella pertussis
augaccugcgacagcaccgg

SEQ ID NO: 2443831 - RNA, 17 nt, Bordetella pertussis
augaccugcgccaggug

SEQ ID NO: 2443832 - RNA, 18 nt, Bordetella pertussis
augaccugcgccaggugc

SEQ ID NO: 2443833 - RNA, 20 nt, Bordetella pertussis
augaccugcgccaggugcuu

SEQ ID NO: 2443834 - RNA, 21 nt, Bordetella pertussis
augaccugcgccaggugcuug

SEQ ID NO: 2443835 - RNA, 19 nt, Bordetella pertussis
augacgaccuugcggccgc

SEQ ID NO: 2443836 - RNA, 14 nt, Bordetella pertussis
augacgacgccggc

SEQ ID NO: 2443837 - RNA, 11 nt, Bordetella pertussis
augacgaucac

SEQ ID NO: 2443838 - RNA, 13 nt, Bordetella pertussis
augacggccagga

SEQ ID NO: 2443839 - RNA, 13 nt, Bordetella pertussis
augacggcgucga

SEQ ID NO: 2443840 - RNA, 13 nt, Bordetella pertussis
augacggggcggc

SEQ ID NO: 2443841 - RNA, 15 nt, Bordetella pertussis
augacggggcggcgc

SEQ ID NO: 2443842 - RNA, 19 nt, Bordetella pertussis
augacggggugccuguccc

SEQ ID NO: 2443843 - RNA, 16 nt, Bordetella pertussis
augacggugccgagca

SEQ ID NO: 2443844 - RNA, 19 nt, Bordetella pertussis
augacgguggugucggcgg

SEQ ID NO: 2443845 - RNA, 20 nt, Bordetella pertussis
augacgguggugucggcggc

SEQ ID NO: 2443846 - RNA, 13 nt, Bordetella pertussis
augacguccagcg

SEQ ID NO: 2443847 - RNA, 15 nt, Bordetella pertussis
augacucgggcaugc

SEQ ID NO: 2443848 - RNA, 19 nt, Bordetella pertussis
augacucgggcaugcgccu

SEQ ID NO: 2443849 - RNA, 14 nt, Bordetella pertussis
augagacacggcag

SEQ ID NO: 2443850 - RNA, 16 nt, Bordetella pertussis
augagcccgaugccgc

SEQ ID NO: 2443851 - RNA, 17 nt, Bordetella pertussis
augagcugaugcucgcc

SEQ ID NO: 2443852 - RNA, 14 nt, Bordetella pertussis
augaggccagggag

SEQ ID NO: 2443853 - RNA, 13 nt, Bordetella pertussis
augaggccccugu

SEQ ID NO: 2443854 - RNA, 22 nt, Bordetella pertussis
augauacccauggccgugcgcc

SEQ ID NO: 2443855 - RNA, 19 nt, Bordetella pertussis
augaucaggccgaacuggg

SEQ ID NO: 2443856 - RNA, 12 nt, Bordetella pertussis
augauccacagu

SEQ ID NO: 2443857 - RNA, 17 nt, Bordetella pertussis
augaucgccucggggcu

SEQ ID NO: 2443858 - RNA, 18 nt, Bordetella pertussis
augaucgcgcagcaccgc

SEQ ID NO: 2443859 - RNA, 12 nt, Bordetella pertussis
augaucggcgcc

SEQ ID NO: 2443860 - RNA, 17 nt, Bordetella pertussis
augaugagcgcgccgcc

SEQ ID NO: 2443861 - RNA, 19 nt, Bordetella pertussis
augaugagcgcgccgccgu

SEQ ID NO: 2443862 - RNA, 14 nt, Bordetella pertussis
augaugcagcacac

SEQ ID NO: 2443863 - RNA, 13 nt, Bordetella pertussis
augaugcccagcg

SEQ ID NO: 2443864 - RNA, 18 nt, Bordetella pertussis
augaugcccagcgccagg

SEQ ID NO: 2443865 - RNA, 13 nt, Bordetella pertussis
augaugcggcgcc

SEQ ID NO: 2443866 - RNA, 16 nt, Bordetella pertussis
augauggaggccagga

SEQ ID NO: 2443867 - RNA, 17 nt, Bordetella pertussis
augauggugaacgccac

SEQ ID NO: 2443868 - RNA, 22 nt, Bordetella pertussis
augcaauagcgcccgccuucgc

SEQ ID NO: 2443869 - RNA, 22 nt, Bordetella pertussis
augcaccacggccacgucgguc

SEQ ID NO: 2443870 - RNA, 10 nt, Bordetella pertussis
augcaccagc

SEQ ID NO: 2443871 - RNA, 14 nt, Bordetella pertussis
augcaccagcacau

SEQ ID NO: 2443872 - RNA, 14 nt, Bordetella pertussis
augcaccaguuuuc

SEQ ID NO: 2443873 - RNA, 21 nt, Bordetella pertussis
augcaccgcguggcgcugcgu

SEQ ID NO: 2443874 - RNA, 14 nt, Bordetella pertussis
augcaccugcaggg

SEQ ID NO: 2443875 - RNA, 17 nt, Bordetella pertussis
augcaccugcaggguca

SEQ ID NO: 2443876 - RNA, 14 nt, Bordetella pertussis
augcacgaccaggc

SEQ ID NO: 2443877 - RNA, 18 nt, Bordetella pertussis
augcacgaugccgucgcc

SEQ ID NO: 2443878 - RNA, 20 nt, Bordetella pertussis
augcacgaugguaucggccg

SEQ ID NO: 2443879 - RNA, 21 nt, Bordetella pertussis
augcacgggcgcugcccagga

SEQ ID NO: 2443880 - RNA, 20 nt, Bordetella pertussis
augcacguagcgcagcaccg

SEQ ID NO: 2443881 - RNA, 17 nt, Bordetella pertussis
augcagcacgucggcgu

SEQ ID NO: 2443882 - RNA, 20 nt, Bordetella pertussis
augcagcacgucggcgucgg

SEQ ID NO: 2443883 - RNA, 13 nt, Bordetella pertussis
augcagccgcaau

SEQ ID NO: 2443884 - RNA, 20 nt, Bordetella pertussis
augcaggcuuugcuggccau

SEQ ID NO: 2443885 - RNA, 24 nt, Bordetella pertussis
augcagguccugguaucccucgcc

SEQ ID NO: 2443886 - RNA, 15 nt, Bordetella pertussis
augcaggucggggcg

SEQ ID NO: 2443887 - RNA, 17 nt, Bordetella pertussis
augcaggucggggcgcu

SEQ ID NO: 2443888 - RNA, 19 nt, Bordetella pertussis
augcaggucggggcgcucg

SEQ ID NO: 2443889 - RNA, 17 nt, Bordetella pertussis
augcaguacaggcgcgu

SEQ ID NO: 2443890 - RNA, 18 nt, Bordetella pertussis
augcauucggcggccggc

SEQ ID NO: 2443891 - RNA, 22 nt, Bordetella pertussis
augccaccacaaggauggacug

SEQ ID NO: 2443892 - RNA, 18 nt, Bordetella pertussis
augccaccucgcuugccc

SEQ ID NO: 2443893 - RNA, 19 nt, Bordetella pertussis
augccagcggcgcagccgg

SEQ ID NO: 2443894 - RNA, 20 nt, Bordetella pertussis
augccagcggcgcagccggc

SEQ ID NO: 2443895 - RNA, 22 nt, Bordetella pertussis
augccagugaaacgcgacgcgc

SEQ ID NO: 2443896 - RNA, 14 nt, Bordetella pertussis
augccaugccgggc

SEQ ID NO: 2443897 - RNA, 19 nt, Bordetella pertussis
augccauuggugcgcacau

SEQ ID NO: 2443898 - RNA, 16 nt, Bordetella pertussis
augcccagcaccgcca

SEQ ID NO: 2443899 - RNA, 23 nt, Bordetella pertussis
aggugcccgcgaagcagccggcc

SEQ ID NO: 2443900 - RNA, 12 nt, Bordetella pertussis
aggugccgccgg

SEQ ID NO: 2443901 - RNA, 16 nt, Bordetella pertussis
aggugccgccggcgcg

SEQ ID NO: 2443902 - RNA, 23 nt, Bordetella pertussis
aggugccgcguaugcggcagcag

SEQ ID NO: 2443903 - RNA, 16 nt, Bordetella pertussis
aggugccggacgcccu

SEQ ID NO: 2443904 - RNA, 16 nt, Bordetella pertussis
aggugccguccggcac

SEQ ID NO: 2443905 - RNA, 21 nt, Bordetella pertussis
aggugccugucccagcgggga

SEQ ID NO: 2443906 - RNA, 15 nt, Bordetella pertussis
aggugccuguccccc

SEQ ID NO: 2443907 - RNA, 22 nt, Bordetella pertussis
aggugccuguccccguggggac

SEQ ID NO: 2443908 - RNA, 18 nt, Bordetella pertussis
aggugcgcagcaggugga

SEQ ID NO: 2443909 - RNA, 14 nt, Bordetella pertussis
aggugcgcagccgg

SEQ ID NO: 2443910 - RNA, 15 nt, Bordetella pertussis
aggugcgcagccggg

SEQ ID NO: 2443911 - RNA, 17 nt, Bordetella pertussis
aggugcgcagccgggcu

SEQ ID NO: 2443912 - RNA, 18 nt, Bordetella pertussis
aggugcgcagccgggcug

SEQ ID NO: 2443913 - RNA, 13 nt, Bordetella pertussis
aggugcgccagca

SEQ ID NO: 2443914 - RNA, 16 nt, Bordetella pertussis
aggugcgcggcgcgcc

SEQ ID NO: 2443915 - RNA, 13 nt, Bordetella pertussis
aggugcggccgca

SEQ ID NO: 2443916 - RNA, 22 nt, Bordetella pertussis
aggugcgucacgcacagcaccu

SEQ ID NO: 2443917 - RNA, 14 nt, Bordetella pertussis
aggugcuuggcggu

SEQ ID NO: 2443918 - RNA, 16 nt, Bordetella pertussis
agguggacacgcccau

SEQ ID NO: 2443919 - RNA, 16 nt, Bordetella pertussis
agguggacagcgccag

SEQ ID NO: 2443920 - RNA, 17 nt, Bordetella pertussis
agguggacagcgccagc

SEQ ID NO: 2443921 - RNA, 16 nt, Bordetella pertussis
agguggaugcguucgc

SEQ ID NO: 2443922 - RNA, 12 nt, Bordetella pertussis
agguggcacauc

SEQ ID NO: 2443923 - RNA, 13 nt, Bordetella pertussis
agguggccagccc

SEQ ID NO: 2443924 - RNA, 14 nt, Bordetella pertussis
agguggcgaugccg

SEQ ID NO: 2443925 - RNA, 17 nt, Bordetella pertussis
agguggcgaugccgggc

SEQ ID NO: 2443926 - RNA, 19 nt, Bordetella pertussis
agguggcgaugccgggcac

SEQ ID NO: 2443927 - RNA, 14 nt, Bordetella pertussis
agguggcggacagg

SEQ ID NO: 2443928 - RNA, 15 nt, Bordetella pertussis
agguggcggacaggc

SEQ ID NO: 2443929 - RNA, 16 nt, Bordetella pertussis
agguggcggacaggcc

SEQ ID NO: 2443930 - RNA, 12 nt, Bordetella pertussis
agguggcggcgg

SEQ ID NO: 2443931 - RNA, 14 nt, Bordetella pertussis
agguggcgugcagc

SEQ ID NO: 2443932 - RNA, 12 nt, Bordetella pertussis
aggugggcgcgc

SEQ ID NO: 2443933 - RNA, 20 nt, Bordetella pertussis
agguggggcagcaggccggc

SEQ ID NO: 2443934 - RNA, 22 nt, Bordetella pertussis
agguggggcagcaggccggcgg

SEQ ID NO: 2443935 - RNA, 18 nt, Bordetella pertussis
agguguaaucgugccgga

SEQ ID NO: 2443936 - RNA, 20 nt, Bordetella pertussis
aggugugccagccgcuggcg

SEQ ID NO: 2443937 - RNA, 14 nt, Bordetella pertussis
agguguucgcgcac

SEQ ID NO: 2443938 - RNA, 15 nt, Bordetella pertussis
agguuagcggcagug

SEQ ID NO: 2443939 - RNA, 14 nt, Bordetella pertussis
agguucgccuggcg

SEQ ID NO: 2443940 - RNA, 15 nt, Bordetella pertussis
agguucgccuggcgg

SEQ ID NO: 2443941 - RNA, 22 nt, Bordetella pertussis
agguucucgauguggcgcuggc

SEQ ID NO: 2443942 - RNA, 14 nt, Bordetella pertussis
agguugaagccgac

SEQ ID NO: 2443943 - RNA, 13 nt, Bordetella pertussis
agguugcaggcca

SEQ ID NO: 2443944 - RNA, 23 nt, Bordetella pertussis
agguugcaggccaggcucagcag

SEQ ID NO: 2443945 - RNA, 16 nt, Bordetella pertussis
agguugcccgagcgcg

SEQ ID NO: 2443946 - RNA, 18 nt, Bordetella pertussis
agguugcccgagcgcgac

SEQ ID NO: 2443947 - RNA, 21 nt, Bordetella pertussis
agguugcccgcccgacgagga

SEQ ID NO: 2443948 - RNA, 22 nt, Bordetella pertussis
agguugcgccggcucagccccc

SEQ ID NO: 2443949 - RNA, 14 nt, Bordetella pertussis
agguugcggccgcc

SEQ ID NO: 2443950 - RNA, 23 nt, Bordetella pertussis
agguugcgguaguucagcagcgc

SEQ ID NO: 2443951 - RNA, 18 nt, Bordetella pertussis
agguuggccgcgacgauc

SEQ ID NO: 2443952 - RNA, 19 nt, Bordetella pertussis
agguugggugcgccgccgg

SEQ ID NO: 2443953 - RNA, 17 nt, Bordetella pertussis
agguuguccagcgcgcc

SEQ ID NO: 2443954 - RNA, 21 nt, Bordetella pertussis
agguuguccagcgcgcccagc

SEQ ID NO: 2443955 - RNA, 22 nt, Bordetella pertussis
agguugugccccuugcccaacg

SEQ ID NO: 2443956 - RNA, 23 nt, Bordetella pertussis
agguuuccuuggggucccacugc

SEQ ID NO: 2443957 - RNA, 17 nt, Bordetella pertussis
agguuuuccacagccag

SEQ ID NO: 2443958 - RNA, 23 nt, Bordetella pertussis
agguuuuccacagccaggccgau

SEQ ID NO: 2443959 - RNA, 13 nt, Bordetella pertussis
aguacagcagcag

SEQ ID NO: 2443960 - RNA, 19 nt, Bordetella pertussis
aguacaggcugccgucguc

SEQ ID NO: 2443961 - RNA, 22 nt, Bordetella pertussis
aguacugcguucgggacgcagg

SEQ ID NO: 2443962 - RNA, 14 nt, Bordetella pertussis
aguagaacgccggc

SEQ ID NO: 2443963 - RNA, 15 nt, Bordetella pertussis
aguagaacgccggcu

SEQ ID NO: 2443964 - RNA, 15 nt, Bordetella pertussis
aguagagcuguugca

SEQ ID NO: 2443965 - RNA, 21 nt, Bordetella pertussis
aguagccgaauccggccagca

SEQ ID NO: 2443966 - RNA, 16 nt, Bordetella pertussis
aguagcgugugcagga

SEQ ID NO: 2443967 - RNA, 14 nt, Bordetella pertussis
aguaggccggcacg

SEQ ID NO: 2443968 - RNA, 13 nt, Bordetella pertussis
aguaggcgcccca

SEQ ID NO: 2443969 - RNA, 15 nt, Bordetella pertussis
aguaggcggccaggc

SEQ ID NO: 2443970 - RNA, 15 nt, Bordetella pertussis
aguagugcccccacg

SEQ ID NO: 2443971 - RNA, 19 nt, Bordetella pertussis
aguagugcccccacgcugc

SEQ ID NO: 2443972 - RNA, 17 nt, Bordetella pertussis
aguaucccggccaggcg

SEQ ID NO: 2443973 - RNA, 16 nt, Bordetella pertussis
aguaugcaaccggcac

SEQ ID NO: 2443974 - RNA, 16 nt, Bordetella pertussis
aguauggugaccggcg

SEQ ID NO: 2443975 - RNA, 17 nt, Bordetella pertussis
aguauucacgccgcgac

SEQ ID NO: 2443976 - RNA, 12 nt, Bordetella pertussis
aguauuucagga

SEQ ID NO: 2443977 - RNA, 16 nt, Bordetella pertussis
agucaucgauggccag

SEQ ID NO: 2443978 - RNA, 14 nt, Bordetella pertussis
agucauguagcggc

SEQ ID NO: 2443979 - RNA, 16 nt, Bordetella pertussis
agucauguagcggccg

SEQ ID NO: 2443980 - RNA, 19 nt, Bordetella pertussis
agucauguagcggccgccc

SEQ ID NO: 2443981 - RNA, 18 nt, Bordetella pertussis
aucggcaggccggcgcgc

SEQ ID NO: 2443982 - RNA, 15 nt, Bordetella pertussis
aucggccaggccggc

SEQ ID NO: 2443983 - RNA, 21 nt, Bordetella pertussis
aucggccaggccggccugcag

SEQ ID NO: 2443984 - RNA, 15 nt, Bordetella pertussis
aucggccaggcgccu

SEQ ID NO: 2443985 - RNA, 17 nt, Bordetella pertussis
aucggccauggcgguga

SEQ ID NO: 2443986 - RNA, 19 nt, Bordetella pertussis
aucggcccgcgccagcgcc

SEQ ID NO: 2443987 - RNA, 21 nt, Bordetella pertussis
aucggcccgcgccagcgccac

SEQ ID NO: 2443988 - RNA, 19 nt, Bordetella pertussis
aucggcccgggcguggcgu

SEQ ID NO: 2443989 - RNA, 16 nt, Bordetella pertussis
aucggccgacugcugu

SEQ ID NO: 2443990 - RNA, 15 nt, Bordetella pertussis
aucggccggccgggc

SEQ ID NO: 2443991 - RNA, 20 nt, Bordetella pertussis
aucggccggcggucgcgcug

SEQ ID NO: 2443992 - RNA, 23 nt, Bordetella pertussis
aucggccggcggucgcgcuggcc

SEQ ID NO: 2443993 - RNA, 16 nt, Bordetella pertussis
aucggcgaaguccugc

SEQ ID NO: 2443994 - RNA, 11 nt, Bordetella pertussis
aucggcgccgc

SEQ ID NO: 2443995 - RNA, 15 nt, Bordetella pertussis
aucggcgccggcguc

SEQ ID NO: 2443996 - RNA, 12 nt, Bordetella pertussis
aucggcgcgccc

SEQ ID NO: 2443997 - RNA, 14 nt, Bordetella pertussis
aucggcgcgcgcug

SEQ ID NO: 2443998 - RNA, 22 nt, Bordetella pertussis
aucggcgcgcgcugcacggccu

SEQ ID NO: 2443999 - RNA, 13 nt, Bordetella pertussis
aucggcggcaggu

SEQ ID NO: 2444000 - RNA, 21 nt, Bordetella pertussis
aucggcggccugggccauggc

SEQ ID NO: 2444001 - RNA, 15 nt, Bordetella pertussis
aucggcguaccaggc

SEQ ID NO: 2444002 - RNA, 23 nt, Bordetella pertussis
aucgggagccucuggaagacgga

SEQ ID NO: 2444003 - RNA, 21 nt, Bordetella pertussis
aucgggauccgugcggcgcgc

SEQ ID NO: 2444004 - RNA, 20 nt, Bordetella pertussis
aucgggcagggcuuccaguu

SEQ ID NO: 2444005 - RNA, 16 nt, Bordetella pertussis
aucgggccggcggcag

SEQ ID NO: 2444006 - RNA, 14 nt, Bordetella pertussis
aucggggggcaggc

SEQ ID NO: 2444007 - RNA, 20 nt, Bordetella pertussis
aucggggucgaucgcaucgc

SEQ ID NO: 2444008 - RNA, 16 nt, Bordetella pertussis
aucgggguggcgccgu

SEQ ID NO: 2444009 - RNA, 23 nt, Bordetella pertussis
aucgggugcugcgggucgaguug

SEQ ID NO: 2444010 - RNA, 22 nt, Bordetella pertussis
aucgguaaugagcccgaugccg

SEQ ID NO: 2444011 - RNA, 13 nt, Bordetella pertussis
aucggugcggccg

SEQ ID NO: 2444012 - RNA, 15 nt, Bordetella pertussis
aucggugcggccggu

SEQ ID NO: 2444013 - RNA, 21 nt, Bordetella pertussis
aucgguggaaugggagguugc

SEQ ID NO: 2444014 - RNA, 22 nt, Bordetella pertussis
aucguaggcgcuguuggccguc

SEQ ID NO: 2444015 - RNA, 13 nt, Bordetella pertussis
aucgucaugaacg

SEQ ID NO: 2444016 - RNA, 20 nt, Bordetella pertussis
aucgucaugaacgucacccc

SEQ ID NO: 2444017 - RNA, 22 nt, Bordetella pertussis
aucgucauuacccauggcaccg

SEQ ID NO: 2444018 - RNA, 19 nt, Bordetella pertussis
aucguccagcgacuccggc

SEQ ID NO: 2444019 - RNA, 18 nt, Bordetella pertussis
aucgucgaacuuguucuu

SEQ ID NO: 2444020 - RNA, 14 nt, Bordetella pertussis
aucgucgaccugga

SEQ ID NO: 2444021 - RNA, 15 nt, Bordetella pertussis
aucgucgaccuggau

SEQ ID NO: 2444022 - RNA, 14 nt, Bordetella pertussis
aucgucgcgcuggg

SEQ ID NO: 2444023 - RNA, 15 nt, Bordetella pertussis
aucgucgcugcggcc

SEQ ID NO: 2444024 - RNA, 18 nt, Bordetella pertussis
aucgucggacaacgccag

SEQ ID NO: 2444025 - RNA, 19 nt, Bordetella pertussis
aucgucggcgccaugcugg

SEQ ID NO: 2444026 - RNA, 21 nt, Bordetella pertussis
aucgucggcgccaugcuggcc

SEQ ID NO: 2444027 - RNA, 15 nt, Bordetella pertussis
aucgucuacgcgaac

SEQ ID NO: 2444028 - RNA, 18 nt, Bordetella pertussis
aucgucuugaccagcagg

SEQ ID NO: 2444029 - RNA, 14 nt, Bordetella pertussis
aucgugacgcuggc

SEQ ID NO: 2444030 - RNA, 15 nt, Bordetella pertussis
aucgugcacgcccgc

SEQ ID NO: 2444031 - RNA, 14 nt, Bordetella pertussis
aucgugcuagaauc

SEQ ID NO: 2444032 - RNA, 23 nt, Bordetella pertussis
aucguggcugccccgaugaugga

SEQ ID NO: 2444033 - RNA, 16 nt, Bordetella pertussis
aucguggguucgaauc

SEQ ID NO: 2444034 - RNA, 14 nt, Bordetella pertussis
aucguucccuaccc

SEQ ID NO: 2444035 - RNA, 15 nt, Bordetella pertussis
aucguugucgcgccg

SEQ ID NO: 2444036 - RNA, 17 nt, Bordetella pertussis
aucguugucgcgccgcg

SEQ ID NO: 2444037 - RNA, 19 nt, Bordetella pertussis
aucguuuucgcgaccugcg

SEQ ID NO: 2444038 - RNA, 14 nt, Bordetella pertussis
aucuacagcgccug

SEQ ID NO: 2444039 - RNA, 13 nt, Bordetella pertussis
aucuacgcgcgcg

SEQ ID NO: 2444040 - RNA, 18 nt, Bordetella pertussis
aucuacgcgcgcgccggc

SEQ ID NO: 2444041 - RNA, 14 nt, Bordetella pertussis
aucuacgugcugga

SEQ ID NO: 2444042 - RNA, 22 nt, Bordetella pertussis
aucuaggccguuuccucuggag

SEQ ID NO: 2444043 - RNA, 20 nt, Bordetella pertussis
aucucacagacgaucacggu

SEQ ID NO: 2444044 - RNA, 13 nt, Bordetella pertussis
aucucagcgcgcc

SEQ ID NO: 2444045 - RNA, 22 nt, Bordetella pertussis
aucucagcgcgccgcgccgggc

SEQ ID NO: 2444046 - RNA, 22 nt, Bordetella pertussis
aucuccaggaugcgcgacaccg

SEQ ID NO: 2444047 - RNA, 13 nt, Bordetella pertussis
aucuccggcgccu

SEQ ID NO: 2444048 - RNA, 14 nt, Bordetella pertussis
aucuccggcgccug

SEQ ID NO: 2444049 - RNA, 18 nt, Bordetella pertussis
aucuccgggagccugucc

SEQ ID NO: 2444050 - RNA, 16 nt, Bordetella pertussis
aucucggcaucggcca

SEQ ID NO: 2444051 - RNA, 19 nt, Bordetella pertussis
aucucggcaucggccacgc

SEQ ID NO: 2444052 - RNA, 22 nt, Bordetella pertussis
aucucggcaucggccacgcugc

SEQ ID NO: 2444053 - RNA, 15 nt, Bordetella pertussis
aucucggccagcagc

SEQ ID NO: 2444054 - RNA, 16 nt, Bordetella pertussis
aucucggccagcagcg

SEQ ID NO: 2444055 - RNA, 20 nt, Bordetella pertussis
aucucggcgcccgcggccug

SEQ ID NO: 2444056 - RNA, 18 nt, Bordetella pertussis
aucucgggcgaggucagc

SEQ ID NO: 2444057 - RNA, 13 nt, Bordetella pertussis
aucucgucgguca

SEQ ID NO: 2444058 - RNA, 20 nt, Bordetella pertussis
aucucguggcccagcaccgc

SEQ ID NO: 2444059 - RNA, 22 nt, Bordetella pertussis
aucucguggcccagcaccgccg

SEQ ID NO: 2444060 - RNA, 22 nt, Bordetella pertussis
aucugcauguacucggccaggc

SEQ ID NO: 2444061 - RNA, 23 nt, Bordetella pertussis
aucugcauguacucggccaggcc

SEQ ID NO: 2444062 - RNA, 22 nt, Bordetella pertussis
aucugccccagcuugucggccg

SEQ ID NO: 2444063 - RNA, 19 nt, Bordetella pertussis
aucugcgagccuucggccg

SEQ ID NO: 2444064 - RNA, 12 nt, Bordetella pertussis
aucugcggcacc

SEQ ID NO: 2444065 - RNA, 19 nt, Bordetella pertussis
aucugcggcaccucggccg

SEQ ID NO: 2444066 - RNA, 12 nt, Bordetella pertussis
aucugcggcgug

SEQ ID NO: 2444067 - RNA, 14 nt, Bordetella pertussis
aucugcgucgccug

SEQ ID NO: 2444068 - RNA, 17 nt, Bordetella pertussis
aucugcguuuucuggcc

SEQ ID NO: 2444069 - RNA, 13 nt, Bordetella pertussis
aucugcugggccg

SEQ ID NO: 2444070 - RNA, 17 nt, Bordetella pertussis
aucugcuugaggccgcg

SEQ ID NO: 2444071 - RNA, 13 nt, Bordetella pertussis
aucugcuugccgu

SEQ ID NO: 2444072 - RNA, 16 nt, Bordetella pertussis
aucugcuugccguuca

SEQ ID NO: 2444073 - RNA, 15 nt, Bordetella pertussis
aucuggaccgcgcgc

SEQ ID NO: 2444074 - RNA, 17 nt, Bordetella pertussis
aucuggaccgcgcgcga

SEQ ID NO: 2444075 - RNA, 20 nt, Bordetella pertussis
aucuggcaaugguccagcag

SEQ ID NO: 2444076 - RNA, 21 nt, Bordetella pertussis
aucuggcaaugguccagcagg

SEQ ID NO: 2444077 - RNA, 22 nt, Bordetella pertussis
aucuggcccuuggucugcaggc

SEQ ID NO: 2444078 - RNA, 20 nt, Bordetella pertussis
aucuggccggcgcugggcag

SEQ ID NO: 2444079 - RNA, 22 nt, Bordetella pertussis
aucugggcgucgaaggcggccg

SEQ ID NO: 2444080 - RNA, 18 nt, Bordetella pertussis
aucugguccugggccguc

SEQ ID NO: 2444081 - RNA, 14 nt, Bordetella pertussis
aucugguugagcag

SEQ ID NO: 2444082 - RNA, 16 nt, Bordetella pertussis
aucugguugagcagca

SEQ ID NO: 2444083 - RNA, 17 nt, Bordetella pertussis
aucugguugagcagcac

SEQ ID NO: 2444084 - RNA, 21 nt, Bordetella pertussis
aucugguugagcagcaccugg

SEQ ID NO: 2444085 - RNA, 23 nt, Bordetella pertussis
aucugguuggccacaucaucgac

SEQ ID NO: 2444086 - RNA, 14 nt, Bordetella pertussis
aucuguaccgccgg

SEQ ID NO: 2444087 - RNA, 16 nt, Bordetella pertussis
aucuguucggcgccgg

SEQ ID NO: 2444088 - RNA, 17 nt, Bordetella pertussis
aucuucgugcuggccau

SEQ ID NO: 2444089 - RNA, 18 nt, Bordetella pertussis
aucuucugcgccacggcg

SEQ ID NO: 2444090 - RNA, 19 nt, Bordetella pertussis
aucuugaugccgcccagca

SEQ ID NO: 2444091 - RNA, 20 nt, Bordetella pertussis
aucuugaugccgcccagcau

SEQ ID NO: 2444092 - RNA, 21 nt, Bordetella pertussis
aucuugaugccgcccagcaug

SEQ ID NO: 2444093 - RNA, 17 nt, Bordetella pertussis
aucuugaugcggccguu

SEQ ID NO: 2444094 - RNA, 13 nt, Bordetella pertussis
aucuugccaggcc

SEQ ID NO: 2444095 - RNA, 14 nt, Bordetella pertussis
aucuugccaggccc

SEQ ID NO: 2444096 - RNA, 13 nt, Bordetella pertussis
aucgcggcgcugu

SEQ ID NO: 2444097 - RNA, 23 nt, Bordetella pertussis
aucgcggcuccagcucagcagcg

SEQ ID NO: 2444098 - RNA, 13 nt, Bordetella pertussis
aucgcgucggcca

SEQ ID NO: 2444099 - RNA, 20 nt, Bordetella pertussis
aucgcgucggccaaggccgg

SEQ ID NO: 2444100 - RNA, 21 nt, Bordetella pertussis
aucgcgucggccaaggccggc

SEQ ID NO: 2444101 - RNA, 16 nt, Bordetella pertussis
aucgcguucacguaga

SEQ ID NO: 2444102 - RNA, 21 nt, Bordetella pertussis
aucgcguucguggaugacucg

SEQ ID NO: 2444103 - RNA, 20 nt, Bordetella pertussis
aucggagaaaucgccgccgg

SEQ ID NO: 2444104 - RNA, 16 nt, Bordetella pertussis
aucggcaaggcgcaca

SEQ ID NO: 2444105 - RNA, 19 nt, Bordetella pertussis
aucggcacccgcauggugg

SEQ ID NO: 2444106 - RNA, 18 nt, Bordetella pertussis
aucggcaccucggcgccg

SEQ ID NO: 2444107 - RNA, 19 nt, Bordetella pertussis
aucggcaccucggcgccgc

SEQ ID NO: 2444108 - RNA, 15 nt, Bordetella pertussis
aucggcaggccggcg

SEQ ID NO: 2444109 - RNA, 17 nt, Bordetella pertussis
aucggcaggccggcgcg

SEQ ID NO: 2444110 - RNA, 15 nt, Bordetella pertussis
augcccagcgagcug

SEQ ID NO: 2444111 - RNA, 23 nt, Bordetella pertussis
augcccagcgagcuggugauggu

SEQ ID NO: 2444112 - RNA, 15 nt, Bordetella pertussis
augcccagcgccagg

SEQ ID NO: 2444113 - RNA, 23 nt, Bordetella pertussis
augcccagcgccagggccgccgc

SEQ ID NO: 2444114 - RNA, 22 nt, Bordetella pertussis
augcccagcgccgccgacggca

SEQ ID NO: 2444115 - RNA, 16 nt, Bordetella pertussis
augcccaggaugcccu

SEQ ID NO: 2444116 - RNA, 16 nt, Bordetella pertussis
augcccaggcccuggc

SEQ ID NO: 2444117 - RNA, 19 nt, Bordetella pertussis
augcccaggcccuggcugg

SEQ ID NO: 2444118 - RNA, 19 nt, Bordetella pertussis
augcccaugcgcugcgccu

SEQ ID NO: 2444119 - RNA, 19 nt, Bordetella pertussis
augcccauggggugcuccu

SEQ ID NO: 2444120 - RNA, 21 nt, Bordetella pertussis
augccccaguccaggccggcc

SEQ ID NO: 2444121 - RNA, 22 nt, Bordetella pertussis
augccccaguccaggccggccu

SEQ ID NO: 2444122 - RNA, 13 nt, Bordetella pertussis
augccccgcccgc

SEQ ID NO: 2444123 - RNA, 14 nt, Bordetella pertussis
augccccgcccgcg

SEQ ID NO: 2444124 - RNA, 13 nt, Bordetella pertussis
augcccgaccgca

SEQ ID NO: 2444125 - RNA, 23 nt, Bordetella pertussis
augcccgaccgcaugggcgccga

SEQ ID NO: 2444126 - RNA, 17 nt, Bordetella pertussis
augcccuccucggccag

SEQ ID NO: 2444127 - RNA, 19 nt, Bordetella pertussis
augcccuccucggccaggu

SEQ ID NO: 2444128 - RNA, 21 nt, Bordetella pertussis
augcccuccucggccaggucg

SEQ ID NO: 2444129 - RNA, 23 nt, Bordetella pertussis
augcccucuucggcggccagccg

SEQ ID NO: 2444130 - RNA, 16 nt, Bordetella pertussis
augcccugcgccagcg

SEQ ID NO: 2444131 - RNA, 17 nt, Bordetella pertussis
augcccuggauggccug

SEQ ID NO: 2444132 - RNA, 16 nt, Bordetella pertussis
augcccuucggcaugc

SEQ ID NO: 2444133 - RNA, 21 nt, Bordetella pertussis
augcccuucggcaugcugcgu

SEQ ID NO: 2444134 - RNA, 16 nt, Bordetella pertussis
augcccuuggcggcga

SEQ ID NO: 2444135 - RNA, 23 nt, Bordetella pertussis
augccgaacagccagggcagggc

SEQ ID NO: 2444136 - RNA, 22 nt, Bordetella pertussis
augccgaaccagaucaggucga

SEQ ID NO: 2444137 - RNA, 23 nt, Bordetella pertussis
augccgaacucgcgcucggccag

SEQ ID NO: 2444138 - RNA, 19 nt, Bordetella pertussis
augccgaacugucgcgcca

SEQ ID NO: 2444139 - RNA, 16 nt, Bordetella pertussis
augccgaagcgcgcgu

SEQ ID NO: 2444140 - RNA, 20 nt, Bordetella pertussis
augccgaccaccagcaccga

SEQ ID NO: 2444141 - RNA, 15 nt, Bordetella pertussis
augccgaccacggcu

SEQ ID NO: 2444142 - RNA, 14 nt, Bordetella pertussis
augccgaccaggcc

SEQ ID NO: 2444143 - RNA, 15 nt, Bordetella pertussis
augccgaccaggccc

SEQ ID NO: 2444144 - RNA, 17 nt, Bordetella pertussis
augccgaccaggcccgc

SEQ ID NO: 2444145 - RNA, 20 nt, Bordetella pertussis
augccgaccaggcccgccac

SEQ ID NO: 2444146 - RNA, 13 nt, Bordetella pertussis
augccgaucgccg

SEQ ID NO: 2444147 - RNA, 22 nt, Bordetella pertussis
augccgaucgccgacaggauga

SEQ ID NO: 2444148 - RNA, 20 nt, Bordetella pertussis
augccgaugauggccauggc

SEQ ID NO: 2444149 - RNA, 23 nt, Bordetella pertussis
augccgaugauggccauggccag

SEQ ID NO: 2444150 - RNA, 17 nt, Bordetella pertussis
augccgauggcgguggu

SEQ ID NO: 2444151 - RNA, 16 nt, Bordetella pertussis
augccgauugugcaug

SEQ ID NO: 2444152 - RNA, 23 nt, Bordetella pertussis
augccgauugugcaugacggcca

SEQ ID NO: 2444153 - RNA, 21 nt, Bordetella pertussis
augccgcagauggccagcagc

SEQ ID NO: 2444154 - RNA, 14 nt, Bordetella pertussis
augccgcagcacca

SEQ ID NO: 2444155 - RNA, 19 nt, Bordetella pertussis
augcgacagcgacagccag

SEQ ID NO: 2444156 - RNA, 16 nt, Bordetella pertussis
augcgacaugagcugc

SEQ ID NO: 2444157 - RNA, 15 nt, Bordetella pertussis
augcgagacgaaggc

SEQ ID NO: 2444158 - RNA, 20 nt, Bordetella pertussis
augcgagacgaaggcgccgg

SEQ ID NO: 2444159 - RNA, 22 nt, Bordetella pertussis
augcgagcaaaggacacgcgcg

SEQ ID NO: 2444160 - RNA, 22 nt, Bordetella pertussis
augcgauagcgggccugcagca

SEQ ID NO: 2444161 - RNA, 13 nt, Bordetella pertussis
augcgaucggccu

SEQ ID NO: 2444162 - RNA, 16 nt, Bordetella pertussis
augcgcaccaugcgca

SEQ ID NO: 2444163 - RNA, 17 nt, Bordetella pertussis
augcgcaccggccaggg

SEQ ID NO: 2444164 - RNA, 13 nt, Bordetella pertussis
augcgcacgcgcg

SEQ ID NO: 2444165 - RNA, 22 nt, Bordetella pertussis
augcgcacggacagcccgcgcu

SEQ ID NO: 2444166 - RNA, 19 nt, Bordetella pertussis
augcgcacgggcgagggcu

SEQ ID NO: 2444167 - RNA, 16 nt, Bordetella pertussis
augcgcacucgaccgc

SEQ ID NO: 2444168 - RNA, 11 nt, Bordetella pertussis
augcgcagcag

SEQ ID NO: 2444169 - RNA, 13 nt, Bordetella pertussis
augcgcagcagca

SEQ ID NO: 2444170 - RNA, 18 nt, Bordetella pertussis
augcgcagcagcagcgca

SEQ ID NO: 2444171 - RNA, 14 nt, Bordetella pertussis
augcgcagcaggcg

SEQ ID NO: 2444172 - RNA, 16 nt, Bordetella pertussis
augcgcagcaggcgcg

SEQ ID NO: 2444173 - RNA, 16 nt, Bordetella pertussis
augcgcagcgcgucgg

SEQ ID NO: 2444174 - RNA, 20 nt, Bordetella pertussis
augcgcagcgcgucggcgcg

SEQ ID NO: 2444175 - RNA, 17 nt, Bordetella pertussis
augcgcaggacggcgcc

SEQ ID NO: 2444176 - RNA, 20 nt, Bordetella pertussis
augcgcaggacggcgccguc

SEQ ID NO: 2444177 - RNA, 14 nt, Bordetella pertussis
augcgcaggcccga

SEQ ID NO: 2444178 - RNA, 16 nt, Bordetella pertussis
augcgcauggccagca

SEQ ID NO: 2444179 - RNA, 17 nt, Bordetella pertussis
augcgcauggccagcac

SEQ ID NO: 2444180 - RNA, 20 nt, Bordetella pertussis
augcgcaugggaaauccgcc

SEQ ID NO: 2444181 - RNA, 22 nt, Bordetella pertussis
augcgcaugggaaauccgccgg

SEQ ID NO: 2444182 - RNA, 17 nt, Bordetella pertussis
augcgccagcaggaugu

SEQ ID NO: 2444183 - RNA, 12 nt, Bordetella pertussis
augcgccaggcc

SEQ ID NO: 2444184 - RNA, 14 nt, Bordetella pertussis
augcgccaggcgcu

SEQ ID NO: 2444185 - RNA, 17 nt, Bordetella pertussis
augcgccaggcgcucgg

SEQ ID NO: 2444186 - RNA, 21 nt, Bordetella pertussis
augcgcccgaugcucgccggc

SEQ ID NO: 2444187 - RNA, 22 nt, Bordetella pertussis
augcgcccgaugcucgccggcg

SEQ ID NO: 2444188 - RNA, 19 nt, Bordetella pertussis
augcgccgcaccagcggcg

SEQ ID NO: 2444189 - RNA, 13 nt, Bordetella pertussis
augcgccgcccca

SEQ ID NO: 2444190 - RNA, 14 nt, Bordetella pertussis
augcgccgcgccaa

SEQ ID NO: 2444191 - RNA, 21 nt, Bordetella pertussis
augcgccggcccggcaacauc

SEQ ID NO: 2444192 - RNA, 14 nt, Bordetella pertussis
augcgccggccugg

SEQ ID NO: 2444193 - RNA, 16 nt, Bordetella pertussis
augcgccggccuggcg

SEQ ID NO: 2444194 - RNA, 18 nt, Bordetella pertussis
augcgccugucccaggcg

SEQ ID NO: 2444195 - RNA, 17 nt, Bordetella pertussis
augcgcgaacgcgcgcc

SEQ ID NO: 2444196 - RNA, 13 nt, Bordetella pertussis
augcgcgaagcgc

SEQ ID NO: 2444197 - RNA, 15 nt, Bordetella pertussis
augcgcgaagcgccc

SEQ ID NO: 2444198 - RNA, 18 nt, Bordetella pertussis
augcgggucggcgccaug

SEQ ID NO: 2444199 - RNA, 19 nt, Bordetella pertussis
augcgggucggcgccauga

SEQ ID NO: 2444200 - RNA, 13 nt, Bordetella pertussis
augcggguuggca

SEQ ID NO: 2444201 - RNA, 17 nt, Bordetella pertussis
augcgguaggcccagca

SEQ ID NO: 2444202 - RNA, 19 nt, Bordetella pertussis
augcgguaggcccagcaau

SEQ ID NO: 2444203 - RNA, 19 nt, Bordetella pertussis
augcggucggccgcgccgc

SEQ ID NO: 2444204 - RNA, 20 nt, Bordetella pertussis
augcggugggucucggcguc

SEQ ID NO: 2444205 - RNA, 23 nt, Bordetella pertussis
augcgguugaucagggccgccag

SEQ ID NO: 2444206 - RNA, 15 nt, Bordetella pertussis
augcguaucggcagc

SEQ ID NO: 2444207 - RNA, 21 nt, Bordetella pertussis
augcgucaggggcaugccggc

SEQ ID NO: 2444208 - RNA, 22 nt, Bordetella pertussis
augcgucaggggcaugccggca

SEQ ID NO: 2444209 - RNA, 16 nt, Bordetella pertussis
augcgucgaacggccg

SEQ ID NO: 2444210 - RNA, 18 nt, Bordetella pertussis
augcgugaagcccauggc

SEQ ID NO: 2444211 - RNA, 17 nt, Bordetella pertussis
augcgugacacggccau

SEQ ID NO: 2444212 - RNA, 18 nt, Bordetella pertussis
augcgugacacggccauc

SEQ ID NO: 2444213 - RNA, 20 nt, Bordetella pertussis
augcgugcgcaucagcgcau

SEQ ID NO: 2444214 - RNA, 14 nt, Bordetella pertussis
augcguggccggcg

SEQ ID NO: 2444215 - RNA, 19 nt, Bordetella pertussis
augcguggcgugccgcagc

SEQ ID NO: 2444216 - RNA, 16 nt, Bordetella pertussis
augcgugguacggcga

SEQ ID NO: 2444217 - RNA, 20 nt, Bordetella pertussis
augcguguuccagcgccugg

SEQ ID NO: 2444218 - RNA, 16 nt, Bordetella pertussis
augcguucgcccgugc

SEQ ID NO: 2444219 - RNA, 13 nt, Bordetella pertussis
augcguucggcca

SEQ ID NO: 2444220 - RNA, 14 nt, Bordetella pertussis
augcuccagcuugc

SEQ ID NO: 2444221 - RNA, 15 nt, Bordetella pertussis
augcucgccggcgcc

SEQ ID NO: 2444222 - RNA, 18 nt, Bordetella pertussis
augcucgccggcgccgcc

SEQ ID NO: 2444223 - RNA, 21 nt, Bordetella pertussis
augcucuggcacaccagcgcc

SEQ ID NO: 2444224 - RNA, 22 nt, Bordetella pertussis
augcucuggcacaccagcgcca

SEQ ID NO: 2444225 - RNA, 21 nt, Bordetella pertussis
augcucuugcucaucaccagc

SEQ ID NO: 2444226 - RNA, 18 nt, Bordetella pertussis
augcugaauugcgggccg

SEQ ID NO: 2444227 - RNA, 17 nt, Bordetella pertussis
augcugcagcgcaucgc

SEQ ID NO: 2444228 - RNA, 13 nt, Bordetella pertussis
augcugcagcugc

SEQ ID NO: 2444229 - RNA, 19 nt, Bordetella pertussis
augcugcagcugcuugccc

SEQ ID NO: 2444230 - RNA, 23 nt, Bordetella pertussis
augcugcagcugcuugcccaggc

SEQ ID NO: 2444231 - RNA, 13 nt, Bordetella pertussis
augcugcagggcc

SEQ ID NO: 2444232 - RNA, 16 nt, Bordetella pertussis
augcugcagggccugg

SEQ ID NO: 2444233 - RNA, 13 nt, Bordetella pertussis
augcugccgggca

SEQ ID NO: 2444234 - RNA, 15 nt, Bordetella pertussis
augcugcgacagcag

SEQ ID NO: 2444235 - RNA, 15 nt, Bordetella pertussis
auggcggggugccug

SEQ ID NO: 2444236 - RNA, 20 nt, Bordetella pertussis
auggcgggguuggccgccag

SEQ ID NO: 2444237 - RNA, 17 nt, Bordetella pertussis
auggcggugaaggcgcc

SEQ ID NO: 2444238 - RNA, 20 nt, Bordetella pertussis
auggcggugaaggcgcccgg

SEQ ID NO: 2444239 - RNA, 17 nt, Bordetella pertussis
auggcgguggccagcgc

SEQ ID NO: 2444240 - RNA, 15 nt, Bordetella pertussis
auggcguacagcagg

SEQ ID NO: 2444241 - RNA, 17 nt, Bordetella pertussis
auggcguacagcagggu

SEQ ID NO: 2444242 - RNA, 17 nt, Bordetella pertussis
auggcguagagcagugu

SEQ ID NO: 2444243 - RNA, 16 nt, Bordetella pertussis
auggcguaugacaggg

SEQ ID NO: 2444244 - RNA, 20 nt, Bordetella pertussis
auggcguaugacagggugcc

SEQ ID NO: 2444245 - RNA, 22 nt, Bordetella pertussis
auggcgucaagccagcggcgcg

SEQ ID NO: 2444246 - RNA, 16 nt, Bordetella pertussis
auggcguccagcagca

SEQ ID NO: 2444247 - RNA, 15 nt, Bordetella pertussis
auggcguccgcgucg

SEQ ID NO: 2444248 - RNA, 22 nt, Bordetella pertussis
auggcguccgcgucgccgccgu

SEQ ID NO: 2444249 - RNA, 18 nt, Bordetella pertussis
auggcgucgaaacgcugc

SEQ ID NO: 2444250 - RNA, 22 nt, Bordetella pertussis
auggcgucgaccgccaugcgca

SEQ ID NO: 2444251 - RNA, 12 nt, Bordetella pertussis
auggcgucggcc

SEQ ID NO: 2444252 - RNA, 15 nt, Bordetella pertussis
auggcgucggccacg

SEQ ID NO: 2444253 - RNA, 17 nt, Bordetella pertussis
auggcgucugcccgugc

SEQ ID NO: 2444254 - RNA, 23 nt, Bordetella pertussis
auggcgugcacgcguaugcccug

SEQ ID NO: 2444255 - RNA, 18 nt, Bordetella pertussis
auggcgugucuccgggcg

SEQ ID NO: 2444256 - RNA, 17 nt, Bordetella pertussis
auggcucgggcagcagc

SEQ ID NO: 2444257 - RNA, 16 nt, Bordetella pertussis
auggcugcgcgccgug

SEQ ID NO: 2444258 - RNA, 18 nt, Bordetella pertussis
auggcuuccugcggcacg

SEQ ID NO: 2444259 - RNA, 14 nt, Bordetella pertussis
auggcuucgcgcac

SEQ ID NO: 2444260 - RNA, 23 nt, Bordetella pertussis
auggcuuucuaucaucaggccca

SEQ ID NO: 2444261 - RNA, 23 nt, Bordetella pertussis
auggcuuucuugucgaacaggcg

SEQ ID NO: 2444262 - RNA, 15 nt, Bordetella pertussis
augggcaccugcuug

SEQ ID NO: 2444263 - RNA, 16 nt, Bordetella pertussis
augggcagcucgccuu

SEQ ID NO: 2444264 - RNA, 12 nt, Bordetella pertussis
augggccaggcg

SEQ ID NO: 2444265 - RNA, 16 nt, Bordetella pertussis
augggcccgggcaggc

SEQ ID NO: 2444266 - RNA, 12 nt, Bordetella pertussis
augggcgccgug

SEQ ID NO: 2444267 - RNA, 20 nt, Bordetella pertussis
augggcgcggcgcgcgccga

SEQ ID NO: 2444268 - RNA, 21 nt, Bordetella pertussis
augggcgcgguagcgccccuc

SEQ ID NO: 2444269 - RNA, 15 nt, Bordetella pertussis
augggcgcuuggccc

SEQ ID NO: 2444270 - RNA, 13 nt, Bordetella pertussis
augggcggcgacg

SEQ ID NO: 2444271 - RNA, 16 nt, Bordetella pertussis
augggcgugccgcgcu

SEQ ID NO: 2444272 - RNA, 22 nt, Bordetella pertussis
augggcguggugcugacggacu

SEQ ID NO: 2444273 - RNA, 19 nt, Bordetella pertussis
augggcucgcgcgagccca

SEQ ID NO: 2444274 - RNA, 18 nt, Bordetella pertussis
augggcuuugacgccggc

SEQ ID NO: 2444275 - RNA, 23 nt, Bordetella pertussis
auggggcaggcgcagcggcggcg

SEQ ID NO: 2444276 - RNA, 14 nt, Bordetella pertussis
augggggcgagcgg

SEQ ID NO: 2444277 - RNA, 22 nt, Bordetella pertussis
auggggguggaaaugccggcgg

SEQ ID NO: 2444278 - RNA, 21 nt, Bordetella pertussis
auggguaaagcgccggcccgc

SEQ ID NO: 2444279 - RNA, 23 nt, Bordetella pertussis
auggguaaagcgccggcccgccu

SEQ ID NO: 2444280 - RNA, 14 nt, Bordetella pertussis
auggguacagcgcg

SEQ ID NO: 2444281 - RNA, 20 nt, Bordetella pertussis
augguagcgguccagcugcg

SEQ ID NO: 2444282 - RNA, 22 nt, Bordetella pertussis
augguaguacucgcugcgcgga

SEQ ID NO: 2444283 - RNA, 18 nt, Bordetella pertussis
augguauguauggcgguc

SEQ ID NO: 2444284 - RNA, 20 nt, Bordetella pertussis
auggucaagcggcugcccuu

SEQ ID NO: 2444285 - RNA, 16 nt, Bordetella pertussis
auggucaccacccgca

SEQ ID NO: 2444286 - RNA, 19 nt, Bordetella pertussis
auggucgaccagcagccgg

SEQ ID NO: 2444287 - RNA, 13 nt, Bordetella pertussis
auggucgcccagc

SEQ ID NO: 2444288 - RNA, 14 nt, Bordetella pertussis
auggucgcccagca

SEQ ID NO: 2444289 - RNA, 20 nt, Bordetella pertussis
auggucgcggccgaggccag

SEQ ID NO: 2444290 - RNA, 21 nt, Bordetella pertussis
auggucgcggccgaggccagc

SEQ ID NO: 2444291 - RNA, 17 nt, Bordetella pertussis
auggucggcauggccag

SEQ ID NO: 2444292 - RNA, 19 nt, Bordetella pertussis
auggucggcauggccagga

SEQ ID NO: 2444293 - RNA, 18 nt, Bordetella pertussis
auggucggugccgccgag

SEQ ID NO: 2444294 - RNA, 17 nt, Bordetella pertussis
auggucucccccucggc

SEQ ID NO: 2444295 - RNA, 19 nt, Bordetella pertussis
auggugagggccacgcgcu

SEQ ID NO: 2444296 - RNA, 13 nt, Bordetella pertussis
auggugccgccgc

SEQ ID NO: 2444297 - RNA, 16 nt, Bordetella pertussis
auggugccgccgcccg

SEQ ID NO: 2444298 - RNA, 22 nt, Bordetella pertussis
auggugcugccgcugcccaccu

SEQ ID NO: 2444299 - RNA, 23 nt, Bordetella pertussis
augguguaccgggccgacgcgcc

SEQ ID NO: 2444300 - RNA, 13 nt, Bordetella pertussis
augguguucaggu

SEQ ID NO: 2444301 - RNA, 17 nt, Bordetella pertussis
augguucggccucgccc

SEQ ID NO: 2444302 - RNA, 21 nt, Bordetella pertussis
auguaaaaacccggccugcgc

SEQ ID NO: 2444303 - RNA, 22 nt, Bordetella pertussis
auguacagcgguucguagccgg

SEQ ID NO: 2444304 - RNA, 19 nt, Bordetella pertussis
auguacgcaucggcgccgg

SEQ ID NO: 2444305 - RNA, 20 nt, Bordetella pertussis
auguacgcaucggcgccggc

SEQ ID NO: 2444306 - RNA, 15 nt, Bordetella pertussis
auguacucggccagg

SEQ ID NO: 2444307 - RNA, 16 nt, Bordetella pertussis
auguacucggccaggc

SEQ ID NO: 2444308 - RNA, 17 nt, Bordetella pertussis
auguacucggccaggcc

SEQ ID NO: 2444309 - RNA, 19 nt, Bordetella pertussis
auguagaacgccagggucu

SEQ ID NO: 2444310 - RNA, 23 nt, Bordetella pertussis
auguagagggucuggccggugau

SEQ ID NO: 2444311 - RNA, 13 nt, Bordetella pertussis
auguagcccaugg

SEQ ID NO: 2444312 - RNA, 19 nt, Bordetella pertussis
auguagcccauggccaggg

SEQ ID NO: 2444313 - RNA, 22 nt, Bordetella pertussis
auguccagcgagcgaaagccgu

SEQ ID NO: 2444314 - RNA, 14 nt, Bordetella pertussis
auguccagcgccag

SEQ ID NO: 2444315 - RNA, 13 nt, Bordetella pertussis
auguccagcggcg

SEQ ID NO: 2444316 - RNA, 14 nt, Bordetella pertussis
auuuccagcucguc

SEQ ID NO: 2444317 - RNA, 22 nt, Bordetella pertussis
auuuccauuuguugggccaccu

SEQ ID NO: 2444318 - RNA, 19 nt, Bordetella pertussis
auuuccggaccggugcccu

SEQ ID NO: 2444319 - RNA, 15 nt, Bordetella pertussis
auuuccucagccugg

SEQ ID NO: 2444320 - RNA, 17 nt, Bordetella pertussis
auuuccucgaccagcgc

SEQ ID NO: 2444321 - RNA, 15 nt, Bordetella pertussis
auuucgcuggccauc

SEQ ID NO: 2444322 - RNA, 14 nt, Bordetella pertussis
auuucgcugggcgc

SEQ ID NO: 2444323 - RNA, 18 nt, Bordetella pertussis
auuucggcgcaucggcgc

SEQ ID NO: 2444324 - RNA, 21 nt, Bordetella pertussis
auuucggcgcaucggcgccag

SEQ ID NO: 2444325 - RNA, 23 nt, Bordetella pertussis
auuucggcgcaucggcgccagua

SEQ ID NO: 2444326 - RNA, 13 nt, Bordetella pertussis
auuucggcgccgc

SEQ ID NO: 2444327 - RNA, 14 nt, Bordetella pertussis
auuucggcgccgcc

SEQ ID NO: 2444328 - RNA, 15 nt, Bordetella pertussis
auuucggcggccagg

SEQ ID NO: 2444329 - RNA, 14 nt, Bordetella pertussis
auuucggggcgcga

SEQ ID NO: 2444330 - RNA, 23 nt, Bordetella pertussis
auuucgggugaggggccagccug

SEQ ID NO: 2444331 - RNA, 19 nt, Bordetella pertussis
auuucuucgccuggccggc

SEQ ID NO: 2444332 - RNA, 21 nt, Bordetella pertussis
auuugaacagccgccccagca

SEQ ID NO: 2444333 - RNA, 13 nt, Bordetella pertussis
auuugcagcggcg

SEQ ID NO: 2444334 - RNA, 19 nt, Bordetella pertussis
auuuggcaaggcccgccgc

SEQ ID NO: 2444335 - RNA, 20 nt, Bordetella pertussis
auuuggcggccuggccgcgc

SEQ ID NO: 2444336 - RNA, 14 nt, Bordetella pertussis
auuuggcguagauc

SEQ ID NO: 2444337 - RNA, 20 nt, Bordetella pertussis
auuuuccggacucgcggucu

SEQ ID NO: 2444338 - RNA, 13 nt, Bordetella pertussis
caaaaaaagaggc

SEQ ID NO: 2444339 - RNA, 19 nt, Bordetella pertussis
caaaaaaagaggccacccg

SEQ ID NO: 2444340 - RNA, 16 nt, Bordetella pertussis
caaaaacgcccggcgc

SEQ ID NO: 2444341 - RNA, 16 nt, Bordetella pertussis
caaaaccgggcccgga

SEQ ID NO: 2444342 - RNA, 14 nt, Bordetella pertussis
caaaacgcaugacc

SEQ ID NO: 2444343 - RNA, 20 nt, Bordetella pertussis
caaaagcguuccagcagauc

SEQ ID NO: 2444344 - RNA, 15 nt, Bordetella pertussis
caaaagucguguuau

SEQ ID NO: 2444345 - RNA, 21 nt, Bordetella pertussis
caaaauacuuguccgccaccc

SEQ ID NO: 2444346 - RNA, 16 nt, Bordetella pertussis
caaaauuggugucaua

SEQ ID NO: 2444347 - RNA, 22 nt, Bordetella pertussis
caaaccgucgaugaccagcgcc

SEQ ID NO: 2444348 - RNA, 23 nt, Bordetella pertussis
caaaccugccguaauccaggcaa

SEQ ID NO: 2444349 - RNA, 22 nt, Bordetella pertussis
caaacgcggcgccgccggcggc

SEQ ID NO: 2444350 - RNA, 15 nt, Bordetella pertussis
caaacggcggcaggc

SEQ ID NO: 2444351 - RNA, 17 nt, Bordetella pertussis
caaacggcggcaggccg

SEQ ID NO: 2444352 - RNA, 16 nt, Bordetella pertussis
caaagacggcuugacc

SEQ ID NO: 2444353 - RNA, 20 nt, Bordetella pertussis
caaagacggcuugaccacgg

SEQ ID NO: 2444354 - RNA, 13 nt, Bordetella pertussis
caaagaucaccug

SEQ ID NO: 2444355 - RNA, 18 nt, Bordetella pertussis
caaagaucugcuggcucg

SEQ ID NO: 2444356 - RNA, 15 nt, Bordetella pertussis
caaagcgcagcguga

SEQ ID NO: 2444357 - RNA, 23 nt, Bordetella pertussis
caaagcggguugcggcagcgccg

SEQ ID NO: 2444358 - RNA, 14 nt, Bordetella pertussis
caaaggacacgcgc

SEQ ID NO: 2444359 - RNA, 13 nt, Bordetella pertussis
caaaggcccaggc

SEQ ID NO: 2444360 - RNA, 14 nt, Bordetella pertussis
caaaguagugcccc

SEQ ID NO: 2444361 - RNA, 13 nt, Bordetella pertussis
caaaucaaugaaa

SEQ ID NO: 2444362 - RNA, 15 nt, Bordetella pertussis
caaauucugcaaaag

SEQ ID NO: 2444363 - RNA, 21 nt, Bordetella pertussis
caacaaaggaaaucgcggcgc

SEQ ID NO: 2444364 - RNA, 22 nt, Bordetella pertussis
caacaaaggaaaucgcggcgcu

SEQ ID NO: 2444365 - RNA, 18 nt, Bordetella pertussis
caacaacggggucaucgc

SEQ ID NO: 2444366 - RNA, 15 nt, Bordetella pertussis
caacaagccgggcgc

SEQ ID NO: 2444367 - RNA, 16 nt, Bordetella pertussis
caacaagccgggcgcc

SEQ ID NO: 2444368 - RNA, 19 nt, Bordetella pertussis
caacaagccgggcgccggc

SEQ ID NO: 2444369 - RNA, 14 nt, Bordetella pertussis
caacacgaccagca

SEQ ID NO: 2444370 - RNA, 17 nt, Bordetella pertussis
caacacgaccagcaggc

SEQ ID NO: 2444371 - RNA, 17 nt, Bordetella pertussis
caacacgauccacggcc

SEQ ID NO: 2444372 - RNA, 18 nt, Bordetella pertussis
caacacgauccacggccg

SEQ ID NO: 2444373 - RNA, 17 nt, Bordetella pertussis
caacacgaugaucgcgc

SEQ ID NO: 2444374 - RNA, 17 nt, Bordetella pertussis
caacagacccgggccgc

SEQ ID NO: 2444375 - RNA, 18 nt, Bordetella pertussis
caacagacccgggccgcu

SEQ ID NO: 2444376 - RNA, 13 nt, Bordetella pertussis
caacagcgccugc

SEQ ID NO: 2444377 - RNA, 15 nt, Bordetella pertussis
caacagcucgcgcca

SEQ ID NO: 2444378 - RNA, 18 nt, Bordetella pertussis
caacagcuugcccacgcg

SEQ ID NO: 2444379 - RNA, 23 nt, Bordetella pertussis
caacagcuugcccacgcgcuccu

SEQ ID NO: 2444380 - RNA, 16 nt, Bordetella pertussis
caacagcuugcccggc

SEQ ID NO: 2444381 - RNA, 20 nt, Bordetella pertussis
caacaucaaugacauggcca

SEQ ID NO: 2444382 - RNA, 14 nt, Bordetella pertussis
caacaugccggaca

SEQ ID NO: 2444383 - RNA, 21 nt, Bordetella pertussis
caacauuggguacgacggccg

SEQ ID NO: 2444384 - RNA, 23 nt, Bordetella pertussis
caacauuggguacgacggccggg

SEQ ID NO: 2444385 - RNA, 14 nt, Bordetella pertussis
caaccaacaugccg

SEQ ID NO: 2444386 - RNA, 19 nt, Bordetella pertussis
caaccacccuucgcgcugc

SEQ ID NO: 2444387 - RNA, 21 nt, Bordetella pertussis
caaccaggaaaaccggcgccu

SEQ ID NO: 2444388 - RNA, 18 nt, Bordetella pertussis
caaccaggggcggcgcgg

SEQ ID NO: 2444389 - RNA, 20 nt, Bordetella pertussis
caaccaggggcggcgcggcg

SEQ ID NO: 2444390 - RNA, 22 nt, Bordetella pertussis
caaccaggggcggcgcggcgcu

SEQ ID NO: 2444391 - RNA, 19 nt, Bordetella pertussis
caacccacggcguggcgcg

SEQ ID NO: 2444392 - RNA, 21 nt, Bordetella pertussis
caacccacggcguggcgcgcc

SEQ ID NO: 2444393 - RNA, 22 nt, Bordetella pertussis
caacccacggcguggcgcgccc

SEQ ID NO: 2444394 - RNA, 14 nt, Bordetella pertussis
caaccccagcagcg

SEQ ID NO: 2444395 - RNA, 21 nt, Bordetella pertussis
caaccccgagggcgcggcgcc

SEQ ID NO: 2444396 - RNA, 19 nt, Bordetella pertussis
caacccgccauccuggccg

SEQ ID NO: 2444397 - RNA, 16 nt, Bordetella pertussis
caacccgcccacgcgg

SEQ ID NO: 2444398 - RNA, 20 nt, Bordetella pertussis
caacccgcccacgcggcgcu

SEQ ID NO: 2444399 - RNA, 13 nt, Bordetella pertussis
caacccgccggcc

SEQ ID NO: 2444400 - RNA, 17 nt, Bordetella pertussis
caacccggccucagcgg

SEQ ID NO: 2444401 - RNA, 18 nt, Bordetella pertussis
caacccggccucagcggc

SEQ ID NO: 2444402 - RNA, 20 nt, Bordetella pertussis
caacccggccucagcggccg

SEQ ID NO: 2444403 - RNA, 13 nt, Bordetella pertussis
caacccggccucg

SEQ ID NO: 2444404 - RNA, 21 nt, Bordetella pertussis
caacccggcgaggccgcccgc

SEQ ID NO: 2444405 - RNA, 14 nt, Bordetella pertussis
caacccgucgacgc

SEQ ID NO: 2444406 - RNA, 15 nt, Bordetella pertussis
caacccgucgacgca

SEQ ID NO: 2444407 - RNA, 20 nt, Bordetella pertussis
caacccgucgacgcagcagc

SEQ ID NO: 2444408 - RNA, 15 nt, Bordetella pertussis
caaccgccacgugcu

SEQ ID NO: 2444409 - RNA, 19 nt, Bordetella pertussis
caaccgcgcguaucggcgc

SEQ ID NO: 2444410 - RNA, 21 nt, Bordetella pertussis
caaccgcgcguaucggcgcga

SEQ ID NO: 2444411 - RNA, 17 nt, Bordetella pertussis
caaccggaacaccagca

SEQ ID NO: 2444412 - RNA, 15 nt, Bordetella pertussis
caaccggcacgucau

SEQ ID NO: 2444413 - RNA, 15 nt, Bordetella pertussis
caaccgggacaggca

SEQ ID NO: 2444414 - RNA, 14 nt, Bordetella pertussis
caaccggucggccg

SEQ ID NO: 2444415 - RNA, 20 nt, Bordetella pertussis
caaccgucgaccggcccgca

SEQ ID NO: 2444416 - RNA, 16 nt, Bordetella pertussis
caaccguucauggcgu

SEQ ID NO: 2444417 - RNA, 14 nt, Bordetella pertussis
caaccucgccgcgc

SEQ ID NO: 2444418 - RNA, 16 nt, Bordetella pertussis
caaccucgccgcgcca

SEQ ID NO: 2444419 - RNA, 21 nt, Bordetella pertussis
caaccugcacgcgggcgcuga

SEQ ID NO: 2444420 - RNA, 16 nt, Bordetella pertussis
caaccugguauccggc

SEQ ID NO: 2444421 - RNA, 18 nt, Bordetella pertussis
caaccugguauccggcgc

SEQ ID NO: 2444422 - RNA, 21 nt, Bordetella pertussis
caaccuggucaagggcggcca

SEQ ID NO: 2444423 - RNA, 19 nt, Bordetella pertussis
caaccuucacgacacgccc

SEQ ID NO: 2444424 - RNA, 18 nt, Bordetella pertussis
caacgaaggcauccaggu

SEQ ID NO: 2444425 - RNA, 16 nt, Bordetella pertussis
caacgacgcaggcgcc

SEQ ID NO: 2444426 - RNA, 17 nt, Bordetella pertussis
caacgacgcaggcgccg

SEQ ID NO: 2444427 - RNA, 18 nt, Bordetella pertussis
caacgaguaccugcuggu

SEQ ID NO: 2444428 - RNA, 15 nt, Bordetella pertussis
caacgccacgcgcgg

SEQ ID NO: 2444429 - RNA, 22 nt, Bordetella pertussis
caacgccacgcgcggaucggcc

SEQ ID NO: 2444430 - RNA, 23 nt, Bordetella pertussis
caacgccacgcgcggaucggcca

SEQ ID NO: 2444431 - RNA, 13 nt, Bordetella pertussis
caacgccagcagg

SEQ ID NO: 2444432 - RNA, 21 nt, Bordetella pertussis
caacgccgccaccagggcgcc

SEQ ID NO: 2444433 - RNA, 22 nt, Bordetella pertussis
caacgccgccaccagggcgccc

SEQ ID NO: 2444434 - RNA, 13 nt, Bordetella pertussis
caacgccgccggc

SEQ ID NO: 2444435 - RNA, 16 nt, Bordetella pertussis
caacgccgcguccgcc

SEQ ID NO: 2444436 - RNA, 23 nt, Bordetella pertussis
caacgccggccauggcggccggc

SEQ ID NO: 2444437 - RNA, 12 nt, Bordetella pertussis
caacgccggccg

SEQ ID NO: 2444438 - RNA, 15 nt, Bordetella pertussis
caacgccggccgcca

SEQ ID NO: 2444439 - RNA, 19 nt, Bordetella pertussis
caacgccggccgccauggc

SEQ ID NO: 2444440 - RNA, 20 nt, Bordetella pertussis
caacgccggccgccauggcc

SEQ ID NO: 2444441 - RNA, 23 nt, Bordetella pertussis
caacgccggccgccauggccggc

SEQ ID NO: 2444442 - RNA, 22 nt, Bordetella pertussis
caacgcgaucucagccaucauc

SEQ ID NO: 2444443 - RNA, 15 nt, Bordetella pertussis
caacgcgcgcgcgca

SEQ ID NO: 2444444 - RNA, 21 nt, Bordetella pertussis
caacggagaaagaagcccccg

SEQ ID NO: 2444445 - RNA, 19 nt, Bordetella pertussis
caacggccuucggcggcgc

SEQ ID NO: 2444446 - RNA, 23 nt, Bordetella pertussis
caacggccuucggcggcgcgcug

SEQ ID NO: 2444447 - RNA, 13 nt, Bordetella pertussis
caacggcgugcug

SEQ ID NO: 2444448 - RNA, 18 nt, Bordetella pertussis
caacggcgugcugcggcu

SEQ ID NO: 2444449 - RNA, 16 nt, Bordetella pertussis
caacggcuggcugggc

SEQ ID NO: 2444450 - RNA, 17 nt, Bordetella pertussis
caacggcuggcugggcg

SEQ ID NO: 2444451 - RNA, 20 nt, Bordetella pertussis
caacggcuggcugggcgcgc

SEQ ID NO: 2444452 - RNA, 15 nt, Bordetella pertussis
caacgggaucggcgu

SEQ ID NO: 2444453 - RNA, 15 nt, Bordetella pertussis
caacgggccgcuggu

SEQ ID NO: 2444454 - RNA, 14 nt, Bordetella pertussis
caacgggccggccg

SEQ ID NO: 2444455 - RNA, 17 nt, Bordetella pertussis
caacgggccggccgccg

SEQ ID NO: 2444456 - RNA, 21 nt, Bordetella pertussis
caacgggccggccgccggcgg

SEQ ID NO: 2444457 - RNA, 23 nt, Bordetella pertussis
caacgggccggccgccggcggca

SEQ ID NO: 2444458 - RNA, 17 nt, Bordetella pertussis
caacgggucgcgcagca

SEQ ID NO: 2444459 - RNA, 18 nt, Bordetella pertussis
caacggugagccggccac

SEQ ID NO: 2444460 - RNA, 18 nt, Bordetella pertussis
caacggugccaguccccc

SEQ ID NO: 2444461 - RNA, 14 nt, Bordetella pertussis
caacgucggcagcc

SEQ ID NO: 2444462 - RNA, 15 nt, Bordetella pertussis
caacuccacgcccug

SEQ ID NO: 2444463 - RNA, 18 nt, Bordetella pertussis
caacuccuggacgaugcg

SEQ ID NO: 2444464 - RNA, 20 nt, Bordetella pertussis
caacucgaggcggcgcagga

SEQ ID NO: 2444465 - RNA, 21 nt, Bordetella pertussis
caacucuuccccgucggcggc

SEQ ID NO: 2444466 - RNA, 18 nt, Bordetella pertussis
caacugccugcagcgcgc

SEQ ID NO: 2444467 - RNA, 20 nt, Bordetella pertussis
caacugccugcagcgcgcgc

SEQ ID NO: 2444468 - RNA, 23 nt, Bordetella pertussis
caacugggccaaccacgagcugc

SEQ ID NO: 2444469 - RNA, 20 nt, Bordetella pertussis
caacugguagugcggcgcca

SEQ ID NO: 2444470 - RNA, 23 nt, Bordetella pertussis
caacugguagugcggcgccagcu

SEQ ID NO: 2444471 - RNA, 14 nt, Bordetella pertussis
caacuggugcacga

SEQ ID NO: 2444472 - RNA, 19 nt, Bordetella pertussis
caacuggugcacgaugccc

SEQ ID NO: 2444473 - RNA, 22 nt, Bordetella pertussis
caacuggugcacgaugcccagg

SEQ ID NO: 2444474 - RNA, 17 nt, Bordetella pertussis
caacuuccagcgcccgc

SEQ ID NO: 2444475 - RNA, 20 nt, Bordetella pertussis
caacuuccagcgcccgcgga

SEQ ID NO: 2444476 - RNA, 17 nt, Bordetella pertussis
caagaagaagccgggcu

SEQ ID NO: 2444477 - RNA, 13 nt, Bordetella pertussis
caagacagcaaga

SEQ ID NO: 2444478 - RNA, 14 nt, Bordetella pertussis
caagaccgcggccg

SEQ ID NO: 2444479 - RNA, 15 nt, Bordetella pertussis
caagaccgcggccgc

SEQ ID NO: 2444480 - RNA, 17 nt, Bordetella pertussis
caagaccgcggccgcgc

SEQ ID NO: 2444481 - RNA, 19 nt, Bordetella pertussis
caagacgcccaggcccacc

SEQ ID NO: 2444482 - RNA, 22 nt, Bordetella pertussis
caagacgcggggacaggcacac

SEQ ID NO: 2444483 - RNA, 16 nt, Bordetella pertussis
caagacggcgcucggc

SEQ ID NO: 2444484 - RNA, 21 nt, Bordetella pertussis
caagacgguaucugucccggc

SEQ ID NO: 2444485 - RNA, 15 nt, Bordetella pertussis
caagauggcccaggg

SEQ ID NO: 2444486 - RNA, 18 nt, Bordetella pertussis
caagauggcccagggcag

SEQ ID NO: 2444487 - RNA, 23 nt, Bordetella pertussis
caagauggcccagggcagcggcc

SEQ ID NO: 2444488 - RNA, 18 nt, Bordetella pertussis
caagcagacccgcgccca

SEQ ID NO: 2444489 - RNA, 18 nt, Bordetella pertussis
caagcagaccuaccaggc

SEQ ID NO: 2444490 - RNA, 20 nt, Bordetella pertussis
caagcagaccuaccaggccg

SEQ ID NO: 2444491 - RNA, 21 nt, Bordetella pertussis
caagcagauggccaucgacgc

SEQ ID NO: 2444492 - RNA, 14 nt, Bordetella pertussis
caagcagcgccggc

SEQ ID NO: 2444493 - RNA, 17 nt, Bordetella pertussis
caagcagcgccggcugg

SEQ ID NO: 2444494 - RNA, 18 nt, Bordetella pertussis
caagcagcgccggcuggg

SEQ ID NO: 2444495 - RNA, 14 nt, Bordetella pertussis
caagcagcgccugc

SEQ ID NO: 2444496 - RNA, 15 nt, Bordetella pertussis
caagcagcgccugcc

SEQ ID NO: 2444497 - RNA, 23 nt, Bordetella pertussis
caagcagcgccugccgcgugccc

SEQ ID NO: 2444498 - RNA, 17 nt, Bordetella pertussis
caagcauuugcgcgacg

SEQ ID NO: 2444499 - RNA, 17 nt, Bordetella pertussis
caagccagcggcgcggc

SEQ ID NO: 2444500 - RNA, 18 nt, Bordetella pertussis
caagccagcggcgcggcg

SEQ ID NO: 2444501 - RNA, 23 nt, Bordetella pertussis
caagccagggcaggaggcgcggg

SEQ ID NO: 2444502 - RNA, 13 nt, Bordetella pertussis
caagcccaccggg

SEQ ID NO: 2444503 - RNA, 16 nt, Bordetella pertussis
caagcccaccgggccg

SEQ ID NO: 2444504 - RNA, 18 nt, Bordetella pertussis
caagcccaccgggccggc

SEQ ID NO: 2444505 - RNA, 15 nt, Bordetella pertussis
caagccccaggcagg

SEQ ID NO: 2444506 - RNA, 16 nt, Bordetella pertussis
caagccccaggcaggc

SEQ ID NO: 2444507 - RNA, 20 nt, Bordetella pertussis
caagccccuguucggcaucg

SEQ ID NO: 2444508 - RNA, 16 nt, Bordetella pertussis
caagcccggcacggag

SEQ ID NO: 2444509 - RNA, 16 nt, Bordetella pertussis
caagcccgucaguccg

SEQ ID NO: 2444510 - RNA, 24 nt, Bordetella pertussis
caagccgauccgcgacgcccuggc

SEQ ID NO: 2444511 - RNA, 15 nt, Bordetella pertussis
caagccgcaccaugc

SEQ ID NO: 2444512 - RNA, 19 nt, Bordetella pertussis
caagccgcaccaugcgguc

SEQ ID NO: 2444513 - RNA, 19 nt, Bordetella pertussis
caagccgcccggccggcac

SEQ ID NO: 2444514 - RNA, 22 nt, Bordetella pertussis
caagccgcccggccggcacggc

SEQ ID NO: 2444515 - RNA, 14 nt, Bordetella pertussis
caagccgccgcccu

SEQ ID NO: 2444516 - RNA, 22 nt, Bordetella pertussis
caagccgcggcgguuucggccg

SEQ ID NO: 2444517 - RNA, 13 nt, Bordetella pertussis
caagccggccgcg

SEQ ID NO: 2444518 - RNA, 17 nt, Bordetella pertussis
caagccggccgcgcggc

SEQ ID NO: 2444519 - RNA, 16 nt, Bordetella pertussis
caagccgggcgccggc

SEQ ID NO: 2444520 - RNA, 19 nt, Bordetella pertussis
caagccuugcggcccuugc

SEQ ID NO: 2444521 - RNA, 19 nt, Bordetella pertussis
caagcgcacgcgcagcacg

SEQ ID NO: 2444522 - RNA, 14 nt, Bordetella pertussis
caagcgcacgcugg

SEQ ID NO: 2444523 - RNA, 17 nt, Bordetella pertussis
caagcgccacagcgcca

SEQ ID NO: 2444524 - RNA, 14 nt, Bordetella pertussis
caagcgcgccauga

SEQ ID NO: 2444525 - RNA, 18 nt, Bordetella pertussis
caagcgcgccaugaacuc

SEQ ID NO: 2444526 - RNA, 12 nt, Bordetella pertussis
caagcgcgccga

SEQ ID NO: 2444527 - RNA, 19 nt, Bordetella pertussis
caagcgcguggccaucaac

SEQ ID NO: 2444528 - RNA, 14 nt, Bordetella pertussis
caagcgcguggccg

SEQ ID NO: 2444529 - RNA, 22 nt, Bordetella pertussis
caagcgcguggccggcgacggc

SEQ ID NO: 2444530 - RNA, 13 nt, Bordetella pertussis
caagcgcucgccg

SEQ ID NO: 2444531 - RNA, 14 nt, Bordetella pertussis
caagcgcucgccgg

SEQ ID NO: 2444532 - RNA, 20 nt, Bordetella pertussis
caagcgcucgccggcgcgca

SEQ ID NO: 2444533 - RNA, 22 nt, Bordetella pertussis
caagcgcucgccggcgcgcagg

SEQ ID NO: 2444534 - RNA, 17 nt, Bordetella pertussis
caagcgcucggccacgc

SEQ ID NO: 2444535 - RNA, 21 nt, Bordetella pertussis
caagcguacguaccaggccgu

SEQ ID NO: 2444536 - RNA, 23 nt, Bordetella pertussis
caagcgucgauggcguacagcag

SEQ ID NO: 2444537 - RNA, 18 nt, Bordetella pertussis
caagcguucauggcgcau

SEQ ID NO: 2444538 - RNA, 22 nt, Bordetella pertussis
caagcuccaggaaaaccuccuc

SEQ ID NO: 2444539 - RNA, 13 nt, Bordetella pertussis
caagcucgcgcau

SEQ ID NO: 2444540 - RNA, 16 nt, Bordetella pertussis
caagcucgcgcaugca

SEQ ID NO: 2444541 - RNA, 23 nt, Bordetella pertussis
caagcucgcgcaugcagcgagcg

SEQ ID NO: 2444542 - RNA, 12 nt, Bordetella pertussis
caagcugcugcu

SEQ ID NO: 2444543 - RNA, 13 nt, Bordetella pertussis
caagcugcugcug

SEQ ID NO: 2444544 - RNA, 16 nt, Bordetella pertussis
caagcugcuggccggc

SEQ ID NO: 2444545 - RNA, 17 nt, Bordetella pertussis
caagcugcuggccggcc

SEQ ID NO: 2444546 - RNA, 20 nt, Bordetella pertussis
caagcugcuggccggcccca

SEQ ID NO: 2444547 - RNA, 22 nt, Bordetella pertussis
caagcugcuggccggccccauc

SEQ ID NO: 2444548 - RNA, 17 nt, Bordetella pertussis
caagcugcuggcgcgcc

SEQ ID NO: 2444549 - RNA, 18 nt, Bordetella pertussis
caagcugcuggcgcgcca

SEQ ID NO: 2444550 - RNA, 18 nt, Bordetella pertussis
caagcuggccgaugucgc

SEQ ID NO: 2444551 - RNA, 17 nt, Bordetella pertussis
caagcuggcggcgcgcg

SEQ ID NO: 2444552 - RNA, 20 nt, Bordetella pertussis
caagcuggcggcgcgcggcu

SEQ ID NO: 2444553 - RNA, 17 nt, Bordetella pertussis
caaggaaagcccggccc

SEQ ID NO: 2444554 - RNA, 16 nt, Bordetella pertussis
caaggacaaggcgcgu

SEQ ID NO: 2444555 - RNA, 18 nt, Bordetella pertussis
caaggaccaugcgcuggg

SEQ ID NO: 2444556 - RNA, 20 nt, Bordetella pertussis
caaggacgcguccucggcca

SEQ ID NO: 2444557 - RNA, 17 nt, Bordetella pertussis
caaggaggauaagccgu

SEQ ID NO: 2444558 - RNA, 15 nt, Bordetella pertussis
caaggauggacuggc

SEQ ID NO: 2444559 - RNA, 20 nt, Bordetella pertussis
caaggcaagaaucgacucgg

SEQ ID NO: 2444560 - RNA, 12 nt, Bordetella pertussis
caaggcaagcag

SEQ ID NO: 2444561 - RNA, 13 nt, Bordetella pertussis
caaggcaugcgcc

SEQ ID NO: 2444562 - RNA, 21 nt, Bordetella pertussis
caaggcaugcgccagcgccug

SEQ ID NO: 2444563 - RNA, 21 nt, Bordetella pertussis
caaggccacgaauuccucgcc

SEQ ID NO: 2444564 - RNA, 20 nt, Bordetella pertussis
caaggccaugaucaggccga

SEQ ID NO: 2444565 - RNA, 21 nt, Bordetella pertussis
caaggccaugaucaggccgaa

SEQ ID NO: 2444566 - RNA, 17 nt, Bordetella pertussis
caaggcccgcccggggu

SEQ ID NO: 2444567 - RNA, 11 nt, Bordetella pertussis
caaggcccgga

SEQ ID NO: 2444568 - RNA, 17 nt, Bordetella pertussis
caaggccgaauugccgc

SEQ ID NO: 2444569 - RNA, 20 nt, Bordetella pertussis
caaggccgaauugccgccgc

SEQ ID NO: 2444570 - RNA, 13 nt, Bordetella pertussis
caaggccgacugg

SEQ ID NO: 2444571 - RNA, 17 nt, Bordetella pertussis
caaggccgacuggauga

SEQ ID NO: 2444572 - RNA, 18 nt, Bordetella pertussis
caaggccgauagcguucg

SEQ ID NO: 2444573 - RNA, 23 nt, Bordetella pertussis
caaggccggcgcgucgcgcggcg

SEQ ID NO: 2444574 - RNA, 14 nt, Bordetella pertussis
caaggccggcggca

SEQ ID NO: 2444575 - RNA, 11 nt, Bordetella pertussis
caaggccugcc

SEQ ID NO: 2444576 - RNA, 15 nt, Bordetella pertussis
caaggccugcccggg

SEQ ID NO: 2444577 - RNA, 14 nt, Bordetella pertussis
caaggccugcugca

SEQ ID NO: 2444578 - RNA, 16 nt, Bordetella pertussis
caaggcgacggucgca

SEQ ID NO: 2444579 - RNA, 23 nt, Bordetella pertussis
caaggcgcgaguauucacgccgc

SEQ ID NO: 2444580 - RNA, 13 nt, Bordetella pertussis
caaggcgcgcgcc

SEQ ID NO: 2444581 - RNA, 24 nt, Bordetella pertussis
caaggcgcggccgucgugcagcgu

SEQ ID NO: 2444582 - RNA, 15 nt, Bordetella pertussis
caaggcggcaaaccc

SEQ ID NO: 2444583 - RNA, 14 nt, Bordetella pertussis
caaggcggcccggc

SEQ ID NO: 2444584 - RNA, 16 nt, Bordetella pertussis
caaggcgggcuggucg

SEQ ID NO: 2444585 - RNA, 20 nt, Bordetella pertussis
caaggcgggcuggucgcgcc

SEQ ID NO: 2444586 - RNA, 17 nt, Bordetella pertussis
caaggcgguggccagcg

SEQ ID NO: 2444587 - RNA, 19 nt, Bordetella pertussis
caaggcguaauccuucauc

SEQ ID NO: 2444588 - RNA, 14 nt, Bordetella pertussis
caaggcgucggcca

SEQ ID NO: 2444589 - RNA, 16 nt, Bordetella pertussis
caaggcgucggccagg

SEQ ID NO: 2444590 - RNA, 23 nt, Bordetella pertussis
caagggccagucguucagcgucu

SEQ ID NO: 2444591 - RNA, 17 nt, Bordetella pertussis
caagggccccagcaucu

SEQ ID NO: 2444592 - RNA, 21 nt, Bordetella pertussis
caagggccccccggcgcggcc

SEQ ID NO: 2444593 - RNA, 15 nt, Bordetella pertussis
caagggcgccgggcg

SEQ ID NO: 2444594 - RNA, 12 nt, Bordetella pertussis
caagggcgcgcc

SEQ ID NO: 2444595 - RNA, 16 nt, Bordetella pertussis
caagggcgcgccagca

SEQ ID NO: 2444596 - RNA, 23 nt, Bordetella pertussis
caagggcgucuucgccgaccagc

SEQ ID NO: 2444597 - RNA, 20 nt, Bordetella pertussis
caaggggccagccuggcgcc

SEQ ID NO: 2444598 - RNA, 21 nt, Bordetella pertussis
caaggggccagccuggcgcca

SEQ ID NO: 2444599 - RNA, 15 nt, Bordetella pertussis
caagggggacuggca

SEQ ID NO: 2444600 - RNA, 21 nt, Bordetella pertussis
caagggggacuggcaccggca

SEQ ID NO: 2444601 - RNA, 22 nt, Bordetella pertussis
caagggguccguggcggccgcg

SEQ ID NO: 2444602 - RNA, 18 nt, Bordetella pertussis
caagggguggcugucccc

SEQ ID NO: 2444603 - RNA, 18 nt, Bordetella pertussis
caagggugccuguccccg

SEQ ID NO: 2444604 - RNA, 22 nt, Bordetella pertussis
caaggguucgggcaugucgcgg

SEQ ID NO: 2444605 - RNA, 18 nt, Bordetella pertussis
caagguacccgcgccggc

SEQ ID NO: 2444606 - RNA, 15 nt, Bordetella pertussis
caagguccaggcccg

SEQ ID NO: 2444607 - RNA, 17 nt, Bordetella pertussis
caagguccaggcccggc

SEQ ID NO: 2444608 - RNA, 18 nt, Bordetella pertussis
caagguccaggcccggca

SEQ ID NO: 2444609 - RNA, 15 nt, Bordetella pertussis
caaggugaucgaggc

SEQ ID NO: 2444610 - RNA, 23 nt, Bordetella pertussis
caagguggcggugguggccaacg

SEQ ID NO: 2444611 - RNA, 19 nt, Bordetella pertussis
caagguggcgugcagcagg

SEQ ID NO: 2444612 - RNA, 19 nt, Bordetella pertussis
caaguccgguauccuggcg

SEQ ID NO: 2444613 - RNA, 21 nt, Bordetella pertussis
caagucgaguucggcgcgccc

SEQ ID NO: 2444614 - RNA, 21 nt, Bordetella pertussis
caagugcuggcccgccagcaa

SEQ ID NO: 2444615 - RNA, 21 nt, Bordetella pertussis
caauaacgccacuugcaggcc

SEQ ID NO: 2444616 - RNA, 14 nt, Bordetella pertussis
caauacccgccaca

SEQ ID NO: 2444617 - RNA, 19 nt, Bordetella pertussis
caauacgaaaaccaggcug

SEQ ID NO: 2444618 - RNA, 17 nt, Bordetella pertussis
caauacgucgcgaccgc

SEQ ID NO: 2444619 - RNA, 20 nt, Bordetella pertussis
caauacuucguggcgcagcu

SEQ ID NO: 2444620 - RNA, 19 nt, Bordetella pertussis
caauagcccgugcgggccu

SEQ ID NO: 2444621 - RNA, 19 nt, Bordetella pertussis
caauagcgguggcgggcca

SEQ ID NO: 2444622 - RNA, 19 nt, Bordetella pertussis
caauaggccgcgaugucgc

SEQ ID NO: 2444623 - RNA, 17 nt, Bordetella pertussis
caaugcggccaggcccg

SEQ ID NO: 2444624 - RNA, 18 nt, Bordetella pertussis
caaugcggcggcgcuggc

SEQ ID NO: 2444625 - RNA, 18 nt, Bordetella pertussis
caauggacacagcggcgc

SEQ ID NO: 2444626 - RNA, 20 nt, Bordetella pertussis
caauggacacagcggcgcga

SEQ ID NO: 2444627 - RNA, 20 nt, Bordetella pertussis
caauggccgcggcgugcugc

SEQ ID NO: 2444628 - RNA, 15 nt, Bordetella pertussis
caaugguccagcagg

SEQ ID NO: 2444629 - RNA, 16 nt, Bordetella pertussis
caaugguccagcaggg

SEQ ID NO: 2444630 - RNA, 19 nt, Bordetella pertussis
caaugucaccgacgccagc

SEQ ID NO: 2444631 - RNA, 22 nt, Bordetella pertussis
caauguccggggcgcuugccac

SEQ ID NO: 2444632 - RNA, 20 nt, Bordetella pertussis
caaugucgcaggccgcggcc

SEQ ID NO: 2444633 - RNA, 14 nt, Bordetella pertussis
caaugugcugacgg

SEQ ID NO: 2444634 - RNA, 20 nt, Bordetella pertussis
caauucaagccgcaccaugc

SEQ ID NO: 2444635 - RNA, 13 nt, Bordetella pertussis
caauucgagcagg

SEQ ID NO: 2444636 - RNA, 23 nt, Bordetella pertussis
caauucguugaucuggccgucga

SEQ ID NO: 2444637 - RNA, 22 nt, Bordetella pertussis
caauugccagccuuggcccacu

SEQ ID NO: 2444638 - RNA, 23 nt, Bordetella pertussis
caauugcgugguggccuugcugc

SEQ ID NO: 2444639 - RNA, 23 nt, Bordetella pertussis
caauuucgcggucgggaucaucc

SEQ ID NO: 2444640 - RNA, 13 nt, Bordetella pertussis
cacaacccgcccg

SEQ ID NO: 2444641 - RNA, 19 nt, Bordetella pertussis
cacaagcgcguggccggcg

SEQ ID NO: 2444642 - RNA, 22 nt, Bordetella pertussis
cacaaggauggacuggccgcga

SEQ ID NO: 2444643 - RNA, 13 nt, Bordetella pertussis
cacaagggccccg

SEQ ID NO: 2444644 - RNA, 11 nt, Bordetella pertussis
cacacauggcg

SEQ ID NO: 2444645 - RNA, 21 nt, Bordetella pertussis
cacaccagguugucggcgcca

SEQ ID NO: 2444646 - RNA, 22 nt, Bordetella pertussis
cacaccagguugucggcgccac

SEQ ID NO: 2444647 - RNA, 18 nt, Bordetella pertussis
cacaccccaccacgucgc

SEQ ID NO: 2444648 - RNA, 15 nt, Bordetella pertussis
cacaccgcugcggga

SEQ ID NO: 2444649 - RNA, 14 nt, Bordetella pertussis
cacaccgucacgcg

SEQ ID NO: 2444650 - RNA, 20 nt, Bordetella pertussis
cacaccguucccggugccag

SEQ ID NO: 2444651 - RNA, 14 nt, Bordetella pertussis
cacacgaccgagcc

SEQ ID NO: 2444652 - RNA, 15 nt, Bordetella pertussis
cacacgaucagcgcc

SEQ ID NO: 2444653 - RNA, 20 nt, Bordetella pertussis
cacacgaucagcgcccaggu

SEQ ID NO: 2444654 - RNA, 15 nt, Bordetella pertussis
cacacgaucgucagc

SEQ ID NO: 2444655 - RNA, 16 nt, Bordetella pertussis
cacacgaucgucagca

SEQ ID NO: 2444656 - RNA, 17 nt, Bordetella pertussis
cacacgaucgucagcag

SEQ ID NO: 2444657 - RNA, 18 nt, Bordetella pertussis
cacacgcauuugcagcgg

SEQ ID NO: 2444658 - RNA, 11 nt, Bordetella pertussis
cacacgcgcgc

SEQ ID NO: 2444659 - RNA, 12 nt, Bordetella pertussis
cacacgcgcgca

SEQ ID NO: 2444660 - RNA, 23 nt, Bordetella pertussis
cacacgcgcugggcguggcgcgc

SEQ ID NO: 2444661 - RNA, 23 nt, Bordetella pertussis
cacacgcucuugcgcgcgccgga

SEQ ID NO: 2444662 - RNA, 12 nt, Bordetella pertussis
cacacgggcgcc

SEQ ID NO: 2444663 - RNA, 15 nt, Bordetella pertussis
cacacggucagcaac

SEQ ID NO: 2444664 - RNA, 16 nt, Bordetella pertussis
cacacggucagcaacc

SEQ ID NO: 2444665 - RNA, 13 nt, Bordetella pertussis
cacacuggccagc

SEQ ID NO: 2444666 - RNA, 13 nt, Bordetella pertussis
cacacugggcggc

SEQ ID NO: 2444667 - RNA, 16 nt, Bordetella pertussis
cacacuuggccggcga

SEQ ID NO: 2444668 - RNA, 18 nt, Bordetella pertussis
cacagauuggccaccagg

SEQ ID NO: 2444669 - RNA, 19 nt, Bordetella pertussis
cacagauuggccaccaggg

SEQ ID NO: 2444670 - RNA, 18 nt, Bordetella pertussis
cacagcaacucuuccccg

SEQ ID NO: 2444671 - RNA, 20 nt, Bordetella pertussis
cacagcaacucuuccccguc

SEQ ID NO: 2444672 - RNA, 14 nt, Bordetella pertussis
cacagcagcgcgcc

SEQ ID NO: 2444673 - RNA, 15 nt, Bordetella pertussis
cacagcagcgcgccg

SEQ ID NO: 2444674 - RNA, 16 nt, Bordetella pertussis
cacagcaugaccucgg

SEQ ID NO: 2444675 - RNA, 22 nt, Bordetella pertussis
cacagcaugcgcuggucgcgca

SEQ ID NO: 2444676 - RNA, 16 nt, Bordetella pertussis
cacagcauggccacca

SEQ ID NO: 2444677 - RNA, 15 nt, Bordetella pertussis
cacagccacugcggc

SEQ ID NO: 2444678 - RNA, 13 nt, Bordetella pertussis
cacagccaggccg

SEQ ID NO: 2444679 - RNA, 18 nt, Bordetella pertussis
cacagccaggccgaucag

SEQ ID NO: 2444680 - RNA, 20 nt, Bordetella pertussis
cacagccaggccgaucagca

SEQ ID NO: 2444681 - RNA, 23 nt, Bordetella pertussis
cacagccauugcccacagcacgg

SEQ ID NO: 2444682 - RNA, 22 nt, Bordetella pertussis
cacagcccgaucgacggccgca

SEQ ID NO: 2444683 - RNA, 18 nt, Bordetella pertussis
cacgcgugaauaccgcgc

SEQ ID NO: 2444684 - RNA, 20 nt, Bordetella pertussis
cacgcgugaauaccgcgcac

SEQ ID NO: 2444685 - RNA, 17 nt, Bordetella pertussis
cacgcguucgggcggca

SEQ ID NO: 2444686 - RNA, 18 nt, Bordetella pertussis
cacgcuaaauacgcuggc

SEQ ID NO: 2444687 - RNA, 14 nt, Bordetella pertussis
cacgcucacgcccg

SEQ ID NO: 2444688 - RNA, 16 nt, Bordetella pertussis
cacgcucagcaugcgc

SEQ ID NO: 2444689 - RNA, 19 nt, Bordetella pertussis
cacgcucagcaugcgcugg

SEQ ID NO: 2444690 - RNA, 21 nt, Bordetella pertussis
cacgcucagcaugcgcugggc

SEQ ID NO: 2444691 - RNA, 18 nt, Bordetella pertussis
cacgcucauguugggggc

SEQ ID NO: 2444692 - RNA, 21 nt, Bordetella pertussis
cacgcucauguugggggcgaa

SEQ ID NO: 2444693 - RNA, 21 nt, Bordetella pertussis
cacgcucuacacggccgccac

SEQ ID NO: 2444694 - RNA, 15 nt, Bordetella pertussis
cacgcucugcaccuu

SEQ ID NO: 2444695 - RNA, 16 nt, Bordetella pertussis
cacgcucugcaccuug

SEQ ID NO: 2444696 - RNA, 21 nt, Bordetella pertussis
cacgcucugcaccuugggcgc

SEQ ID NO: 2444697 - RNA, 16 nt, Bordetella pertussis
cacgcucuugagcgcg

SEQ ID NO: 2444698 - RNA, 17 nt, Bordetella pertussis
cacgcucuugagcgcgg

SEQ ID NO: 2444699 - RNA, 20 nt, Bordetella pertussis
cacgcucuugagcgcggccu

SEQ ID NO: 2444700 - RNA, 13 nt, Bordetella pertussis
cacgcugaucgcc

SEQ ID NO: 2444701 - RNA, 19 nt, Bordetella pertussis
cacgcugaucgccggcgcc

SEQ ID NO: 2444702 - RNA, 21 nt, Bordetella pertussis
cacgcugaucgccggcgcccc

SEQ ID NO: 2444703 - RNA, 22 nt, Bordetella pertussis
cacgcugaucgccggcgccccc

SEQ ID NO: 2444704 - RNA, 15 nt, Bordetella pertussis
cacgcugcccugcug

SEQ ID NO: 2444705 - RNA, 16 nt, Bordetella pertussis
cacgcugcgcaggcgc

SEQ ID NO: 2444706 - RNA, 17 nt, Bordetella pertussis
cacgcugcgcaggcgcg

SEQ ID NO: 2444707 - RNA, 19 nt, Bordetella pertussis
cacgcugcgcaggcgcgcg

SEQ ID NO: 2444708 - RNA, 16 nt, Bordetella pertussis
cacgcugcgcggcggc

SEQ ID NO: 2444709 - RNA, 23 nt, Bordetella pertussis
cacgcugcugauccucgccagcg

SEQ ID NO: 2444710 - RNA, 17 nt, Bordetella pertussis
cacgcuggacgacgugc

SEQ ID NO: 2444711 - RNA, 15 nt, Bordetella pertussis
cacgcuggccgcgcc

SEQ ID NO: 2444712 - RNA, 17 nt, Bordetella pertussis
cacgcuggccgcgcccg

SEQ ID NO: 2444713 - RNA, 18 nt, Bordetella pertussis
cacgcuggccgcgcccgc

SEQ ID NO: 2444714 - RNA, 16 nt, Bordetella pertussis
cacgcuggccgcgcug

SEQ ID NO: 2444715 - RNA, 21 nt, Bordetella pertussis
cacgcuggccgcgcuggcggc

SEQ ID NO: 2444716 - RNA, 12 nt, Bordetella pertussis
cacgcuggccuu

SEQ ID NO: 2444717 - RNA, 14 nt, Bordetella pertussis
cacgcuggcgcccg

SEQ ID NO: 2444718 - RNA, 15 nt, Bordetella pertussis
cacgcuggcgcccgc

SEQ ID NO: 2444719 - RNA, 16 nt, Bordetella pertussis
cacgcuggcgcccgcc

SEQ ID NO: 2444720 - RNA, 21 nt, Bordetella pertussis
cacgcuggcgcccgccugcgc

SEQ ID NO: 2444721 - RNA, 17 nt, Bordetella pertussis
cacgcuggcggacacgc

SEQ ID NO: 2444722 - RNA, 23 nt, Bordetella pertussis
cacgcuggcggacacgcccuggc

SEQ ID NO: 2444723 - RNA, 23 nt, Bordetella pertussis
cacgcuggcuucgucgccggcgu

SEQ ID NO: 2444724 - RNA, 14 nt, Bordetella pertussis
cacgcugggccaga

SEQ ID NO: 2444725 - RNA, 20 nt, Bordetella pertussis
cacgcugggccagaccgcgc

SEQ ID NO: 2444726 - RNA, 21 nt, Bordetella pertussis
cacgcugggccagaccgcgcg

SEQ ID NO: 2444727 - RNA, 18 nt, Bordetella pertussis
cacgggcgcugcccagga

SEQ ID NO: 2444728 - RNA, 15 nt, Bordetella pertussis
cacggggacaggcac

SEQ ID NO: 2444729 - RNA, 17 nt, Bordetella pertussis
cacggggacaggcaccu

SEQ ID NO: 2444730 - RNA, 17 nt, Bordetella pertussis
cacggggacuggcacgc

SEQ ID NO: 2444731 - RNA, 15 nt, Bordetella pertussis
cacggggacuggcuc

SEQ ID NO: 2444732 - RNA, 17 nt, Bordetella pertussis
cacggggcugucgcgcg

SEQ ID NO: 2444733 - RNA, 13 nt, Bordetella pertussis
cacggguaccagg

SEQ ID NO: 2444734 - RNA, 21 nt, Bordetella pertussis
cacgguaggcgcgucgcugcg

SEQ ID NO: 2444735 - RNA, 17 nt, Bordetella pertussis
cacggucaaccacgcca

SEQ ID NO: 2444736 - RNA, 18 nt, Bordetella pertussis
cacggucaaccacgccaa

SEQ ID NO: 2444737 - RNA, 14 nt, Bordetella pertussis
cacggucagcaacc

SEQ ID NO: 2444738 - RNA, 21 nt, Bordetella pertussis
cacggucagcaaccccagcag

SEQ ID NO: 2444739 - RNA, 20 nt, Bordetella pertussis
cacggucgaagaucuucggc

SEQ ID NO: 2444740 - RNA, 15 nt, Bordetella pertussis
cacggucugcaccug

SEQ ID NO: 2444741 - RNA, 15 nt, Bordetella pertussis
cacggucugcacgcc

SEQ ID NO: 2444742 - RNA, 18 nt, Bordetella pertussis
cacggucuggcccacgcg

SEQ ID NO: 2444743 - RNA, 22 nt, Bordetella pertussis
cacggucuggcccacgcgcacg

SEQ ID NO: 2444744 - RNA, 16 nt, Bordetella pertussis
cacggucuggcgcgac

SEQ ID NO: 2444745 - RNA, 17 nt, Bordetella pertussis
cacggucuggcgcgaca

SEQ ID NO: 2444746 - RNA, 21 nt, Bordetella pertussis
cacggugaccggguggcugcg

SEQ ID NO: 2444747 - RNA, 13 nt, Bordetella pertussis
cacggugccgcgc

SEQ ID NO: 2444748 - RNA, 22 nt, Bordetella pertussis
cacgguggauucggacgccucg

SEQ ID NO: 2444749 - RNA, 20 nt, Bordetella pertussis
cacgguggcgaaggccgccg

SEQ ID NO: 2444750 - RNA, 16 nt, Bordetella pertussis
cacgguggcgcccggc

SEQ ID NO: 2444751 - RNA, 19 nt, Bordetella pertussis
cacgguggcgcccggcggc

SEQ ID NO: 2444752 - RNA, 22 nt, Bordetella pertussis
cacgguggcggugcucgaggug

SEQ ID NO: 2444753 - RNA, 20 nt, Bordetella pertussis
cacggugggcagcagcacgc

SEQ ID NO: 2444754 - RNA, 23 nt, Bordetella pertussis
cacggugggcagcagcacgccca

SEQ ID NO: 2444755 - RNA, 21 nt, Bordetella pertussis
cacggugucgaugggcccggg

SEQ ID NO: 2444756 - RNA, 19 nt, Bordetella pertussis
cacgguugccacggugaag

SEQ ID NO: 2444757 - RNA, 13 nt, Bordetella pertussis
cacguaaucgaag

SEQ ID NO: 2444758 - RNA, 18 nt, Bordetella pertussis
cacguacaaccgcgccga

SEQ ID NO: 2444759 - RNA, 16 nt, Bordetella pertussis
cacguagcgcagcacc

SEQ ID NO: 2444760 - RNA, 17 nt, Bordetella pertussis
cacguagcgcagcaccg

SEQ ID NO: 2444761 - RNA, 22 nt, Bordetella pertussis
cacguaggcaaagcgcggcugc

SEQ ID NO: 2444762 - RNA, 18 nt, Bordetella pertussis
cacguagguggucagcau

SEQ ID NO: 2444763 - RNA, 16 nt, Bordetella pertussis
cacguaguacagcagc

SEQ ID NO: 2444764 - RNA, 13 nt, Bordetella pertussis
cacgucaguccgu

SEQ ID NO: 2444765 - RNA, 21 nt, Bordetella pertussis
cacgucaguccguggcgcggc

SEQ ID NO: 2444766 - RNA, 23 nt, Bordetella pertussis
cacgucaguccguggcgcggcca

SEQ ID NO: 2444767 - RNA, 17 nt, Bordetella pertussis
cacgucauccugggcgc

SEQ ID NO: 2444768 - RNA, 16 nt, Bordetella pertussis
cacgucaucguggccg

SEQ ID NO: 2444769 - RNA, 12 nt, Bordetella pertussis
cacgucauugca

SEQ ID NO: 2444770 - RNA, 12 nt, Bordetella pertussis
cacguccagcac

SEQ ID NO: 2444771 - RNA, 16 nt, Bordetella pertussis
cacguccagcacggcc

SEQ ID NO: 2444772 - RNA, 17 nt, Bordetella pertussis
cacguccagcacggccg

SEQ ID NO: 2444773 - RNA, 18 nt, Bordetella pertussis
cacguccagcacggccgc

SEQ ID NO: 2444774 - RNA, 19 nt, Bordetella pertussis
cacguccagcacggccgcg

SEQ ID NO: 2444775 - RNA, 20 nt, Bordetella pertussis
cacguccagcacggccgcgg

SEQ ID NO: 2444776 - RNA, 11 nt, Bordetella pertussis
cacguccagcg

SEQ ID NO: 2444777 - RNA, 14 nt, Bordetella pertussis
cacguccagcgccg

SEQ ID NO: 2444778 - RNA, 18 nt, Bordetella pertussis
cacguccagcggcgcgac

SEQ ID NO: 2444779 - RNA, 13 nt, Bordetella pertussis
cacgucccagucg

SEQ ID NO: 2444780 - RNA, 17 nt, Bordetella pertussis
cacgucccagucgccgc

SEQ ID NO: 2444781 - RNA, 21 nt, Bordetella pertussis
cacgucccagucgccgcgccc

SEQ ID NO: 2444782 - RNA, 23 nt, Bordetella pertussis
cacgucccagucgccgcgcccgc

SEQ ID NO: 2444783 - RNA, 22 nt, Bordetella pertussis
cacguccgagaggaucaccgca

SEQ ID NO: 2444784 - RNA, 19 nt, Bordetella pertussis
cacguccggcacggcggca

SEQ ID NO: 2444785 - RNA, 19 nt, Bordetella pertussis
cacguccggguuggcgaug

SEQ ID NO: 2444786 - RNA, 23 nt, Bordetella pertussis
cacguccucgacguaagugccca

SEQ ID NO: 2444787 - RNA, 23 nt, Bordetella pertussis
cacgucgaccucgagcaccuuga

SEQ ID NO: 2444788 - RNA, 20 nt, Bordetella pertussis
cacgucgaucaggcccagca

SEQ ID NO: 2444789 - RNA, 14 nt, Bordetella pertussis
cacgucgccggcgu

SEQ ID NO: 2444790 - RNA, 21 nt, Bordetella pertussis
cacgucggcggccgccuugac

SEQ ID NO: 2444791 - RNA, 21 nt, Bordetella pertussis
cacgucgggcaggauggccau

SEQ ID NO: 2444792 - RNA, 12 nt, Bordetella pertussis
cacgucggucga

SEQ ID NO: 2444793 - RNA, 22 nt, Bordetella pertussis
cacgucggucgcuuccagcgca

SEQ ID NO: 2444794 - RNA, 23 nt, Bordetella pertussis
cacgucggugggaaucggcaccu

SEQ ID NO: 2444795 - RNA, 15 nt, Bordetella pertussis
cacgucguagcgcug

SEQ ID NO: 2444796 - RNA, 20 nt, Bordetella pertussis
cacgucguagcgcugcagcc

SEQ ID NO: 2444797 - RNA, 15 nt, Bordetella pertussis
cacgugaagcgccgc

SEQ ID NO: 2444798 - RNA, 15 nt, Bordetella pertussis
auguccagcggcgua

SEQ ID NO: 2444799 - RNA, 13 nt, Bordetella pertussis
auguccagcucca

SEQ ID NO: 2444800 - RNA, 14 nt, Bordetella pertussis
auguccauggccug

SEQ ID NO: 2444801 - RNA, 14 nt, Bordetella pertussis
augucccacaggcg

SEQ ID NO: 2444802 - RNA, 22 nt, Bordetella pertussis
augucccgcaugaccugcagga

SEQ ID NO: 2444803 - RNA, 21 nt, Bordetella pertussis
auguccgccacgccggccacg

SEQ ID NO: 2444804 - RNA, 16 nt, Bordetella pertussis
auguccgcgucggccg

SEQ ID NO: 2444805 - RNA, 13 nt, Bordetella pertussis
auguccugcaggc

SEQ ID NO: 2444806 - RNA, 13 nt, Bordetella pertussis
auguccugcaggu

SEQ ID NO: 2444807 - RNA, 17 nt, Bordetella pertussis
augucgaacagcugcag

SEQ ID NO: 2444808 - RNA, 16 nt, Bordetella pertussis
augucgaucuggcuca

SEQ ID NO: 2444809 - RNA, 17 nt, Bordetella pertussis
augucgcaggccgcggc

SEQ ID NO: 2444810 - RNA, 13 nt, Bordetella pertussis
augucgcccaugc

SEQ ID NO: 2444811 - RNA, 16 nt, Bordetella pertussis
augucgccgccgcgca

SEQ ID NO: 2444812 - RNA, 19 nt, Bordetella pertussis
augucgccgccugcggcgc

SEQ ID NO: 2444813 - RNA, 13 nt, Bordetella pertussis
augucgcgcgccu

SEQ ID NO: 2444814 - RNA, 23 nt, Bordetella pertussis
augucgcgcgccugcgcgccgcc

SEQ ID NO: 2444815 - RNA, 12 nt, Bordetella pertussis
augucgcgcgcg

SEQ ID NO: 2444816 - RNA, 20 nt, Bordetella pertussis
augucgcggcccacggccag

SEQ ID NO: 2444817 - RNA, 23 nt, Bordetella pertussis
augucgcgggcccgcucggccag

SEQ ID NO: 2444818 - RNA, 20 nt, Bordetella pertussis
augucggccuucugcgccag

SEQ ID NO: 2444819 - RNA, 17 nt, Bordetella pertussis
augucggcuaccacgug

SEQ ID NO: 2444820 - RNA, 15 nt, Bordetella pertussis
augucggugaaggcc

SEQ ID NO: 2444821 - RNA, 18 nt, Bordetella pertussis
augucguccucggccacg

SEQ ID NO: 2444822 - RNA, 12 nt, Bordetella pertussis
augugcagcgca

SEQ ID NO: 2444823 - RNA, 16 nt, Bordetella pertussis
augugcagcgcacggu

SEQ ID NO: 2444824 - RNA, 15 nt, Bordetella pertussis
augugcaugccgucg

SEQ ID NO: 2444825 - RNA, 21 nt, Bordetella pertussis
cacgcaggauaccggagcggc

SEQ ID NO: 2444826 - RNA, 16 nt, Bordetella pertussis
cacgcaggcgggcgcc

SEQ ID NO: 2444827 - RNA, 20 nt, Bordetella pertussis
cacgcaggcgggcgccgcgc

SEQ ID NO: 2444828 - RNA, 23 nt, Bordetella pertussis
cacgcaugcgacaugagcugcgc

SEQ ID NO: 2444829 - RNA, 17 nt, Bordetella pertussis
cacgcauuugcagcggc

SEQ ID NO: 2444830 - RNA, 14 nt, Bordetella pertussis
cacgccacuggccu

SEQ ID NO: 2444831 - RNA, 16 nt, Bordetella pertussis
cacgccauggucucgu

SEQ ID NO: 2444832 - RNA, 18 nt, Bordetella pertussis
cacgccauggucucgucc

SEQ ID NO: 2444833 - RNA, 18 nt, Bordetella pertussis
cacgccauucauccagcg

SEQ ID NO: 2444834 - RNA, 21 nt, Bordetella pertussis
cacgccauucauccagcgcgc

SEQ ID NO: 2444835 - RNA, 22 nt, Bordetella pertussis
cacgccauucauccagcgcgcg

SEQ ID NO: 2444836 - RNA, 16 nt, Bordetella pertussis
cacgcccacgcgccgc

SEQ ID NO: 2444837 - RNA, 21 nt, Bordetella pertussis
cacgcccacgcgccgccaggc

SEQ ID NO: 2444838 - RNA, 19 nt, Bordetella pertussis
cacgcccacuuccucggcg

SEQ ID NO: 2444839 - RNA, 18 nt, Bordetella pertussis
cacgcccagacuggcgua

SEQ ID NO: 2444840 - RNA, 12 nt, Bordetella pertussis
cacgcccagccg

SEQ ID NO: 2444841 - RNA, 15 nt, Bordetella pertussis
cacgcccagccgcag

SEQ ID NO: 2444842 - RNA, 17 nt, Bordetella pertussis
cacgcccagccgcagca

SEQ ID NO: 2444843 - RNA, 23 nt, Bordetella pertussis
cacgcccagccgcagcaggcgcu

SEQ ID NO: 2444844 - RNA, 16 nt, Bordetella pertussis
cacgcccagcgccggc

SEQ ID NO: 2444845 - RNA, 19 nt, Bordetella pertussis
cacgcccagcgccggcacg

SEQ ID NO: 2444846 - RNA, 14 nt, Bordetella pertussis
cacgcccaggccgc

SEQ ID NO: 2444847 - RNA, 14 nt, Bordetella pertussis
cacgcccaggccgu

SEQ ID NO: 2444848 - RNA, 19 nt, Bordetella pertussis
cacgcccaggccguggcgc

SEQ ID NO: 2444849 - RNA, 23 nt, Bordetella pertussis
cacgcccaggccguggcgcacca

SEQ ID NO: 2444850 - RNA, 12 nt, Bordetella pertussis
cacgcccaggcg

SEQ ID NO: 2444851 - RNA, 20 nt, Bordetella pertussis
cacgcccagucccaggccga

SEQ ID NO: 2444852 - RNA, 21 nt, Bordetella pertussis
cacgcccaucuaugaggaugg

SEQ ID NO: 2444853 - RNA, 22 nt, Bordetella pertussis
cacgcccauguagaacgccagg

SEQ ID NO: 2444854 - RNA, 12 nt, Bordetella pertussis
cacgccccgccc

SEQ ID NO: 2444855 - RNA, 14 nt, Bordetella pertussis
cacgcccgagaugg

SEQ ID NO: 2444856 - RNA, 17 nt, Bordetella pertussis
cacgcccgccagcagcu

SEQ ID NO: 2444857 - RNA, 17 nt, Bordetella pertussis
cacgcccgccugcagca

SEQ ID NO: 2444858 - RNA, 18 nt, Bordetella pertussis
cacgcccgccugcagcag

SEQ ID NO: 2444859 - RNA, 19 nt, Bordetella pertussis
cacgcccgccugcagcagc

SEQ ID NO: 2444860 - RNA, 23 nt, Bordetella pertussis
cacgcccgccugcagcagcgccu

SEQ ID NO: 2444861 - RNA, 12 nt, Bordetella pertussis
cacgcccgccuu

SEQ ID NO: 2444862 - RNA, 14 nt, Bordetella pertussis
cacgcccgcgccgc

SEQ ID NO: 2444863 - RNA, 15 nt, Bordetella pertussis
cacgcccgcgccgca

SEQ ID NO: 2444864 - RNA, 14 nt, Bordetella pertussis
cacgcccgcgcgcg

SEQ ID NO: 2444865 - RNA, 15 nt, Bordetella pertussis
cacgcccgcgcgcga

SEQ ID NO: 2444866 - RNA, 17 nt, Bordetella pertussis
cacgcccgcggcgccca

SEQ ID NO: 2444867 - RNA, 16 nt, Bordetella pertussis
cacgcgagcccgcguc

SEQ ID NO: 2444868 - RNA, 23 nt, Bordetella pertussis
cacgcgauggcggcaucuugccu

SEQ ID NO: 2444869 - RNA, 13 nt, Bordetella pertussis
cacgcgcaacgcc

SEQ ID NO: 2444870 - RNA, 15 nt, Bordetella pertussis
cacgcgcaacgccgc

SEQ ID NO: 2444871 - RNA, 17 nt, Bordetella pertussis
cacgcgcaacgccgcca

SEQ ID NO: 2444872 - RNA, 18 nt, Bordetella pertussis
cacgcgcaacgccgccac

SEQ ID NO: 2444873 - RNA, 19 nt, Bordetella pertussis
cacgcgcaacgccgccacc

SEQ ID NO: 2444874 - RNA, 21 nt, Bordetella pertussis
cacgcgcaacgccgccaccag

SEQ ID NO: 2444875 - RNA, 19 nt, Bordetella pertussis
cacgcgcaaggcgggcugg

SEQ ID NO: 2444876 - RNA, 14 nt, Bordetella pertussis
cacgcgcaccaggc

SEQ ID NO: 2444877 - RNA, 14 nt, Bordetella pertussis
cacgcgcacggcca

SEQ ID NO: 2444878 - RNA, 13 nt, Bordetella pertussis
cacgcgcagcguc

SEQ ID NO: 2444879 - RNA, 15 nt, Bordetella pertussis
cacgcgccgccaggc

SEQ ID NO: 2444880 - RNA, 18 nt, Bordetella pertussis
cacgcgccgccaggcgcg

SEQ ID NO: 2444881 - RNA, 22 nt, Bordetella pertussis
cacgcgccgugcagacggcggc

SEQ ID NO: 2444882 - RNA, 20 nt, Bordetella pertussis
cacgcgcgacgccguggugg

SEQ ID NO: 2444883 - RNA, 19 nt, Bordetella pertussis
cacgcgcgcaaugcgcggc

SEQ ID NO: 2444884 - RNA, 13 nt, Bordetella pertussis
cacgcgcgcgccg

SEQ ID NO: 2444885 - RNA, 15 nt, Bordetella pertussis
cacgcgcgcgccgcc

SEQ ID NO: 2444886 - RNA, 16 nt, Bordetella pertussis
cacgcgcgcgugcagg

SEQ ID NO: 2444887 - RNA, 17 nt, Bordetella pertussis
cacgcgcgcuggcgccc

SEQ ID NO: 2444888 - RNA, 20 nt, Bordetella pertussis
cacgcgcgcuggcgcccggc

SEQ ID NO: 2444889 - RNA, 14 nt, Bordetella pertussis
cacgcgcggaucgg

SEQ ID NO: 2444890 - RNA, 19 nt, Bordetella pertussis
cacgcgcggcagcgccggg

SEQ ID NO: 2444891 - RNA, 13 nt, Bordetella pertussis
cacgcgcggcggc

SEQ ID NO: 2444892 - RNA, 14 nt, Bordetella pertussis
cacgcgcuccagcg

SEQ ID NO: 2444893 - RNA, 23 nt, Bordetella pertussis
cacgcgcuccggcugcgcgcgca

SEQ ID NO: 2444894 - RNA, 19 nt, Bordetella pertussis
cacgcgcuccugcucggcg

SEQ ID NO: 2444895 - RNA, 21 nt, Bordetella pertussis
cacgcgcuugcgcgccacguc

SEQ ID NO: 2444896 - RNA, 23 nt, Bordetella pertussis
cacgcgcuugcgcgccacgucga

SEQ ID NO: 2444897 - RNA, 18 nt, Bordetella pertussis
cacgcggccgcgggccgc

SEQ ID NO: 2444898 - RNA, 20 nt, Bordetella pertussis
cacgcggccgcgggccgcug

SEQ ID NO: 2444899 - RNA, 14 nt, Bordetella pertussis
cacgcggccgggca

SEQ ID NO: 2444900 - RNA, 17 nt, Bordetella pertussis
cacgcggccguggcggc

SEQ ID NO: 2444901 - RNA, 14 nt, Bordetella pertussis
cacgcggcgcagca

SEQ ID NO: 2444902 - RNA, 14 nt, Bordetella pertussis
cacgcggcgcggca

SEQ ID NO: 2444903 - RNA, 21 nt, Bordetella pertussis
cacgcggcgcugcuggccggc

SEQ ID NO: 2444904 - RNA, 22 nt, Bordetella pertussis
cacgcggcgcugcuggccggcc

SEQ ID NO: 2444905 - RNA, 17 nt, Bordetella pertussis
cacgcggcuucgcccgg

SEQ ID NO: 2444906 - RNA, 14 nt, Bordetella pertussis
cacgcgggccggcc

SEQ ID NO: 2444907 - RNA, 12 nt, Bordetella pertussis
cacgcgggcgcu

SEQ ID NO: 2444908 - RNA, 17 nt, Bordetella pertussis
cacgcgguagguagcgc

SEQ ID NO: 2444909 - RNA, 23 nt, Bordetella pertussis
cacgcgguagguagcgcgcagcu

SEQ ID NO: 2444910 - RNA, 16 nt, Bordetella pertussis
cacgcgguccacgccg

SEQ ID NO: 2444911 - RNA, 18 nt, Bordetella pertussis
cacgcgguccacgccggg

SEQ ID NO: 2444912 - RNA, 14 nt, Bordetella pertussis
cacgcgguccagcc

SEQ ID NO: 2444913 - RNA, 14 nt, Bordetella pertussis
cacgcggucgaugc

SEQ ID NO: 2444914 - RNA, 16 nt, Bordetella pertussis
cacgcggucgaugcgc

SEQ ID NO: 2444915 - RNA, 21 nt, Bordetella pertussis
cacgcggucgaugcgcacgcc

SEQ ID NO: 2444916 - RNA, 15 nt, Bordetella pertussis
cacgcguacggcccu

SEQ ID NO: 2444917 - RNA, 17 nt, Bordetella pertussis
cacgcguacggcccugg

SEQ ID NO: 2444918 - RNA, 20 nt, Bordetella pertussis
cacgcguacggcccuggucu

SEQ ID NO: 2444919 - RNA, 18 nt, Bordetella pertussis
cacuggguggccagcgcc

SEQ ID NO: 2444920 - RNA, 22 nt, Bordetella pertussis
cacuggguggccagcgccgcca

SEQ ID NO: 2444921 - RNA, 13 nt, Bordetella pertussis
cacugucgccacg

SEQ ID NO: 2444922 - RNA, 23 nt, Bordetella pertussis
cacugucggcguuccuggcgcug

SEQ ID NO: 2444923 - RNA, 23 nt, Bordetella pertussis
cacuuccucggcgcgcgcggucg

SEQ ID NO: 2444924 - RNA, 18 nt, Bordetella pertussis
cacuuccuggugggcggc

SEQ ID NO: 2444925 - RNA, 13 nt, Bordetella pertussis
cacuuccuugcca

SEQ ID NO: 2444926 - RNA, 14 nt, Bordetella pertussis
cacuucgaaaauga

SEQ ID NO: 2444927 - RNA, 14 nt, Bordetella pertussis
cacuucgaaacccu

SEQ ID NO: 2444928 - RNA, 17 nt, Bordetella pertussis
cacuucgcggccgaugu

SEQ ID NO: 2444929 - RNA, 14 nt, Bordetella pertussis
cacuucuucgagca

SEQ ID NO: 2444930 - RNA, 15 nt, Bordetella pertussis
cacuucuucgagcaa

SEQ ID NO: 2444931 - RNA, 14 nt, Bordetella pertussis
cacuugacggccaa

SEQ ID NO: 2444932 - RNA, 14 nt, Bordetella pertussis
cacuugccggccgc

SEQ ID NO: 2444933 - RNA, 16 nt, Bordetella pertussis
cacuugccggccgccc

SEQ ID NO: 2444934 - RNA, 19 nt, Bordetella pertussis
cacuugcgaacggccgccc

SEQ ID NO: 2444935 - RNA, 20 nt, Bordetella pertussis
cacuugcgaacggccgcccg

SEQ ID NO: 2444936 - RNA, 19 nt, Bordetella pertussis
cacuugcggguccagcagg

SEQ ID NO: 2444937 - RNA, 24 nt, Bordetella pertussis
cacuugcggguccagcaggauggc

SEQ ID NO: 2444938 - RNA, 14 nt, Bordetella pertussis
cacuuggccggcga

SEQ ID NO: 2444939 - RNA, 14 nt, Bordetella pertussis
cacuuugaacaguu

SEQ ID NO: 2444940 - RNA, 17 nt, Bordetella pertussis
cagaaaaaauacccguc

SEQ ID NO: 2444941 - RNA, 19 nt, Bordetella pertussis
cagaaaccgccacagcgcc

SEQ ID NO: 2444942 - RNA, 22 nt, Bordetella pertussis
cagaaaccgccacagcgccgcg

SEQ ID NO: 2444943 - RNA, 13 nt, Bordetella pertussis
cagaaaggaugcc

SEQ ID NO: 2444944 - RNA, 15 nt, Bordetella pertussis
cagaaaggcagcgga

SEQ ID NO: 2444945 - RNA, 19 nt, Bordetella pertussis
cagaaauggaugcgcgccc

SEQ ID NO: 2444946 - RNA, 23 nt, Bordetella pertussis
cagaaauggaugcgcgccccguc

SEQ ID NO: 2444947 - RNA, 16 nt, Bordetella pertussis
cagaacagcagcguga

SEQ ID NO: 2444948 - RNA, 13 nt, Bordetella pertussis
cagaacaugagcc

SEQ ID NO: 2444949 - RNA, 14 nt, Bordetella pertussis
cagaacccggccgg

SEQ ID NO: 2444950 - RNA, 21 nt, Bordetella pertussis
cagaacccggccggcgccggc

SEQ ID NO: 2444951 - RNA, 22 nt, Bordetella pertussis
cagaacccggccggcgccggca

SEQ ID NO: 2444952 - RNA, 16 nt, Bordetella pertussis
cagaacgacagcgaca

SEQ ID NO: 2444953 - RNA, 16 nt, Bordetella pertussis
cagaacgacgaucugg

SEQ ID NO: 2444954 - RNA, 22 nt, Bordetella pertussis
cagaacgcguaggucaggccca

SEQ ID NO: 2444955 - RNA, 20 nt, Bordetella pertussis
cagaacgcugaugcgcguca

SEQ ID NO: 2444956 - RNA, 14 nt, Bordetella pertussis
cagaacggcgcggg

SEQ ID NO: 2444957 - RNA, 14 nt, Bordetella pertussis
cagaagcagccgcg

SEQ ID NO: 2444958 - RNA, 18 nt, Bordetella pertussis
cagaagcagccgcgcggc

SEQ ID NO: 2444959 - RNA, 23 nt, Bordetella pertussis
cagaagcagccgcgcggccgggc

SEQ ID NO: 2444960 - RNA, 20 nt, Bordetella pertussis
cagaagcgccauggcagggu

SEQ ID NO: 2444961 - RNA, 21 nt, Bordetella pertussis
cagaaggucugggccagcagg

SEQ ID NO: 2444962 - RNA, 23 nt, Bordetella pertussis
cagaaggucugggccagcaggcu

SEQ ID NO: 2444963 - RNA, 16 nt, Bordetella pertussis
cagacagccacgcgcg

SEQ ID NO: 2444964 - RNA, 13 nt, Bordetella pertussis
cagacaggccggc

SEQ ID NO: 2444965 - RNA, 19 nt, Bordetella pertussis
cagacauugucaagcagcg

SEQ ID NO: 2444966 - RNA, 16 nt, Bordetella pertussis
cagaccaagcgccaca

SEQ ID NO: 2444967 - RNA, 21 nt, Bordetella pertussis
cagaccaagcgccacagcgcc

SEQ ID NO: 2444968 - RNA, 13 nt, Bordetella pertussis
cagaccacgccgg

SEQ ID NO: 2444969 - RNA, 22 nt, Bordetella pertussis
cagacccgaaucucccggcgcc

SEQ ID NO: 2444970 - RNA, 13 nt, Bordetella pertussis
cagacccgcgccc

SEQ ID NO: 2444971 - RNA, 21 nt, Bordetella pertussis
cagacccgggccgcuggcccg

SEQ ID NO: 2444972 - RNA, 23 nt, Bordetella pertussis
cagacccgggccgcuggcccggg

SEQ ID NO: 2444973 - RNA, 14 nt, Bordetella pertussis
cagacccuggcgcg

SEQ ID NO: 2444974 - RNA, 18 nt, Bordetella pertussis
cagaccgagcgcgcccgc

SEQ ID NO: 2444975 - RNA, 16 nt, Bordetella pertussis
cagaccgcgcgcacca

SEQ ID NO: 2444976 - RNA, 16 nt, Bordetella pertussis
cagaccguagcgcagg

SEQ ID NO: 2444977 - RNA, 19 nt, Bordetella pertussis
cagaccguagcgcaggcgc

SEQ ID NO: 2444978 - RNA, 23 nt, Bordetella pertussis
cagaccguagcgcaggcgcuuga

SEQ ID NO: 2444979 - RNA, 16 nt, Bordetella pertussis
cagaccuaccaggccg

SEQ ID NO: 2444980 - RNA, 17 nt, Bordetella pertussis
cagaccuaccaggccga

SEQ ID NO: 2444981 - RNA, 20 nt, Bordetella pertussis
cagaccuaccaggccgacga

SEQ ID NO: 2444982 - RNA, 15 nt, Bordetella pertussis
cagaccugcgcgccg

SEQ ID NO: 2444983 - RNA, 17 nt, Bordetella pertussis
cagaccugcgcgccggc

SEQ ID NO: 2444984 - RNA, 18 nt, Bordetella pertussis
cagaccugcgcgccggca

SEQ ID NO: 2444985 - RNA, 15 nt, Bordetella pertussis
cagacgaucacggug

SEQ ID NO: 2444986 - RNA, 20 nt, Bordetella pertussis
cagacgaucauccaggccgu

SEQ ID NO: 2444987 - RNA, 22 nt, Bordetella pertussis
cagacgaugcccaggcccgcca

SEQ ID NO: 2444988 - RNA, 19 nt, Bordetella pertussis
cagacgauggugccggccg

SEQ ID NO: 2444989 - RNA, 13 nt, Bordetella pertussis
cagacgcagacca

SEQ ID NO: 2444990 - RNA, 18 nt, Bordetella pertussis
cagacgcagaccacgccg

SEQ ID NO: 2444991 - RNA, 19 nt, Bordetella pertussis
cagacgcagaccacgccgg

SEQ ID NO: 2444992 - RNA, 21 nt, Bordetella pertussis
cagacgcaguggaaaucgugc

SEQ ID NO: 2444993 - RNA, 22 nt, Bordetella pertussis
cagacgccaucuugcaggcgcc

SEQ ID NO: 2444994 - RNA, 17 nt, Bordetella pertussis
cagacgcgagaccauga

SEQ ID NO: 2444995 - RNA, 19 nt, Bordetella pertussis
cagacgcgagaccaugacg

SEQ ID NO: 2444996 - RNA, 23 nt, Bordetella pertussis
cagacgcgagaccaugacgucga

SEQ ID NO: 2444997 - RNA, 18 nt, Bordetella pertussis
cagacgcgcucaggcggu

SEQ ID NO: 2444998 - RNA, 23 nt, Bordetella pertussis
cagacgcgcuuuuccccgcccag

SEQ ID NO: 2444999 - RNA, 15 nt, Bordetella pertussis
cagacgcuucaggcc

SEQ ID NO: 2445000 - RNA, 16 nt, Bordetella pertussis
cagacgcuucaggccg

SEQ ID NO: 2445001 - RNA, 17 nt, Bordetella pertussis
cagacgcuucaggccgu

SEQ ID NO: 2445002 - RNA, 15 nt, Bordetella pertussis
cagacggccagcgcg

SEQ ID NO: 2445003 - RNA, 17 nt, Bordetella pertussis
cagacggcggcuggacg

SEQ ID NO: 2445004 - RNA, 19 nt, Bordetella pertussis
cagacgggcuggaagacgc

SEQ ID NO: 2445005 - RNA, 11 nt, Bordetella pertussis
cagagcgcgca

SEQ ID NO: 2445006 - RNA, 19 nt, Bordetella pertussis
cagagcgggauggucgcgg

SEQ ID NO: 2445007 - RNA, 21 nt, Bordetella pertussis
cagagcgggauggucgcggcc

SEQ ID NO: 2445008 - RNA, 17 nt, Bordetella pertussis
cagaggaacgccgcgcu

SEQ ID NO: 2445009 - RNA, 15 nt, Bordetella pertussis
cagagggagcgacac

SEQ ID NO: 2445010 - RNA, 22 nt, Bordetella pertussis
cagagggagcgacacccgcggc

SEQ ID NO: 2445011 - RNA, 22 nt, Bordetella pertussis
cagagucugccuggcgaacagu

SEQ ID NO: 2445012 - RNA, 22 nt, Bordetella pertussis
cagcacauagggcgagaucauc

SEQ ID NO: 2445013 - RNA, 20 nt, Bordetella pertussis
cagcacauccgacagauggc

SEQ ID NO: 2445014 - RNA, 17 nt, Bordetella pertussis
cagcacaucgacgucgg

SEQ ID NO: 2445015 - RNA, 17 nt, Bordetella pertussis
cagcacauggcgcgccg

SEQ ID NO: 2445016 - RNA, 18 nt, Bordetella pertussis
cagcacauggcgcgccgg

SEQ ID NO: 2445017 - RNA, 19 nt, Bordetella pertussis
cagcacauggcgcgccggc

SEQ ID NO: 2445018 - RNA, 21 nt, Bordetella pertussis
cagcacauggcgcgccggccg

SEQ ID NO: 2445019 - RNA, 22 nt, Bordetella pertussis
cagcacauggcgcgccggccgg

SEQ ID NO: 2445020 - RNA, 23 nt, Bordetella pertussis
cagcacaugggcgcgguagcgcc

SEQ ID NO: 2445021 - RNA, 16 nt, Bordetella pertussis
cagcaccacaucgccg

SEQ ID NO: 2445022 - RNA, 18 nt, Bordetella pertussis
cagcaccacaucgccggc

SEQ ID NO: 2445023 - RNA, 15 nt, Bordetella pertussis
cagcaccacggcggc

SEQ ID NO: 2445024 - RNA, 17 nt, Bordetella pertussis
cagcaccacggcggcca

SEQ ID NO: 2445025 - RNA, 20 nt, Bordetella pertussis
cagcaccacggcggccaggc

SEQ ID NO: 2445026 - RNA, 12 nt, Bordetella pertussis
cagcaccacggg

SEQ ID NO: 2445027 - RNA, 14 nt, Bordetella pertussis
cagcaccacgggcu

SEQ ID NO: 2445028 - RNA, 13 nt, Bordetella pertussis
cagcaccagcaug

SEQ ID NO: 2445029 - RNA, 16 nt, Bordetella pertussis
cagcaccagcaugcgc

SEQ ID NO: 2445030 - RNA, 13 nt, Bordetella pertussis
cagcaccagcgcc

SEQ ID NO: 2445031 - RNA, 16 nt, Bordetella pertussis
cagcaccagcgccugc

SEQ ID NO: 2445032 - RNA, 13 nt, Bordetella pertussis
cagcaccaggccg

SEQ ID NO: 2445033 - RNA, 14 nt, Bordetella pertussis
cagcaccaggccga

SEQ ID NO: 2445034 - RNA, 14 nt, Bordetella pertussis
cagcaccaggccgc

SEQ ID NO: 2445035 - RNA, 16 nt, Bordetella pertussis
cagcaccaggccgccg

SEQ ID NO: 2445036 - RNA, 17 nt, Bordetella pertussis
cagcaccaggccgccgg

SEQ ID NO: 2445037 - RNA, 22 nt, Bordetella pertussis
cagcaccaggccgccggccagc

SEQ ID NO: 2445038 - RNA, 21 nt, Bordetella pertussis
cagcaccaggcuuugcgcgcc

SEQ ID NO: 2445039 - RNA, 22 nt, Bordetella pertussis
cagcaccaggcuuugcgcgcca

SEQ ID NO: 2445040 - RNA, 16 nt, Bordetella pertussis
cagcaccagggcgcgc

SEQ ID NO: 2445041 - RNA, 19 nt, Bordetella pertussis
cagcaccagggcgcgcagc

SEQ ID NO: 2445042 - RNA, 24 nt, Bordetella pertussis
cagcaccagggcgcgcagcaggcc

SEQ ID NO: 2445043 - RNA, 14 nt, Bordetella pertussis
cagcaccaggucga

SEQ ID NO: 2445044 - RNA, 14 nt, Bordetella pertussis
cagcaccaugccga

SEQ ID NO: 2445045 - RNA, 20 nt, Bordetella pertussis
cagcaccaugggcucgugca

SEQ ID NO: 2445046 - RNA, 20 nt, Bordetella pertussis
cagcaccccgucggcucagu

SEQ ID NO: 2445047 - RNA, 13 nt, Bordetella pertussis
cagcaccgacagg

SEQ ID NO: 2445048 - RNA, 17 nt, Bordetella pertussis
cagcaccgacaggccga

SEQ ID NO: 2445049 - RNA, 14 nt, Bordetella pertussis
cagcaccgagcugc

SEQ ID NO: 2445050 - RNA, 21 nt, Bordetella pertussis
cagcaccgagcugccgccuuc

SEQ ID NO: 2445051 - RNA, 18 nt, Bordetella pertussis
cagcaccgaugcgccggc

SEQ ID NO: 2445052 - RNA, 21 nt, Bordetella pertussis
cagcaccgaugcgccggccug

SEQ ID NO: 2445053 - RNA, 13 nt, Bordetella pertussis
cagcaccgccacc

SEQ ID NO: 2445054 - RNA, 15 nt, Bordetella pertussis
cagcaccgccaccgu

SEQ ID NO: 2445055 - RNA, 19 nt, Bordetella pertussis
cagcaccgccgccaguucg

SEQ ID NO: 2445056 - RNA, 14 nt, Bordetella pertussis
cagcaccgcgacca

SEQ ID NO: 2445057 - RNA, 16 nt, Bordetella pertussis
cagcaccgcgaccaug

SEQ ID NO: 2445058 - RNA, 18 nt, Bordetella pertussis
cagcaccgcgaccaugcg

SEQ ID NO: 2445059 - RNA, 21 nt, Bordetella pertussis
cagcaccgcgaccaugcggcc

SEQ ID NO: 2445060 - RNA, 14 nt, Bordetella pertussis
cagcaccgcgcgca

SEQ ID NO: 2445061 - RNA, 15 nt, Bordetella pertussis
cagcaccgcggcggg

SEQ ID NO: 2445062 - RNA, 19 nt, Bordetella pertussis
cagcaccggauccugcggc

SEQ ID NO: 2445063 - RNA, 21 nt, Bordetella pertussis
cagcaccggauccugcggcgc

SEQ ID NO: 2445064 - RNA, 17 nt, Bordetella pertussis
cagcaccggcacgacgg

SEQ ID NO: 2445065 - RNA, 20 nt, Bordetella pertussis
cagcaccggcacgacggccu

SEQ ID NO: 2445066 - RNA, 21 nt, Bordetella pertussis
cagcaccggcagcguaucgcc

SEQ ID NO: 2445067 - RNA, 13 nt, Bordetella pertussis
cagcaccggcccg

SEQ ID NO: 2445068 - RNA, 15 nt, Bordetella pertussis
cagcaccggccgccg

SEQ ID NO: 2445069 - RNA, 16 nt, Bordetella pertussis
cagcaccggccgccgc

SEQ ID NO: 2445070 - RNA, 12 nt, Bordetella pertussis
cagcaccggcgu

SEQ ID NO: 2445071 - RNA, 13 nt, Bordetella pertussis
cagcaccggcgug

SEQ ID NO: 2445072 - RNA, 21 nt, Bordetella pertussis
cagcaccggcgugagcgccac

SEQ ID NO: 2445073 - RNA, 21 nt, Bordetella pertussis
cagcaccggcugccagggccg

SEQ ID NO: 2445074 - RNA, 21 nt, Bordetella pertussis
cagcaccgggaaguccgccgc

SEQ ID NO: 2445075 - RNA, 22 nt, Bordetella pertussis
cagcaccgggaaguccgccgcg

SEQ ID NO: 2445076 - RNA, 16 nt, Bordetella pertussis
cagcaccggggcaggg

SEQ ID NO: 2445077 - RNA, 16 nt, Bordetella pertussis
cagcaccgugccggcg

SEQ ID NO: 2445078 - RNA, 15 nt, Bordetella pertussis
cagcaccucgacgca

SEQ ID NO: 2445079 - RNA, 16 nt, Bordetella pertussis
cagcaccucgacgcag

SEQ ID NO: 2445080 - RNA, 13 nt, Bordetella pertussis
cagcaccucggac

SEQ ID NO: 2445081 - RNA, 13 nt, Bordetella pertussis
cagcaccucggcg

SEQ ID NO: 2445082 - RNA, 19 nt, Bordetella pertussis
cagcaccucggcgcccagc

SEQ ID NO: 2445083 - RNA, 14 nt, Bordetella pertussis
cagcaccucggcgu

SEQ ID NO: 2445084 - RNA, 20 nt, Bordetella pertussis
cagcaccucggggcgcggcc

SEQ ID NO: 2445085 - RNA, 22 nt, Bordetella pertussis
cagcaccucggggcgcggccgg

SEQ ID NO: 2445086 - RNA, 13 nt, Bordetella pertussis
cagcaccugcagg

SEQ ID NO: 2445087 - RNA, 17 nt, Bordetella pertussis
cagcaccugcaggccgc

SEQ ID NO: 2445088 - RNA, 20 nt, Bordetella pertussis
cagcaccugcaggccgccgg

SEQ ID NO: 2445089 - RNA, 14 nt, Bordetella pertussis
cagcaccugcuuga

SEQ ID NO: 2445090 - RNA, 15 nt, Bordetella pertussis
cagcaccugcuugac

SEQ ID NO: 2445091 - RNA, 16 nt, Bordetella pertussis
cagcaccugcuugacg

SEQ ID NO: 2445092 - RNA, 20 nt, Bordetella pertussis
cagcaccugguggcgcuggc

SEQ ID NO: 2445093 - RNA, 21 nt, Bordetella pertussis
cagcaccugguggcgcuggcc

SEQ ID NO: 2445094 - RNA, 18 nt, Bordetella pertussis
cagcaccuugaccugguc

SEQ ID NO: 2445095 - RNA, 19 nt, Bordetella pertussis
cagcaccuugaccuggucg

SEQ ID NO: 2445096 - RNA, 18 nt, Bordetella pertussis
cagcaccuuggcauugaa

SEQ ID NO: 2445097 - RNA, 18 nt, Bordetella pertussis
cagcacgaaccacagggu

SEQ ID NO: 2445098 - RNA, 15 nt, Bordetella pertussis
cagcacgaagggcag

SEQ ID NO: 2445099 - RNA, 17 nt, Bordetella pertussis
cagcacgaagggcagca

SEQ ID NO: 2445100 - RNA, 18 nt, Bordetella pertussis
cagcacgaagggcagcag

SEQ ID NO: 2445101 - RNA, 19 nt, Bordetella pertussis
cagcacgaagggcagcagc

SEQ ID NO: 2445102 - RNA, 17 nt, Bordetella pertussis
cagcacgacgacggccg

SEQ ID NO: 2445103 - RNA, 18 nt, Bordetella pertussis
cagcacgacgacggccgg

SEQ ID NO: 2445104 - RNA, 19 nt, Bordetella pertussis
cagcacgacgacggccggc

SEQ ID NO: 2445105 - RNA, 22 nt, Bordetella pertussis
cagcacgacgacggccggcgcg

SEQ ID NO: 2445106 - RNA, 21 nt, Bordetella pertussis
cagcacgagauguccauggcc

SEQ ID NO: 2445107 - RNA, 23 nt, Bordetella pertussis
cagcacgagauguccauggccug

SEQ ID NO: 2445108 - RNA, 17 nt, Bordetella pertussis
cagcacgaucacgaaca

SEQ ID NO: 2445109 - RNA, 22 nt, Bordetella pertussis
cagcacgaucacgaacagcgcc

SEQ ID NO: 2445110 - RNA, 17 nt, Bordetella pertussis
cagcacgaucgcggcgc

SEQ ID NO: 2445111 - RNA, 21 nt, Bordetella pertussis
cagcacgaucgcggcgcuggc

SEQ ID NO: 2445112 - RNA, 20 nt, Bordetella pertussis
cagcacgaucuggcgcgcga

SEQ ID NO: 2445113 - RNA, 17 nt, Bordetella pertussis
cagcacgauggcgccca

SEQ ID NO: 2445114 - RNA, 19 nt, Bordetella pertussis
cagcacgauggcgcccacg

SEQ ID NO: 2445115 - RNA, 16 nt, Bordetella pertussis
cagcacgauggggcca

SEQ ID NO: 2445116 - RNA, 19 nt, Bordetella pertussis
cagcacgauggggccaugg

SEQ ID NO: 2445117 - RNA, 20 nt, Bordetella pertussis
cagcacgauggggccauggc

SEQ ID NO: 2445118 - RNA, 24 nt, Bordetella pertussis
cagcacgauggggccauggcacag

SEQ ID NO: 2445119 - RNA, 13 nt, Bordetella pertussis
cagcacgaugguc

SEQ ID NO: 2445120 - RNA, 19 nt, Bordetella pertussis
cagcacgauggucagcggc

SEQ ID NO: 2445121 - RNA, 15 nt, Bordetella pertussis
cagcacgcaccaggc

SEQ ID NO: 2445122 - RNA, 16 nt, Bordetella pertussis
cagcacgcaccaggcg

SEQ ID NO: 2445123 - RNA, 19 nt, Bordetella pertussis
cagcacgcaccaggcgcac

SEQ ID NO: 2445124 - RNA, 15 nt, Bordetella pertussis
cagcacgcagauguu

SEQ ID NO: 2445125 - RNA, 18 nt, Bordetella pertussis
cagcagccgguuggcgcc

SEQ ID NO: 2445126 - RNA, 22 nt, Bordetella pertussis
cagcagccgguuggcgccuucc

SEQ ID NO: 2445127 - RNA, 15 nt, Bordetella pertussis
cagcagcgaaucgcc

SEQ ID NO: 2445128 - RNA, 14 nt, Bordetella pertussis
cagcagcgacggcc

SEQ ID NO: 2445129 - RNA, 23 nt, Bordetella pertussis
cagcagcgacggccccagcgccg

SEQ ID NO: 2445130 - RNA, 17 nt, Bordetella pertussis
cagcagcgagcccgcca

SEQ ID NO: 2445131 - RNA, 23 nt, Bordetella pertussis
cagcagcgcaucgagcuccugca

SEQ ID NO: 2445132 - RNA, 16 nt, Bordetella pertussis
cagcagcgcaucgcgc

SEQ ID NO: 2445133 - RNA, 18 nt, Bordetella pertussis
cagcagcgcaucgcgcgc

SEQ ID NO: 2445134 - RNA, 12 nt, Bordetella pertussis
cagcagcgccac

SEQ ID NO: 2445135 - RNA, 14 nt, Bordetella pertussis
cagcagcgccaccg

SEQ ID NO: 2445136 - RNA, 14 nt, Bordetella pertussis
cagcagcgccacga

SEQ ID NO: 2445137 - RNA, 15 nt, Bordetella pertussis
cagcagcgccaggau

SEQ ID NO: 2445138 - RNA, 14 nt, Bordetella pertussis
cagcagcgccaggg

SEQ ID NO: 2445139 - RNA, 20 nt, Bordetella pertussis
cagcagcgccagggccaggc

SEQ ID NO: 2445140 - RNA, 14 nt, Bordetella pertussis
cagcagcgccgcca

SEQ ID NO: 2445141 - RNA, 15 nt, Bordetella pertussis
cagcagcgccgccag

SEQ ID NO: 2445142 - RNA, 17 nt, Bordetella pertussis
cagcagcgccgccagca

SEQ ID NO: 2445143 - RNA, 13 nt, Bordetella pertussis
cagcagcgccgga

SEQ ID NO: 2445144 - RNA, 16 nt, Bordetella pertussis
cagcagcgccggcagg

SEQ ID NO: 2445145 - RNA, 21 nt, Bordetella pertussis
cagcagcgccggcaggcgcgc

SEQ ID NO: 2445146 - RNA, 22 nt, Bordetella pertussis
cagcagcgccggcaggcgcgcc

SEQ ID NO: 2445147 - RNA, 23 nt, Bordetella pertussis
cagcagcgccggcaggcgcgcca

SEQ ID NO: 2445148 - RNA, 13 nt, Bordetella pertussis
cagcagcgccggg

SEQ ID NO: 2445149 - RNA, 21 nt, Bordetella pertussis
cagcagcgccgggaucggcgu

SEQ ID NO: 2445150 - RNA, 23 nt, Bordetella pertussis
cagcagcgccgguucgacgcuga

SEQ ID NO: 2445151 - RNA, 12 nt, Bordetella pertussis
cagcagcgcgcc

SEQ ID NO: 2445152 - RNA, 13 nt, Bordetella pertussis
cagcagcgcgccg

SEQ ID NO: 2445153 - RNA, 13 nt, Bordetella pertussis
cagcagcgcggcg

SEQ ID NO: 2445154 - RNA, 16 nt, Bordetella pertussis
cagcagcgcggcgccg

SEQ ID NO: 2445155 - RNA, 14 nt, Bordetella pertussis
cagcagcgcgguca

SEQ ID NO: 2445156 - RNA, 19 nt, Bordetella pertussis
cagcagcgcggucaugccg

SEQ ID NO: 2445157 - RNA, 19 nt, Bordetella pertussis
cagcagcgcgguggccagc

SEQ ID NO: 2445158 - RNA, 13 nt, Bordetella pertussis
cagcagcggcagc

SEQ ID NO: 2445159 - RNA, 14 nt, Bordetella pertussis
cagcagcggcagca

SEQ ID NO: 2445160 - RNA, 14 nt, Bordetella pertussis
cagcagcggcagcu

SEQ ID NO: 2445161 - RNA, 20 nt, Bordetella pertussis
cagcagcggcagcucggcga

SEQ ID NO: 2445162 - RNA, 12 nt, Bordetella pertussis
cagcagcgggcu

SEQ ID NO: 2445163 - RNA, 17 nt, Bordetella pertussis
cagcagcgggcuggggc

SEQ ID NO: 2445164 - RNA, 15 nt, Bordetella pertussis
cagcagcggguugcg

SEQ ID NO: 2445165 - RNA, 19 nt, Bordetella pertussis
cagcagcggguugcgcgcc

SEQ ID NO: 2445166 - RNA, 14 nt, Bordetella pertussis
cagcagcguggcca

SEQ ID NO: 2445167 - RNA, 17 nt, Bordetella pertussis
cagcagcguggccacca

SEQ ID NO: 2445168 - RNA, 23 nt, Bordetella pertussis
cagcagcguggccaccaggcgcg

SEQ ID NO: 2445169 - RNA, 15 nt, Bordetella pertussis
cagcagcguggccgc

SEQ ID NO: 2445170 - RNA, 19 nt, Bordetella pertussis
cagcagcguggccgccacc

SEQ ID NO: 2445171 - RNA, 23 nt, Bordetella pertussis
cagcagcguggccgccaccagcg

SEQ ID NO: 2445172 - RNA, 20 nt, Bordetella pertussis
cagcagcuccucggccugcc

SEQ ID NO: 2445173 - RNA, 23 nt, Bordetella pertussis
cagcagcuccucggccugccggc

SEQ ID NO: 2445174 - RNA, 14 nt, Bordetella pertussis
cagcagcucggcca

SEQ ID NO: 2445175 - RNA, 17 nt, Bordetella pertussis
cagcagcucggcgacca

SEQ ID NO: 2445176 - RNA, 19 nt, Bordetella pertussis
cagcagcucggcgaccagg

SEQ ID NO: 2445177 - RNA, 20 nt, Bordetella pertussis
cagcagcucggcgaccaggc

SEQ ID NO: 2445178 - RNA, 22 nt, Bordetella pertussis
cagcagcucguugaccugcugg

SEQ ID NO: 2445179 - RNA, 12 nt, Bordetella pertussis
cagcagcuggcg

SEQ ID NO: 2445180 - RNA, 14 nt, Bordetella pertussis
cagcagcuggcgca

SEQ ID NO: 2445181 - RNA, 17 nt, Bordetella pertussis
cagcagcuggcgcagca

SEQ ID NO: 2445182 - RNA, 20 nt, Bordetella pertussis
cagcagcuguuccugcucgg

SEQ ID NO: 2445183 - RNA, 14 nt, Bordetella pertussis
cagcagcuugccga

SEQ ID NO: 2445184 - RNA, 15 nt, Bordetella pertussis
cagcagcuugccgac

SEQ ID NO: 2445185 - RNA, 16 nt, Bordetella pertussis
cagcaggagcccgcug

SEQ ID NO: 2445186 - RNA, 18 nt, Bordetella pertussis
cagcaggagcccgcugcc

SEQ ID NO: 2445187 - RNA, 23 nt, Bordetella pertussis
cagcaggauggaucccuggucga

SEQ ID NO: 2445188 - RNA, 21 nt, Bordetella pertussis
cagcaggccaggaagcggcgc

SEQ ID NO: 2445189 - RNA, 12 nt, Bordetella pertussis
cagcaggcccac

SEQ ID NO: 2445190 - RNA, 15 nt, Bordetella pertussis
cagcaggcccaccag

SEQ ID NO: 2445191 - RNA, 17 nt, Bordetella pertussis
cagcaggcccaccaggg

SEQ ID NO: 2445192 - RNA, 19 nt, Bordetella pertussis
cagcaggcccaccagggcc

SEQ ID NO: 2445193 - RNA, 16 nt, Bordetella pertussis
cagcaggcccaugccg

SEQ ID NO: 2445194 - RNA, 20 nt, Bordetella pertussis
cagcaggcccuccggcgcca

SEQ ID NO: 2445195 - RNA, 23 nt, Bordetella pertussis
cagcaggcccugggccagcagcu

SEQ ID NO: 2445196 - RNA, 17 nt, Bordetella pertussis
cagcaggcccugggcga

SEQ ID NO: 2445197 - RNA, 14 nt, Bordetella pertussis
cagcaggccgcgcg

SEQ ID NO: 2445198 - RNA, 15 nt, Bordetella pertussis
cagcaggccgcgcgu

SEQ ID NO: 2445199 - RNA, 15 nt, Bordetella pertussis
cagcaggccggcggc

SEQ ID NO: 2445200 - RNA, 18 nt, Bordetella pertussis
cagcaggccguaaccggc

SEQ ID NO: 2445201 - RNA, 16 nt, Bordetella pertussis
cagcaggccguugccg

SEQ ID NO: 2445202 - RNA, 15 nt, Bordetella pertussis
cagcaggcgaaacgc

SEQ ID NO: 2445203 - RNA, 13 nt, Bordetella pertussis
cagcaggcgcacc

SEQ ID NO: 2445204 - RNA, 17 nt, Bordetella pertussis
cagcaggcgcaccagcg

SEQ ID NO: 2445205 - RNA, 20 nt, Bordetella pertussis
cagcaggcgcaucagcuugg

SEQ ID NO: 2445206 - RNA, 13 nt, Bordetella pertussis
cagcaggcgcgcg

SEQ ID NO: 2445207 - RNA, 16 nt, Bordetella pertussis
cagcaggcgcgcggcc

SEQ ID NO: 2445208 - RNA, 17 nt, Bordetella pertussis
cagcaggcgcgcggccu

SEQ ID NO: 2445209 - RNA, 20 nt, Bordetella pertussis
cagcaggcgcgcggccucga

SEQ ID NO: 2445210 - RNA, 20 nt, Bordetella pertussis
cagcaggcgcgugaggucgc

SEQ ID NO: 2445211 - RNA, 15 nt, Bordetella pertussis
cagcaggcgcgugcu

SEQ ID NO: 2445212 - RNA, 14 nt, Bordetella pertussis
cagcaggcgcucgg

SEQ ID NO: 2445213 - RNA, 19 nt, Bordetella pertussis
cagcaggcgcucggccagc

SEQ ID NO: 2445214 - RNA, 16 nt, Bordetella pertussis
cagcaggcgcucggcu

SEQ ID NO: 2445215 - RNA, 17 nt, Bordetella pertussis
cagcaggcgcucggcuu

SEQ ID NO: 2445216 - RNA, 18 nt, Bordetella pertussis
cagcaggcgcucggcuuc

SEQ ID NO: 2445217 - RNA, 20 nt, Bordetella pertussis
cagcaggcgcuggucgucgc

SEQ ID NO: 2445218 - RNA, 21 nt, Bordetella pertussis
cagcaggcgcuggucgucgcg

SEQ ID NO: 2445219 - RNA, 17 nt, Bordetella pertussis
cagcaggcggccgacca

SEQ ID NO: 2445220 - RNA, 19 nt, Bordetella pertussis
cagcaggcggccgaccagc

SEQ ID NO: 2445221 - RNA, 22 nt, Bordetella pertussis
cagcaggcggccgaccagcacg

SEQ ID NO: 2445222 - RNA, 18 nt, Bordetella pertussis
cagcagggucagcggccg

SEQ ID NO: 2445223 - RNA, 19 nt, Bordetella pertussis
cagcagggucaugaugucg

SEQ ID NO: 2445224 - RNA, 22 nt, Bordetella pertussis
cagcagggucaugaugucggcc

SEQ ID NO: 2445225 - RNA, 23 nt, Bordetella pertussis
cagcagggucgagaccagcagcg

SEQ ID NO: 2445226 - RNA, 14 nt, Bordetella pertussis
cagcagggucggcc

SEQ ID NO: 2445227 - RNA, 16 nt, Bordetella pertussis
cagcagggucggcccc

SEQ ID NO: 2445228 - RNA, 17 nt, Bordetella pertussis
cagcaggguggccacgc

SEQ ID NO: 2445229 - RNA, 23 nt, Bordetella pertussis
cagcagguccugcacgcgggcca

SEQ ID NO: 2445230 - RNA, 14 nt, Bordetella pertussis
cagcaggucgcgca

SEQ ID NO: 2445231 - RNA, 20 nt, Bordetella pertussis
cagcaggucggagucggcgc

SEQ ID NO: 2445232 - RNA, 22 nt, Bordetella pertussis
cagcaggucggagucggcgccg

SEQ ID NO: 2445233 - RNA, 13 nt, Bordetella pertussis
cagcaggucgguc

SEQ ID NO: 2445234 - RNA, 17 nt, Bordetella pertussis
cagcagguggaucgacg

SEQ ID NO: 2445235 - RNA, 16 nt, Bordetella pertussis
cagcaguguuucggcc

SEQ ID NO: 2445236 - RNA, 17 nt, Bordetella pertussis
cagcaguguuucggccu

SEQ ID NO: 2445237 - RNA, 20 nt, Bordetella pertussis
cagcaguguuucggccugcu

SEQ ID NO: 2445238 - RNA, 24 nt, Bordetella pertussis
cagcaguguuucggccugcucgca

SEQ ID NO: 2445239 - RNA, 14 nt, Bordetella pertussis
cagcaguucggccg

SEQ ID NO: 2445240 - RNA, 22 nt, Bordetella pertussis
cagcaguucggccggcggccca

SEQ ID NO: 2445241 - RNA, 14 nt, Bordetella pertussis
cagcaguucggcgu

SEQ ID NO: 2445242 - RNA, 15 nt, Bordetella pertussis
cagcaguucggcguc

SEQ ID NO: 2445243 - RNA, 20 nt, Bordetella pertussis
cagcaguucggcgucggugc

SEQ ID NO: 2445244 - RNA, 16 nt, Bordetella pertussis
cagcaguucggucagc

SEQ ID NO: 2445245 - RNA, 22 nt, Bordetella pertussis
cagcaguucggucagcgcggcg

SEQ ID NO: 2445246 - RNA, 23 nt, Bordetella pertussis
cagcaguucggucagcgcggcgc

SEQ ID NO: 2445247 - RNA, 16 nt, Bordetella pertussis
cagcaguugcagcaug

SEQ ID NO: 2445248 - RNA, 19 nt, Bordetella pertussis
cagcaguuucugcaccggc

SEQ ID NO: 2445249 - RNA, 21 nt, Bordetella pertussis
cagcaguuucugcaccggcgc

SEQ ID NO: 2445250 - RNA, 22 nt, Bordetella pertussis
cagcaguuucugcaccggcgcc

SEQ ID NO: 2445251 - RNA, 18 nt, Bordetella pertussis
cagcauacccugcgcgcc

SEQ ID NO: 2445252 - RNA, 22 nt, Bordetella pertussis
cagcauacccugcgcgccgccg

SEQ ID NO: 2445253 - RNA, 23 nt, Bordetella pertussis
cagcauacccugcgcgccgccgg

SEQ ID NO: 2445254 - RNA, 20 nt, Bordetella pertussis
cagcauaucgucgcugcggc

SEQ ID NO: 2445255 - RNA, 23 nt, Bordetella pertussis
cagcauaucgucgcugcggccgg

SEQ ID NO: 2445256 - RNA, 16 nt, Bordetella pertussis
cagcaucaccagcucg

SEQ ID NO: 2445257 - RNA, 15 nt, Bordetella pertussis
cagcaucacggugcc

SEQ ID NO: 2445258 - RNA, 19 nt, Bordetella pertussis
cagcaucacggugccgccg

SEQ ID NO: 2445259 - RNA, 13 nt, Bordetella pertussis
cagcaucagcggc

SEQ ID NO: 2445260 - RNA, 17 nt, Bordetella pertussis
cagcaucagcggcagca

SEQ ID NO: 2445261 - RNA, 19 nt, Bordetella pertussis
cagcaucagcggcagcacg

SEQ ID NO: 2445262 - RNA, 24 nt, Bordetella pertussis
cagcauccagccgaucagccggcc

SEQ ID NO: 2445263 - RNA, 20 nt, Bordetella pertussis
cagcauccgcgccaggaugg

SEQ ID NO: 2445264 - RNA, 22 nt, Bordetella pertussis
cagcauccgcgccaggauggcc

SEQ ID NO: 2445265 - RNA, 14 nt, Bordetella pertussis
cagcaucgccgcca

SEQ ID NO: 2445266 - RNA, 18 nt, Bordetella pertussis
cagcaucguaucgggcgu

SEQ ID NO: 2445267 - RNA, 15 nt, Bordetella pertussis
cagcaucugccccag

SEQ ID NO: 2445268 - RNA, 14 nt, Bordetella pertussis
cagcaucuugcgcc

SEQ ID NO: 2445269 - RNA, 15 nt, Bordetella pertussis
cagcaucuugcgccg

SEQ ID NO: 2445270 - RNA, 17 nt, Bordetella pertussis
cagcaucuugcgccgcu

SEQ ID NO: 2445271 - RNA, 20 nt, Bordetella pertussis
cagcaucuugcgccgcugcg

SEQ ID NO: 2445272 - RNA, 17 nt, Bordetella pertussis
cagcaucuuggccgcca

SEQ ID NO: 2445273 - RNA, 13 nt, Bordetella pertussis
cagcaugaaaugc

SEQ ID NO: 2445274 - RNA, 21 nt, Bordetella pertussis
cagcaugaagcgguggcggcc

SEQ ID NO: 2445275 - RNA, 17 nt, Bordetella pertussis
cagcaugaucuugccga

SEQ ID NO: 2445276 - RNA, 21 nt, Bordetella pertussis
cagcaugcacgacuacggcgg

SEQ ID NO: 2445277 - RNA, 14 nt, Bordetella pertussis
cagcaugcgcgcga

SEQ ID NO: 2445278 - RNA, 23 nt, Bordetella pertussis
cagcaugcgcgcgacuuccucga

SEQ ID NO: 2445279 - RNA, 15 nt, Bordetella pertussis
cagcaugcgcgcggc

SEQ ID NO: 2445280 - RNA, 19 nt, Bordetella pertussis
cagcaugcgcgcggccucg

SEQ ID NO: 2445281 - RNA, 20 nt, Bordetella pertussis
cagcaugcgcgcggccucga

SEQ ID NO: 2445282 - RNA, 14 nt, Bordetella pertussis
cagcaugcgcgucu

SEQ ID NO: 2445283 - RNA, 23 nt, Bordetella pertussis
cagcaugcgcgucuccagcgccg

SEQ ID NO: 2445284 - RNA, 14 nt, Bordetella pertussis
cagcaugcgcuggg

SEQ ID NO: 2445285 - RNA, 16 nt, Bordetella pertussis
cagcaugcgcuggucg

SEQ ID NO: 2445286 - RNA, 19 nt, Bordetella pertussis
cagcaugcgcuggucgcgc

SEQ ID NO: 2445287 - RNA, 14 nt, Bordetella pertussis
cagcaugcggcccg

SEQ ID NO: 2445288 - RNA, 16 nt, Bordetella pertussis
cagcaugcggcccgcg

SEQ ID NO: 2445289 - RNA, 15 nt, Bordetella pertussis
cagcauggagcuggg

SEQ ID NO: 2445290 - RNA, 20 nt, Bordetella pertussis
cagcauggagcuggggccgc

SEQ ID NO: 2445291 - RNA, 19 nt, Bordetella pertussis
cagcauggccguggcgugc

SEQ ID NO: 2445292 - RNA, 22 nt, Bordetella pertussis
cagcauggcgccaugcgacagc

SEQ ID NO: 2445293 - RNA, 14 nt, Bordetella pertussis
cagcauggcgcgcg

SEQ ID NO: 2445294 - RNA, 21 nt, Bordetella pertussis
cagcauggcggcgcccgcugc

SEQ ID NO: 2445295 - RNA, 23 nt, Bordetella pertussis
cagcauggcggcgcccgcugcgu

SEQ ID NO: 2445296 - RNA, 15 nt, Bordetella pertussis
cagcauggcgggcga

SEQ ID NO: 2445297 - RNA, 14 nt, Bordetella pertussis
cagcauggcgucga

SEQ ID NO: 2445298 - RNA, 14 nt, Bordetella pertussis
cagcauggucggca

SEQ ID NO: 2445299 - RNA, 23 nt, Bordetella pertussis
cagcauggucggcauggccagga

SEQ ID NO: 2445300 - RNA, 22 nt, Bordetella pertussis
cagcauguauucaucacgggcg

SEQ ID NO: 2445301 - RNA, 24 nt, Bordetella pertussis
cagcauguauucaucacgggcgcc

SEQ ID NO: 2445302 - RNA, 16 nt, Bordetella pertussis
cagcauguccgccaug

SEQ ID NO: 2445303 - RNA, 18 nt, Bordetella pertussis
cagcauguccguaucgcg

SEQ ID NO: 2445304 - RNA, 21 nt, Bordetella pertussis
cagcauguccguaucgcggcc

SEQ ID NO: 2445305 - RNA, 22 nt, Bordetella pertussis
cagcauguccguaucgcggccg

SEQ ID NO: 2445306 - RNA, 19 nt, Bordetella pertussis
cagcgccggcacgcugauc

SEQ ID NO: 2445307 - RNA, 20 nt, Bordetella pertussis
cagcgccggcacgcugaucg

SEQ ID NO: 2445308 - RNA, 15 nt, Bordetella pertussis
cagcgccggcagcgc

SEQ ID NO: 2445309 - RNA, 16 nt, Bordetella pertussis
cagcgccggcagcgca

SEQ ID NO: 2445310 - RNA, 20 nt, Bordetella pertussis
cagcgccggcaggcgcgcca

SEQ ID NO: 2445311 - RNA, 21 nt, Bordetella pertussis
cagcgccggcaggcgcgccag

SEQ ID NO: 2445312 - RNA, 22 nt, Bordetella pertussis
cagcgccggcaugaagcgcagc

SEQ ID NO: 2445313 - RNA, 13 nt, Bordetella pertussis
cagcgccggcgca

SEQ ID NO: 2445314 - RNA, 17 nt, Bordetella pertussis
cagcgccggcgcgucca

SEQ ID NO: 2445315 - RNA, 15 nt, Bordetella pertussis
cagcgccggcugggc

SEQ ID NO: 2445316 - RNA, 16 nt, Bordetella pertussis
cagcgccggcugggcg

SEQ ID NO: 2445317 - RNA, 14 nt, Bordetella pertussis
cagcgccgggaucg

SEQ ID NO: 2445318 - RNA, 18 nt, Bordetella pertussis
cagcgccgggaucggcgu

SEQ ID NO: 2445319 - RNA, 16 nt, Bordetella pertussis
cagcgccggggggcgc

SEQ ID NO: 2445320 - RNA, 20 nt, Bordetella pertussis
cagcgccggggggcgcacgc

SEQ ID NO: 2445321 - RNA, 22 nt, Bordetella pertussis
cagcgccggggggcgcacgccg

SEQ ID NO: 2445322 - RNA, 21 nt, Bordetella pertussis
cagcgccggggucagcgccgg

SEQ ID NO: 2445323 - RNA, 23 nt, Bordetella pertussis
cagcgccggggucagcgccggca

SEQ ID NO: 2445324 - RNA, 20 nt, Bordetella pertussis
cagcgccgguucgacgcuga

SEQ ID NO: 2445325 - RNA, 14 nt, Bordetella pertussis
cagcgccgucagca

SEQ ID NO: 2445326 - RNA, 17 nt, Bordetella pertussis
cagcgccgucagcagcg

SEQ ID NO: 2445327 - RNA, 16 nt, Bordetella pertussis
cagcgccgucaucugc

SEQ ID NO: 2445328 - RNA, 13 nt, Bordetella pertussis
cagcgccucgcgc

SEQ ID NO: 2445329 - RNA, 19 nt, Bordetella pertussis
cagcgccucgcgcucgagc

SEQ ID NO: 2445330 - RNA, 20 nt, Bordetella pertussis
cagcgccucgcgcucgagcg

SEQ ID NO: 2445331 - RNA, 14 nt, Bordetella pertussis
cagcgccucgucgc

SEQ ID NO: 2445332 - RNA, 19 nt, Bordetella pertussis
cagcgccucgucgcgcaac

SEQ ID NO: 2445333 - RNA, 23 nt, Bordetella pertussis
cagcgccugcaaguccagcgugg

SEQ ID NO: 2445334 - RNA, 20 nt, Bordetella pertussis
cagcgccugcauccggccca

SEQ ID NO: 2445335 - RNA, 14 nt, Bordetella pertussis
cagcgccugccgau

SEQ ID NO: 2445336 - RNA, 17 nt, Bordetella pertussis
cagcgccugccgaucgu

SEQ ID NO: 2445337 - RNA, 14 nt, Bordetella pertussis
cagcgccugccgcg

SEQ ID NO: 2445338 - RNA, 15 nt, Bordetella pertussis
cagcgccugcgcggc

SEQ ID NO: 2445339 - RNA, 17 nt, Bordetella pertussis
cagcgccugcgcggccu

SEQ ID NO: 2445340 - RNA, 18 nt, Bordetella pertussis
cagcgccugcgcggccuc

SEQ ID NO: 2445341 - RNA, 16 nt, Bordetella pertussis
cagcgccugcgcggcg

SEQ ID NO: 2445342 - RNA, 20 nt, Bordetella pertussis
cagcgccuggaccuggacga

SEQ ID NO: 2445343 - RNA, 13 nt, Bordetella pertussis
cagcgccuggccg

SEQ ID NO: 2445344 - RNA, 14 nt, Bordetella pertussis
cagcgccuggccga

SEQ ID NO: 2445345 - RNA, 16 nt, Bordetella pertussis
cagcgccuggccgagc

SEQ ID NO: 2445346 - RNA, 15 nt, Bordetella pertussis
cagcgccuggcggcu

SEQ ID NO: 2445347 - RNA, 23 nt, Bordetella pertussis
cagcgccuggcuucccgguccag

SEQ ID NO: 2445348 - RNA, 14 nt, Bordetella pertussis
cagcgccugggcgc

SEQ ID NO: 2445349 - RNA, 18 nt, Bordetella pertussis
cagcgccugggcgcggau

SEQ ID NO: 2445350 - RNA, 22 nt, Bordetella pertussis
cagcgccugggguaggcgcggu

SEQ ID NO: 2445351 - RNA, 24 nt, Bordetella pertussis
cagcgccuugccgccgugcgagca

SEQ ID NO: 2445352 - RNA, 14 nt, Bordetella pertussis
cagcgccuugcggc

SEQ ID NO: 2445353 - RNA, 17 nt, Bordetella pertussis
cagcgccuugcggcgcu

SEQ ID NO: 2445354 - RNA, 19 nt, Bordetella pertussis
cagcgcgaaaacccgcggc

SEQ ID NO: 2445355 - RNA, 20 nt, Bordetella pertussis
cagcgcgaaaacccgcggca

SEQ ID NO: 2445356 - RNA, 19 nt, Bordetella pertussis
cagcgcgaaaugcccagcg

SEQ ID NO: 2445357 - RNA, 14 nt, Bordetella pertussis
cagcgcgaacaacg

SEQ ID NO: 2445358 - RNA, 24 nt, Bordetella pertussis
cagcgcgaacaacgggaucggcgu

SEQ ID NO: 2445359 - RNA, 15 nt, Bordetella pertussis
cagcgcgaacgccug

SEQ ID NO: 2445360 - RNA, 21 nt, Bordetella pertussis
cagcgcgaaguaccagcgcac

SEQ ID NO: 2445361 - RNA, 15 nt, Bordetella pertussis
cagcgcgaccggcgc

SEQ ID NO: 2445362 - RNA, 16 nt, Bordetella pertussis
cagcgcgaccggcgcg

SEQ ID NO: 2445363 - RNA, 19 nt, Bordetella pertussis
cagcgcgaccggcgcgaac

SEQ ID NO: 2445364 - RNA, 15 nt, Bordetella pertussis
cagcgcgaccgggca

SEQ ID NO: 2445365 - RNA, 23 nt, Bordetella pertussis
cagcgcgacgaagccggaaccgc

SEQ ID NO: 2445366 - RNA, 13 nt, Bordetella pertussis
cagcgcgacggcc

SEQ ID NO: 2445367 - RNA, 14 nt, Bordetella pertussis
cagcgcgacggccu

SEQ ID NO: 2445368 - RNA, 20 nt, Bordetella pertussis
cagcgcgacggccucguccu

SEQ ID NO: 2445369 - RNA, 14 nt, Bordetella pertussis
cagcgcgacuucgc

SEQ ID NO: 2445370 - RNA, 21 nt, Bordetella pertussis
cagcgcgacuucgcgaaagcg

SEQ ID NO: 2445371 - RNA, 16 nt, Bordetella pertussis
cagcgcgaucucgcgc

SEQ ID NO: 2445372 - RNA, 19 nt, Bordetella pertussis
cagcgcgaucucgcgcagg

SEQ ID NO: 2445373 - RNA, 20 nt, Bordetella pertussis
cagcgcgaucucgcgcaggg

SEQ ID NO: 2445374 - RNA, 16 nt, Bordetella pertussis
cagcgcgauucccugg

SEQ ID NO: 2445375 - RNA, 21 nt, Bordetella pertussis
cagcgcgauucccuggcgcgc

SEQ ID NO: 2445376 - RNA, 19 nt, Bordetella pertussis
cagcgcgcaacccacggcg

SEQ ID NO: 2445377 - RNA, 14 nt, Bordetella pertussis
cagcgcgcaggaca

SEQ ID NO: 2445378 - RNA, 15 nt, Bordetella pertussis
cagcgcgcaggacaa

SEQ ID NO: 2445379 - RNA, 19 nt, Bordetella pertussis
cagcgcgcaggacaaggcg

SEQ ID NO: 2445380 - RNA, 16 nt, Bordetella pertussis
cagcgcgccagcgcgc

SEQ ID NO: 2445381 - RNA, 16 nt, Bordetella pertussis
cagcgcgccauggccg

SEQ ID NO: 2445382 - RNA, 18 nt, Bordetella pertussis
cagcgcgccauggccggc

SEQ ID NO: 2445383 - RNA, 16 nt, Bordetella pertussis
cagcgcgcccgaugcc

SEQ ID NO: 2445384 - RNA, 13 nt, Bordetella pertussis
cagcgcgccgaag

SEQ ID NO: 2445385 - RNA, 23 nt, Bordetella pertussis
cagcgcgccgaucaccacgggca

SEQ ID NO: 2445386 - RNA, 16 nt, Bordetella pertussis
cagcgcgccgccagcg

SEQ ID NO: 2445387 - RNA, 14 nt, Bordetella pertussis
cagcgcgccgccca

SEQ ID NO: 2445388 - RNA, 17 nt, Bordetella pertussis
cagcgcgccgcccacca

SEQ ID NO: 2445389 - RNA, 21 nt, Bordetella pertussis
cagcgcgccgcccaccaccag

SEQ ID NO: 2445390 - RNA, 23 nt, Bordetella pertussis
cagcgcgccgcccaccaccagcg

SEQ ID NO: 2445391 - RNA, 14 nt, Bordetella pertussis
cagcgcgccgcgcc

SEQ ID NO: 2445392 - RNA, 15 nt, Bordetella pertussis
cagcgcgccgcgccg

SEQ ID NO: 2445393 - RNA, 17 nt, Bordetella pertussis
cagcgcgccgcgccggg

SEQ ID NO: 2445394 - RNA, 18 nt, Bordetella pertussis
cagcgcgccgcgcgcggc

SEQ ID NO: 2445395 - RNA, 20 nt, Bordetella pertussis
cagcgcgccgcgcgcggcgg

SEQ ID NO: 2445396 - RNA, 11 nt, Bordetella pertussis
cagcgcgccgg

SEQ ID NO: 2445397 - RNA, 12 nt, Bordetella pertussis
cagcgcgccgga

SEQ ID NO: 2445398 - RNA, 14 nt, Bordetella pertussis
cagcgcgccggcca

SEQ ID NO: 2445399 - RNA, 17 nt, Bordetella pertussis
cagcgcgccggccaggg

SEQ ID NO: 2445400 - RNA, 23 nt, Bordetella pertussis
cagcgcgccggccagggccacca

SEQ ID NO: 2445401 - RNA, 23 nt, Bordetella pertussis
cagcgcgccgggcgggucggcga

SEQ ID NO: 2445402 - RNA, 22 nt, Bordetella pertussis
cagcgcgccgucgggggccggc

SEQ ID NO: 2445403 - RNA, 18 nt, Bordetella pertussis
cagcgcgccugcccaggc

SEQ ID NO: 2445404 - RNA, 17 nt, Bordetella pertussis
cagcgcgcgaucgccag

SEQ ID NO: 2445405 - RNA, 13 nt, Bordetella pertussis
cagcgcgcgcagc

SEQ ID NO: 2445406 - RNA, 17 nt, Bordetella pertussis
cagcgcgcgcagccgcg

SEQ ID NO: 2445407 - RNA, 20 nt, Bordetella pertussis
cagcgcgcgcagccgcgcca

SEQ ID NO: 2445408 - RNA, 15 nt, Bordetella pertussis
cagcgcgcgccggcc

SEQ ID NO: 2445409 - RNA, 16 nt, Bordetella pertussis
cagcgcgcgccggccg

SEQ ID NO: 2445410 - RNA, 18 nt, Bordetella pertussis
cagcgcgcgcgaggcggc

SEQ ID NO: 2445411 - RNA, 22 nt, Bordetella pertussis
cagcgcgcgcgaggcggcggcc

SEQ ID NO: 2445412 - RNA, 14 nt, Bordetella pertussis
cagcgcgcgcgccg

SEQ ID NO: 2445413 - RNA, 14 nt, Bordetella pertussis
cagcgcgcgcguga

SEQ ID NO: 2445414 - RNA, 12 nt, Bordetella pertussis
cagcgcgcggcc

SEQ ID NO: 2445415 - RNA, 15 nt, Bordetella pertussis
cagcgcgcggccggc

SEQ ID NO: 2445416 - RNA, 21 nt, Bordetella pertussis
cagcgcgcggccggccgcgcc

SEQ ID NO: 2445417 - RNA, 15 nt, Bordetella pertussis
cagcgcgcggccucg

SEQ ID NO: 2445418 - RNA, 13 nt, Bordetella pertussis
cagcgcgcggcgc

SEQ ID NO: 2445419 - RNA, 14 nt, Bordetella pertussis
cagcgcgcggcgca

SEQ ID NO: 2445420 - RNA, 13 nt, Bordetella pertussis
cagcgcgcgggcg

SEQ ID NO: 2445421 - RNA, 15 nt, Bordetella pertussis
cagcgcggcacgcug

SEQ ID NO: 2445422 - RNA, 17 nt, Bordetella pertussis
cagcgcggcacgcugcu

SEQ ID NO: 2445423 - RNA, 10 nt, Bordetella pertussis
cagcgcggcc

SEQ ID NO: 2445424 - RNA, 15 nt, Bordetella pertussis
cagcgcggccacggc

SEQ ID NO: 2445425 - RNA, 14 nt, Bordetella pertussis
cagcgcggccagca

SEQ ID NO: 2445426 - RNA, 17 nt, Bordetella pertussis
cagcgcggccagcaccg

SEQ ID NO: 2445427 - RNA, 18 nt, Bordetella pertussis
cagcgcggccagcaccgg

SEQ ID NO: 2445428 - RNA, 20 nt, Bordetella pertussis
cagcgcggccagcgcgucga

SEQ ID NO: 2445429 - RNA, 19 nt, Bordetella pertussis
cagcgcggccaggucggcg

SEQ ID NO: 2445430 - RNA, 13 nt, Bordetella pertussis
cagcgcggccgcu

SEQ ID NO: 2445431 - RNA, 15 nt, Bordetella pertussis
cagcgcggccgcuug

SEQ ID NO: 2445432 - RNA, 14 nt, Bordetella pertussis
cagcgcggccggca

SEQ ID NO: 2445433 - RNA, 20 nt, Bordetella pertussis
cagcgcggccgucaccgccg

SEQ ID NO: 2445434 - RNA, 16 nt, Bordetella pertussis
cagcgcggcgcacagg

SEQ ID NO: 2445435 - RNA, 13 nt, Bordetella pertussis
cagcgcggcgcca

SEQ ID NO: 2445436 - RNA, 15 nt, Bordetella pertussis
cagcgcggcgccggc

SEQ ID NO: 2445437 - RNA, 18 nt, Bordetella pertussis
cagcgcggcgccggccuc

SEQ ID NO: 2445438 - RNA, 14 nt, Bordetella pertussis
cagcgcggcgcggc

SEQ ID NO: 2445439 - RNA, 16 nt, Bordetella pertussis
cagcgcggcgcggcca

SEQ ID NO: 2445440 - RNA, 19 nt, Bordetella pertussis
cagcgcggcgcggccagca

SEQ ID NO: 2445441 - RNA, 12 nt, Bordetella pertussis
cagcgcggcggc

SEQ ID NO: 2445442 - RNA, 23 nt, Bordetella pertussis
cagcgcggcggcgaccggcgccg

SEQ ID NO: 2445443 - RNA, 16 nt, Bordetella pertussis
cagcgcggcgggccgg

SEQ ID NO: 2445444 - RNA, 16 nt, Bordetella pertussis
cagcgcggcgggcggc

SEQ ID NO: 2445445 - RNA, 22 nt, Bordetella pertussis
cagcgcggcgggcggcgcggcc

SEQ ID NO: 2445446 - RNA, 21 nt, Bordetella pertussis
cagcgcggcguugaccugguc

SEQ ID NO: 2445447 - RNA, 23 nt, Bordetella pertussis
cagcgcggcuugguugucgcgca

SEQ ID NO: 2445448 - RNA, 17 nt, Bordetella pertussis
cagcgcgggccacugcg

SEQ ID NO: 2445449 - RNA, 12 nt, Bordetella pertussis
cagcgcgggcgc

SEQ ID NO: 2445450 - RNA, 13 nt, Bordetella pertussis
cagcgcgggcgca

SEQ ID NO: 2445451 - RNA, 15 nt, Bordetella pertussis
cagcgcggucaugcc

SEQ ID NO: 2445452 - RNA, 17 nt, Bordetella pertussis
cagcgcggucaugccga

SEQ ID NO: 2445453 - RNA, 14 nt, Bordetella pertussis
cagcgcgguggcca

SEQ ID NO: 2445454 - RNA, 17 nt, Bordetella pertussis
cagcgcgguggccagcg

SEQ ID NO: 2445455 - RNA, 20 nt, Bordetella pertussis
cagcgcguccaggugcggcg

SEQ ID NO: 2445456 - RNA, 20 nt, Bordetella pertussis
cagcgcguccugcacguccu

SEQ ID NO: 2445457 - RNA, 23 nt, Bordetella pertussis
cagcgcguccugccaguugccgc

SEQ ID NO: 2445458 - RNA, 22 nt, Bordetella pertussis
cagcgcgucgagcagcgcaucg

SEQ ID NO: 2445459 - RNA, 19 nt, Bordetella pertussis
cagcgcgucgcguagcgcg

SEQ ID NO: 2445460 - RNA, 22 nt, Bordetella pertussis
cagcgcgucggccagcgccgcg

SEQ ID NO: 2445461 - RNA, 20 nt, Bordetella pertussis
cagcgcgucggccaggcgcc

SEQ ID NO: 2445462 - RNA, 21 nt, Bordetella pertussis
cagcgcgucggccaggcgcca

SEQ ID NO: 2445463 - RNA, 13 nt, Bordetella pertussis
cagcgcgucggcg

SEQ ID NO: 2445464 - RNA, 16 nt, Bordetella pertussis
cagcgcgucggcgccg

SEQ ID NO: 2445465 - RNA, 17 nt, Bordetella pertussis
cagcgcgucguccagcg

SEQ ID NO: 2445466 - RNA, 20 nt, Bordetella pertussis
cagcgcgucguccagcgugg

SEQ ID NO: 2445467 - RNA, 21 nt, Bordetella pertussis
cagcgcgugcagccagcggcc

SEQ ID NO: 2445468 - RNA, 22 nt, Bordetella pertussis
cagcgcgugcagccagcggccg

SEQ ID NO: 2445469 - RNA, 14 nt, Bordetella pertussis
cagcgcgugggcca

SEQ ID NO: 2445470 - RNA, 20 nt, Bordetella pertussis
cagcgcucaguagcucgacc

SEQ ID NO: 2445471 - RNA, 19 nt, Bordetella pertussis
cagcgcucgggcucgcgcg

SEQ ID NO: 2445472 - RNA, 21 nt, Bordetella pertussis
cagcgcucgggcucgcgcgcg

SEQ ID NO: 2445473 - RNA, 15 nt, Bordetella pertussis
cagcgcugcaugccc

SEQ ID NO: 2445474 - RNA, 16 nt, Bordetella pertussis
cagcgcugguggccag

SEQ ID NO: 2445475 - RNA, 17 nt, Bordetella pertussis
cagcgcugguucgaccu

SEQ ID NO: 2445476 - RNA, 18 nt, Bordetella pertussis
cagcgcuguccaggccgg

SEQ ID NO: 2445477 - RNA, 15 nt, Bordetella pertussis
cagcgcuucgggcag

SEQ ID NO: 2445478 - RNA, 19 nt, Bordetella pertussis
cagcgcuucgggcagcucg

SEQ ID NO: 2445479 - RNA, 23 nt, Bordetella pertussis
cagcgcuucgggcagcucgcgcg

SEQ ID NO: 2445480 - RNA, 19 nt, Bordetella pertussis
cagcgcuucgugcagcgcg

SEQ ID NO: 2445481 - RNA, 20 nt, Bordetella pertussis
cagcgcuugaguuuggcgaa

SEQ ID NO: 2445482 - RNA, 15 nt, Bordetella pertussis
cagcgcuugcacgcc

SEQ ID NO: 2445483 - RNA, 16 nt, Bordetella pertussis
cagcgcuugcacgcca

SEQ ID NO: 2445484 - RNA, 17 nt, Bordetella pertussis
cagcgcuugcacgccau

SEQ ID NO: 2445485 - RNA, 23 nt, Bordetella pertussis
cagcggaaguauucgcgcggcga

SEQ ID NO: 2445486 - RNA, 23 nt, Bordetella pertussis
cagcggaaugaugguggggcugg

SEQ ID NO: 2445487 - RNA, 16 nt, Bordetella pertussis
cagcggacgggccagg

SEQ ID NO: 2445488 - RNA, 17 nt, Bordetella pertussis
cagcggacgggccaggc

SEQ ID NO: 2445489 - RNA, 20 nt, Bordetella pertussis
cagcggacgggccaggccga

SEQ ID NO: 2445490 - RNA, 16 nt, Bordetella pertussis
cagcggagccgcgcac

SEQ ID NO: 2445491 - RNA, 23 nt, Bordetella pertussis
cagcggagccgcgcacacauggc

SEQ ID NO: 2445492 - RNA, 24 nt, Bordetella pertussis
cagcggagccgcgcacacauggcg

SEQ ID NO: 2445493 - RNA, 16 nt, Bordetella pertussis
cagcggagcgacggca

SEQ ID NO: 2445494 - RNA, 18 nt, Bordetella pertussis
cagcggagcgacggcaga

SEQ ID NO: 2445495 - RNA, 13 nt, Bordetella pertussis
cagcggaucgccg

SEQ ID NO: 2445496 - RNA, 14 nt, Bordetella pertussis
cagcggaucgccgg

SEQ ID NO: 2445497 - RNA, 16 nt, Bordetella pertussis
cagcggaucgccgggc

SEQ ID NO: 2445498 - RNA, 17 nt, Bordetella pertussis
cagcggaucgccgggca

SEQ ID NO: 2445499 - RNA, 20 nt, Bordetella pertussis
cagcggaucgccgggcaggc

SEQ ID NO: 2445500 - RNA, 16 nt, Bordetella pertussis
cagcggaugccgcccg

SEQ ID NO: 2445501 - RNA, 18 nt, Bordetella pertussis
cagcggauugaccagcgc

SEQ ID NO: 2445502 - RNA, 19 nt, Bordetella pertussis
cagcggauugaccagcgcg

SEQ ID NO: 2445503 - RNA, 21 nt, Bordetella pertussis
cagcggauugaccagcgcggc

SEQ ID NO: 2445504 - RNA, 22 nt, Bordetella pertussis
cagcggauugaccagcgcggcc

SEQ ID NO: 2445505 - RNA, 23 nt, Bordetella pertussis
cagcggauugaccagcgcggccg

SEQ ID NO: 2445506 - RNA, 14 nt, Bordetella pertussis
cagcggcaaaguag

SEQ ID NO: 2445507 - RNA, 13 nt, Bordetella pertussis
cagcggcacgccg

SEQ ID NO: 2445508 - RNA, 15 nt, Bordetella pertussis
cagcggcacgccggc

SEQ ID NO: 2445509 - RNA, 18 nt, Bordetella pertussis
cagcggcacgccggcggc

SEQ ID NO: 2445510 - RNA, 13 nt, Bordetella pertussis
cagcggcagcacg

SEQ ID NO: 2445511 - RNA, 14 nt, Bordetella pertussis
cagcggcagcacga

SEQ ID NO: 2445512 - RNA, 15 nt, Bordetella pertussis
cagcggcagcacgau

SEQ ID NO: 2445513 - RNA, 13 nt, Bordetella pertussis
cagcggcagcagc

SEQ ID NO: 2445514 - RNA, 19 nt, Bordetella pertussis
cagcggcagcauggcgcgc

SEQ ID NO: 2445515 - RNA, 20 nt, Bordetella pertussis
cagcggcagcauggcgcgcg

SEQ ID NO: 2445516 - RNA, 13 nt, Bordetella pertussis
cagcggcagcgca

SEQ ID NO: 2445517 - RNA, 16 nt, Bordetella pertussis
cagcggcagcgcaccg

SEQ ID NO: 2445518 - RNA, 15 nt, Bordetella pertussis
cagcggcagcgcgca

SEQ ID NO: 2445519 - RNA, 21 nt, Bordetella pertussis
cagcggcagcgcgcaggacaa

SEQ ID NO: 2445520 - RNA, 14 nt, Bordetella pertussis
cagcggcagcgggu

SEQ ID NO: 2445521 - RNA, 19 nt, Bordetella pertussis
cagcggcaggacggggaac

SEQ ID NO: 2445522 - RNA, 22 nt, Bordetella pertussis
cagcggcaggacggggaacagg

SEQ ID NO: 2445523 - RNA, 14 nt, Bordetella pertussis
cagcggcaggccca

SEQ ID NO: 2445524 - RNA, 19 nt, Bordetella pertussis
cagcggcaggcccagcuug

SEQ ID NO: 2445525 - RNA, 15 nt, Bordetella pertussis
cagcggcaggcggcu

SEQ ID NO: 2445526 - RNA, 14 nt, Bordetella pertussis
cagcggcaggcugg

SEQ ID NO: 2445527 - RNA, 21 nt, Bordetella pertussis
cagcggcaggcuggccggcgu

SEQ ID NO: 2445528 - RNA, 21 nt, Bordetella pertussis
cagcggcaggggcucgcgccc

SEQ ID NO: 2445529 - RNA, 14 nt, Bordetella pertussis
cagcggcaucacgc

SEQ ID NO: 2445530 - RNA, 17 nt, Bordetella pertussis
cagcggcaucacgccgg

SEQ ID NO: 2445531 - RNA, 23 nt, Bordetella pertussis
cagcggcaucacgccgguguucu

SEQ ID NO: 2445532 - RNA, 16 nt, Bordetella pertussis
cagcggccagcgcggc

SEQ ID NO: 2445533 - RNA, 14 nt, Bordetella pertussis
cagcggccagucca

SEQ ID NO: 2445534 - RNA, 15 nt, Bordetella pertussis
cagcggccaguccac

SEQ ID NO: 2445535 - RNA, 13 nt, Bordetella pertussis
cagcggccgcgcg

SEQ ID NO: 2445536 - RNA, 15 nt, Bordetella pertussis
cagcccaguugcugg

SEQ ID NO: 2445537 - RNA, 23 nt, Bordetella pertussis
cagccccaaugugcugacggugc

SEQ ID NO: 2445538 - RNA, 17 nt, Bordetella pertussis
cagccccaccuugccca

SEQ ID NO: 2445539 - RNA, 13 nt, Bordetella pertussis
cagccccacgccg

SEQ ID NO: 2445540 - RNA, 16 nt, Bordetella pertussis
cagccccagcagcacg

SEQ ID NO: 2445541 - RNA, 22 nt, Bordetella pertussis
cagccccagcagcacgcccagu

SEQ ID NO: 2445542 - RNA, 16 nt, Bordetella pertussis
cagccccagcgccagc

SEQ ID NO: 2445543 - RNA, 18 nt, Bordetella pertussis
cagccccagcgccagcgu

SEQ ID NO: 2445544 - RNA, 14 nt, Bordetella pertussis
cagccccagcgccc

SEQ ID NO: 2445545 - RNA, 11 nt, Bordetella pertussis
cagccccaggc

SEQ ID NO: 2445546 - RNA, 14 nt, Bordetella pertussis
cagccccaggcgcg

SEQ ID NO: 2445547 - RNA, 18 nt, Bordetella pertussis
cagccccccguaggcggc

SEQ ID NO: 2445548 - RNA, 24 nt, Bordetella pertussis
cagccccccguaggcggcccaggc

SEQ ID NO: 2445549 - RNA, 12 nt, Bordetella pertussis
cagcccccugcg

SEQ ID NO: 2445550 - RNA, 22 nt, Bordetella pertussis
cagcccccugcggggucugcag

SEQ ID NO: 2445551 - RNA, 14 nt, Bordetella pertussis
cagccccgcggccg

SEQ ID NO: 2445552 - RNA, 23 nt, Bordetella pertussis
cagccccgcggccgcggucagcc

SEQ ID NO: 2445553 - RNA, 16 nt, Bordetella pertussis
cagccccggcgcgccg

SEQ ID NO: 2445554 - RNA, 22 nt, Bordetella pertussis
cagccccggcgcgccggccgcc

SEQ ID NO: 2445555 - RNA, 18 nt, Bordetella pertussis
cagccccgggugcagguc

SEQ ID NO: 2445556 - RNA, 12 nt, Bordetella pertussis
cagccccugcca

SEQ ID NO: 2445557 - RNA, 14 nt, Bordetella pertussis
cagcccgacggcca

SEQ ID NO: 2445558 - RNA, 16 nt, Bordetella pertussis
cagcccgacggccagc

SEQ ID NO: 2445559 - RNA, 15 nt, Bordetella pertussis
cagcccgaucgacgg

SEQ ID NO: 2445560 - RNA, 19 nt, Bordetella pertussis
cagcccgaucgacggccgc

SEQ ID NO: 2445561 - RNA, 13 nt, Bordetella pertussis
cagcccgaugcgc

SEQ ID NO: 2445562 - RNA, 19 nt, Bordetella pertussis
cagcccgaugcgccaggcc

SEQ ID NO: 2445563 - RNA, 21 nt, Bordetella pertussis
cagcccgaugcgccaggccuc

SEQ ID NO: 2445564 - RNA, 17 nt, Bordetella pertussis
cagcccgcaccgcccgc

SEQ ID NO: 2445565 - RNA, 16 nt, Bordetella pertussis
cagcccgccaucgcgc

SEQ ID NO: 2445566 - RNA, 14 nt, Bordetella pertussis
cagcccgcccgcga

SEQ ID NO: 2445567 - RNA, 19 nt, Bordetella pertussis
cagcccgcccgcgagcggc

SEQ ID NO: 2445568 - RNA, 16 nt, Bordetella pertussis
cagcccgcccgcgccc

SEQ ID NO: 2445569 - RNA, 23 nt, Bordetella pertussis
cagcccgccgauccacucggcca

SEQ ID NO: 2445570 - RNA, 16 nt, Bordetella pertussis
cagcccgccggcgcgc

SEQ ID NO: 2445571 - RNA, 16 nt, Bordetella pertussis
cagcccgcgcacgccc

SEQ ID NO: 2445572 - RNA, 13 nt, Bordetella pertussis
cagcccgcgcgcg

SEQ ID NO: 2445573 - RNA, 15 nt, Bordetella pertussis
cagcccgcgcgcguu

SEQ ID NO: 2445574 - RNA, 14 nt, Bordetella pertussis
cagcccgcgcuggc

SEQ ID NO: 2445575 - RNA, 17 nt, Bordetella pertussis
cagcccgcgcuggcgca

SEQ ID NO: 2445576 - RNA, 21 nt, Bordetella pertussis
cagcccgcgcuggcgcagcag

SEQ ID NO: 2445577 - RNA, 20 nt, Bordetella pertussis
cagcccgcggguucgcccgg

SEQ ID NO: 2445578 - RNA, 13 nt, Bordetella pertussis
cagcccgcgucgc

SEQ ID NO: 2445579 - RNA, 16 nt, Bordetella pertussis
cagcccgcgucgcugu

SEQ ID NO: 2445580 - RNA, 22 nt, Bordetella pertussis
cagcccgcgucgcugucggcga

SEQ ID NO: 2445581 - RNA, 18 nt, Bordetella pertussis
cagcccgcguucaggcgc

SEQ ID NO: 2445582 - RNA, 21 nt, Bordetella pertussis
cagcccgcguucaggcgcggc

SEQ ID NO: 2445583 - RNA, 22 nt, Bordetella pertussis
cagcccgcguucaggcgcggcu

SEQ ID NO: 2445584 - RNA, 14 nt, Bordetella pertussis
cagcccgcuggccg

SEQ ID NO: 2445585 - RNA, 15 nt, Bordetella pertussis
cagcccgcuggccga

SEQ ID NO: 2445586 - RNA, 13 nt, Bordetella pertussis
cagcccggaucgc

SEQ ID NO: 2445587 - RNA, 16 nt, Bordetella pertussis
cagcccggcacgucgg

SEQ ID NO: 2445588 - RNA, 13 nt, Bordetella pertussis
cagcccggccaga

SEQ ID NO: 2445589 - RNA, 15 nt, Bordetella pertussis
cagcccggccagagc

SEQ ID NO: 2445590 - RNA, 20 nt, Bordetella pertussis
cagcccggccagagccugga

SEQ ID NO: 2445591 - RNA, 24 nt, Bordetella pertussis
cagcccggccagagccuggaagug

SEQ ID NO: 2445592 - RNA, 12 nt, Bordetella pertussis
cagcccggcccc

SEQ ID NO: 2445593 - RNA, 14 nt, Bordetella pertussis
cagcccggccgcca

SEQ ID NO: 2445594 - RNA, 22 nt, Bordetella pertussis
cagcccggccgccagcauggcg

SEQ ID NO: 2445595 - RNA, 11 nt, Bordetella pertussis
cagcccggcga

SEQ ID NO: 2445596 - RNA, 12 nt, Bordetella pertussis
cagcccggcgcg

SEQ ID NO: 2445597 - RNA, 16 nt, Bordetella pertussis
cagcggccgcugccgc

SEQ ID NO: 2445598 - RNA, 22 nt, Bordetella pertussis
cagcggccgcugccgcgcgccg

SEQ ID NO: 2445599 - RNA, 13 nt, Bordetella pertussis
cagcggccggccc

SEQ ID NO: 2445600 - RNA, 15 nt, Bordetella pertussis
cagcggcgacggcgc

SEQ ID NO: 2445601 - RNA, 17 nt, Bordetella pertussis
cagcggcgacggcgccu

SEQ ID NO: 2445602 - RNA, 19 nt, Bordetella pertussis
cagcggcgacggcgccugg

SEQ ID NO: 2445603 - RNA, 21 nt, Bordetella pertussis
cagcggcgacggcgccuggcg

SEQ ID NO: 2445604 - RNA, 22 nt, Bordetella pertussis
cagcggcgacggcgccuggcgc

SEQ ID NO: 2445605 - RNA, 17 nt, Bordetella pertussis
cagcggcgacugcccca

SEQ ID NO: 2445606 - RNA, 23 nt, Bordetella pertussis
cagcggcgacugccccagcggcu

SEQ ID NO: 2445607 - RNA, 17 nt, Bordetella pertussis
cagcggcgagcgcggcg

SEQ ID NO: 2445608 - RNA, 20 nt, Bordetella pertussis
cagcggcgcaccgacagcaa

SEQ ID NO: 2445609 - RNA, 16 nt, Bordetella pertussis
cagcggcgcagccggc

SEQ ID NO: 2445610 - RNA, 14 nt, Bordetella pertussis
cagcggcgccaugc

SEQ ID NO: 2445611 - RNA, 15 nt, Bordetella pertussis
cagcggcgccaugcg

SEQ ID NO: 2445612 - RNA, 20 nt, Bordetella pertussis
cagcggcgccaugcgcacca

SEQ ID NO: 2445613 - RNA, 15 nt, Bordetella pertussis
cagcggcgccgacca

SEQ ID NO: 2445614 - RNA, 13 nt, Bordetella pertussis
cagcggcgccgga

SEQ ID NO: 2445615 - RNA, 22 nt, Bordetella pertussis
cagcggcgccggaucggccggc

SEQ ID NO: 2445616 - RNA, 17 nt, Bordetella pertussis
cagcggcgcgacgcgcu

SEQ ID NO: 2445617 - RNA, 20 nt, Bordetella pertussis
cagcggcgcgacgcgcuuga

SEQ ID NO: 2445618 - RNA, 13 nt, Bordetella pertussis
cagcggcgcgccc

SEQ ID NO: 2445619 - RNA, 16 nt, Bordetella pertussis
cagcggcgcgcgcagg

SEQ ID NO: 2445620 - RNA, 13 nt, Bordetella pertussis
cagcggcgcggcg

SEQ ID NO: 2445621 - RNA, 14 nt, Bordetella pertussis
cagcggcgcggcgc

SEQ ID NO: 2445622 - RNA, 22 nt, Bordetella pertussis
cagcggcgcuuaccgcgccggc

SEQ ID NO: 2445623 - RNA, 23 nt, Bordetella pertussis
cagcggcgcuuaccgcgccggcu

SEQ ID NO: 2445624 - RNA, 17 nt, Bordetella pertussis
cagcggcggcacggugg

SEQ ID NO: 2445625 - RNA, 21 nt, Bordetella pertussis
cagcggcggcacgguggcgaa

SEQ ID NO: 2445626 - RNA, 14 nt, Bordetella pertussis
cagcggcggcgcgg

SEQ ID NO: 2445627 - RNA, 18 nt, Bordetella pertussis
cagcggcggcgcggucag

SEQ ID NO: 2445628 - RNA, 18 nt, Bordetella pertussis
cagcggcguauaggccac

SEQ ID NO: 2445629 - RNA, 21 nt, Bordetella pertussis
cagcggcguauaggccacccc

SEQ ID NO: 2445630 - RNA, 20 nt, Bordetella pertussis
cagcggcgugaugcccaggc

SEQ ID NO: 2445631 - RNA, 22 nt, Bordetella pertussis
cagcggcgugaugcccaggccc

SEQ ID NO: 2445632 - RNA, 13 nt, Bordetella pertussis
cagcggcguggcg

SEQ ID NO: 2445633 - RNA, 22 nt, Bordetella pertussis
cagcggcguggcggccaggccg

SEQ ID NO: 2445634 - RNA, 13 nt, Bordetella pertussis
cagcggcucgacg

SEQ ID NO: 2445635 - RNA, 14 nt, Bordetella pertussis
cagcggcucgacgc

SEQ ID NO: 2445636 - RNA, 22 nt, Bordetella pertussis
cagcggcucgacgccguacugg

SEQ ID NO: 2445637 - RNA, 14 nt, Bordetella pertussis
cagcggcuggccac

SEQ ID NO: 2445638 - RNA, 21 nt, Bordetella pertussis
cagcggcuggccacuggccgc

SEQ ID NO: 2445639 - RNA, 14 nt, Bordetella pertussis
cagcggcuggcgca

SEQ ID NO: 2445640 - RNA, 23 nt, Bordetella pertussis
cagcggcuggcgccguucgucgc

SEQ ID NO: 2445641 - RNA, 17 nt, Bordetella pertussis
cagcggcuucaugccgg

SEQ ID NO: 2445642 - RNA, 18 nt, Bordetella pertussis
cagcggcuucaugccggc

SEQ ID NO: 2445643 - RNA, 20 nt, Bordetella pertussis
cagcggcuucaugccggcgu

SEQ ID NO: 2445644 - RNA, 19 nt, Bordetella pertussis
cagcggcuucgagcgcgac

SEQ ID NO: 2445645 - RNA, 20 nt, Bordetella pertussis
cagcggcuucgagcgcgacg

SEQ ID NO: 2445646 - RNA, 23 nt, Bordetella pertussis
cagcgggagccuguccccgcggg

SEQ ID NO: 2445647 - RNA, 18 nt, Bordetella pertussis
cagcgggcccgucgcgcc

SEQ ID NO: 2445648 - RNA, 19 nt, Bordetella pertussis
cagcgggcccgucgcgcca

SEQ ID NO: 2445649 - RNA, 14 nt, Bordetella pertussis
cagcgggccgcagc

SEQ ID NO: 2445650 - RNA, 19 nt, Bordetella pertussis
cagcgggccgcagcauggc

SEQ ID NO: 2445651 - RNA, 14 nt, Bordetella pertussis
cagcgggccggcac

SEQ ID NO: 2445652 - RNA, 18 nt, Bordetella pertussis
cagcgggccggcaccacg

SEQ ID NO: 2445653 - RNA, 19 nt, Bordetella pertussis
cagcgggccggcaccacga

SEQ ID NO: 2445654 - RNA, 14 nt, Bordetella pertussis
cagcgggcgcgccc

SEQ ID NO: 2445655 - RNA, 17 nt, Bordetella pertussis
cagcgggcgcgcccggc

SEQ ID NO: 2445656 - RNA, 19 nt, Bordetella pertussis
cagcgggcgcgcccggcgc

SEQ ID NO: 2445657 - RNA, 22 nt, Bordetella pertussis
cagcgggcgcgcccggcgcgcc

SEQ ID NO: 2445658 - RNA, 13 nt, Bordetella pertussis
cagcgggcugggg

SEQ ID NO: 2445659 - RNA, 20 nt, Bordetella pertussis
cagcgggcuggggcaggcac

SEQ ID NO: 2445660 - RNA, 16 nt, Bordetella pertussis
cagcggggacaggcac

SEQ ID NO: 2445661 - RNA, 18 nt, Bordetella pertussis
cagcggggacaggcaccc

SEQ ID NO: 2445662 - RNA, 19 nt, Bordetella pertussis
cagcggggacaggcacccc

SEQ ID NO: 2445663 - RNA, 20 nt, Bordetella pertussis
cagcggggacaggcaccccu

SEQ ID NO: 2445664 - RNA, 17 nt, Bordetella pertussis
cagcggggacaggcgcc

SEQ ID NO: 2445665 - RNA, 20 nt, Bordetella pertussis
cagcggggccgugacgugcu

SEQ ID NO: 2445666 - RNA, 15 nt, Bordetella pertussis
cagcgggucgaucgu

SEQ ID NO: 2445667 - RNA, 19 nt, Bordetella pertussis
cagcgggugaucacggccg

SEQ ID NO: 2445668 - RNA, 14 nt, Bordetella pertussis
cagcggguugcgcg

SEQ ID NO: 2445669 - RNA, 16 nt, Bordetella pertussis
cagcggguugcgcgcc

SEQ ID NO: 2445670 - RNA, 17 nt, Bordetella pertussis
cagcggguugcgcgcca

SEQ ID NO: 2445671 - RNA, 12 nt, Bordetella pertussis
cagcggugcgcg

SEQ ID NO: 2445672 - RNA, 13 nt, Bordetella pertussis
cagcggugcgcgg

SEQ ID NO: 2445673 - RNA, 20 nt, Bordetella pertussis
cagcgguucgucggcgcucu

SEQ ID NO: 2445674 - RNA, 17 nt, Bordetella pertussis
cagcgucaauccgccgc

SEQ ID NO: 2445675 - RNA, 19 nt, Bordetella pertussis
cagcgucaauccgccgcca

SEQ ID NO: 2445676 - RNA, 15 nt, Bordetella pertussis
cagcgucaccagcag

SEQ ID NO: 2445677 - RNA, 17 nt, Bordetella pertussis
cagcgucaccagcaggc

SEQ ID NO: 2445678 - RNA, 16 nt, Bordetella pertussis
cagcgucagcgcaaac

SEQ ID NO: 2445679 - RNA, 18 nt, Bordetella pertussis
cagcgucaugcgcaccuu

SEQ ID NO: 2445680 - RNA, 23 nt, Bordetella pertussis
cagcgucaugcgcaccuugucgc

SEQ ID NO: 2445681 - RNA, 22 nt, Bordetella pertussis
cagcgucauggccuggcccagc

SEQ ID NO: 2445682 - RNA, 22 nt, Bordetella pertussis
cagcgucaugugcugcggcagc

SEQ ID NO: 2445683 - RNA, 14 nt, Bordetella pertussis
cagcguccagccgc

SEQ ID NO: 2445684 - RNA, 17 nt, Bordetella pertussis
cagcguccagccgcccg

SEQ ID NO: 2445685 - RNA, 13 nt, Bordetella pertussis
cagcguccaggcg

SEQ ID NO: 2445686 - RNA, 18 nt, Bordetella pertussis
cagcguccaggcggccau

SEQ ID NO: 2445687 - RNA, 11 nt, Bordetella pertussis
cagcugcagcg

SEQ ID NO: 2445688 - RNA, 17 nt, Bordetella pertussis
cagcugcaugcgcacgg

SEQ ID NO: 2445689 - RNA, 17 nt, Bordetella pertussis
cagcugccugagcaccg

SEQ ID NO: 2445690 - RNA, 19 nt, Bordetella pertussis
cagcugccugagcaccgcc

SEQ ID NO: 2445691 - RNA, 21 nt, Bordetella pertussis
cagcugccugagcaccgccgc

SEQ ID NO: 2445692 - RNA, 23 nt, Bordetella pertussis
cagcugccugagcaccgccgcgu

SEQ ID NO: 2445693 - RNA, 13 nt, Bordetella pertussis
cagcugcgcagcg

SEQ ID NO: 2445694 - RNA, 18 nt, Bordetella pertussis
cagcugcgcccccucuuc

SEQ ID NO: 2445695 - RNA, 15 nt, Bordetella pertussis
cagcugcgcgcgagc

SEQ ID NO: 2445696 - RNA, 17 nt, Bordetella pertussis
cagcugcgcgcgagcgg

SEQ ID NO: 2445697 - RNA, 18 nt, Bordetella pertussis
cagcugcgcgcgagcggc

SEQ ID NO: 2445698 - RNA, 14 nt, Bordetella pertussis
cagcugcgcgucga

SEQ ID NO: 2445699 - RNA, 18 nt, Bordetella pertussis
cagcugcgcgucgacagc

SEQ ID NO: 2445700 - RNA, 20 nt, Bordetella pertussis
cagcugcgcgucgacagcau

SEQ ID NO: 2445701 - RNA, 16 nt, Bordetella pertussis
cagcugcggccccggc

SEQ ID NO: 2445702 - RNA, 22 nt, Bordetella pertussis
cagcugcguggcgacgcgcugc

SEQ ID NO: 2445703 - RNA, 16 nt, Bordetella pertussis
cagcugcuguuggccu

SEQ ID NO: 2445704 - RNA, 22 nt, Bordetella pertussis
cagcugcuguuggccuucggcg

SEQ ID NO: 2445705 - RNA, 23 nt, Bordetella pertussis
cagcugcuucaguuccaggcgga

SEQ ID NO: 2445706 - RNA, 14 nt, Bordetella pertussis
cagcugcuucaugc

SEQ ID NO: 2445707 - RNA, 15 nt, Bordetella pertussis
cagcugcuugcccag

SEQ ID NO: 2445708 - RNA, 13 nt, Bordetella pertussis
cagcuggaacgcg

SEQ ID NO: 2445709 - RNA, 17 nt, Bordetella pertussis
cagcuggaacgcgccgc

SEQ ID NO: 2445710 - RNA, 18 nt, Bordetella pertussis
cagcuggaacgcgccgcu

SEQ ID NO: 2445711 - RNA, 23 nt, Bordetella pertussis
cagcuggaacgcgccgcuggcgu

SEQ ID NO: 2445712 - RNA, 17 nt, Bordetella pertussis
cagcuggaagcgcgcca

SEQ ID NO: 2445713 - RNA, 17 nt, Bordetella pertussis
cagcuggaccgccuggc

SEQ ID NO: 2445714 - RNA, 23 nt, Bordetella pertussis
cagcuggacuauggccuggaugu

SEQ ID NO: 2445715 - RNA, 14 nt, Bordetella pertussis
cagcuggaucuggu

SEQ ID NO: 2445716 - RNA, 17 nt, Bordetella pertussis
cagcuggcaccgcgacg

SEQ ID NO: 2445717 - RNA, 20 nt, Bordetella pertussis
cagcuggcccaguucggcga

SEQ ID NO: 2445718 - RNA, 18 nt, Bordetella pertussis
cagcuggcccuggcagac

SEQ ID NO: 2445719 - RNA, 20 nt, Bordetella pertussis
cagcuggcccuggcagacgu

SEQ ID NO: 2445720 - RNA, 17 nt, Bordetella pertussis
cagcuggcgcaccaggc

SEQ ID NO: 2445721 - RNA, 18 nt, Bordetella pertussis
cagcuggcgcaccaggcu

SEQ ID NO: 2445722 - RNA, 14 nt, Bordetella pertussis
cagcuggcgcagca

SEQ ID NO: 2445723 - RNA, 23 nt, Bordetella pertussis
cagcuggcgccccuuccacccgc

SEQ ID NO: 2445724 - RNA, 20 nt, Bordetella pertussis
cagcuggcgcguggccgcca

SEQ ID NO: 2445725 - RNA, 18 nt, Bordetella pertussis
cagcugggaggcgugcug

SEQ ID NO: 2445726 - RNA, 22 nt, Bordetella pertussis
cagcugggcaugcacgauggua

SEQ ID NO: 2445727 - RNA, 13 nt, Bordetella pertussis
cagcugggccaca

SEQ ID NO: 2445728 - RNA, 23 nt, Bordetella pertussis
cagcugggccaguucggcuugca

SEQ ID NO: 2445729 - RNA, 12 nt, Bordetella pertussis
cagucccaggcc

SEQ ID NO: 2445730 - RNA, 13 nt, Bordetella pertussis
cagucccaguccg

SEQ ID NO: 2445731 - RNA, 16 nt, Bordetella pertussis
caguccccaugcggcc

SEQ ID NO: 2445732 - RNA, 20 nt, Bordetella pertussis
caguccccaugcggccccuc

SEQ ID NO: 2445733 - RNA, 21 nt, Bordetella pertussis
caguccccauguggggacagg

SEQ ID NO: 2445734 - RNA, 17 nt, Bordetella pertussis
caguccccgcagggaca

SEQ ID NO: 2445735 - RNA, 18 nt, Bordetella pertussis
caguccccgcagggacag

SEQ ID NO: 2445736 - RNA, 20 nt, Bordetella pertussis
caguccccgcagggacaggc

SEQ ID NO: 2445737 - RNA, 14 nt, Bordetella pertussis
caguccccgcaugg

SEQ ID NO: 2445738 - RNA, 16 nt, Bordetella pertussis
caguccccgcaugggg

SEQ ID NO: 2445739 - RNA, 22 nt, Bordetella pertussis
caguccccgcauggggacuggc

SEQ ID NO: 2445740 - RNA, 21 nt, Bordetella pertussis
caguccccguucggggacagg

SEQ ID NO: 2445741 - RNA, 15 nt, Bordetella pertussis
cagucccgcaccggg

SEQ ID NO: 2445742 - RNA, 17 nt, Bordetella pertussis
cagucccgcaccgggca

SEQ ID NO: 2445743 - RNA, 14 nt, Bordetella pertussis
caguccgacgacaa

SEQ ID NO: 2445744 - RNA, 20 nt, Bordetella pertussis
caguccgcagcgcagcgcca

SEQ ID NO: 2445745 - RNA, 14 nt, Bordetella pertussis
caguccgcccagcc

SEQ ID NO: 2445746 - RNA, 18 nt, Bordetella pertussis
caguccgcccagccaggc

SEQ ID NO: 2445747 - RNA, 20 nt, Bordetella pertussis
caguccgcgcucgcccagcc

SEQ ID NO: 2445748 - RNA, 16 nt, Bordetella pertussis
caguccggcagcaccc

SEQ ID NO: 2445749 - RNA, 23 nt, Bordetella pertussis
caguccguaguugcgccccgcca

SEQ ID NO: 2445750 - RNA, 17 nt, Bordetella pertussis
caguccguggcgcggcc

SEQ ID NO: 2445751 - RNA, 19 nt, Bordetella pertussis
caguccucaugcgggacag

SEQ ID NO: 2445752 - RNA, 20 nt, Bordetella pertussis
caguccucguugcccgcggu

SEQ ID NO: 2445753 - RNA, 14 nt, Bordetella pertussis
cagucgaccacgcg

SEQ ID NO: 2445754 - RNA, 16 nt, Bordetella pertussis
cagucgaguucgucgu

SEQ ID NO: 2445755 - RNA, 17 nt, Bordetella pertussis
cagucgaugauccacag

SEQ ID NO: 2445756 - RNA, 17 nt, Bordetella pertussis
cagucgccgcgcccgcg

SEQ ID NO: 2445757 - RNA, 20 nt, Bordetella pertussis
cagucgccgcgcccgcgggu

SEQ ID NO: 2445758 - RNA, 23 nt, Bordetella pertussis
cagucgcgcacgaagccgaugcg

SEQ ID NO: 2445759 - RNA, 13 nt, Bordetella pertussis
cagucgcgcagca

SEQ ID NO: 2445760 - RNA, 13 nt, Bordetella pertussis
cagucgcgcagcc

SEQ ID NO: 2445761 - RNA, 16 nt, Bordetella pertussis
cagucgcgcagccaca

SEQ ID NO: 2445762 - RNA, 14 nt, Bordetella pertussis
cagucggccuggcg

SEQ ID NO: 2445763 - RNA, 20 nt, Bordetella pertussis
cagucggccuggcgcuccuc

SEQ ID NO: 2445764 - RNA, 14 nt, Bordetella pertussis
cagucgggacggcg

SEQ ID NO: 2445765 - RNA, 15 nt, Bordetella pertussis
cagucgggacggcgc

SEQ ID NO: 2445766 - RNA, 18 nt, Bordetella pertussis
cagucgggacggcgcggg

SEQ ID NO: 2445767 - RNA, 14 nt, Bordetella pertussis
cagucgggcagcgc

SEQ ID NO: 2445768 - RNA, 15 nt, Bordetella pertussis
cagucgggcagcgcc

SEQ ID NO: 2445769 - RNA, 18 nt, Bordetella pertussis
cagucgggcagcgcccgc

SEQ ID NO: 2445770 - RNA, 13 nt, Bordetella pertussis
cagucggggccgc

SEQ ID NO: 2445771 - RNA, 16 nt, Bordetella pertussis
cagucguccagcacgc

SEQ ID NO: 2445772 - RNA, 18 nt, Bordetella pertussis
cagucguccagcacgcgg

SEQ ID NO: 2445773 - RNA, 21 nt, Bordetella pertussis
cagucguccagcacgcggcgc

SEQ ID NO: 2445774 - RNA, 14 nt, Bordetella pertussis
cagucuccaggcuc

SEQ ID NO: 2445775 - RNA, 15 nt, Bordetella pertussis
cagucuccaggcuca

SEQ ID NO: 2445776 - RNA, 15 nt, Bordetella pertussis
cagugcccugacccg

SEQ ID NO: 2445777 - RNA, 17 nt, Bordetella pertussis
cagugcccugacccgcu

SEQ ID NO: 2445778 - RNA, 15 nt, Bordetella pertussis
cagugccugcgaacg

SEQ ID NO: 2445779 - RNA, 14 nt, Bordetella pertussis
cagugccuggacgc

SEQ ID NO: 2445780 - RNA, 17 nt, Bordetella pertussis
cagugccuggacgcgcu

SEQ ID NO: 2445781 - RNA, 19 nt, Bordetella pertussis
cagugccuggacgcgcugg

SEQ ID NO: 2445782 - RNA, 23 nt, Bordetella pertussis
cagugccuggacgcgcuggccga

SEQ ID NO: 2445783 - RNA, 17 nt, Bordetella pertussis
cagugcgacggaugggc

SEQ ID NO: 2445784 - RNA, 12 nt, Bordetella pertussis
cagugcgccggc

SEQ ID NO: 2445785 - RNA, 14 nt, Bordetella pertussis
cagugcgccggcgc

SEQ ID NO: 2445786 - RNA, 18 nt, Bordetella pertussis
cagugcgccggcgcggcg

SEQ ID NO: 2445787 - RNA, 15 nt, Bordetella pertussis
cagugcuucgagauc

SEQ ID NO: 2445788 - RNA, 21 nt, Bordetella pertussis
caguggcgagggucaggcgcg

SEQ ID NO: 2445789 - RNA, 21 nt, Bordetella pertussis
cagugggccaguucgcggcgc

SEQ ID NO: 2445790 - RNA, 17 nt, Bordetella pertussis
cagugguggugcagcgg

SEQ ID NO: 2445791 - RNA, 14 nt, Bordetella pertussis
cagugucucgacca

SEQ ID NO: 2445792 - RNA, 16 nt, Bordetella pertussis
caguuccaccugcaug

SEQ ID NO: 2445793 - RNA, 15 nt, Bordetella pertussis
caguuccacgcggcc

SEQ ID NO: 2445794 - RNA, 15 nt, Bordetella pertussis
caguuccagcacgac

SEQ ID NO: 2445795 - RNA, 16 nt, Bordetella pertussis
caguuccggcgggccg

SEQ ID NO: 2445796 - RNA, 18 nt, Bordetella pertussis
caguucgacgcccaugcg

SEQ ID NO: 2445797 - RNA, 21 nt, Bordetella pertussis
caguucgccccccgaggccac

SEQ ID NO: 2445798 - RNA, 17 nt, Bordetella pertussis
caguucgccggcgccgu

SEQ ID NO: 2445799 - RNA, 15 nt, Bordetella pertussis
caguucgcgcagcag

SEQ ID NO: 2445800 - RNA, 16 nt, Bordetella pertussis
caguucgcggccggcc

SEQ ID NO: 2445801 - RNA, 18 nt, Bordetella pertussis
caguucgcggccggccgg

SEQ ID NO: 2445802 - RNA, 17 nt, Bordetella pertussis
caguucgcggcgcagcg

SEQ ID NO: 2445803 - RNA, 22 nt, Bordetella pertussis
caguucgcgguauucggcgacc

SEQ ID NO: 2445804 - RNA, 16 nt, Bordetella pertussis
caguucggccagcagc

SEQ ID NO: 2445805 - RNA, 15 nt, Bordetella pertussis
caguucggccggcgg

SEQ ID NO: 2445806 - RNA, 15 nt, Bordetella pertussis
caguucggcgacgau

SEQ ID NO: 2445807 - RNA, 23 nt, Bordetella pertussis
caguucggcuuguucgagcgcgc

SEQ ID NO: 2445808 - RNA, 18 nt, Bordetella pertussis
caguucgugcaccagccc

SEQ ID NO: 2445809 - RNA, 21 nt, Bordetella pertussis
caguugaaucggcgcgagcgu

SEQ ID NO: 2445810 - RNA, 20 nt, Bordetella pertussis
caguugacccauaccagccc

SEQ ID NO: 2445811 - RNA, 13 nt, Bordetella pertussis
caguugcaggcca

SEQ ID NO: 2445812 - RNA, 19 nt, Bordetella pertussis
caguugccgccgccggcgc

SEQ ID NO: 2445813 - RNA, 17 nt, Bordetella pertussis
caguugcgcgccgucgg

SEQ ID NO: 2445814 - RNA, 21 nt, Bordetella pertussis
caguugcggggcgcccagcgc
